United States Patent 10,293,058 (RNA CONTAINING COMPOSITION FOR TREATMENT OF TUMOR DISEASES) - sequence listing, part 3

SEQ ID NO: 6232 - RNA, 720 nt, Artificial Sequence
  derived and/or modified sequence opt6 from Purine_Nucleoside_Phosphorylase_deoD__Escherichia_coli__AEQ15845
auggcaacaccacauauaaaugccgaaaugggagacuuugcagacguaguacuaaugccaggagauccacuaagagcaaaauacauagcagaaacauuucuagaagacgcaagagaaguaaauaauguaagaggaauguuaggauuuacaggaacauauaaaggaagaaaaauaaguguaaugggacauggaauggguauaccaucauguaguauauacacaaaagaauuaaucacagacuuuggaguaaaaaaaauaauaagaguaggaaguugcggagcaguacuaccacacguaaaauuaagagauguaguaauaggaaugggagcauguacagacagcaaaguaaauagaauaagauuuaaagaccaugauuuugccgcaauagcagauuucgauaugguacgaaacgcaguagacgcagcaaaagcacuaggaguagaugcaagaguaggaaauuuauuuagcgcggacuuauuuuacagcccagacggagaaauguucgauguaauggaaaaauacggaauauuaggaguagaaauggaagcagcaggaauauauggaguagcagcagaauuuggagcaaaagcacuaacgauauguacaguaagcgaucacauaagaacacacgaacaaacaacagcagcagaaagacaaacaacuuucaaugacaugauaaaaauagcauuagaaagcguuuuacuaggagauaaagaauaa

SEQ ID NO: 6233 - protein, 239 aa, Artificial Sequence; identical to SEQ ID NO: 6193
  Purine_Nucleoside_Phosphorylase_deoD__Escherichia_coli_ _A0A0E0Y455

SEQ ID NO: 6234 - RNA, 720 nt, Artificial Sequence
  Purine_Nucleoside_Phosphorylase_deoD__Escherichia_coli__AFS76188
auggcuaccccacacauuaaugcagaaaugggcgauuucgcugacguaguuuugaugccaggcgacccgcugcgugcaaaguauauugcugaaacuuuccuugaagaugcccgugaagugaacaacguucgcgguaugcugggcuucaccgguacuuauaaaggccgcaaaauuuccguaaugggucacgguauggguaucccguccugcuccaucuacaccaaagaacugaucaccgauuucggcgugaagaaaauuauccgcguggguuccuguggcgcaguucugccgcacguaaaacugcgcgacgucguuaucgguaugggugccugcaccgauuccaaaguuaaccgcauccguuuuaaagaucaugacuuugccgcuaucgcugacuuugacauggugcguaacgcgguagacgcggcuaaagcacugggcauugaugcucgcguugguaaccuguucuccgcugaccuguucuacucuccggacggcgaaauguucgacgugauggaaaaauacggcauccucggcguggaaauggaagcggcugguaucuacggcgucgcugcagaauuuggcgcgaaagcccugaccaucuguaccgugucugaccacauccgcacucacgagcagaccacugccgcugagcgucagaccaccuucaacgacaugaucaaaaucgcacuggaauccguucugcugggcgauaaagaguaa

SEQ ID NO: 6235 - RNA, 720 nt, Artificial Sequence; identical to SEQ ID NO: 6195
  derived and/or modified sequence opt1 from Purine_Nucleoside_Phosphorylase_deoD__Escherichia_coli__AFS76188

SEQ ID NO: 6236 - RNA, 720 nt, Artificial Sequence; identical to SEQ ID NO: 6196
  derived and/or modified sequence opt2 from Purine_Nucleoside_Phosphorylase_deoD__Escherichia_coli__AFS76188

SEQ ID NO: 6237 - RNA, 720 nt, Artificial Sequence; identical to SEQ ID NO: 6197
  derived and/or modified sequence opt3 from Purine_Nucleoside_Phosphorylase_deoD__Escherichia_coli__AFS76188

SEQ ID NO: 6238 - RNA, 720 nt, Artificial Sequence; identical to SEQ ID NO: 6198
  derived and/or modified sequence opt4 from Purine_Nucleoside_Phosphorylase_deoD__Escherichia_coli__AFS76188

SEQ ID NO: 6239 - RNA, 720 nt, Artificial Sequence; identical to SEQ ID NO: 6199
  derived and/or modified sequence opt5 from Purine_Nucleoside_Phosphorylase_deoD__Escherichia_coli__AFS76188

SEQ ID NO: 6240 - RNA, 720 nt, Artificial Sequence
  derived and/or modified sequence opt6 from Purine_Nucleoside_Phosphorylase_deoD__Escherichia_coli__AFS76188
auggcaacaccacauauaaaugcagaaaugggagacuuugcagauguaguauuaaugccaggagauccccuaagagcaaaauacauagcagaaacauuucuagaagacgcaagagaagucaauaacguaagaggaauguuaggauuuacaggaacauauaaaggaagaaaaauaucaguaaugggacauggaaugggaauaccaucaugcucaauauauacaaaagaauuaauaacggacuuuggaguaaaaaaaauaauaagaguaggaucaugcggagcaguauuaccacacgugaaacuaagagauguaguaauaggaaugggagcauguacagauagcaaaguaaauagaauaagauuuaaagaucacgauuuugcagcaauagcagauuucgauaugguaagaaaugcaguagacgcagcaaaagcacuaggaauagacgcaagagugggaaauuuauuuagcgcagacuuauucuauagcccagacggagaaauguucgauguaauggaaaaauacggaaucuuaggaguagaaauggaagcggcaggaauauauggaguagcagcagaauuuggagcaaaagcauuaacgauauguacaguaagcgaucacauaagaacgcacgaacaaacaacagcagcagaacgacaaacaacauucaaugauaugauaaaaauagcacuagaaagcguacuauuaggcgauaaagaauaa

SEQ ID NO: 6241 - protein, 239 aa, Artificial Sequence; identical to SEQ ID NO: 6201
  Purine_Nucleoside_Phosphorylase_deoD__Escherichia_coli_ _A0A0E1M7E2

SEQ ID NO: 6242 - RNA, 720 nt, Artificial Sequence; identical to SEQ ID NO: 6202
  Purine_Nucleoside_Phosphorylase_deoD__Escherichia_coli__AJF59253

SEQ ID NO: 6243 - RNA, 720 nt, Artificial Sequence; identical to SEQ ID NO: 6203
  derived and/or modified sequence opt1 from Purine_Nucleoside_Phosphorylase_deoD__Escherichia_coli__AJF59253

SEQ ID NO: 6244 - RNA, 720 nt, Artificial Sequence; identical to SEQ ID NO: 6204
  derived and/or modified sequence opt2 from Purine_Nucleoside_Phosphorylase_deoD__Escherichia_coli__AJF59253

SEQ ID NO: 6245 - RNA, 720 nt, Artificial Sequence; identical to SEQ ID NO: 6205
  derived and/or modified sequence opt3 from Purine_Nucleoside_Phosphorylase_deoD__Escherichia_coli__AJF59253

SEQ ID NO: 6246 - RNA, 720 nt, Artificial Sequence; identical to SEQ ID NO: 6206
  derived and/or modified sequence opt4 from Purine_Nucleoside_Phosphorylase_deoD__Escherichia_coli__AJF59253

SEQ ID NO: 6247 - RNA, 720 nt, Artificial Sequence; identical to SEQ ID NO: 6207
  derived and/or modified sequence opt5 from Purine_Nucleoside_Phosphorylase_deoD__Escherichia_coli__AJF59253

SEQ ID NO: 6248 - RNA, 720 nt, Artificial Sequence
  derived and/or modified sequence opt6 from Purine_Nucleoside_Phosphorylase_deoD__Escherichia_coli__AJF59253
auggcaacaccacauauaaaugcagaaaugggagauuuugcagauguaguacuaaugccaggagacccgcuaagagccaaauacauagcagaaacauuuuuagaagacgcaagagaagucaauaauguaagagggauguuaggauuuacaggaaccuacaaaggaagaaaaauaucaguaaugggacauggaaugggaauaccuucaugcaguauauauacaaaagaauuaauaacagacuuuggaguaaaaaaaauaauaagaguaggaucaugcggagcaguacuaccacacguaaaacuaagagauguaguaauaggaaugggagccuguacagauagcaaaguaaauagaauaagauuuaaagaucacgauuucgcagcaauagcagauuuugacaugguaagaaaugcaguggacgcagcaaaagcauuaggaguagacgcaagaguaggaaaucuauuuagcgcagauuuauucuauaguccagacggagaaauguucgauguaauggaaaaauauggaauacuaggaguagaaauggaagcagcagggauauauggaguagcagcagaauuuggagcaaaagcacuaacaauauguacaguaagugaucauauaaggacgcacgaacaaacaacagcagcagaaagacaaacuacauuuaaugacaugauaaaaauagcacuagaaagcguauuauuaggagauaaagaauaa

SEQ ID NO: 6249 - protein, 239 aa, Artificial Sequence; identical to SEQ ID NO: 6193
  Purine_Nucleoside_Phosphorylase_deoD__Escherichia_coli_ _A0A0E3KJD7

SEQ ID NO: 6250 - RNA, 720 nt, Artificial Sequence
  Purine_Nucleoside_Phosphorylase_deoD__Escherichia_coli__AKA93549
auggcuaccccacacauuaaugcagaaaugggcgauuucgcugacguaguuuugaugccaggcgacccgcugcgugcgaaguauauugcugaaacuuuccuugaagaugcccgugaagugaacaacguucgcgguaugcugggcuucaccgguacuuacaaaggccgcaaaauuuccguaaugggucacgguauggguaucccguccugcuccaucuacaccaaagaacugaucaccgauuucggcgugaagaaaauuauccgcguaggcuccuguggcgcuguucugccgcacguaaaacugcgcgacgucguuaucgguaugggugccugcaccgauuccaaaguuaaccguauccguuuuaaagaccaugacuuugccgcuaucgcugacuuugacauggugcguaacgcgguagacgcggcuaaagcacugggcauugaugcucgcguugguaaccuguucuccgcugaccuguucuacucuccggacggcgaaauguucgacgugauggaaaaauacggcauccucggcguggaaauggaagcggcugguaucuacggcgucgcugcagaauuuggcgcgaaagcccugaccaucuguaccgugucugaccacauccgcacucacgagcagaccacugccgcugagcgucagaccaccuucaacgacaugaucaaaaucgcacuggaauccguucugcugggcgauaaagaguaa

SEQ ID NO: 6251 - RNA, 720 nt, Artificial Sequence; identical to SEQ ID NO: 6195
  derived and/or modified sequence opt1 from Purine_Nucleoside_Phosphorylase_deoD__Escherichia_coli__AKA93549

SEQ ID NO: 6252 - RNA, 720 nt, Artificial Sequence; identical to SEQ ID NO: 6196
  derived and/or modified sequence opt2 from Purine_Nucleoside_Phosphorylase_deoD__Escherichia_coli__AKA93549

SEQ ID NO: 6253 - RNA, 720 nt, Artificial Sequence; identical to SEQ ID NO: 6197
  derived and/or modified sequence opt3 from Purine_Nucleoside_Phosphorylase_deoD__Escherichia_coli__AKA93549

SEQ ID NO: 6254 - RNA, 720 nt, Artificial Sequence; identical to SEQ ID NO: 6198
  derived and/or modified sequence opt4 from Purine_Nucleoside_Phosphorylase_deoD__Escherichia_coli__AKA93549

SEQ ID NO: 6255 - RNA, 720 nt, Artificial Sequence; identical to SEQ ID NO: 6199
  derived and/or modified sequence opt5 from Purine_Nucleoside_Phosphorylase_deoD__Escherichia_coli__AKA93549

SEQ ID NO: 6256 - RNA, 720 nt, Artificial Sequence
  derived and/or modified sequence opt6 from Purine_Nucleoside_Phosphorylase_deoD__Escherichia_coli__AKA93549
auggcaacaccacauauaaacgcagaaaugggagacuuugcagauguaguacuaaugcccggagauccacuaagagcaaaauacauagcagaaacauucuuagaagacgcaagagaaguaaauaacguaagaggaauguuagguuuuacaggaacauauaaaggaagaaaaauaucaguaaugggacauggaaugggaauaccaaguugcucaauauauacaaaagaauuaauaacagacuuuggaguaaaaaaaauaauaagaguagguucgugcggagcaguacuaccacacguaaaauuaagagauguaguaauaggaaugggagcauguacagauagcaaaguaaauagaauaagauuuaaagaucacgauuucgcagcaauagcagauuucgauaugguaagaaaugcaguagacgcagcaaaagcauuaggaauagacgcaaggguaggcaauuuauuuagugcagacuuauucuauagcccagacggagaaauguucgauguaauggaaaaauacggaauauuaggaguagaaauggaagcagcuggaauauauggaguagcagcagaauuuggagcaaaagcacuaacaaucugcacaguaagugaucacauaagaacacaugaacaaacaacagcagcagaacgacaaacaacauucaaugacaugauaaaaauagcacuagaaaguguauuauuaggagauaaagaauaa

SEQ ID NO: 6257 - protein, 239 aa, Artificial Sequence; identical to SEQ ID NO: 6193
  Purine_Nucleoside_Phosphorylase_deoD__Escherichia_coli_ _A0A0F6CCW6

SEQ ID NO: 6258 - RNA, 720 nt, Artificial Sequence
  Purine_Nucleoside_Phosphorylase_deoD__Escherichia_coli__AFJ32072
auggcuaccccacacauuaaugcagaaaugggcgauuucgcugacguaguuuugaugccaggcgacccgcugcgugcgaaguauauugcugaaacuuuccuugaagaugcccgugaagugaacaacguucgcgguaugcugggcuucaccgguacuuacaaaggccgcaaaauuuccguaaugggucacgguauggguaucccguccugcuccaucuacaccaaagaacugaucaccgauuucggcgugaagaaaauuauccgcguggguuccuguggcgcaguucugccgcacguaaaacugcgcgacgucguuaucgguaugggugccugcaccgauuccaaaguuaaccgcauccguuuuaaagaccaugacuuugccgcuaucgcugacuucgacauggugcguaacgcaguagaugcagcuaaagcacugggcauugaugcucgcguugguaaccuguucuccgcugaccuguucuacucuccggacggcgaaauguucgacgugauggaaaaauacggcauucucggcguggaaauggaagcggcugguaucuacggcguggcugcagaguuuggcgcgaaagcccugaccaucugcaccgugucugaccacauccgcacucacgagcaaaccacugccgcugagcgucagaccaccuucaacgacaugaucaaaaucgcacuggaauccguucugcugggcgauaaagaguaa

SEQ ID NO: 6259 - RNA, 720 nt, Artificial Sequence; identical to SEQ ID NO: 6195
  derived and/or modified sequence opt1 from Purine_Nucleoside_Phosphorylase_deoD__Escherichia_coli__AFJ32072

SEQ ID NO: 6260 - RNA, 720 nt, Artificial Sequence; identical to SEQ ID NO: 6196
  derived and/or modified sequence opt2 from Purine_Nucleoside_Phosphorylase_deoD__Escherichia_coli__AFJ32072

SEQ ID NO: 6261 - RNA, 720 nt, Artificial Sequence; identical to SEQ ID NO: 6197
  derived and/or modified sequence opt3 from Purine_Nucleoside_Phosphorylase_deoD__Escherichia_coli__AFJ32072

SEQ ID NO: 6262 - RNA, 720 nt, Artificial Sequence; identical to SEQ ID NO: 6198
  derived and/or modified sequence opt4 from Purine_Nucleoside_Phosphorylase_deoD__Escherichia_coli__AFJ32072

SEQ ID NO: 6263 - RNA, 720 nt, Artificial Sequence; identical to SEQ ID NO: 6199
  derived and/or modified sequence opt5 from Purine_Nucleoside_Phosphorylase_deoD__Escherichia_coli__AFJ32072

SEQ ID NO: 6264 - RNA, 720 nt, Artificial Sequence
  derived and/or modified sequence opt6 from Purine_Nucleoside_Phosphorylase_deoD__Escherichia_coli__AFJ32072
auggcaacaccccauauaaaugcagaaaugggggacuuugcagauguaguacuaaugccaggggauccacuaagagcaaaauacauagcagaaacauuuuuagaagacgcaagggaaguaaauaacguacgaggaauguuaggauuuacaggaacauauaaaggaagaaaaauaaguguaaugggccauggaaugggaauaccaucaugcucaauauauacaaaagaauuaauaacagacuuuggaguaaaaaaaauaauaagaguaggaucaugcggagcaguacuaccacacguaaaauuaagagauguuguaauaggaaugggagcauguacagauagcaaaguaaauagaauaagauuuaaagaucacgauuucgcagcuauagcagauuucgauaugguaagaaaugccguagacgcggcaaaagcacuaggaauagacgcgagaguaggaaaucuauuuagcgcagacuuauucuauagcccagacggagaaauguucgacguaauggaaaaguauggaauacuaggaguagaaauggaagcagcaggaauauauggaguagcagcagaauucggagcaaaagcacuaacaauauguacaguaagugaucacauaagaacacacgaacaaacaacagcagcagaaagacaaacaacauuuaaugacaugauaaaaauagcacuagaaagcguacuauuaggagauaaagaauaa

SEQ ID NO: 6265 - protein, 239 aa, Artificial Sequence; identical to SEQ ID NO: 6193
  Purine_Nucleoside_Phosphorylase_deoD__Escherichia_coli_ _A0A0F6FGI8

SEQ ID NO: 6266 - RNA, 720 nt, Artificial Sequence; identical to SEQ ID NO: 6258
  Purine_Nucleoside_Phosphorylase_deoD__Escherichia_coli__AJA29528

SEQ ID NO: 6267 - RNA, 720 nt, Artificial Sequence; identical to SEQ ID NO: 6195
  derived and/or modified sequence opt1 from Purine_Nucleoside_Phosphorylase_deoD__Escherichia_coli__AJA29528

SEQ ID NO: 6268 - RNA, 720 nt, Artificial Sequence; identical to SEQ ID NO: 6196
  derived and/or modified sequence opt2 from Purine_Nucleoside_Phosphorylase_deoD__Escherichia_coli__AJA29528

SEQ ID NO: 6269 - RNA, 720 nt, Artificial Sequence; identical to SEQ ID NO: 6197
  derived and/or modified sequence opt3 from Purine_Nucleoside_Phosphorylase_deoD__Escherichia_coli__AJA29528

SEQ ID NO: 6270 - RNA, 720 nt, Artificial Sequence; identical to SEQ ID NO: 6198
  derived and/or modified sequence opt4 from Purine_Nucleoside_Phosphorylase_deoD__Escherichia_coli__AJA29528

SEQ ID NO: 6271 - RNA, 720 nt, Artificial Sequence; identical to SEQ ID NO: 6199
  derived and/or modified sequence opt5 from Purine_Nucleoside_Phosphorylase_deoD__Escherichia_coli__AJA29528

SEQ ID NO: 6272 - RNA, 720 nt, Artificial Sequence
  derived and/or modified sequence opt6 from Purine_Nucleoside_Phosphorylase_deoD__Escherichia_coli__AJA29528
auggcaacaccacauauaaaugcagaaaugggagacuuugcagauguaguacuaaugccaggagauccacuaagagcuaaauacauagcagaaacauuucuagaagacgcaagagaaguaaauaauguaagaggaauguuaggauuuacaggaacauauaaaggaagaaaaauaucaguaaugggacauggaaugggaauaccaaguugcucaauauauacaaaagaacuaauaacagacuuuggaguaaaaaaaauaauaagagugggaaguugcggagcaguucuaccacacguaaaauuaagagauguaguaauaggaaugggagcauguacagauaguaaaguaaauagaauaagauuuaaagaccacgauuucgcagcaauagcagauuuugauaugguaagaaaugcaguagaugcagcgaaagcauuaggaauagacgcacgaguaggaaauuuauuuagcgcagacuuauucuauagcccagacggggaaauguucgauguaauggaaaaauacgggauauuaggaguagaaauggaagcagcaggaauauauggaguagcagcagaauuuggagcaaaggcauuaacaauaugcacaguaagcgaucacauaagaacacacgaacaaacaacagcagcagaaagacagacaacauucaaugacaugauaaaaauagcauuagaaaguguacuacuaggagauaaagaauaa

SEQ ID NO: 6273 - protein, 239 aa, Artificial Sequence; identical to SEQ ID NO: 6193
  Purine_Nucleoside_Phosphorylase_deoD__Escherichia_coli_ _A0A0F6GWR2

SEQ ID NO: 6274 - RNA, 720 nt, Artificial Sequence
  Purine_Nucleoside_Phosphorylase_deoD__Escherichia_coli__BAI57857
auggcuacuccacacauuaaugcagaaaugggcgauuucgcugacguaguuuugaugccaggcgacccgcugcgugcgaaguauauugcugaaacuuuccuugaagaugcucgugaagugaacaacguucgcgguaugcugggcuucaccgguacuuacaaaggccgcaaaauuucuguaaugggccacgguauggguaucccguccugcuccaucuacacuaaagaacugaucaccgauuucggcgugaagaaaaucauucgcguugguuccuguggcgcaguucugccgcacguaaaacugcgugacguagugauugguaugggugccugcaccgauuccaaaguuaaccgcauccguuuuaaagaccaugacuuugcagcuaucgcugacuucgacauggugcguaacgcaguagaugcagcuaaagcacugggcauugaugcucgcguugguaaccuguucuccgcugaccuguucuacucuccggacggugaaauguucgacgugauggaaaaauacggcauucucggcguggaaauggaagcagcugguaucuacggcguggcugcagaguuuggcgcgaaagcccugaccaucugcaccguaucugaccauauucgcacgcacgagcagaccacugccgcugagcgucagacuaccuucaacgacaugaucaaaaucgcacuggaauccguucugcugggcgauaaagaguaa

SEQ ID NO: 6275 - RNA, 720 nt, Artificial Sequence; identical to SEQ ID NO: 6195
  derived and/or modified sequence opt1 from Purine_Nucleoside_Phosphorylase_deoD__Escherichia_coli__BAI57857

SEQ ID NO: 6276 - RNA, 720 nt, Artificial Sequence; identical to SEQ ID NO: 6196
  derived and/or modified sequence opt2 from Purine_Nucleoside_Phosphorylase_deoD__Escherichia_coli__BAI57857

SEQ ID NO: 6277 - RNA, 720 nt, Artificial Sequence; identical to SEQ ID NO: 6197
  derived and/or modified sequence opt3 from Purine_Nucleoside_Phosphorylase_deoD__Escherichia_coli__BAI57857

SEQ ID NO: 6278 - RNA, 720 nt, Artificial Sequence; identical to SEQ ID NO: 6198
  derived and/or modified sequence opt4 from Purine_Nucleoside_Phosphorylase_deoD__Escherichia_coli__BAI57857

SEQ ID NO: 6279 - RNA, 720 nt, Artificial Sequence; identical to SEQ ID NO: 6199
  derived and/or modified sequence opt5 from Purine_Nucleoside_Phosphorylase_deoD__Escherichia_coli__BAI57857

SEQ ID NO: 6280 - RNA, 720 nt, Artificial Sequence
  derived and/or modified sequence opt6 from Purine_Nucleoside_Phosphorylase_deoD__Escherichia_coli__BAI57857
auggcaacaccacauaucaaugcagaaaugggagacuuugcagauguaguacuaaugccaggagacccacuaagagccaaauacauagcagaaacauuuuuagaagacgcaagagaaguaaauaauguaagaggaauguuaggauuuacaggaaccuauaaaggacgaaaaauaaguguaaugggacauggaaugggaauaccaaguuguucaauauauacaaaagaauuaauaacagacuuuggaguaaagaaaauaauaagaguaggaucaugcggagcaguacuaccacacguaaaacuaagagauguaguaauagggaugggagcauguacagauagcaaaguaaauagaauaagauuuaaagaucacgauuuugcagcaauagcagauuucgauaugguaagaaaugcaguagacgcagcaaaagcauuaggaauagacgcaagaguaggaaaucuauuuagcgcagaccuauucuauagcccagacggagaaauguucgauguaauggaaaaauacggaauauuaggaguagaaauggaagcagcaggaauauauggaguagcagcagaauuuggagcaaaagcauuaacaauauguacaguaagcgaucacauaagaacacacgaacaaacaacggcagcagaaagacaaacgacguucaaugacaugauaaaaauagcauuagaaagcguacuauuaggagauaaagaguaa

SEQ ID NO: 6281 - protein, 239 aa, Artificial Sequence; identical to SEQ ID NO: 6201
  Purine_Nucleoside_Phosphorylase_deoD__Escherichia_coli_ _A0A0G2SIK5

SEQ ID NO: 6282 - RNA, 720 nt, Artificial Sequence
  Purine_Nucleoside_Phosphorylase_deoD__Escherichia_coli__AJM76720
auggcuacuccacacauuaaugcagaaaugggcgauuuugcugacguaguuuugaugccaggugacccgcugcgugcgaaguauauugcugaaacuuuccuugaagaugcccgugaagugaacaacguucgcgguaugcugggcuucacugguacuuacaaaggccgcaaaauuuccguaaugggccacgguauggguaucccguccugcuccaucuacaccaaagaacugaucacugauuucggcgugaagaaaauuauccgcguugguuccuguggcgcuguucugccgcacguaaaacugcgcgacgucguuaucgguaugggugccugcaccgauuccaaaguuaaccgcauccguuuuaaagaccaugacuuugccgcuaucgcugacuucgacauggugcguaacgcgguagacgcggcaaaagcacugggcguugaugcucguguugguaaccuguucuccgcugaccuguucuacucuccggacggcgaaauguucgacgugauggaaaaauacggcauccucggcguggaaauggaagcggcugguaucuacggcgucgcugcagaauuuggcgcgaaagcccugaccaucugcaccgugucugaccacauccgcacucacgagcagaccacugccgcugagcgucagaccaccuucaacgacaugaucaaaaucgcgcuggaauccguucugcugggcgauaaagaguaa

SEQ ID NO: 6283 - RNA, 720 nt, Artificial Sequence; identical to SEQ ID NO: 6203
  derived and/or modified sequence opt1 from Purine_Nucleoside_Phosphorylase_deoD__Escherichia_coli__AJM76720

SEQ ID NO: 6284 - RNA, 720 nt, Artificial Sequence; identical to SEQ ID NO: 6204
  derived and/or modified sequence opt2 from Purine_Nucleoside_Phosphorylase_deoD__Escherichia_coli__AJM76720

SEQ ID NO: 6285 - RNA, 720 nt, Artificial Sequence; identical to SEQ ID NO: 6205
  derived and/or modified sequence opt3 from Purine_Nucleoside_Phosphorylase_deoD__Escherichia_coli__AJM76720

SEQ ID NO: 6286 - RNA, 720 nt, Artificial Sequence; identical to SEQ ID NO: 6206
  derived and/or modified sequence opt4 from Purine_Nucleoside_Phosphorylase_deoD__Escherichia_coli__AJM76720

SEQ ID NO: 6287 - RNA, 720 nt, Artificial Sequence; identical to SEQ ID NO: 6207
  derived and/or modified sequence opt5 from Purine_Nucleoside_Phosphorylase_deoD__Escherichia_coli__AJM76720

SEQ ID NO: 6288 - RNA, 720 nt, Artificial Sequence
  derived and/or modified sequence opt6 from Purine_Nucleoside_Phosphorylase_deoD__Escherichia_coli__AJM76720
auggcaacaccccauauaaaugcagagaugggagacuucgcagauguaguacuaaugccaggagauccacuaagagcaaaauacauagcagaaacauuucuagaagacgcgagagaaguaaacaacguaagaggaaugcuaggauuuacaggaacauauaaaggaagaaaaauaucagucaugggacauggcaugggaauaccaaguuguaguauauauaccaaagaauuaauaacagacuuuggagucaaaaaaauaauaagaguaggaucaugcggagcaguacucccacacguaaaauuaagagauguaguaauaggaaugggagcauguacagauaguaagguaaauagaauacgauuuaaagaucacgauuucgcagcaauagcagauuucgauaugguaagaaaugcaguagacgcagcaaaagcauuaggaguagacgcacgaguaggaaaucuauuuagcgcagacuuauucuauagcccggacggagaaauguuugauguaauggaaaaauacggaauauuaggaguagaaauggaagcagcagggauauauggaguagcagcagaauuuggagcaaaagcacuaacaauauguacaguaagugaucacauaagaacacacgaacaaacaacagcagcagaaagacaaacaacauucaaugacaugauaaaaauagcauuagaaagcguauuauuaggagauaaagaauaa

SEQ ID NO: 6289 - protein, 239 aa, Artificial Sequence; identical to SEQ ID NO: 6201
  Purine_Nucleoside_Phosphorylase_deoD__Escherichia_coli_ _A0A0G3J9R6

SEQ ID NO: 6290 - RNA, 720 nt, Artificial Sequence
  Purine_Nucleoside_Phosphorylase_deoD__Escherichia_coli__AKK37374
auggcuaccccacacauuaaugcagaaaugggcgauuucgcugacguaguuuugaugccaggcgacccgcugcgugcgaaguauauugcugaaacuuuccuugaagaugcccgugaagugaacaacguucgcgguaugcugggcuucaccgguacuuacaaaggccgcaaaauuuccguaaugggccacgguauggguaucccguccugcuccaucuacaccaaagaacugaucaccgauuucggcgugaagaaaauuauccgcguugguuccuguggcgcuguucugccgcacguaaaacugcgcgacgucguuaucgguaugggugccugcaccgauuccaaaguuaaccgcauccguuuuaaagaccaugacuuugccgcuaucgcugacuucgacauggugcguaacgcgguagacgcggcuaaagcacugggcguugaugcucgcguugguaaccuguucuccgcugaccuguucuacucuccggacggcgaaauguucgacgugauggaaaaauacggcauccucggcguggaaauggaagccgcuggcaucuacggcgucgcugcagaauuuggcgcgaaagcccugaccaucugcaccgugucugaccacauccgcacucacgagcagaccacugccgcugagcgucagaccaccuucaacgacaugaucaaaaucgcacuggaauccguucuguugggcgauaaagaguaa

SEQ ID NO: 6291 - RNA, 720 nt, Artificial Sequence; identical to SEQ ID NO: 6203
  derived and/or modified sequence opt1 from Purine_Nucleoside_Phosphorylase_deoD__Escherichia_coli__AKK37374

SEQ ID NO: 6292 - RNA, 720 nt, Artificial Sequence; identical to SEQ ID NO: 6204
  derived and/or modified sequence opt2 from Purine_Nucleoside_Phosphorylase_deoD__Escherichia_coli__AKK37374

SEQ ID NO: 6293 - RNA, 720 nt, Artificial Sequence; identical to SEQ ID NO: 6205
  derived and/or modified sequence opt3 from Purine_Nucleoside_Phosphorylase_deoD__Escherichia_coli__AKK37374

SEQ ID NO: 6294 - RNA, 720 nt, Artificial Sequence; identical to SEQ ID NO: 6206
  derived and/or modified sequence opt4 from Purine_Nucleoside_Phosphorylase_deoD__Escherichia_coli__AKK37374

SEQ ID NO: 6295 - RNA, 720 nt, Artificial Sequence; identical to SEQ ID NO: 6207
  derived and/or modified sequence opt5 from Purine_Nucleoside_Phosphorylase_deoD__Escherichia_coli__AKK37374

SEQ ID NO: 6296 - RNA, 720 nt, Artificial Sequence
  derived and/or modified sequence opt6 from Purine_Nucleoside_Phosphorylase_deoD__Escherichia_coli__AKK37374
auggcaacaccacauauaaaugcagaaaugggagacuuugcagauguaguauuaaugccaggagacccacuaagagcaaaauacauagcagaaacauuuuuagaagacgcaagggaaguaaauaacgucagaggaauguuaggcuuuacaggaacauauaaaggaagaaaaauaaguguaaugggacauggaaugggaauaccaucaugcaguauauauacaaaagaauuaauaacagacuuuggaguaaaaaaaauaauaagaguaggaaguuguggagcaguacuaccacacguaaaacuaagagacguaguaauaggaaugggagcauguacagauagcaaaguaaauagaauaagauuuaaggaucaugauuucgcagcuauagcagauuucgauaugguaagaaaugcaguagacgcagcaaaagcccuaggaguagacgcaagagugggaaaucuauuuagugcagaccuauucuauagcccggacggagaaauguucgauguaauggaaaaauacggaauauuaggaguagaaauggaagcagcaggaauauauggaguagcagcagaauuuggagcaaaagcauuaacaauauguacaguaucagaucacauaagaacacacgaacaaacaacagcagccgaaagacaaacuacguuuaaugacaugauaaaaauagcacuagaaagugugcuauuaggagauaaagaauaa

SEQ ID NO: 6297 - protein, 239 aa, Artificial Sequence; identical to SEQ ID NO: 6201
  Purine_Nucleoside_Phosphorylase_deoD__Escherichia_coli_ _A0A0G3J9Y2

SEQ ID NO: 6298 - RNA, 720 nt, Artificial Sequence; identical to SEQ ID NO: 6282
  Purine_Nucleoside_Phosphorylase_deoD__Escherichia_coli__AKK35966

SEQ ID NO: 6299 - RNA, 720 nt, Artificial Sequence; identical to SEQ ID NO: 6203
  derived and/or modified sequence opt1 from Purine_Nucleoside_Phosphorylase_deoD__Escherichia_coli__AKK35966

SEQ ID NO: 6300 - RNA, 720 nt, Artificial Sequence; identical to SEQ ID NO: 6204
  derived and/or modified sequence opt2 from Purine_Nucleoside_Phosphorylase_deoD__Escherichia_coli__AKK35966

SEQ ID NO: 6301 - RNA, 720 nt, Artificial Sequence; identical to SEQ ID NO: 6205
  derived and/or modified sequence opt3 from Purine_Nucleoside_Phosphorylase_deoD__Escherichia_coli__AKK35966

SEQ ID NO: 6302 - RNA, 720 nt, Artificial Sequence; identical to SEQ ID NO: 6206
  derived and/or modified sequence opt4 from Purine_Nucleoside_Phosphorylase_deoD__Escherichia_coli__AKK35966

SEQ ID NO: 6303 - RNA, 720 nt, Artificial Sequence; identical to SEQ ID NO: 6207
  derived and/or modified sequence opt5 from Purine_Nucleoside_Phosphorylase_deoD__Escherichia_coli__AKK35966

SEQ ID NO: 6304 - RNA, 720 nt, Artificial Sequence
  derived and/or modified sequence opt6 from Purine_Nucleoside_Phosphorylase_deoD__Escherichia_coli__AKK35966
auggcaacaccacauauaaaugcagaaaugggagacuuugcagauguaguauuaaugccaggagacccacuaagagcaaaauacauagcagaaacauuuuuagaagaugcaagagaaguaaauaacguaagaggaaugcuaggauuuacaggaacauauaaaggaagaaaaauaucaguaaugggacauggaaugggaauaccaucaugcucaauauauacaaaagaauuaauaacagacuuuggaguaaaaaaaauaauaagagugggaucaugcggagcaguacuaccacacguuaaacuaagagauguaguaauaggaaugggagcauguaccgauagcaaaguaaauagaauaagauuuaaagaucaugauuucgcagcaauagcagauuucgauaugguaaggaaugcaguagacgcggcaaaagcauuaggaguggacgcaagaguaggaaauuuauuuagcgcagacuuauucuauagcccagauggagaaauguucgauguaauggaaaaauaugggauauuaggaguagaaauggaagcagcaggaauauauggaguagcagcagaauuuggagcaaaagcacuaacaauauguacaguaagcgaucacauaagaacacacgaacaaacaacagcggcagaaagacaaacaacauucaaugacaugauaaaaauagcacuagaaagcguacuauuaggagauaaagaauaa

SEQ ID NO: 6305 - protein, 239 aa, Artificial Sequence; identical to SEQ ID NO: 6201
  Purine_Nucleoside_Phosphorylase_deoD__Escherichia_coli_ _A0A0G3KD68

SEQ ID NO: 6306 - RNA, 720 nt, Artificial Sequence
  Purine_Nucleoside_Phosphorylase_deoD__Escherichia_coli__AKK51383
auggcuaccccacacauuaaugcagaaaugggcgauuucgcugacguaguuuugaugccaggcgacccgcugcgugcgaaguauauugcugaaacuuuccuugaagaugcccgugaagugaacaacguucgcgguaugcugggcuucaccgguacuuacaaaggccgcaaaauuuccguaaugggucacgguauggguaucccguccugcuccaucuacaccaaagaacugaucaccgauuucggcgugaagaaaauuauccgcguaggcuccuguggcgcuguucugccacacguaaaacugcgcgacgucguuaucgguaugggugccugcaccgauuccaaaguuaaccguauccguuuuaaagaccaugacuuugccgcuaucgcugacuuugacauggugcguaacgcgguagacgcggcuaaagcacugggcguugaugcucgcguugguaaccuguucuccgcugaccuguucuacucuccggacggcgaaauguucgacgugauggaaaaauacggcauccucggcguggaaauggaagcagcugguaucuacggcgucgcugcagaauuuggcgcgaaagcccugaccaucuguaccguaucugaccacauccgcacucacgagcagaccacugccgcugagcgucagaccaccuucaacgacaugaucaaaaucgcacuggaauccguucugcugggcgauaaagaguaa

SEQ ID NO: 6307 - RNA, 720 nt, Artificial Sequence; identical to SEQ ID NO: 6203
  derived and/or modified sequence opt1 from Purine_Nucleoside_Phosphorylase_deoD__Escherichia_coli__AKK51383

SEQ ID NO: 6308 - RNA, 720 nt, Artificial Sequence; identical to SEQ ID NO: 6204
  derived and/or modified sequence opt2 from Purine_Nucleoside_Phosphorylase_deoD__Escherichia_coli__AKK51383

SEQ ID NO: 6309 - RNA, 720 nt, Artificial Sequence; identical to SEQ ID NO: 6205
  derived and/or modified sequence opt3 from Purine_Nucleoside_Phosphorylase_deoD__Escherichia_coli__AKK51383

SEQ ID NO: 6310 - RNA, 720 nt, Artificial Sequence; identical to SEQ ID NO: 6206
  derived and/or modified sequence opt4 from Purine_Nucleoside_Phosphorylase_deoD__Escherichia_coli__AKK51383

SEQ ID NO: 6311 - RNA, 720 nt, Artificial Sequence; identical to SEQ ID NO: 6207
  derived and/or modified sequence opt5 from Purine_Nucleoside_Phosphorylase_deoD__Escherichia_coli__AKK51383

SEQ ID NO: 6312 - RNA, 720 nt, Artificial Sequence
  derived and/or modified sequence opt6 from Purine_Nucleoside_Phosphorylase_deoD__Escherichia_coli__AKK51383
auggcaacaccacauauaaaugcagaaaugggagacuuugcagauguuguauuaaugccaggagacccauuaagagccaaguacauagcagaaacauuucuagaagacgcaagagaaguaaauaacgugagaggaauguuaggauuuacaggaacauauaaaggaaggaaaauaagcguaaugggccauggaaugggaauaccaucaugcucaauauauacaaaagaauuaauaacagacuucggaguaaaaaaaauaauaagaguaggaucauguggagcagugcuaccacacguaaaauuaagagauguaguaauaggaaugggagccuguacagauaguaaaguaaauagaauaagauuuaaagaucaugauuucgcagcaauagcagauuucgauaugguacgaaaugcaguagacgcagcaaaagcauuaggaguagaugcaagaguaggaaaucuauuuagcgcggacuuauucuauagcccagacggagaaauguucgacguaauggaaaaauacggaauauuaggaguagaaauggaagcagcaggaauauauggaguagcagcagaauuuggagcaaaagcacuaacaauauguaccguaagugaucacauaagaacacacgaacaaacaacagcagcagaacgacaaaccacauucaaugacaugauaaaaauagcacuagaaagcguacuacuaggagauaaagaauaa

SEQ ID NO: 6313 - protein, 258 aa, Artificial Sequence
  Purine_Nucleoside_Phosphorylase_deoD__Escherichia_coli_ _A0A0H2Z6H1
MDLGGAVTPPLICHKKDKMMATPHINAEMGDFADVVLMPGDPLRAKYIAETFLEDAREVNNVRGMLGFTGTYKGRKISVMGHGMGIPSCSIYTKELITDFGVKKIIRVGSCGAVLPHVKLRDVVIGMGACTDSKVNRIRFKDHDFAAIADFDMVRNAVDAAKALGVDARVGNLFSADLFYSPDGEMFDVMEKYGILGVEMEAAGIYGVAAEFGAKALTICTVSDHIRTHEQTTAAERQTTFNDMIKIALESVLLGDKE

SEQ ID NO: 6314 - RNA, 777 nt, Artificial Sequence
  Purine_Nucleoside_Phosphorylase_deoD__Escherichia_coli__ABJ03941
auggauuugggcggagcagugacuccgccuuuaauaugucacaaaaaggauaaaaugauggcuacuccacacauuaaugcagaaaugggcgauuuugcugacguaguuuugaugccaggugacccgcugcgugcgaaguauauugcugaaacuuuccuugaagaugcccgugaagugaacaacguucgcgguaugcugggcuucacugguacuuacaaaggccgcaaaauuuccguaaugggccacgguauggguaucccguccugcuccaucuacaccaaagaacugaucacugauuucggcgugaagaaaauuauccgcguugguuccuguggcgcuguucugccgcacguaaaacugcgcgacgucguuaucgguaugggugccugcaccgauuccaaaguuaaccgcauccguuuuaaagaccaugacuuugccgcuaucgcugacuucgacauggugcguaacgcgguagacgcggcaaaagcacugggcguugaugcucguguugguaaccuguucuccgcugaccuguucuacucuccggacggcgaaauguucgacgugauggaaaaauacggcauccucggcguggaaauggaagcggcugguaucuacggcgucgcugcagaauuuggcgcgaaagcccugaccaucugcaccgugucugaccacauccgcacucacgagcagaccacugccgcugagcgucagaccaccuucaacgacaugaucaaaaucgcgcuggaauccguucugcugggcgauaaagaguaa

SEQ ID NO: 6315 - RNA, 777 nt, Artificial Sequence
  derived and/or modified sequence opt1 from Purine_Nucleoside_Phosphorylase_deoD__Escherichia_coli__ABJ03941
auggaccugggcggggccgugacgcccccgcucaucugccacaagaaggacaagaugauggccacgccccacaucaacgcggagaugggcgacuucgccgacgucgugcugaugcccggggacccccugcgcgccaaguacaucgccgagaccuuccucgaggacgcccgggaggugaacaacguccgcggcaugcugggguucaccggcaccuacaagggccggaagaucagcgugauggggcacggcauggggaucccguccugcagcaucuacaccaaggagcugaucaccgacuucggcgugaagaagaucauccgcgucggguccugcggcgcggugcucccccacgugaagcugcgggacgucgugaucggcaugggggccugcaccgacagcaaggugaaccgcauccgguucaaggaccacgacuucgccgccaucgcggacuucgacaugguccgcaacgccguggacgccgccaaggcccugggcguggacgcgcgggucgggaaccucuucuccgccgaccuguucuacagccccgacggcgagauguucgacgugauggagaaguacggcauccuggggguggagauggaggccgccggcaucuacggggucgccgcggaguucggcgccaaggcccucaccaucugcaccguguccgaccacauccgcacgcacgagcagaccaccgccgccgagcggcagaccacguucaacgacaugaucaagaucgcgcuggagagcgugcugcucggggacaaggaguga

SEQ ID NO: 6316 - RNA, 777 nt, Artificial Sequence
  derived and/or modified sequence opt2 from Purine_Nucleoside_Phosphorylase_deoD__Escherichia_coli__ABJ03941
auggaccucggcggcgccgucacccccccccucaucugccacaagaaggacaagaugauggccaccccccacaucaacgccgagaugggcgacuucgccgacgucguccucaugcccggcgacccccuccgcgccaaguacaucgccgagaccuuccucgaggacgcccgcgaggucaacaacguccgcggcaugcucggcuucaccggcaccuacaagggccgcaagaucuccgucaugggccacggcaugggcauccccuccugcuccaucuacaccaaggagcucaucaccgacuucggcgucaagaagaucauccgcgucggcuccugcggcgccguccucccccacgucaagcuccgcgacgucgucaucggcaugggcgccugcaccgacuccaaggucaaccgcauccgcuucaaggaccacgacuucgccgccaucgccgacuucgacaugguccgcaacgccgucgacgccgccaaggcccucggcgucgacgcccgcgucggcaaccucuucuccgccgaccucuucuacucccccgacggcgagauguucgacgucauggagaaguacggcauccucggcgucgagauggaggccgccggcaucuacggcgucgccgccgaguucggcgccaaggcccucaccaucugcaccgucuccgaccacauccgcacccacgagcagaccaccgccgccgagcgccagaccaccuucaacgacaugaucaagaucgcccucgaguccguccuccucggcgacaaggaguga

SEQ ID NO: 6317 - RNA, 777 nt, Artificial Sequence
  derived and/or modified sequence opt3 from Purine_Nucleoside_Phosphorylase_deoD__Escherichia_coli__ABJ03941
auggaccugggcggggccgugacucccccucucaucugccacaagaaagauaagaugauggcuacaccacauauuaacgcagagaugggagacuucgccgaugucguucuuaugccgggugacccccugagagcgaaauacauagcugaaaccuuuuuggaggaugccagggaagugaauaacguacggggcauguuaggguucacgggaaccuauaagggccgcaaaaucagcgugaugggucacgggaugggcauuccuuccuguucuaucuacacaaaggagcugauuacugacuuuggagucaagaaaaucauacgagugggcucaugcggggcaguucuaccacaugugaagcuccgugaugucgugaucggaaugggugccuguaccgacaguaaaguaaauagaauuagguucaaggaucacgacuuugcugcaaucgccgauuucgacaugguucggaacgcuguggaugccgcgaaagcacugggcgucgacgcccgcguggggaaucuuuuuagcgcugaccuguucuauucccccgauggagaaauguuugacgugauggagaaguacggcauuuugggugucgagauggaagccgcagggaucuauggaguugcugccgaguucggcgcgaaggcccucacaauaugcaccgugucugaucauauuagaacucacgaacagacaaccgcagcugagaggcaaacgacuuuuaacgacaugaucaaaauugcccuggagucgguacugcucggcgauaaggaauga

SEQ ID NO: 6318 - RNA, 777 nt, Artificial Sequence
  derived and/or modified sequence opt4 from Purine_Nucleoside_Phosphorylase_deoD__Escherichia_coli__ABJ03941
auggaccugggcggcgccgugacccccccccugaucugccacaagaaggacaagaugauggccaccccccacaucaacgccgagaugggcgacuucgccgacguggugcugaugcccggcgacccccugagagccaaguacaucgccgagaccuuccuggaggacgccagagaggugaacaacgugagaggcaugcugggcuucaccggcaccuacaagggcagaaagaucagcgugaugggccacggcaugggcauccccagcugcagcaucuacaccaaggagcugaucaccgacuucggcgugaagaagaucaucagagugggcagcugcggcgccgugcugccccacgugaagcugagagacguggugaucggcaugggcgccugcaccgacagcaaggugaacagaaucagauucaaggaccacgacuucgccgccaucgccgacuucgacauggugagaaacgccguggacgccgccaaggcccugggcguggacgccagagugggcaaccuguucagcgccgaccuguucuacagccccgacggcgagauguucgacgugauggagaaguacggcauccugggcguggagauggaggccgccggcaucuacggcguggccgccgaguucggcgccaaggcccugaccaucugcaccgugagcgaccacaucagaacccacgagcagaccaccgccgccgagagacagaccaccuucaacgacaugaucaagaucgcccuggagagcgugcugcugggcgacaaggaguga

SEQ ID NO: 6319 - RNA, 777 nt, Artificial Sequence
  derived and/or modified sequence opt5 from Purine_Nucleoside_Phosphorylase_deoD__Escherichia_coli__ABJ03941
auggaccugggcggggccgugacacccccucucaucugccacaagaaagauaagaugauggcuaccccgcauauuaacgccgagaugggagacuucgcggaugucguucugaugcccggcgacccucuuagagcuaaauacaucgccgaaacguuucuggaggaugcccgggaagugaauaacgugcgcgggaugcucggauucaccggcacauauaaggggagaaaaauuagcgucaugggacacggcaugggcauccccuccuguucuauuuacaccaaggagcugaucacagacuuuggggugaagaaaaucauucggguuggaagcugcggcgcugugcuuccucaugucaagcugcgcgaugugguuaucgggaugggagccuguaccgacuccaaagugaaucggauuagauucaaggaucacgacuuugcugccaucgcggauuucgacaugguccgcaacgccguggaugcugccaaagcucucggcguggacgccagagucgggaaucuguuuucugcggaccuguucuauagccccgauggagaaauguuugacguuauggagaaguacggcauucucggcguggagauggaagccgcugggaucuauggaguggccgcugaguucggcgccaaggcccugacaauuugcaccgucuccgaucauauccggacgcacgaacagaccacagcugcggagcgccaaaccacauuuaacgacaugaucaaaauugcccuugagucugugcugcucggggauaaggaauga

SEQ ID NO: 6320 - RNA, 777 nt, Artificial Sequence
  derived and/or modified sequence opt6 from Purine_Nucleoside_Phosphorylase_deoD__Escherichia_coli__ABJ03941
auggauuuaggaggagcaguaacgccaccacuaauaugccauaaaaaagacaaaaugauggcaacaccacauauaaaugcagaaaugggagacuuugcagauguaguauuaaugccaggagacccacuaagagcaaaauacauagcagaaacauuucuagaagacgcaagagaaguaaauaauguacgaggaauguuaggauuuacaggaacauauaaaggaagaaaaauaucaguaaugggacauggaaugggaauaccaucaugcagcauauauacaaaagaauuaauaacagauuuuggaguaaaaaaaauaauacgaguaggaaguugcggagcaguacuaccacacguaaaauuaagagauguaguaauaggaaugggagccuguacagauagcaaaguaaauagaauuagauuuaaagaucacgacuucgcagcaaucgcagauuucgauaugguaagaaaugcaguggacgcggcaaaagcauuaggaguagacgcaagaguaggaaauuuauuuagugcugacuuauuuuauagcccagacggagaaauguucgauguaauggaaaaauacggaauacuaggaguagaaauggaagcagcaggaauauauggaguagcagcagaauuuggagcaaaagcacuaacaauaugcacaguaucagaucauauaagaacacaugaacaaacgacagcagcagaaagacaaacaacauucaaugauaugauaaaaauagcauuagaaaguguacuauuaggagauaaggaauaa

SEQ ID NO: 6321 - protein, 239 aa, Artificial Sequence; identical to SEQ ID NO: 6201
  Purine_Nucleoside_Phosphorylase_deoD__Escherichia_coli_ _A0A0H3EQW1

SEQ ID NO: 6322 - RNA, 720 nt, Artificial Sequence
  Purine_Nucleoside_Phosphorylase_deoD__Escherichia_coli__ADR29841
auggcuacuccacacauuaaugcagaaaugggcgauuuugcugacguaguuuugaugccaggcgacccgcugcgugcgaaguauauugcugaaacuuuccuugaagaugcccgugaagugaacaacguucgcgguaugcugggcuucaccgguacuuauaaaggccgcaaaauuuccguaaugggucacgguauggguaucccguccugcuccaucuacaccaaagaacugaucaccgauuucggcgugaagaaaauuauccgcguagguuccuguggugcuguucugccgcacguaaaacugcgugacgucguuaucgguaugggugccugcaccgauuccaaaguuaaccgcauccguuuuaaagaccaugacuuugccgcuaucgcugacuucgacauggugcguaacgcgguagacgcggcaaaagcacugggcguugaugcucgcguugguaaccuguucuccgcugaccuguucuacucuccggacggcgaaauguucgacgugauggaaaaauacggcauccucggcguggaaauggaagcggcugguaucuacggcgucgcugcagaauuuggcgcgaaagcccugaccaucugcaccgugucugaccacauccgcacucacgagcagaccacugccgcugagcgucagaccaccuucaacgacaugaucaaaaucgcgcuggaauccguucugcugggcgauaaagaguaa

SEQ ID NO: 6323 - RNA, 720 nt, Artificial Sequence; identical to SEQ ID NO: 6203
  derived and/or modified sequence opt1 from Purine_Nucleoside_Phosphorylase_deoD__Escherichia_coli__ADR29841

SEQ ID NO: 6324 - RNA, 720 nt, Artificial Sequence; identical to SEQ ID NO: 6204
  derived and/or modified sequence opt2 from Purine_Nucleoside_Phosphorylase_deoD__Escherichia_coli__ADR29841

SEQ ID NO: 6325 - RNA, 720 nt, Artificial Sequence; identical to SEQ ID NO: 6205
  derived and/or modified sequence opt3 from Purine_Nucleoside_Phosphorylase_deoD__Escherichia_coli__ADR29841

SEQ ID NO: 6326 - RNA, 720 nt, Artificial Sequence; identical to SEQ ID NO: 6206
  derived and/or modified sequence opt4 from Purine_Nucleoside_Phosphorylase_deoD__Escherichia_coli__ADR29841

SEQ ID NO: 6327 - RNA, 720 nt, Artificial Sequence; identical to SEQ ID NO: 6207
  derived and/or modified sequence opt5 from Purine_Nucleoside_Phosphorylase_deoD__Escherichia_coli__ADR29841

SEQ ID NO: 6328 - RNA, 720 nt, Artificial Sequence
  derived and/or modified sequence opt6 from Purine_Nucleoside_Phosphorylase_deoD__Escherichia_coli__ADR29841
auggcaacaccacauauaaaugcagaaaugggagacuuugcagauguaguauuaaugcccggagacccgcuaagagcaaaauacauagcagaaacauuucuagaagacgcaagagaaguaaauaacguaagaggaauguuaggauuuacaggaacauauaaagggagaaaaauaucaguaaugggacauggaaugggaauaccaaguugcucaauauauacaaaagaauuaauaacagacuuuggaguaaaaaaaauaauaagaguaggaucaugcggagcaguacuaccacacguaaaacuaagagauguaguaauaggaaugggagcauguacagauaguaaaguaaauagaauaagauuuaaagaucacgauuucgcagcaauagcagauuuugauaugguaagaaaugcaguggacgcagcaaaagcauugggaguagaugcaagaguaggaaaucuauuuagcgcagacuuguucuauagcccagacggagaaauguuugauguaauggaaaaauacggaauacuaggaguagaaauggaagcagcaggaauauauggcguagcagcagaauuuggagcaaaagcacuaacgauauguacaguaagcgaucacauaagaacacacgaacaaacaacagcagcagaaagacaaacaacauucaaugacaugauaaaaauagcacuagaaagcguacuauuaggagauaaagaauaa

SEQ ID NO: 6329 - protein, 239 aa, Artificial Sequence; identical to SEQ ID NO: 6193
  Purine_Nucleoside_Phosphorylase_deoD__Escherichia_coli_ _A0A0H3XF09

SEQ ID NO: 6330 - RNA, 720 nt, Artificial Sequence
  Purine_Nucleoside_Phosphorylase_deoD__Escherichia_coli__AKM37993
auggcuaccccacacauuaaugcagaaaugggcgauuucgcugacguaguuuugaugccaggcgacccgcugcgugcgaaguauauugcugaaacuuuccuugaagaugcccgugaagugaacaacguucgcgguaugcugggcuucaccgguacuuacaaaggccgcaaaauuuccguaaugggucacgguauggguaucccguccugcuccaucuacaccaaagaacugaucaccgauuucggcgugaagaaaauuauccgcguggguuccuguggcgcaguucugccgcacguaaaacugcgcgacgucguuaucgguaugggugccugcaccgauuccaaaguuaaccgcauccguuuuaaagaucaugacuuugccgcuaucgcugacuuugacauggugcguaacgcgguagacgcggcuaaagcacugggcauugaugcucgcguugguaaccuguucuccgcugaccuguucuacucuccggacggcgaaauguucgacgugauggaaaaauacggcauccucggcguggaaauggaagcggcugguaucuacggcgucgcugcagaauuuggcgcgaaagcccugaccaucuguaccgugucugaccacauccgcacucacgagcagaccacugccgcugagcgucagaccaccuucaacgacaugaucaaaaucgcacuggaauccguucugcugggcgauaaagaguaa

SEQ ID NO: 6331 - RNA, 720 nt, Artificial Sequence; identical to SEQ ID NO: 6195
  derived and/or modified sequence opt1 from Purine_Nucleoside_Phosphorylase_deoD__Escherichia_coli__AKM37993

SEQ ID NO: 6332 - RNA, 720 nt, Artificial Sequence; identical to SEQ ID NO: 6196
  derived and/or modified sequence opt2 from Purine_Nucleoside_Phosphorylase_deoD__Escherichia_coli__AKM37993

SEQ ID NO: 6333 - RNA, 720 nt, Artificial Sequence; identical to SEQ ID NO: 6197
  derived and/or modified sequence opt3 from Purine_Nucleoside_Phosphorylase_deoD__Escherichia_coli__AKM37993

SEQ ID NO: 6334 - RNA, 720 nt, Artificial Sequence; identical to SEQ ID NO: 6198
  derived and/or modified sequence opt4 from Purine_Nucleoside_Phosphorylase_deoD__Escherichia_coli__AKM37993

SEQ ID NO: 6335 - RNA, 720 nt, Artificial Sequence; identical to SEQ ID NO: 6199
  derived and/or modified sequence opt5 from Purine_Nucleoside_Phosphorylase_deoD__Escherichia_coli__AKM37993

SEQ ID NO: 6336 - RNA, 720 nt, Artificial Sequence
  derived and/or modified sequence opt6 from Purine_Nucleoside_Phosphorylase_deoD__Escherichia_coli__AKM37993
auggcaacgccucauauaaaugcagaaaugggagacuuugcagauguaguacuaaugccaggagacccuuuaagagcaaaguacauagcagagacauuucuagaagacgcaagagaaguaaauaacguaagaggaauguuaggauucacaggaacauauaaaggacgaaaaauaucaguaaugggacauggaaugggaauaccaucaugcucaauauacacaaaagaauuaauaacagacuuuggaguaaaaaaaauaauaagaguagguucaugcggagcaguauuaccacacguaaaauuacgagauguaguaaucggaaugggagcauguacagauaguaaaguaaauagaauaagauuuaaagaucacgauuuugcagccauagcagauuucgauaugguaagaaaugcaguagacgcagcuaaagcauuaggaauagacgcaagaguaggaaaucuauuuagugcagaccuauucuauagcccagacggagaaauguucgauguaauggaaaaauacgggauauuaggaguagaaauggaagcagcaggaauauauggaguagcagcagaauuuggagcaaaagcacuaacaauauguacaguaagugaucacauacguacacacgaacaaacaacagcagcagaaagacaaacaacauucaaugacaugauaaaaauagcauuagaaagcguauuauuaggagauaaagaauaa

SEQ ID NO: 6337 - protein, 239 aa, Artificial Sequence; identical to SEQ ID NO: 6193
  Purine_Nucleoside_Phosphorylase_deoD__Escherichia_coli_ _A0A0J9WZC9

SEQ ID NO: 6338 - RNA, 720 nt, Artificial Sequence
  Purine_Nucleoside_Phosphorylase_deoD__Escherichia_coli__BAL40848
auggcuaccccacacauuaaugcagaaaugggcgauuucgcugacguaguuuugaugccaggcgacccgcugcgugcgaaguauauugcugaaacuuuccuugaagaugcccgugaagugaacaacguucgcgguaugcugggcuucaccgguacuuacaaaggccgcaaaauuuccguaaugggucacgguauggguaucccguccugcuccaucuacaccaaagaacugaucaccgauuucggcgugaagaaaauuauccgcguggguuccuguggcgcaguucugccgcacguaaaacugcgcgacgucguuaucgguaugggugccugcaccgauuccaaaguuaaccgcauccguuuuaaagaccaugacuuugccgcuaucgcugacuucgacauggugcguaacgcaguagaugcagcuaaagcacuggguauugaugcucgcguggguaaccuguucuccgcugaccuguucuacucuccggacggcgaaauguucgacgugauggaaaaauacggcauucucggcguggaaauggaagcggcugguaucuacggcgucgcugcagaauuuggcgcgaaagcccugaccaucugcaccguaucugaccacauccgcacucacgagcagaccacugccgcugagcgucagacuaccuucaacgacaugaucaaaaucgcacuggaauccguucugcugggcgauaaagaguaa

SEQ ID NO: 6339 - RNA, 720 nt, Artificial Sequence; identical to SEQ ID NO: 6195
  derived and/or modified sequence opt1 from Purine_Nucleoside_Phosphorylase_deoD__Escherichia_coli__BAL40848

SEQ ID NO: 6340 - RNA, 720 nt, Artificial Sequence; identical to SEQ ID NO: 6196
  derived and/or modified sequence opt2 from Purine_Nucleoside_Phosphorylase_deoD__Escherichia_coli__BAL40848

SEQ ID NO: 6341 - RNA, 720 nt, Artificial Sequence; identical to SEQ ID NO: 6197
  derived and/or modified sequence opt3 from Purine_Nucleoside_Phosphorylase_deoD__Escherichia_coli__BAL40848

SEQ ID NO: 6342 - RNA, 720 nt, Artificial Sequence; identical to SEQ ID NO: 6198
  derived and/or modified sequence opt4 from Purine_Nucleoside_Phosphorylase_deoD__Escherichia_coli__BAL40848

SEQ ID NO: 6343 - RNA, 720 nt, Artificial Sequence; identical to SEQ ID NO: 6199
  derived and/or modified sequence opt5 from Purine_Nucleoside_Phosphorylase_deoD__Escherichia_coli__BAL40848

SEQ ID NO: 6344 - RNA, 720 nt, Artificial Sequence
  derived and/or modified sequence opt6 from Purine_Nucleoside_Phosphorylase_deoD__Escherichia_coli__BAL40848
auggcaacaccacauauaaacgcagaaaugggagacuuugcagauguaguacuaaugccaggagacccauuaagagcgaaauacauagcagaaacauuucuagaagacgcaagagaaguaaauaacguaagaggaauguuaggauuuacaggaacauauaaaggaagaaaaauaucaguaaugggacauggaaugggaauaccuucaugcaguauauauacaaaagaacuaauaacggauuuuggaguaaaaaaaauaauaagaguaggaucauguggagcaguacuaccacacguaaaauuaagagauguaguaauaggaaugggggccuguacagauagcaaaguaaauagaauaagauuuaaagaucacgauuucgcagcaauagcagauuucgauaugguaagaaaugcaguggacgcagcaaaagcacuaggaauagacgcaagaguaggaaaucuauuuagcgcagacuuauucuauaguccggacggagaaauguucgauguaauggaaaaauacggaauauuaggaguagaaauggaagcagccggaauauauggaguagcagcagaauuuggagcgaaagcauuaacaauauguacaguaagugaucacauaagaacacacgaacaaacaacagcagcagaaagacaaacaacauucaaugacaugauaaaaauagcacuagaaaguguacucuuaggagauaaagaauaa

SEQ ID NO: 6345 - protein, 239 aa, Artificial Sequence; identical to SEQ ID NO: 6193
  Purine_Nucleoside_Phosphorylase_deoD__Escherichia_coli__A7ZVS7

SEQ ID NO: 6346 - RNA, 720 nt, Artificial Sequence; identical to SEQ ID NO: 6234
  Purine_Nucleoside_Phosphorylase_deoD__Escherichia_coli__ABV17365

SEQ ID NO: 6347 - RNA, 720 nt, Artificial Sequence; identical to SEQ ID NO: 6195
  derived and/or modified sequence opt1 from Purine_Nucleoside_Phosphorylase_deoD__Escherichia_coli__ABV17365

SEQ ID NO: 6348 - RNA, 720 nt, Artificial Sequence; identical to SEQ ID NO: 6196
  derived and/or modified sequence opt2 from Purine_Nucleoside_Phosphorylase_deoD__Escherichia_coli__ABV17365

SEQ ID NO: 6349 - RNA, 720 nt, Artificial Sequence; identical to SEQ ID NO: 6197
  derived and/or modified sequence opt3 from Purine_Nucleoside_Phosphorylase_deoD__Escherichia_coli__ABV17365

SEQ ID NO: 6350 - RNA, 720 nt, Artificial Sequence; identical to SEQ ID NO: 6198
  derived and/or modified sequence opt4 from Purine_Nucleoside_Phosphorylase_deoD__Escherichia_coli__ABV17365

SEQ ID NO: 6351 - RNA, 720 nt, Artificial Sequence; identical to SEQ ID NO: 6199
  derived and/or modified sequence opt5 from Purine_Nucleoside_Phosphorylase_deoD__Escherichia_coli__ABV17365

SEQ ID NO: 6352 - RNA, 720 nt, Artificial Sequence
  derived and/or modified sequence opt6 from Purine_Nucleoside_Phosphorylase_deoD__Escherichia_coli__ABV17365
auggcaacaccacauauaaaugcagaaaugggagacuucgcagacguuguacuaaugccaggagacccauuaagagcaaaauacauagcagaaacauuucuagaagacgcaagagaaguaaauaacguaagaggaauguuaggcuuuacaggaacauauaaaggaagaaaaauaaguguaaugggacauggaaugggaauaccaucaugcaguauauauacaaaagaacuaauaacagacuuuggaguaaaaaaaauaauaagaguaggaucaugcggagcaguacuaccacacguaaaauuaagggauguagugauaggaaugggagcauguacagauagcaaaguaaauagaauaagauucaaagaucacgauuucgcagcaauagcagauuucgacaugguaagaaaugcaguagacgcagcaaaagcauuaggaauagacgcaagaguaggaaaucuauuuagcgcagaccuauucuauaguccagacggagaaauguucgauguaauggaaaaauacggaauacuaggaguggaaauggaagcagcaggaauauauggaguagcagcagaauuuggagcaaaagcacuaacaauauguacagugagcgaucacauaagaacacacgaacaaacaacagcggcagaaagacaaacaacauucaaugacaugauaaaaauagcacuagaaaguguauuauuaggagauaaagaauaa

SEQ ID NO: 6353 - protein, 239 aa, Artificial Sequence; identical to SEQ ID NO: 6193
  Purine_Nucleoside_Phosphorylase_deoD__Escherichia_coli__A8A8B3

SEQ ID NO: 6354 - RNA, 720 nt, Artificial Sequence; identical to SEQ ID NO: 6330
  Purine_Nucleoside_Phosphorylase_deoD__Escherichia_coli__ABV08767

SEQ ID NO: 6355 - RNA, 720 nt, Artificial Sequence; identical to SEQ ID NO: 6195
  derived and/or modified sequence opt1 from Purine_Nucleoside_Phosphorylase_deoD__Escherichia_coli__ABV08767

SEQ ID NO: 6356 - RNA, 720 nt, Artificial Sequence; identical to SEQ ID NO: 6196
  derived and/or modified sequence opt2 from Purine_Nucleoside_Phosphorylase_deoD__Escherichia_coli__ABV08767

SEQ ID NO: 6357 - RNA, 720 nt, Artificial Sequence; identical to SEQ ID NO: 6197
  derived and/or modified sequence opt3 from Purine_Nucleoside_Phosphorylase_deoD__Escherichia_coli__ABV08767

SEQ ID NO: 6358 - RNA, 720 nt, Artificial Sequence; identical to SEQ ID NO: 6198
  derived and/or modified sequence opt4 from Purine_Nucleoside_Phosphorylase_deoD__Escherichia_coli__ABV08767

SEQ ID NO: 6359 - RNA, 720 nt, Artificial Sequence; identical to SEQ ID NO: 6199
  derived and/or modified sequence opt5 from Purine_Nucleoside_Phosphorylase_deoD__Escherichia_coli__ABV08767

SEQ ID NO: 6360 - RNA, 720 nt, Artificial Sequence
  derived and/or modified sequence opt6 from Purine_Nucleoside_Phosphorylase_deoD__Escherichia_coli__ABV08767
auggcaacaccacauauaaaugcagaaaugggagacuuugcagacguaguacuaaugccaggagacccacuuagagcaaaauacauagcagaaacauuucuagaagacgcuagagaaguaaauaacguaagaggaauguuaggauuuacaggaacauauaaaggaagaaaaauaucaguaaugggacauggaaugggaauaccaucauguagcauauauacaaaagaacuaauaacagacuuuggaguaaaaaaaauaauaagaguaggaucuugcggggcaguacuaccacacguaaaauuaagagauguaguaauaggaaugggagcauguacagauucaaaaguaaauagaauacgauuuaaagaucacgauuucgcagcaauagcagacuuugauaugguaagaaaugcaguagacgcggcaaaagcuuuaggaauagacgcaagaguaggaaauuuauuuagugcagacuuauucuauagcccagauggagaaauguucgauguaauggaaaaauauggaauauuaggcguggaaauggaagcagcaggaauauauggaguagcagcagaauuuggagcaaaagcauuaacaauauguacaguaagcgaccauauacgaacacacgaacaaacaacagcagccgaaagacaaacaacauuuaaugauaugauaaaaauagcauuagaaagcguacuauuaggagauaaagaauaa

SEQ ID NO: 6361 - protein, 239 aa, Artificial Sequence; identical to SEQ ID NO: 6201
  Purine_Nucleoside_Phosphorylase_deoD__Escherichia_coli__B1IS35

SEQ ID NO: 6362 - RNA, 720 nt, Artificial Sequence
  Purine_Nucleoside_Phosphorylase_deoD__Escherichia_coli__ACA79283
auggcuaccccacacauuaaugcagaaaugggcgauuucgcugacguaguuuugaugccaggcgacccgcugcgugcgaaguauauugcugaaacuuuccuugaagaugcccgugaagugaacaacguucgcgguaugcugggcuucaccgguacuuacaaaggccgcaaaauuuccguaaugggucacgguauggguaucccguccugcuccaucuacaccaaagaacugaucaccgauuucggcguaaagaaaauuauccgcguaggcuccuguggcgcuguucugccgcacguaaaacugcgcgacgucguuaucgguaugggugccugcaccgauuccaaaguuaaccguauccguuuuaaagaccaugacuuugccgcuaucgcugacuuugacauggugcguaacgcgguagacgcggcuaaagcacugggcguugaugcucgcguugguaaccuguucuccgcugaccuguucuacucuccggacggcgaaauguucgacgugauggaaaaauacggcauccucggcguggaaauggaagcggcugguaucuacggcgucgcugcagaauuuggcgcgaaagcccugaccaucugcaccgugucugaccacauccgcacucacgagcagaccacugccgcugagcgucagaccaccuucaacgacaugaucaaaaucgcacuggaauccguucugcugggcgauaaagaguaa

SEQ ID NO: 6363 - RNA, 720 nt, Artificial Sequence; identical to SEQ ID NO: 6203
  derived and/or modified sequence opt1 from Purine_Nucleoside_Phosphorylase_deoD__Escherichia_coli__ACA79283

SEQ ID NO: 6364 - RNA, 720 nt, Artificial Sequence; identical to SEQ ID NO: 6204
  derived and/or modified sequence opt2 from Purine_Nucleoside_Phosphorylase_deoD__Escherichia_coli__ACA79283

SEQ ID NO: 6365 - RNA, 720 nt, Artificial Sequence; identical to SEQ ID NO: 6205
  derived and/or modified sequence opt3 from Purine_Nucleoside_Phosphorylase_deoD__Escherichia_coli__ACA79283

SEQ ID NO: 6366 - RNA, 720 nt, Artificial Sequence; identical to SEQ ID NO: 6206
  derived and/or modified sequence opt4 from Purine_Nucleoside_Phosphorylase_deoD__Escherichia_coli__ACA79283

SEQ ID NO: 6367 - RNA, 720 nt, Artificial Sequence; identical to SEQ ID NO: 6207
  derived and/or modified sequence opt5 from Purine_Nucleoside_Phosphorylase_deoD__Escherichia_coli__ACA79283

SEQ ID NO: 6368 - RNA, 720 nt, Artificial Sequence
  derived and/or modified sequence opt6 from Purine_Nucleoside_Phosphorylase_deoD__Escherichia_coli__ACA79283
auggcaacaccacauauaaaugcagaaaugggagacuuugcagauguaguacuaaugccaggagacccacuaagagcaaaauacauugcagaaaccuuuuuagaagacgcaagagaaguaaauaacguaagaggaauguuaggauuuacaggaacauauaaaggaagaaaaauaaguguaaugggacauggaaugggaauaccaaguuguucgauauauacaaaagaauuaauaacagacuuuggcguaaaaaaaauaauaagaguaggaagcugcggagcaguacuaccacacguaaaauuaagagauguaguaauaggaaugggagccuguacagauagcaaaguaaauagaauuagauuuaaagaucacgauuuugcggcaauagccgauuuugauaugguaagaaaugcaguagacgcagcaaaagcauuaggaguggacgcaagaguaggaaaucuauuuagugcagacuuauuuuauagcccagacggggaaauguucgauguaauggaaaaauacggaauauuaggaguagaaauggaagcagcaggaauauauggaguggcagcggaauuuggagcaaaagcacuaacaauauguacaguaagcgaucacauaagaacacacgaacaaacaacagcagccgaaagacaaacaacguucaaugacaugauaaaaauagcacuagaaaguguauuauuaggagauaaagaauaa

SEQ ID NO: 6369 - protein, 239 aa, Artificial Sequence; identical to SEQ ID NO: 6193
  Purine_Nucleoside_Phosphorylase_deoD__Escherichia_coli__B1LEI9

SEQ ID NO: 6370 - RNA, 720 nt, Artificial Sequence
  Purine_Nucleoside_Phosphorylase_deoD__Escherichia_coli__ACB16204
auggcuaccccacacauuaaugcagaaaugggcgauuucgcugacguaguuuugaugccaggcgacccgcugcgugcgaaguauauugcugaaacuuuccuugaagaugcccgugaagugaacaacguucgcgguaugcugggcuucaccgguacuuacaaaggccgcaaaauuuccguaauggggcacgguauggguaucccguccugcuccaucuacaccaaagaacugaucaccgauuucggcgugaagaaaauuauccgcguaggcuccuguggcgcuguucugccgcacguaaaacugcgcgacgucguuaucgguaugggugccugcaccgauuccaaaguuaaccguauccguuuuaaagaccaugacuuugccgcuaucgcugacuuugacauggugcguaacgcgguagaugcagcuaaagcacugggcauugaugcucgcguugguaaccuguucuccgcugaccuguuuuacucuccggacggcgaaauguucgacgugauggaaaaauacggcauccucggcguggaaauggaagcagcugguaucuacggcgucgcugcagaauuuggcgcgaaagcccugaccaucugcaccgugucugaccacauccgcacucacgagcagaccacugccgcugagcgucagaccaccuucaacgacaugaucaaaaucgcacuggaauccguucuguugggcgauaaagaguaa

SEQ ID NO: 6371 - RNA, 720 nt, Artificial Sequence; identical to SEQ ID NO: 6195
  derived and/or modified sequence opt1 from Purine_Nucleoside_Phosphorylase_deoD__Escherichia_coli__ACB16204

SEQ ID NO: 6372 - RNA, 720 nt, Artificial Sequence; identical to SEQ ID NO: 6196
  derived and/or modified sequence opt2 from Purine_Nucleoside_Phosphorylase_deoD__Escherichia_coli__ACB16204

SEQ ID NO: 6373 - RNA, 720 nt, Artificial Sequence; identical to SEQ ID NO: 6197
  derived and/or modified sequence opt3 from Purine_Nucleoside_Phosphorylase_deoD__Escherichia_coli__ACB16204

SEQ ID NO: 6374 - RNA, 720 nt, Artificial Sequence; identical to SEQ ID NO: 6198
  derived and/or modified sequence opt4 from Purine_Nucleoside_Phosphorylase_deoD__Escherichia_coli__ACB16204

SEQ ID NO: 6375 - RNA, 720 nt, Artificial Sequence; identical to SEQ ID NO: 6199
  derived and/or modified sequence opt5 from Purine_Nucleoside_Phosphorylase_deoD__Escherichia_coli__ACB16204

SEQ ID NO: 6376 - RNA, 720 nt, Artificial Sequence
  derived and/or modified sequence opt6 from Purine_Nucleoside_Phosphorylase_deoD__Escherichia_coli__ACB16204
auggcaacaccacauauaaaugcagaaaugggagacuuugcagauguaguacuaaugccaggagacccacuaagagcaaaauacauagcagaaacauuucuagaagacgcaagagaaguaaauaacguaagaggaauguuaggauuuacaggaacauauaaaggaagaaaaauaaguguaaugggacauggcaugggaauaccaucauguucaauuuauacaaaagaauuaauaacagacuuuggaguaaaaaaaaucauaagaguaggaucaugcggagcaguacuaccacacguaaaauuaagagaugucguaauuggaaugggagcaugcacagauaguaaaguaaauagaauaagauucaaagaucaugauuucgcagcaauagcagauuucgauaugguaagaaaugcaguagacgcagcaaaagcacuaggaauagacgcaagaguagguaaucuauuuagcgcagacuuauucuauaguccagacggagaaauguucgauguaauggaaaaauacggaauauuaggaguagaaauggaagcagcaggaauauauggcguagcagcagaauuuggcgcaaaagcacuaacgauauguaccguaagcgaucauauaagaacgcacgaacagacaacagcggcagagagacaaacaacauucaaugacaugauaaaaauagcacuagaaaguguacuauuaggagauaaagaauaa

SEQ ID NO: 6377 - protein, 239 aa, Artificial Sequence; identical to SEQ ID NO: 6193
  Purine_Nucleoside_Phosphorylase_deoD__Escherichia_coli__B1XFJ4

SEQ ID NO: 6378 - RNA, 720 nt, Artificial Sequence; identical to SEQ ID NO: 6338
  Purine_Nucleoside_Phosphorylase_deoD__Escherichia_coli__ACB05312

SEQ ID NO: 6379 - RNA, 720 nt, Artificial Sequence; identical to SEQ ID NO: 6195
  derived and/or modified sequence opt1 from Purine_Nucleoside_Phosphorylase_deoD__Escherichia_coli__ACB05312

SEQ ID NO: 6380 - RNA, 720 nt, Artificial Sequence; identical to SEQ ID NO: 6196
  derived and/or modified sequence opt2 from Purine_Nucleoside_Phosphorylase_deoD__Escherichia_coli__ACB05312

SEQ ID NO: 6381 - RNA, 720 nt, Artificial Sequence; identical to SEQ ID NO: 6197
  derived and/or modified sequence opt3 from Purine_Nucleoside_Phosphorylase_deoD__Escherichia_coli__ACB05312

SEQ ID NO: 6382 - RNA, 720 nt, Artificial Sequence; identical to SEQ ID NO: 6198
  derived and/or modified sequence opt4 from Purine_Nucleoside_Phosphorylase_deoD__Escherichia_coli__ACB05312

SEQ ID NO: 6383 - RNA, 720 nt, Artificial Sequence; identical to SEQ ID NO: 6199
  derived and/or modified sequence opt5 from Purine_Nucleoside_Phosphorylase_deoD__Escherichia_coli__ACB05312

SEQ ID NO: 6384 - RNA, 720 nt, Artificial Sequence
  derived and/or modified sequence opt6 from Purine_Nucleoside_Phosphorylase_deoD__Escherichia_coli__ACB05312
auggcaacaccacauauaaaugcagaaaugggagacuuugcagauguaguacuaaugccaggagacccauuaagagcaaaauacauagcagaaacauuucuagaagacgcaagagaaguaaauaacguaagaggaauguuaggauuuacaggaacguauaaaggaagaaaaaucucaguaaugggacauggaaugggaauaccaucauguaguauauauaccaaagaauuaauaacagacuuuggaguaaaaaaaauaauaagaguaggaucaugcggagcaguacuaccacacguaaaauuaagagauguaguaauaggaaugggagcauguacagauagcaaaguaaauagaauuagauuuaaagaucacgacuucgcagcaauagcagauuucgauaugguaagaaaugcaguagaugcggcaaaagcauuaggaauagacgcaagaguaggaaauuuauuuagugcggacuuauuuuauagcccagauggagaaauguucgauguaauggaaaaauacggaauacuaggaguagaaauggaagcagcaggaauauacggaguagcagcggaauuuggagcaaaagcauuaacaaucuguacaguaagcgaucacauaagaacacacgaacaaacaacagcagcagaaagacaaacaacguucaaugacaugauaaaaauagcacuagaaaguguacuauuaggcgauaaagaauaa

SEQ ID NO: 6385 - protein, 239 aa, Artificial Sequence; identical to SEQ ID NO: 6201
  Purine_Nucleoside_Phosphorylase_deoD__Escherichia_coli__B3HEI4

SEQ ID NO: 6386 - RNA, 720 nt, Artificial Sequence; identical to SEQ ID NO: 6218
  Purine_Nucleoside_Phosphorylase_deoD__Escherichia_coli__AIF62240

SEQ ID NO: 6387 - RNA, 720 nt, Artificial Sequence; identical to SEQ ID NO: 6203
  derived and/or modified sequence opt1 from Purine_Nucleoside_Phosphorylase_deoD__Escherichia_coli__AIF62240

SEQ ID NO: 6388 - RNA, 720 nt, Artificial Sequence; identical to SEQ ID NO: 6204
  derived and/or modified sequence opt2 from Purine_Nucleoside_Phosphorylase_deoD__Escherichia_coli__AIF62240

SEQ ID NO: 6389 - RNA, 720 nt, Artificial Sequence; identical to SEQ ID NO: 6205
  derived and/or modified sequence opt3 from Purine_Nucleoside_Phosphorylase_deoD__Escherichia_coli__AIF62240

SEQ ID NO: 6390 - RNA, 720 nt, Artificial Sequence; identical to SEQ ID NO: 6206
  derived and/or modified sequence opt4 from Purine_Nucleoside_Phosphorylase_deoD__Escherichia_coli__AIF62240

SEQ ID NO: 6391 - RNA, 720 nt, Artificial Sequence; identical to SEQ ID NO: 6207
  derived and/or modified sequence opt5 from Purine_Nucleoside_Phosphorylase_deoD__Escherichia_coli__AIF62240

SEQ ID NO: 6392 - RNA, 720 nt, Artificial Sequence
  derived and/or modified sequence opt6 from Purine_Nucleoside_Phosphorylase_deoD__Escherichia_coli__AIF62240
auggcaacaccacauauaaaugcagaaaugggagacuuugcagauguaguauuaaugccaggagacccacuaagagcaaaauacauagcagaaacauuucuagaagacgcaagagaaguaaauaauguaagaggaauguuaggauuuacaggaacauauaaagggagaaaaauaaguguaaugggccauggaaugggaauaccaucaugcucaauauauacaaaagaauuaauaacagacuucggaguaaaaaagauaauaagaguaggaucaugcggagcaguacuaccacacgugaaauuaagagauguaguaauaggaaugggugcauguacagacagcaaaguaaauagaauaagauuuaaagaucacgauuucgcagcaauagccgauuucgauaugguaagaaaugcaguagacgcagcaaaagcauuaggaguagacgcaagaguaggaaaucuauuuagcgcagacuuauucuauagcccagacggagaaauguuugauguaauggaaaaauacggaauauuaggaguagaaauggaagcagcaggaauauauggaguagcagcagaauuuggagcaaaagcacuaacaaucuguacaguaagcgaucacauaagaacacacgaacaaacaacagcagcagaaagacaaacaacauucaaugacaugauaaaaauagcauuagaaagcguauuauuaggagauaaagaauaa

SEQ ID NO: 6393 - protein, 239 aa, Artificial Sequence; identical to SEQ ID NO: 6193
  Purine_Nucleoside_Phosphorylase_deoD__Escherichia_coli__B5Z4R6

SEQ ID NO: 6394 - RNA, 720 nt, Artificial Sequence; identical to SEQ ID NO: 6258
  Purine_Nucleoside_Phosphorylase_deoD__Escherichia_coli__ACI39330

SEQ ID NO: 6395 - RNA, 720 nt, Artificial Sequence; identical to SEQ ID NO: 6195
  derived and/or modified sequence opt1 from Purine_Nucleoside_Phosphorylase_deoD__Escherichia_coli__ACI39330

SEQ ID NO: 6396 - RNA, 720 nt, Artificial Sequence; identical to SEQ ID NO: 6196
  derived and/or modified sequence opt2 from Purine_Nucleoside_Phosphorylase_deoD__Escherichia_coli__ACI39330

SEQ ID NO: 6397 - RNA, 720 nt, Artificial Sequence; identical to SEQ ID NO: 6197
  derived and/or modified sequence opt3 from Purine_Nucleoside_Phosphorylase_deoD__Escherichia_coli__ACI39330

SEQ ID NO: 6398 - RNA, 720 nt, Artificial Sequence; identical to SEQ ID NO: 6198
  derived and/or modified sequence opt4 from Purine_Nucleoside_Phosphorylase_deoD__Escherichia_coli__ACI39330

SEQ ID NO: 6399 - RNA, 720 nt, Artificial Sequence; identical to SEQ ID NO: 6199
  derived and/or modified sequence opt5 from Purine_Nucleoside_Phosphorylase_deoD__Escherichia_coli__ACI39330

SEQ ID NO: 6400 - RNA, 720 nt, Artificial Sequence
  derived and/or modified sequence opt6 from Purine_Nucleoside_Phosphorylase_deoD__Escherichia_coli__ACI39330
auggcaacaccacauauaaaugcugaaaugggagacuucgcagauguaguacuaaugccaggagacccacuaagagcaaaauauauagcagaaacauuucuagaagacgcaagagaaguaaauaacguaagagggauguuaggauuuacaggaacauauaaaggaagaaaaauaucaguaaugggacauggaaugggaauaccaagcugcucaaucuauacaaaggaacuaauaacagacuuuggagugaaaaaaauaauaagaguaggaaguugcggagcaguauuaccacacguaaaauuaagagauguaguaauaggaaugggagcauguacagauagcaaaguaaauagaauaagauuuaaagaucacgauuucgcagcaauagcagauuuugauaugguaagaaaugccguagacgcagcaaaagcauuggggauagacgcaagaguaggaaaucuauuuagcgcagacuuauucuauagcccagacggggaaauguucgauguaauggaaaaauacggaauauuaggaguagaaauggaagcagcaggaauauauggaguagcagcagaauuuggagcaaaagcauuaacaauauguacaguaagcgaucacauaagaacacaugaacaaacaacagcagcagaaagacaaacaacauucaaugacaugauaaaaauagcacuagaaagcguauuauuaggcgauaaagaauaa

SEQ ID NO: 6401 - protein, 239 aa, Artificial Sequence; identical to SEQ ID NO: 6193
  Purine_Nucleoside_Phosphorylase_deoD__Escherichia_coli__B6I6N1

SEQ ID NO: 6402 - RNA, 720 nt, Artificial Sequence; identical to SEQ ID NO: 6234
  Purine_Nucleoside_Phosphorylase_deoD__Escherichia_coli__BAG80183

SEQ ID NO: 6403 - RNA, 720 nt, Artificial Sequence; identical to SEQ ID NO: 6195
  derived and/or modified sequence opt1 from Purine_Nucleoside_Phosphorylase_deoD__Escherichia_coli__BAG80183

SEQ ID NO: 6404 - RNA, 720 nt, Artificial Sequence; identical to SEQ ID NO: 6196
  derived and/or modified sequence opt2 from Purine_Nucleoside_Phosphorylase_deoD__Escherichia_coli__BAG80183

SEQ ID NO: 6405 - RNA, 720 nt, Artificial Sequence; identical to SEQ ID NO: 6197
  derived and/or modified sequence opt3 from Purine_Nucleoside_Phosphorylase_deoD__Escherichia_coli__BAG80183

SEQ ID NO: 6406 - RNA, 720 nt, Artificial Sequence; identical to SEQ ID NO: 6198
  derived and/or modified sequence opt4 from Purine_Nucleoside_Phosphorylase_deoD__Escherichia_coli__BAG80183

SEQ ID NO: 6407 - RNA, 720 nt, Artificial Sequence; identical to SEQ ID NO: 6199
  derived and/or modified sequence opt5 from Purine_Nucleoside_Phosphorylase_deoD__Escherichia_coli__BAG80183

SEQ ID NO: 6408 - RNA, 720 nt, Artificial Sequence
  derived and/or modified sequence opt6 from Purine_Nucleoside_Phosphorylase_deoD__Escherichia_coli__BAG80183
auggcaacaccacauaucaaugcagaaaugggagacuuugcagauguaguauuaaugccaggagacccacuaagagcaaaauacauagcagaaacauuucuagaagacgcaagagaaguaaauaacguaagaggaauguuaggauuuacaggaacauauaaaggaagaaaaauaucaguuaugggacauggaaugggaauaccaucaugcagcauauauacaaaagaacugauaacagacuuuggaguaaaaaaaauaauaagaguaggaucaugcggagcaguacuaccacacguaaaauuaagagauguaguaauaggaaugggagcauguacagauagcaaaguaaauagaauaagauuuaaagaccacgauuucgcagcaauagcagauuuugauaugguaagaaaugcaguugacgcagcaaaagcauuaggaauagacgcaagaguuggaaaucuauuuagcgcagacuuauucuauagcccagacggggaaauguucgauguaauggaaaaauacggaauauuaggaguagaaauggaagcagcagggauauauggaguagcagcagaauuuggagcaaaagcauuaacaauauguacaguaagugaucacauaagaacgcacgaacaaacaacagcagcagaaagacaaacaacauucaaugacaugauaaaaauagcauuagaaagcguacuauuaggcgauaaagaauaa

SEQ ID NO: 6409 - protein, 239 aa, Artificial Sequence; identical to SEQ ID NO: 6193
  Purine_Nucleoside_Phosphorylase_deoD__Escherichia_coli__B7LEN0

SEQ ID NO: 6410 - RNA, 720 nt, Artificial Sequence; identical to SEQ ID NO: 6234
  Purine_Nucleoside_Phosphorylase_deoD__Escherichia_coli__CAV02186

SEQ ID NO: 6411 - RNA, 720 nt, Artificial Sequence; identical to SEQ ID NO: 6195
  derived and/or modified sequence opt1 from Purine_Nucleoside_Phosphorylase_deoD__Escherichia_coli__CAV02186

SEQ ID NO: 6412 - RNA, 720 nt, Artificial Sequence; identical to SEQ ID NO: 6196
  derived and/or modified sequence opt2 from Purine_Nucleoside_Phosphorylase_deoD__Escherichia_coli__CAV02186

SEQ ID NO: 6413 - RNA, 720 nt, Artificial Sequence; identical to SEQ ID NO: 6197
  derived and/or modified sequence opt3 from Purine_Nucleoside_Phosphorylase_deoD__Escherichia_coli__CAV02186

SEQ ID NO: 6414 - RNA, 720 nt, Artificial Sequence; identical to SEQ ID NO: 6198
  derived and/or modified sequence opt4 from Purine_Nucleoside_Phosphorylase_deoD__Escherichia_coli__CAV02186

SEQ ID NO: 6415 - RNA, 720 nt, Artificial Sequence; identical to SEQ ID NO: 6199
  derived and/or modified sequence opt5 from Purine_Nucleoside_Phosphorylase_deoD__Escherichia_coli__CAV02186

SEQ ID NO: 6416 - RNA, 720 nt, Artificial Sequence
  derived and/or modified sequence opt6 from Purine_Nucleoside_Phosphorylase_deoD__Escherichia_coli__CAV02186
auggcaacaccacauauaaaugcagaaaugggagacuuugcagauguaguacuaaugccaggagacccacuaagagcaaaauacauagcagaaacuuuuuuagaagacgcaagagaaguaaauaacguaagaggaaugcuaggauuuacaggaacauauaaaggacgaaaaauaagugucaugggacauggaaugggaauaccaucaugcucaauauauacaaaagaauuaauaacagacuuuggaguaaaaaaaauaauaagaguaggaucaugcggagcaguacuaccacacguaaaauuaagagaugucguaauaggaaugggagcauguacagauagcaaaguaaauagaauaagauuuaaagaucacgauuucgcagcaauagccgauuucgauaugguaagaaaugcaguagacgcagcaaaagcacuaggaauagacgcgagaguaggaaaucuauuuagcgcagacuuauuuuauagcccggacggagaaauguucgauguaauggaaaaauacggaauauuaggaguagaaauggaagcagcagggauauauggaguagcagcagaauuuggagcaaaagcauuaacaauauguacaguaucagaucacauaagaacacacgaacaaacaacagcagcagagagacaaacaacauucaaugacaugauaaaaauagcauuagaaagcguacuacuaggcgauaaagaauaa

SEQ ID NO: 6417 - protein, 239 aa, Artificial Sequence; identical to SEQ ID NO: 6193
  Purine_Nucleoside_Phosphorylase_deoD__Escherichia_coli__B7LXU6

SEQ ID NO: 6418 - RNA, 720 nt, Artificial Sequence; identical to SEQ ID NO: 6234
  Purine_Nucleoside_Phosphorylase_deoD__Escherichia_coli__CAR01347

SEQ ID NO: 6419 - RNA, 720 nt, Artificial Sequence; identical to SEQ ID NO: 6195
  derived and/or modified sequence opt1 from Purine_Nucleoside_Phosphorylase_deoD__Escherichia_coli__CAR01347

SEQ ID NO: 6420 - RNA, 720 nt, Artificial Sequence; identical to SEQ ID NO: 6196
  derived and/or modified sequence opt2 from Purine_Nucleoside_Phosphorylase_deoD__Escherichia_coli__CAR01347

SEQ ID NO: 6421 - RNA, 720 nt, Artificial Sequence; identical to SEQ ID NO: 6197
  derived and/or modified sequence opt3 from Purine_Nucleoside_Phosphorylase_deoD__Escherichia_coli__CAR01347

SEQ ID NO: 6422 - RNA, 720 nt, Artificial Sequence; identical to SEQ ID NO: 6198
  derived and/or modified sequence opt4 from Purine_Nucleoside_Phosphorylase_deoD__Escherichia_coli__CAR01347

SEQ ID NO: 6423 - RNA, 720 nt, Artificial Sequence; identical to SEQ ID NO: 6199
  derived and/or modified sequence opt5 from Purine_Nucleoside_Phosphorylase_deoD__Escherichia_coli__CAR01347

SEQ ID NO: 6424 - RNA, 720 nt, Artificial Sequence
  derived and/or modified sequence opt6 from Purine_Nucleoside_Phosphorylase_deoD__Escherichia_coli__CAR01347
auggcaacaccacauauaaaugcagaaaugggagauuuugcagauguaguauuaaugccaggagacccauuaagagcaaaauacauagcagaaacauuucuagaagacgcaagagaaguaaauaacguaagaggaaugcuaggauuuaccggaacauauaaagggagaaaaauaucaguaaugggacauggaaugggaauaccaagcugcaguauauauacaaaagaauuaauaacagauuuuggaguaaaaaaaauaauaagaguaggaaguuguggagcaguauuaccacauguaaaauuaagagauguaguaauaggaaugggagcauguacagauagcaaaguaaauagaauaagauuuaaagaucacgauuucgcugcaauagcagauuucgauaugguacggaaugcaguggacgcagcaaaagcauuaggaauagacgcgagaguaggaaaucuauuuagugcagaccuauucuauagcccagacggagaaauguucgacguaauggaaaaauauggaauauuaggaguagaaauggaagcagcaggaauauauggaguagcagcggaauuuggagcaaaagcauuaacgauauguacaguaagugaucacauaagaacacacgaacaaacaacagcagcagaaagacaaacaacauucaaugacaugauaaaaauagcauuagaaagcguacuauuaggagauaaagaauaa

SEQ ID NO: 6425 - protein, 239 aa, Artificial Sequence; identical to SEQ ID NO: 6193
  Purine_Nucleoside_Phosphorylase_deoD__Escherichia_coli__B7MNJ1

SEQ ID NO: 6426 - RNA, 720 nt, Artificial Sequence; identical to SEQ ID NO: 6338
  Purine_Nucleoside_Phosphorylase_deoD__Escherichia_coli__CAR06204

SEQ ID NO: 6427 - RNA, 720 nt, Artificial Sequence; identical to SEQ ID NO: 6195
  derived and/or modified sequence opt1 from Purine_Nucleoside_Phosphorylase_deoD__Escherichia_coli__CAR06204

SEQ ID NO: 6428 - RNA, 720 nt, Artificial Sequence; identical to SEQ ID NO: 6196
  derived and/or modified sequence opt2 from Purine_Nucleoside_Phosphorylase_deoD__Escherichia_coli__CAR06204

SEQ ID NO: 6429 - RNA, 720 nt, Artificial Sequence; identical to SEQ ID NO: 6197
  derived and/or modified sequence opt3 from Purine_Nucleoside_Phosphorylase_deoD__Escherichia_coli__CAR06204

SEQ ID NO: 6430 - RNA, 720 nt, Artificial Sequence; identical to SEQ ID NO: 6198
  derived and/or modified sequence opt4 from Purine_Nucleoside_Phosphorylase_deoD__Escherichia_coli__CAR06204

SEQ ID NO: 6431 - RNA, 720 nt, Artificial Sequence; identical to SEQ ID NO: 6199
  derived and/or modified sequence opt5 from Purine_Nucleoside_Phosphorylase_deoD__Escherichia_coli__CAR06204

SEQ ID NO: 6432 - RNA, 720 nt, Artificial Sequence
  derived and/or modified sequence opt6 from Purine_Nucleoside_Phosphorylase_deoD__Escherichia_coli__CAR06204
auggcaacaccacauauaaaugcagaaaugggagacuuugcagauguagugcuaaugcccggagacccacuaagggcaaaauacauagcagaaacauuuuuagaagacgcaagagaaguaaauaacguaagaggaauguuaggauuuacaggaacauauaaaggaagaaaaauaaguguaaugggacauggaaugggaauaccaaguugcucaauauauaccaaagaauuaauaacagauuuuggaguuaaaaaaauaauaagaguaggaaguugcggagcaguacuaccacacguaaaauuaagagauguaguaauaggaaugggagcauguacagauagcaaaguaaauagaauaagauuuaaagaucacgauuucgcggcaauagcagauuuugauaugguacgaaaugccguagacgcagccaaagcacuaggaauugacgcaagaguuggaaauuuauuuagugcagacuuauuuuauaguccagacggagaaauguucgaugugauggaaaaauacggaauauuaggaguggaaauggaagcagcaggaauauauggaguagcagcagaauuuggagcaaaagcauuaacaauauguacaguaagcgaucacauaagaacacacgaacaaacuacagcagcagaaagacaaacaacauucaaugacaugauaaaaauagcacuagaaagcgugcuauuaggagacaaagaauaa

SEQ ID NO: 6433 - protein, 239 aa, Artificial Sequence; identical to SEQ ID NO: 6201
  Purine_Nucleoside_Phosphorylase_deoD__Escherichia_coli__B7N2V8

SEQ ID NO: 6434 - RNA, 720 nt, Artificial Sequence; identical to SEQ ID NO: 6282
  Purine_Nucleoside_Phosphorylase_deoD__Escherichia_coli__CAV18213

SEQ ID NO: 6435 - RNA, 720 nt, Artificial Sequence; identical to SEQ ID NO: 6203
  derived and/or modified sequence opt1 from Purine_Nucleoside_Phosphorylase_deoD__Escherichia_coli__CAV18213

SEQ ID NO: 6436 - RNA, 720 nt, Artificial Sequence; identical to SEQ ID NO: 6204
  derived and/or modified sequence opt2 from Purine_Nucleoside_Phosphorylase_deoD__Escherichia_coli__CAV18213

SEQ ID NO: 6437 - RNA, 720 nt, Artificial Sequence; identical to SEQ ID NO: 6205
  derived and/or modified sequence opt3 from Purine_Nucleoside_Phosphorylase_deoD__Escherichia_coli__CAV18213

SEQ ID NO: 6438 - RNA, 720 nt, Artificial Sequence; identical to SEQ ID NO: 6206
  derived and/or modified sequence opt4 from Purine_Nucleoside_Phosphorylase_deoD__Escherichia_coli__CAV18213

SEQ ID NO: 6439 - RNA, 720 nt, Artificial Sequence; identical to SEQ ID NO: 6207
  derived and/or modified sequence opt5 from Purine_Nucleoside_Phosphorylase_deoD__Escherichia_coli__CAV18213

SEQ ID NO: 6440 - RNA, 720 nt, Artificial Sequence
  derived and/or modified sequence opt6 from Purine_Nucleoside_Phosphorylase_deoD__Escherichia_coli__CAV18213
auggccacaccacauaucaaugcagaaaugggagacuucgcagauguaguguuaaugccaggagauccacuacgagcaaaauacauagcagaaacauuucuagaagaugcaagagaaguaaauaacguaagaggaauguuaggcuuuacaggaacauauaaaggaagaaaaauaucaguaaugggacauggaaugggaauaccaucaugcaguauauauacaaaagaauuaauaacagacuuuggaguaaaaaaaauaauaagaguaggaucaugcggagcaguauuaccacacguaaaauuaagagauguaguaauaggaaugggagcauguacagauagcaaaguaaauagaauaagauuuaaagaucacgauuucgcagcaauagcagauuucgauaugguaagaaaugcaguagacgcagcaaaagcauuaggaguagacgcaagaguaggaaaucuauuuucagcagacuuauuuuauagcccagacggagaaauguucgauguaauggaaaaauacgggauccuaggaguagaaauggaagcagcaggaauauauggaguagcagcagaauuuggagcaaaagcacuaacaauauguacaguaagcgaucacauaagaacacaugagcaaacaacagcagcagaaagacaaacaacauuuaaugacaugauaaaaauagcccuagaaaguguacuauuaggagauaaagaauaa

SEQ ID NO: 6441 - protein, 239 aa, Artificial Sequence; identical to SEQ ID NO: 6193
  Purine_Nucleoside_Phosphorylase_deoD__Escherichia_coli__B7NH52

SEQ ID NO: 6442 - RNA, 720 nt, Artificial Sequence
  Purine_Nucleoside_Phosphorylase_deoD__Escherichia_coli__CAR16117
auggcuaccccacacauuaaugcagaaaugggcgauuucgcugacguaguuuugaugccaggcgacccgcugcgugcgaaguauauugcugaaacuuuccuugaagaugcccgugaagugaacaacguucgcgguaugcugggcuucaccgguacuuacaaaggccgcaaaauuuccguaaugggucacgguauggguaucccguccugcuccaucuacaccaaagaacugaucaccgauuucggcgugaagaaaauuauccgcguaggcuccuguggcgcuguucugccacacguaaaacugcgcgacgucguuaucgguaugggugccugcaccgauuccaaaguuaaccgcauccguuuuaaagaccaugacuuugccgcuaucgcugacuuugacauggugcguaacgcaguagaugcagcuaaagcacugggcauugaugcucgcguugguaaccuguucuccgcugaccuguucuacucuccggacggcgaaauguucgacgugauggaaaaauacggcauccucggcguggaaauggaagcggcugguaucuacggcgucgcugcagaauuuggcgcgaaagcccugaccaucugcaccgugucugaccacauccguacucacgagcagaccacugccgcugagcgucagaccaccuucaacgacaugaucaaaaucgcacuggaauccguucugcugggcgauaaagaguaa

SEQ ID NO: 6443 - RNA, 720 nt, Artificial Sequence; identical to SEQ ID NO: 6195
  derived and/or modified sequence opt1 from Purine_Nucleoside_Phosphorylase_deoD__Escherichia_coli__CAR16117

SEQ ID NO: 6444 - RNA, 720 nt, Artificial Sequence; identical to SEQ ID NO: 6196
  derived and/or modified sequence opt2 from Purine_Nucleoside_Phosphorylase_deoD__Escherichia_coli__CAR16117

SEQ ID NO: 6445 - RNA, 720 nt, Artificial Sequence; identical to SEQ ID NO: 6197
  derived and/or modified sequence opt3 from Purine_Nucleoside_Phosphorylase_deoD__Escherichia_coli__CAR16117

SEQ ID NO: 6446 - RNA, 720 nt, Artificial Sequence; identical to SEQ ID NO: 6198
  derived and/or modified sequence opt4 from Purine_Nucleoside_Phosphorylase_deoD__Escherichia_coli__CAR16117

SEQ ID NO: 6447 - RNA, 720 nt, Artificial Sequence; identical to SEQ ID NO: 6199
  derived and/or modified sequence opt5 from Purine_Nucleoside_Phosphorylase_deoD__Escherichia_coli__CAR16117

SEQ ID NO: 6448 - RNA, 720 nt, Artificial Sequence
  derived and/or modified sequence opt6 from Purine_Nucleoside_Phosphorylase_deoD__Escherichia_coli__CAR16117
auggcaacaccacauauaaaugcagaaaugggagacuuugcagauguaguacuaaugccaggagacccauuaagagcaaaauacauagcagaaacauuccuagaagacgcaagagaaguaaauaacguaagaggaauguuaggguuuacaggaacauauaaaggaagaaaaauaucaguaaugggacauggaaugggaauaccaaguuguucaauauauacaaaagaauuaauaacagacuuuggaguaaaaaaaauaauaagagugggaaguugcggagcaguacuaccgcacguaaaauuaagagauguaguaauaggaaugggagcauguacagauucaaaaguaaauagaauaagauuuaaagaucacgauuucgcagcaauagcagauuucgauaugguaagaaaugcaguggacgcagcaaaagcauuaggaauagacgcaagaguaggaaaucuauuuagugcagacuuauucuauucaccagacggagaaauguucgauguaauggaaaaauauggaauauuaggaguagaaauggaagcagcaggaauauacggaguagcagcagaauuuggagcaaaagcacuaacuauauguacuguaagugaucacauaagaacacacgaacaaacaacagcagcagaaagacaaacaacauucaacgacaugauaaaaauagcacuagaaaguguacuauuaggagauaaagaauaa

SEQ ID NO: 6449 - protein, 239 aa, Artificial Sequence; identical to SEQ ID NO: 6201
  Purine_Nucleoside_Phosphorylase_deoD__Escherichia_coli__B7NW64

SEQ ID NO: 6450 - RNA, 720 nt, Artificial Sequence; identical to SEQ ID NO: 6226
  Purine_Nucleoside_Phosphorylase_deoD__Escherichia_coli__CAR21012

SEQ ID NO: 6451 - RNA, 720 nt, Artificial Sequence; identical to SEQ ID NO: 6203
  derived and/or modified sequence opt1 from Purine_Nucleoside_Phosphorylase_deoD__Escherichia_coli__CAR21012

SEQ ID NO: 6452 - RNA, 720 nt, Artificial Sequence; identical to SEQ ID NO: 6204
  derived and/or modified sequence opt2 from Purine_Nucleoside_Phosphorylase_deoD__Escherichia_coli__CAR21012

SEQ ID NO: 6453 - RNA, 720 nt, Artificial Sequence; identical to SEQ ID NO: 6205
  derived and/or modified sequence opt3 from Purine_Nucleoside_Phosphorylase_deoD__Escherichia_coli__CAR21012

SEQ ID NO: 6454 - RNA, 720 nt, Artificial Sequence; identical to SEQ ID NO: 6206
  derived and/or modified sequence opt4 from Purine_Nucleoside_Phosphorylase_deoD__Escherichia_coli__CAR21012

SEQ ID NO: 6455 - RNA, 720 nt, Artificial Sequence; identical to SEQ ID NO: 6207
  derived and/or modified sequence opt5 from Purine_Nucleoside_Phosphorylase_deoD__Escherichia_coli__CAR21012

SEQ ID NO: 6456 - RNA, 720 nt, Artificial Sequence
  derived and/or modified sequence opt6 from Purine_Nucleoside_Phosphorylase_deoD__Escherichia_coli__CAR21012
auggcaacaccacauauaaaugcagaaaugggugacuuugcagaugucguacuaaugccaggagacccauuaagagccaaauacauugcagaaacauucuuagaagacgcaagagaaguaaauaacguaagaggaauguugggauuuacaggaacauauaaaggaagaaaaauaucaguaaugggacauggaaugggcauaccaucaugcucaauauauacaaaagaauuaauaacagacuuuggaguaaaaaaaauaauaagaguaggaucaugcggagcaguauuaccacacguaaaauuaagagauguaguaaucggaaugggagccuguacagauagcaaaguaaauagaauaagauuuaaagaucaugauuucgcggcaauagcagauuucgauaugguacgaaaugcaguagacgcagcaaaagcauugggaguagacgcaagaguaggaaaccuauuuucagcagauuuauuuuauagcccagauggagaaauguucgauguaauggaaaaauacggaauauuaggaguagaaauggaagcagcagguauauauggaguagcagcagaauuuggagcaaaagcacuaacaauauguacaguaagcgaucacauaaggacacacgaacaaacaacagcagcagaaaggcaaacuacauuuaaugacaugauaaaaauagcacuagaaagcguauuauugggcgauaaagaauaa

SEQ ID NO: 6457 - protein, 239 aa, Artificial Sequence; identical to SEQ ID NO: 6201
  Purine_Nucleoside_Phosphorylase_deoD__Escherichia_coli__B7UR12

SEQ ID NO: 6458 - RNA, 720 nt, Artificial Sequence
  Purine_Nucleoside_Phosphorylase_deoD__Escherichia_coli__CAS12230
auggcuacuccacacauuaaugcagaaaugggcgauuuugcugacguaguuuugaugccaggcgacccgcugcgugcgaaguauauugcugaaacuuuccuugaagaugcccgugaagugaacaacguucgcgguaugcugggcuucacugguacuuacaaaggccgcaaaauuuccguaaugggccacgguauggguaucccguccugcuccaucuacaccaaagaacugaucacugauuucggcgugaagaaaauuauccgcguggguuccuguggcgcuguucugccgcacguaaaacugcgcgacgucguuaucgguaugggggccugcaccgauuccaaaguuaaccgcauccguuuuaaagaccaugacuuugccgcuaucgcugacuucgacauggugcguaacgcgguagacgcggcaaaagcacugggcguugaugcucgcguugguaaccuguucuccgcugaccuguucuacucuccggacggcgaaauguucgacgugauggaaaaauacggcauccucggcguggaaauggaagcggcugguaucuacggcgucgcugcagaauuuggcgcgaaagcccugaccaucugcaccgugucugaccacauccgcacucacgagcagaccacugccgcugagcgucagaccaccuucaacgacaugaucaaaaucgcgcuggaauccguucuacugggcgauaaagaguaa

SEQ ID NO: 6459 - RNA, 720 nt, Artificial Sequence; identical to SEQ ID NO: 6203
  derived and/or modified sequence opt1 from Purine_Nucleoside_Phosphorylase_deoD__Escherichia_coli__CAS12230

SEQ ID NO: 6460 - RNA, 720 nt, Artificial Sequence; identical to SEQ ID NO: 6204
  derived and/or modified sequence opt2 from Purine_Nucleoside_Phosphorylase_deoD__Escherichia_coli__CAS12230

SEQ ID NO: 6461 - RNA, 720 nt, Artificial Sequence; identical to SEQ ID NO: 6205
  derived and/or modified sequence opt3 from Purine_Nucleoside_Phosphorylase_deoD__Escherichia_coli__CAS12230

SEQ ID NO: 6462 - RNA, 720 nt, Artificial Sequence; identical to SEQ ID NO: 6206
  derived and/or modified sequence opt4 from Purine_Nucleoside_Phosphorylase_deoD__Escherichia_coli__CAS12230

SEQ ID NO: 6463 - RNA, 720 nt, Artificial Sequence; identical to SEQ ID NO: 6207
  derived and/or modified sequence opt5 from Purine_Nucleoside_Phosphorylase_deoD__Escherichia_coli__CAS12230

SEQ ID NO: 6464 - RNA, 720 nt, Artificial Sequence
  derived and/or modified sequence opt6 from Purine_Nucleoside_Phosphorylase_deoD__Escherichia_coli__CAS12230
auggcaacaccacauauaaacgcagaaaugggagacuuugcagauguaguacuaaugccaggagacccacucagagcaaaauacauagcagagaccuuucuggaagacgcaagagaaguaaauaauguaagaggaauguuaggauuuacaggaacauauaaaggaagaaaaauaucagucaugggacauggaaugggaauaccaucaugcucaauauauaccaaagaauuaauaacagacuuuggaguaaaaaaaauaauaagaguaggaucgugcggagcaguauuaccacacguaaaauuaagagauguaguaauaggaaugggagcauguacagauagcaaaguaaaucgaauaagauuuaaagaucacgauuuugcagcaauagcagauuucgauaugguaagaaaugcaguagacgcagcaaaagcauuaggaguagacgcaagaguaggaaaucuauucagcgcugacuuauucuauagcccagacggagaaauguucgauguaauggaaaaauacggaauauuaggaguggaaauggaagcugcaggaauauauggaguagcagcagaauuuggcgcaaaagcacuaacaauauguacaguaagcgaucacauacgaacacacgaacaaacaacagcagcagaaagacaaacaacauucaaugacaugauaaaaauagcauuagaaaguguacuauuaggagauaaagaauaa

SEQ ID NO: 6465 - protein, 239 aa, Artificial Sequence; identical to SEQ ID NO: 6193
  Purine_Nucleoside_Phosphorylase_deoD__Escherichia_coli__C3SE47

SEQ ID NO: 6466 - RNA, 720 nt, Artificial Sequence; identical to SEQ ID NO: 6258
  Purine_Nucleoside_Phosphorylase_deoD__Escherichia_coli__ACI72751

SEQ ID NO: 6467 - RNA, 720 nt, Artificial Sequence; identical to SEQ ID NO: 6195
  derived and/or modified sequence opt1 from Purine_Nucleoside_Phosphorylase_deoD__Escherichia_coli__ACI72751

SEQ ID NO: 6468 - RNA, 720 nt, Artificial Sequence; identical to SEQ ID NO: 6196
  derived and/or modified sequence opt2 from Purine_Nucleoside_Phosphorylase_deoD__Escherichia_coli__ACI72751

SEQ ID NO: 6469 - RNA, 720 nt, Artificial Sequence; identical to SEQ ID NO: 6197
  derived and/or modified sequence opt3 from Purine_Nucleoside_Phosphorylase_deoD__Escherichia_coli__ACI72751

SEQ ID NO: 6470 - RNA, 720 nt, Artificial Sequence; identical to SEQ ID NO: 6198
  derived and/or modified sequence opt4 from Purine_Nucleoside_Phosphorylase_deoD__Escherichia_coli__ACI72751

SEQ ID NO: 6471 - RNA, 720 nt, Artificial Sequence; identical to SEQ ID NO: 6199
  derived and/or modified sequence opt5 from Purine_Nucleoside_Phosphorylase_deoD__Escherichia_coli__ACI72751

SEQ ID NO: 6472 - RNA, 720 nt, Artificial Sequence
  derived and/or modified sequence opt6 from Purine_Nucleoside_Phosphorylase_deoD__Escherichia_coli__ACI72751
auggcaacaccacauauaaaugcagaaaugggagacuucgcggacguaguacuaaugccaggagacccacuaagagcaaaauacauagcagaaacauuuuuagaagacgcaagagaaguaaauaacgugagaggaauguuaggauuuacaggaacauauaaaggaagaaaaauaaguguaaugggacauggaauggguauaccaucaugcaguauauauacaaaagaauuaauaacagacuuuggaguaaaaaaaauaauaagaguaggaaguugcggagcaguacuaccacacguaaaauuaagagauguaguaauaggaaugggggcauguacagauagcaaaguaaauagaauaagauuuaaagaucacgauuucgcagcaauagcagauuucgauaugguacgaaaugcaguagacgcagcaaaggcauuaggaauagacgcaagaguaggaaaccuauuuagcgcagacuuauucuacaguccagacggagaaauguucgauguaauggaaaaauacggaauauuaggaguagaaauggaagcagcaggaauauauggaguagcagcagaauuuggagcuaaagcacuaacaauaugcacagugagugaucacauaagaacacacgaacaaacaacagcagcagaaagacaaacaacauucaaugacaugauaaaaauagcacuagaaaguguacuauuaggagauaaagaauaa

SEQ ID NO: 6473 - protein, 239 aa, Artificial Sequence; identical to SEQ ID NO: 6193
  Purine_Nucleoside_Phosphorylase_deoD__Escherichia_coli__C4ZT66

SEQ ID NO: 6474 - RNA, 720 nt, Artificial Sequence; identical to SEQ ID NO: 6338
  Purine_Nucleoside_Phosphorylase_deoD__Escherichia_coli__ACR65334

SEQ ID NO: 6475 - RNA, 720 nt, Artificial Sequence; identical to SEQ ID NO: 6195
  derived and/or modified sequence opt1 from Purine_Nucleoside_Phosphorylase_deoD__Escherichia_coli__ACR65334

SEQ ID NO: 6476 - RNA, 720 nt, Artificial Sequence; identical to SEQ ID NO: 6196
  derived and/or modified sequence opt2 from Purine_Nucleoside_Phosphorylase_deoD__Escherichia_coli__ACR65334

SEQ ID NO: 6477 - RNA, 720 nt, Artificial Sequence; identical to SEQ ID NO: 6197
  derived and/or modified sequence opt3 from Purine_Nucleoside_Phosphorylase_deoD__Escherichia_coli__ACR65334

SEQ ID NO: 6478 - RNA, 720 nt, Artificial Sequence; identical to SEQ ID NO: 6198
  derived and/or modified sequence opt4 from Purine_Nucleoside_Phosphorylase_deoD__Escherichia_coli__ACR65334

SEQ ID NO: 6479 - RNA, 720 nt, Artificial Sequence; identical to SEQ ID NO: 6199
  derived and/or modified sequence opt5 from Purine_Nucleoside_Phosphorylase_deoD__Escherichia_coli__ACR65334

SEQ ID NO: 6480 - RNA, 720 nt, Artificial Sequence
  derived and/or modified sequence opt6 from Purine_Nucleoside_Phosphorylase_deoD__Escherichia_coli__ACR65334
auggcaacaccacauauaaaugcggaaaugggagauuuugcagacguaguauuaaugccaggugacccacuaagagcaaaauacauagcagaaacauuuuuagaagaugcaagagaaguaaauaacguaaggggaauguuaggauuuacaggaacauauaaaggaagaaaaauaucaguaaugggacauggaaugggaauaccauccugcucaauauauacaaaagaauuaauaacagacuucggaguaaaaaaaauaauaagaguaggcaguuguggagcuguauuaccacacguaaaacuaagagauguaguaauaggaaugggagcauguacagauagcaaaguaaauagaauaagauuuaaagaucacgauuucgcagcaauagcagauuucgauaugguaagaaaugcaguugacgcagccaaagccuuaggaauagaugcaagaguaggaaacuuauucagcgcagaucuauucuauagcccagacggagaaauguucgauguaauggaaaaauacggaauauuaggaguagaaauggaagcagccggaauauauggaguagcagcagaauuuggagcaaaagcacugacaauauguacaguaucagaucacauacgaacacaugaacaaacaacagcagcagaaagacaaacaacauucaaugacaugauaaaaauagcacuagaaagcguacuauuaggagauaaagaauaa

SEQ ID NO: 6481 - protein, 239 aa, Artificial Sequence; identical to SEQ ID NO: 6201
  Purine_Nucleoside_Phosphorylase_deoD__Escherichia_coli__C8TQD7

SEQ ID NO: 6482 - RNA, 720 nt, Artificial Sequence
  Purine_Nucleoside_Phosphorylase_deoD__Escherichia_coli__BAI28709
auggcuaccccacacauuaaugcagaaaugggcgauuucgcugacguaguuuugaugccaggcgacccgcugcgugcaaaguauauugcugaaacuuuccuugaagaugcccgugaagugaacaacguucgcgguaugcugggcuucaccgguacuuacaaaggccgcaaaauuuccguaaugggucacgguauggguaucccguccugcuccaucuacaccaaagaacugaucaccgauuucggcgugaagaaaauuauccgcguggguuccuguggcgcaguucugccgcacguaaaacugcgcgacgucguuaucgguaugggugccugcaccgauuccaaaguuaaccgcauccguuuuaaagaucaugacuuugccgcuaucgcugacuuugacauggugcguaacgcgguagacgcggcuaaagcacugggcguugaugcucgcguggguaaccuguucuccgcugaccuguucuacucuccggacggcgaaauguucgacgugauggaaaaauacggcauccucggcguggaaauggaagcggcugguaucuacggcguggcugcagaguuuggcgcgaaagcccugaccaucugcaccgugucugaccacauccgcacucacgagcagaccacugccgcugagcgucagaccaccuucaacgacaugaucaaaaucgcacuggaauccguucugcugggcgauaaagaguaa

SEQ ID NO: 6483 - RNA, 720 nt, Artificial Sequence; identical to SEQ ID NO: 6203
  derived and/or modified sequence opt1 from Purine_Nucleoside_Phosphorylase_deoD__Escherichia_coli__BAI28709

SEQ ID NO: 6484 - RNA, 720 nt, Artificial Sequence; identical to SEQ ID NO: 6204
  derived and/or modified sequence opt2 from Purine_Nucleoside_Phosphorylase_deoD__Escherichia_coli__BAI28709

SEQ ID NO: 6485 - RNA, 720 nt, Artificial Sequence; identical to SEQ ID NO: 6205
  derived and/or modified sequence opt3 from Purine_Nucleoside_Phosphorylase_deoD__Escherichia_coli__BAI28709

SEQ ID NO: 6486 - RNA, 720 nt, Artificial Sequence; identical to SEQ ID NO: 6206
  derived and/or modified sequence opt4 from Purine_Nucleoside_Phosphorylase_deoD__Escherichia_coli__BAI28709

SEQ ID NO: 6487 - RNA, 720 nt, Artificial Sequence; identical to SEQ ID NO: 6207
  derived and/or modified sequence opt5 from Purine_Nucleoside_Phosphorylase_deoD__Escherichia_coli__BAI28709

SEQ ID NO: 6488 - RNA, 720 nt, Artificial Sequence
  derived and/or modified sequence opt6 from Purine_Nucleoside_Phosphorylase_deoD__Escherichia_coli__BAI28709
auggcaacgccacauauaaaugcagaaaugggagacuuugcagauguaguuuuaaugccaggagacccacuaagagcaaaauacauagcagaaacauuuuuagaagacgcaagagaaguaaauaacguaagaggaauguuaggauuuacagggacauauaaagguagaaaaauaucaguaaugggacauggaaugggaauaccaucaugcucaauauauacaaaagaauuaauaacugacuuuggaguaaaaaaaauaauaagaguaggaucaugcggagcaguacuaccacacguaaaauuaagagauguaguaauaggaaugggagcauguacagauagcaaaguaaauagaauaagauuuaaagaucacgauuuugcagcaauagcagauuucgauaugguaagaaaugcaguagacgcagcaaaagcauugggaguagacgcaagaguaggaaaucuauuuagugcagacuuauucuauagcccggacggagaaauguucgauguaauggaaaaauacggaauauuaggcguagaaauggaagcagcaggaauauauggaguagccgcagaauuuggagcaaaagcauuaacaauauguacaguaagcgaucacauaagaacacacgagcaaacaacagcggcagaaagacaaacaacauucaaugacaugauaaaaauagcacuagaaagcguacuauuaggagauaaagaauaa

SEQ ID NO: 6489 - protein, 239 aa, Artificial Sequence; identical to SEQ ID NO: 6193
  Purine_Nucleoside_Phosphorylase_deoD__Escherichia_coli__C8U157

SEQ ID NO: 6490 - RNA, 720 nt, Artificial Sequence; identical to SEQ ID NO: 6234
  Purine_Nucleoside_Phosphorylase_deoD__Escherichia_coli__BAI33919

SEQ ID NO: 6491 - RNA, 720 nt, Artificial Sequence; identical to SEQ ID NO: 6195
  derived and/or modified sequence opt1 from Purine_Nucleoside_Phosphorylase_deoD__Escherichia_coli__BAI33919

SEQ ID NO: 6492 - RNA, 720 nt, Artificial Sequence; identical to SEQ ID NO: 6196
  derived and/or modified sequence opt2 from Purine_Nucleoside_Phosphorylase_deoD__Escherichia_coli__BAI33919

SEQ ID NO: 6493 - RNA, 720 nt, Artificial Sequence; identical to SEQ ID NO: 6197
  derived and/or modified sequence opt3 from Purine_Nucleoside_Phosphorylase_deoD__Escherichia_coli__BAI33919

SEQ ID NO: 6494 - RNA, 720 nt, Artificial Sequence; identical to SEQ ID NO: 6198
  derived and/or modified sequence opt4 from Purine_Nucleoside_Phosphorylase_deoD__Escherichia_coli__BAI33919

SEQ ID NO: 6495 - RNA, 720 nt, Artificial Sequence; identical to SEQ ID NO: 6199
  derived and/or modified sequence opt5 from Purine_Nucleoside_Phosphorylase_deoD__Escherichia_coli__BAI33919

SEQ ID NO: 6496 - RNA, 720 nt, Artificial Sequence
  derived and/or modified sequence opt6 from Purine_Nucleoside_Phosphorylase_deoD__Escherichia_coli__BAI33919
auggcaacaccacauauaaaugccgaaaugggagacuuugcagauguaguauuaaugccaggggacccauuaagagcaaaauacauagcagaaacauuucuagaagacgcaagagaaguaaauaacguaagaggaauguuaggauuuacaggaacauacaaaggaagaaaaauaucaguaaugggacauggaaugggaauacccucaugcaguauauauacaaaagaauuaaucacagacuuuggaguaaaaaaaauaauaagaguaggaucaugcggagcaguacuaccacacguaaaauuaagagauguaguaauaggaaugggagcauguacagauaguaaaguaaacagaauacgauuuaaagaucaugauuucgcagcaauagcagauuucgauaugguaagaaaugcaguagacgcagcaaaagcauuaggcauagacgcaagaguaggaaaucuuuuuagcgcagacuuauucuauaguccagacggagaaauguucgauguaauggaaaaauacggaauauuaggaguagaaauggaagcagcaggaauauauggaguagcagcagaauuuggagcaaaagcauuaacaauauguacaguaagcgaucauauaagaacacacgaacaaacaacagcagcagaaagacaaacaacauucaaugacaugauaaaaaucgcacuagaaagcguauuauuaggagauaaagaauaa

SEQ ID NO: 6497 - protein, 239 aa, Artificial Sequence; identical to SEQ ID NO: 6193
  Purine_Nucleoside_Phosphorylase_deoD__Escherichia_coli__C8UN92

SEQ ID NO: 6498 - RNA, 720 nt, Artificial Sequence
  Purine_Nucleoside_Phosphorylase_deoD__Escherichia_coli__BAI38958
auggcuaccccacacauuaaugcagaaaugggcgauuucgcugacguaguuuugaugccaggcgacccgcugcgugcgaaguauauugcugaaacuuuccuugaagaugcccgugaagugaacaacguucgcgguaugcugggcuucaccgguacuuacaaaggccgcaaaauuuccguaaugggucacgguauggguaucccguccugcuccaucuacaccaaagaacugaucaccgauuucggcgugaagaaaauuauccgcguggguuccuguggcgcaguucugccgcacguaaaacugcgcgacgucguuaucgguaugggugccugcaccgauuccaaaguuaaccgcauccguuuuaaagaucaugacuuugccgcuaucgcugacuuugacaugguacguaacgcgguagacgcggcuaaagcacugggcauugaugcucgcguugguaaccuguucuccgcugaccuguucuacucuccggacggcgaaauguucgacgugauggaaaaauacggcauccucggcguggaaauggaagcagcugguaucuacggcgucgcugcagaauuuggcgcgaaagcccugaccaucugcaccgugucugaccacauccgcacucacgagcagaccacugccgcugagcgucagaccaccuucaacgacaugaucaaaaucgcacuggaauccguucugcugggcgauaaagaguaa

SEQ ID NO: 6499 - RNA, 720 nt, Artificial Sequence; identical to SEQ ID NO: 6195
  derived and/or modified sequence opt1 from Purine_Nucleoside_Phosphorylase_deoD__Escherichia_coli__BAI38958

SEQ ID NO: 6500 - RNA, 720 nt, Artificial Sequence; identical to SEQ ID NO: 6196
  derived and/or modified sequence opt2 from Purine_Nucleoside_Phosphorylase_deoD__Escherichia_coli__BAI38958

SEQ ID NO: 6501 - RNA, 720 nt, Artificial Sequence; identical to SEQ ID NO: 6197
  derived and/or modified sequence opt3 from Purine_Nucleoside_Phosphorylase_deoD__Escherichia_coli__BAI38958

SEQ ID NO: 6502 - RNA, 720 nt, Artificial Sequence; identical to SEQ ID NO: 6198
  derived and/or modified sequence opt4 from Purine_Nucleoside_Phosphorylase_deoD__Escherichia_coli__BAI38958

SEQ ID NO: 6503 - RNA, 720 nt, Artificial Sequence; identical to SEQ ID NO: 6199
  derived and/or modified sequence opt5 from Purine_Nucleoside_Phosphorylase_deoD__Escherichia_coli__BAI38958

SEQ ID NO: 6504 - RNA, 720 nt, Artificial Sequence
  derived and/or modified sequence opt6 from Purine_Nucleoside_Phosphorylase_deoD__Escherichia_coli__BAI38958
auggcaacaccacauauaaaugcagaaaugggugacuuugcagauguaguauuaaugccaggagauccgcuaagagcaaaauacauagcagaaacauuuuuagaagacgcaagagaaguaaauaacguaagaggaaugcuaggauuuacaggaaccuauaaaggaagaaaaaucucaguaaugggacauggaaugggaauaccaucaugcucaauauauacaaaagaauuaauaacagacuuuggaguaaaaaaaauaauaagaguaggaucauguggagcaguauuaccacauguaaaauuaagagauguagugauaggaaugggagcauguacagauucaaaagucaauagaauaagauuuaaagaucacgauuucgcagcaauagccgauuucgauauggugcgaaaugcaguagacgcagcaaaagcauuaggaauagacgcaagaguaggaaaucuauuuagugcagacuuauucuauagcccagacggagaaauguucgauguaauggaaaaauacggaauacuaggaguagaaauggaagcagcaggaauauauggaguagcagcagaauuuggagcaaaagcacuaacaauauguacaguaagcgaucacauaagaacacacgaacaaacaacagcagcugaaagacaaacaacauucaaugacaugauaaaaauagcauuagaaagugugcuacuaggagauaaagaauaa

SEQ ID NO: 6505 - protein, 239 aa, Artificial Sequence; identical to SEQ ID NO: 6201
  Purine_Nucleoside_Phosphorylase_deoD__Escherichia_coli__D3GY24

SEQ ID NO: 6506 - RNA, 720 nt, Artificial Sequence; identical to SEQ ID NO: 6202
  Purine_Nucleoside_Phosphorylase_deoD__Escherichia_coli__CBG37702

SEQ ID NO: 6507 - RNA, 720 nt, Artificial Sequence; identical to SEQ ID NO: 6203
  derived and/or modified sequence opt1 from Purine_Nucleoside_Phosphorylase_deoD__Escherichia_coli__CBG37702

SEQ ID NO: 6508 - RNA, 720 nt, Artificial Sequence; identical to SEQ ID NO: 6204
  derived and/or modified sequence opt2 from Purine_Nucleoside_Phosphorylase_deoD__Escherichia_coli__CBG37702

SEQ ID NO: 6509 - RNA, 720 nt, Artificial Sequence; identical to SEQ ID NO: 6205
  derived and/or modified sequence opt3 from Purine_Nucleoside_Phosphorylase_deoD__Escherichia_coli__CBG37702

SEQ ID NO: 6510 - RNA, 720 nt, Artificial Sequence; identical to SEQ ID NO: 6206
  derived and/or modified sequence opt4 from Purine_Nucleoside_Phosphorylase_deoD__Escherichia_coli__CBG37702

SEQ ID NO: 6511 - RNA, 720 nt, Artificial Sequence; identical to SEQ ID NO: 6207
  derived and/or modified sequence opt5 from Purine_Nucleoside_Phosphorylase_deoD__Escherichia_coli__CBG37702

SEQ ID NO: 6512 - RNA, 720 nt, Artificial Sequence
  derived and/or modified sequence opt6 from Purine_Nucleoside_Phosphorylase_deoD__Escherichia_coli__CBG37702
auggcaacaccacauaucaaugcagaaaugggagacuuugcagauguaguacuaaugccaggagacccacuaagagcaaaauacauagcagaaacauuucuagaagacgcaagagaaguaaauaacguaagaggaauguuaggauuuacaggaacauauaaaggaagaaaaauaaguguaaugggacauggaaugggaauaccaaguugcucaauauauacaaaagaauuaauaacagacuuuggaguaaaaaaaauaauaagaguaggaucaugcggagcaguauuaccacacguaaaauugagagauguaguaauaggaaugggagcauguacagauagcaaaguaaauagaauaagauuuaaagaucaugauuucgcagcaauagcagauuucgacaugguaagaaaugcaguagacgcagcaaaagcauuaggaguagaugcaagaguaggaaaucuauuuagcgcggacuuauucuauaguccagacggagaaauguucgauguaauggaaaaauauggaauacugggaguagaaauggaagcagcaggaauauauggaguagcagcagaauuuggagcgaaagcacuaacaauauguaccguaagugaucauauaagaacacacgaacaaacaacagcagcagaaagacaaacaacauucaaugacaugauaaaaauagcacuagaaagcguauuauuaggagauaaagaauaa

SEQ ID NO: 6513 - protein, 239 aa, Artificial Sequence; identical to SEQ ID NO: 6193
  Purine_Nucleoside_Phosphorylase_deoD__Escherichia_coli__D3QNE6

SEQ ID NO: 6514 - RNA, 720 nt, Artificial Sequence; identical to SEQ ID NO: 6258
  Purine_Nucleoside_Phosphorylase_deoD__Escherichia_coli__ADD59655

SEQ ID NO: 6515 - RNA, 720 nt, Artificial Sequence; identical to SEQ ID NO: 6195
  derived and/or modified sequence opt1 from Purine_Nucleoside_Phosphorylase_deoD__Escherichia_coli__ADD59655

SEQ ID NO: 6516 - RNA, 720 nt, Artificial Sequence; identical to SEQ ID NO: 6196
  derived and/or modified sequence opt2 from Purine_Nucleoside_Phosphorylase_deoD__Escherichia_coli__ADD59655

SEQ ID NO: 6517 - RNA, 720 nt, Artificial Sequence; identical to SEQ ID NO: 6197
  derived and/or modified sequence opt3 from Purine_Nucleoside_Phosphorylase_deoD__Escherichia_coli__ADD59655

SEQ ID NO: 6518 - RNA, 720 nt, Artificial Sequence; identical to SEQ ID NO: 6198
  derived and/or modified sequence opt4 from Purine_Nucleoside_Phosphorylase_deoD__Escherichia_coli__ADD59655

SEQ ID NO: 6519 - RNA, 720 nt, Artificial Sequence; identical to SEQ ID NO: 6199
  derived and/or modified sequence opt5 from Purine_Nucleoside_Phosphorylase_deoD__Escherichia_coli__ADD59655

SEQ ID NO: 6520 - RNA, 720 nt, Artificial Sequence
  derived and/or modified sequence opt6 from Purine_Nucleoside_Phosphorylase_deoD__Escherichia_coli__ADD59655
auggcaacaccucauauaaaugcagaaaugggagacuuugcagauguaguacuaaugccaggagacccauuaagagcaaaauacauagcagaaacauuucuagaagacgcaagagaaguaaauaauguaagaggaauguuaggauuuacaggaacauauaaaggaagaaaaauaucaguaaugggacauggaaugggaauaccaucaugcucaauauauaccaaagaauuaauaacagacuuuggaguaaaaaaaauaauaagaguaggaucaugcggggcaguauuaccacacguaaaauuaagagauguaguaauaggaaugggagcauguacagauagcaaaguaaauagaauaagauuuaaagaucacgauuucgcagcaauagcagauuucgauaugguaagaaaugccguagacgcagcaaaagcauuaggaauagacgcaagaguaggaaaucuauuuagcgcagauuuauucuauaguccagauggagaaauguucgauguaauggaaaaauacggaauauuaggaguagagauggaagcagcaggaauauauggaguagcagcagaauuuggagcaaaagcacuaacaauauguacagugagugaucacauaagaacacaugaacaaacaacagcggcagaaagacaaacaacauucaaugacaugauaaaaauagcgcuagaaaguguauuauuaggagauaaagaauaa

SEQ ID NO: 6521 - protein, 239 aa, Artificial Sequence; identical to SEQ ID NO: 6193
  Purine_Nucleoside_Phosphorylase_deoD__Escherichia_coli__D6I4N2

SEQ ID NO: 6522 - RNA, 720 nt, Artificial Sequence; identical to SEQ ID NO: 6234
  Purine_Nucleoside_Phosphorylase_deoD__Escherichia_coli__EFE60543

SEQ ID NO: 6523 - RNA, 720 nt, Artificial Sequence; identical to SEQ ID NO: 6195
  derived and/or modified sequence opt1 from Purine_Nucleoside_Phosphorylase_deoD__Escherichia_coli__EFE60543

SEQ ID NO: 6524 - RNA, 720 nt, Artificial Sequence; identical to SEQ ID NO: 6196
  derived and/or modified sequence opt2 from Purine_Nucleoside_Phosphorylase_deoD__Escherichia_coli__EFE60543

SEQ ID NO: 6525 - RNA, 720 nt, Artificial Sequence; identical to SEQ ID NO: 6197
  derived and/or modified sequence opt3 from Purine_Nucleoside_Phosphorylase_deoD__Escherichia_coli__EFE60543

SEQ ID NO: 6526 - RNA, 720 nt, Artificial Sequence; identical to SEQ ID NO: 6198
  derived and/or modified sequence opt4 from Purine_Nucleoside_Phosphorylase_deoD__Escherichia_coli__EFE60543

SEQ ID NO: 6527 - RNA, 720 nt, Artificial Sequence; identical to SEQ ID NO: 6199
  derived and/or modified sequence opt5 from Purine_Nucleoside_Phosphorylase_deoD__Escherichia_coli__EFE60543

SEQ ID NO: 6528 - RNA, 720 nt, Artificial Sequence
  derived and/or modified sequence opt6 from Purine_Nucleoside_Phosphorylase_deoD__Escherichia_coli__EFE60543
auggcaacaccacauauaaaugcagaaaugggagacuuugcagauguaguauuaaugccaggagacccacuaagagcaaaauauauagcagaaacauuucuagaagacgcaagagaaguaaauaacguaagaggaaugcuagguuuuacaggaacauauaaaggaagaaaaauaaguguaauggggcauggaaugggaauaccaucaugcaguauauauacuaaagaacuaauaacagacuuuggagugaaaaaaauaauaagaguaggaaguugcggagcaguacuaccacacguaaaauuaagagauguaguaauaggaaugggagcauguacagauaguaaaguaaauagaauaagauuuaaagaucacgauuucgcagcaauagcagauuucgauaugguaagaaaugcaguagacgcagcaaaagcacuaggaauagaugcaagaguaggaaaucuauuuagcgcagaccuauucuauaguccugacggugaaauguucgauguaauggaaaaauacggaauauuagggguagaaauggaagcagcaggaauauauggaguagcagcagaauuuggggcaaaagcauuaacaauauguacaguaagugaucacauaagaacacacgaacaaacaaccgcagcagaaagacaaacaacauucaaugacaugauaaaaauagcacuagaaaguguacuacuaggagauaaagaguaa

SEQ ID NO: 6529 - protein, 239 aa, Artificial Sequence; identical to SEQ ID NO: 6201
  Purine_Nucleoside_Phosphorylase_deoD__Escherichia_coli__D6IHU2

SEQ ID NO: 6530 - RNA, 720 nt, Artificial Sequence
  Purine_Nucleoside_Phosphorylase_deoD__Escherichia_coli__EFF03573
auggcuaccccacacauuaaugcagaaaugggcgauuucgcugacguaguuuugaugccaggcgacccgcugcgugcgaaguauauugcugaaacuuuccuugaagaugcccgugaagugaacaacguucgcgguaugcugggcuucaccgguacuuacaaaggccgcaaaauuuccguaaugggucacgguauggguaucccguccugcuccaucuacaccaaagaacugaucaccgauuucggcgugaagaaaauuauccgcguggguuccuguggcgcaguucugccgcacguaaaacugcgcgacgucguuaucgguaugggugccugcaccgauuccaaaguuaaccgcauccguuuuaaagaucaugacuuugccgcuaucgcugacuuugacauggugcguaacgcgguagacgcggcuaaagcacugggcguugaugcucgcguggguaaccuguucuccgcugaccuguucuacucuccggacggcgaaauguucgacgugauggaaaaauacggcauccucggcguggaaauggaagcggcugguaucuacggcgucgcugcagaauuuggcgcgaaagcccugaccaucugcaccguaucugaucacauccgcacucacgagcagaccacugccgcugagcgucagaccaccuucaacgacaugaucaaaaucgcacuggaauccguucugcugggcgauaaagaguaa

SEQ ID NO: 6531 - RNA, 720 nt, Artificial Sequence; identical to SEQ ID NO: 6203
  derived and/or modified sequence opt1 from Purine_Nucleoside_Phosphorylase_deoD__Escherichia_coli__EFF03573

SEQ ID NO: 6532 - RNA, 720 nt, Artificial Sequence; identical to SEQ ID NO: 6204
  derived and/or modified sequence opt2 from Purine_Nucleoside_Phosphorylase_deoD__Escherichia_coli__EFF03573

SEQ ID NO: 6533 - RNA, 720 nt, Artificial Sequence; identical to SEQ ID NO: 6205
  derived and/or modified sequence opt3 from Purine_Nucleoside_Phosphorylase_deoD__Escherichia_coli__EFF03573

SEQ ID NO: 6534 - RNA, 720 nt, Artificial Sequence; identical to SEQ ID NO: 6206
  derived and/or modified sequence opt4 from Purine_Nucleoside_Phosphorylase_deoD__Escherichia_coli__EFF03573

SEQ ID NO: 6535 - RNA, 720 nt, Artificial Sequence; identical to SEQ ID NO: 6207
  derived and/or modified sequence opt5 from Purine_Nucleoside_Phosphorylase_deoD__Escherichia_coli__EFF03573

SEQ ID NO: 6536 - RNA, 720 nt, Artificial Sequence
  derived and/or modified sequence opt6 from Purine_Nucleoside_Phosphorylase_deoD__Escherichia_coli__EFF03573
auggcaacaccacauauaaaugcagaaaugggagacuuugcagauguaguacuaaugccaggagauccacuaagagcaaaauacauagcagaaacauuucuagaagacgcaagagaaguaaauaauguaagaggaauguuaggcuucacaggaacauauaaaggaaggaaaauaagcguaaugggacauggcaugggaauaccaucauguucaauauauacaaaagaauuaauaacagacuuuggaguaaaaaaaauaauaagaguaggcucaugcggagcaguacuaccucauguaaaauuaagggauguaguaauaggaaugggagccuguacagauagcaaaguaaaucgaauaagauuuaaagaucacgauuucgcagcaauagcagauuucgauaugguaagaaaugcaguagacgcagcaaaagcauuaggaguagacgcaagaguaggaaauuuauuuagcgcagauuuauuuuauaguccagacggagaaauguucgauguaauggaaaaauacgggauauuaggaguagaaauggaagcagcaggaauauauggaguagcagcagaauuuggagcaaaagcacuaacaauauguacaguaagcgaucauauaagaacacaugaacaaacaacagcagccgaaagacaaacaacauucaaugacaugauaaaaaucgcacuagaaagcguauuauuaggagauaaagaauaa

SEQ ID NO: 6537 - protein, 239 aa, Artificial Sequence; identical to SEQ ID NO: 6201
  Purine_Nucleoside_Phosphorylase_deoD__Escherichia_coli__D6J6A4

SEQ ID NO: 6538 - RNA, 720 nt, Artificial Sequence
  Purine_Nucleoside_Phosphorylase_deoD__Escherichia_coli__EFF14801
auggcuaccccacacauuaaugcagaaaugggcgauuucgcugacguaguuuugaugccaggcgacccgcugcgugcgaaguauauugcugaaacuuuccuugaagaugcccgugaagugaacaacguucgcgguaugcugggcuucaccgguacuuacaaaggccgcaaaauuuccguaaugggucacgguauggguaucccguccugcuccaucuacaccaaagaacugaucaccgauuucggcgugaagaaaauuauccgcguaggcucuuguggcgcuguucugccacacguaaaacugcgcgacguaguuaucgguaugggugccugcaccgauuccaaaguuaaccgcauccguuuuaaagaccaugacuuugccgcuaucgcugacuuugacauggugcguaacgcgguagaugcggcuaaagcacugggcguugaugcucgcguugguaaccuguucuccgcugaccuguucuacucuccggacggcgaaauguucgacgugauggaaaaauacggcauccucggcguggaaauggaagcggcugguaucuacggcguggcugcagaguuuggcgcgaaagcccugaccaucugcaccgugucugaccacauccgcacucacgagcagaccacugccgcugagcgucagaccaccuucaacgacaugaucaaaaucgcacuggaauccguucugcugggcgauaaagaguaa

SEQ ID NO: 6539 - RNA, 720 nt, Artificial Sequence; identical to SEQ ID NO: 6203
  derived and/or modified sequence opt1 from Purine_Nucleoside_Phosphorylase_deoD__Escherichia_coli__EFF14801

SEQ ID NO: 6540 - RNA, 720 nt, Artificial Sequence; identical to SEQ ID NO: 6204
  derived and/or modified sequence opt2 from Purine_Nucleoside_Phosphorylase_deoD__Escherichia_coli__EFF14801

SEQ ID NO: 6541 - RNA, 720 nt, Artificial Sequence; identical to SEQ ID NO: 6205
  derived and/or modified sequence opt3 from Purine_Nucleoside_Phosphorylase_deoD__Escherichia_coli__EFF14801

SEQ ID NO: 6542 - RNA, 720 nt, Artificial Sequence; identical to SEQ ID NO: 6206
  derived and/or modified sequence opt4 from Purine_Nucleoside_Phosphorylase_deoD__Escherichia_coli__EFF14801

SEQ ID NO: 6543 - RNA, 720 nt, Artificial Sequence; identical to SEQ ID NO: 6207
  derived and/or modified sequence opt5 from Purine_Nucleoside_Phosphorylase_deoD__Escherichia_coli__EFF14801

SEQ ID NO: 6544 - RNA, 720 nt, Artificial Sequence
  derived and/or modified sequence opt6 from Purine_Nucleoside_Phosphorylase_deoD__Escherichia_coli__EFF14801
auggcgacaccacauauaaacgcagaaaugggagacuuugcagauguaguacuaaugccaggggacccauuaagagcaaaauacauagccgaaacauuuuuagaagacgcaagagaaguaaauaacguaagaggaauguuaggauuuacaggaacauauaaaggaagaaaaauaaguguaaugggacauggaaugggaauacccucaugcucaauauauacaaaagaauuaauaacagacuuuggaguaaaaaagauaauaagaguaggaucaugcggagccguauuaccacacguaaaauuaagagauguaguaauaggaaugggagcauguacagauagcaaaguaaauagaauaagauuuaaagaucacgauuucgcagcaauagcagauuucgauaugguaagaaaugcaguagaugcagcaaaagcacuaggaguagacgcaagaguaggaaaucuauuuagcgcagacuuauucuauaguccagauggagaaauguuugauguaauggaaaaauacggaauauuaggaguagaaauggaagcagcagggauauauggaguggcagcagaauucggagcaaaagcacuaacaauauguacagugucagaucauauaagaacacacgaacaaacaacagcagcagaaagacaaacaacauucaaugacaugauaaaaauagcacuagaaagcguacuauuaggagauaaagaauaa

SEQ ID NO: 6545 - protein, 239 aa, Artificial Sequence; identical to SEQ ID NO: 6193
  Purine_Nucleoside_Phosphorylase_deoD__Escherichia_coli__E0J437

SEQ ID NO: 6546 - RNA, 720 nt, Artificial Sequence
  Purine_Nucleoside_Phosphorylase_deoD__Escherichia_coli__AFH14259
auggcuaccccacacauuaaugcagaaaugggcgauuucgcugacguaguuuugaugccaggcgacccgcugcgugcgaaguauauugcugaaacuuuccuugaagaugcccgugaagugaacaacguucgcgguaugcugggcuucaccgguacuuacaaaggccgcaaaauuuccguaaugggucacgguauggguaucccguccugcuccaucuacaccaaagaacugaucaccgauuucggcgugaagaaaauuauccgcguggguuccuguggcgcaguucugccgcacguaaaacugcgcgacgucguuaucgguaugggugccugcaccgauuccaaaguuaaccgcauccguuuuaaagaucaugacuuugccgcuaucgcugacuuugacauggugcguaacgcgguagacgcggcuaaagcacugggcauugaugcucgcguugguaaccuguucuccgcugaccuguucuacucuccggacggcgaaauguucgacgugauggaaaaauacggcauccucggcguggaaauggaagcagcugguaucuacggcgucgcugcagaauuuggcgcgaaagcccugaccaucugcaccgugucugaccacauccgcacucacgagcagaccacugccgcugagcgucagaccaccuucaacgacaugaucaaaaucgcacuggaauccguucugcugggcgauaaagaguaa

SEQ ID NO: 6547 - RNA, 720 nt, Artificial Sequence; identical to SEQ ID NO: 6195
  derived and/or modified sequence opt1 from Purine_Nucleoside_Phosphorylase_deoD__Escherichia_coli__AFH14259

SEQ ID NO: 6548 - RNA, 720 nt, Artificial Sequence; identical to SEQ ID NO: 6196
  derived and/or modified sequence opt2 from Purine_Nucleoside_Phosphorylase_deoD__Escherichia_coli__AFH14259

SEQ ID NO: 6549 - RNA, 720 nt, Artificial Sequence; identical to SEQ ID NO: 6197
  derived and/or modified sequence opt3 from Purine_Nucleoside_Phosphorylase_deoD__Escherichia_coli__AFH14259

SEQ ID NO: 6550 - RNA, 720 nt, Artificial Sequence; identical to SEQ ID NO: 6198
  derived and/or modified sequence opt4 from Purine_Nucleoside_Phosphorylase_deoD__Escherichia_coli__AFH14259

SEQ ID NO: 6551 - RNA, 720 nt, Artificial Sequence; identical to SEQ ID NO: 6199
  derived and/or modified sequence opt5 from Purine_Nucleoside_Phosphorylase_deoD__Escherichia_coli__AFH14259

SEQ ID NO: 6552 - RNA, 720 nt, Artificial Sequence
  derived and/or modified sequence opt6 from Purine_Nucleoside_Phosphorylase_deoD__Escherichia_coli__AFH14259
auggcaacaccacauauaaaugcagaaaugggagacuuugcagacguaguauuaaugccaggagacccauuaagagcaaaauacauagcagaaacauuucuagaagaugcaagagaaguaaauaacguaagaggaauguuaggcuuuacaggaacauauaaaggaagaaaaauaucaguaaugggacauggaaugggaauaccaagcugcucaauauauacaaaagaacugauaacagacuuuggaguaaaaaaaauaauaagagugggaucaugcggagcaguacuaccacacguaaaauuaagagauguaguaauaggaaugggagcauguaccgauaguaaaguaaauagaauaagauuuaaagaucacgauuucgcagcaauagcagauuuugauaugguaagaaaugcaguggacgcagcaaaagcauuaggaauagaugcaagagugggaaaucucuuuagugcggaccuauucuauagcccagacggagaaauguucgauguaauggaaaaauacgggauauuaggaguagaaauggaagcagcaggaauauauggaguagccgcagaauuuggcgcaaaagcauuaacaauauguacaguaagcgaucacauaagaacacacgaacaaacaacagcagcagaaagacaaacaacauucaaugauaugauaaaaauagcacuagaaaguguacuauuaggagauaaagaauaa

SEQ ID NO: 6553 - protein, 239 aa, Artificial Sequence; identical to SEQ ID NO: 6201
  Purine_Nucleoside_Phosphorylase_deoD__Escherichia_coli__E2QLE4

SEQ ID NO: 6554 - RNA, 720 nt, Artificial Sequence
  Purine_Nucleoside_Phosphorylase_deoD__Escherichia_coli__AJO86506
auggcuacuccacacauuaaugcagaaaugggcgauuuugcugacguaguuuugaugccaggcgacccgcugcgugcgaaguauauugcugaaacuuuccuugaagaugcccgugaagugaacaacguucgcgguaugcugggcuucacugguacuuacaaaggccgcaaaauuuccguaaugggccacgguauggguaucccguccugcuccaucuacaccaaagaacugaucacugauuucggcgugaagaaaauuauccgcguggguuccuguggcgcuguucugccgcacguaaaacugcgcgacgucguuaucgguaugggugccugcaccgauuccaaaguuaaccgcauccguuuuaaagaccaugacuuugccgcuaucgcugacuucgacauggugcguaacgcgguagacgcggcaaaagcacugggcguugaugcucgcguugguaaccuguucuccgcugaccuguucuacucuccggacggcgaaauguucgacgugauggaaaaauacggcauccucggcguggaaauggaagcggcggguaucuacggcgucgcugcagaauuuggcgcgaaagcccugaccaucugcaccgugucugaccacauccgcacucacgagcagaccacugccgcugagcgucagaccaccuucaacgacaugaucaaaaucgcgcuggaauccguucugcugggcgauaaagaguaa

SEQ ID NO: 6555 - RNA, 720 nt, Artificial Sequence; identical to SEQ ID NO: 6203
  derived and/or modified sequence opt1 from Purine_Nucleoside_Phosphorylase_deoD__Escherichia_coli__AJO86506

SEQ ID NO: 6556 - RNA, 720 nt, Artificial Sequence; identical to SEQ ID NO: 6204
  derived and/or modified sequence opt2 from Purine_Nucleoside_Phosphorylase_deoD__Escherichia_coli__AJO86506

SEQ ID NO: 6557 - RNA, 720 nt, Artificial Sequence; identical to SEQ ID NO: 6205
  derived and/or modified sequence opt3 from Purine_Nucleoside_Phosphorylase_deoD__Escherichia_coli__AJO86506

SEQ ID NO: 6558 - RNA, 720 nt, Artificial Sequence; identical to SEQ ID NO: 6206
  derived and/or modified sequence opt4 from Purine_Nucleoside_Phosphorylase_deoD__Escherichia_coli__AJO86506

SEQ ID NO: 6559 - RNA, 720 nt, Artificial Sequence; identical to SEQ ID NO: 6207
  derived and/or modified sequence opt5 from Purine_Nucleoside_Phosphorylase_deoD__Escherichia_coli__AJO86506

SEQ ID NO: 6560 - RNA, 720 nt, Artificial Sequence
  derived and/or modified sequence opt6 from Purine_Nucleoside_Phosphorylase_deoD__Escherichia_coli__AJO86506
auggcaacaccacauauaaaugcagaaaugggagacuucgcagauguaguacuaaugccaggagacccacuaagagcaaaauauauagcagaaacauuucuagaagacgcaagagaaguaaacaacguaagagguauguuaggauuuacaggaacauauaaaggaagaaaaauaaguguaaugggacauggaaugggaauaccaucauguaguauauauacaaaagaauuaauaacagacuuuggaguaaaaaaaauaauaagaguaggaucaugcggagccguacuaccacacguaaaacuaagagauguaguaauaggaaugggagccuguacagauagcaaaguaaauagaauaagauuuaaagaucaugauuucgcagcaauagcagauuucgacaugguaagaaaugcaguagacgcagcaaaagcauuaggaguagacgcgagaguaggaaauuuauuuagcgcagacuuauucuauucaccagacggagaaauguucgauguaauggaaaaauauggaauauuaggaguagaaauggaagcagcaggaauauauggaguagcagcagaauuuggagcaaaagcacuaacaauauguacaguaagcgaucacauaagaacacacgaacaaacaacagcagcagaaagacaaacaacauucaaugacaugauaaaaauagcacuagaaagcguacuauuaggagauaaagaauaa

SEQ ID NO: 6561 - protein, 239 aa, Artificial Sequence; identical to SEQ ID NO: 6193
  Purine_Nucleoside_Phosphorylase_deoD__Escherichia_coli__E3PFG7

SEQ ID NO: 6562 - RNA, 720 nt, Artificial Sequence
  Purine_Nucleoside_Phosphorylase_deoD__Escherichia_coli__CBJ04246
auggcuaccccacacauuaaugcagaaaugggcgauuucgcugacguaguuuugaugccaggcgacccgcugcgugcgaaguauauugcugaaacuuuccuugaagaugcccgugaagugaacaacguucgcgguaugcugggcuucaccgguacuuacaaaggccgcaaaauuuccguaaugggucacgguauggguaucccguccugcuccaucuacaccaaagaacugaucaccgauuucggcgugaagaaaauuauccgcguggguuccuguggcgcaguucugccgcacguaaaacuacgcgacgucguuaucgguaugggugccugcaccgauuccaaaguuaaccgcauccguuuuaaagaucaugacuuugccgcuaucgcugacuuugacauggugcguaacgcgguagacgcggcuaaagcacugggcauugaugcucgcguugguaaccuguucuccgcugaccuguucuacucuccggacggcgaaauguucgacgugauggaaaaauacggcauccucggcguggaaauggaagcggcugguaucuacggcgucgcugcagaauuuggcgcgaaagcccugaccaucuguaccgugucugaccacauccgcacucacgagcagaccacugccgcugagcgucagaccaccuucaacgacaugaucaaaaucgcacuggaauccguucugcugggcgauaaagaguaa

SEQ ID NO: 6563 - RNA, 720 nt, Artificial Sequence; identical to SEQ ID NO: 6195
  derived and/or modified sequence opt1 from Purine_Nucleoside_Phosphorylase_deoD__Escherichia_coli__CBJ04246

SEQ ID NO: 6564 - RNA, 720 nt, Artificial Sequence; identical to SEQ ID NO: 6196
  derived and/or modified sequence opt2 from Purine_Nucleoside_Phosphorylase_deoD__Escherichia_coli__CBJ04246

SEQ ID NO: 6565 - RNA, 720 nt, Artificial Sequence; identical to SEQ ID NO: 6197
  derived and/or modified sequence opt3 from Purine_Nucleoside_Phosphorylase_deoD__Escherichia_coli__CBJ04246

SEQ ID NO: 6566 - RNA, 720 nt, Artificial Sequence; identical to SEQ ID NO: 6198
  derived and/or modified sequence opt4 from Purine_Nucleoside_Phosphorylase_deoD__Escherichia_coli__CBJ04246

SEQ ID NO: 6567 - RNA, 720 nt, Artificial Sequence; identical to SEQ ID NO: 6199
  derived and/or modified sequence opt5 from Purine_Nucleoside_Phosphorylase_deoD__Escherichia_coli__CBJ04246

SEQ ID NO: 6568 - RNA, 720 nt, Artificial Sequence
  derived and/or modified sequence opt6 from Purine_Nucleoside_Phosphorylase_deoD__Escherichia_coli__CBJ04246
auggcaacaccacauauaaaugcagaaaugggagacuuugcagauguaguauuaaugccaggagauccauuaagagcaaaauauauagcagaaacauuucuagaagacgcaagagaaguaaauaacguaagaggaaugcuaggauuuacaggaacauauaaagguagaaaaauaucaguaaugggacauggaaugggaauacccucaugcagcauauauacaaaagaauuaauaacagacuucggagugaaaaaaauaauaagaguaggaucauguggagcaguacuaccacacgugaaauuaagagauguaguaauaggaaugggagcauguacagauagcaaaguaaauagaauaagauuuaaagaucacgauuuugcagccauagcagauuucgauaugguaagaaacgcaguagacgcagcaaaagcauuaggaauagacgcaagaguaggaaaucuauuuagcgcagacuuguucuauucaccagacggggaaauguucgauguaauggaaaaauacggaauuuuaggcguagaaauggaagcagcaggaauauauggaguagcagcagaauuuggagcaaaagcacuaacaauauguacaguaagcgaucacauuagaacacaugaacaaacaacagcagcugaacgacaaacaacauucaaugacaugauaaaaauagcacuagagaguguacuauuaggagauaaagaauaa

SEQ ID NO: 6569 - protein, 239 aa, Artificial Sequence; identical to SEQ ID NO: 6193
  Purine_Nucleoside_Phosphorylase_deoD__Escherichia_coli__E8YEH0

SEQ ID NO: 6570 - RNA, 720 nt, Artificial Sequence; identical to SEQ ID NO: 6546
  Purine_Nucleoside_Phosphorylase_deoD__Escherichia_coli__ADX52500

SEQ ID NO: 6571 - RNA, 720 nt, Artificial Sequence; identical to SEQ ID NO: 6195
  derived and/or modified sequence opt1 from Purine_Nucleoside_Phosphorylase_deoD__Escherichia_coli__ADX52500

SEQ ID NO: 6572 - RNA, 720 nt, Artificial Sequence; identical to SEQ ID NO: 6196
  derived and/or modified sequence opt2 from Purine_Nucleoside_Phosphorylase_deoD__Escherichia_coli__ADX52500

SEQ ID NO: 6573 - RNA, 720 nt, Artificial Sequence; identical to SEQ ID NO: 6197
  derived and/or modified sequence opt3 from Purine_Nucleoside_Phosphorylase_deoD__Escherichia_coli__ADX52500

SEQ ID NO: 6574 - RNA, 720 nt, Artificial Sequence; identical to SEQ ID NO: 6198
  derived and/or modified sequence opt4 from Purine_Nucleoside_Phosphorylase_deoD__Escherichia_coli__ADX52500

SEQ ID NO: 6575 - RNA, 720 nt, Artificial Sequence; identical to SEQ ID NO: 6199
  derived and/or modified sequence opt5 from Purine_Nucleoside_Phosphorylase_deoD__Escherichia_coli__ADX52500

SEQ ID NO: 6576 - RNA, 720 nt, Artificial Sequence
  derived and/or modified sequence opt6 from Purine_Nucleoside_Phosphorylase_deoD__Escherichia_coli__ADX52500
auggcaacaccacauauaaaugcagaaaugggagacuuugcagauguagugcuaaugccaggggacccacuaagagcgaaauacauagcagaaacauuucuagaagacgcgagagaaguaaauaacguaagaggaauguuaggauuuacaggaacauauaaaggaagaaaaauaucaguaaugggacauggaaugggaauaccaucgugcucaauauauacaaaagaauuaauaacagacuuuggaguaaaaaaaauaauaagaguaggaucaugcggagcaguacuaccacacguaaaacuaagagauguaguaauagggaugggagcauguacagauagcaaaguaaauagaauacgauuuaaagaucacgauuucgcagcaauagcagauuucgauaugguacgaaaugcaguagacgcagcaaaagcauuaggaauagacgcaagaguaggaaauuuauuuagcgcagauuuauucuauagcccagacggagaaauguucgauguaauggaaaaauacgggauauuaggaguagaaauggaagcagcaggaauauauggaguagcagcagaauuuggagcaaaagcacuaacaauauguacaguaagcgaucacauaagaacacacgaacaaacaacagcggcagaaagacaaacaacguuuaaugacaugauaaaaauagcacucgaaagcgugcuauuaggagauaaagaauaa

SEQ ID NO: 6577 - protein, 239 aa, Artificial Sequence; identical to SEQ ID NO: 6193
  Purine_Nucleoside_Phosphorylase_deoD__Escherichia_coli__F4NLK2

SEQ ID NO: 6578 - RNA, 720 nt, Artificial Sequence; identical to SEQ ID NO: 6546
  Purine_Nucleoside_Phosphorylase_deoD__Escherichia_coli__EGJ07033

SEQ ID NO: 6579 - RNA, 720 nt, Artificial Sequence; identical to SEQ ID NO: 6195
  derived and/or modified sequence opt1 from Purine_Nucleoside_Phosphorylase_deoD__Escherichia_coli__EGJ07033

SEQ ID NO: 6580 - RNA, 720 nt, Artificial Sequence; identical to SEQ ID NO: 6196
  derived and/or modified sequence opt2 from Purine_Nucleoside_Phosphorylase_deoD__Escherichia_coli__EGJ07033

SEQ ID NO: 6581 - RNA, 720 nt, Artificial Sequence; identical to SEQ ID NO: 6197
  derived and/or modified sequence opt3 from Purine_Nucleoside_Phosphorylase_deoD__Escherichia_coli__EGJ07033

SEQ ID NO: 6582 - RNA, 720 nt, Artificial Sequence; identical to SEQ ID NO: 6198
  derived and/or modified sequence opt4 from Purine_Nucleoside_Phosphorylase_deoD__Escherichia_coli__EGJ07033

SEQ ID NO: 6583 - RNA, 720 nt, Artificial Sequence; identical to SEQ ID NO: 6199
  derived and/or modified sequence opt5 from Purine_Nucleoside_Phosphorylase_deoD__Escherichia_coli__EGJ07033

SEQ ID NO: 6584 - RNA, 720 nt, Artificial Sequence
  derived and/or modified sequence opt6 from Purine_Nucleoside_Phosphorylase_deoD__Escherichia_coli__EGJ07033
auggcaacaccacauauaaaugcagaaaugggagauuuugcagauguaguacuaaugccaggagauccacuaagggccaaauauauugcagaaacauuucuagaagaugcaagagaaguaaauaacguacgaggaaugcuaggauuuaccggaacauauaaaggaagaaaaaucucaguaaugggacauggaaugggcauaccaucaugcucaauauauacaaaagaauuaauaacagacuuuggaguaaaaaaaauaauacgaguaggaucguguggagcaguacucccucacguaaaauuaagagauguaguuauaggaaugggagccuguacagauagcaaaguaaauagaauaagauuuaaagaucacgauuucgcagcaauagcagauuucgauaugguaaggaaugcaguggacgcagcaaaagcauuaggaauagacgcaagaguaggaaacuuauuuagugcagacuuauucuauaguccagacggagaaauguucgauguaauggaaaaauacggaauauuaggaguagaaauggaagcagcaggaauauauggaguagcagcggaauuuggagcaaaagcacuaacaauauguaccgugagugaucacauaagaacacacgaacaaacaacugcagcagaaagacaaacaacauuuaaugauaugauaaaaauagcacuagaaaguguacuauuaggagauaaagaauaa

SEQ ID NO: 6585 - protein, 239 aa, Artificial Sequence; identical to SEQ ID NO: 6201
  Purine_Nucleoside_Phosphorylase_deoD__Escherichia_coli__F4SEX7

SEQ ID NO: 6586 - RNA, 720 nt, Artificial Sequence
  Purine_Nucleoside_Phosphorylase_deoD__Escherichia_coli__EGI12380
auggcuaccccacacauuaaugcagaaaugggcgauuucgcugacguaguuuugaugccaggcgacccgcugcgugcgaaguauauugcugaaacuuuccuugaagaugcccgugaagugaacaacguucgcgguaugcugggcuucaccgguacuuacaaaggccgcaaaauuuccguaaugggucacgguauggguaucccguccugcuccaucuacaccaaagaacugaucaccgauuucggcgugaagaaaauuauccgcguggguuccuguggcgcaguucugccgcacguaaaacugcgcgacgucguuaucgguaugggugccugcaccgauuccaaaguuaaccgcauccguuuuaaagaccaugacuuugccgcuaucgcugacuuugacauggugcguaacgcgguagacgcggcuaaagcacugggcguugaugcucgcguugguaaccuguucuccgcugaccuguucuacucuccggacggcgaaauguucgacgugauggaaaaauacggcauccucggcguggaaauggaagcggcugguaucuacggcgucgcugcagaauuuggcgcgaaagcccugaccaucugcaccgugucugaccacauccgcacucacgagcagaccacugccgcugagcgucagaccaccuucaacgacaugaucaaaaucgcacuggaauccguucugcugggcgauaaagaguaa

SEQ ID NO: 6587 - RNA, 720 nt, Artificial Sequence; identical to SEQ ID NO: 6203
  derived and/or modified sequence opt1 from Purine_Nucleoside_Phosphorylase_deoD__Escherichia_coli__EGI12380

SEQ ID NO: 6588 - RNA, 720 nt, Artificial Sequence; identical to SEQ ID NO: 6204
  derived and/or modified sequence opt2 from Purine_Nucleoside_Phosphorylase_deoD__Escherichia_coli__EGI12380

SEQ ID NO: 6589 - RNA, 720 nt, Artificial Sequence; identical to SEQ ID NO: 6205
  derived and/or modified sequence opt3 from Purine_Nucleoside_Phosphorylase_deoD__Escherichia_coli__EGI12380

SEQ ID NO: 6590 - RNA, 720 nt, Artificial Sequence; identical to SEQ ID NO: 6206
  derived and/or modified sequence opt4 from Purine_Nucleoside_Phosphorylase_deoD__Escherichia_coli__EGI12380

SEQ ID NO: 6591 - RNA, 720 nt, Artificial Sequence; identical to SEQ ID NO: 6207
  derived and/or modified sequence opt5 from Purine_Nucleoside_Phosphorylase_deoD__Escherichia_coli__EGI12380

SEQ ID NO: 6592 - RNA, 720 nt, Artificial Sequence
  derived and/or modified sequence opt6 from Purine_Nucleoside_Phosphorylase_deoD__Escherichia_coli__EGI12380
auggcaacaccacauauaaaugcagaaaugggagacuuugcagauguaguacuaaugccaggagacccauuaagagcaaaauauauagcagaaacauuucuagaagacgcaagagaaguaaauaacguaagaggaauguugggauucacaggaacauauaaaggaagaaaaauaucaguaaugggacacggcaugggaauaccaucaugcucaauauauacaaaagaauuaauaacagacuuuggaguaaaaaaaauaauacgaguaggaucaugcggagccguacuaccacacguaaaauuaagagacguaguaauaggaaugggagcauguacagauaguaaaguaaacagaauacgauuuaaagaucaugauuucgcagcaauagcagauuuugauaugguaagaaaugcaguagacgcugcaaaagcacuaggaguagacgcaagaguaggaaaucuauuuagugcagacuuauucuauagcccagacggagaaauguucgauguaauggaaaaauacgggauauuaggaguagaaauggaagcagcaggaauauauggaguagcagcagaauuuggagcaaaagcacuaacgauauguacagugagcgaucacauaagaacacacgaacaaacgacagcagccgaacgacaaacaacauucaaugacaugauaaaaauagcacuagaaagcguacuauuaggagauaaagaauaa

SEQ ID NO: 6593 - protein, 258 aa, Artificial Sequence
  Purine_Nucleoside_Phosphorylase_deoD__Escherichia_coli__F4STB8
MDLGGAVTPPLICHKKDKTMATPHINAEMGDFADVVLMPGDPLRAKYIAETFLEDAREVNNVRGMLGFTGTYKGRKISVMGHGMGIPSCSIYTKELITDFGVKKIIRVGSCGAVLPHVKLRDVVIGMGACTDSKVNRIRFKDHDFAAIADFDMVRNAVDAAKALGVDARVGNLFSADLFYSPDGEMFDVMEKYGILGVEMEAAGIYGVAAEFGAKALTICTVSDHIRTHEQTTAAERQTTFNDMIKIALESVLLGDKE

SEQ ID NO: 6594 - RNA, 777 nt, Artificial Sequence
  Purine_Nucleoside_Phosphorylase_deoD__Escherichia_coli__EGI17958
auggauuugggcggagcagugacuccgccuuuaauaugucacaaaaaggauaaaacgauggcuacuccacacauuaaugcagaaaugggcgauuuugcugacguaguuuugaugccaggcgacccgcugcgugcgaaguauauugcugaaacuuuccuugaagaugcccgugaagugaacaacguucgcgguaugcugggcuucacugguacuuacaaaggccgcaaaauuuccguaaugggccacgguauggguaucccguccugcuccaucuacaccaaagaacugaucacugauuucggcgugaagaaaauuauccgcguggguuccuguggcgcuguucugccgcacguaaaacugcgcgacgucguuaucgguaugggugccugcaccgauuccaaaguuaaccgcauccguuuuaaagaccaugacuuugccgcuaucgcugacuucgacauggugcguaacgcgguagacgcggcaaaagcacugggcguugaugcucgcguugguaaccuguucuccgcugaccuguucuacucuccggacggcgaaauguucgacgugauggaaaaauacggcauccucggcguggaaauggaagcggcggguaucuacggcgucgcugcagaauuuggcgcgaaagcccugaccaucugcaccgugucugaccacauccgcacucacgagcagaccacugccgcugagcgucagaccaccuucaacgacaugaucaaaaucgcgcuggaauccguucugcugggcgauaaagaguaa

SEQ ID NO: 6595 - RNA, 777 nt, Artificial Sequence
  derived and/or modified sequence opt1 from Purine_Nucleoside_Phosphorylase_deoD__Escherichia_coli__EGI17958
auggaccugggcggggccgugaccccgccccucaucugccacaagaaggacaagaccauggccacgccccacaucaacgcggagaugggcgacuucgccgacgucgugcugaugcccggggacccccugcgcgccaaguacaucgccgagaccuuccucgaggacgcccgggaggugaacaacguccgcggcaugcugggguucaccggcaccuacaagggccggaagaucagcgugauggggcacggcauggggaucccguccugcagcaucuacacgaaggagcugaucaccgacuucggcgugaagaagaucauccgcgucggguccugcggcgcggugcucccccacgugaagcugcgggacgucgugaucggcaugggggccugcaccgacagcaaggugaaccgcauccgguucaaggaccacgacuucgccgccaucgcggacuucgacaugguccgcaacgccguggacgccgccaaggcccugggcguggacgcgcgggucgggaaccucuucuccgccgaccuguucuacagccccgacggcgagauguucgacgugauggagaaguacggcauccuggggguggagauggaggccgccggcaucuacggggucgccgcggaguucggcgccaaggcccucaccaucugcacgguguccgaccacauccgcacccacgagcagaccaccgccgccgagcggcagacgaccuucaacgacaugaucaagaucgcgcuggagagcgugcugcucggggacaaggaguga

SEQ ID NO: 6596 - RNA, 777 nt, Artificial Sequence
  derived and/or modified sequence opt2 from Purine_Nucleoside_Phosphorylase_deoD__Escherichia_coli__EGI17958
auggaccucggcggcgccgucacccccccccucaucugccacaagaaggacaagaccauggccaccccccacaucaacgccgagaugggcgacuucgccgacgucguccucaugcccggcgacccccuccgcgccaaguacaucgccgagaccuuccucgaggacgcccgcgaggucaacaacguccgcggcaugcucggcuucaccggcaccuacaagggccgcaagaucuccgucaugggccacggcaugggcauccccuccugcuccaucuacaccaaggagcucaucaccgacuucggcgucaagaagaucauccgcgucggcuccugcggcgccguccucccccacgucaagcuccgcgacgucgucaucggcaugggcgccugcaccgacuccaaggucaaccgcauccgcuucaaggaccacgacuucgccgccaucgccgacuucgacaugguccgcaacgccgucgacgccgccaaggcccucggcgucgacgcccgcgucggcaaccucuucuccgccgaccucuucuacucccccgacggcgagauguucgacgucauggagaaguacggcauccucggcgucgagauggaggccgccggcaucuacggcgucgccgccgaguucggcgccaaggcccucaccaucugcaccgucuccgaccacauccgcacccacgagcagaccaccgccgccgagcgccagaccaccuucaacgacaugaucaagaucgcccucgaguccguccuccucggcgacaaggaguga

SEQ ID NO: 6597 - RNA, 777 nt, Artificial Sequence
  derived and/or modified sequence opt3 from Purine_Nucleoside_Phosphorylase_deoD__Escherichia_coli__EGI17958
auggaccugggcggggccgugacacccccucucaucugccacaagaaagauaagaccauggcuacuccacauauuaacgcagagaugggagacuucgccgaugucguucuuaugccgggugacccccugagagcgaaauacauagcugaaacguuuuuggaggaugccagggaagugaauaacguacggggcauguuaggguucaccggaacauauaagggccgcaaaaucagcgugaugggucacgggaugggcauuccuuccuguucuaucuacacuaaggagcugauuaccgacuuuggagucaagaaaaucauacgagugggcucaugcggggcaguucuaccacaugugaagcuccgugaugucgugaucggaaugggugccuguacagacaguaaaguaaauagaauuagguucaaggaucacgacuuugcugcaaucgccgauuucgacaugguucggaacgcuguggaugccgcgaaagcacugggcgucgacgcccgcguggggaaucuuuuuagcgcugaccuguucuauucccccgauggagaaauguuugacgugauggagaaguacggcauuuugggugucgagauggaagccgcagggaucuauggaguugcugccgaguucggcgcgaaggcccucaccauaugcacugugucugaucauauuagaacacacgaacagaccacggcagcugagaggcaaacuaccuuuaacgacaugaucaaaauugcccuggagucgguacugcucggcgauaaggaauga

SEQ ID NO: 6598 - RNA, 777 nt, Artificial Sequence
  derived and/or modified sequence opt4 from Purine_Nucleoside_Phosphorylase_deoD__Escherichia_coli__EGI17958
auggaccugggcggcgccgugacccccccccugaucugccacaagaaggacaagaccauggccaccccccacaucaacgccgagaugggcgacuucgccgacguggugcugaugcccggcgacccccugagagccaaguacaucgccgagaccuuccuggaggacgccagagaggugaacaacgugagaggcaugcugggcuucaccggcaccuacaagggcagaaagaucagcgugaugggccacggcaugggcauccccagcugcagcaucuacaccaaggagcugaucaccgacuucggcgugaagaagaucaucagagugggcagcugcggcgccgugcugccccacgugaagcugagagacguggugaucggcaugggcgccugcaccgacagcaaggugaacagaaucagauucaaggaccacgacuucgccgccaucgccgacuucgacauggugagaaacgccguggacgccgccaaggcccugggcguggacgccagagugggcaaccuguucagcgccgaccuguucuacagccccgacggcgagauguucgacgugauggagaaguacggcauccugggcguggagauggaggccgccggcaucuacggcguggccgccgaguucggcgccaaggcccugaccaucugcaccgugagcgaccacaucagaacccacgagcagaccaccgccgccgagagacagaccaccuucaacgacaugaucaagaucgcccuggagagcgugcugcugggcgacaaggaguga

SEQ ID NO: 6599 - RNA, 777 nt, Artificial Sequence
  derived and/or modified sequence opt5 from Purine_Nucleoside_Phosphorylase_deoD__Escherichia_coli__EGI17958
auggaccugggcggggccgugacacccccucucaucugccacaagaaagauaagaccauggcuacgccgcauauuaacgccgagaugggagacuucgcggaugucguucugaugcccggcgacccucuuagagcuaaauacaucgccgaaaccuuucuggaggaugcccgggaagugaauaacgugcgcgggaugcucggauucacaggcaccuauaaggggagaaaaauuagcgucaugggacacggcaugggcauccccuccuguucuauuuacacaaaggagcugaucaccgacuuuggggugaagaaaaucauucggguuggaagcugcggcgcugugcuuccucaugucaagcugcgcgaugugguuaucgggaugggagccuguacagacuccaaagugaaucggauuagauucaaggaucacgacuuugcugccaucgcggauuucgacaugguccgcaacgccguggaugcugccaaagcucucggcguggacgccagagucgggaaucuguuuucugcggaccuguucuauagccccgauggagaaauguuugacguuauggagaaguacggcauucucggcguggagauggaagccgcugggaucuauggaguggccgcugaguucggcgccaaggcccugaccauuugcacggucuccgaucauauccggacccacgaacagacaaccgcugcggagcgccaaacaaccuuuaacgacaugaucaaaauugcccuugagucugugcugcucggggauaaggaauga

SEQ ID NO: 6600 - RNA, 777 nt, Artificial Sequence
  derived and/or modified sequence opt6 from Purine_Nucleoside_Phosphorylase_deoD__Escherichia_coli__EGI17958
auggaucuaggaggagcaguaacaccaccauuaauaugccauaaaaaagacaaaacuauggcaacaccacauauaaaugcagaaaugggagacuuugcagauguaguauuaaugccaggagacccacuaagagcaaaauacauagcagaaacauuucuagaagacgcaagagaaguaaauaacguaagaggaaugcuaggauuuacaggaacuuauaaaggaagaaaaauaucaguaaugggacauggaaugggaauaccaucaugcucgauauauacaaaagaauuaauaacagauuuuggaguaaaaaaaauaauaagaguaggaucaugcggagcaguacuaccucauguaaaacuaagagauguaguaauaggaaugggagcauguacagauaguaaaguaaauagaauaagguuuaaagaucacgacuucgcagcaauagcagauuucgauaugguuagaaaugcaguugaugcagcaaaagccuuaggaguagacgcaagaguaggaaauuuauuuagugcagacuuauucuauaguccagacggagaaauguucgacguaauggaaaaauacggaauauuaggaguagaaauggaagcagcaggaauauauggaguagcagcagaauuuggagcaaaagcacuuacuauuuguacaguaagcgaucacauaagaacacaugaacaaacaacagcagcagaaagacaaacaacguucaaugacaugauaaaaauagcauuagaaagcguauuauuaggagauaaagaauaa

SEQ ID NO: 6601 - protein, 239 aa, Artificial Sequence; identical to SEQ ID NO: 6193
  Purine_Nucleoside_Phosphorylase_deoD__Escherichia_coli__F4T9F1

SEQ ID NO: 6602 - RNA, 720 nt, Artificial Sequence
  Purine_Nucleoside_Phosphorylase_deoD__Escherichia_coli__EGI23374
auggcuaccccacacauuaaugcagaaaugggcgauuucgcugacguaguuuugaugccaggcgacccgcugcgugcgaaguauauugcugaaacuuuccuugaagaugcccgugaagugaacaacguucgcgguaugcugggcuucaccgguacuuacaaaggccgcaaaauuuccguaaugggucacgguauggguaucccguccugcuccaucuacaccaaagaacugaucaccgauuucggcgugaagaaaauuauccgcguaggcuccuguggcgcuguucugccgcacguaaaacugcgcgacgucguuaucgguaugggugccugcaccgauuccaaaguuaaccguauccguuuuaaagaccaugacuuugccgcuaucgcugacuuugacauggugcguaacgcgguagacgcggcuaaagcacugggcauugaugcucgcguugguaaccuguucuccgcugaccuguucuacucuccggacggcgaaauguucgacgugauggaaaaauacggcauccucggcguggaaauggaagcggcugguaucuacggcgucgcugcagaauuuggcgcgaaagcccugaccaucuguaccgugucugaccacauccgcacucacgagcagaccacugccgcugagcgucagaccaccuucaacgacaugaucaaaauugcacuggaauccguucugcugggcgauaaagaguaa

SEQ ID NO: 6603 - RNA, 720 nt, Artificial Sequence; identical to SEQ ID NO: 6195
  derived and/or modified sequence opt1 from Purine_Nucleoside_Phosphorylase_deoD__Escherichia_coli__EGI23374

SEQ ID NO: 6604 - RNA, 720 nt, Artificial Sequence; identical to SEQ ID NO: 6196
  derived and/or modified sequence opt2 from Purine_Nucleoside_Phosphorylase_deoD__Escherichia_coli__EGI23374

SEQ ID NO: 6605 - RNA, 720 nt, Artificial Sequence; identical to SEQ ID NO: 6197
  derived and/or modified sequence opt3 from Purine_Nucleoside_Phosphorylase_deoD__Escherichia_coli__EGI23374

SEQ ID NO: 6606 - RNA, 720 nt, Artificial Sequence; identical to SEQ ID NO: 6198
  derived and/or modified sequence opt4 from Purine_Nucleoside_Phosphorylase_deoD__Escherichia_coli__EGI23374

SEQ ID NO: 6607 - RNA, 720 nt, Artificial Sequence; identical to SEQ ID NO: 6199
  derived and/or modified sequence opt5 from Purine_Nucleoside_Phosphorylase_deoD__Escherichia_coli__EGI23374

SEQ ID NO: 6608 - RNA, 720 nt, Artificial Sequence
  derived and/or modified sequence opt6 from Purine_Nucleoside_Phosphorylase_deoD__Escherichia_coli__EGI23374
auggcaacaccacauauaaaugcggaaaugggagacuuugccgauguaguauuaaugccaggagacccauuaagggcaaaauacauagcagaaacauuucuagaagacgcaagagaaguaaauaacguaagaggaauguugggauuuacaggaacauauaaaggaaggaaaauaaguguaaugggacauggaaugggaauaccaaguugcucaauauauacaaaagaacuaauaacagauuuuggaguaaaaaaaauaauaagaguaggaucauguggagcaguacuaccacacguaaaauuaagagauguaguaauaggaaugggagcauguacagauaguaaaguaaauagaauaagauuuaaagaucacgauuucgcagcaauagcagacuucgauaugguaagaaaugcaguagacgcagccaaagcauuaggaauagacgcaagaguaggaaauuuauuuagcgcagacuuauucuauaguccugacggagaaauguucgauguaauggaaaaauacggaauauuaggaguagaaauggaagcagcaggaauauauggaguagcagcagaauuuggagcaaaagcacuaacaauauguacagugagcgaucacauuagaacacacgaacaaacaacagcagcagaaagacaaacaacauuuaaugacaugauaaaaauagcauuagaaaguguauuauuaggagauaaagaauaa

SEQ ID NO: 6609 - protein, 258 aa, Artificial Sequence
  Purine_Nucleoside_Phosphorylase_deoD__Escherichia_coli__F4UXB7
MDLGGALTPPLLCHKKDKTMATPHINAEMGDFADVVLMPGDPLRAKYIAETFLEDAREVNNVRGMLGFTGTYKGRKISVMGHGMGIPSCSIYTKELITDFGVKKIIRVGSCGAVLPHVKLRDVVIGMGACTDSKVNRIRFKDHDFAAIADFDMVRNAVDAAKALGVDARVGNLFSADLFYSPDGEMFDVMEKYGILGVEMEAAGIYGVAAEFGAKALTICTVSDHIRTHEQTTAAERQTTFNDMIKIALESVLLGDKE

SEQ ID NO: 6610 - RNA, 777 nt, Artificial Sequence
  Purine_Nucleoside_Phosphorylase_deoD__Escherichia_coli__EGI42706
auggauuugggcggagcguugacuccgccuuuguuaugucacaaaaaggauaaaacaauggcuaccccacacauuaaugcagaaaugggcgauuucgcugacguaguuuugaugccaggcgacccgcugcgugcgaaguauauugcugaaacuuuccuugaagaugcccgugaagugaauaacguucgcgguaugcugggcuucacugguacuuacaaaggccgcaaaauuuccguaaugggucacgguauggguaucccguccugcuccaucuacaccaaagaacugaucaccgauuucggcgugaagaaaauuauccgcguaggcuccuguggcgcuguucuaccacacguaaaacugcgcgacgucguuaucgguaugggugccugcaccgauuccaaaguuaaccguauccguuuuaaagaccaugacuuugccgcuaucgcugacuuugacauggugcguaacgcgguagacgcggcuaaagcacugggcguugaugcucgcguugguaaccuguucuccgcugaccuguucuacucuccggacggcgaaauguucgacgugauggaaaaauacggcauccucggcguggaaauggaagcagcugguaucuacggcgucgcugcagaauuuggcgcgaaagcccugaccaucugcaccgugucugaccacauccgcacucacgagcagaccacugccgcugagcgucagaccaccuucaacgacaugaucaaaaucgcacuggaauccguucuguugggcgauaaagaguaa

SEQ ID NO: 6611 - RNA, 777 nt, Artificial Sequence
  derived and/or modified sequence opt1 from Purine_Nucleoside_Phosphorylase_deoD__Escherichia_coli__EGI42706
auggaccugggcggggcccucaccccgccccugcugugccacaagaaggacaagaccauggccacgccccacaucaacgcggagaugggcgacuucgccgacgugguccucaugcccggggacccccugcgcgccaaguacaucgccgagaccuuccuggaggacgcccgggaggugaacaacgugcgcggcaugcucggguucaccggcaccuacaagggccggaagaucagcgucauggggcacggcauggggaucccguccugcagcaucuacacgaaggagcugaucaccgacuucggcgugaagaagaucauccgcgugggguccugcggcgcgguccugccccacgugaagcuccgggacguggucaucggcaugggggccugcaccgacagcaaggugaaccgcauccgguucaaggaccacgacuucgccgccaucgcggacuucgacauggugcgcaacgccgucgacgccgccaaggcccugggcguggacgcgcggguggggaaccuguucuccgccgaccucuucuacagccccgacggcgagauguucgacgucauggagaaguacggcauccuggggguggagauggaggccgccggcaucuacgggguggccgcggaguucggcgccaaggcccugaccaucugcacggucuccgaccacauccgcacccacgagcagaccaccgccgccgagcggcagacgaccuucaacgacaugaucaagaucgcgcucgagagcgugcugcugggggacaaggaguga

SEQ ID NO: 6612 - RNA, 777 nt, Artificial Sequence
  derived and/or modified sequence opt2 from Purine_Nucleoside_Phosphorylase_deoD__Escherichia_coli__EGI42706
auggaccucggcggcgcccucacccccccccuccucugccacaagaaggacaagaccauggccaccccccacaucaacgccgagaugggcgacuucgccgacgucguccucaugcccggcgacccccuccgcgccaaguacaucgccgagaccuuccucgaggacgcccgcgaggucaacaacguccgcggcaugcucggcuucaccggcaccuacaagggccgcaagaucuccgucaugggccacggcaugggcauccccuccugcuccaucuacaccaaggagcucaucaccgacuucggcgucaagaagaucauccgcgucggcuccugcggcgccguccucccccacgucaagcuccgcgacgucgucaucggcaugggcgccugcaccgacuccaaggucaaccgcauccgcuucaaggaccacgacuucgccgccaucgccgacuucgacaugguccgcaacgccgucgacgccgccaaggcccucggcgucgacgcccgcgucggcaaccucuucuccgccgaccucuucuacucccccgacggcgagauguucgacgucauggagaaguacggcauccucggcgucgagauggaggccgccggcaucuacggcgucgccgccgaguucggcgccaaggcccucaccaucugcaccgucuccgaccacauccgcacccacgagcagaccaccgccgccgagcgccagaccaccuucaacgacaugaucaagaucgcccucgaguccguccuccucggcgacaaggaguga

SEQ ID NO: 6613 - RNA, 777 nt, Artificial Sequence
  derived and/or modified sequence opt3 from Purine_Nucleoside_Phosphorylase_deoD__Escherichia_coli__EGI42706
auggaccugggcggggcccucacacccccucuucugugccacaagaaagauaagaccauggcuacuccacauaucaacgcagagaugggagacuucgccgauguggucuugaugccgggugaccccuuaagagcgaaauacauugcugaaacguuucuggaggaugccagggaaguuaauaacgugcggggcaugcuaggguucaccggaacauauaagggccgcaaaauaagcguaaugggucacgggaugggaaucccuuccuguucuauuuacacuaaggagcucaucaccgacuuuggcgugaagaaaauuauccgagucggcucaugcggggcagugcugccacauguuaaacuucgugauguggucauaggaaugggugccuguacagacaguaaggugaauagaaucagguucaaggaucacgacuuugcugcaauugccgauuucgacaugguacggaacgcuguugaugccgcgaaagcacugggcguggacgcccgcgucgggaauuuguuuagcgcugaccucuucuauucccccgauggagaaauguuugacgugauggagaaguacggcauccuggguguggagauggaagccgcagggauuuauggagucgcugccgaguucggcgcgaaggcccugaccaucugcacuguuucugaucauauaagaacacacgaacagaccacggcagcugagaggcaaacuaccuuuaacgacaugauuaaaaucgcccucgagucgguguuacugggcgauaaggaauga

SEQ ID NO: 6614 - RNA, 777 nt, Artificial Sequence
  derived and/or modified sequence opt4 from Purine_Nucleoside_Phosphorylase_deoD__Escherichia_coli__EGI42706
auggaccugggcggcgcccugacccccccccugcugugccacaagaaggacaagaccauggccaccccccacaucaacgccgagaugggcgacuucgccgacguggugcugaugcccggcgacccccugagagccaaguacaucgccgagaccuuccuggaggacgccagagaggugaacaacgugagaggcaugcugggcuucaccggcaccuacaagggcagaaagaucagcgugaugggccacggcaugggcauccccagcugcagcaucuacaccaaggagcugaucaccgacuucggcgugaagaagaucaucagagugggcagcugcggcgccgugcugccccacgugaagcugagagacguggugaucggcaugggcgccugcaccgacagcaaggugaacagaaucagauucaaggaccacgacuucgccgccaucgccgacuucgacauggugagaaacgccguggacgccgccaaggcccugggcguggacgccagagugggcaaccuguucagcgccgaccuguucuacagccccgacggcgagauguucgacgugauggagaaguacggcauccugggcguggagauggaggccgccggcaucuacggcguggccgccgaguucggcgccaaggcccugaccaucugcaccgugagcgaccacaucagaacccacgagcagaccaccgccgccgagagacagaccaccuucaacgacaugaucaagaucgcccuggagagcgugcugcugggcgacaaggaguga

SEQ ID NO: 6615 - RNA, 777 nt, Artificial Sequence
  derived and/or modified sequence opt5 from Purine_Nucleoside_Phosphorylase_deoD__Escherichia_coli__EGI42706
auggaccugggcggggcccucacacccccucugcuuugccacaagaaagauaagaccauggcuacgccgcauaucaacgccgagaugggagacuucgcggaugugguccugaugcccggcgacccucucagagcuaaauacauugccgaaaccuuucuggaggaugcccgggaaguuaauaacgugcgcgggaugcuuggauucacaggcaccuauaaggggagaaaaaucagcgugaugggacacggcaugggcauucccuccuguucuaucuacacaaaggagcugauuaccgacuuuggggucaagaaaaucauccgggugggaagcugcggcgcuguucucccucaugugaagcugcgcgaugucgugauugggaugggagccuguacagacuccaaaguuaauagaauccgguucaaggaucacgacuuugcugccauugcggauuucgacauggugcgcaacgccgucgaugcugccaaagcucugggcguggacgccagaguggggaaucucuuuucugcggaccuguucuauagccccgauggagaaauguuugacgucauggagaaguacggcauccuuggcguugagauggaagccgcugggauuuauggaguggccgcugaguucggcgccaaggcccugaccaucugcacgguguccgaucauauucggacccacgaacagacaaccgcugcggagcgccaaacaaccuuuaacgacaugaucaaaaucgcccucgagucuguccugcuuggggauaaggaauga

SEQ ID NO: 6616 - RNA, 777 nt, Artificial Sequence
  derived and/or modified sequence opt6 from Purine_Nucleoside_Phosphorylase_deoD__Escherichia_coli__EGI42706
auggaccuaggaggagcacuaacaccaccacuauuaugccauaaaaaagacaaaacaauggcaacaccacauauaaaugcagaaaugggagacuuugcagauguaguacuaaugccaggagacccacuaagagcaaaauacauagccgaaacauuucuagaagacgcaagagaaguaaauaacguaagaggaauguuaggauuuacagggacauauaaaggaagaaaaauaaguguaaugggacauggaaugggaauaccaucaugcaguauauauacaaaagaauuaauaacggacuuuggaguaaaaaagaucauaagaguaggcucaugcggagcaguacuaccacauguaaaauuaagagauguaguaauaggaaugggagcauguaccgauucaaaagucaauagaauaagauuuaaagaucacgauuucgcggcaauagcagacuuugauaugguaagaaaugcaguagacgcagcaaaagcauuaggaguagacgcaagaguaggaaaucuauuuagcgcagacuuauucuauagcccagacggagaaauguucgauguaauggaaaaauacggaauauuaggaguagaaauggaagcggcaggaauauauggaguagcagcagaauuuggagcaaaagcauuaacaauauguacaguaagcgaucacauaagaacacacgaacaaacaacagcugcagaaagacaaacaacauucaaugacaugauaaaaauagcacuagaaagcguacuacuaggagauaaagaauaa

SEQ ID NO: 6617 - protein, 239 aa, Artificial Sequence; identical to SEQ ID NO: 6193
  Purine_Nucleoside_Phosphorylase_deoD__Escherichia_coli__F4VN60

SEQ ID NO: 6618 - RNA, 720 nt, Artificial Sequence; identical to SEQ ID NO: 6234
  Purine_Nucleoside_Phosphorylase_deoD__Escherichia_coli__EGI43348

SEQ ID NO: 6619 - RNA, 720 nt, Artificial Sequence; identical to SEQ ID NO: 6195
  derived and/or modified sequence opt1 from Purine_Nucleoside_Phosphorylase_deoD__Escherichia_coli__EGI43348

SEQ ID NO: 6620 - RNA, 720 nt, Artificial Sequence; identical to SEQ ID NO: 6196
  derived and/or modified sequence opt2 from Purine_Nucleoside_Phosphorylase_deoD__Escherichia_coli__EGI43348

SEQ ID NO: 6621 - RNA, 720 nt, Artificial Sequence; identical to SEQ ID NO: 6197
  derived and/or modified sequence opt3 from Purine_Nucleoside_Phosphorylase_deoD__Escherichia_coli__EGI43348

SEQ ID NO: 6622 - RNA, 720 nt, Artificial Sequence; identical to SEQ ID NO: 6198
  derived and/or modified sequence opt4 from Purine_Nucleoside_Phosphorylase_deoD__Escherichia_coli__EGI43348

SEQ ID NO: 6623 - RNA, 720 nt, Artificial Sequence; identical to SEQ ID NO: 6199
  derived and/or modified sequence opt5 from Purine_Nucleoside_Phosphorylase_deoD__Escherichia_coli__EGI43348

SEQ ID NO: 6624 - RNA, 720 nt, Artificial Sequence
  derived and/or modified sequence opt6 from Purine_Nucleoside_Phosphorylase_deoD__Escherichia_coli__EGI43348
auggcaacaccacauauuaaugcagaaaugggagacuuugcagauguaguacuaaugccaggagacccauuaagagcaaaauauauagcagaaacauuuuuagaagacgcaagagaaguaaauaacguaagagggauguuaggauuuacaggaacauauaaaggaagaaaaauaucaguaaugggacauggaaugggaauaccaaguugcucaauauauacaaaagaauuaauaacagacuuuggaguaaaaaagauaauaagaguaggaucaugcggagcaguauuaccacacguaaaauuaagagauguagugauaggaaugggagcauguacagauaguaaagucaaucgaauaagauucaaagaucacgauuucgcagcaauagcagauuucgauaugguaagaaaugcaguagacgcagcaaaagcauuaggaauagaugcaagaguaggaaaucuauuuucagcagacuuauucuauagcccagacggagaaauguucgauguaauggaaaaauacggaauacuaggaguagaaauggaagcagcaggaauauauggaguagcagcagaauuuggagcaaaagcacucacaauauguacaguaagcgaucacauaagaacgcacgaacaaacaacagcagcagaaagacaaacaacauucaacgacaugauaaaaauagcauuagaaagcguacuacuaggagacaaagaauaa

SEQ ID NO: 6625 - protein, 239 aa, Artificial Sequence; identical to SEQ ID NO: 6201
  Purine_Nucleoside_Phosphorylase_deoD__Escherichia_coli__F4VQF8

SEQ ID NO: 6626 - RNA, 720 nt, Artificial Sequence; identical to SEQ ID NO: 6290
  Purine_Nucleoside_Phosphorylase_deoD__Escherichia_coli__EGI52751

SEQ ID NO: 6627 - RNA, 720 nt, Artificial Sequence; identical to SEQ ID NO: 6203
  derived and/or modified sequence opt1 from Purine_Nucleoside_Phosphorylase_deoD__Escherichia_coli__EGI52751

SEQ ID NO: 6628 - RNA, 720 nt, Artificial Sequence; identical to SEQ ID NO: 6204
  derived and/or modified sequence opt2 from Purine_Nucleoside_Phosphorylase_deoD__Escherichia_coli__EGI52751

SEQ ID NO: 6629 - RNA, 720 nt, Artificial Sequence; identical to SEQ ID NO: 6205
  derived and/or modified sequence opt3 from Purine_Nucleoside_Phosphorylase_deoD__Escherichia_coli__EGI52751

SEQ ID NO: 6630 - RNA, 720 nt, Artificial Sequence; identical to SEQ ID NO: 6206
  derived and/or modified sequence opt4 from Purine_Nucleoside_Phosphorylase_deoD__Escherichia_coli__EGI52751

SEQ ID NO: 6631 - RNA, 720 nt, Artificial Sequence; identical to SEQ ID NO: 6207
  derived and/or modified sequence opt5 from Purine_Nucleoside_Phosphorylase_deoD__Escherichia_coli__EGI52751

SEQ ID NO: 6632 - RNA, 720 nt, Artificial Sequence
  derived and/or modified sequence opt6 from Purine_Nucleoside_Phosphorylase_deoD__Escherichia_coli__EGI52751
auggcaacaccacauauaaaugcagaaaugggagacuuugccgauguagugcuaaugccaggagacccacuaagagcaaaauacauagcagaaacauuucuagaagacgcaagagaaguaaauaacguaagaggaauguuaggauuuacaggaaccuauaaaggaagaaaaauaucaguaaugggacauggaaugggaauaccaucauguucaauauauacaaaagaauugauaacagacuuuggaguaaaaaaaauaauaagaguaggaucaugcggagcaguauuaccacacguaaaauuaagagauguaguaauaggaaugggagcauguaccgacagcaaaguaaauagaauaagauuuaaagaucaugauuucgcagcaauagcagauuucgauaugguaagaaaugcaguagacgcggcaaaagcauuaggaguagacgcaagaguaggaaaccuauuuagcgcagacuuguuuuauagcccagacggagaaauguuugauguaauggaaaaauacggaauauuaggaguagaaauggaagcagcaggaauauauggaguagcagcagaauuuggagcaaaagcguuaacaauauguacaguaagugaucacauaagaacacacgaacaaacaacagcagcagaaagacaaacaacauucaaugacaugauaaagauagcacuagaaagcguacuauugggagauaaagaauaa

SEQ ID NO: 6633 - protein, 239 aa, Artificial Sequence; identical to SEQ ID NO: 6201
  Purine_Nucleoside_Phosphorylase_deoD__Escherichia_coli__H9V0H4

SEQ ID NO: 6634 - RNA, 720 nt, Artificial Sequence
  Purine_Nucleoside_Phosphorylase_deoD__Escherichia_coli__AFG43267
auggcuaccccacacauuaaugcagaaaugggcgauuucgcugacguaguuuugaugccaggcgacccgcugcgugcgaaguauauugcugaaacuuuccuugaagaugcccgugaagugaacaacguucgcgguaugcugggcuucaccgguacuuacaaaggccgcaaaauuuccguaaugggucacgguauggguaucccguccugcuccaucuacaccaaagaacugaucaccgauuucggcgugaagaaaauuauccgcguaggcuccuguggcgcuguucugccacacguaaaacugcgcgacgucguuaucgguaugggugccugcaccgauuccaaaguuaaccguauccguuuuaaagaccaugacuuugccgcuaucgcugacuuugacauggugcguaacgcgguagacgcggcuaaagcacugggcguugaugcucgcguugguaaccuguucuccgcugaccuguucuacucuccggacggcgaaauguucgacgugauggaaaaauacggcauccucggcguggaaauggaagcagcugguaucuacggcgucgcugcagaauuuggcgcgaaagcccugaccaucugcaccgugucugaccacauccgcacucacgagcagaccacugccgcugagcgucagaccaccuucaacgacaugaucaaaaucgcacuggaauccguucuguugggcgauaaagaguaa

SEQ ID NO: 6635 - RNA, 720 nt, Artificial Sequence; identical to SEQ ID NO: 6203
  derived and/or modified sequence opt1 from Purine_Nucleoside_Phosphorylase_deoD__Escherichia_coli__AFG43267

SEQ ID NO: 6636 - RNA, 720 nt, Artificial Sequence; identical to SEQ ID NO: 6204
  derived and/or modified sequence opt2 from Purine_Nucleoside_Phosphorylase_deoD__Escherichia_coli__AFG43267

SEQ ID NO: 6637 - RNA, 720 nt, Artificial Sequence; identical to SEQ ID NO: 6205
  derived and/or modified sequence opt3 from Purine_Nucleoside_Phosphorylase_deoD__Escherichia_coli__AFG43267

SEQ ID NO: 6638 - RNA, 720 nt, Artificial Sequence; identical to SEQ ID NO: 6206
  derived and/or modified sequence opt4 from Purine_Nucleoside_Phosphorylase_deoD__Escherichia_coli__AFG43267

SEQ ID NO: 6639 - RNA, 720 nt, Artificial Sequence; identical to SEQ ID NO: 6207
  derived and/or modified sequence opt5 from Purine_Nucleoside_Phosphorylase_deoD__Escherichia_coli__AFG43267

SEQ ID NO: 6640 - RNA, 720 nt, Artificial Sequence
  derived and/or modified sequence opt6 from Purine_Nucleoside_Phosphorylase_deoD__Escherichia_coli__AFG43267
auggcaacaccacauauuaaugcagaaaugggagacuuugcagauguaguauuaaugccaggggacccauuaagagcaaaauacauagcagaaacauuucuagaagacgcaagagaaguaaacaauguaagaggaauguuaggauuuacaggaacauauaaaggaagaaaaauaucaguaaugggacauggaaugggaauaccaucaugcucaauauauacaaaagaauuaauaacagacuuuggaguaaaaaaaauaauaagaguuggaucaugcggagcaguacuaccacacguaaaauuaagagauguaguaauaggaaugggggcauguacagauagcaaaguaaauagaauaagauuuaaagaucacgauuuugcagcaauagcagauuucgauaugguacgaaaugccguggacgcagcaaaagcauuaggaguagacgcaagaguaggaaaucuauuuagcgcagacuuauucuauaguccagacggagaaauguucgauguaauggaaaaauacggaauauuaggaguagaaauggaagcagcaggaauauacggaguagcagcagaauuuggagcaaaagcgcuaacaauaugcacaguaagugaucacauaagaacgcacgaacaaacaacagcagcagaaagacaaacaacauucaaugacaugauaaaaauagcacuagaaagcguauuauuaggcgauaaagaauaa

SEQ ID NO: 6641 - protein, 239 aa, Artificial Sequence; identical to SEQ ID NO: 6193
  Purine_Nucleoside_Phosphorylase_deoD__Escherichia_coli__J7QV83

SEQ ID NO: 6642 - RNA, 720 nt, Artificial Sequence; identical to SEQ ID NO: 6330
  Purine_Nucleoside_Phosphorylase_deoD__Escherichia_coli__CCK49767

SEQ ID NO: 6643 - RNA, 720 nt, Artificial Sequence; identical to SEQ ID NO: 6195
  derived and/or modified sequence opt1 from Purine_Nucleoside_Phosphorylase_deoD__Escherichia_coli__CCK49767

SEQ ID NO: 6644 - RNA, 720 nt, Artificial Sequence; identical to SEQ ID NO: 6196
  derived and/or modified sequence opt2 from Purine_Nucleoside_Phosphorylase_deoD__Escherichia_coli__CCK49767

SEQ ID NO: 6645 - RNA, 720 nt, Artificial Sequence; identical to SEQ ID NO: 6197
  derived and/or modified sequence opt3 from Purine_Nucleoside_Phosphorylase_deoD__Escherichia_coli__CCK49767

SEQ ID NO: 6646 - RNA, 720 nt, Artificial Sequence; identical to SEQ ID NO: 6198
  derived and/or modified sequence opt4 from Purine_Nucleoside_Phosphorylase_deoD__Escherichia_coli__CCK49767

SEQ ID NO: 6647 - RNA, 720 nt, Artificial Sequence; identical to SEQ ID NO: 6199
  derived and/or modified sequence opt5 from Purine_Nucleoside_Phosphorylase_deoD__Escherichia_coli__CCK49767

SEQ ID NO: 6648 - RNA, 720 nt, Artificial Sequence
  derived and/or modified sequence opt6 from Purine_Nucleoside_Phosphorylase_deoD__Escherichia_coli__CCK49767
auggcaacaccacauauaaaugcugaaaugggagauuuugcagauguaguacugaugccaggugauccacuaagagcaaaauacauagcagaaacauuuuuagaagacgcaagagaagugaauaacguaagaggaauguugggauuuacagggacauauaaaggaagaaaaauaucaguaaugggacauggaaugggaauaccaucauguaguauauauacaaaagaauuaauaacagacuuuggaguaaaaaaaauaauaagaguaggaaguugcggagcaguauuaccacacguaaaauuaagagaugucguaauaggaaugggagcauguacagauaguaaaguaaauagaauaagauuuaaagaucacgauuuugcagccauagcagauuuugauaugguaagaaaugcaguagacgcagcaaaagcauuaggaauagacgcaagaguaggaaauuuauuuagugcagacuuauucuauaguccagacggagaaauguucgauguaauggaaaaauacggaauacuaggaguagaaauggaagcagcaggaauauauggaguagcagcagaauuuggagcaaaagcacuaacaauauguacaguaagcgaucacauaagaacacacgaacaaacaacagcagcagaaagacaaacaacauucaaugacaugauaaaaauagcauuagaaagcguacuauuaggagauaaagaauaa

SEQ ID NO: 6649 - protein, 239 aa, Artificial Sequence; identical to SEQ ID NO: 6193
  Purine_Nucleoside_Phosphorylase_deoD__Escherichia_coli__P0ABP8

SEQ ID NO: 6650 - RNA, 720 nt, Artificial Sequence; identical to SEQ ID NO: 6338
  Purine_Nucleoside_Phosphorylase_deoD__Escherichia_coli__AAA24401

SEQ ID NO: 6651 - RNA, 720 nt, Artificial Sequence; identical to SEQ ID NO: 6195
  derived and/or modified sequence opt1 from Purine_Nucleoside_Phosphorylase_deoD__Escherichia_coli__AAA24401

SEQ ID NO: 6652 - RNA, 720 nt, Artificial Sequence; identical to SEQ ID NO: 6196
  derived and/or modified sequence opt2 from Purine_Nucleoside_Phosphorylase_deoD__Escherichia_coli__AAA24401

SEQ ID NO: 6653 - RNA, 720 nt, Artificial Sequence; identical to SEQ ID NO: 6197
  derived and/or modified sequence opt3 from Purine_Nucleoside_Phosphorylase_deoD__Escherichia_coli__AAA24401

SEQ ID NO: 6654 - RNA, 720 nt, Artificial Sequence; identical to SEQ ID NO: 6198
  derived and/or modified sequence opt4 from Purine_Nucleoside_Phosphorylase_deoD__Escherichia_coli__AAA24401

SEQ ID NO: 6655 - RNA, 720 nt, Artificial Sequence; identical to SEQ ID NO: 6199
  derived and/or modified sequence opt5 from Purine_Nucleoside_Phosphorylase_deoD__Escherichia_coli__AAA24401

SEQ ID NO: 6656 - RNA, 720 nt, Artificial Sequence
  derived and/or modified sequence opt6 from Purine_Nucleoside_Phosphorylase_deoD__Escherichia_coli__AAA24401
auggcaacaccacauauaaaugcagaaaugggggacuuugcagauguaguauuaaugccuggggacccacuaagagcaaaauacauagcagaaacauuucuagaagacgcaagagaaguaaauaauguaagaggaauguuaggauuuacaggaacauauaaaggacgaaaaauaucaguaaugggccauggaaugggaauacccucaugcaguauauauacaaaagaauuaauaacagacuuuggaguaaaaaaaaucauaagaguaggaagcugcggagcaguacuaccgcacguaaaacuacgagauguaguaauaggaaugggggcauguacagauaguaaaguaaauagaauaagauuuaaagaucacgauuucgcagcaauagcagauuucgauaugguaagaaaugcaguagacgcagcaaaagcauuaggaauagacgcaaggguaggaaauuuauuuagcgcagacuuauucuauagcccagacggagaaauguucgauguaauggaaaaauauggaauacuaggaguagaaauggaagcagcaggaauauauggaguagcagcagaauuuggugcaaaagcacuaacaauauguacaguaagcgaucacauaagaacacacgaacaaacaacagcagcagaaagacaaacaacauucaaugacaugauaaaaauagcacuagaaagcguauuauuaggagauaaagaauaa

SEQ ID NO: 6657 - protein, 239 aa, Artificial Sequence; identical to SEQ ID NO: 6201
  Purine_Nucleoside_Phosphorylase_deoD__Escherichia_coli__Q0T8S9

SEQ ID NO: 6658 - RNA, 720 nt, Artificial Sequence
  Purine_Nucleoside_Phosphorylase_deoD__Escherichia_coli__ABG72650
auggcuacuccacacauuaaugcagaaaugggcgauuuugcugacguaguuuugaugccaggcgacccgcugcgugcgaaguauauugcugaaacuuuccuugaagaugcccgugaagugaacaacguucgcgguaugcugggcuucacugguacuuacaaaggccgcaaaauuuccguaaugggccacgguauggguaucccguccugcuccaucuacaccaaagaacugaucacugauuucggcgugaagaaaauuauccgcguugguuccuguggcgcuguucugccgcacguaaaacugcgcgacgucguuaucgguaugggugccugcaccgauuccaaaguuaaccgcauccguuuuaaagaccaugacuuugccgcuaucgcugacuucgacauggugcguaacgcgguagacgcggcaaaagcacugggcguugaugcucgcguugguaaccuguucuccgcugaccuguucuacucuccggacggcgaaauguucgacgugauggaaaaauacggcauccucggcguggaaauggaagcggcugguaucuacggcgucgcugcagaauuuggcgcgaaagcccugaccaucugcaccgugucugaccacauccgcacucacgagcagaccacugccgcugagcgucagaccaccuucaacgacaugaucaaaaucgcgcuggaauccguucugcugggcgauaaagaguaa

SEQ ID NO: 6659 - RNA, 720 nt, Artificial Sequence; identical to SEQ ID NO: 6203
  derived and/or modified sequence opt1 from Purine_Nucleoside_Phosphorylase_deoD__Escherichia_coli__ABG72650

SEQ ID NO: 6660 - RNA, 720 nt, Artificial Sequence; identical to SEQ ID NO: 6204
  derived and/or modified sequence opt2 from Purine_Nucleoside_Phosphorylase_deoD__Escherichia_coli__ABG72650

SEQ ID NO: 6661 - RNA, 720 nt, Artificial Sequence; identical to SEQ ID NO: 6205
  derived and/or modified sequence opt3 from Purine_Nucleoside_Phosphorylase_deoD__Escherichia_coli__ABG72650

SEQ ID NO: 6662 - RNA, 720 nt, Artificial Sequence; identical to SEQ ID NO: 6206
  derived and/or modified sequence opt4 from Purine_Nucleoside_Phosphorylase_deoD__Escherichia_coli__ABG72650

SEQ ID NO: 6663 - RNA, 720 nt, Artificial Sequence; identical to SEQ ID NO: 6207
  derived and/or modified sequence opt5 from Purine_Nucleoside_Phosphorylase_deoD__Escherichia_coli__ABG72650

SEQ ID NO: 6664 - RNA, 720 nt, Artificial Sequence
  derived and/or modified sequence opt6 from Purine_Nucleoside_Phosphorylase_deoD__Escherichia_coli__ABG72650
auggcaacaccacauauaaaugcagaaaugggagacuuugcagauguaguauuaaugccaggagacccacuaagagcaaaauacauagcagaaacauuucuagaagacgcaagagaaguaaauaacguaagaggaaugcuaggauuuacaggaacauauaaaggaagaaaaauaucagucaugggacauggaaugggaauaccaucaugcucaauauacaccaaagaauuaauaacagacuuuggaguaaaaaaaauaauaagaguaggcaguugcggagcaguacuaccacacguaaaauuacgagaugucguaauaggaaugggagcauguacagauucaaaaguaaauagaauaagauuuaaagaucacgauuucgcagcaauagcagauuucgauaugguaagaaaugcuguagacgcagcaaaagcauuaggaguagacgcaagaguaggaaaucuauuuagcgcagacuuauucuauagcccagacggagaaauguucgauguaauggaaaaauauggaauauuaggaguagaaauggaagcagcaggaauauauggaguagccgcagaauuuggagcaaaagcacuaacaauauguacaguaagcgaucacauaagaacacacgaacaaacaaccgcagcagaaagacaaacaacauucaaugacaugauaaaaauagcacuagaaaguguacuauugggagauaaagaauga

SEQ ID NO: 6665 - protein, 258 aa, Artificial Sequence; identical to SEQ ID NO: 6313
  Purine_Nucleoside_Phosphorylase_deoD__Escherichia_coli__Q1R259

SEQ ID NO: 6666 - RNA, 777 nt, Artificial Sequence; identical to SEQ ID NO: 6314
  Purine_Nucleoside_Phosphorylase_deoD__Escherichia_coli__ABE10555

SEQ ID NO: 6667 - RNA, 777 nt, Artificial Sequence; identical to SEQ ID NO: 6315
  derived and/or modified sequence opt1 from Purine_Nucleoside_Phosphorylase_deoD__Escherichia_coli__ABE10555

SEQ ID NO: 6668 - RNA, 777 nt, Artificial Sequence; identical to SEQ ID NO: 6316
  derived and/or modified sequence opt2 from Purine_Nucleoside_Phosphorylase_deoD__Escherichia_coli__ABE10555

SEQ ID NO: 6669 - RNA, 777 nt, Artificial Sequence; identical to SEQ ID NO: 6317
  derived and/or modified sequence opt3 from Purine_Nucleoside_Phosphorylase_deoD__Escherichia_coli__ABE10555

SEQ ID NO: 6670 - RNA, 777 nt, Artificial Sequence; identical to SEQ ID NO: 6318
  derived and/or modified sequence opt4 from Purine_Nucleoside_Phosphorylase_deoD__Escherichia_coli__ABE10555

SEQ ID NO: 6671 - RNA, 777 nt, Artificial Sequence; identical to SEQ ID NO: 6319
  derived and/or modified sequence opt5 from Purine_Nucleoside_Phosphorylase_deoD__Escherichia_coli__ABE10555

SEQ ID NO: 6672 - RNA, 777 nt, Artificial Sequence
  derived and/or modified sequence opt6 from Purine_Nucleoside_Phosphorylase_deoD__Escherichia_coli__ABE10555
auggaucuaggaggagcaguaacaccaccauuaauaugccauaaaaaagacaaaaugauggcuacaccccauauaaaugcagaaaugggagacuucgccgauguaguacuaaugccaggagacccacuaagagcaaaauacauagcagaaacauucuuagaagacgcaagagaaguaaauaacguaagaggaaugcuaggauuuacaggaacauauaaaggaagaaaaauaucaguaaugggacauggaaugggaauaccaucaugcucaauauauacaaaagaauugauaacagacuuuggaguaaaaaaaauaauaagaguaggaaguugcggagcagugcuaccgcacguaaaauuaagagauguaguaauaggaaugggagcauguacagauagcaaaguaaauagaauaagauuuaaagaucacgauuucgcagcaauagcagauuuugauaugguaagaaaugcaguagacgcugcaaaagcauuaggaguagacgcaagaguaggaaaucuauuuagcgcagacuuauucuauaguccagacggagaaauguuugacguaauggaaaaauacggaauauuagguguagaaauggaagcagcaggaauauaugguguagcagcagaauuuggagcaaaagcacuaacaauauguacaguaagcgaucacauaagaacacacgaacaaacaacagcagcagaaaggcaaacaacauuuaaugacaugauaaaaauagcauuagaaaguguacuauuaggagauaaagaauaa

SEQ ID NO: 6673 - protein, 258 aa, Artificial Sequence; identical to SEQ ID NO: 6593
  Purine_Nucleoside_Phosphorylase_deoD__Escherichia_coli__W8ZSE4

SEQ ID NO: 6674 - RNA, 777 nt, Artificial Sequence; identical to SEQ ID NO: 6594
  Purine_Nucleoside_Phosphorylase_deoD__Escherichia_coli__CDN85331

SEQ ID NO: 6675 - RNA, 777 nt, Artificial Sequence; identical to SEQ ID NO: 6595
  derived and/or modified sequence opt1 from Purine_Nucleoside_Phosphorylase_deoD__Escherichia_coli__CDN85331

SEQ ID NO: 6676 - RNA, 777 nt, Artificial Sequence; identical to SEQ ID NO: 6596
  derived and/or modified sequence opt2 from Purine_Nucleoside_Phosphorylase_deoD__Escherichia_coli__CDN85331

SEQ ID NO: 6677 - RNA, 777 nt, Artificial Sequence; identical to SEQ ID NO: 6597
  derived and/or modified sequence opt3 from Purine_Nucleoside_Phosphorylase_deoD__Escherichia_coli__CDN85331

SEQ ID NO: 6678 - RNA, 777 nt, Artificial Sequence; identical to SEQ ID NO: 6598
  derived and/or modified sequence opt4 from Purine_Nucleoside_Phosphorylase_deoD__Escherichia_coli__CDN85331

SEQ ID NO: 6679 - RNA, 777 nt, Artificial Sequence; identical to SEQ ID NO: 6599
  derived and/or modified sequence opt5 from Purine_Nucleoside_Phosphorylase_deoD__Escherichia_coli__CDN85331

SEQ ID NO: 6680 - RNA, 777 nt, Artificial Sequence
  derived and/or modified sequence opt6 from Purine_Nucleoside_Phosphorylase_deoD__Escherichia_coli__CDN85331
auggauuuaggaggagcaguaacaccaccacuaauaugccauaaaaaagauaaaacaauggcgacaccacauaucaaugcagagaugggugacuuugcagauguaguacuaaugccaggagauccacuaagggcaaaauauauagcagaaacauuucuagaagacgcaagagaaguaaauaauguaagaggaauguuaggauuuacaggaacauauaaagguagaaaaauaucaguaaugggacauggaaugggaauaccaaguugcaguauauauacaaaagaauuaauaacagacuuuggaguaaaaaaaauaauaagaguaggaaguugcggagcaguauuaccacacguaaaauuaagagauguaguaauaggaaugggggcguguacagauagcaaagucaacagaauaagauuuaaagaucacgauuucgcagcaauagcagacuucgauaugguaagaaaugcaguagacgcagcaaaagcauuaggaguagacgcaagaguaggcaaucuauuuagcgcagaccuauucuauucaccagacggagaaauguucgauguaauggaaaaauacggaauauuaggaguagaaauggaagcagcaggaauauauggaguagcagcagaauuuggagcaaaagcacuaacaauauguacaguuagcgaucauauuagaacacacgaacaaacaacagcagcagaaagacaaacaacauucaaugacaugauaaagauagcacuagaaaguguauuauuaggagauaaagaauaa

SEQ ID NO: 6681 - protein, 221 aa, Artificial Sequence
  Purine_Nucleoside_Phosphorylase_deoD__Escherichia_coli__X5FDR9
MKKDMDINIDALLRDTFLTVVELRQGTTVRHGIELYRHCQRQVELVRERLKDAGFSRENVEHITYAQCALLDETVLSRSGMDDGQAIWMKNPLQSHFFNTLQAGELLYERMKQVLQEPAPAQAVLTCFHRVLLLGFRGRYQDPAAPERDQLISTLNGQVAPFGVLPETAVLNVPLSTRQHPLLHSPFFWLVTLALLLAGVWWGLHHWLNVLVDELLPQSLR

SEQ ID NO: 6682 - RNA, 666 nt, Artificial Sequence
  Purine_Nucleoside_Phosphorylase_deoD__Escherichia_coli__AHW84482
augaaaaaagauauggauaucaauaucgaugcgcugcugcgcgacacguuucugacggugguggaacugcgucagggaaccaccgugcgucacgguaucgagcuguaucgccacugucagcggcagguggaacugguccgcgaacgucugaaagaugccggauucagucgggagaacguggagcacauaacuuacgcgcagugcgcccugcuggacgaaacggugcucagccguaguggcauggacgacggucaggccaucuggaugaaaaacccacuccagucgcauuucuucaacacccugcaggccggugagcugcuguacgagcggaugaagcaggugcuacaggaacccgcccccgcgcaggccgugcugaccugcuuucaccguguccugcugcugggauuucgcgggcguuaucaggauccggcagccccggagcgcgaccagcuuauuucgacgcucaacgggcaggucgcgccauuuggugugcugccggaaacggcgguacugaacgugccguuauccacccgucagcacccuuugcugcauucgccauuuuucuggcugguaacacuggcgcugcuacuggcgggcgucuggugggggcuacaccacuggcugaauguacugguggaugaacugcugccgcaaagccugcguuaa

SEQ ID NO: 6683 - RNA, 666 nt, Artificial Sequence
  derived and/or modified sequence opt1 from Purine_Nucleoside_Phosphorylase_deoD__Escherichia_coli__AHW84482
augaagaaggacauggacaucaacaucgacgcccugcuccgcgacaccuuccugaccguggucgagcugcggcagggcacgaccgugcgccacgggaucgagcucuaccggcacugccagcgccagguggagcugguccgggagcgccugaaggacgccggcuucagccgggagaacguggagcacaucaccuacgcgcagugcgcccuccuggacgagaccgugcugucccgcagcgggauggacgacggccaggccaucuggaugaagaacccccuccagucccacuucuucaacacgcugcaggccggggagcugcucuacgagcggaugaagcagguccugcaggagccggcccccgcgcaggccgugcugaccugcuuccaccgcgugcuccugcugggcuuccggggccgcuaccaggaccccgccgcccccgagcgggaccagcucaucagcacccugaacgggcaggucgcgccguucggcgugcugcccgagaccgccgugcucaacgucccccuguccacgcgccagcacccccugcuccacagcccguucuucuggcuggugacccuggcccuccugcuggccggggugugguggggccuccaccacuggcugaacguccugguggacgagcuccugccccagucccugcgguga

SEQ ID NO: 6684 - RNA, 666 nt, Artificial Sequence
  derived and/or modified sequence opt2 from Purine_Nucleoside_Phosphorylase_deoD__Escherichia_coli__AHW84482
augaagaaggacauggacaucaacaucgacgcccuccuccgcgacaccuuccucaccgucgucgagcuccgccagggcaccaccguccgccacggcaucgagcucuaccgccacugccagcgccaggucgagcucguccgcgagcgccucaaggacgccggcuucucccgcgagaacgucgagcacaucaccuacgcccagugcgcccuccucgacgagaccguccucucccgcuccggcauggacgacggccaggccaucuggaugaagaacccccuccagucccacuucuucaacacccuccaggccggcgagcuccucuacgagcgcaugaagcagguccuccaggagcccgcccccgcccaggccguccucaccugcuuccaccgcguccuccuccucggcuuccgcggccgcuaccaggaccccgccgcccccgagcgcgaccagcucaucuccacccucaacggccaggucgcccccuucggcguccuccccgagaccgccguccucaacgucccccucuccacccgccagcacccccuccuccacucccccuucuucuggcucgucacccucgcccuccuccucgccggcgucugguggggccuccaccacuggcucaacguccucgucgacgagcuccucccccagucccuccgcuga

SEQ ID NO: 6685 - RNA, 666 nt, Artificial Sequence
  derived and/or modified sequence opt3 from Purine_Nucleoside_Phosphorylase_deoD__Escherichia_coli__AHW84482
augaagaaggacauggauaucaacauugacgcccugcucagagauaccuuccuuacaguggucgagcugaggcagggcacuacgguucggcacgggauagaauuguaccgccauugccaacgacagguggaguuaguacgugaaagacugaaggacgcuggauuuagcagggagaauguggaacacaucaccuaugcacagugugcccuacucgaugagacaguccugucccggucugguauggacgauggccaggcgauuuggaugaaaaacccccuucaaucacauuucuuuaauacucugcaggcuggggaguugcucuacgaacgcaugaaacaggugcugcaggagccugccccagcacaagccguucugaccugcuuccacagagugcucuuacugggauuuaggggccgguaucaggacccggcugcacccgaacgcgaucagcuuaucaguacauugaacggucaggucgccccuuucggggugcugccagagaccgcuguacuaaauguuccccucagcacucgacaacauccucugcuucacuccccauuuuucuggcuggugacauuggcccuccuguuagcgggagucugguggggccugcaccauuggcucaacgugcuuguggacgagcuguugccccagucucuaagauga

SEQ ID NO: 6686 - RNA, 666 nt, Artificial Sequence
  derived and/or modified sequence opt4 from Purine_Nucleoside_Phosphorylase_deoD__Escherichia_coli__AHW84482
augaagaaggacauggacaucaacaucgacgcccugcugagagacaccuuccugaccgugguggagcugagacagggcaccaccgugagacacggcaucgagcuguacagacacugccagagacagguggagcuggugagagagagacugaaggacgccggcuucagcagagagaacguggagcacaucaccuacgcccagugcgcccugcuggacgagaccgugcugagcagaagcggcauggacgacggccaggccaucuggaugaagaacccccugcagagccacuucuucaacacccugcaggccggcgagcugcuguacgagagaaugaagcaggugcugcaggagcccgcccccgcccaggccgugcugaccugcuuccacagagugcugcugcugggcuucagaggcagauaccaggaccccgccgcccccgagagagaccagcugaucagcacccugaacggccagguggcccccuucggcgugcugcccgagaccgccgugcugaacgugccccugagcaccagacagcacccccugcugcacagccccuucuucuggcuggugacccuggcccugcugcuggccggcgugugguggggccugcaccacuggcugaacgugcugguggacgagcugcugccccagagccugagauga

SEQ ID NO: 6687 - RNA, 666 nt, Artificial Sequence
  derived and/or modified sequence opt5 from Purine_Nucleoside_Phosphorylase_deoD__Escherichia_coli__AHW84482
augaagaaagacauggauaucaacauugacgcccugcucagagauaccuuccugacaguggucgagcuucggcagggcacgaccguucgccacgggaucgaacuguacagacauugccaacgccagguggagcucgugcgggaaagacugaaggacgcuggauuuagccgggagaaugucgaacacauuacauaugcccagugugcgcuucuggaugagaccgugcucucccgcucuggcauggacgaugggcaggcuaucuggaugaaaaacccccugcaaagccauuucuuuaauacacugcaggccggagagcuccuguacgaaagaaugaagcagguucuucaggagccugccccggcucaagccgugcugaccugcuuccaccggguccuccugcuuggcuuucgcgggagauaucaggaccccgcugccccugaacgggaucagcugauuuccacacucaacggacagguggcgcccuucggcguucugccugagaccgccgugcugaaugucccccucucuacgcgccaacauccucugcuucacagcccguuuuucuggcuggugacccucgcucugcuucuggccggcguguggugggggcuccaccauuggcugaacguccugguugacgagcuccugccccagucccuuagauga

SEQ ID NO: 6688 - RNA, 666 nt, Artificial Sequence
  derived and/or modified sequence opt6 from Purine_Nucleoside_Phosphorylase_deoD__Escherichia_coli__AHW84482
augaaaaaagacauggauauaaacauagacgcauuacuaagagacacauucuuaacaguaguagaauuaagacaaggaacaacaguuagacacggaauagaacuauacagacacugccaaagacaaguagaacuaguaagagaaagauuaaaagacgcaggauucagcagagaaaauguagaacacauaacauacgcacaaugcgcacuccuagaugaaacaguccuaucuagaucaggaauggacgacggacaagcaauauggaugaaaaacccacuacaaucacacuucuucaacacacuacaagcaggagaauuacuauacgaaagaaugaaacaaguacuacaagaaccagcaccagcccaagcaguacuaacaugcuuucacagaguacuacuacuaggcuuuagaggaagauaccaagacccagcugcaccagaaagagaucaacuaauuucaacauuaaacggacaaguagcaccauucggaguacuaccagaaacagcagucuuaaauguaccacuaucaacaagacaacacccacuauuacacucaccauucuucugguuaguaacacuagcccuacuacuagcaggaguaugguggggacuacaccacuggcuaaacguacuaguagacgaacuacuaccacaaucacuaagauaa

SEQ ID NO: 6689 - protein, 376 aa, Artificial Sequence
  Thymidine_Kinase_TK__Herpes_Simplex_Virus_1_(HSV-1)__B2CPP5
MASYPCHQHASAFDQAARSRGHNNRRTALRPRRQQKATEVRLEQKMPTLLRVYIDGPHGMGKTTTTQLLVALGSRDDIVYVPEPMTYWRVLGASETIANIYTTQHRLDQGEISAGDAAVVMTSAQITMGMPYAVTDAVLAPHIGGEAGSSHAPPPALTLIFDRHPIAALLCYPAARYRMGSMTPQAVLAFVALIPPTLPGTNIVLGALPEDRHIDRLAKRQRPGERLDLAMLAAIRRVYELLANTVRYLQGGGSWREDWGQLSGTAVPPQGAEPQSNAGPQPHIGDTLFTLFRAPELLAPNGDLYNVFAWALDVLAKRLRPMHVFILDYDQSPAGCRDALLQLTSGMVQTHVTTPGSIPTICDLARTFAREMGEAN

SEQ ID NO: 6690 - RNA, 1131 nt, Artificial Sequence
  Thymidine_Kinase_TK__Herpes_Simplex_Virus_1_(HSV-1)__ACB59251
auggcuucguaccccugccaucaacacgcgucggcguucgaccaggcugcgcguucucgcggccauaacaaccgacguacggcguugcgcccucgccggcagcaaaaagccacggaaguccgccuggagcagaaaaugcccacgcuacugcggguuuauauagacgguccccacgggauggggaaaaccaccaccacgcaacugcugguggcccuggguucgcgcgacgauaucgucuacguacccgagccgaugacuuacuggcgggugcugggggcuuccgagacaaucgcgaacaucuacaccacacaacaccgccucgaccagggugagauaucggccggggacgcggcggugguaaugacaagcgcccagauaacaaugggcaugccuuaugccgugaccgacgccguucuggcuccucauaucgggggggaggcugggagcucacaugccccgcccccggcccucacccucaucuucgaccgccaucccaucgccgcccuccuguguuacccggccgcgcgauaccguaugggcagcaugaccccccaggccgugcuggcguucguggcccucaucccgccgaccuugcccggcacaaacaucguguugggggcccuuccggaggacagacacaucgaccgccuggccaaacgccagcgccccggcgagcggcuugaccuggcuaugcuggccgcgauucgccgcguuuacgagcugcuugccaauacggugcgguaucugcagggcggcgggucguggcgggaggauuggggacagcuuucggggacggccgugccgccccagggugccgagccccagagcaacgcgggcccacaaccccauaucggggacacguuauuuacccuguuucgggcccccgaguugcuggcccccaacggcgaccuguauaacguguuugccugggccuuggacgucuuggccaaacgccuccgucccaugcacgucuuuauccuggauuacgaccaaucgcccgccggcugccgggacgcccugcugcaacuuaccuccgggaugguccagacccacgucaccacccccggcuccauaccgacgaucugcgaccuggcgcgcacguuugcccgggagaugggggaggcuaacuaa

SEQ ID NO: 6691 - RNA, 1131 nt, Artificial Sequence
  derived and/or modified sequence opt1 from Thymidine_Kinase_TK__Herpes_Simplex_Virus_1_(HSV-1)__ACB59251
auggccagcuaccccugccaccagcacgccuccgcguucgaccaggccgcccgcagccggggccacaacaaccgccggaccgcccugcgcccgcggcgccagcagaaggccaccgaggugcggcucgagcagaagaugcccacgcugcugcgcgucuacaucgacgggccccacggcauggggaagaccaccaccacgcagcuccugguggcgcugggcucccgggacgacaucguguacguccccgagccgaugaccuacuggcgcgugcucggggccagcgagaccaucgccaacaucuacaccacgcagcaccggcuggaccagggcgagaucuccgccggcgacgcggccguggucaugaccagcgcccagaucaccauggggaugcccuacgccgugaccgacgccgugcuggcgccccacaucggcggggaggccggcuccagccacgcgcccccgcccgcccucacgcugaucuucgaccgccaccccaucgccgcccugcucugcuaccccgccgcccgguaccgcaugggguccaugaccccgcaggccguccuggccuucguggcgcugaucccgcccacccuccccggcaccaacaucgugcugggcgcccugcccgaggaccggcacaucgaccgccucgccaagcggcagcgccccggggagcggcuggaccuggccaugcucgccgcgauccgccgggucuacgagcugcuggccaacacggugcgcuaccuccagggcgggggcagcuggcgcgaggacuggggccagcuguccgggaccgccgugccgccccagggcgccgagccccagagcaacgcggggccccagccccacaucggcgacacccuguucacccucuuccgggcccccgagcugcuggccccgaacggggaccucuacaacgucuucgccugggcccuggacgugcuggcgaagcgccuccggcccaugcacguguucauccuggacuacgaccagucccccgccggcugccgcgacgcccugcuccagcugacgagcggcaugguccagacccacgugaccacccccggguccaucccgacgaucugcgaccuggcccggaccuucgcccgcgagaugggcgaggcgaacuga

SEQ ID NO: 6692 - RNA, 1131 nt, Artificial Sequence
  derived and/or modified sequence opt2 from Thymidine_Kinase_TK__Herpes_Simplex_Virus_1_(HSV-1)__ACB59251
auggccuccuaccccugccaccagcacgccuccgccuucgaccaggccgcccgcucccgcggccacaacaaccgccgcaccgcccuccgcccccgccgccagcagaaggccaccgagguccgccucgagcagaagaugcccacccuccuccgcgucuacaucgacggcccccacggcaugggcaagaccaccaccacccagcuccucgucgcccucggcucccgcgacgacaucgucuacguccccgagcccaugaccuacuggcgcguccucggcgccuccgagaccaucgccaacaucuacaccacccagcaccgccucgaccagggcgagaucuccgccggcgacgccgccgucgucaugaccuccgcccagaucaccaugggcaugcccuacgccgucaccgacgccguccucgccccccacaucggcggcgaggccggcuccucccacgcccccccccccgcccucacccucaucuucgaccgccaccccaucgccgcccuccucugcuaccccgccgcccgcuaccgcaugggcuccaugaccccccaggccguccucgccuucgucgcccucaucccccccacccuccccggcaccaacaucguccucggcgcccuccccgaggaccgccacaucgaccgccucgccaagcgccagcgccccggcgagcgccucgaccucgccaugcucgccgccauccgccgcgucuacgagcuccucgccaacaccguccgcuaccuccagggcggcggcuccuggcgcgaggacuggggccagcucuccggcaccgccguccccccccagggcgccgagccccaguccaacgccggcccccagccccacaucggcgacacccucuucacccucuuccgcgcccccgagcuccucgcccccaacggcgaccucuacaacgucuucgccugggcccucgacguccucgccaagcgccuccgccccaugcacgucuucauccucgacuacgaccagucccccgccggcugccgcgacgcccuccuccagcucaccuccggcaugguccagacccacgucaccacccccggcuccauccccaccaucugcgaccucgcccgcaccuucgcccgcgagaugggcgaggccaacuga

SEQ ID NO: 6693 - RNA, 1131 nt, Artificial Sequence
  derived and/or modified sequence opt3 from Thymidine_Kinase_TK__Herpes_Simplex_Virus_1_(HSV-1)__ACB59251
auggccagcuaccccugccaccagcaugcuuccgcauucgaccaagccgcgagaucuaggggccacaacaaucggcgcaccgcucugcgaccucguagacagcagaaggccacagaggugaggcucgaacagaaaaugccaacucuucugcgggucuauaucgaugggccgcauggaauggguaagacgaccacaacucaauuguuaguugcacugggcucacgcgacgauauuguguacguacccgagccuaugaccuauuggagagugcuaggggccagugaaacaauagcuaacaucuacaccacucagcacaggcucgaccagggagagauuagcgcaggcgaugccgcugucgugaugacauccgcccagaucaccauggguaugccauaugcgguuacggacgcagugcuggcuccccauauugggggagaagccgggucuucgcacgccccuccacccgcacuuacucugaucuuugaucggcacccuauagcugccuugcucuguuacccagcggcccgcuaucgaaugggcucaaugaccccgcaagcaguccuggcuuucguggcccugauucccccuacacucccaggcacuaauaucguauuaggagcucugcccgaggacagacauaucgauaggcuugccaaacggcagcguccuggugagcgcuuggaccuggcaaugcuagccgcuauuagaaggguuuacgaacuccuggcgaacaccgugcgguaccuucagggcgggggaagcuggcgagaggauuggggccagcugagugguacagcagucccaccccaaggggccgaaccgcaguccaaugcuggaccucagccccacaucggcgacaccuuguuuacucucuuccgcgccccagagcuguuagcaccuaacggcgaucuguauaauguguuugccugggcucucgacgugcuugccaagagacugaggcccaugcaugucuucauauuggacuacgaucaaucuccagcagggugccgggacgcgcuacugcagcucacgagcggaaugguucagacacacgugaccacucccgguuccauuccuacaaucugugaucuggcucgcaccuuugccagagagaugggcgaagcaaacuga

SEQ ID NO: 6694 - RNA, 1131 nt, Artificial Sequence
  derived and/or modified sequence opt4 from Thymidine_Kinase_TK__Herpes_Simplex_Virus_1_(HSV-1)__ACB59251
auggccagcuaccccugccaccagcacgccagcgccuucgaccaggccgccagaagcagaggccacaacaacagaagaaccgcccugagacccagaagacagcagaaggccaccgaggugagacuggagcagaagaugcccacccugcugagaguguacaucgacggcccccacggcaugggcaagaccaccaccacccagcugcugguggcccugggcagcagagacgacaucguguacgugcccgagcccaugaccuacuggagagugcugggcgccagcgagaccaucgccaacaucuacaccacccagcacagacuggaccagggcgagaucagcgccggcgacgccgccguggugaugaccagcgcccagaucaccaugggcaugcccuacgccgugaccgacgccgugcuggccccccacaucggcggcgaggccggcagcagccacgcccccccccccgcccugacccugaucuucgacagacaccccaucgccgcccugcugugcuaccccgccgccagauacagaaugggcagcaugaccccccaggccgugcuggccuucguggcccugaucccccccacccugcccggcaccaacaucgugcugggcgcccugcccgaggacagacacaucgacagacuggccaagagacagagacccggcgagagacuggaccuggccaugcuggccgccaucagaagaguguacgagcugcuggccaacaccgugagauaccugcagggcggcggcagcuggagagaggacuggggccagcugagcggcaccgccgugcccccccagggcgccgagccccagagcaacgccggcccccagccccacaucggcgacacccuguucacccuguucagagcccccgagcugcuggcccccaacggcgaccuguacaacguguucgccugggcccuggacgugcuggccaagagacugagacccaugcacguguucauccuggacuacgaccagagccccgccggcugcagagacgcccugcugcagcugaccagcggcauggugcagacccacgugaccacccccggcagcauccccaccaucugcgaccuggccagaaccuucgccagagagaugggcgaggccaacuga

SEQ ID NO: 6695 - RNA, 1131 nt, Artificial Sequence
  derived and/or modified sequence opt5 from Thymidine_Kinase_TK__Herpes_Simplex_Virus_1_(HSV-1)__ACB59251
auggccagcuaccccugccaccagcaugcuuccgccuucgaccaagcggcuagaucucggggccacaacaaucgcagaaccgcccugcggccucgcagacagcagaaggccacagaggugcggcucgaacagaaaaugccgacgcugcuucgcgucuauaucgaugggccccauggaaugggcaagaccacaaccacacaacugcucguugcucuggggagcagagacgauauuguguacgugccugagcccaugaccuauuggcggguccuuggagccuccgaaacaaucgcuaacauuuacaccacgcagcaccgccuggaccagggcgagaucucugccggggaugcggccgugguuaugaccagcgcucagauuacaaugggaaugccuuaugccgugaccgacgcuguccucgcuccccauaucggcggcgaagcgggguccucucacgccccuccgcccgcucugacacugaucuuugauagacacccuauugccgcucuccuguguuaccccgccgcccgguaucgcaugggaagcaugaccccucaagcugugcuugcguucguugcccugauucccccgacgcucccuggcacaaauaucgugcugggggcccuucccgaggacagacauaucgaucggcuggccaaacgccagagaccuggagagcggcucgaccuggccaugcuggcugccauuagacgcgucuacgaacuccuggcgaacaccgugcgguaccuucagggcgggggauccuggagagaggauuggggccagcugagcggcacagcugugccuccccaaggggccgaaccccagucuaaugccggaccgcagccccacaucggcgacacccucuuuacccuguuccgcgcuccugagcuucuggcccccaacggggaucucuauaaugucuuugcuugggcccuggacguucuggcgaagcggcucagaccuaugcauguguucauucuggacuacgaucaaucccccgccggaugccgcgacgcccuucugcagcucacaagcggcauggugcagacgcacgucaccacaccggggucuaucccuaccaucugugaucuggcucggacauuugcuagagagaugggagaagccaacuga

SEQ ID NO: 6696 - RNA, 1131 nt, Artificial Sequence
  derived and/or modified sequence opt6 from Thymidine_Kinase_TK__Herpes_Simplex_Virus_1_(HSV-1)__ACB59251
auggcaagcuauccuugucaccaacaugcaucagcauucgaucaagcagcgagaucuagaggacacaauaacagaagaacagcguuaagaccaaggagacaacaaaaagcaaccgaaguuagacuagaacaaaaaaugccaacacuacuaagaguauacauugacggaccccauggaaugggaaaaacaacaacaacacaauuacuuguagcacuaggaagucgagaugauauagucuauguaccagaaccaaugacauauuggagaguuuuaggagcuagugaaacuauagcaaauauauauacaacacaacacagacuagaucaaggagaaaucagugcaggagaugcugcaguaguaaugacaucagcacaaauaacaaugggaaugccauaugcagucacagaugcaguauuagcaccacauauagguggugaagcaggcagcucucaugcaccaccacccgcauuaacauuaauuuuugauagacauccaauagcagcauuacuuugcuauccagcagcaagauacagaaugggcaguaugacaccacaagcaguauuagcauuuguagcacuaauaccaccaacauuaccuggcacaaauauaguuuuaggugcacuaccagaagauagacauauagaucgacuagcaaaacgacaaaggcccggagaaagauuagauuuagcaaugcucgcagcaaucagaagaguauaugaauuauuagcaaacaccguaagauacuuacaaggaggaggaucauggagagaagauuggggacaacuaaguggaacagcaguacccccacaaggugcugaaccacaaucaaaugcaggaccgcaaccccauauaggagauacacucuuuacauuauuuagagcuccagaacuauuagcaccaaauggagaucuauauaauguauuugcaugggcacuagauguguuagcaaaaagauuaaggcccaugcauguauuuauacuagauuacgaucaaucaccugcaggaugucgagaugcccucuuacaacuaacaucaggaaugguacaaacacauguaacaacuccaggaaguauaccaacaauaugugauuuagcaagaacauuugccagagaaaugggagaagcaaauuaa

SEQ ID NO: 6697 - protein, 376 aa, Artificial Sequence
  Thymidine_Kinase_TK__Herpes_Simplex_Virus_1_(HSV-1)__B2CPP6
MASYPGHQHASAFDQAARSRGHSNRRTALRPRRQQEATEVHLEQKMPTLLRVYIDGPHGMGKTTTTQLLVALGSRDDIVYVPEPMTYWRVLGASETIANIYTTQHRLDQGEISAGDAAVVMTSAQITMGMPYAVTDAVLAPHIGGEAGSSHAPPPALTLIFDRHPIAALLCYPAARYLMGSMTPQAVLAFVVLIPPTLPGTNIVLGALPEDRHIDRLAKRQRPGERLDLAMLAAIRRVYGLLANTVRYLQCGGSWREDWGQLSGTALTPQGAEPQSNAGPRPHIGETLFTLFRAPELLAPNGDLYNVFAWALDVLAKRLRPMHVFILDYDQSPAGCRDALLQLTSGMVQTHVTPPGSIPTICDLARTFAREMGEAH

SEQ ID NO: 6698 - RNA, 1131 nt, Artificial Sequence
  Thymidine_Kinase_TK__Herpes_Simplex_Virus_1_(HSV-1)__ACB59252
auggcuucguaccccggccaucaacacgcgucugcguucgaccaggcugcgcguucucgcggccauagcaaccgacguacggcguugcgcccucgccggcagcaagaagccacggaaguccaccuggagcagaaaaugcccacgcuacugcggguuuauauagacgguccucacgggauggggaaaaccaccaccacgcaacugcugguggcccuggguucgcgcgacgauaucgucuacguacccgagccgaugacuuacuggcgggugcugggggcuuccgagacaaucgcgaacaucuacaccacacaacaccgccucgaccagggugagauaucggccggggacgcggcggugguaaugacaagcgcccagauaacaaugggcaugccuuaugccgugaccgacgccguucuggcuccucauaucgggggggaggcugggagcucacaugccccgcccccggcccucacccucaucuucgaccgccaucccaucgccgcccuccugugcuacccggccgcgcgguaccuuaugggcagcaugaccccccaggccgugcuggcguucgugguccucaucccgccgaccuugcccggcacaaacaucguguugggggcccuuccggaggacagacacaucgaccgccuggccaaacgccagcgccccggugagcggcuugaccuggcuaugcuggccgcgauucgccgcguuuacgggcuacuugccaauacggugcgguaucugcagugcggcgggucguggcgggaggauuggggacagcuuucggggacggccuugacgccccagggugccgagccccagagcaacgcgggcccacgaccccauaucggggaaacguuauuuacccuguuucgggcccccgaguugcuggcccccaacggcgaccuguacaacguguuugccugggccuuggacgucuuggccaaacgccuccgucccaugcacgucuuuauccuggauuacgaccaaucgcccgccggcugccgggacgcccugcugcaacuuaccuccgggaugguccagacccaugucacccccccaggcuccauaccgacgaucugcgaccuggcgcgcacguuugcccgggagaugggggaggcucacuaa

SEQ ID NO: 6699 - RNA, 1131 nt, Artificial Sequence
  derived and/or modified sequence opt1 from Thymidine_Kinase_TK__Herpes_Simplex_Virus_1_(HSV-1)__ACB59252
auggccagcuaccccggccaccagcacgccuccgcguucgaccaggccgcccgcagccgggggcacuccaaccgccggaccgcccugcgcccgcggcgccagcaggaggccaccgaggugcaccucgagcagaagaugcccacgcugcugcgggucuacaucgacggcccccacgggaugggcaagaccaccaccacgcagcuccugguggcgcuggggagccgcgacgacaucguguacguccccgagccgaugaccuacuggcgggugcucggcgccuccgagaccaucgccaacaucuacaccacgcagcaccgccuggaccagggcgagaucagcgccggggacgcggccguggucaugaccuccgcccagaucaccaugggcaugcccuacgccgugaccgacgccgugcuggcgccccacaucgggggcgaggccgggagcucccacgcgcccccgcccgcccucacgcugaucuucgaccggcaccccaucgccgcccugcucugcuaccccgccgcccgcuaccugaugggcagcaugaccccgcaggccguccuggccuucguggugcucaucccgcccacccugcccggcaccaacaucguccugggggcgcuccccgaggaccggcacaucgaccgccuggccaagcggcagcgccccggcgagcggcuggaccucgccaugcuggccgccauccgccggguguacgggcugcucgcgaacacggugcgcuaccugcagugcggcggcuccuggcgggaggacugggggcagcugagcggcaccgcccucacgccccagggggccgagccccaguccaacgccggcccgcgcccccacaucggggagacccuguucacccuguuccgcgcgcccgagcuccuggcccccaacggcgaccuguacaacgucuucgccugggcccucgacgugcuggccaagcggcugcgcccgaugcacguguucauccucgacuacgaccagagccccgcgggcugccgggacgcccugcugcagcucaccuccgggaugguccagacccacgugaccccgcccggcagcauccccacgaucugcgaccuggcccgcaccuucgcccgggagaugggggaggcccacuga

SEQ ID NO: 6700 - RNA, 1131 nt, Artificial Sequence
  derived and/or modified sequence opt2 from Thymidine_Kinase_TK__Herpes_Simplex_Virus_1_(HSV-1)__ACB59252
auggccuccuaccccggccaccagcacgccuccgccuucgaccaggccgcccgcucccgcggccacuccaaccgccgcaccgcccuccgcccccgccgccagcaggaggccaccgagguccaccucgagcagaagaugcccacccuccuccgcgucuacaucgacggcccccacggcaugggcaagaccaccaccacccagcuccucgucgcccucggcucccgcgacgacaucgucuacguccccgagcccaugaccuacuggcgcguccucggcgccuccgagaccaucgccaacaucuacaccacccagcaccgccucgaccagggcgagaucuccgccggcgacgccgccgucgucaugaccuccgcccagaucaccaugggcaugcccuacgccgucaccgacgccguccucgccccccacaucggcggcgaggccggcuccucccacgcccccccccccgcccucacccucaucuucgaccgccaccccaucgccgcccuccucugcuaccccgccgcccgcuaccucaugggcuccaugaccccccaggccguccucgccuucgucguccucaucccccccacccuccccggcaccaacaucguccucggcgcccuccccgaggaccgccacaucgaccgccucgccaagcgccagcgccccggcgagcgccucgaccucgccaugcucgccgccauccgccgcgucuacggccuccucgccaacaccguccgcuaccuccagugcggcggcuccuggcgcgaggacuggggccagcucuccggcaccgcccucaccccccagggcgccgagccccaguccaacgccggcccccgcccccacaucggcgagacccucuucacccucuuccgcgcccccgagcuccucgcccccaacggcgaccucuacaacgucuucgccugggcccucgacguccucgccaagcgccuccgccccaugcacgucuucauccucgacuacgaccagucccccgccggcugccgcgacgcccuccuccagcucaccuccggcaugguccagacccacgucaccccccccggcuccauccccaccaucugcgaccucgcccgcaccuucgcccgcgagaugggcgaggcccacuga

SEQ ID NO: 6701 - RNA, 1131 nt, Artificial Sequence
  derived and/or modified sequence opt3 from Thymidine_Kinase_TK__Herpes_Simplex_Virus_1_(HSV-1)__ACB59252
auggccagcuaccccggccaccagcaugcuuccgcauucgaccaagccgcgagaucuagggggcacucaaaccggcgcaccgcucugcgaccucguagacagcaggaggccacagaagugcaucucgagcagaagaugccaacucuucugagggucuauaucgauggaccgcacgguaugggcaaaacgaccacaacucaauuguuaguugcacuggggagucgggacgauauuguguacguacccgaaccuaugaccuauuggcgcgugcuaggagccagcgagacaauagcuaauaucuacaccacucagcauagacucgaccagggcgaaauuuccgccggugaugccgcugucgugaugacaucugcccagaucaccauggggaugccauaugcgguuacggacgcagugcuggcaccccacauuggaggcgaggcuggcucgucacacgccccuccacccgcacuuacucugaucuuugauaggcauccuauagcugccuugcucugcuacccagcggcccgguaucugauggggagcaugaccccgcaagcaguccuggcuuucgugguacucauucccccuacauuaccaggaacuaacaucguucugggugcccuucccgaggaccgccacaucgaucgauuggcuaagagacagaggccuggcgaacggcuggaccuagccaugcucgcagccauucgucgcguguacgggcugcuugcuaauaccgucagauaccugcaguguggaggcaguuggagggaggauuggggucaguuguccgggacagcgcucaccccacaaggagcagaaccccagucuaacgccggcccgcggccucauaucggcgagacgcuguuuacuuuauuccgagcucccgagcugcucgccccaaauggggaccuuuauaacguguuugcaugggcccuggauguguuggcuaaacgccuaagaccuaugcacgucuucauacuggacuacgaccagagccccgccggaugcagggaugcacuccugcaacuuacauccgguaugguucagacccacgugacuccacccggcucaauuccuacaaucugugaccuggcgcggaccuuugcucgcgaaaugggggaggcccauuga

SEQ ID NO: 6702 - RNA, 1131 nt, Artificial Sequence
  derived and/or modified sequence opt4 from Thymidine_Kinase_TK__Herpes_Simplex_Virus_1_(HSV-1)__ACB59252
auggccagcuaccccggccaccagcacgccagcgccuucgaccaggccgccagaagcagaggccacagcaacagaagaaccgcccugagacccagaagacagcaggaggccaccgaggugcaccuggagcagaagaugcccacccugcugagaguguacaucgacggcccccacggcaugggcaagaccaccaccacccagcugcugguggcccugggcagcagagacgacaucguguacgugcccgagcccaugaccuacuggagagugcugggcgccagcgagaccaucgccaacaucuacaccacccagcacagacuggaccagggcgagaucagcgccggcgacgccgccguggugaugaccagcgcccagaucaccaugggcaugcccuacgccgugaccgacgccgugcuggccccccacaucggcggcgaggccggcagcagccacgcccccccccccgcccugacccugaucuucgacagacaccccaucgccgcccugcugugcuaccccgccgccagauaccugaugggcagcaugaccccccaggccgugcuggccuucguggugcugaucccccccacccugcccggcaccaacaucgugcugggcgcccugcccgaggacagacacaucgacagacuggccaagagacagagacccggcgagagacuggaccuggccaugcuggccgccaucagaagaguguacggccugcuggccaacaccgugagauaccugcagugcggcggcagcuggagagaggacuggggccagcugagcggcaccgcccugaccccccagggcgccgagccccagagcaacgccggccccagaccccacaucggcgagacccuguucacccuguucagagcccccgagcugcuggcccccaacggcgaccuguacaacguguucgccugggcccuggacgugcuggccaagagacugagacccaugcacguguucauccuggacuacgaccagagccccgccggcugcagagacgcccugcugcagcugaccagcggcauggugcagacccacgugaccccccccggcagcauccccaccaucugcgaccuggccagaaccuucgccagagagaugggcgaggcccacuga

SEQ ID NO: 6703 - RNA, 1131 nt, Artificial Sequence
  derived and/or modified sequence opt5 from Thymidine_Kinase_TK__Herpes_Simplex_Virus_1_(HSV-1)__ACB59252
auggccagcuaccccggccaccagcaugcuuccgccuucgaccaagcggcuagaucucgggggcacagcaaccgcagaaccgcccugcggccucgcagacagcaggaggccacagaagugcaucucgagcagaagaugccgacgcugcuucgggucuauaucgauggaccccacggcauggggaaaaccacaaccacacaacugcucguugcucugggaucccgcgacgauauuguguacgugccugaacccaugaccuauuggagaguccuuggcgccucugagacaaucgcuaauauuuacaccacgcagcaucggcuggaccagggggaaaucagcgccggagaugcggccgugguuaugaccuccgcucagauuacaaugggcaugccuuaugccgugaccgacgcuguccucgcgccccacaucggcggggaggccggaucuagccacgccccuccgcccgcucugacacugaucuuugaucgccauccuauugccgcucuccugugcuaccccgccgccagauaucuuaugggcuccaugaccccucaagcugugcuggcguucguugugcucauucccccgacgcugccugggacaaacaucguccuuggagcccugcccgaggaccggcacaucgaucgccucgcuaagagacagcggccuggcgaacgccuggaccuggccaugcucgccgcuauuagacggguguacgggcugcuugccaauaccgugagauaccugcaguguggaggcagcuggcgcgaggauuggggccagcucucugggacagcgcugacaccccaaggagcugaaccccaguccaacgccggcccucggccgcauaucggggagacccuuuuuacccuguucagagcccccgagcuccuggcuccuaauggagaccuguauaacgucuuugccugggcucucgauguucuggccaaacgccuucggcccaugcacguguucauucuggacuacgaccagagcccugcgggcugcagagaugcccuccugcaacuuacgucugggauggugcagacccacgucacacccccgggauccaucccuaccaucugugaccuggcucgcacauuugcccgggaaaugggcgaggcucauuga

SEQ ID NO: 6704 - RNA, 1131 nt, Artificial Sequence
  derived and/or modified sequence opt6 from Thymidine_Kinase_TK__Herpes_Simplex_Virus_1_(HSV-1)__ACB59252
auggcaucauauccaggacaucaacaugcaagcgcauuugaucaagcagcaagaucaagaggccacagcaauagaagaaccgcacuuagaccaagacgacaacaagaagcaacggaaguacauuuagaacaaaaaaugccaacacuuuuacgaguauauauugauggaccacauggaaugggaaaaacuacaacaacacaacuauuaguagcauuaggcaguagagaugauauaguuuauguaccagaaccaaugacauauuggagaguuuuaggagcaucagaaacaauagcaaauauauauaccacacaacauaggcuugaccaaggagaaauaagugcuggcgaugccgcaguagucaugacuuccgcacaaauaacuauggguaugccauaugcaguaacagaugccguacuagcaccacacauugguggagaagccgguucaagucaugcaccuccaccagcauuaacacugauauuugauagacauccaauagcugcacuauuauguuauccagcagcuagauauuuaaugggaucaaugacaccucaagcaguacuagcauucgucguuuuaauuccaccaacauuaccaggaacuaauauaguacuuggagcauuaccagaagauagacauauagacaggcuugcaaaaagacaacgaccaggagaaagauuagauuuagcaauguuagcagcaauaagaagaguuuauggauuauuagcaaauacaguaagauauuuacaauguggaggaucauggagagaagauuggggacaacucucaggaacagcuuuaaccccacaaggagcugaaccacaaucaaaugcaggaccaagaccacauauaggagaaacauuauuuacacucuucagagcaccagaauuacuagcaccaaauggagauuuauauaauguauuugccugggcacuagauguauuagcaaaaagauuaagaccuaugcauguauuuauauuagauuaugaccaaucaccagcaggaugcagagaugcuuuauuacaacuaacaagugguaugguacaaacacauguaacaccaccuggaaguauaccaacaauaugugacuuagcacgaacauucgcaagagaaaugggagaggcacauuaa

SEQ ID NO: 6705 - protein, 376 aa, Artificial Sequence
  Thymidine_Kinase_TK__Herpes_Simplex_Virus_1_(HSV-1)__B2CPP7
MASYPCHQHASAFDQAARSRGHSNRRTALRPRRQQEATEVRPEQKMPTLLRVYIDGPHGMGKTTTTQLLVALGSRDDIVYVPEPMTYWRVLGASETIANIYTTQHRLDQGEISAGDAAVVMTSAQITMGMPYAVTDAVLAPHIGGEAGSSHAPPPALTLIFDRHPIAALLCYPAARYLMGSMTPQAVLAFVALIPPTLPGTNIVLGALPEDRHIDRLAKRQRPGERLDLAMLAAIRRVYELLANTVRYLQGGGSWREDWGQLSGTALTPQGAEPQSNAGPRPHIGETLFTLFRAPELLAPNGDLYNVFAWALDVLAKRLRPMHVFILDYDQSPAGCRDALLQLTSGMVQTHVTTPGSIPTICDLARTFAREMGEAP

SEQ ID NO: 6706 - RNA, 1131 nt, Artificial Sequence
  Thymidine_Kinase_TK__Herpes_Simplex_Virus_1_(HSV-1)__ACB59253
auggcuucguaccccugccaucaacacgcgucugcguucgaccaggcugcgcguucucgcggccauagcaaccgacguacggcguugcgcccucgccggcagcaagaagccacggaaguccgcccggagcagaaaaugcccacgcuacugcggguuuauauagacgguccccacgggauggggaaaaccaccaccacgcaacugcugguggcccuggguucgcgcgacgauaucgucuacguacccgagccgaugacuuacuggcgggugcugggggcuuccgagacaaucgcgaacaucuacaccacacaacaccgccucgaccagggugagauaucggccggggacgcggcggugguaaugacaagcgcccagauaacaaugggcaugccuuaugccgugaccgacgccgugcuggcuccucauaucgggggggaggcugggagcucacaugccccgcccccggcccucacccucaucuucgaccgccaucccaucgccgcccuccuguguuacccggccgcgcgauaccuuaugggcagcaugaccccccaggccgugcuggcguucguggcccucaucccgccgaccuugccgggcacaaacaucguguugggggcccuuccggaggacagacacaucgaccgccuggccaaacgccagcgccccggcgagcggcuugaccuggcuaugcuggccgcgauucgccgcguuuacgagcugcuugccaauacggugcgguaucugcagggcggcgggucguggcgggaggauuggggacagcuuucggggacggccuugacgccccagggugccgagccccagagcaacgcgggcccgcgaccccauaucggggaaacguuauuuacccuguuucgggcccccgaguugcuggcccccaacggcgaccuguacaacguguuugccugggccuuggacgucuuggccaaacgccuccgucccaugcacgucuuuauccuggauuacgaccaaucgcccgccggcugccgggacgcccugcugcaacuuaccuccgggaugguccagacccacgucaccaccccaggcuccauaccgacgaucugcgaccuggcgcgcacguuugcccgggagaugggggaggcucccuaa

SEQ ID NO: 6707 - RNA, 1131 nt, Artificial Sequence
  derived and/or modified sequence opt1 from Thymidine_Kinase_TK__Herpes_Simplex_Virus_1_(HSV-1)__ACB59253
auggccagcuaccccugccaccagcacgccuccgcguucgaccaggccgcccgcagccggggccacuccaaccgccggaccgcccugcgcccgcggcgccagcaggaggccaccgaggugcggcccgagcagaagaugcccacgcuccugcgcgucuacaucgacgggccccacggcauggggaagaccaccaccacgcagcugcucguggcgcugggcagccgggacgacaucguguacgucccggagcccaugaccuacuggcgcgugcugggggccuccgagaccaucgccaacaucuacaccacgcagcaccggcucgaccagggcgagaucagcgccggcgacgcggccguggucaugaccuccgcccagaucaccauggggaugcccuacgccgugaccgacgccgugcuggcgccccacaucggcggggaggccggcagcucccacgccccgccgcccgcccugacgcucaucuucgaccgccaccccaucgccgcgcugcugugcuaccccgccgcccgguaccucauggggagcaugacgccccaggccguccuggccuucguggcgcugaucccgcccacccuccccggcaccaacaucgugcugggcgcccugcccgaggaccgccacaucgaccggcucgccaagcgccagcggcccggggagcgccuggaccuggccaugcucgccgcgauccggcgcgucuacgagcugcuggccaacaccgugcgguaccuccagggcgggggcuccuggcgcgaggacuggggccagcugagcgggaccgcccugacgccccagggcgccgagccgcaguccaacgcggggccccgcccccacaucggcgagacccucuucacccuguuccgggcccccgagcugcucgccccgaacggggaccuguacaacguguucgccugggcccuggacguccucgcgaagcgccugcggcccaugcacguguucauccuggacuacgaccagagccccgccggcugccgcgacgcccuccugcagcugaccuccggcauggugcagacccacgucaccacgcccgggagcaucccgaccaucugcgaccucgcccggaccuucgcccgcgagaugggcgaggcgcccuga

SEQ ID NO: 6708 - RNA, 1131 nt, Artificial Sequence
  derived and/or modified sequence opt2 from Thymidine_Kinase_TK__Herpes_Simplex_Virus_1_(HSV-1)__ACB59253
auggccuccuaccccugccaccagcacgccuccgccuucgaccaggccgcccgcucccgcggccacuccaaccgccgcaccgcccuccgcccccgccgccagcaggaggccaccgagguccgccccgagcagaagaugcccacccuccuccgcgucuacaucgacggcccccacggcaugggcaagaccaccaccacccagcuccucgucgcccucggcucccgcgacgacaucgucuacguccccgagcccaugaccuacuggcgcguccucggcgccuccgagaccaucgccaacaucuacaccacccagcaccgccucgaccagggcgagaucuccgccggcgacgccgccgucgucaugaccuccgcccagaucaccaugggcaugcccuacgccgucaccgacgccguccucgccccccacaucggcggcgaggccggcuccucccacgcccccccccccgcccucacccucaucuucgaccgccaccccaucgccgcccuccucugcuaccccgccgcccgcuaccucaugggcuccaugaccccccaggccguccucgccuucgucgcccucaucccccccacccuccccggcaccaacaucguccucggcgcccuccccgaggaccgccacaucgaccgccucgccaagcgccagcgccccggcgagcgccucgaccucgccaugcucgccgccauccgccgcgucuacgagcuccucgccaacaccguccgcuaccuccagggcggcggcuccuggcgcgaggacuggggccagcucuccggcaccgcccucaccccccagggcgccgagccccaguccaacgccggcccccgcccccacaucggcgagacccucuucacccucuuccgcgcccccgagcuccucgcccccaacggcgaccucuacaacgucuucgccugggcccucgacguccucgccaagcgccuccgccccaugcacgucuucauccucgacuacgaccagucccccgccggcugccgcgacgcccuccuccagcucaccuccggcaugguccagacccacgucaccacccccggcuccauccccaccaucugcgaccucgcccgcaccuucgcccgcgagaugggcgaggcccccuga

SEQ ID NO: 6709 - RNA, 1131 nt, Artificial Sequence
  derived and/or modified sequence opt3 from Thymidine_Kinase_TK__Herpes_Simplex_Virus_1_(HSV-1)__ACB59253
auggccagcuaccccugccaccagcaugcuuccgcauucgaccaagccgcgagaucuaggggccacucaaaccggcgcaccgcucugcgaccucguagacagcaggaggccacagaagugaggccagagcagaagaugccgacucuccuucgggucuauaucgaugggccccauggaauggguaaaacgaccacaacucaacuguugguugcauuaggcagucgcgacgauauuguguacguaccugaaccaaugaccuauuggagagugcugggggccagcgagacaauagcuaauaucuacaccacucagcacaggcuagaccagggagaaauuuccgcaggcgaugccgcugucgugaugacaucugcccagaucaccauggguaugcccuaugcgguuacggacgcagugcucgccccucauauugggggagaggcuggcucgucacacgccccacccccugcacugacucuuaucuuugaucggcacccaauagcugcccuguuguguuacccggcggcccgcuaucucaugggcagcaugacaccccaagcaguccuggcuuucguggcccugaucccuccaacccuccccgggacuaacauuguauuaggagcucugccugaggaccgacauaucgauagacuugccaagaggcagcggccaggugaacguuuggaccuggcaaugcuagccgcuauucgcagaguuuacgagcuccuggcgaauaccgugagguaccuucagggcgggggaaguuggcgggaagauuggggccagcuguccgguacagcauugacgccccaaggggccgagccgcagucuaacgcuggaccucgaccccacaucggcgagacccucuuuacucuguuccgcgccccagaauuacuggcaccuaauggcgaccucuauaacgucuuugccugggcucuugaugugcuggccaaaagauugaggcccaugcauguguucauacuagacuacgaccagagcccagcagggugccgggaugcgcugcuccaacugacauccggaaugguccagacccacguuacuacacccgguucaauuccuaccaucugugaccuugcucgcacguuugccagagagaugggcgaagcaccauga

SEQ ID NO: 6710 - RNA, 1131 nt, Artificial Sequence
  derived and/or modified sequence opt4 from Thymidine_Kinase_TK__Herpes_Simplex_Virus_1_(HSV-1)__ACB59253
auggccagcuaccccugccaccagcacgccagcgccuucgaccaggccgccagaagcagaggccacagcaacagaagaaccgcccugagacccagaagacagcaggaggccaccgaggugagacccgagcagaagaugcccacccugcugagaguguacaucgacggcccccacggcaugggcaagaccaccaccacccagcugcugguggcccugggcagcagagacgacaucguguacgugcccgagcccaugaccuacuggagagugcugggcgccagcgagaccaucgccaacaucuacaccacccagcacagacuggaccagggcgagaucagcgccggcgacgccgccguggugaugaccagcgcccagaucaccaugggcaugcccuacgccgugaccgacgccgugcuggccccccacaucggcggcgaggccggcagcagccacgcccccccccccgcccugacccugaucuucgacagacaccccaucgccgcccugcugugcuaccccgccgccagauaccugaugggcagcaugaccccccaggccgugcuggccuucguggcccugaucccccccacccugcccggcaccaacaucgugcugggcgcccugcccgaggacagacacaucgacagacuggccaagagacagagacccggcgagagacuggaccuggccaugcuggccgccaucagaagaguguacgagcugcuggccaacaccgugagauaccugcagggcggcggcagcuggagagaggacuggggccagcugagcggcaccgcccugaccccccagggcgccgagccccagagcaacgccggccccagaccccacaucggcgagacccuguucacccuguucagagcccccgagcugcuggcccccaacggcgaccuguacaacguguucgccugggcccuggacgugcuggccaagagacugagacccaugcacguguucauccuggacuacgaccagagccccgccggcugcagagacgcccugcugcagcugaccagcggcauggugcagacccacgugaccacccccggcagcauccccaccaucugcgaccuggccagaaccuucgccagagagaugggcgaggcccccuga

SEQ ID NO: 6711 - RNA, 1131 nt, Artificial Sequence
  derived and/or modified sequence opt5 from Thymidine_Kinase_TK__Herpes_Simplex_Virus_1_(HSV-1)__ACB59253
auggccagcuaccccugccaccagcaugcuuccgccuucgaccaagcggcuagaucucggggccacagcaaccgcagaaccgcccugcggccucgcagacagcaggaggccacagaagugcggccggagcagaagaugcccacgcuccugcgcgucuauaucgaugggccucauggaaugggcaaaaccacaaccacacaacuucugguugcucucggguccagagacgauauuguguacgugcccgaaccuaugaccuauuggcggguccugggagccucugagacaaucgcuaauauuuacaccacgcagcaccgccuugaccagggcgaaaucagcgccggggaugcggccgugguuaugaccuccgcucagauuacaaugggaaugcccuaugccgugaccgacgcuguccuggccccucauaucggcggcgaggcggggucuagccacgccccgcccccugcucucacacugaucuuugauagacaccccauugccgcucugcucuguuacccugccgcccgguaucugaugggauccaugacgccccaagcugugcuugcguucguugcccugaucccgccuacccuccccggcacaaacauugugcugggggcccuuccugaggaccgccauaucgauagacuggcuaagcggcagcgccccggagaaagacucgaccuggccaugcuggcugccauucggagagucuacgagcuccuggcgaauaccgugcgcuaccuucagggcgggggaagcuggcgggaagauuggggccagcugucuggcacagcucucacaccccaaggggccgagccucaguccaacgccggaccgagaccccacaucggcgagacccuguuuacccuuuuccgcgcuccugaacugcucgcccccaauggggaccuguauaacguguuugcuugggcccuggauguccucgcgaaacggcugagaccuaugcauguuuucauucuugacuacgaccagagccccgccggaugccgcgaugcucugcuccaacugacgucuggcauggugcagacccacgugacaaccccgggguccaucccuacaaucugugaccuugcccggaccuuugcuagagagaugggagaagcccccuga

SEQ ID NO: 6712 - RNA, 1131 nt, Artificial Sequence
  derived and/or modified sequence opt6 from Thymidine_Kinase_TK__Herpes_Simplex_Virus_1_(HSV-1)__ACB59253
auggcuucguacccaugccaucaacaugcaagcgcauucgaucaagcagcaagaucaagaggacauaguaaucgaagaacagcucuaagaccaagaagacaacaagaagcuacagaaguaagaccagaacaaaaaaugccuacauuacuaagaguauauauagauggaccucauggaaugggaaaaacaacaacaacacaacuacuuguugcauuaggaucaagagaugauauaguuuacguuccagaaccgaugacauacuggagaguacuaggagcaucagaaacaauagcaaacauuuauacaacacaacauagauuagaucaaggagaaauaucagcaggagaugcugcaguaguaaugacaagugcacaaauaacaaugggaaugccauaugcaguaacagaugcuguacuagcgccacacauaggaggugaagcagguucaucacacgcaccaccaccagcacuuacauuaauauuugauagacauccaauagcagcauuauugugcuauccugcagcuagauaucuuaugggaucaaugacaccacaagcaguuuuagccuuuguugcuuuaauacccccaacauuaccuggaacaaauauaguacuuggagcauuaccagaagauagacacauagauagguuagcaaaaagacaaagaccaggagaaagacuugaucuagcaauguuggcugcaauaagaagaguauaugaauuauuagccaauacaguaagauacuuacaaggaggagguucuuggagagaagauuggggacaacuaagcggaacagcucuuacaccucaaggagcagaaccccaaucaaaugccggaccaagaccucauauaggagaaacacuauuuacuuuauuuagagcaccagaacuucuagcaccuaacggagacuuauauaacgucuuugcaugggcacuagacguauuagcaaaaagauuaagaccaaugcauguauuuauucuagauuaugaucaaucaccagcaggauguagagaugcauuauuacaacucacuucaggaaugguacaaacacauguaacuaccccaggaaguauaccaacaauuugugaccuugcuagaacauuugcacgagaaaugggagaggcaccauaa

SEQ ID NO: 6713 - protein, 375 aa, Artificial Sequence
  Thymidine_Kinase_TK__Herpes_Simplex_Virus_1_(HSV-1)__B2CPP8
MASYPGHQHASAFDQAARSRGHSNRRTALRPRRQQATEVHLEQKMPTLLRVYIDGPHGMGKTTTTQLLVALGSRDDIVYVPEPMTYWRVLGASETIANIYTTQHRLDQGEISAGDAAVVMTSAQITMGMPYAVTDAVLAPHIGGEAGSSHAPPPALTLIFDRHPIAALLCYPAARYLMGSMTPQAVLAFVVLIPPTLPGTNIVLGALPEDRHIDRLAKRQRPGERLDLAMLAAIRRVYGLLANTVRYLQCGGSWREDWGQLSGTALTPQGAEPQSNAGPRPHIGETLFTLFRAPELLAPNGDLYNVFAWALDVLAKRLRPMHVFILDYDQSPAGCRDALLQLTSGMVQTHVTTPGSIPTICDLARTFAREMGEAH

SEQ ID NO: 6714 - RNA, 1128 nt, Artificial Sequence
  Thymidine_Kinase_TK__Herpes_Simplex_Virus_1_(HSV-1)__ACB59254
auggcuucguaccccggccaucaacacgcgucugcguucgaccaggcugcgcguucucgcggccauagcaaccgacguacggcguugcgcccucgccggcagcaagccacggaaguccaccuggagcagaaaaugcccacgcuacugcggguuuauauagacgguccucacgggauggggaaaaccaccaccacgcaacugcugguggcccuggguucgcgcgacgauaucgucuacguacccgagccgaugacuuacuggcgggugcugggggcuuccgagacaaucgcgaacaucuacaccacacaacaccgccucgaccagggugagauaucggccggggacgcggcggugguaaugacaagcgcccagauaacaaugggcaugccuuaugccgugaccgacgccguucuggcuccucauaucgggggggaggcugggagcucacaugccccgcccccggcccucacccucaucuucgaccgccaucccaucgccgcccuccugugcuacccggccgcgcgguaccuuaugggcagcaugaccccccaggccgugcuggcguucgugguccucaucccgccgaccuugcccggcacaaacaucguguugggggcccuuccggaggacagacacaucgaccgccuggccaaacgccagcgccccggugagcggcuugaccuggcuaugcuggccgcgauucgccgcguuuacgggcuacuugccaauacggugcgguaucugcagugcggcgggucguggcgggaggauuggggacagcuuucggggacggccuugacgccccagggugccgagccccagagcaacgcgggcccacgaccccauaucggggaaacguuauuuacccuguuucgggcccccgaguugcuggcccccaacggcgaccuguacaacguguuugccugggccuuggacgucuuggccaaacgccuccgucccaugcacgucuuuauccuggauuacgaccaaucgcccgccggcugccgggacgcccugcugcaacuuaccuccgggaugguccagacccaugucaccaccccaggcuccauaccgacgaucugcgaccuggcgcgcacguuugcccgggagaugggggaggcucacuaa

SEQ ID NO: 6715 - RNA, 1128 nt, Artificial Sequence
  derived and/or modified sequence opt1 from Thymidine_Kinase_TK__Herpes_Simplex_Virus_1_(HSV-1)__ACB59254
auggccagcuaccccggccaccagcacgccuccgcguucgaccaggccgcccgcagccgggggcacuccaaccgccggaccgcccugcgcccgcggcgccagcaggccaccgaggugcaccucgagcagaagaugcccacgcugcugcgggucuacaucgacggcccccacgggaugggcaagaccaccaccacgcagcuccugguggcgcuggggagccgcgacgacaucguguacguccccgagccgaugaccuacuggcgggugcucggcgccuccgagaccaucgccaacaucuacaccacgcagcaccgccuggaccagggcgagaucagcgccggggacgcggccguggucaugaccuccgcccagaucaccaugggcaugcccuacgccgugaccgacgccgugcuggcgccccacaucgggggcgaggccgggagcucccacgcgcccccgcccgcccucacgcugaucuucgaccggcaccccaucgccgcccugcucugcuaccccgccgcccgcuaccugaugggcagcaugaccccgcaggccguccuggccuucguggugcucaucccgcccacccugcccggcaccaacaucguccugggggcgcuccccgaggaccggcacaucgaccgccuggccaagcggcagcgccccggcgagcggcuggaccucgccaugcuggccgccauccgccggguguacgggcugcucgcgaacacggugcgcuaccugcagugcggcggcuccuggcgggaggacugggggcagcugagcggcaccgcccucacgccccagggggccgagccccaguccaacgccggcccgcgcccccacaucggggagacccuguucacccuguuccgcgcgcccgagcuccuggcccccaacggcgaccuguacaacgucuucgccugggcccucgacgugcuggccaagcggcugcgcccgaugcacguguucauccucgacuacgaccagagccccgcgggcugccgggacgcccugcugcagcucaccuccgggaugguccagacccacgugaccacgcccggcagcauccccaccaucugcgaccuggcccgcaccuucgcccgggagaugggggaggcccacuga

SEQ ID NO: 6716 - RNA, 1128 nt, Artificial Sequence
  derived and/or modified sequence opt2 from Thymidine_Kinase_TK__Herpes_Simplex_Virus_1_(HSV-1)__ACB59254
auggccuccuaccccggccaccagcacgccuccgccuucgaccaggccgcccgcucccgcggccacuccaaccgccgcaccgcccuccgcccccgccgccagcaggccaccgagguccaccucgagcagaagaugcccacccuccuccgcgucuacaucgacggcccccacggcaugggcaagaccaccaccacccagcuccucgucgcccucggcucccgcgacgacaucgucuacguccccgagcccaugaccuacuggcgcguccucggcgccuccgagaccaucgccaacaucuacaccacccagcaccgccucgaccagggcgagaucuccgccggcgacgccgccgucgucaugaccuccgcccagaucaccaugggcaugcccuacgccgucaccgacgccguccucgccccccacaucggcggcgaggccggcuccucccacgcccccccccccgcccucacccucaucuucgaccgccaccccaucgccgcccuccucugcuaccccgccgcccgcuaccucaugggcuccaugaccccccaggccguccucgccuucgucguccucaucccccccacccuccccggcaccaacaucguccucggcgcccuccccgaggaccgccacaucgaccgccucgccaagcgccagcgccccggcgagcgccucgaccucgccaugcucgccgccauccgccgcgucuacggccuccucgccaacaccguccgcuaccuccagugcggcggcuccuggcgcgaggacuggggccagcucuccggcaccgcccucaccccccagggcgccgagccccaguccaacgccggcccccgcccccacaucggcgagacccucuucacccucuuccgcgcccccgagcuccucgcccccaacggcgaccucuacaacgucuucgccugggcccucgacguccucgccaagcgccuccgccccaugcacgucuucauccucgacuacgaccagucccccgccggcugccgcgacgcccuccuccagcucaccuccggcaugguccagacccacgucaccacccccggcuccauccccaccaucugcgaccucgcccgcaccuucgcccgcgagaugggcgaggcccacuga

SEQ ID NO: 6717 - RNA, 1128 nt, Artificial Sequence
  derived and/or modified sequence opt3 from Thymidine_Kinase_TK__Herpes_Simplex_Virus_1_(HSV-1)__ACB59254
auggccagcuaccccggccaccagcaugcuuccgcauucgaccaagccgcgagaucuagggggcacucaaaccggcgcaccgcucugcgaccucguagacagcaggccacagaggugcaucucgaacagaagaugccaacucuucugagggucuauaucgauggaccgcacgguaugggcaaaacgaccacaacucaauuguuaguugcacuggggagucgggacgauauuguguacguacccgagccuaugaccuauuggcgcgugcuaggagccagcgaaacaauagcuaauaucuacaccacucagcauagacucgaccagggcgagauuuccgccggugaugccgcugucgugaugacaucugcccagaucaccauggggaugccauaugcgguuacggacgcagugcuggcaccccacauuggaggcgaagcuggcucgucacacgccccuccacccgcacuuacucugaucuuugauaggcauccuauagcugccuugcucugcuacccagcggcccgguaucugauggggagcaugaccccgcaagcaguccuggcuuucgugguacucauucccccuacauuaccaggaacuaacaucguucugggugcccuucccgaggaccgccacaucgaucgauuggcuaagagacagaggccuggcgagcggcuggaccuagccaugcucgcagccauucgucgcguguacgggcugcuugcuaauaccgucagauaccugcaguguggaggcaguuggagggaagauuggggucaguuguccgggacagcgcucaccccacaaggagcagagccccagucuaacgccggcccgcggccucauaucggcgaaacgcuguuuacuuuauuccgagcucccgagcugcucgccccaaauggggaccuuuauaacguguuugcaugggcccuggauguguuggcuaaacgccuaagaccuaugcacgucuucauacuggacuacgaccagagccccgccggaugcagggaugcacuccugcaacuuacauccgguaugguucagacccacgugacuacaccaggcucaauucccaccaucugugaccuggcgcggacguuugcucgcgagaugggggaagcccauuga

SEQ ID NO: 6718 - RNA, 1128 nt, Artificial Sequence
  derived and/or modified sequence opt4 from Thymidine_Kinase_TK__Herpes_Simplex_Virus_1_(HSV-1)__ACB59254
auggccagcuaccccggccaccagcacgccagcgccuucgaccaggccgccagaagcagaggccacagcaacagaagaaccgcccugagacccagaagacagcaggccaccgaggugcaccuggagcagaagaugcccacccugcugagaguguacaucgacggcccccacggcaugggcaagaccaccaccacccagcugcugguggcccugggcagcagagacgacaucguguacgugcccgagcccaugaccuacuggagagugcugggcgccagcgagaccaucgccaacaucuacaccacccagcacagacuggaccagggcgagaucagcgccggcgacgccgccguggugaugaccagcgcccagaucaccaugggcaugcccuacgccgugaccgacgccgugcuggccccccacaucggcggcgaggccggcagcagccacgcccccccccccgcccugacccugaucuucgacagacaccccaucgccgcccugcugugcuaccccgccgccagauaccugaugggcagcaugaccccccaggccgugcuggccuucguggugcugaucccccccacccugcccggcaccaacaucgugcugggcgcccugcccgaggacagacacaucgacagacuggccaagagacagagacccggcgagagacuggaccuggccaugcuggccgccaucagaagaguguacggccugcuggccaacaccgugagauaccugcagugcggcggcagcuggagagaggacuggggccagcugagcggcaccgcccugaccccccagggcgccgagccccagagcaacgccggccccagaccccacaucggcgagacccuguucacccuguucagagcccccgagcugcuggcccccaacggcgaccuguacaacguguucgccugggcccuggacgugcuggccaagagacugagacccaugcacguguucauccuggacuacgaccagagccccgccggcugcagagacgcccugcugcagcugaccagcggcauggugcagacccacgugaccacccccggcagcauccccaccaucugcgaccuggccagaaccuucgccagagagaugggcgaggcccacuga

SEQ ID NO: 6719 - RNA, 1128 nt, Artificial Sequence
  derived and/or modified sequence opt5 from Thymidine_Kinase_TK__Herpes_Simplex_Virus_1_(HSV-1)__ACB59254
auggccagcuaccccggccaccagcaugcuuccgccuucgaccaagcggcuagaucucgggggcacagcaaccgcagaaccgcccugcggccucgcagacagcaggccacagaggugcaucucgaacagaagaugccgacgcugcuucgggucuauaucgauggaccccacggcauggggaaaaccacaaccacacaacugcucguugcucugggaucccgcgacgauauuguguacgugccugagcccaugaccuauuggagaguccuuggcgccucugaaacaaucgcuaauauuuacaccacgcagcaucggcuggaccagggggagaucagcgccggagaugcggccgugguuaugaccuccgcucagauuacaaugggcaugccuuaugccgugaccgacgcuguccucgcgccccacaucggcggggaagccggaucuagccacgccccuccgcccgcucugacacugaucuuugaucgccauccuauugccgcucuccugugcuaccccgccgccagauaucuuaugggcuccaugaccccucaagcugugcuggcguucguugugcucauucccccgacgcugccugggacaaacaucguccuuggagcccugcccgaggaccggcacaucgaucgccucgcuaagagacagcggccuggcgagcgccuggaccuggccaugcucgccgcuauuagacggguguacgggcugcuugccaauaccgugagauaccugcaguguggaggcagcuggcgcgaagauuggggccagcucucugggacagcgcugacaccccaaggagcugagccccaguccaacgccggcccucggccgcauaucggggaaacccuuuuuacccuguucagagcccccgagcuccuggcuccuaauggagaccuguauaacgucuuugccugggcucucgauguucuggccaaacgccuucggcccaugcacguguucauucuggacuacgaccagagcccugcgggcugcagagaugcccuccugcaacuuacgucugggauggugcagacccacgucacaacccccggauccaucccgacaaucugugaccuggcucgcaccuuugcccgggagaugggcgaagcucauuga

SEQ ID NO: 6720 - RNA, 1128 nt, Artificial Sequence
  derived and/or modified sequence opt6 from Thymidine_Kinase_TK__Herpes_Simplex_Virus_1_(HSV-1)__ACB59254
auggcuucauauccaggccaucaacaugcaucugcauuugaucaagcagcuagaucaagaggacauucaaauaggagaacagcuuuaagaccaagaagacaacaagcaacggaaguacaucuagaacaaaaaaugccaacauuauuaagaguauauaucgauggaccucacggcauggguaaaacaacaaccacacaauuacuaguagcacuaggaaguagagacgauauaguauaugucccagaaccuaugacauauuggagaguauuaggagcaagcgaaacaauagcaaauauauauacaacacaacacagauuagaucaaggagaaauauccgcaggagaugcagcaguaguaaugacaucugcacaaaucacuaugggaaugccauaugcuguaacagacgcaguauuagcaccacauauuggaggagaagcagguucaucgcaugcaccaccucccgcauuaacauuaaucuucgaccgucaucccauagcagcacucuuauguuauccagcagcuagguacuuaaugggaucuaugacaccacaagcaguccuagcuuucguaguauuaauaccaccaacacuaccuggaacuaauaucguauuaggagcuuuaccugaagaucgacauauagauagacuagcaaaaagacaaagaccaggugaacgacuagaucucgcaauguuagcagcaauaagaagaguauauggauuacuagcaaauaccguccgauauuuacaauguggaggaucauggcgagaagauuggggacaauuaucuggcacagcauuaacaccucaaggagcagaaccacaaucaaaugcaggaccaagaccacauauaggagaaacucuuuucaccuuauuuagagcaccagaauuacuagcaccaaauggugaucuauacaauguauuugcuugggcauuagauguauuagcaaaaagacuacgaccaaugcauguauucauauuagauuaugaucaaaguccagcuggaugcagagaugcauuacuacaauuaacaagcggaaugguacaaacacacguaaccacaccaggaucaauaccuaccauaugcgaccuagcaagaacauuugcaagagaaaugggagaagcacauuaa

SEQ ID NO: 6721 - protein, 376 aa, Artificial Sequence
  Thymidine_Kinase_TK__Herpes_Simplex_Virus_1_(HSV-1)__B2CPP9
MASYPGHQHASAFDQAARSRGHSNRRTALRPRRQQEATEVHLEQKMPTLLRVYIDGPHGMGKTTTTQLLVALGSRDDIVYVPEPMTYWRVLGASETIANIYTTQHRLDQGEISAGDAAVVMTSAQITMGMPYAVTDAVLAPHIGGEAGSSHAPPPALTLIFDRHPIAALLCYPAARYLMGNMTPQAVLAFVVLIPPTLPGTNIVLGALPEDRHIDRLAKRQRPGERLDLAMLAAIRRVYGLLANTVRYLQCGGSWREDWGQLSGTALTPQGAEPQSNAGPRPHIGETLFTLFRAPELLAPNGDLYNVFAWALDVLAKRLRPMHVFILDYDQSPAGCRDALLQLTSGMVQTHVTTPGSIPTICDLARTFAREMGEAN

SEQ ID NO: 6722 - RNA, 1131 nt, Artificial Sequence
  Thymidine_Kinase_TK__Herpes_Simplex_Virus_1_(HSV-1)__ACB59255
auggcuucguaccccggccaucaacacgcgucugcguucgaccaggcugcgcguucucgcggccauagcaaccgacguacggcguugcgcccucgccggcagcaagaagccacggaaguccaccuggagcagaaaaugcccacgcuacugcggguuuauauagacgguccucacgggauggggaaaaccaccaccacgcaacugcugguggcccuggguucgcgcgacgauaucgucuacguacccgagccgaugacuuacuggcgggugcugggggcuuccgagacaaucgcgaacaucuacaccacacaacaccgccucgaccagggugagauaucggccggggacgcggcggugguaaugacaagcgcccagauaacaaugggcaugccuuaugccgugaccgacgccguucuggcuccucauaucgggggggaggcugggagcucacaugccccgcccccggcccucacccucaucuucgaccgccaucccaucgccgcccuccugugcuacccggccgcgcgguaccuuaugggcaacaugaccccccaggccgugcuggcguucgugguccucaucccgccgaccuugcccggcacaaacaucguguugggggcccuuccggaggacagacacaucgaccgccuggccaaacgccagcgccccggugagcggcuugaccuggcuaugcuggccgcgauucgccgcguuuacgggcuacuugccaauacggugcgguaucugcagugcggcgggucguggcgggaggauuggggacagcuuucggggacggccuugacgccccagggugccgagccccagagcaacgcgggcccacgaccccauaucggggaaacguuauuuacccuguuucgggcccccgaguugcuggcccccaacggcgaccuguacaacguguuugccugggccuuggacgucuuggccaaacgccuccgucccaugcacgucuuuauccuggauuacgaccaaucgcccgccggcugccgggacgcccugcugcaacuuaccuccgggaugguccagacccacgucaccacccccggcuccauaccgacgaucugcgaccuggcgcgcacguuugcccgggagaugggggaggcuaacuaa

SEQ ID NO: 6723 - RNA, 1131 nt, Artificial Sequence
  derived and/or modified sequence opt1 from Thymidine_Kinase_TK__Herpes_Simplex_Virus_1_(HSV-1)__ACB59255
auggccagcuaccccggccaccagcacgccuccgcguucgaccaggccgcccgcagccgggggcacuccaaccgccggaccgcccugcgcccgcggcgccagcaggaggccaccgaggugcaccucgagcagaagaugcccacgcugcugcgggucuacaucgacggcccccacgggaugggcaagaccaccaccacgcagcuccugguggcgcuggggagccgcgacgacaucguguacguccccgagccgaugaccuacuggcgggugcucggcgccuccgagaccaucgccaacaucuacaccacgcagcaccgccuggaccagggcgagaucagcgccggggacgcggccguggucaugaccuccgcccagaucaccaugggcaugcccuacgccgugaccgacgccgugcuggcgccccacaucgggggcgaggccgggagcucccacgcgcccccgcccgcccucacgcugaucuucgaccggcaccccaucgccgcccugcucugcuaccccgccgcccgcuaccugaugggcaacaugaccccgcaggccguccuggccuucguggugcucaucccgcccacccugcccggcaccaacaucguccugggggcgcuccccgaggaccggcacaucgaccgccuggccaagcggcagcgccccggcgagcggcuggaccucgccaugcuggccgccauccgccggguguacgggcugcucgcgaacacggugcgcuaccugcagugcggcggcagcuggcgggaggacugggggcagcuguccggcaccgcccucacgccccagggggccgagccccagagcaacgccggcccgcgcccccacaucggggagacccuguucacccuguuccgcgcgcccgagcuccuggcccccaacggcgaccuguacaacgucuucgccugggcccucgacgugcuggccaagcggcugcgcccgaugcacguguucauccucgacuacgaccagucccccgcgggcugccgggacgcccugcugcagcucaccagcgggaugguccagacccacgugaccacgcccggcuccauccccaccaucugcgaccuggcccgcaccuucgcccgggagaugggggaggccaacuga

SEQ ID NO: 6724 - RNA, 1131 nt, Artificial Sequence
  derived and/or modified sequence opt2 from Thymidine_Kinase_TK__Herpes_Simplex_Virus_1_(HSV-1)__ACB59255
auggccuccuaccccggccaccagcacgccuccgccuucgaccaggccgcccgcucccgcggccacuccaaccgccgcaccgcccuccgcccccgccgccagcaggaggccaccgagguccaccucgagcagaagaugcccacccuccuccgcgucuacaucgacggcccccacggcaugggcaagaccaccaccacccagcuccucgucgcccucggcucccgcgacgacaucgucuacguccccgagcccaugaccuacuggcgcguccucggcgccuccgagaccaucgccaacaucuacaccacccagcaccgccucgaccagggcgagaucuccgccggcgacgccgccgucgucaugaccuccgcccagaucaccaugggcaugcccuacgccgucaccgacgccguccucgccccccacaucggcggcgaggccggcuccucccacgcccccccccccgcccucacccucaucuucgaccgccaccccaucgccgcccuccucugcuaccccgccgcccgcuaccucaugggcaacaugaccccccaggccguccucgccuucgucguccucaucccccccacccuccccggcaccaacaucguccucggcgcccuccccgaggaccgccacaucgaccgccucgccaagcgccagcgccccggcgagcgccucgaccucgccaugcucgccgccauccgccgcgucuacggccuccucgccaacaccguccgcuaccuccagugcggcggcuccuggcgcgaggacuggggccagcucuccggcaccgcccucaccccccagggcgccgagccccaguccaacgccggcccccgcccccacaucggcgagacccucuucacccucuuccgcgcccccgagcuccucgcccccaacggcgaccucuacaacgucuucgccugggcccucgacguccucgccaagcgccuccgccccaugcacgucuucauccucgacuacgaccagucccccgccggcugccgcgacgcccuccuccagcucaccuccggcaugguccagacccacgucaccacccccggcuccauccccaccaucugcgaccucgcccgcaccuucgcccgcgagaugggcgaggccaacuga

SEQ ID NO: 6725 - RNA, 1131 nt, Artificial Sequence
  derived and/or modified sequence opt3 from Thymidine_Kinase_TK__Herpes_Simplex_Virus_1_(HSV-1)__ACB59255
auggccagcuaccccggccaccagcaugcuuccgcauucgaccaagccgcgagaucuagggggcacucaaaccggcgcaccgcucugcgaccucguagacagcaggaggccacagaagugcaucucgagcagaagaugccaacucuucugagggucuauaucgauggaccgcacgguaugggcaaaacgaccacaacucaauuguuaguugcacuggggagucgggacgauauuguguacguacccgaaccuaugaccuauuggcgcgugcuaggagccagcgagacaauagcuaauaucuacaccacucagcauagacucgaccagggcgaaauuuccgccggugaugccgcugucgugaugacaucugcccagaucaccauggggaugccauaugcgguuacggacgcagugcuggcaccccacauuggaggcgaggcuggcucgucacacgccccuccacccgcacuuacucugaucuuugauaggcauccuauagcugccuugcucugcuacccagcggcccgguaucugauggggaacaugaccccgcaagcaguccuggcuuucgugguacucauucccccuacauuaccaggaacuaauaucguucugggugcccuucccgaggaccgccacaucgaucgauuggcuaagagacagaggccuggcgaacggcuggaccuagccaugcucgcagccauucgucgcguguacgggcugcuugcuaacaccgucagauaccugcaguguggaggcagcuggagggaggauuggggucaguugagugggacagcgcucaccccacaaggagcagaaccccaguccaaugccggcccgcggccucauaucggcgagacgcuguuuacuuuauuccgagcucccgagcugcucgccccaaacggggaccuuuauaauguguuugcaugggcccuggauguguuggcuaaacgccuaagaccuaugcacgucuucauacuggacuacgaccagucucccgccggaugcagggaugcacuccugcaacuuacaagcgguaugguucagacccacgugacuacaccaggcuccauucccaccaucugugaccuggcgcggacguuugcucgcgaaaugggggaggccaacuga

SEQ ID NO: 6726 - RNA, 1131 nt, Artificial Sequence
  derived and/or modified sequence opt4 from Thymidine_Kinase_TK__Herpes_Simplex_Virus_1_(HSV-1)__ACB59255
auggccagcuaccccggccaccagcacgccagcgccuucgaccaggccgccagaagcagaggccacagcaacagaagaaccgcccugagacccagaagacagcaggaggccaccgaggugcaccuggagcagaagaugcccacccugcugagaguguacaucgacggcccccacggcaugggcaagaccaccaccacccagcugcugguggcccugggcagcagagacgacaucguguacgugcccgagcccaugaccuacuggagagugcugggcgccagcgagaccaucgccaacaucuacaccacccagcacagacuggaccagggcgagaucagcgccggcgacgccgccguggugaugaccagcgcccagaucaccaugggcaugcccuacgccgugaccgacgccgugcuggccccccacaucggcggcgaggccggcagcagccacgcccccccccccgcccugacccugaucuucgacagacaccccaucgccgcccugcugugcuaccccgccgccagauaccugaugggcaacaugaccccccaggccgugcuggccuucguggugcugaucccccccacccugcccggcaccaacaucgugcugggcgcccugcccgaggacagacacaucgacagacuggccaagagacagagacccggcgagagacuggaccuggccaugcuggccgccaucagaagaguguacggccugcuggccaacaccgugagauaccugcagugcggcggcagcuggagagaggacuggggccagcugagcggcaccgcccugaccccccagggcgccgagccccagagcaacgccggccccagaccccacaucggcgagacccuguucacccuguucagagcccccgagcugcuggcccccaacggcgaccuguacaacguguucgccugggcccuggacgugcuggccaagagacugagacccaugcacguguucauccuggacuacgaccagagccccgccggcugcagagacgcccugcugcagcugaccagcggcauggugcagacccacgugaccacccccggcagcauccccaccaucugcgaccuggccagaaccuucgccagagagaugggcgaggccaacuga

SEQ ID NO: 6727 - RNA, 1131 nt, Artificial Sequence
  derived and/or modified sequence opt5 from Thymidine_Kinase_TK__Herpes_Simplex_Virus_1_(HSV-1)__ACB59255
auggccagcuaccccggccaccagcaugcuuccgccuucgaccaagcggcuagaucucgggggcacagcaaccgcagaaccgcccugcggccucgcagacagcaggaggccacagaagugcaucucgagcagaagaugccgacgcugcuucgggucuauaucgauggaccccacggcauggggaaaaccacaaccacacaacugcucguugcucugggaucccgcgacgauauuguguacgugccugaacccaugaccuauuggagaguccuuggcgccucugagacaaucgcuaauauuuacaccacgcagcaucggcuggaccagggggaaaucagcgccggagaugcggccgugguuaugaccuccgcucagauuacaaugggcaugccuuaugccgugaccgacgcuguccucgcgccccacaucggcggggaggccggaucuagccacgccccuccgcccgcucugacacugaucuuugaucgccauccuauugccgcucuccugugcuaccccgccgccagauaucuuaugggcaacaugaccccucaagcugugcuggcguucguugugcucauucccccgacgcugccugggacaaauaucguccuuggagcccugcccgaggaccggcacaucgaucgccucgcuaagagacagcggccuggcgaacgccuggaccuggccaugcucgccgcuauuagacggguguacgggcugcuugccaacaccgugagauaccugcaguguggaggcuccuggcgcgaggauuggggccagcucagcgggacagcgcugacaccccaaggagcugaaccccagucuaaugccggcccucggccgcauaucggggagacccuuuuuacccuguucagagcccccgagcuccuggcuccuaacggagaccuguauaaugucuuugccugggcucucgauguucuggccaaacgccuucggcccaugcacguguucauucuggacuacgaccaguccccugcgggcugcagagaugcccuccugcaacuuacgagcgggauggugcagacccacgucacaacccccggaucuaucccgacaaucugugaccuggcucgcaccuuugcccgggaaaugggcgaggcuaacuga

SEQ ID NO: 6728 - RNA, 1131 nt, Artificial Sequence
  derived and/or modified sequence opt6 from Thymidine_Kinase_TK__Herpes_Simplex_Virus_1_(HSV-1)__ACB59255
auggcaucauacccaggacaccaacacgccagugcuuuugaucaagcugcaagaaguagaggacauucaaauagaagaacugcauuaagaccaagaagacaacaagaagcaacagaaguacauuuagaacaaaaaaugccuacacuauuaagaguauauaucgauggaccucauggaauggguaaaacuacuacaacacaauuacuaguagcucuaggcaguagagaugacauuguauauguaccagaaccuaugacauauuggagaguacuaggagcaucagaaacaauagcaaacauuuauacaacacaacauagacucgaucaaggagaaauaagcgcaggcgaugcagcaguaguaaugacaucugcacaaauuacuaugggaaugcccuaugccguaacagacgcuguacuagccccucauauugguggagaagcgggaagcucacaugcaccaccaccagcacucaccuuaauauuugacagacauccaauugcagcauuauuauguuauccagcagcaagauaucuaaugggaaauaugacuccacaagcaguauuagcauucguuguacuaauaccuccaacauuaccaggaacaaacauaguuuuaggagcauuaccugaagauagacacauagauagauuagcaaaaagacaaagaccaggagaacgacuagaccuagcaaugcuagcagcaauaagaagaguauaugguuuauuagcaaauacaguacgauaucuucaaugugguggaucauggagagaagauuggggacaauuaaguggaaccgcauuaacaccacaaggagcagaaccacaaucaaacgcaggaccaagaccacacauaggcgaaacauuauucacauuauuuagagcaccagaacuauuagccccaaauggagaucuguauaaugucuucgcuugggcauuagauguauuagcaaaaagauuaagaccuaugcauguauuuauauuagacuaugaucaaaguccagcuggauguagagacgcauuauuacaauuaacaucaggaaugguacaaacucauguaacaacaccuggaaguauacccacaauaugugacuuagccagaacauuugcacgagaaaugggagaagccaauuaa

SEQ ID NO: 6729 - protein, 375 aa, Artificial Sequence
  Thymidine_Kinase_TK__Herpes_Simplex_Virus_1_(HSV-1)__B2CPQ0
MASYPCHQHASAFDQAARSRGHNNRRTALRPRRQQKATEVRLEQKMPTLLRVYIDGPHGMGKTTTTQLLVALGSRDDIVYVPEPMTYWRVLGASETIANIYTTQHRLDQGEISAGDAAVVMTSAQITMGMPYAVTDAVLAPHIGGEAGSSHAPPPALTLIFDRHPIAALLCYPAARYLMGSMTPQAVLAFVALPPTLPGTNIVLGALPEDRHIDRLAKRQRPGERLDLAMLAAIRRVYELLANTVRYLQGGGSWREDWGQLSGTAVPPQGAEPQSNAGPQPHIGDTLFTLFRAPELLAPNGDLYNVFAWALDVLAKRLRPMHVFILDYDQSPAGCRDALLQLTSGMVQTHVTTPGSIPTICDLARTFAREMGEAN

SEQ ID NO: 6730 - RNA, 1128 nt, Artificial Sequence
  Thymidine_Kinase_TK__Herpes_Simplex_Virus_1_(HSV-1)__ACB59256
auggcuucguaccccugccaucaacacgcgucugcguucgaccaggcugcgcguucucgcggccauaacaaccgacguacggcguugcgcccucgccggcagcaaaaagccacggaaguccgccuggagcagaaaaugcccacgcuacugcggguuuauauagacgguccccacgggauggggaaaaccaccaccacgcaacugcugguggcccuggguucgcgcgacgauaucgucuacguacccgagccgaugacuuacuggcgggugcugggggcuuccgagacaaucgcgaacaucuacaccacacaacaccgccucgaccagggugagauaucggccggggacgcggcggugguaaugacaagcgcccagauaacaaugggcaugccuuaugccgugaccgacgccguucuggcuccucauaucgggggggaggcugggagcucacaugccccgcccccggcccucacccucaucuucgaccgccaucccaucgccgcccuccuguguuacccggccgcgcgauaccuuaugggcagcaugaccccccaggccgugcuggcguucguggcccucccgccgaccuugcccggcacaaacaucguguugggggcccuuccggaggacagacacaucgaccgccuggccaaacgccagcgccccggcgagcggcuugaccuggcuaugcuggccgcgauucgccgcguuuacgagcugcuugccaauacggugcgguaucugcagggcggcgggucguggcgggaggauuggggacagcuuucggggacggccgugccgccccagggugccgagccccagagcaacgcgggcccacaaccccauaucggggacacguuauuuacccuguuucgggcccccgaguugcuggcccccaacggcgaccuguauaacguguuugccugggccuuggacgucuuggccaaacgccuccgucccaugcacgucuuuauccuggauuacgaccaaucgcccgccggcugccgggacgcccugcugcaacuuaccuccgggaugguccagacccacgucaccacccccggcuccauaccgacgaucugcgaccuggcgcgcacguuugcccgggagaugggggaggcuaacuaa

SEQ ID NO: 6731 - RNA, 1128 nt, Artificial Sequence
  derived and/or modified sequence opt1 from Thymidine_Kinase_TK__Herpes_Simplex_Virus_1_(HSV-1)__ACB59256
auggccagcuaccccugccaccagcacgccuccgcguucgaccaggccgcccgcagccggggccacaacaaccgccggaccgcccugcgcccgcggcgccagcagaaggccaccgaggugcggcucgagcagaagaugcccacgcugcugcgcgucuacaucgacgggccccacggcauggggaagaccaccaccacgcagcuccugguggcgcugggcucccgggacgacaucguguacguccccgagccgaugaccuacuggcgcgugcucggggccagcgagaccaucgccaacaucuacaccacgcagcaccggcuggaccagggcgagaucuccgccggcgacgcggccguggucaugaccagcgcccagaucaccauggggaugcccuacgccgugaccgacgccgugcuggcgccccacaucggcggggaggccggcuccagccacgcgcccccgcccgcccucacgcugaucuucgaccgccaccccaucgccgcccugcucugcuaccccgccgcccgguaccugaugggguccaugaccccgcaggccguccuggccuucguggcgcucccgcccacccugcccggcaccaacaucgugcugggcgcccuccccgaggaccgccacaucgaccggcuggccaagcgccagcggcccggggagcgccuggaccucgccaugcuggccgcgauccggcgcgucuacgagcugcucgccaacacggugcgguaccugcagggcgggggcagcuggcgcgaggacuggggccagcuguccgggaccgccgugccgccccagggcgccgagccccagagcaacgcggggccccagccccacaucggcgacacccucuucacccuguuccgcgcccccgagcugcucgccccgaacggggaccuguacaacgucuucgccugggcccuggacgugcucgcgaagcggcugcgccccaugcacguguucauccuggacuacgaccagucccccgccggcugccgggacgcccuccugcagcugacgagcggcaugguccagacccacgugaccacccccggguccaucccgacgaucugcgaccucgcccgcaccuucgcccgggagaugggcgaggcgaacuga

SEQ ID NO: 6732 - RNA, 1128 nt, Artificial Sequence
  derived and/or modified sequence opt2 from Thymidine_Kinase_TK__Herpes_Simplex_Virus_1_(HSV-1)__ACB59256
auggccuccuaccccugccaccagcacgccuccgccuucgaccaggccgcccgcucccgcggccacaacaaccgccgcaccgcccuccgcccccgccgccagcagaaggccaccgagguccgccucgagcagaagaugcccacccuccuccgcgucuacaucgacggcccccacggcaugggcaagaccaccaccacccagcuccucgucgcccucggcucccgcgacgacaucgucuacguccccgagcccaugaccuacuggcgcguccucggcgccuccgagaccaucgccaacaucuacaccacccagcaccgccucgaccagggcgagaucuccgccggcgacgccgccgucgucaugaccuccgcccagaucaccaugggcaugcccuacgccgucaccgacgccguccucgccccccacaucggcggcgaggccggcuccucccacgcccccccccccgcccucacccucaucuucgaccgccaccccaucgccgcccuccucugcuaccccgccgcccgcuaccucaugggcuccaugaccccccaggccguccucgccuucgucgcccucccccccacccuccccggcaccaacaucguccucggcgcccuccccgaggaccgccacaucgaccgccucgccaagcgccagcgccccggcgagcgccucgaccucgccaugcucgccgccauccgccgcgucuacgagcuccucgccaacaccguccgcuaccuccagggcggcggcuccuggcgcgaggacuggggccagcucuccggcaccgccguccccccccagggcgccgagccccaguccaacgccggcccccagccccacaucggcgacacccucuucacccucuuccgcgcccccgagcuccucgcccccaacggcgaccucuacaacgucuucgccugggcccucgacguccucgccaagcgccuccgccccaugcacgucuucauccucgacuacgaccagucccccgccggcugccgcgacgcccuccuccagcucaccuccggcaugguccagacccacgucaccacccccggcuccauccccaccaucugcgaccucgcccgcaccuucgcccgcgagaugggcgaggccaacuga

SEQ ID NO: 6733 - RNA, 1128 nt, Artificial Sequence
  derived and/or modified sequence opt3 from Thymidine_Kinase_TK__Herpes_Simplex_Virus_1_(HSV-1)__ACB59256
auggccagcuaccccugccaccagcaugcuuccgcauucgaccaagccgcgagaucuaggggccacaacaaucggcgcaccgcucugcgaccucguagacagcagaaggccacagaggugaggcucgaacagaaaaugccaacucuucugcgggucuauaucgaugggccgcauggaauggguaagacgaccacaacucaauuguuaguugcacugggcucacgcgacgauauuguguacguacccgagccuaugaccuauuggagagugcuaggggccagugaaacaauagcuaacaucuacaccacucagcacaggcucgaccagggagagauuagcgcaggcgaugccgcugucgugaugacauccgcccagaucaccauggguaugccauaugcgguuacggacgcagugcuggcuccccauauugggggagaagcugggucuucgcacgccccuccacccgcacuuacucugaucuuugaucggcacccuauagcugccuugcucuguuacccagcggcccgcuaucugaugggcucaaugaccccgcaagcaguccuggcuuucguggccuuacccccuacacucccaggcacuaauaucguacugggagcccuucccgaggaccgacauauugauagauuggccaaaaggcagcggccuggugagcgucuggaccuagcaaugcucgccgcuauccgcagaguuuacgaacugcuugcgaacaccgugagguaccugcagggcgggggaagcuggcgggaggauuggggccaguugagugguacagcagucccaccccaaggggccgaaccgcaguccaaugcuggaccucagccccacauuggcgacacccucuuuacgcuguuccgagccccagaguuacuggcaccuaacggcgaucucuauaauguguuugccugggcucuugacgugcuggccaagcgcuugagacccaugcaugucuucauccuagacuacgaucaaucuccagcagggugcagggacgcgcugcuccagcugacuagcggaaugguucagacacacgugaccacucccgguuccauaccuacaauuugugaucuugcucggaccuuugcccgcgagaugggcgaagcaaacuga

SEQ ID NO: 6734 - RNA, 1128 nt, Artificial Sequence
  derived and/or modified sequence opt4 from Thymidine_Kinase_TK__Herpes_Simplex_Virus_1_(HSV-1)__ACB59256
auggccagcuaccccugccaccagcacgccagcgccuucgaccaggccgccagaagcagaggccacaacaacagaagaaccgcccugagacccagaagacagcagaaggccaccgaggugagacuggagcagaagaugcccacccugcugagaguguacaucgacggcccccacggcaugggcaagaccaccaccacccagcugcugguggcccugggcagcagagacgacaucguguacgugcccgagcccaugaccuacuggagagugcugggcgccagcgagaccaucgccaacaucuacaccacccagcacagacuggaccagggcgagaucagcgccggcgacgccgccguggugaugaccagcgcccagaucaccaugggcaugcccuacgccgugaccgacgccgugcuggccccccacaucggcggcgaggccggcagcagccacgcccccccccccgcccugacccugaucuucgacagacaccccaucgccgcccugcugugcuaccccgccgccagauaccugaugggcagcaugaccccccaggccgugcuggccuucguggcccugccccccacccugcccggcaccaacaucgugcugggcgcccugcccgaggacagacacaucgacagacuggccaagagacagagacccggcgagagacuggaccuggccaugcuggccgccaucagaagaguguacgagcugcuggccaacaccgugagauaccugcagggcggcggcagcuggagagaggacuggggccagcugagcggcaccgccgugcccccccagggcgccgagccccagagcaacgccggcccccagccccacaucggcgacacccuguucacccuguucagagcccccgagcugcuggcccccaacggcgaccuguacaacguguucgccugggcccuggacgugcuggccaagagacugagacccaugcacguguucauccuggacuacgaccagagccccgccggcugcagagacgcccugcugcagcugaccagcggcauggugcagacccacgugaccacccccggcagcauccccaccaucugcgaccuggccagaaccuucgccagagagaugggcgaggccaacuga

SEQ ID NO: 6735 - RNA, 1128 nt, Artificial Sequence
  derived and/or modified sequence opt5 from Thymidine_Kinase_TK__Herpes_Simplex_Virus_1_(HSV-1)__ACB59256
auggccagcuaccccugccaccagcaugcuuccgccuucgaccaagcggcuagaucucggggccacaacaaucgcagaaccgcccugcggccucgcagacagcagaaggccacagaggugcggcucgaacagaaaaugccgacgcugcuucgcgucuauaucgaugggccccauggaaugggcaagaccacaaccacacaacugcucguugcucuggggagcagagacgauauuguguacgugccugagcccaugaccuauuggcggguccuuggagccuccgaaacaaucgcuaacauuuacaccacgcagcaccgccuggaccagggcgagaucucugccggggaugcggccgugguuaugaccagcgcucagauuacaaugggaaugccuuaugccgugaccgacgcuguccucgcgccccauaucggcggcgaagccggguccucucacgccccuccgcccgcucugacacugaucuuugauagacacccuauugccgcucuccuguguuaccccgccgcccgguaucuuaugggaagcaugaccccucaagcugugcuggcguucguugcccugcccccgacgcucccuggcacaaauaucgugcuuggggcucugcccgaggaccgccauauugauagacucgccaaacggcagcgcccuggagagagacuggaccuggccaugcucgcugccauccggagagucuacgaacugcuugcgaacaccgugcgcuaccugcagggcgggggauccuggcgggaggauuggggccagcucagcggcacagcugugccuccccaaggggccgaaccccagucuaaugccggaccgcagccccacauuggcgacacccuguuuacccuuuucagagcuccugagcugcucgcccccaacggggaucuguauaaugucuuugcuugggcccuggacguucucgcgaagcgccugcggccuaugcauguguucauccuugacuacgaucaaucccccgccggaugcagagacgcucugcuccagcugacaagcggcauggugcagacgcacgucaccacaccggggucuauuccuaccaucugugaucuugcccgcacauuugcucgggagaugggagaagccaacuga

SEQ ID NO: 6736 - RNA, 1128 nt, Artificial Sequence
  derived and/or modified sequence opt6 from Thymidine_Kinase_TK__Herpes_Simplex_Virus_1_(HSV-1)__ACB59256
auggcuucauauccaugucaucaacaugcauccgcauuugaucaagcagcaagaucaagaggacauaauaaucgaagaacagcccuuagaccaagaagacaacaaaaagcuacagaaguuagauuagaacaaaaaaugccaacauuauuaagaguauauauagauggaccacaugguauggguaaaacuacaacaacacaauuacucguugcauuaggaucaagggacgacauaguauacguaccagaaccaaugacauacuggagaguacucggcgcuagugaaacgauugcuaauauauauacaacacaacacagauuagaccaaggagaaauaucagcaggagaugcagcaguaguuaugacaucagcucaaauaacaauggguaugccauaugcaguaacagaugcgguccuagcaccacauauuggcggcgaagcuggaucaucacacgcaccaccaccagcauuaacauuaauauuugauagacauccaauagccgcauuauuauguuauccagcagcuagauaucuaaugggauccaugacaccacaagcaguauuagcuuuuguagcauuaccaccuacuuuaccagggacaaauauaguucuaggugcuuuaccagaagauagacauauagauagacuagcaaaaagacaacgaccaggagaaagauuagauuuagcaauguuagcagcaauaagaagaguuuacgaacuauuagcaaauacaguuagauaucuacaaggaggaggaucauggagagaagauuggggacaauuaucuggaacagcaguaccaccacaaggagcagaaccacaauccaaugcaggaccucaaccacauauaggagauacacuauuuacauuauucagagcaccagaauuauuagcaccaaauggugaucuauauaauguuuuugcaugggcucuagauguauuagcaaaaagauuaagaccaaugcauguauuuauauuagauuaugaucaaucaccagcugguuguagagaugcacuacuacaauuaacaucagguaugguucaaacucacguuaccacaccaggcaguauaccaacaauaugugaucuagcaagaacauuugcacgagaaaugggagaagcaaauuaa

SEQ ID NO: 6737 - protein, 227 aa, Artificial Sequence
  Thymidine_Kinase_TK__Herpes_Simplex_Virus_1_(HSV-1)__B2CPQ2
MASYPGHQHASAFDQAARSRGHSNRRTALRPRRQQEATEVRPEQKMPTLLRVYIDGPHGMGKTTTTQLLVALGSRDDIVYVPEPMTYWQVLGASETIANIYTTQHRLDQGEISAGDAAVVMTSAQITMGMPYAVTDAVLAPHIGGGGWELTCPAPGPHPHLRPPSHRRPPVLPGRAIPYGQHDPPGRAGVRGPHPADLARHKHRVGGPSGGQTHRPPGQTPAPRRAA

SEQ ID NO: 6738 - RNA, 684 nt, Artificial Sequence
  Thymidine_Kinase_TK__Herpes_Simplex_Virus_1_(HSV-1)__ACB59258
auggcuucguaccccggccaucagcacgcgucugcguucgaccaggcugcgcguucucgcggccauagcaaccgacguacggcguugcgcccucgccggcagcaagaagccacggaaguccgcccggagcagaaaaugcccacgcuacugcggguuuauauagacgguccccacgggauggggaaaaccaccaccacgcaacugcugguggcccuggguucgcgcgacgauaucgucuacguacccgagccgaugacuuacuggcaggugcugggggcuuccgagacaaucgcgaacaucuacaccacacaacaccgccucgaccagggugagauaucggccggggacgcggcggugguaaugacaagcgcccagauaacaaugggcaugccuuaugccgugaccgacgccguucuggcuccucauaucggggggggaggcugggagcucacaugccccgcccccggcccucacccucaucuucgaccgccaucccaucgccgcccuccuguguuacccggccgcgcgauaccuuaugggcagcaugaccccccaggccgugcuggcguucguggcccucaucccgccgaccuugcccggcacaaacaucguguugggggcccuuccggaggacagacacaucgaccgccuggccaaacgccagcgccccggcgagcggcuuga

SEQ ID NO: 6739 - RNA, 684 nt, Artificial Sequence
  derived and/or modified sequence opt1 from Thymidine_Kinase_TK__Herpes_Simplex_Virus_1_(HSV-1)__ACB59258
auggccagcuaccccggccaccagcacgccuccgccuucgaccaggccgcccgcagccgggggcacuccaaccgccggaccgcccugcgcccgcggcgccagcaggaggccaccgaggugcggcccgagcagaagaugcccacgcuccugcgcguguacaucgacggcccccacgggaugggcaagaccaccaccacgcagcugcucguggcgcuggggagccgggacgacaucguguacgucccggagcccaugaccuacuggcagguccugggcgccuccgagaccaucgccaacaucuacaccacgcagcaccgccucgaccagggcgagaucagcgccggggacgcggccguggugaugaccuccgcccagaucaccaugggcaugcccuacgccgugaccgacgccgugcuggcgccccacaucgggggcgggggcugggagcugacgugcccggcccccggcccccacccccaccuccggccgcccagccaccgccggccgcccguccugcccgggcgcgccauccccuacggccagcacgacccgcccgggcgggccggcgugcgcggcccccaccccgccgaccuggcgcggcacaagcaccgcgucgggggccccuccgggggccagacccaccggcccccggggcagacccccgcgccccgccgggccgccuga

SEQ ID NO: 6740 - RNA, 684 nt, Artificial Sequence
  derived and/or modified sequence opt2 from Thymidine_Kinase_TK__Herpes_Simplex_Virus_1_(HSV-1)__ACB59258
auggccuccuaccccggccaccagcacgccuccgccuucgaccaggccgcccgcucccgcggccacuccaaccgccgcaccgcccuccgcccccgccgccagcaggaggccaccgagguccgccccgagcagaagaugcccacccuccuccgcgucuacaucgacggcccccacggcaugggcaagaccaccaccacccagcuccucgucgcccucggcucccgcgacgacaucgucuacguccccgagcccaugaccuacuggcagguccucggcgccuccgagaccaucgccaacaucuacaccacccagcaccgccucgaccagggcgagaucuccgccggcgacgccgccgucgucaugaccuccgcccagaucaccaugggcaugcccuacgccgucaccgacgccguccucgccccccacaucggcggcggcggcugggagcucaccugccccgcccccggcccccacccccaccuccgcccccccucccaccgccgcccccccguccuccccggccgcgccauccccuacggccagcacgacccccccggccgcgccggcguccgcggcccccaccccgccgaccucgcccgccacaagcaccgcgucggcggccccuccggcggccagacccaccgcccccccggccagacccccgccccccgccgcgccgccuga

SEQ ID NO: 6741 - RNA, 684 nt, Artificial Sequence
  derived and/or modified sequence opt3 from Thymidine_Kinase_TK__Herpes_Simplex_Virus_1_(HSV-1)__ACB59258
auggccagcuaccccggccaccagcaugcuuccgcauucgaccaagccgcgagaucuagggggcacucaaaccggcgcaccgcucugcgaccucguagacagcaggaggccacagaagugaggccagagcagaagaugccgacucuccuucgggucuauaucgauggaccccaugguaugggcaaaacgaccacaacucaacuguugguugcauuagggagucgcgacgauauuguguacguaccugaaccaaugaccuauuggcaagugcugggagccagcgagacaauagcuaauaucuacaccacucagcacagacuagaccagggcgaaauuuccgccggugaugcagcugucgugaugacaucugcccagaucaccauggggaugcccuaugcgguuacggacgcagugcucgccccucauauuggaggcggcgggugggagcugacuugcccagcucccggaccucacccacaccuuaggccgcccucgcaucggcgcccuccaguccugcccggucgagccaucccuuacggccagcacgauccacccgggagagcaggagugaggggcccgcauccugcugacuuggcccggcacaagcaccguguaggugggcccucaggaggccagacccaucgcccaccuggccagacacccgcgccaagaagggccgcauga

SEQ ID NO: 6742 - RNA, 684 nt, Artificial Sequence
  derived and/or modified sequence opt4 from Thymidine_Kinase_TK__Herpes_Simplex_Virus_1_(HSV-1)__ACB59258
auggccagcuaccccggccaccagcacgccagcgccuucgaccaggccgccagaagcagaggccacagcaacagaagaaccgcccugagacccagaagacagcaggaggccaccgaggugagacccgagcagaagaugcccacccugcugagaguguacaucgacggcccccacggcaugggcaagaccaccaccacccagcugcugguggcccugggcagcagagacgacaucguguacgugcccgagcccaugaccuacuggcaggugcugggcgccagcgagaccaucgccaacaucuacaccacccagcacagacuggaccagggcgagaucagcgccggcgacgccgccguggugaugaccagcgcccagaucaccaugggcaugcccuacgccgugaccgacgccgugcuggccccccacaucggcggcggcggcugggagcugaccugccccgcccccggcccccacccccaccugagaccccccagccacagaagaccccccgugcugcccggcagagccauccccuacggccagcacgacccccccggcagagccggcgugagaggcccccaccccgccgaccuggccagacacaagcacagagugggcggccccagcggcggccagacccacagaccccccggccagacccccgcccccagaagagccgccuga

SEQ ID NO: 6743 - RNA, 684 nt, Artificial Sequence
  derived and/or modified sequence opt5 from Thymidine_Kinase_TK__Herpes_Simplex_Virus_1_(HSV-1)__ACB59258
auggccagcuaccccggccaccagcaugcuuccgccuucgaccaagcggcuagaucucgggggcacagcaaccgcagaaccgcccugcggccucgcagacagcaggaggccacagaagugcggccggagcagaagaugcccacgcuccugcgcgucuauaucgauggaccucauggcauggggaaaaccacaaccacacaacuucugguugcucucggauccagagacgauauuguguacgugcccgaaccuaugaccuauuggcagguccugggcgccucugagacaaucgcuaauauuuacaccacgcagcaccggcuugaccagggggaaaucagcgccggagaugcggccgugguuaugaccuccgcucaaauuacaaugggcaugcccuaugccgugaccgacgcuguccuggccccucauaucggcgggggaggcugggagcucacaugcccggcgcccgggccucacccccaucugcgcccucccucucacagacggccgccugugcugcccggacgcgccaucccuuacggccagcacgauccucccgggagagcuggaguucggggcccccauccggccgaccucgcucgccacaagcacagagugggcgggcccagcggaggccagacccaucggccucccgggcagacgccugcccccagacgcgccgcuuga

SEQ ID NO: 6744 - RNA, 684 nt, Artificial Sequence
  derived and/or modified sequence opt6 from Thymidine_Kinase_TK__Herpes_Simplex_Virus_1_(HSV-1)__ACB59258
auggcaucauauccaggacaucaacaugcaagcgcauuugaucaagcagcaagaagcagaggacauucaaaucgaagaacagcuuuaagaccaagaagacaacaagaagcaacagaaguaagaccagaacaaaaaaugccaacauuacuaagaguuuauauagaugguccccauggaauggguaaaacaacuacuacacaauuauuaguagcauuaggaucaagagaugauauaguauacguuccagaaccaaugacauauuggcaaguauuaggagcaucagaaacaaucgcaaauauauacaccacacaacauagauuagaucaaggagaaauaagugcaggugaugcagcaguaguuaugacaagugcucaaauaacuaugggaaugccauaugcaguaacagaugcaguauuagcaccacauauaggaggaggaggaugggaauuaacauguccagcaccaggaccacauccacauuuaagaccacccucucauagaagaccaccaguucuaccaggaagagcaauaccauauggacaacaugacccaccaggaagagcaggaguaagaggaccacauccagcagauuuagcacgacauaaacacagaguuggaggaccaucaggaggacaaacucaucgcccaccuggacaaacaccagcaccaagaagagcagcauaa

SEQ ID NO: 6745 - protein, 227 aa, Artificial Sequence
  Thymidine_Kinase_TK__Herpes_Simplex_Virus_1_(HSV-1)__B2CPQ3
MASYPGHQHASAFDQAARSRGHSNRRTALRPRRQQEATEVRPEQKMPTLLRVYIDGPHGMGKTTTTQLLVALGSRDDIVYVPEPMTYWRVLGASETIANIYTTQHRLDQGEISAGDAAVVMTSAQITMGMPYAVTDAVLAPHIGGGGWELTCPAPGPHPHLRPPSHRRPPVLPGRAIPYGQHDPPGRAGVRGPHPADLARHKHRVGGPSGGQTHRPPGQTPAPRRAA

SEQ ID NO: 6746 - RNA, 684 nt, Artificial Sequence
  Thymidine_Kinase_TK__Herpes_Simplex_Virus_1_(HSV-1)__ACB59259
auggcuucguaccccggccaucaacacgcgucugcguucgaccaggcugcgcguucucgcggccauagcaaccgacguacggcguugcgcccucgccggcagcaagaagccacggaaguccgcccggagcagaaaaugcccacgcuacugcggguuuauauagacgguccccacgggauggggaaaaccaccaccacgcaacugcugguggcccuggguucgcgcgacgauaucgucuacguacccgagccgaugacuuacuggcgggugcugggggcuuccgagacaaucgcgaacaucuacaccacacaacaccgccucgaccagggugagauaucggccggggacgcggcggugguaaugacaagcgcccagauaacaaugggcaugccuuaugccgugaccgacgccguucuggcuccucauaucggggggggaggcugggagcucacaugccccgcccccggcccucacccucaucuucgaccgccaucccaucgccgcccuccuguguuacccggccgcgcgauaccuuaugggcagcaugaccccccaggccgugcuggcguucguggcccucaucccgccgaccuugcccggcacaaacaucguguugggggcccuuccggaggacagacacaucgaccgccuggccaaacgccagcgccccggcgagcggcuuga

SEQ ID NO: 6747 - RNA, 684 nt, Artificial Sequence
  derived and/or modified sequence opt1 from Thymidine_Kinase_TK__Herpes_Simplex_Virus_1_(HSV-1)__ACB59259
auggccagcuaccccggccaccagcacgccuccgccuucgaccaggccgcccgcagccgggggcacuccaaccgccggaccgcccugcgcccgcggcgccagcaggaggccaccgaggugcggcccgagcagaagaugcccacgcuccugcgcguguacaucgacggcccccacgggaugggcaagaccaccaccacgcagcugcucguggcgcuggggagccgggacgacaucguguacgucccggagcccaugaccuacuggcgcgugcugggcgccuccgagaccaucgccaacaucuacaccacgcagcaccggcucgaccagggcgagaucagcgccggggacgcggccguggucaugaccuccgcccagaucaccaugggcaugcccuacgccgugaccgacgccgugcuggcgccccacaucgggggcgggggcugggagcugacgugcccggcccccggcccccacccccaccuccgcccgcccagccaccggcgcccgcccguccugcccgggcgggccauccccuacggccagcacgacccgcccgggcgcgccggcgugcggggcccccaccccgccgaccuggcgcgccacaagcaccgggucgggggccccuccgggggccagacccaccggcccccggggcagacccccgcgccccgccgcgccgccuga

SEQ ID NO: 6748 - RNA, 684 nt, Artificial Sequence
  derived and/or modified sequence opt2 from Thymidine_Kinase_TK__Herpes_Simplex_Virus_1_(HSV-1)__ACB59259
auggccuccuaccccggccaccagcacgccuccgccuucgaccaggccgcccgcucccgcggccacuccaaccgccgcaccgcccuccgcccccgccgccagcaggaggccaccgagguccgccccgagcagaagaugcccacccuccuccgcgucuacaucgacggcccccacggcaugggcaagaccaccaccacccagcuccucgucgcccucggcucccgcgacgacaucgucuacguccccgagcccaugaccuacuggcgcguccucggcgccuccgagaccaucgccaacaucuacaccacccagcaccgccucgaccagggcgagaucuccgccggcgacgccgccgucgucaugaccuccgcccagaucaccaugggcaugcccuacgccgucaccgacgccguccucgccccccacaucggcggcggcggcugggagcucaccugccccgcccccggcccccacccccaccuccgcccccccucccaccgccgcccccccguccuccccggccgcgccauccccuacggccagcacgacccccccggccgcgccggcguccgcggcccccaccccgccgaccucgcccgccacaagcaccgcgucggcggccccuccggcggccagacccaccgcccccccggccagacccccgccccccgccgcgccgccuga

SEQ ID NO: 6749 - RNA, 684 nt, Artificial Sequence
  derived and/or modified sequence opt3 from Thymidine_Kinase_TK__Herpes_Simplex_Virus_1_(HSV-1)__ACB59259
auggccagcuaccccggccaccagcaugcuuccgcauucgaccaagccgcgagaucuagggggcacucaaaccggcgcaccgcucugcgaccucguagacagcaggaggccacagaagugaggccagagcagaagaugccgacucuccuucgggucuauaucgauggaccccaugguaugggcaaaacgaccacaacucaacuguugguugcauuagggagucgcgacgauauuguguacguaccugaaccaaugaccuauuggagagugcugggagccagcgagacaauagcuaauaucuacaccacucagcacaggcuagaccagggcgaaauuuccgccggugaugcagcugucgugaugacaucugcccagaucaccauggggaugcccuaugcgguuacggacgcagugcucgccccucauauuggaggcggcgggugggagcugacuugcccagcucccggaccucacccacaccuucggccgcccucgcaucgccgaccuccaguccugcccgguagagccaucccuuacggccaacacgauccacccgggagggcaggagugcggggcccgcauccugcugacuuggcccgucacaagcaccgcguaggugggcccucaggaggccagacccauagaccaccuggccagacacccgcgccaaggcgggccgcauga

SEQ ID NO: 6750 - RNA, 684 nt, Artificial Sequence
  derived and/or modified sequence opt4 from Thymidine_Kinase_TK__Herpes_Simplex_Virus_1_(HSV-1)__ACB59259
auggccagcuaccccggccaccagcacgccagcgccuucgaccaggccgccagaagcagaggccacagcaacagaagaaccgcccugagacccagaagacagcaggaggccaccgaggugagacccgagcagaagaugcccacccugcugagaguguacaucgacggcccccacggcaugggcaagaccaccaccacccagcugcugguggcccugggcagcagagacgacaucguguacgugcccgagcccaugaccuacuggagagugcugggcgccagcgagaccaucgccaacaucuacaccacccagcacagacuggaccagggcgagaucagcgccggcgacgccgccguggugaugaccagcgcccagaucaccaugggcaugcccuacgccgugaccgacgccgugcuggccccccacaucggcggcggcggcugggagcugaccugccccgcccccggcccccacccccaccugagaccccccagccacagaagaccccccgugcugcccggcagagccauccccuacggccagcacgacccccccggcagagccggcgugagaggcccccaccccgccgaccuggccagacacaagcacagagugggcggccccagcggcggccagacccacagaccccccggccagacccccgcccccagaagagccgccuga

SEQ ID NO: 6751 - RNA, 684 nt, Artificial Sequence
  derived and/or modified sequence opt5 from Thymidine_Kinase_TK__Herpes_Simplex_Virus_1_(HSV-1)__ACB59259
auggccagcuaccccggccaccagcaugcuuccgccuucgaccaagcggcuagaucucgggggcacagcaaccgcagaaccgcccugcggccucgcagacagcaggaggccacagaagugcggccggagcagaagaugcccacgcuccugcgcgucuauaucgauggaccucauggcauggggaaaaccacaaccacacaacuucugguugcucucggauccagagacgauauuguguacgugcccgaaccuaugaccuauuggcggguccugggcgccucugagacaaucgcuaauauuuacaccacgcagcaccgccuugaccagggggaaaucagcgccggagaugcggccgugguuaugaccuccgcucagauuacaaugggcaugcccuaugccgugaccgacgcuguccuggccccucauaucggcgggggaggcugggagcucacaugcccggcgcccgggccucacccccaccugagaccucccucucaucggcgcccgccugugcugcccggacgcgccaucccuuacggccaacacgauccucccgggcgggcuggaguucgcggcccccauccggccgaccucgcuagacacaagcaccgggugggcgggcccagcggaggccagacccauagaccucccgggcagacgccugcccccagacgggccgcuuga

SEQ ID NO: 6752 - RNA, 684 nt, Artificial Sequence
  derived and/or modified sequence opt6 from Thymidine_Kinase_TK__Herpes_Simplex_Virus_1_(HSV-1)__ACB59259
auggcaucauauccaggucaccaacacgcuucagcauuugaucaagcagcaagaucaagaggacauaguaauagaagaacagcauuaagaccaagaagacaacaagaagcaacagaaguaagaccagaacaaaaaaugccaacauuacuaagaguauauauagauggaccucacggaauggguaaaacaacaacaacacaauuauuaguagcacuaggaucaagagaugauauaguauauguaccagaaccaaugacauauuggagaguacuaggagcaucagaaacaauagcaaauauauauacaacacaacauagacuagaucaaggagaaauaucagcaggugacgcagcaguaguaaugacaagcgcacaaauaacaaugggaaugccauaugcaguaacagaugcuguauuagcaccacauauaggaggaggaggaugggaauuaacauguccagcaccaggaccucacccucaucuaagaccaccaucacauaggagaccaccaguauuaccaggaagagcaauaccauauggacaacaugauccaccaggaagagcagguguaagaggaccacauccagcagauuuagcaagacauaaacauagaguaggugggccaagcggaggacaaacacaucgaccaccaggucaaacaccagcuccaagaagggcagcauaa

SEQ ID NO: 6753 - protein, 376 aa, Artificial Sequence
  Thymidine_Kinase_TK__Herpes_Simplex_Virus_1_(HSV-1)__B2CPQ4
MASYPGHQHASAFDQAARSRGHSNRRTALRPRRQQEATEVRLEQKMPTLLRVYIDGPHGMGKTTTTQLLVALGSRDDSVYVPEPMTYWRVLGASETIANIYTTQHRLDQGEISAGDAAVVMTSAQITMGMPYAVTDAVLAPHIGGEAGSSHAPPPALTLIFDRHPIAALLCYPAARYLMGSMTPQAVLAFVVLIPPTLPGTNIVLGALPEDRHIDRLAKRQRPGERLDLAMLAAIRRVYGLLANTVRYLQCGGSWREDWGQLSGTALTPQGAEPQSNAGPRPHIGETLFTLFRAPELLAPNGDLYNVFAWALDVLAKRLRPMHVFILDYDQSPAGCRDALLQLTSGMVQTHVTTPGSIPTICDLARTFAREMGEAN

SEQ ID NO: 6754 - RNA, 1131 nt, Artificial Sequence
  Thymidine_Kinase_TK__Herpes_Simplex_Virus_1_(HSV-1)__ACB59260
auggcuucguaccccggccaucaacacgcgucugcguucgaccaggcugcgcguucucgcggccauagcaaccgacguacggcguugcgcccucgccggcagcaagaagccacggaaguccgccuggagcagaaaaugcccacgcuacugcggguuuauauagacgguccucacgggauggggaaaaccaccaccacgcaacugcugguggcccuggguucgcgcgacgauagcgucuacguacccgagccgaugacuuacuggcgggugcugggggcuuccgagacaaucgcgaacaucuacaccacacaacaccgccucgaccagggugagauaucggccggggacgcggcggugguaaugacaagcgcccagauaacaaugggcaugccuuaugccgugaccgacgccguucuggcuccucauaucgggggggaggcugggagcucacaugccccgcccccggcccucacccucaucuucgaccgccaucccaucgccgcccuccugugcuacccggccgcgcgguaccuuaugggcagcaugaccccccaggccgugcuggcguucgugguccucaucccgccgaccuugcccggcacaaacaucguguugggggcccuuccggaggacagacacaucgaccgccuggccaaacgccagcgccccggugagcggcuugaccuggcuaugcuggccgcgauucgccgcguuuacgggcuacuugccaauacggugcgguaucugcagugcggcgggucguggcgggaggauuggggacagcuuucggggacggccuugacgccccagggugccgagccccagagcaacgcgggcccacgaccccauaucggggaaacguuauuuacccuguuucgggcccccgaguugcuggcccccaacggcgaccuguacaacguguuugccugggccuuggacgucuuggccaaacgccuccgucccaugcacgucuuuauccuggauuacgaccaaucgcccgccggcugccgggacgcccugcugcaacuuaccuccgggaugguccagacccaugucaccaccccaggcuccauaccgacgaucugcgaccuggcgcgcacguuugcccgggagaugggggaggcuaacuaa

SEQ ID NO: 6755 - RNA, 1131 nt, Artificial Sequence
  derived and/or modified sequence opt1 from Thymidine_Kinase_TK__Herpes_Simplex_Virus_1_(HSV-1)__ACB59260
auggccagcuaccccggccaccagcacgccuccgcguucgaccaggccgcccgcagccgggggcacuccaaccgccggaccgcccugcgcccgcggcgccagcaggaggccaccgaggugcggcucgagcagaagaugcccacgcugcugcgcgucuacaucgacggcccccacgggaugggcaagaccaccaccacgcagcuccugguggcgcuggggagccgggacgacuccguguacguccccgagccgaugaccuacuggcgcgugcucggcgccagcgagaccaucgccaacaucuacaccacgcagcaccggcuggaccagggcgagaucuccgccggggacgcggccguggucaugaccagcgcccagaucaccaugggcaugcccuacgccgugaccgacgccgugcuggcgccccacaucgggggcgaggccggguccagccacgcgcccccgcccgcccucacgcugaucuucgaccgccaccccaucgccgcccugcucugcuaccccgccgcccgguaccugaugggcuccaugaccccgcaggccguccuggccuucguggugcucaucccgcccacccugcccggcaccaacaucguccugggggcgcuccccgaggaccgccacaucgaccggcuggccaagcgccagcggcccggcgagcgccuggaccucgccaugcuggccgccauccggcgcguguacgggcugcucgcgaacacggugcgguaccugcagugcggcggcagcuggcgcgaggacugggggcagcuguccggcaccgcccucacgccccagggggccgagccccagagcaacgccggcccgcgcccccacaucggggagacccuguucacccuguuccgggcgcccgagcuccuggcccccaacggcgaccuguacaacgucuucgccugggcccucgacgugcuggccaagcgccugcggccgaugcacguguucauccucgacuacgaccagucccccgcgggcugccgcgacgcccugcugcagcucaccagcgggaugguccagacccacgugaccacgcccggcuccauccccaccaucugcgaccuggcccggaccuucgcccgcgagaugggggaggccaacuga

SEQ ID NO: 6756 - RNA, 1131 nt, Artificial Sequence
  derived and/or modified sequence opt2 from Thymidine_Kinase_TK__Herpes_Simplex_Virus_1_(HSV-1)__ACB59260
auggccuccuaccccggccaccagcacgccuccgccuucgaccaggccgcccgcucccgcggccacuccaaccgccgcaccgcccuccgcccccgccgccagcaggaggccaccgagguccgccucgagcagaagaugcccacccuccuccgcgucuacaucgacggcccccacggcaugggcaagaccaccaccacccagcuccucgucgcccucggcucccgcgacgacuccgucuacguccccgagcccaugaccuacuggcgcguccucggcgccuccgagaccaucgccaacaucuacaccacccagcaccgccucgaccagggcgagaucuccgccggcgacgccgccgucgucaugaccuccgcccagaucaccaugggcaugcccuacgccgucaccgacgccguccucgccccccacaucggcggcgaggccggcuccucccacgcccccccccccgcccucacccucaucuucgaccgccaccccaucgccgcccuccucugcuaccccgccgcccgcuaccucaugggcuccaugaccccccaggccguccucgccuucgucguccucaucccccccacccuccccggcaccaacaucguccucggcgcccuccccgaggaccgccacaucgaccgccucgccaagcgccagcgccccggcgagcgccucgaccucgccaugcucgccgccauccgccgcgucuacggccuccucgccaacaccguccgcuaccuccagugcggcggcuccuggcgcgaggacuggggccagcucuccggcaccgcccucaccccccagggcgccgagccccaguccaacgccggcccccgcccccacaucggcgagacccucuucacccucuuccgcgcccccgagcuccucgcccccaacggcgaccucuacaacgucuucgccugggcccucgacguccucgccaagcgccuccgccccaugcacgucuucauccucgacuacgaccagucccccgccggcugccgcgacgcccuccuccagcucaccuccggcaugguccagacccacgucaccacccccggcuccauccccaccaucugcgaccucgcccgcaccuucgcccgcgagaugggcgaggccaacuga

SEQ ID NO: 6757 - RNA, 1131 nt, Artificial Sequence
  derived and/or modified sequence opt3 from Thymidine_Kinase_TK__Herpes_Simplex_Virus_1_(HSV-1)__ACB59260
auggccagcuaccccggccaccagcaugcuuccgcauucgaccaagccgcgagaucuagggggcacucaaaccggcgcaccgcucugcgaccucguagacagcaggaggccacagaagugaggcucgagcagaagaugccaacucuucugcgggucuauaucgauggaccgcaugguaugggcaaaacgaccacaacucaauuguuaguugcacuggggagucgcgacgauagcguguacguacccgaaccuaugaccuauuggagagugcuaggagccuccgagacaauugcuaauauauacaccacucagcacaggcucgaccagggcgaaaucucugccggugaugccgcugucgugaugacaucggcccagauuaccauggggaugccauaugcgguuacggacgcagugcuggcaccccauaucggaggcgaggcuggcucaagccacgccccuccacccgcacuuacucugauuuuugaucggcacccuaucgcugccuugcucugcuacccagcggcccgcuaucugauggggaguaugaccccgcaagcaguccuggcuuucgugguacucauacccccuacauuaccaggaacuaacaucguucugggugcccuucccgaggaccgacauauugauagauuggcuaagaggcagcggccuggcgaacgucuggaccuagccaugcucgcagccauccgcagaguguacgggcugcuugcuaauaccgucagguaccugcaguguggaggcuccuggcgggaggauuggggucaguugucugggacagcgcucaccccacaaggagcagaaccccagagcaacgccggcccgcgaccucacauuggcgagacgcuguuuacuuuauuccgcgcucccgagcugcucgccccaaauggggaccuuuauaacguguuugcaugggcccuggauguguuggcuaaaagacuaaggccuaugcaugucuucauccuggacuacgaccagucccccgccggaugccgggaugcacuccugcaacuuacaucagguaugguucagacccacgugacuacaccaggcaguauacccaccauuugugaccuggcgcgcacguuugcuagagaaaugggggaggccaauuga

SEQ ID NO: 6758 - RNA, 1131 nt, Artificial Sequence
  derived and/or modified sequence opt4 from Thymidine_Kinase_TK__Herpes_Simplex_Virus_1_(HSV-1)__ACB59260
auggccagcuaccccggccaccagcacgccagcgccuucgaccaggccgccagaagcagaggccacagcaacagaagaaccgcccugagacccagaagacagcaggaggccaccgaggugagacuggagcagaagaugcccacccugcugagaguguacaucgacggcccccacggcaugggcaagaccaccaccacccagcugcugguggcccugggcagcagagacgacagcguguacgugcccgagcccaugaccuacuggagagugcugggcgccagcgagaccaucgccaacaucuacaccacccagcacagacuggaccagggcgagaucagcgccggcgacgccgccguggugaugaccagcgcccagaucaccaugggcaugcccuacgccgugaccgacgccgugcuggccccccacaucggcggcgaggccggcagcagccacgcccccccccccgcccugacccugaucuucgacagacaccccaucgccgcccugcugugcuaccccgccgccagauaccugaugggcagcaugaccccccaggccgugcuggccuucguggugcugaucccccccacccugcccggcaccaacaucgugcugggcgcccugcccgaggacagacacaucgacagacuggccaagagacagagacccggcgagagacuggaccuggccaugcuggccgccaucagaagaguguacggccugcuggccaacaccgugagauaccugcagugcggcggcagcuggagagaggacuggggccagcugagcggcaccgcccugaccccccagggcgccgagccccagagcaacgccggccccagaccccacaucggcgagacccuguucacccuguucagagcccccgagcugcuggcccccaacggcgaccuguacaacguguucgccugggcccuggacgugcuggccaagagacugagacccaugcacguguucauccuggacuacgaccagagccccgccggcugcagagacgcccugcugcagcugaccagcggcauggugcagacccacgugaccacccccggcagcauccccaccaucugcgaccuggccagaaccuucgccagagagaugggcgaggccaacuga

SEQ ID NO: 6759 - RNA, 1131 nt, Artificial Sequence
  derived and/or modified sequence opt5 from Thymidine_Kinase_TK__Herpes_Simplex_Virus_1_(HSV-1)__ACB59260
auggccagcuaccccggccaccagcaugcuuccgccuucgaccaagcggcuagaucucgggggcacagcaaccgcagaaccgcccugcggccucgcagacagcaggaggccacagaagugcggcucgagcagaagaugccgacgcugcuucgcgucuauaucgauggaccccauggcauggggaaaaccacaaccacacaacugcucguugcucugggauccagagacgauucuguguacgugccugaacccaugaccuauuggcggguccuuggcgccagcgagacaauugcuaauaucuacaccacgcagcaccgccuggaccagggggaaauuuccgccggagaugcggccgugguuaugaccucugcucagaucacaaugggcaugccuuaugccgugaccgacgcuguccucgcgccccauauuggcggggaggccggaagcucccacgccccuccgcccgcucugacacugaucuuugauagacacccuaucgccgcucuccugugcuaccccgccgcccgguaucuuaugggcagcaugaccccucaagcugugcuggcguucguugugcucauucccccgacgcugccugggacaaacaucguccuuggagcccugcccgaggaccgccauauugauagacucgcuaagcggcagcgcccuggcgaaagacuggaccuggccaugcucgccgcuauccggagaguguacgggcugcuugccaauaccgugcgcuaccugcaguguggaggcucuuggcgggaggauuggggccagcucuccgggacagcgcugacaccccaaggagcugaaccccagagcaacgccggcccuagaccgcacauuggggagacccuuuuuacccuguuccgcgcccccgagcuccuggcuccuaauggagaccuguauaacgucuuugccugggcucucgauguucuggccaaacggcuuagacccaugcauguguucauccuggacuacgaccagucuccugcgggcugccgcgaugcccuccugcaacuuacguccgggauggugcagacccacgucacaacccccggaagcauuccgacaaucugugaccuggcucggaccuuugccagagaaaugggcgaggcuaauuga

SEQ ID NO: 6760 - RNA, 1131 nt, Artificial Sequence
  derived and/or modified sequence opt6 from Thymidine_Kinase_TK__Herpes_Simplex_Virus_1_(HSV-1)__ACB59260
auggccagcuauccaggucaucaacaugcaagugcauuugaccaagcagcaagaucaagaggucauucaaauagaaggacagcucuaagaccuagaagacaacaagaagcaacagaaguaagacuagaacaaaaaaugccaacauuauuaagaguauauauagauggaccacauggaaugggaaaaacaacaaccacacaauuauuaguagcuuuaggaucaagagaugacucaguauauguaccagagccaaugacguauuggagaguacuaggagcaagcgaaacaauagcaaauauauacacaacacaacauagauuagaucaaggagaaauaagcgcaggagaugcagcaguaguaaugaccagugcacaaauaacaaugggaaugccuuaugcaguuaccgaugcaguauuagccccacauauagguggugaagcagguaguucacaugcaccaccaccugcguuaacauuaauuuuugaucgacacccaauagccgcccuacuaugcuaccccgcagcaagauaucuaaugggaaguaugacaccacaagcaguauuagcauuuguaguuuuaauaccuccuaccuuaccaggaacaaauauaguauuaggagcauugccugaagacagacauauagaccgauuagcaaaaagacaaagaccaggagaaagacuagaucuagcuauguuagcagcaauaagacgaguauacggacuauuagcaaacacaguuagauauuuacaauguggaggaucguggagagaagauuggggacaauuaaguggaacagcauuaacaccacaaggagcagaaccacaaagcaacgcaggaccaagaccacacauaggcgaaacauuguuuacacuauuuagagcaccagaauuauuagcaccaaacggagaucuauauaacguauuugccugggcauuagauguuuuagcaaaaagauuaagaccaaugcauguauuuauucuagauuaugaucaaucaccggcaggauguagagaugcauuauuacaacuuacaagcggaaugguacaaacacaugugacaacaccaggaucaauaccaacaauaugugaccuugcaagaacauuugcaagagaaaugggugaagcuaauuaa

SEQ ID NO: 6761 - protein, 376 aa, Artificial Sequence
  Thymidine_Kinase_TK__Herpes_Simplex_Virus_1_(HSV-1)__B2CPQ5
MASYPGHQHASAFDQAARSRGHSNRRTALRPRRQQEATEVHLEQKMPTLLRVYIDGPHGMGKTTTTQLLVALGSRDDIVYVPEPMTYWRVLGASETIANIYTTQHRLDQGEISAGDAAVVMTSAQITMGMPYAVTDAVLAPHIGGEAGSSHAPPPALTLIFDRHPIAALLCYPAARYLMGSMTPQAVLAFVVLIPPTLPGTNIVLGALPEDRHIDRLAKRQRPGERLDLAMLAAIRRVYGLLANTVRYLQCGGSWRENWGQLSGTALTPQGAEPQSNAGPRPHIGETLFTLFRAPELLAPNGDLYNVFAWALDVLAKRLRPMHVFILDYDQSPAGCRDALLQLTSGMVQTHVTTPGSIPTICDLARTFAREMGEAN

SEQ ID NO: 6762 - RNA, 1131 nt, Artificial Sequence
  Thymidine_Kinase_TK__Herpes_Simplex_Virus_1_(HSV-1)__ACB59261
auggcuucguaccccggccaucaacacgcgucugcguucgaccaggcugcgcguucucgcggccauagcaaccgacguacggcguugcgcccucgccggcagcaagaagccacggaaguccaccuggagcagaaaaugcccacgcuacugcggguuuauauagacgguccucacgggauggggaaaaccaccaccacgcaacugcugguggcccuggguucgcgcgacgauaucgucuacguacccgagccgaugacuuacuggcgggugcugggggcuuccgagacaaucgcgaacaucuacaccacacaacaccgccucgaccagggugagauaucggccggggacgcggcggugguaaugacaagcgcccagauaacaaugggcaugccuuaugccgugaccgacgccguucuggcuccucauaucgggggggaggcugggagcucacaugccccgcccccggcccucacccucaucuucgaccgccaucccaucgccgcccuccugugcuacccggccgcgcgguaccuuaugggcagcaugaccccccaggccgugcuggcguucgugguccucaucccgccgaccuugcccggcacaaacaucguguugggggcccuuccggaggacagacacaucgaccgccuggccaaacgccagcgccccggugagcggcuugaccuggcuaugcuggccgcgauucgccgcguuuacgggcuacuugccaauacggugcgguaucugcagugcggcgggucguggcgggagaauuggggacagcuuucggggacggccuugacgccccagggugccgagccccagagcaacgcgggcccacgaccccauaucggggaaacguuauuuacccuguuucgggcccccgaguugcuggcccccaacggcgaccuguacaacguguuugccugggccuuggacgucuuggccaaacgccuccgucccaugcacgucuuuauccuggauuacgaccaaucgcccgccggcugccgggacgcccugcugcaacuuaccuccgggaugguccagacccacgucaccacccccggcuccauaccgacgaucugcgaccuggcgcgcacguuugcccgggagaugggggaggcuaacuaa

SEQ ID NO: 6763 - RNA, 1131 nt, Artificial Sequence
  derived and/or modified sequence opt1 from Thymidine_Kinase_TK__Herpes_Simplex_Virus_1_(HSV-1)__ACB59261
auggccagcuaccccggccaccagcacgccuccgcguucgaccaggccgcccgcagccgggggcacuccaaccgccggaccgcccugcgcccgcggcgccagcaggaggccaccgaggugcaccucgagcagaagaugcccacgcugcugcgggucuacaucgacggcccccacgggaugggcaagaccaccaccacgcagcuccugguggcgcuggggagccgcgacgacaucguguacguccccgagccgaugaccuacuggcgggugcucggcgccuccgagaccaucgccaacaucuacaccacgcagcaccgccuggaccagggcgagaucagcgccggggacgcggccguggucaugaccuccgcccagaucaccaugggcaugcccuacgccgugaccgacgccgugcuggcgccccacaucgggggcgaggccgggagcucccacgcgcccccgcccgcccucacgcugaucuucgaccggcaccccaucgccgcccugcucugcuaccccgccgcccgcuaccugaugggcagcaugaccccgcaggccguccuggccuucguggugcucaucccgcccacccugcccggcaccaacaucguccugggggcgcuccccgaggaccggcacaucgaccgccuggccaagcggcagcgccccggcgagcggcuggaccucgccaugcuggccgccauccgccggguguacgggcugcucgcgaacacggugcgcuaccugcagugcggcggcuccuggcgggagaacugggggcagcugagcggcaccgcccucacgccccagggggccgagccccaguccaacgccggcccgcgcccccacaucggggagacccuguucacccuguuccgcgcgcccgagcuccuggcccccaacggcgaccuguacaacgucuucgccugggcccucgacgugcuggccaagcggcugcgcccgaugcacguguucauccucgacuacgaccagagccccgcgggcugccgggacgcccugcugcagcucaccuccgggaugguccagacccacgugaccacgcccggcagcauccccaccaucugcgaccuggcccgcaccuucgcccgggagaugggggaggccaacuga

SEQ ID NO: 6764 - RNA, 1131 nt, Artificial Sequence
  derived and/or modified sequence opt2 from Thymidine_Kinase_TK__Herpes_Simplex_Virus_1_(HSV-1)__ACB59261
auggccuccuaccccggccaccagcacgccuccgccuucgaccaggccgcccgcucccgcggccacuccaaccgccgcaccgcccuccgcccccgccgccagcaggaggccaccgagguccaccucgagcagaagaugcccacccuccuccgcgucuacaucgacggcccccacggcaugggcaagaccaccaccacccagcuccucgucgcccucggcucccgcgacgacaucgucuacguccccgagcccaugaccuacuggcgcguccucggcgccuccgagaccaucgccaacaucuacaccacccagcaccgccucgaccagggcgagaucuccgccggcgacgccgccgucgucaugaccuccgcccagaucaccaugggcaugcccuacgccgucaccgacgccguccucgccccccacaucggcggcgaggccggcuccucccacgcccccccccccgcccucacccucaucuucgaccgccaccccaucgccgcccuccucugcuaccccgccgcccgcuaccucaugggcuccaugaccccccaggccguccucgccuucgucguccucaucccccccacccuccccggcaccaacaucguccucggcgcccuccccgaggaccgccacaucgaccgccucgccaagcgccagcgccccggcgagcgccucgaccucgccaugcucgccgccauccgccgcgucuacggccuccucgccaacaccguccgcuaccuccagugcggcggcuccuggcgcgagaacuggggccagcucuccggcaccgcccucaccccccagggcgccgagccccaguccaacgccggcccccgcccccacaucggcgagacccucuucacccucuuccgcgcccccgagcuccucgcccccaacggcgaccucuacaacgucuucgccugggcccucgacguccucgccaagcgccuccgccccaugcacgucuucauccucgacuacgaccagucccccgccggcugccgcgacgcccuccuccagcucaccuccggcaugguccagacccacgucaccacccccggcuccauccccaccaucugcgaccucgcccgcaccuucgcccgcgagaugggcgaggccaacuga

SEQ ID NO: 6765 - RNA, 1131 nt, Artificial Sequence
  derived and/or modified sequence opt3 from Thymidine_Kinase_TK__Herpes_Simplex_Virus_1_(HSV-1)__ACB59261
auggccagcuaccccggccaccagcaugcuuccgcauucgaccaagccgcgagaucuagggggcacucaaaccggcgcaccgcucugcgaccucguagacagcaggaggccacagaagugcaucucgagcagaagaugccaacucuucugagggucuauaucgauggaccgcacgguaugggcaaaacgaccacaacucaauuguuaguugcacuggggagucgggacgauauuguguacguacccgaaccuaugaccuauuggcgcgugcuaggagccagcgagacaauagcuaauaucuacaccacucagcauagacucgaccagggcgaaauuuccgccggugaugccgcugucgugaugacaucugcccagaucaccauggggaugccauaugcgguuacggacgcagugcuggcaccccacauuggaggcgaggcuggcucgucacacgccccuccacccgcacuuacucugaucuuugauaggcauccuauagcugccuugcucugcuacccagcggcccgguaucugauggggagcaugaccccgcaagcaguccuggcuuucgugguacucauucccccuacauuaccaggaacuaacaucguucugggugcccuucccgaggaccgccacaucgaucgauuggcuaagagacagaggccuggcgaacggcuggaccuagccaugcucgcagccauucgucgcguguacgggcugcuugcuaauaccgucagauaccugcaguguggaggcaguuggagggagaacuggggucaguuguccgggacagcgcucaccccacaaggagcagaaccccagucuaaugccggcccgcggccucauaucggcgagacgcuguuuacuuuauuccgagcucccgagcugcucgccccaaacggggaucuuuauaauguguuugcaugggcccuggacguguuggcuaaacgccuaagaccuaugcacgucuucauacuggauuacgaccagagccccgccggaugcagggacgcacuccugcaacuuacauccgguaugguucagacccacgugacuacaccaggcucaauucccaccaucugugaucuggcgcggacguuugcucgcgaaaugggggaggccaacuga

SEQ ID NO: 6766 - RNA, 1131 nt, Artificial Sequence
  derived and/or modified sequence opt4 from Thymidine_Kinase_TK__Herpes_Simplex_Virus_1_(HSV-1)__ACB59261
auggccagcuaccccggccaccagcacgccagcgccuucgaccaggccgccagaagcagaggccacagcaacagaagaaccgcccugagacccagaagacagcaggaggccaccgaggugcaccuggagcagaagaugcccacccugcugagaguguacaucgacggcccccacggcaugggcaagaccaccaccacccagcugcugguggcccugggcagcagagacgacaucguguacgugcccgagcccaugaccuacuggagagugcugggcgccagcgagaccaucgccaacaucuacaccacccagcacagacuggaccagggcgagaucagcgccggcgacgccgccguggugaugaccagcgcccagaucaccaugggcaugcccuacgccgugaccgacgccgugcuggccccccacaucggcggcgaggccggcagcagccacgcccccccccccgcccugacccugaucuucgacagacaccccaucgccgcccugcugugcuaccccgccgccagauaccugaugggcagcaugaccccccaggccgugcuggccuucguggugcugaucccccccacccugcccggcaccaacaucgugcugggcgcccugcccgaggacagacacaucgacagacuggccaagagacagagacccggcgagagacuggaccuggccaugcuggccgccaucagaagaguguacggccugcuggccaacaccgugagauaccugcagugcggcggcagcuggagagagaacuggggccagcugagcggcaccgcccugaccccccagggcgccgagccccagagcaacgccggccccagaccccacaucggcgagacccuguucacccuguucagagcccccgagcugcuggcccccaacggcgaccuguacaacguguucgccugggcccuggacgugcuggccaagagacugagacccaugcacguguucauccuggacuacgaccagagccccgccggcugcagagacgcccugcugcagcugaccagcggcauggugcagacccacgugaccacccccggcagcauccccaccaucugcgaccuggccagaaccuucgccagagagaugggcgaggccaacuga

SEQ ID NO: 6767 - RNA, 1131 nt, Artificial Sequence
  derived and/or modified sequence opt5 from Thymidine_Kinase_TK__Herpes_Simplex_Virus_1_(HSV-1)__ACB59261
auggccagcuaccccggccaccagcaugcuuccgccuucgaccaagcggcuagaucucgggggcacagcaaccgcagaaccgcccugcggccucgcagacagcaggaggccacagaagugcaucucgagcagaagaugccgacgcugcuucgggucuauaucgauggaccccacggcauggggaaaaccacaaccacacaacugcucguugcucugggaucccgcgacgauauuguguacgugccugaacccaugaccuauuggagaguccuuggcgccucugagacaaucgcuaauauuuacaccacgcagcaucggcuggaccagggggaaaucagcgccggagaugcggccgugguuaugaccuccgcucagauuacaaugggcaugccuuaugccgugaccgacgcuguccucgcgccccacaucggcggggaggccggaucuagccacgccccuccgcccgcucugacacugaucuuugaucgccauccuauugccgcucuccugugcuaccccgccgccagauaucuuaugggcuccaugaccccucaagcugugcuggcguucguugugcucauucccccgacgcugccugggacaaacaucguccuuggagcccugcccgaggaccggcacaucgaucgccucgcuaagagacagcggccuggcgaacgccuggaccuggccaugcucgccgcuauuagacggguguacgggcugcuugccaauaccgugagauaccugcaguguggaggcagcuggcgcgagaacuggggccagcucucugggacagcgcugacaccccaaggagcugaaccccaguccaaugccggcccucggccgcauaucggggagacccuuuuuacccuguucagagcccccgagcuccuggcuccuaacggagaucuguauaaugucuuugccugggcucucgacguucuggccaaacgccuucggcccaugcacguguucauucuggauuacgaccagagcccugcgggcugcagagacgcccuccugcaacuuacgucugggauggugcagacccacgucacaacccccggauccaucccgacaaucugugaucuggcucgcaccuuugcccgggaaaugggcgaggcuaacuga

SEQ ID NO: 6768 - RNA, 1131 nt, Artificial Sequence
  derived and/or modified sequence opt6 from Thymidine_Kinase_TK__Herpes_Simplex_Virus_1_(HSV-1)__ACB59261
auggcuaguuauccaggacaucaacaugcaucagcauuugaucaagccgcaagaucaagaggacauucaaauagaagaacugcacuaagaccaagacgacaacaagaagcaacagaaguacaucuagaacaaaaaaugccuacacuacuaagaguauacauagauggaccacaugguauggguaaaacaacgaccacacaauuauuaguagcacuuggcagucgugacgauauaguauaugucccagaaccaaugacauauuggagaguacuuggagcaucagaaacaauagcaaauaucuauacaacacaacauagacuagaucaaggugaaauaagugcaggagaugcagcaguaguaaugaccucagcacaaaucacaauggguaugccauaugcaguaacagaugcaguauuagcaccacacauuggaggagaagcaggaucaagucaugcaccuccaccagcauuaacacuaauuuuugauagacauccaauagcagcacuacugugcuauccagcagcucgauacuuaaugggaucaaugacaccacaagcaguucuagccuuuguaguauuaauaccaccaacauuaccaggaacaaacauaguacuaggagcacuaccagaagauagacauauagaucgacuagcaaaaagacaaaggccaggagaacgauuagaucuugcaauguuagcagcaauaagaagaguauacggauuauuagcaaauacuguaagauaucuacaaugcggagguucauggagagaaaacuggggacaacuaucaggaacagcauuaacaccacaaggagcugaaccacaaucaaacgcagguccaagaccacauauaggagaaacacucuucacccucuuuagagcaccagaacuacuagcaccaaacggugauuuauauaauguauuugcaugggcccuagauguauuagcaaaaagacuaagaccaaugcauguauuuauacuagauuaugaucaaucacccgcaggaugucgcgaugcacuauuacaauuaacaagcgguaugguacaaacacauguaacaaccccaggaucaauaccaacaauuugugauuuagcaagaacauucgcaagagaaaugggagaagcaaauuga

SEQ ID NO: 6769 - protein, 376 aa, Artificial Sequence
  Thymidine_Kinase_TK__Herpes_Simplex_Virus_1_(HSV-1)__O72346
MASYPCHQHASAFDQAARSRGHSNRRTALRPRRQQEATEVRPEQKMPTLLRVYIDGPHGMGKTTTTQLLVALGSRDDIVYVPEPMTYWRVLGASETIANIYTTQHRLDQGEISAGDAAVVMTSAQITMGMPYAVTDAVLAPHIGGEAGSSHAPPPALTLIFDRHPIAALLCYPAARYLMGSMTPQAVLAFVALIPPTLPGTNIVLGALPEDRHIDRLAKRQRPGERLDLAMLAAIRRVYGLLANTVRYLQGGGSWREDWGQLSGTAVPPQGAEPQSNAGPRPHIGDTLFTLFRAPELLAPNGDLYNVFAWALDVLAKRLRPMHVFILDYDQSPAGCRDALLQLTSGMVQTHVTTPGSIPTICDLARTFAREMGEAN

SEQ ID NO: 6770 - RNA, 1131 nt, Artificial Sequence
  Thymidine_Kinase_TK__Herpes_Simplex_Virus_1_(HSV-1)__AAC16235
auggcuucguaccccugccaucaacacgcgucugcguucgaccaggcugcgcguucucgcggccauagcaaccgacguacggcguugcgcccucgccggcagcaagaagccacggaaguccgcccggagcagaaaaugcccacgcuacugcggguuuauauagacgguccccacgggauggggaaaaccaccaccacgcaacugcugguggcccuggguucgcgcgacgauaucgucuacguacccgagccgaugacuuacuggcgggugcugggggcuuccgagacaaucgcgaacaucuacaccacacaacaccgccucgaccagggugagauaucggccggggacgcggcggugguaaugacaagcgcccagauaacaaugggcaugccuuaugccgugaccgacgccguucuggcuccucauaucgggggggaggcugggagcucacaugccccgcccccggcccucacccucaucuucgaccgccaucccaucgccgcccuccugugcuacccggccgcgcgauaccuuaugggcagcaugaccccccaggccgugcuggcguucguggcccucaucccgccgaccuugcccggcacaaacaucguguugggggcccuuccggaggacagacacaucgaccgccuggccaaacgccagcgccccggcgagcggcuugaccuggcuaugcuggccgcgauucgccgcguuuacgggcugcuugccaauacggugcgguaucugcagggcggcgggucguggcgggaggauuggggacagcuuucggggacggccgugccgccccagggugccgagccccagagcaacgcgggcccacgaccccauaucggggacacguuauuuacccuguuucgggcccccgaguugcuggcccccaacggcgaccuguauaacguguuugccugggccuuggacgucuuggccaaacgccuccgucccaugcacgucuuuauccuggauuacgaccaaucgcccgccggcugccgggacgcccugcugcaacuuaccuccgggaugguccagacccacgucaccaccccaggcuccauaccgacgaucugcgaccuggcgcgcacguuugcccgggagaugggggaggcuaacuga

SEQ ID NO: 6771 - RNA, 1131 nt, Artificial Sequence
  derived and/or modified sequence opt1 from Thymidine_Kinase_TK__Herpes_Simplex_Virus_1_(HSV-1)__AAC16235
auggccagcuaccccugccaccagcacgccuccgcguucgaccaggccgcccgcagccggggccacuccaaccgccggaccgcccugcgcccgcggcgccagcaggaggccaccgaggugcggcccgagcagaagaugcccacgcuccugcgcgucuacaucgacgggccccacggcauggggaagaccaccaccacgcagcugcucguggcgcugggcagccgggacgacaucguguacgucccggagcccaugaccuacuggcgcgugcugggggccuccgagaccaucgccaacaucuacaccacgcagcaccggcucgaccagggcgagaucagcgccggcgacgcggccguggucaugaccuccgcccagaucaccauggggaugcccuacgccgugaccgacgccgugcuggcgccccacaucggcggggaggccggcagcucccacgccccgccgcccgcccugacgcucaucuucgaccgccaccccaucgccgcgcugcugugcuaccccgccgcccgguaccucauggggagcaugacgccccaggccguccuggccuucguggcgcugaucccgcccacccuccccggcaccaacaucgugcugggcgcccugcccgaggaccgccacaucgaccggcucgccaagcgccagcggcccggggagcgccuggaccuggccaugcucgccgcgauccggcgcgucuacggccugcuggccaacaccgugcgguaccuccagggcgggggcuccuggcgcgaggacugggggcagcugagcggcaccgccgugcccccgcagggggccgagccccaguccaacgcgggcccccgcccccacaucggggacacccuguucacccucuuccgggccccggagcugcuggcccccaacggcgaccucuacaacgucuucgccugggcccuggacgugcuggcgaagcgccuccggcccaugcacguguucauccuggacuacgaccagagccccgccggcugccgcgacgcccugcuccagcugacguccgggaugguccagacccacgugaccaccccgggcagcauccccacgaucugcgaccuggcccggaccuucgcccgcgagaugggggaggcgaacuga

SEQ ID NO: 6772 - RNA, 1131 nt, Artificial Sequence
  derived and/or modified sequence opt2 from Thymidine_Kinase_TK__Herpes_Simplex_Virus_1_(HSV-1)__AAC16235
auggccuccuaccccugccaccagcacgccuccgccuucgaccaggccgcccgcucccgcggccacuccaaccgccgcaccgcccuccgcccccgccgccagcaggaggccaccgagguccgccccgagcagaagaugcccacccuccuccgcgucuacaucgacggcccccacggcaugggcaagaccaccaccacccagcuccucgucgcccucggcucccgcgacgacaucgucuacguccccgagcccaugaccuacuggcgcguccucggcgccuccgagaccaucgccaacaucuacaccacccagcaccgccucgaccagggcgagaucuccgccggcgacgccgccgucgucaugaccuccgcccagaucaccaugggcaugcccuacgccgucaccgacgccguccucgccccccacaucggcggcgaggccggcuccucccacgcccccccccccgcccucacccucaucuucgaccgccaccccaucgccgcccuccucugcuaccccgccgcccgcuaccucaugggcuccaugaccccccaggccguccucgccuucgucgcccucaucccccccacccuccccggcaccaacaucguccucggcgcccuccccgaggaccgccacaucgaccgccucgccaagcgccagcgccccggcgagcgccucgaccucgccaugcucgccgccauccgccgcgucuacggccuccucgccaacaccguccgcuaccuccagggcggcggcuccuggcgcgaggacuggggccagcucuccggcaccgccguccccccccagggcgccgagccccaguccaacgccggcccccgcccccacaucggcgacacccucuucacccucuuccgcgcccccgagcuccucgcccccaacggcgaccucuacaacgucuucgccugggcccucgacguccucgccaagcgccuccgccccaugcacgucuucauccucgacuacgaccagucccccgccggcugccgcgacgcccuccuccagcucaccuccggcaugguccagacccacgucaccacccccggcuccauccccaccaucugcgaccucgcccgcaccuucgcccgcgagaugggcgaggccaacuga

SEQ ID NO: 6773 - RNA, 1131 nt, Artificial Sequence
  derived and/or modified sequence opt3 from Thymidine_Kinase_TK__Herpes_Simplex_Virus_1_(HSV-1)__AAC16235
auggccagcuaccccugccaccagcaugcuuccgcauucgaccaagccgcgagaucuaggggccacucaaaccggcgcaccgcucugcgaccucguagacagcaggaggccacagaagugaggccagagcagaagaugccgacucuccuucgggucuauaucgaugggccccauggaauggguaaaacgaccacaacucaacuguugguugcauuaggcagucgcgacgauauuguguacguaccugaaccaaugaccuauuggagagugcugggggccagcgagacaauagcuaauaucuacaccacucagcacaggcuagaccagggagaaauuuccgcaggcgaugccgcugucgugaugacaucugcccagaucaccauggguaugcccuaugcgguuacggacgcagugcucgccccucauauugggggagaggcuggcucgucacacgccccacccccugcacugacucuuaucuuugaucggcacccaauagcugcccuguuguguuacccggcggcccgcuaucucaugggcagcaugacgccccaagcaguccuggcuuucguggcccugaucccuccaacacuccccgggacuaacauuguauuaggagcucugccugaggaccgacauaucgauagacuugccaagaggcagcggccaggugaacguuuggaccuggcaaugcuagccgcuauucgcagaguuuacggccuccuggcgaauaccgugagguaccuucaagggggaggcaguuggcgggaggauuggggucagcuguccgggacagcagugcccccgcagggagccgaaccucagucuaacgcuggcccccgaccacacaucggcgacaccuuguuuacccucuuccgcgccccugagcuguuagcacccaauggggaucuguauaacgucuuugccugggcucucgacgugcuugccaaaagacugaggccaaugcaugucuucauauuggacuacgaucagagccccgcaggaugccgggacgcgcuacugcaacucacuuccgguaugguucagacacacgugaccacuccuggcucaauuccaacaaucugugaucuggcucgcaccuuugccagagagaugggggaagcaaauuga

SEQ ID NO: 6774 - RNA, 1131 nt, Artificial Sequence
  derived and/or modified sequence opt4 from Thymidine_Kinase_TK__Herpes_Simplex_Virus_1_(HSV-1)__AAC16235
auggccagcuaccccugccaccagcacgccagcgccuucgaccaggccgccagaagcagaggccacagcaacagaagaaccgcccugagacccagaagacagcaggaggccaccgaggugagacccgagcagaagaugcccacccugcugagaguguacaucgacggcccccacggcaugggcaagaccaccaccacccagcugcugguggcccugggcagcagagacgacaucguguacgugcccgagcccaugaccuacuggagagugcugggcgccagcgagaccaucgccaacaucuacaccacccagcacagacuggaccagggcgagaucagcgccggcgacgccgccguggugaugaccagcgcccagaucaccaugggcaugcccuacgccgugaccgacgccgugcuggccccccacaucggcggcgaggccggcagcagccacgcccccccccccgcccugacccugaucuucgacagacaccccaucgccgcccugcugugcuaccccgccgccagauaccugaugggcagcaugaccccccaggccgugcuggccuucguggcccugaucccccccacccugcccggcaccaacaucgugcugggcgcccugcccgaggacagacacaucgacagacuggccaagagacagagacccggcgagagacuggaccuggccaugcuggccgccaucagaagaguguacggccugcuggccaacaccgugagauaccugcagggcggcggcagcuggagagaggacuggggccagcugagcggcaccgccgugcccccccagggcgccgagccccagagcaacgccggccccagaccccacaucggcgacacccuguucacccuguucagagcccccgagcugcuggcccccaacggcgaccuguacaacguguucgccugggcccuggacgugcuggccaagagacugagacccaugcacguguucauccuggacuacgaccagagccccgccggcugcagagacgcccugcugcagcugaccagcggcauggugcagacccacgugaccacccccggcagcauccccaccaucugcgaccuggccagaaccuucgccagagagaugggcgaggccaacuga

SEQ ID NO: 6775 - RNA, 1131 nt, Artificial Sequence
  derived and/or modified sequence opt5 from Thymidine_Kinase_TK__Herpes_Simplex_Virus_1_(HSV-1)__AAC16235
auggccagcuaccccugccaccagcaugcuuccgccuucgaccaagcggcuagaucucggggccacagcaaccgcagaaccgcccugcggccucgcagacagcaggaggccacagaagugcggccggagcagaagaugcccacgcuccugcgcgucuauaucgaugggccucauggaaugggcaaaaccacaaccacacaacuucugguugcucucggguccagagacgauauuguguacgugcccgaaccuaugaccuauuggcggguccugggagccucugagacaaucgcuaauauuuacaccacgcagcaccgccuugaccagggcgaaaucagcgccggggaugcggccgugguuaugaccuccgcucagauuacaaugggaaugcccuaugccgugaccgacgcuguccuggccccucauaucggcggcgaggcggggucuagccacgccccgcccccugcucucacacugaucuuugauagacaccccauugccgcucugcucuguuacccugccgcccgguaucugaugggauccaugacgccccaagcugugcuugcguucguugcccugaucccgccuacccuccccggcacaaacauugugcugggggcccuuccugaggaccgccauaucgauagacuggcuaagcggcagcgccccggagaaagacucgaccuggccaugcuggcugccauucggagagucuacggccuccuggcgaauaccgugcgcuaccuucaagggggaggcagcuggcgggaggauuggggccagcugucugggacagcugugcccccucagggagccgaaccgcaguccaacgccggccccagaccucacaucggggacacccucuuuacccuguuccgcgcucccgagcuucuggccccuaauggagaucucuauaacgucuuugcuugggcccuggacguucuggcgaaacggcucagacccaugcauguguucauucuggacuacgaucagagcccggccggcugccgcgacgcccuucugcaacucacaucugggauggugcagacgcacgucaccacaccuggauccauccccaccaucugugaucuggcucggacauuugcuagagagaugggcgaagccaauuga

SEQ ID NO: 6776 - RNA, 1131 nt, Artificial Sequence
  derived and/or modified sequence opt6 from Thymidine_Kinase_TK__Herpes_Simplex_Virus_1_(HSV-1)__AAC16235
auggcaucauauccaugucaccaacacgcaagugcauuugaucaagcagcaaggagcagaggucauucaaauagaagaacagcauuaagaccuagacgacaacaagaagcuacugaaguaagaccagaacaaaaaaugccaaccuuauuaagaguauauauagaugguccacacggaaugggaaaaacuacaacaacucaauuacuuguugcauuagguucaagggacgauauaguauauguaccagaaccuaugacauacuggagaguacuaggugcaucugaaacaauugcaaauauuuauacaacacaacauagacuagaucaaggcgaaauaucagcaggagaugcagcaguuguuaugacaagugcacaaauaacuaugggaaugccauacgcaguuacagacgcaguacucgcaccacauauaggaggagaagcaggaucuucacaugcaccaccaccagcacuaacauuaauauucgacagacaucccauagcagcauuacuaugcuauccagcugcaagauauuuaaugggaucaaugacaccacaagcaguauuagccuuuguagccuugauaccaccaacauuaccaggcacaaacauuguucuaggagcauuaccagaagauagacauauagauagacuagcaaaaagacaaagaccaggagaaagacuagauuuagccaugcucgcagcaauaagaagagucuauggacuuuuagcaaauacaguaagauacuuacaaggaggagguucauggagagaagacuggggacaacuaucaggaacagcaguaccaccucaaggagcagaaccacaaucaaacgcaggaccgagaccccauauaggagauacauuauucaccuuauuuagagcaccagaauuacucgcaccaaauggagaccuauauaauguauuugccugggcauuagauguacuagcuaaaagacucagaccaaugcacguauuuauacuagauuaugaucaauccccagcagguuguagagaugcacucuuacaauuaacaucaggaaugguucaaacacauguaacaacaccaggaucuaucccaacaauaugugaucuagccagaacauuugcuagagaaaugggagaagcuaauuaa

SEQ ID NO: 6777 - protein, 376 aa, Artificial Sequence
  Thymidine_Kinase_TK__Herpes_Simplex_Virus_1_(HSV-1)__P06478
MASYPCHQHASAFDQAARSRGHSNRRTALRPRRQQEATEVRLEQKMPTLLRVYIDGPHGMGKTTTTQLLVALGSRDDIVYVPEPMTYWQVLGASETIANIYTTQHRLDQGEISAGDAAVVMTSAQITMGMPYAVTDAVLAPHVGGEAGSSHAPPPALTLIFDRHPIAALLCYPAARYLMGSMTPQAVLAFVALIPPTLPGTNIVLGALPEDRHIDRLAKRQRPGERLDLAMLAAIRRVYGLLANTVRYLQGGGSWWEDWGQLSGTAVPPQGAEPQSNAGPRPHIGDTLFTLFRAPELLAPNGDLYNVFAWALDVLAKRLRPMHVFILDYDQSPAGCRDALLQLTSGMVQTHVTTPGSIPTICDLARTFAREMGEAN

SEQ ID NO: 6778 - RNA, 1131 nt, Artificial Sequence
  Thymidine_Kinase_TK__Herpes_Simplex_Virus_1_(HSV-1)__AAA45811
auggcuucguaccccugccaucaacacgcgucugcguucgaccaggcugcgcguucucgcggccauagcaaccgacguacggcguugcgcccucgccggcagcaagaagccacggaaguccgccuggagcagaaaaugcccacgcuacugcggguuuauauagacgguccucacgggauggggaaaaccaccaccacgcaacugcugguggcccuggguucgcgcgacgauaucgucuacguacccgagccgaugacuuacuggcaggugcugggggcuuccgagacaaucgcgaacaucuacaccacacaacaccgccucgaccagggugagauaucggccggggacgcggcggugguaaugacaagcgcccagauaacaaugggcaugccuuaugccgugaccgacgccguucuggcuccucaugucgggggggaggcugggaguucacaugccccgcccccggcccucacccucaucuucgaccgccaucccaucgccgcccuccugugcuacccggccgcgcgauaccuuaugggcagcaugaccccccaggccgugcuggcguucguggcccucaucccgccgaccuugcccggcacaaacaucguguugggggcccuuccggaggacagacacaucgaccgccuggccaaacgccagcgccccggcgagcggcuugaccuggcuaugcuggccgcgauucgccgcguuuacgggcugcuugccaauacggugcgguaucugcagggcggcgggucguggugggaggauuggggacagcuuucggggacggccgugccgccccagggugccgagccccagagcaacgcgggcccacgaccccauaucggggacacguuauuuacccuguuucgggcccccgaguugcuggcccccaacggcgaccuguauaacguguuugccugggccuuggacgucuuggccaaacgccuccgucccaugcacgucuuuauccuggauuacgaccaaucgcccgccggcugccgggacgcccugcugcaacuuaccuccgggaugguccagacccacgucaccaccccaggcuccauaccgacgaucugcgaccuggcgcgcacguuugcccgggagaugggggaggcuaacuga

SEQ ID NO: 6779 - RNA, 1131 nt, Artificial Sequence
  derived and/or modified sequence opt1 from Thymidine_Kinase_TK__Herpes_Simplex_Virus_1_(HSV-1)__AAA45811
auggccagcuaccccugccaccagcacgccuccgcguucgaccaggccgcccgcagccggggccacuccaaccgccggaccgcccugcgcccgcggcgccagcaggaggccaccgaggugcggcucgagcagaagaugcccacgcugcugcgcgucuacaucgacgggccccacggcauggggaagaccaccaccacgcagcuccugguggcgcugggcagccgggacgacaucguguacguccccgagccgaugaccuacuggcagguccucggggccuccgagaccaucgccaacaucuacaccacgcagcaccgccuggaccagggcgagaucagcgccggcgacgcggccguggugaugaccuccgcccagaucaccauggggaugcccuacgccgugaccgacgccgugcuggcgccccacgucggcggggaggccggcagcucccacgcgcccccgcccgcccucacgcugaucuucgaccggcaccccaucgccgcccugcucugcuaccccgccgcccgcuaccugauggggagcaugaccccgcaggccgugcuggccuucguggcgcucaucccgcccacccugcccggcaccaacaucguccugggcgcccuccccgaggaccggcacaucgaccgccuggccaagcggcagcgccccggggagcggcuggaccucgccaugcuggccgcgauccgccggguguacggccugcucgccaacacggugcgcuaccugcagggcgggggcuccuggugggaggacugggggcagcugagcggcaccgccgucccgccccagggggccgagccccaguccaacgcgggcccccggccccacaucggggacacccucuucacccuguuccgcgcccccgagcugcucgccccgaacggcgaccuguacaacguguucgccugggcccuggacgugcucgcgaagcgccugcggcccaugcacgucuucauccuggacuacgaccagagccccgccggcugccgcgacgcccuccugcagcugacguccgggauggugcagacccacgugaccacccccggcagcaucccgacgaucugcgaccucgcccggaccuucgcccgcgagaugggggaggcgaacuga

SEQ ID NO: 6780 - RNA, 1131 nt, Artificial Sequence
  derived and/or modified sequence opt2 from Thymidine_Kinase_TK__Herpes_Simplex_Virus_1_(HSV-1)__AAA45811
auggccuccuaccccugccaccagcacgccuccgccuucgaccaggccgcccgcucccgcggccacuccaaccgccgcaccgcccuccgcccccgccgccagcaggaggccaccgagguccgccucgagcagaagaugcccacccuccuccgcgucuacaucgacggcccccacggcaugggcaagaccaccaccacccagcuccucgucgcccucggcucccgcgacgacaucgucuacguccccgagcccaugaccuacuggcagguccucggcgccuccgagaccaucgccaacaucuacaccacccagcaccgccucgaccagggcgagaucuccgccggcgacgccgccgucgucaugaccuccgcccagaucaccaugggcaugcccuacgccgucaccgacgccguccucgccccccacgucggcggcgaggccggcuccucccacgcccccccccccgcccucacccucaucuucgaccgccaccccaucgccgcccuccucugcuaccccgccgcccgcuaccucaugggcuccaugaccccccaggccguccucgccuucgucgcccucaucccccccacccuccccggcaccaacaucguccucggcgcccuccccgaggaccgccacaucgaccgccucgccaagcgccagcgccccggcgagcgccucgaccucgccaugcucgccgccauccgccgcgucuacggccuccucgccaacaccguccgcuaccuccagggcggcggcuccuggugggaggacuggggccagcucuccggcaccgccguccccccccagggcgccgagccccaguccaacgccggcccccgcccccacaucggcgacacccucuucacccucuuccgcgcccccgagcuccucgcccccaacggcgaccucuacaacgucuucgccugggcccucgacguccucgccaagcgccuccgccccaugcacgucuucauccucgacuacgaccagucccccgccggcugccgcgacgcccuccuccagcucaccuccggcaugguccagacccacgucaccacccccggcuccauccccaccaucugcgaccucgcccgcaccuucgcccgcgagaugggcgaggccaacuga

SEQ ID NO: 6781 - RNA, 1131 nt, Artificial Sequence
  derived and/or modified sequence opt3 from Thymidine_Kinase_TK__Herpes_Simplex_Virus_1_(HSV-1)__AAA45811
auggccagcuaccccugccaccagcaugcuuccgcauucgaccaagccgcgagaucuaggggccacucaaaccggcgcaccgcucugcgaccucguagacagcaggaggccacagaagugaggcucgagcagaagaugccaacucuucugcgggucuauaucgaugggccgcauggaauggguaaaacgaccacaacucaauuguuaguugcacugggcagucgcgacgauauuguguacguacccgaaccuaugaccuauuggcaagugcuaggggccagcgagacaauagcuaauaucuacaccacucagcacagacucgaccagggagaaauuuccgcaggcgaugccgcugucgugaugacaucugcccagaucaccauggguaugccauaugcgguuacggacgcagugcuggcuccccaugucgggggagaggcuggcucgucacacgccccuccacccgcacuuacucugauuuuugauaggcacccuaucgcugccuugcucuguuacccagcggcccgguaucugaugggcagcaugaccccgcaggcagugcuggcuuucguagcccucauacccccuacauuaccagggacuaacaucguucugggagcccuucccgaggaccgccauauugaucgauuggccaagagacagaggccuggugaacggcuggaccuagcaaugcucgccgcuauccgucgcguguacggccugcuugcgaauaccgucagauaccugcaagggggaggcaguuggugggaggauuggggucaguuguccgggacagcagugccaccccagggagccgaaccgcagucuaacgcuggcccuaggccccacauuggcgacacccucuuuacgcuguuccgggccccagaguuacuggcaccuaauggggaucucuauaacguguuugccugggcucuugacguccuggccaaacgauugcgccccaugcauguuuucauccuagacuacgaucaaagcccagcaggaugcagagacgcgcugcuccagcugacuuccgguauggugcagacacacguaaccacucccggcucaauaccuacaauuugugaucuugcuaggaccuuugcccgggagaugggggaagcaaauuga

SEQ ID NO: 6782 - RNA, 1131 nt, Artificial Sequence
  derived and/or modified sequence opt4 from Thymidine_Kinase_TK__Herpes_Simplex_Virus_1_(HSV-1)__AAA45811
auggccagcuaccccugccaccagcacgccagcgccuucgaccaggccgccagaagcagaggccacagcaacagaagaaccgcccugagacccagaagacagcaggaggccaccgaggugagacuggagcagaagaugcccacccugcugagaguguacaucgacggcccccacggcaugggcaagaccaccaccacccagcugcugguggcccugggcagcagagacgacaucguguacgugcccgagcccaugaccuacuggcaggugcugggcgccagcgagaccaucgccaacaucuacaccacccagcacagacuggaccagggcgagaucagcgccggcgacgccgccguggugaugaccagcgcccagaucaccaugggcaugcccuacgccgugaccgacgccgugcuggccccccacgugggcggcgaggccggcagcagccacgcccccccccccgcccugacccugaucuucgacagacaccccaucgccgcccugcugugcuaccccgccgccagauaccugaugggcagcaugaccccccaggccgugcuggccuucguggcccugaucccccccacccugcccggcaccaacaucgugcugggcgcccugcccgaggacagacacaucgacagacuggccaagagacagagacccggcgagagacuggaccuggccaugcuggccgccaucagaagaguguacggccugcuggccaacaccgugagauaccugcagggcggcggcagcuggugggaggacuggggccagcugagcggcaccgccgugcccccccagggcgccgagccccagagcaacgccggccccagaccccacaucggcgacacccuguucacccuguucagagcccccgagcugcuggcccccaacggcgaccuguacaacguguucgccugggcccuggacgugcuggccaagagacugagacccaugcacguguucauccuggacuacgaccagagccccgccggcugcagagacgcccugcugcagcugaccagcggcauggugcagacccacgugaccacccccggcagcauccccaccaucugcgaccuggccagaaccuucgccagagagaugggcgaggccaacuga

SEQ ID NO: 6783 - RNA, 1131 nt, Artificial Sequence
  derived and/or modified sequence opt5 from Thymidine_Kinase_TK__Herpes_Simplex_Virus_1_(HSV-1)__AAA45811
auggccagcuaccccugccaccagcaugcuuccgccuucgaccaagcggcuagaucucggggccacagcaaccgcagaaccgcccugcggccucgcagacagcaggaggccacagaagugcggcucgagcagaagaugccgacgcugcuucgcgucuauaucgaugggccccauggaaugggcaaaaccacaaccacacaacugcucguugcucugggguccagagacgauauuguguacgugccugaacccaugaccuauuggcagguccuuggagccucugagacaaucgcuaauauuuacaccacgcagcaccggcuggaccagggcgaaaucagcgccggggaugcggccgugguuaugaccuccgcucaaauuacaaugggaaugccuuaugccgugaccgacgcuguccucgcgccccaugugggcggcgaggccgggucuagccacgccccuccgcccgcucugacacugaucuuugaucgccacccuaucgccgcucuccuguguuaccccgccgccagauaucuuaugggauccaugaccccucaggcuguucuggcguucguggcccucauucccccgacgcugccuggcacaaacaucguccuuggggcucugcccgaggaccggcauauugaucgccucgccaagagacagcggccuggagaacgccuggaccuggccaugcucgcugccaucagacggguguacggccugcuugcgaauaccgugagauaccugcaagggggaggcagcuggugggaggauuggggccagcucucugggacagcugucccuccccagggagccgaaccccaguccaacgccggcccgcgcccccacauuggggacacccuguuuacccuuuuccgggcuccugagcugcucgcccccaauggagaucuguauaacguuuuugcuugggcccuggacgugcucgcgaaaagacugcgcccuaugcauguguucauccuugacuacgaucaaagccccgccggcugccgggacgcucugcuccagcugacaucugggaugguccagacgcacgugaccacaccgggauccauuccuaccaucugugaucuugccagaacauuugcucgcgagaugggcgaagccaauuga

SEQ ID NO: 6784 - RNA, 1131 nt, Artificial Sequence
  derived and/or modified sequence opt6 from Thymidine_Kinase_TK__Herpes_Simplex_Virus_1_(HSV-1)__AAA45811
auggcaucauacccuugucaccaacaugcaucagcauuugaucaagcagcacgaucaagaggacauucaaauagaagaacugcacuaagaccuagaagacaacaagaagcaacagaaguaagauuagaacaaaaaaugcccacacuacuuagaguuuauauagauggaccacaugguaugggaaaaacaacaacaacucaauuacuaguagcauuaggaucaagagaugauauaguauauguucccgaacccaugaccuacuggcaaguauuaggagcaagcgaaacaauagcaaauauauacacaacucaacauagacuugaccaaggcgaaauaucagcaggagacgcagcaguuguaaugacaucagcacaaauaacaaugggcaugccauaugcaguuacagacgcaguauuagcuccccacguaggaggcgaagcaggauccucacaugcaccaccaccagcacuaacauuaauuuuugacagacaccccauagcugcacuccuauguuacccagcagcaagauauuuaaugggcucaaugacaccacaagcaguauuagccuucguagcauugauacccccaacauuaccaggaacaaauaucguuuuaggagcauuaccagaagacagacauauagaucgccuugcaaagagacaaagaccuggagaaagacuagaccuugcaaugcuagcagcaaucagaagaguauacggauuacuagcaaauacaguaagauaucuucaaggaggaggaucauggugggaagauuggggacaauuaucaggaacagcaguuccaccacaaggagcagaaccucaaucaaaugcuggcccuagaccacauauaggagauacauuauuuacuuuauucagagcaccugaauuacucgcucccaauggugauuuauauaauguuuucgcuugggcauuagauguauuagcaaaaagacuaagaccaaugcauguauuuauauuagauuaugaucaaucaccagcaggauguagagaugcuuuacuacaauuaacaagugguaugguacaaacacauguaacaaccccugguucuauaccaacaauaugugauuuggcaagaacauuugcaagagaaaugggcgaagcaaauuaa

SEQ ID NO: 6785 - protein, 376 aa, Artificial Sequence
  Thymidine_Kinase_TK__Herpes_Simplex_Virus_1_(HSV-1)__P08333
MASYPGHQHASAFDQAARSRGHSNRRTALRPRRQQEATEVRPEQKMPTLLRVYIDGPHGMGKTTTTQLLVALGSRDDIVYVPEPMTYWRVLGASETIANIYTTQHRLDQGEISAGDAAVVMTSAQITIGMPYAVTDAVLAPHIGGEAGSSHAPPPALTLIFDRHPIAALLCYPAARYLMGSMTPQAVLAFVALIPPTLPGTNIVLGALPEDRHIDRLAKRQRPGERLDLAMLAAIRRVYGLLANTVRYLQGGGSWREDWGQLSGTAVPPQGAEPQSNAGPRPHIGDTLFTLFRAPELLAPNGDLYNVFAWALDVLAKRLRPMHVFILDYDQSPAGCRDALLQLTSGMIQTHVTTPGSIPTICDLARTFAREMGEAN

SEQ ID NO: 6786 - RNA, 1131 nt, Artificial Sequence
  Thymidine_Kinase_TK__Herpes_Simplex_Virus_1_(HSV-1)__AAA45814
auggcuucguaccccggccaucagcacgcgucugcguucgaccaggcugcgcguucucgcggccauagcaaccgacguacggcguugcgcccucgccggcagcaagaagccacggaaguccgcccggagcagaaaaugcccacgcuacugcggguuuauauagacgguccccacgggauggggaaaaccaccaccacgcaacugcugguggcccuggguucgcgcgacgauaucgucuacguacccgagccgaugacuuacuggcgggugcugggggcuuccgagacaaucgcgaacaucuacaccacacaacaccgccucgaccagggugagauaucggccggggacgcggcggugguaaugacaagcgcccagauaacaauaggcaugccuuaugccgugaccgacgccguucuggcuccucauaucgggggggaggcugggagcucacaugccccgcccccggcccucacccucaucuucgaccgccaucccaucgccgcccuccugugcuacccggccgcgcgauaccuuaugggcagcaugaccccccaggccgugcuggcguucguggcccucaucccgccgaccuugcccggcacaaacaucguguugggggcccuuccggaggacagacacaucgaccgccuggccaaacgccagcgccccggcgagcggcuugaccuggcuaugcuggccgcgauucgccgcguuuacgggcugcuugccaauacggugcgguaucugcagggcggcgggucguggcgggaggauuggggacagcuuucggggacggccgugccgccccagggugccgagccccagagcaacgcgggcccacgaccccauaucggggacacguuauuuacccuguuucgggcccccgaguugcuggcccccaacggcgaccuguacaacguguuugccugggccuuggacgucuuggccaaacgccuccgucccaugcacgucuuuauccuggauuacgaccaaucgcccgccggcugccgggacgcccugcugcaacuuaccuccgggaugauccagacccacgucaccaccccaggcuccauaccgacgaucugcgaccuggcgcgcacguuugcccgggagaugggggaggcuaacuga

SEQ ID NO: 6787 - RNA, 1131 nt, Artificial Sequence
  derived and/or modified sequence opt1 from Thymidine_Kinase_TK__Herpes_Simplex_Virus_1_(HSV-1)__AAA45814
auggccagcuaccccggccaccagcacgccuccgcguucgaccaggccgcccgcagccgggggcacuccaaccgccggaccgcccugcgcccgcggcgccagcaggaggccaccgaggugcggcccgagcagaagaugcccacgcuccugcgcgucuacaucgacggcccccacgggaugggcaagaccaccaccacgcagcugcucguggcgcuggggagccgggacgacaucguguacgucccggagcccaugaccuacuggcgcgugcugggcgccuccgagaccaucgccaacaucuacaccacgcagcaccggcucgaccagggcgagaucagcgccggggacgcggccguggucaugaccuccgcccagaucaccaucggcaugcccuacgccgugaccgacgccgugcuggcgccccacaucgggggcgaggccgggagcucccacgccccgccgcccgcccugacgcucaucuucgaccgccaccccaucgccgcgcugcugugcuaccccgccgcccgguaccucaugggcagcaugacgccccaggccguccuggccuucguggcgcugaucccgcccacccuccccggcaccaacaucgugcugggggcccugcccgaggaccgccacaucgaccggcucgccaagcgccagcggcccggcgagcgccuggaccuggccaugcucgccgcgauccggcgcgucuacgggcugcuggccaacaccgugcgguaccuccagggcggcggguccuggcgcgaggacuggggccagcugagcgggaccgccgugcccccgcagggcgccgagccccaguccaacgcggggccccgcccccacaucggcgacacccuguucacccucuuccgggccccggagcugcuggcccccaacggcgaccucuacaacgucuucgccugggcccuggacgugcuggcgaagcgccuccggcccaugcacguguucauccuggacuacgaccagagccccgccgggugccgcgacgcccugcuccagcugacguccggcaugauccagacccacgucaccaccccggggagcauccccacgaucugcgaccuggcccggaccuucgcccgcgagaugggcgaggcgaacuga

SEQ ID NO: 6788 - RNA, 1131 nt, Artificial Sequence
  derived and/or modified sequence opt2 from Thymidine_Kinase_TK__Herpes_Simplex_Virus_1_(HSV-1)__AAA45814
auggccuccuaccccggccaccagcacgccuccgccuucgaccaggccgcccgcucccgcggccacuccaaccgccgcaccgcccuccgcccccgccgccagcaggaggccaccgagguccgccccgagcagaagaugcccacccuccuccgcgucuacaucgacggcccccacggcaugggcaagaccaccaccacccagcuccucgucgcccucggcucccgcgacgacaucgucuacguccccgagcccaugaccuacuggcgcguccucggcgccuccgagaccaucgccaacaucuacaccacccagcaccgccucgaccagggcgagaucuccgccggcgacgccgccgucgucaugaccuccgcccagaucaccaucggcaugcccuacgccgucaccgacgccguccucgccccccacaucggcggcgaggccggcuccucccacgcccccccccccgcccucacccucaucuucgaccgccaccccaucgccgcccuccucugcuaccccgccgcccgcuaccucaugggcuccaugaccccccaggccguccucgccuucgucgcccucaucccccccacccuccccggcaccaacaucguccucggcgcccuccccgaggaccgccacaucgaccgccucgccaagcgccagcgccccggcgagcgccucgaccucgccaugcucgccgccauccgccgcgucuacggccuccucgccaacaccguccgcuaccuccagggcggcggcuccuggcgcgaggacuggggccagcucuccggcaccgccguccccccccagggcgccgagccccaguccaacgccggcccccgcccccacaucggcgacacccucuucacccucuuccgcgcccccgagcuccucgcccccaacggcgaccucuacaacgucuucgccugggcccucgacguccucgccaagcgccuccgccccaugcacgucuucauccucgacuacgaccagucccccgccggcugccgcgacgcccuccuccagcucaccuccggcaugauccagacccacgucaccacccccggcuccauccccaccaucugcgaccucgcccgcaccuucgcccgcgagaugggcgaggccaacuga

SEQ ID NO: 6789 - RNA, 1131 nt, Artificial Sequence
  derived and/or modified sequence opt3 from Thymidine_Kinase_TK__Herpes_Simplex_Virus_1_(HSV-1)__AAA45814
auggccagcuaccccggccaccagcaugcuuccgcauucgaccaagccgcgagaucuagggggcacucaaaccggcgcaccgcucugcgaccucguagacagcaggaggccacagaagugaggccagagcagaagaugccgacucuccuucgggucuauaucgauggaccccaugguaugggcaaaacgaccacaacucaacuguugguugcauuagggagucgcgacgauauuguguacguaccugaaccaaugaccuauuggagagugcugggagccagcgagacaauagcuaauaucuacaccacucagcacaggcuagaccagggcgaaauuuccgccggugaugcagcugucgugaugacaucugcccagaucaccauugggaugcccuaugcgguuacggacgcagugcucgccccucauaucggaggcgaggcuggcucgucacacgccccacccccugcacugacucuuauauuugaucggcacccaaucgcugcccuguugugcuacccggcggcccgcuaucucauggggagcaugacgccccaagcaguccuggcuuucguggcccugauuccuccaacacuccccggaacuaacaucguauuaggugcucugccugaggaccgacauauugauagacuugccaagaggcagcggccaggcgaacguuuggaccuggcaaugcuagccgcuauccgcagaguuuacgggcuccuggcgaauaccgugagguaccuucagggaggcgguaguuggcgggaggauugggggcagcuguccggaacagcagugcccccgcaaggcgccgaaccucagucuaacgcuggcccccgaccacacauaggggacaccuuguuuacccucuuccgcgccccugagcuguuagcacccaauggagaucuguauaacgucuuugccugggcucucgacgugcuugccaaaagacugaggccaaugcaugucuucauuuuggacuacgaucagagccccgcagguugucgggacgcgcuacugcaacucacuuccggcaugauccagacacacguuaccacuccugggucaauuccaacaaucugcgaucuggcucgcaccuuugccagagagaugggagaagcaaauuga

SEQ ID NO: 6790 - RNA, 1131 nt, Artificial Sequence
  derived and/or modified sequence opt4 from Thymidine_Kinase_TK__Herpes_Simplex_Virus_1_(HSV-1)__AAA45814
auggccagcuaccccggccaccagcacgccagcgccuucgaccaggccgccagaagcagaggccacagcaacagaagaaccgcccugagacccagaagacagcaggaggccaccgaggugagacccgagcagaagaugcccacccugcugagaguguacaucgacggcccccacggcaugggcaagaccaccaccacccagcugcugguggcccugggcagcagagacgacaucguguacgugcccgagcccaugaccuacuggagagugcugggcgccagcgagaccaucgccaacaucuacaccacccagcacagacuggaccagggcgagaucagcgccggcgacgccgccguggugaugaccagcgcccagaucaccaucggcaugcccuacgccgugaccgacgccgugcuggccccccacaucggcggcgaggccggcagcagccacgcccccccccccgcccugacccugaucuucgacagacaccccaucgccgcccugcugugcuaccccgccgccagauaccugaugggcagcaugaccccccaggccgugcuggccuucguggcccugaucccccccacccugcccggcaccaacaucgugcugggcgcccugcccgaggacagacacaucgacagacuggccaagagacagagacccggcgagagacuggaccuggccaugcuggccgccaucagaagaguguacggccugcuggccaacaccgugagauaccugcagggcggcggcagcuggagagaggacuggggccagcugagcggcaccgccgugcccccccagggcgccgagccccagagcaacgccggccccagaccccacaucggcgacacccuguucacccuguucagagcccccgagcugcuggcccccaacggcgaccuguacaacguguucgccugggcccuggacgugcuggccaagagacugagacccaugcacguguucauccuggacuacgaccagagccccgccggcugcagagacgcccugcugcagcugaccagcggcaugauccagacccacgugaccacccccggcagcauccccaccaucugcgaccuggccagaaccuucgccagagagaugggcgaggccaacuga

SEQ ID NO: 6791 - RNA, 1131 nt, Artificial Sequence
  derived and/or modified sequence opt5 from Thymidine_Kinase_TK__Herpes_Simplex_Virus_1_(HSV-1)__AAA45814
auggccagcuaccccggccaccagcaugcuuccgccuucgaccaagcggcuagaucucgggggcacagcaaccgcagaaccgcccugcggccucgcagacagcaggaggccacagaagugcggccggagcagaagaugcccacgcuccugcgcgucuauaucgauggaccucauggcauggggaaaaccacaaccacacaacuucugguugcucucggauccagagacgauauuguguacgugcccgaaccuaugaccuauuggcggguccugggcgccucugagacaaucgcuaauauuuacaccacgcagcaccgccuugaccagggggaaaucagcgccggagaugcggccgugguuaugaccuccgcucagauuacaaucggcaugcccuaugccgugaccgacgcuguccuggccccucauaucggcggggaggcgggaucuagccacgccccgcccccugcucucacacugauuuuugauagacaccccaucgccgcucugcucugcuacccugccgcccgguaucugaugggcuccaugacgccccaagcugugcuugcguucguugcccugauuccgccuacccuccccgggacaaacaucgugcugggagcccuuccugaggaccgccauauugauagacuggcuaagcggcagcgccccggcgaaagacucgaccuggccaugcuggcugccauccggagagucuacgggcuccuggcgaauaccgugcgcuaccuucagggaggcggcagcuggcgggaggauugggggcagcugucuggaacagcugugcccccucaaggcgccgaaccgcaguccaacgccgggcccagaccucacauuggagacacccucuuuacccuguuccgcgcucccgagcuucuggccccuaauggcgaucucuauaacgucuuugcuugggcccuggacguucuggcgaaacggcucagacccaugcauguguucauccuggacuacgaucagagcccggccgggugucgcgacgcccuucugcaacucacaucuggaaugauccagacgcacgugaccacaccuggcuccauucccaccaucugcgaucuggcucggacauuugcuagagagaugggcgaagccaauuga

SEQ ID NO: 6792 - RNA, 1131 nt, Artificial Sequence
  derived and/or modified sequence opt6 from Thymidine_Kinase_TK__Herpes_Simplex_Virus_1_(HSV-1)__AAA45814
auggcaucauauccaggacaucaacaugcaucagcauucgaucaagcagcaagaucaagaggacauagcaaucguagaacagcauuacgaccaagacgacaacaagaagcaacagaaguaagaccagaacaaaaaaugccaacauuacuaagaguauauauagaugguccacauggaaugggaaaaacaacaacaacucaauuauuaguagcacuaggaucaagagaugauauaguuuacguaccagaaccaaugacauauuggagaguacuaggagccucagaaacuauagcaaauauauacacaacacaacacagauuagaucaaggagaaauaagugcaggugacgcugcaguuguuaugacaagugcacaaauaacuauaggcaugccuuaugcaguaacugaugcuguccuagcaccacauauaggaggagaagcaggaucaucacacgcuccuccaccugcccucacauuaauauuugaucgacaccccauagcugcacuauuauguuauccagcagcaagauaucucaugggauccaugacaccacaagcuguuuuagccuuuguagcauuaauuccaccaacucucccaggcacaaauauuguauuaggagcccuaccagaagaucgacauauagauagauuagcaaaaagacaaagaccaggagaaagauuagauuuagcuaugcuagcugcuauacgucgaguauauggauuacuagcaaauacaguaagauauuuacaaggaggaggaaguuggagagaagacuggggacaauuaucaggaacagcuguaccaccacaaggagcagaaccacaaucaaaugcaggaccaagaccacacauaggugauacacuauuuaccuuauucagagcaccagaacuauuagcuccaaauggagaccuauauaacguauuugcaugggccuuagacguauuagcuaaaagacuaagaccaaugcauguuuuuauucucgacuaugaucaaucaccagccgguuguagagacgcauuacuacaauuaacuucagguaugauacaaacacauguaacaacaccuggaucaauaccaaccauaugcgaccuagcaaggacauuugcaagagaaaugggagaagcaaauuaa

SEQ ID NO: 6793 - protein, 376 aa, Artificial Sequence
  Thymidine_Kinase_TK__Herpes_Simplex_Virus_1_(HSV-1)__Q9DLP2
MASYPCHQHASAFDQAARSRGHSNRRTALRPRRQQEATEVRLEQKMPTLLRVYIDGPHGMGKTTTTQLLVALGSRDDIVYVPEPMTYWQVLGASETIANIYTTQHRLDQGEISAGDAAVVMTSAQITMGMPYAVTDAVLAPHIGGEAGSSHAPPPALTLIFDRHPIAALLCYPAARYLMGSMTPQAVLAFVALIPPTLPGTNIVLGALPEDRHIDRLAKRQRPGERLDLAMLAAIRRVYGLLANTVRYLQGGGSWREDWGQLSGTAVPPQGAEPQSNAGPRPHIGDTLFTLFRAPELLAPNGDLYNVFAWALDVLAKRLRPMHVFILDYDQSPAGCRDALLQLTSGMVQTHVTTPGSIPTICDLARTFARGVGEAN

SEQ ID NO: 6794 - RNA, 1131 nt, Artificial Sequence
  Thymidine_Kinase_TK__Herpes_Simplex_Virus_1_(HSV-1)__AAG40842
auggcuucguaccccugccaucaacacgcgucugcguucgaccaggcugcgcguucucgcggccauagcaaccgacguacggcguugcgcccucgccggcagcaagaagccacggaaguccgccuggagcagaaaaugcccacgcuacugcggguuuauauagacgguccucacgggauggggaaaaccaccaccacgcaacugcugguggcccuggguucgcgcgacgauaucgucuacguacccgagccgaugacuuacuggcaggugcugggggcuuccgagacaaucgcgaacaucuacaccacacaacaccgccucgaccagggugagauaucggccggggacgcggcggugguaaugacaagcgcccagauaacaaugggcaugccuuaugccgugaccgacgccguucuggcuccucauaucgggggggaggcugggagcucacaugccccgcccccggcccucacccucaucuucgaccgccaucccaucgccgcccuccugugcuacccggccgcgcgauaccuuaugggcagcaugaccccccaggccgugcuggcguucguggcccucaucccgccgaccuugcccggcacaaacaucguguugggggcccuuccggaggacagacacaucgaccgccuggccaaacgccagcgccccggcgagcggcuugaccuggcuaugcuggccgcgauucgccgcguuuacgggcugcuugccaauacggugcgguaucugcagggcggcgggucguggcgggaggauuggggacagcuuucggggacggccgugccgccccagggugccgagccccagagcaacgcgggcccacgaccccauaucggggacacguuauuuacccuguuucgggcccccgaguugcuggcccccaacggcgaccuguauaacguguuugccugggccuuggacgucuuggccaaacgccuccgucccaugcacgucuuuauccuggauuacgaccaaucgcccgccggcugccgggacgcccugcugcaacuuaccuccgggaugguccagacccacgucaccacccccggcuccauaccgacgaucugcgaccuggcgcgcacguuugcccggggagugggggaggcuaacuga

SEQ ID NO: 6795 - RNA, 1131 nt, Artificial Sequence
  derived and/or modified sequence opt1 from Thymidine_Kinase_TK__Herpes_Simplex_Virus_1_(HSV-1)__AAG40842
auggccagcuaccccugccaccagcacgccuccgcguucgaccaggccgcccggagccggggccacuccaaccgccggaccgcccugcgcccgcggcgccagcaggaggccaccgaggugcggcucgagcagaagaugcccacgcugcugcgcgucuacaucgacgggccccacggcauggggaagaccaccaccacgcagcuccugguggcgcugggcagccgggacgacaucguguacguccccgagccgaugaccuacuggcagguccucggggccuccgagaccaucgccaacaucuacaccacgcagcaccgccuggaccagggcgagaucagcgccggcgacgcggccguggugaugaccuccgcccagaucaccauggggaugcccuacgccgugaccgacgccgugcuggcgccccacaucggcggggaggccggcagcucccacgcgcccccgcccgcccucacgcugaucuucgaccggcaccccaucgccgcccugcucugcuaccccgccgcccgcuaccugauggggagcaugaccccgcaggccguccuggccuucguggcgcucaucccgcccacccugcccggcaccaacaucgugcugggcgcccuccccgaggaccggcacaucgaccgccuggccaagcggcagcgccccggggagcggcuggaccucgccaugcuggccgcgauccgccgggucuacggccugcucgccaacacggugcgcuaccugcagggcgggggcuccuggcgggaggacugggggcagcugagcggcaccgccgugccgccccagggggccgagccccaguccaacgcgggcccccgcccccacaucggggacacccucuucacccuguuccgcgcccccgagcugcucgccccgaacggcgaccuguacaacgucuucgccugggcccuggacgugcucgcgaagcggcugcgccccaugcacguguucauccuggacuacgaccagagccccgccggcugccgggacgcccuccugcagcugacguccgggaugguccagacccacgugaccacccccggcagcaucccgacgaucugcgaccucgcccgcaccuucgcccgcggggugggcgaggcgaacuga

SEQ ID NO: 6796 - RNA, 1131 nt, Artificial Sequence
  derived and/or modified sequence opt2 from Thymidine_Kinase_TK__Herpes_Simplex_Virus_1_(HSV-1)__AAG40842
auggccuccuaccccugccaccagcacgccuccgccuucgaccaggccgcccgcucccgcggccacuccaaccgccgcaccgcccuccgcccccgccgccagcaggaggccaccgagguccgccucgagcagaagaugcccacccuccuccgcgucuacaucgacggcccccacggcaugggcaagaccaccaccacccagcuccucgucgcccucggcucccgcgacgacaucgucuacguccccgagcccaugaccuacuggcagguccucggcgccuccgagaccaucgccaacaucuacaccacccagcaccgccucgaccagggcgagaucuccgccggcgacgccgccgucgucaugaccuccgcccagaucaccaugggcaugcccuacgccgucaccgacgccguccucgccccccacaucggcggcgaggccggcuccucccacgcccccccccccgcccucacccucaucuucgaccgccaccccaucgccgcccuccucugcuaccccgccgcccgcuaccucaugggcuccaugaccccccaggccguccucgccuucgucgcccucaucccccccacccuccccggcaccaacaucguccucggcgcccuccccgaggaccgccacaucgaccgccucgccaagcgccagcgccccggcgagcgccucgaccucgccaugcucgccgccauccgccgcgucuacggccuccucgccaacaccguccgcuaccuccagggcggcggcuccuggcgcgaggacuggggccagcucuccggcaccgccguccccccccagggcgccgagccccaguccaacgccggcccccgcccccacaucggcgacacccucuucacccucuuccgcgcccccgagcuccucgcccccaacggcgaccucuacaacgucuucgccugggcccucgacguccucgccaagcgccuccgccccaugcacgucuucauccucgacuacgaccagucccccgccggcugccgcgacgcccuccuccagcucaccuccggcaugguccagacccacgucaccacccccggcuccauccccaccaucugcgaccucgcccgcaccuucgcccgcggcgucggcgaggccaacuga

SEQ ID NO: 6797 - RNA, 1131 nt, Artificial Sequence
  derived and/or modified sequence opt3 from Thymidine_Kinase_TK__Herpes_Simplex_Virus_1_(HSV-1)__AAG40842
auggccagcuaccccugccaccagcaugcuuccgcauucgaccaagccgcgagaucuaggggccacucaaaccggcgcaccgcucugcgaccucguagacagcaggaggccacagaagugaggcucgagcagaagaugccaacucuucugcgggucuauaucgaugggccgcauggaauggguaaaacgaccacaacucaauuguuaguugcacugggcagucgcgacgauauuguguacguacccgaaccuaugaccuauuggcaagugcuaggggccagcgagacaauagcuaauaucuacaccacucagcacagacucgaccagggagaaauuuccgcaggcgaugccgcugucgugaugacaucugcccagaucaccauggguaugccauaugcgguuacggacgcagugcuggcuccccauauugggggagaggcuggcucgucacacgccccuccacccgcacuuacucugaucuuugauaggcacccuauagcugccuugcucuguuacccagcggcccgguaucugaugggcagcaugaccccgcaggcaguccuggcuuucguggcccucauucccccuacauuaccagggacuaacaucguacugggagcccuucccgaggaccgccauaucgaucgauuggccaagagacagaggccuggugaacggcuggaccuagcaaugcucgccgcuauucgucgcguuuacggccugcuugcgaauaccgugagauaccugcaagggggaggcaguuggagggaggauuggggucaguuguccgggacagcagucccaccccagggagccgaaccgcagucuaacgcuggcccucggccccacaucggcgacacccucuuuacgcuguuccgagccccagaguuacuggcaccuaauggggaucucuauaacguguuugccugggcucuugacgugcuggccaaacgcuugagacccaugcaugucuucauacuagacuacgaucaaagcccagcaggaugcagggacgcgcugcuccagcugacuuccgguaugguucagacacacgugaccacucccggcucaauuccuacaaucugugaucuugcucggaccuuugcccgcgggguaggagaggcaaauuga

SEQ ID NO: 6798 - RNA, 1131 nt, Artificial Sequence
  derived and/or modified sequence opt4 from Thymidine_Kinase_TK__Herpes_Simplex_Virus_1_(HSV-1)__AAG40842
auggccagcuaccccugccaccagcacgccagcgccuucgaccaggccgccagaagcagaggccacagcaacagaagaaccgcccugagacccagaagacagcaggaggccaccgaggugagacuggagcagaagaugcccacccugcugagaguguacaucgacggcccccacggcaugggcaagaccaccaccacccagcugcugguggcccugggcagcagagacgacaucguguacgugcccgagcccaugaccuacuggcaggugcugggcgccagcgagaccaucgccaacaucuacaccacccagcacagacuggaccagggcgagaucagcgccggcgacgccgccguggugaugaccagcgcccagaucaccaugggcaugcccuacgccgugaccgacgccgugcuggccccccacaucggcggcgaggccggcagcagccacgcccccccccccgcccugacccugaucuucgacagacaccccaucgccgcccugcugugcuaccccgccgccagauaccugaugggcagcaugaccccccaggccgugcuggccuucguggcccugaucccccccacccugcccggcaccaacaucgugcugggcgcccugcccgaggacagacacaucgacagacuggccaagagacagagacccggcgagagacuggaccuggccaugcuggccgccaucagaagaguguacggccugcuggccaacaccgugagauaccugcagggcggcggcagcuggagagaggacuggggccagcugagcggcaccgccgugcccccccagggcgccgagccccagagcaacgccggccccagaccccacaucggcgacacccuguucacccuguucagagcccccgagcugcuggcccccaacggcgaccuguacaacguguucgccugggcccuggacgugcuggccaagagacugagacccaugcacguguucauccuggacuacgaccagagccccgccggcugcagagacgcccugcugcagcugaccagcggcauggugcagacccacgugaccacccccggcagcauccccaccaucugcgaccuggccagaaccuucgccagaggcgugggcgaggccaacuga

SEQ ID NO: 6799 - RNA, 1131 nt, Artificial Sequence
  derived and/or modified sequence opt5 from Thymidine_Kinase_TK__Herpes_Simplex_Virus_1_(HSV-1)__AAG40842
auggccagcuaccccugccaccagcaugcuuccgccuucgaccaagcggcuagaucucggggccacagcaaccgcagaaccgcccugcggccucgcagacagcaggaggccacagaagugcggcucgagcagaagaugccgacgcugcuucgcgucuauaucgaugggccccauggaaugggcaaaaccacaaccacacaacugcucguugcucugggguccagagacgauauuguguacgugccugaacccaugaccuauuggcagguccuuggagccucugagacaaucgcuaauauuuacaccacgcagcaccggcuggaccagggcgaaaucagcgccggggaugcggccgugguuaugaccuccgcucaaauuacaaugggaaugccuuaugccgugaccgacgcuguccucgcgccccauaucggcggcgaggccgggucuagccacgccccuccgcccgcucugacacugaucuuugaucgccacccuauugccgcucuccuguguuaccccgccgccagauaucuuaugggauccaugaccccucaggcugugcuggcguucguugcccucauucccccgacgcugccuggcacaaacaucgugcuuggggcucugcccgaggaccggcauaucgaucgccucgccaagagacagcggccuggagaacgccuggaccuggccaugcucgcugccauuagacgggucuacggccugcuugcgaauaccgugagauaccugcaagggggaggcagcuggcgcgaggauuggggccagcucucugggacagcugugccuccccagggagccgaaccccaguccaacgccggcccgcggccccacaucggggacacccuguuuacccuuuucagagcuccugagcugcucgcccccaauggagaucuguauaacgucuuugcuugggcccuggacguucucgcgaaacgccugcggccuaugcauguguucauucuugacuacgaucaaagccccgccggcugcagagacgcucugcuccagcugacaucugggauggugcagacgcacgucaccacaccgggauccaucccuaccaucugugaucuugcccgcacauuugcucggggcgugggcgaggccaauuga

SEQ ID NO: 6800 - RNA, 1131 nt, Artificial Sequence
  derived and/or modified sequence opt6 from Thymidine_Kinase_TK__Herpes_Simplex_Virus_1_(HSV-1)__AAG40842
auggcuucauauccaugucaucaacacgcaucagcauucgaucaagccgcaagaucaagaggucauucaaauagaagaacagcacuaagaccaagaagacaacaagaagcaacugaaguaagacuagaacaaaaaaugccaacuuuacuaagaguuuauauugauggcccacauggcaugggaaaaacaacuacaacacaacuccuaguagcauuaggcucacgagaugauauaguauacgucccagaaccaaugacauauuggcaaguauuaggagcaucagaaacaauagcuaauauauauacaacacaacauagacucgaucaaggugaaauaucagcaggugaugcagcaguaguaaugacaucagcacaaauaacaaugggaaugccauacgcaguaacagacgcaguacuagcaccccacauaggaggugaagccgguucaucacaugcaccaccaccugcacuaacacuaauauuugaucgacaucccauagcugcauuauuauguuacccugcagcaagauaucuaaugggaucaaugacaccacaagcaguauuagcauuugucgcacuaauaccaccaacuuuaccaggaacaaauauaguauuaggagcacuaccagaagacaggcauauagauagacuagcaaaaagacaaagaccaggagaacgcuuagaucuagcaaugcuagcagcaauuaggagaguauauggauuauuagcaaauacaguuagauauuuacaaggcgguggaucauggagagaggauuggggacaauuaucagguacugcaguaccaccucaaggagcagaaccacaaucaaacgccggaccgagaccacauauaggugauacauuauucacauuauuuagagccccagaacuacuagcaccaaauggugauuuauauaacguauucgcaugggccuuagauguacuagcaaaaagguuaagacccaugcauguuuucauauuagauuaugaucaaaguccagcaggauguagagaugcucuacuacaauuaacaaguggaaugguucaaacucauguaacaacaccaggauccauaccaacaauaugugauuuagcaagaacuuucgcaagaggaguaggugaagcaaauuaa

SEQ ID NO: 6801 - protein, 280 aa, Artificial Sequence
  Thymidine_Kinase_TK__Herpes_Simplex_Virus_1_(HSV-1)__Q9ENS0
MASYPCHQHASAFDQAARSRGHSNRRTALRPRRQQEATEVRLEQKMPTLLRVYIDGPHGMGKTTTTQLLVALGSRDDIVYVPEPMTYWQVLGASETIANIYTTQHRLDQGEISAGDAAVVMTSAQITMGMPYAVTDAVLAPHIGGEAGSSHAPPPALTLIFDRHPIAALLCYPAARYLMGSMTPQAVLAFVALIPPTLPGTNIVLGALPEDRHIDRLAKRQRPGERLDLAMLAAIRRVYGLLANTVRYLQGGGSWREDWGQLSGTAVPPQGAEPQSNAGP

SEQ ID NO: 6802 - RNA, 843 nt, Artificial Sequence
  Thymidine_Kinase_TK__Herpes_Simplex_Virus_1_(HSV-1)__AEL30083
auggcuucguaccccugccaucaacacgcgucugcguucgaccaggcugcgcguucucgcggccauagcaaccgacguacggcguugcgcccucgccggcagcaagaagccacggaaguccgccuggagcagaaaaugcccacgcuacugcggguuuauauagacgguccucacgggauggggaaaaccaccaccacgcaacugcugguggcccuggguucgcgcgacgauaucgucuacguacccgagccgaugacuuacuggcaggugcugggggcuuccgagacaaucgcgaacaucuacaccacacaacaccgccucgaccagggugagauaucggccggggacgcggcggugguaaugacaagcgcccagauaacaaugggcaugccuuaugccgugaccgacgccguucuggcuccucauaucgggggggaggcugggagcucacaugccccgcccccggcccucacccucaucuucgaccgccaucccaucgccgcccuccugugcuacccggccgcgcgauaccuuaugggcagcaugaccccccaggccgugcuggcguucguggcccucaucccgccgaccuugcccggcacaaacaucguguugggggcccuuccggaggacagacacaucgaccgccuggccaaacgccagcgccccggcgagcggcuugaccuggcuaugcuggccgcgauucgccgcguuuacgggcugcuugccaauacggugcgguaucugcagggcggcgggucguggcgggaggauuggggacagcuuucggggacggccgugccgccccagggugccgagccccagagcaacgcgggcccauga

SEQ ID NO: 6803 - RNA, 843 nt, Artificial Sequence
  derived and/or modified sequence opt1 from Thymidine_Kinase_TK__Herpes_Simplex_Virus_1_(HSV-1)__AEL30083
auggccagcuaccccugccaccagcacgccuccgcguucgaccaggccgcccgcagccggggccacuccaaccgccggaccgcccugcgcccgcggcgccagcaggaggccaccgaggugcggcucgagcagaagaugcccacgcugcugcgcgucuacaucgacgggccccacggcauggggaagaccaccaccacgcagcuccugguggcgcugggcagccgggacgacaucguguacguccccgagccgaugaccuacuggcagguccucggggccuccgagaccaucgccaacaucuacaccacgcagcaccgccuggaccagggcgagaucagcgccggcgacgcggccguggugaugaccuccgcccagaucaccauggggaugcccuacgccgugaccgacgccgugcuggcgccccacaucggcggggaggccggcagcucccacgcgcccccgcccgcccucacgcugaucuucgaccggcaccccaucgccgcccugcucugcuaccccgccgcccgcuaccugauggggagcaugaccccgcaggccguccuggccuucguggcgcucaucccgcccacccugcccggcaccaacaucgugcugggcgcccuccccgaggaccggcacaucgaccgccuggccaagcggcagcgccccggggagcggcuggaccucgccaugcuggccgcgauccgccgggucuacggccugcucgccaacacggugcgcuaccugcagggcgggggcuccuggcgggaggacugggggcagcugagcggcaccgccgugccgccccagggggccgagccccaguccaacgcgggccccuga

SEQ ID NO: 6804 - RNA, 843 nt, Artificial Sequence
  derived and/or modified sequence opt2 from Thymidine_Kinase_TK__Herpes_Simplex_Virus_1_(HSV-1)__AEL30083
auggccuccuaccccugccaccagcacgccuccgccuucgaccaggccgcccgcucccgcggccacuccaaccgccgcaccgcccuccgcccccgccgccagcaggaggccaccgagguccgccucgagcagaagaugcccacccuccuccgcgucuacaucgacggcccccacggcaugggcaagaccaccaccacccagcuccucgucgcccucggcucccgcgacgacaucgucuacguccccgagcccaugaccuacuggcagguccucggcgccuccgagaccaucgccaacaucuacaccacccagcaccgccucgaccagggcgagaucuccgccggcgacgccgccgucgucaugaccuccgcccagaucaccaugggcaugcccuacgccgucaccgacgccguccucgccccccacaucggcggcgaggccggcuccucccacgcccccccccccgcccucacccucaucuucgaccgccaccccaucgccgcccuccucugcuaccccgccgcccgcuaccucaugggcuccaugaccccccaggccguccucgccuucgucgcccucaucccccccacccuccccggcaccaacaucguccucggcgcccuccccgaggaccgccacaucgaccgccucgccaagcgccagcgccccggcgagcgccucgaccucgccaugcucgccgccauccgccgcgucuacggccuccucgccaacaccguccgcuaccuccagggcggcggcuccuggcgcgaggacuggggccagcucuccggcaccgccguccccccccagggcgccgagccccaguccaacgccggccccuga

SEQ ID NO: 6805 - RNA, 843 nt, Artificial Sequence
  derived and/or modified sequence opt3 from Thymidine_Kinase_TK__Herpes_Simplex_Virus_1_(HSV-1)__AEL30083
auggccagcuaccccugccaccagcaugcuuccgcauucgaccaagccgcgagaucuaggggccacucaaaccggcgcaccgcucugcgaccucguagacagcaggaggccacagaagugaggcucgagcagaagaugccaacucuucugcgggucuauaucgaugggccgcauggaauggguaaaacgaccacaacucaauuguuaguugcacugggcagucgcgacgauauuguguacguacccgaaccuaugaccuauuggcaagugcuaggggccagcgagacaauagcuaauaucuacaccacucagcacagacucgaccagggagaaauuuccgcaggcgaugccgcugucgugaugacaucugcccagaucaccauggguaugccauaugcgguuacggacgcagugcuggcuccccauauugggggagaggcuggcucgucacacgccccuccacccgcacuuacucugaucuuugauaggcacccuauagcugccuugcucuguuacccagcggcccgguaucugaugggcagcaugaccccgcaggcaguccuggcuuucguggcccucauucccccuacauuaccagggacuaacaucguacugggagcccuucccgaggaccgccauaucgaucgauuggccaagagacagaggccuggugaacggcuggaccuagcaaugcucgccgcuauucgucgcguuuacggccugcuugcgaauaccgugagauaccugcaagggggaggcaguuggagggaggauuggggucaguuguccgggacagcagucccaccccagggagccgaaccgcagucuaacgcuggcccuuga

SEQ ID NO: 6806 - RNA, 843 nt, Artificial Sequence
  derived and/or modified sequence opt4 from Thymidine_Kinase_TK__Herpes_Simplex_Virus_1_(HSV-1)__AEL30083
auggccagcuaccccugccaccagcacgccagcgccuucgaccaggccgccagaagcagaggccacagcaacagaagaaccgcccugagacccagaagacagcaggaggccaccgaggugagacuggagcagaagaugcccacccugcugagaguguacaucgacggcccccacggcaugggcaagaccaccaccacccagcugcugguggcccugggcagcagagacgacaucguguacgugcccgagcccaugaccuacuggcaggugcugggcgccagcgagaccaucgccaacaucuacaccacccagcacagacuggaccagggcgagaucagcgccggcgacgccgccguggugaugaccagcgcccagaucaccaugggcaugcccuacgccgugaccgacgccgugcuggccccccacaucggcggcgaggccggcagcagccacgcccccccccccgcccugacccugaucuucgacagacaccccaucgccgcccugcugugcuaccccgccgccagauaccugaugggcagcaugaccccccaggccgugcuggccuucguggcccugaucccccccacccugcccggcaccaacaucgugcugggcgcccugcccgaggacagacacaucgacagacuggccaagagacagagacccggcgagagacuggaccuggccaugcuggccgccaucagaagaguguacggccugcuggccaacaccgugagauaccugcagggcggcggcagcuggagagaggacuggggccagcugagcggcaccgccgugcccccccagggcgccgagccccagagcaacgccggccccuga

SEQ ID NO: 6807 - RNA, 843 nt, Artificial Sequence
  derived and/or modified sequence opt5 from Thymidine_Kinase_TK__Herpes_Simplex_Virus_1_(HSV-1)__AEL30083
auggccagcuaccccugccaccagcaugcuuccgccuucgaccaagcggcuagaucucggggccacagcaaccgcagaaccgcccugcggccucgcagacagcaggaggccacagaagugcggcucgagcagaagaugccgacgcugcuucgcgucuauaucgaugggccccauggaaugggcaaaaccacaaccacacaacugcucguugcucugggguccagagacgauauuguguacgugccugaacccaugaccuauuggcagguccuuggagccucugagacaaucgcuaauauuuacaccacgcagcaccggcuggaccagggcgaaaucagcgccggggaugcggccgugguuaugaccuccgcucaaauuacaaugggaaugccuuaugccgugaccgacgcuguccucgcgccccauaucggcggcgaggccgggucuagccacgccccuccgcccgcucugacacugaucuuugaucgccacccuauugccgcucuccuguguuaccccgccgccagauaucuuaugggauccaugaccccucaggcugugcuggcguucguugcccucauucccccgacgcugccuggcacaaacaucgugcuuggggcucugcccgaggaccggcauaucgaucgccucgccaagagacagcggccuggagaacgccuggaccuggccaugcucgcugccauuagacgggucuacggccugcuugcgaauaccgugagauaccugcaagggggaggcagcuggcgcgaggauuggggccagcucucugggacagcugugccuccccagggagccgaaccccaguccaacgccggcccguga

SEQ ID NO: 6808 - RNA, 843 nt, Artificial Sequence
  derived and/or modified sequence opt6 from Thymidine_Kinase_TK__Herpes_Simplex_Virus_1_(HSV-1)__AEL30083
auggcaucauauccaugccaucaacaugcaagcgcauuugaucaagcagcaagaucaagaggacauagcaauagaagaacugcauuaagaccaagaagacaacaagaagcaacagaaguaagauuagaacaaaaaaugccaacacuacuaagaguauauauagauggaccacacggcaugggaaaaaccacaacuacacaacuauuaguagcucuaggaagcagagaugauauaguauauguuccagaaccaaugacauauuggcaaguacucggagcaucagaaacaauagcaaauauauacacaacacaacauagacuugaucaaggagaaauaagcgcaggugaugcagcuguuguuaugacaagcgcacaaauaacaaugggaaugccauaugcaguaaccgaugcaguauuagcaccucacauaggaggagaagcaggaaguagccaugcaccaccaccagcauuaacacuaauauuugaccgacacccaauagcagcauuacuauguuauccagcagcaagauaucuaaugggaaguaugacaccacaagcaguacuagcauuuguagcauuaauacccccaacauuaccaggaacaaauauaguauuaggagcacuaccagaagauagacauauagauagauuagcaaaaagacaaagaccaggagaaagauuagauuuagcaauguuagcagcaauaaggagaguauauggauuauuagcaaauacaguaagauauuuacaaggaggaggaucauggagagaagacuggggacaauuaucaggaacagcaguaccaccacaaggagcagaaccucaaucaaaugcaggaccauaa

SEQ ID NO: 6809 - protein, 108 aa, Artificial Sequence
  Thymidine_Kinase_TK__Herpes_Simplex_Virus_1_(HSV-1)__Q9ENS1
MASYPCHQHASAFDQAARSRGHSNRRTALRPRRQQEATEVRLEQKMPTLLRVYIDGPHGMGKTTTTQLLVALGSRDDIVYVPEPMTYWQVLGASETIANIYTTQHRLD

SEQ ID NO: 6810 - RNA, 327 nt, Artificial Sequence
  Thymidine_Kinase_TK__Herpes_Simplex_Virus_1_(HSV-1)__BAB11946
auggcuucguaccccugccaucaacacgcgucugcguucgaccaggcugcgcguucucgcggccauagcaaccgacguacggcguugcgcccucgccggcagcaagaagccacggaaguccgccuggagcagaaaaugcccacgcuacugcggguuuauauagacgguccucacgggauggggaaaaccaccaccacgcaacugcugguggcccuggguucgcgcgacgauaucgucuacguacccgagccgaugacuuacuggcaggugcugggggcuuccgagacaaucgcgaacaucuacaccacacaacaccgccucgacuag

SEQ ID NO: 6811 - RNA, 327 nt, Artificial Sequence
  derived and/or modified sequence opt1 from Thymidine_Kinase_TK__Herpes_Simplex_Virus_1_(HSV-1)__BAB11946
auggccagcuaccccugccaccagcacgccuccgcguucgaccaggccgcccgcagccggggccacuccaaccgccggaccgcccugcgcccgcggcgccagcaggaggccaccgaggugcggcucgagcagaagaugcccacgcugcugcgcguguacaucgacgggccccacggcauggggaagaccaccaccacgcagcuccugguggcgcugggcagccgggacgacaucguguacguccccgagccgaugaccuacuggcagguccucggggccuccgagaccaucgccaacaucuacaccacgcagcaccgccuggacuga

SEQ ID NO: 6812 - RNA, 327 nt, Artificial Sequence
  derived and/or modified sequence opt2 from Thymidine_Kinase_TK__Herpes_Simplex_Virus_1_(HSV-1)__BAB11946
auggccuccuaccccugccaccagcacgccuccgccuucgaccaggccgcccgcucccgcggccacuccaaccgccgcaccgcccuccgcccccgccgccagcaggaggccaccgagguccgccucgagcagaagaugcccacccuccuccgcgucuacaucgacggcccccacggcaugggcaagaccaccaccacccagcuccucgucgcccucggcucccgcgacgacaucgucuacguccccgagcccaugaccuacuggcagguccucggcgccuccgagaccaucgccaacaucuacaccacccagcaccgccucgacuga

SEQ ID NO: 6813 - RNA, 327 nt, Artificial Sequence
  derived and/or modified sequence opt3 from Thymidine_Kinase_TK__Herpes_Simplex_Virus_1_(HSV-1)__BAB11946
auggccagcuaccccugccaccagcaugcuuccgcauucgaccaggccgcgagaucuaggggccacucaaaccggcgcaccgcucugcgaccucguagacagcaggaggccacagaagugaggcucgagcagaagaugccaacucuucugcgggucuauaucgaugggccgcauggaauggguaaaacgaccacaacucaauuguuaguugcacugggcagucgcgacgauauuguguacguacccgaaccuaugaccuauuggcaagugcuaggggccagcgagacaauagcuaauaucuacaccacucagcacagacucgacuga

SEQ ID NO: 6814 - RNA, 327 nt, Artificial Sequence
  derived and/or modified sequence opt4 from Thymidine_Kinase_TK__Herpes_Simplex_Virus_1_(HSV-1)__BAB11946
auggccagcuaccccugccaccagcacgccagcgccuucgaccaggccgccagaagcagaggccacagcaacagaagaaccgcccugagacccagaagacagcaggaggccaccgaggugagacuggagcagaagaugcccacccugcugagaguguacaucgacggcccccacggcaugggcaagaccaccaccacccagcugcugguggcccugggcagcagagacgacaucguguacgugcccgagcccaugaccuacuggcaggugcugggcgccagcgagaccaucgccaacaucuacaccacccagcacagacuggacuga

SEQ ID NO: 6815 - RNA, 327 nt, Artificial Sequence
  derived and/or modified sequence opt5 from Thymidine_Kinase_TK__Herpes_Simplex_Virus_1_(HSV-1)__BAB11946
auggccagcuaccccugccaccagcaugcuuccgccuucgaccaagcggcuagaucucggggccacagcaaccgcagaaccgcccugcggccucgcagacagcaggaggccacagaagugcggcucgagcagaagaugccgacgcugcuucgcgucuauaucgaugggccccauggaaugggcaaaaccacaaccacacaacugcucguugcucugggguccagagacgauauuguguacgugccugaacccaugaccuauuggcagguccuuggagccucugagacaaucgcuaauauuuacaccacgcagcaccggcuggacuga

SEQ ID NO: 6816 - RNA, 327 nt, Artificial Sequence
  derived and/or modified sequence opt6 from Thymidine_Kinase_TK__Herpes_Simplex_Virus_1_(HSV-1)__BAB11946
auggcaucauacccaugccaccaacacgcaucagcauucgaccaagcagcaagaucaagaggacacucaaacagaagaacagcacuaagaccaagaagacaacaagaagcaacagaaguaagacuagaacaaaaaaugccaacacuacuaagaguauacauagacggaccacacggaaugggaaaaacaacaacaacacaacuacuaguagcacuaggaucaagagacgacauaguauacguaccagaaccaaugacauacuggcaaguacuaggagcaucagaaacaauagcaaacauauacacaacacaacacagacuagacuaa

SEQ ID NO: 6817 - protein, 103 aa, Artificial Sequence
  Thymidine_Kinase_TK__Herpes_Simplex_Virus_1_(HSV-1)__Q9ENS2
MASYPCHQHASAFDQAARSRGHSNRRTALRPRRQQEATEVRLEQKMPTLLRVYIDGPHGMGKTTTTQLLVALGSRDDIVYVPEPMTYWQVLGASETIANIYTT

SEQ ID NO: 6818 - RNA, 312 nt, Artificial Sequence
  Thymidine_Kinase_TK__Herpes_Simplex_Virus_1_(HSV-1)__BAB11945
auggcuucguaccccugccaucaacacgcgucugcguucgaccaggcugcgcguucucgcggccauagcaaccgacguacggcguugcgcccucgccggcagcaagaagccacggaaguccgccuggagcagaaaaugcccacgcuacugcggguuuauauagacgguccucacgggauggggaaaaccaccaccacgcaacugcugguggcccuggguucgcgcgacgauaucgucuacguacccgagccgaugacuuacuggcaggugcugggggcuuccgagacaaucgcgaacaucuacaccacauaa

SEQ ID NO: 6819 - RNA, 312 nt, Artificial Sequence
  derived and/or modified sequence opt1 from Thymidine_Kinase_TK__Herpes_Simplex_Virus_1_(HSV-1)__BAB11945
auggccagcuaccccugccaccagcacgccuccgcguucgaccaggccgcccgcagccggggccacuccaaccgccggaccgcccugcgcccgcggcgccagcaggaggccaccgaggugcggcucgagcagaagaugcccacgcugcugcgcguguacaucgacgggccccacggcauggggaagaccaccaccacgcagcuccugguggcgcugggcagccgggacgacaucguguacguccccgagccgaugaccuacuggcagguccucggggccuccgagaccaucgccaacaucuacaccacguga

SEQ ID NO: 6820 - RNA, 312 nt, Artificial Sequence
  derived and/or modified sequence opt2 from Thymidine_Kinase_TK__Herpes_Simplex_Virus_1_(HSV-1)__BAB11945
auggccuccuaccccugccaccagcacgccuccgccuucgaccaggccgcccgcucccgcggccacuccaaccgccgcaccgcccuccgcccccgccgccagcaggaggccaccgagguccgccucgagcagaagaugcccacccuccuccgcgucuacaucgacggcccccacggcaugggcaagaccaccaccacccagcuccucgucgcccucggcucccgcgacgacaucgucuacguccccgagcccaugaccuacuggcagguccucggcgccuccgagaccaucgccaacaucuacaccaccuga

SEQ ID NO: 6821 - RNA, 312 nt, Artificial Sequence
  derived and/or modified sequence opt3 from Thymidine_Kinase_TK__Herpes_Simplex_Virus_1_(HSV-1)__BAB11945
auggccagcuaccccugccaccagcaugcuuccgcauucgaccaggccgcgagaucuaggggccacucaaaccggcgcaccgcucugcgaccucguagacagcaggaggccacagaagugaggcucgagcagaagaugccaacucuucugcgggucuauaucgaugggccgcauggaauggguaaaacgaccacaacucaauuguuaguugcacugggcagucgcgacgauauuguguacguacccgaaccuaugaccuauuggcaagugcuaggggccagcgagacaauagcuaauaucuacaccacuuga

SEQ ID NO: 6822 - RNA, 312 nt, Artificial Sequence
  derived and/or modified sequence opt4 from Thymidine_Kinase_TK__Herpes_Simplex_Virus_1_(HSV-1)__BAB11945
auggccagcuaccccugccaccagcacgccagcgccuucgaccaggccgccagaagcagaggccacagcaacagaagaaccgcccugagacccagaagacagcaggaggccaccgaggugagacuggagcagaagaugcccacccugcugagaguguacaucgacggcccccacggcaugggcaagaccaccaccacccagcugcugguggcccugggcagcagagacgacaucguguacgugcccgagcccaugaccuacuggcaggugcugggcgccagcgagaccaucgccaacaucuacaccaccuga

SEQ ID NO: 6823 - RNA, 312 nt, Artificial Sequence
  derived and/or modified sequence opt5 from Thymidine_Kinase_TK__Herpes_Simplex_Virus_1_(HSV-1)__BAB11945
auggccagcuaccccugccaccagcaugcuuccgccuucgaccaagcggcuagaucucggggccacagcaaccgcagaaccgcccugcggccucgcagacagcaggaggccacagaagugcggcucgagcagaagaugccgacgcugcuucgcgucuauaucgaugggccccauggaaugggcaaaaccacaaccacacaacugcucguugcucugggguccagagacgauauuguguacgugccugaacccaugaccuauuggcagguccuuggagccucugagacaaucgcuaauauuuacaccacguga

SEQ ID NO: 6824 - RNA, 312 nt, Artificial Sequence
  derived and/or modified sequence opt6 from Thymidine_Kinase_TK__Herpes_Simplex_Virus_1_(HSV-1)__BAB11945
auggcaucauacccaugccaccaacacgcaucagcauucgaccaagcagcaagaucaagaggacacucaaacagaagaacagcacuaagaccaagaagacaacaagaagcaacagaaguaagacuagaacaaaaaaugccaacacuacuaagaguauacauagacggaccacacggaaugggaaaaacaacaacaacacaacuacuaguagcacuaggaucaagagacgacauaguauacguaccagaaccaaugacauacuggcaaguacuaggagcaucagaaacaauagcaaacauauacacaacauaa

SEQ ID NO: 6825 - protein, 262 aa, Artificial Sequence
  Thymidine_Kinase_TK__Herpes_Simplex_Virus_1_(HSV-1)__Q9ENS3
MASYPCHQHASAFDQAARSRGHSNRRTALRPRRQQEATEVRLEQKMPTLLRVYIDGPHGMGKTTTTQLLVALGSRDDIVYVPEPMTYWQVLGASETIANIYTTQHRLDQGEISAGDAAVVMTSAQITMGMPYAAHDPISGTRYLPCFGPPSCWPPTATCITCLPGPWTSWPNASVPCTSLSWITTNRPPAAGTPCCNLPPGWSRPTSPPQAPYRRSATWRARLPGRWGRLTETRKETIPEGTRAMTAIKRQNKTHGCWVVCS

SEQ ID NO: 6826 - RNA, 789 nt, Artificial Sequence
  Thymidine_Kinase_TK__Herpes_Simplex_Virus_1_(HSV-1)__BAB11944
auggcuucguaccccugccaucaacacgcgucugcguucgaccaggcugcgcguucucgcggccauagcaaccgacguacggcguugcgcccucgccggcagcaagaagccacggaaguccgccuggagcagaaaaugcccacgcuacugcggguuuauauagacgguccucacgggauggggaaaaccaccaccacgcaacugcugguggcccuggguucgcgcgacgauaucgucuacguacccgagccgaugacuuacuggcaggugcugggggcuuccgagacaaucgcgaacaucuacaccacacaacaccgccucgaccagggugagauaucggccggggacgcggcggugguaaugacaagcgcccagauaacaaugggcaugccuuaugccgcccacgaccccauaucggggacacguuauuuacccuguuucgggcccccgaguugcuggcccccaacggcgaccuguauaacguguuugccugggccuuggacgucuuggccaaacgccuccgucccaugcacgucuuuauccuggauuacgaccaaucgcccgccggcugccgggacgcccugcugcaacuuaccuccgggaugguccagacccacgucaccaccccaggcuccauaccgacgaucugcgaccuggcgcgcacguuugcccgggagaugggggaggcuaacugaaacacggaaggagacaauaccggaaggaacccgcgcuaugacggcaauaaaaagacagaauaaaacgcacggguguugggucguuuguucauaa

SEQ ID NO: 6827 - RNA, 789 nt, Artificial Sequence
  derived and/or modified sequence opt1 from Thymidine_Kinase_TK__Herpes_Simplex_Virus_1_(HSV-1)__BAB11944
auggccagcuaccccugccaccagcacgccuccgcguucgaccaggccgcccgcagccggggccacuccaaccgccggaccgcccugcgcccgcggcgccagcaggaggccaccgaggugcggcucgagcagaagaugcccacgcugcugcgcgucuacaucgacgggccccacggcauggggaagaccaccaccacgcagcuccugguggcgcugggcagccgggacgacaucguguacguccccgagccgaugaccuacuggcagguccucggggccuccgagaccaucgccaacaucuacaccacgcagcaccgccuggaccagggcgagaucagcgccggcgacgcggccguggugaugaccuccgcccagaucaccauggggaugcccuacgccgcccacgaccccaucagcggcacccgguaccugcccugcuucgggccgcccuccugcuggccgcccacggcgaccugcaucacgugccuccccggccccuggaccagcuggcccaacgccuccgugcccugcaccagccuguccuggaucaccaccaaccgcccgcccgccgccgggacccccugcugcaaccugcccccgggcuggagccggcccacguccccgccccaggcccccuaccgccggagcgcgaccuggcgcgcccggcuccccggccgcugggggcggcugaccgagacccgcaaggagacgauccccgagggcacccgggccaugaccgccaucaagcgccagaacaagacccacgggugcuggguggucugcuccuga

SEQ ID NO: 6828 - RNA, 789 nt, Artificial Sequence
  derived and/or modified sequence opt2 from Thymidine_Kinase_TK__Herpes_Simplex_Virus_1_(HSV-1)__BAB11944
auggccuccuaccccugccaccagcacgccuccgccuucgaccaggccgcccgcucccgcggccacuccaaccgccgcaccgcccuccgcccccgccgccagcaggaggccaccgagguccgccucgagcagaagaugcccacccuccuccgcgucuacaucgacggcccccacggcaugggcaagaccaccaccacccagcuccucgucgcccucggcucccgcgacgacaucgucuacguccccgagcccaugaccuacuggcagguccucggcgccuccgagaccaucgccaacaucuacaccacccagcaccgccucgaccagggcgagaucuccgccggcgacgccgccgucgucaugaccuccgcccagaucaccaugggcaugcccuacgccgcccacgaccccaucuccggcacccgcuaccuccccugcuucggcccccccuccugcuggccccccaccgccaccugcaucaccugccuccccggccccuggaccuccuggcccaacgccuccguccccugcaccucccucuccuggaucaccaccaaccgcccccccgccgccggcacccccugcugcaaccucccccccggcuggucccgccccaccucccccccccaggcccccuaccgccgcuccgccaccuggcgcgcccgccuccccggccgcuggggccgccucaccgagacccgcaaggagaccauccccgagggcacccgcgccaugaccgccaucaagcgccagaacaagacccacggcugcugggucgucugcuccuga

SEQ ID NO: 6829 - RNA, 789 nt, Artificial Sequence
  derived and/or modified sequence opt3 from Thymidine_Kinase_TK__Herpes_Simplex_Virus_1_(HSV-1)__BAB11944
auggccagcuaccccugccaccagcaugcuuccgcauucgaccaagccgcgagaucuaggggccacucaaaccggcgcaccgcucugcgaccucguagacagcaggaggccacagaagugaggcucgagcagaagaugccaacucuucugcgggucuauaucgaugggccgcauggaauggguaaaacgaccacaacucaauuguuaguugcacugggcagucgcgacgauauuguguacguacccgaaccuaugaccuauuggcaagugcuaggggccagcgagacaauagcuaauaucuacaccacucagcacagacucgaccagggagaaauuuccgcaggcgaugccgcugucgugaugacaucugcccagaucaccauggguaugccauaugcggcacaugaccccauuucggggacgagguaccugccuuguuuuggaccacccucaugcuggccuccaacugccaccuguaucacaugccuuccgggccccuggacuagcuggccuaacgcuaguguuccauguaccucccugucuuggauaacaaccaaucggcccccugccgcaggcacgccaugcuguaacuugcccccgggguggagccgcccuacuucacccccacaggcuccuuaucgaagauccgccacauggagggcgcggcuccccggacguuggggucgccugaccgagacuagaaaggagacaaucccagaaggcaccagggccaugacggcaauuaaacggcagaauaagacccacgggugcuggguggucuguaguuga

SEQ ID NO: 6830 - RNA, 789 nt, Artificial Sequence
  derived and/or modified sequence opt4 from Thymidine_Kinase_TK__Herpes_Simplex_Virus_1_(HSV-1)__BAB11944
auggccagcuaccccugccaccagcacgccagcgccuucgaccaggccgccagaagcagaggccacagcaacagaagaaccgcccugagacccagaagacagcaggaggccaccgaggugagacuggagcagaagaugcccacccugcugagaguguacaucgacggcccccacggcaugggcaagaccaccaccacccagcugcugguggcccugggcagcagagacgacaucguguacgugcccgagcccaugaccuacuggcaggugcugggcgccagcgagaccaucgccaacaucuacaccacccagcacagacuggaccagggcgagaucagcgccggcgacgccgccguggugaugaccagcgcccagaucaccaugggcaugcccuacgccgcccacgaccccaucagcggcaccagauaccugcccugcuucggcccccccagcugcuggccccccaccgccaccugcaucaccugccugcccggccccuggaccagcuggcccaacgccagcgugcccugcaccagccugagcuggaucaccaccaacagaccccccgccgccggcacccccugcugcaaccugccccccggcuggagcagacccaccagccccccccaggcccccuacagaagaagcgccaccuggagagccagacugcccggcagauggggcagacugaccgagaccagaaaggagaccauccccgagggcaccagagccaugaccgccaucaagagacagaacaagacccacggcugcuggguggugugcagcuga

SEQ ID NO: 6831 - RNA, 789 nt, Artificial Sequence
  derived and/or modified sequence opt5 from Thymidine_Kinase_TK__Herpes_Simplex_Virus_1_(HSV-1)__BAB11944
auggccagcuaccccugccaccagcaugcuuccgccuucgaccaagcggcuagaucucggggccacagcaaccgcagaaccgcccugcggccucgcagacagcaggaggccacagaagugcggcucgagcagaagaugccgacgcugcuucgcgucuauaucgaugggccccauggaaugggcaaaaccacaaccacacaacugcucguugcucugggguccagagacgauauuguguacgugccugaacccaugaccuauuggcagguccuuggagccucugagacaaucgcuaauauuuacaccacgcagcaccggcuggaccagggcgaaaucagcgccggggaugcggccgugguuaugaccuccgcucaaauuacaaugggaaugccuuaugccgcucaugaccccaucucuggcacccgcuaccucccuuguuuuggcccgcccagcugcuggccucccacagccaccuguaucacgugccugccugggcccuggacauccuggccgaacgcgagcgugccuuguaccucucuguccuggauuacaaccaauagacccccugccgcuggaacccccugcuguaaccugcccccuggcuggagccggccgacaucucccccucaggcccccuaucgcagauccgcuacguggcgggcccgccucccugggagauggggacggcuuaccgagacaagaaaggagaccauccccgaaggcacacgcgccaugaccgcuauuaaacggcagaauaagacgcacgggugcugggucguguguagcuga

SEQ ID NO: 6832 - RNA, 789 nt, Artificial Sequence
  derived and/or modified sequence opt6 from Thymidine_Kinase_TK__Herpes_Simplex_Virus_1_(HSV-1)__BAB11944
auggcauccuacccuugccaucaacaugccucagcauuugaccaagcagcuagaucaagaggacacucaaacagaagaacagcauuaagaccaagacgacaacaagaagcaacagaaguaagacuagaacaaaaaaugccaacacuacuaagaguauauauagauggaccacauggaaugggaaaaacaacaacaacacaacucuuaguagcacuaggaucaagagacgauauaguauacguaccagaaccaaugacauauuggcaaguauuaggagcaucagaaacaauagcaaacauauauacaacacaacaucgauuagaucaaggagaaauaucagcaggagacgcagcagugguaaugacaucagcacaaaucacuaugggaaugccauacgcagcacaugaccccauauccggaacaagauaucuaccaugcuucggaccaccaucaugcuggccaccaacagcaacauguauaacaugcuuaccaggaccauggacaucauggccuaacgccucaguaccauguaccucauuaucauggauuacaacaaacagaccaccagcagcaggaacaccauguugcaaucuaccaccaggauggucuagaccaacaucaccaccacaagcaccuuauagaagaucagcaacauggagagcaagacuuccagguagauggggacgcuuaaccgaaaccagaaaagaaacaauaccagaaggaacaagagcuaugacagcaauaaaacgacaaaacaaaacacauggaugcuggguaguauguucauaa

SEQ ID NO: 6833 - protein, 407 aa, Artificial Sequence
  Thymidine_Kinase_TK__Herpes_Simplex_Virus_1_(HSV-1)__Q9ENS4
MASYPCHQHASAFDQAARSRGHSNRRTALRPRRQQEATEVRLEQKMPTLLRVYIDGPHGMGKTTTTQLLVALGSRDDIVYVPEPMTYWQVLGASETIANIYTTQHRLDQGEISAGDAAVVMTSAQITMGMPYAVTDAVLAPHIGGEAGSSHAPPPALTLIFDRHPIAALLCYPAARYLMGSMTPRPCWRSWPSSRRPCPAQTSCWGPFRRTDTSTAWPNASAPASGLTWLCWPRFAAFTGCLPIRCGICRAAGRGGRIGDSFRGRPCRPRVPSPRATRAHDPISGTRYLPCFGPPSCWPPTATCITCLPGPWTSWPNASVPCTSLSWITTNRPPAAGTPCCNLPPGWSRPTSPPQAPYRRSATWRARLPGRWGRLTETRKETIPEGTRAMTAIKRQNKTHGCWVVCS

SEQ ID NO: 6834 - RNA, 1224 nt, Artificial Sequence
  Thymidine_Kinase_TK__Herpes_Simplex_Virus_1_(HSV-1)__BAB11943
auggcuucguaccccugccaucaacacgcgucugcguucgaccaggcugcgcguucucgcggccauagcaaccgacguacggcguugcgcccucgccggcagcaagaagccacggaaguccgccuggagcagaaaaugcccacgcuacugcggguuuauauagacgguccucacgggauggggaaaaccaccaccacgcaacugcugguggcccuggguucgcgcgacgauaucgucuacguacccgagccgaugacuuacuggcaggugcugggggcuuccgagacaaucgcgaacaucuacaccacacaacaccgccucgaccagggugagauaucggccggggacgcggcggugguaaugacaagcgcccagauaacaaugggcaugccuuaugccgugaccgacgccguucuggcuccucauaucgggggggaggcugggagcucacaugccccgcccccggcccucacccucaucuucgaccgccaucccaucgccgcccuccugugcuacccggccgcgcgauaccuuaugggcagcaugacccccaggccgugcuggcguucguggcccucaucccgccgaccuugcccggcacaaacaucguguugggggcccuuccggaggacagacacaucgaccgccuggccaaacgccagcgccccggcgagcggcuugaccuggcuaugcuggccgcgauucgccgcguuuacgggcugcuugccaauacggugcgguaucugcagggcggcgggucguggcgggaggauuggggacagcuuucggggacggccgugccgccccagggugccgagccccagagcaacgcgggcccacgaccccauaucggggacacguuauuuacccuguuucgggcccccgaguugcuggcccccaacggcgaccuguauaacguguuugccugggccuuggacgucuuggccaaacgccuccgucccaugcacgucuuuauccuggauuacgaccaaucgcccgccggcugccgggacgcccugcugcaacuuaccuccgggaugguccagacccacgucaccaccccaggcuccauaccgacgaucugcgaccuggcgcgcacguuugcccgggagaugggggaggcuaacugaaacacggaaggagacaauaccggaaggaacccgcgcuaugacggcaauaaaaagacagaauaaaacgcacggguguugggucguuuguucauaa

SEQ ID NO: 6835 - RNA, 1224 nt, Artificial Sequence
  derived and/or modified sequence opt1 from Thymidine_Kinase_TK__Herpes_Simplex_Virus_1_(HSV-1)__BAB11943
auggccagcuaccccugccaccagcacgccuccgcguucgaccaggccgcccgcagccggggccacuccaaccgccggaccgcccugcgcccccggcgccagcaggaggccaccgaggugcggcucgagcagaagaugcccacgcugcugcgcgucuacaucgacgggccccacggcauggggaagaccaccaccacgcagcuccugguggcgcugggcagccgggacgacaucguguacguccccgagccgaugaccuacuggcagguccucggggccuccgagaccaucgccaacaucuacaccacgcagcaccgccuggaccagggcgagaucagcgccggcgacgcggccguggugaugaccuccgcccagaucaccauggggaugcccuacgccgugaccgacgccgugcuggcgccccacaucggcggggaggccggcagcucccacgcgcccccgcccgcccucacgcugaucuucgaccggcaccccaucgccgcccugcucugcuaccccgccgcccgcuaccugauggggagcaugaccccgcggcccugcuggcgcuccuggcccagcucccggcgccccugcccggcccagaccagcugcuggggccccuuccggcgcaccgacacguccaccgccuggcccaacgcgagcgcccccgccuccggccugaccuggcucugcuggccgcgguucgccgccuucaccgggugccugcccauccgcugcggcaucugccgggcggccgggcgcggcggccgcaucggggacagcuuccggggccgccccugccggccccgcgucccgagcccccgggccacgcgcgcccacgaccccaucuccgggacccgguaccugcccugcuucggcccgcccagcugcuggcccccgaccgcgaccugcaucacgugccuccccgggcccuggaccuccuggcccaacgccagcgugccgugcaccucccugagcuggaucaccacgaaccgcccgcccgccgccggcacccccugcugcaaccugccgcccggcuggucccggcccaccagcccgccccaggcccccuaccgccgguccgcgaccuggcgcgcccggcuccccgggcgcuggggccggcugacggagacccgcaaggagaccauccccgaggggacccgggccaugacggccaucaagcgccagaacaagacccacggcugcuggguggucugcagcuga

SEQ ID NO: 6836 - RNA, 1224 nt, Artificial Sequence
  derived and/or modified sequence opt2 from Thymidine_Kinase_TK__Herpes_Simplex_Virus_1_(HSV-1)__BAB11943
auggccuccuaccccugccaccagcacgccuccgccuucgaccaggccgcccgcucccgcggccacuccaaccgccgcaccgcccuccgcccccgccgccagcaggaggccaccgagguccgccucgagcagaagaugcccacccuccuccgcgucuacaucgacggcccccacggcaugggcaagaccaccaccacccagcuccucgucgcccucggcucccgcgacgacaucgucuacguccccgagcccaugaccuacuggcagguccucggcgccuccgagaccaucgccaacaucuacaccacccagcaccgccucgaccagggcgagaucuccgccggcgacgccgccgucgucaugaccuccgcccagaucaccaugggcaugcccuacgccgucaccgacgccguccucgccccccacaucggcggcgaggccggcuccucccacgcccccccccccgcccucacccucaucuucgaccgccaccccaucgccgcccuccucugcuaccccgccgcccgcuaccucaugggcuccaugaccccccgccccugcuggcgcuccuggcccuccucccgccgccccugccccgcccagaccuccugcuggggccccuuccgccgcaccgacaccuccaccgccuggcccaacgccuccgcccccgccuccggccucaccuggcucugcuggccccgcuucgccgccuucaccggcugccuccccauccgcugcggcaucugccgcgccgccggccgcggcggccgcaucggcgacuccuuccgcggccgccccugccgcccccgcguccccuccccccgcgccacccgcgcccacgaccccaucuccggcacccgcuaccuccccugcuucggcccccccuccugcuggccccccaccgccaccugcaucaccugccuccccggccccuggaccuccuggcccaacgccuccguccccugcaccucccucuccuggaucaccaccaaccgcccccccgccgccggcacccccugcugcaaccucccccccggcuggucccgccccaccucccccccccaggcccccuaccgccgcuccgccaccuggcgcgcccgccuccccggccgcuggggccgccucaccgagacccgcaaggagaccauccccgagggcacccgcgccaugaccgccaucaagcgccagaacaagacccacggcugcugggucgucugcuccuga

SEQ ID NO: 6837 - RNA, 1224 nt, Artificial Sequence
  derived and/or modified sequence opt3 from Thymidine_Kinase_TK__Herpes_Simplex_Virus_1_(HSV-1)__BAB11943
auggccagcuaccccugccaccagcaugcuuccgcauucgaccaagccgcgagaucuaggggccacucaaaccggcgcaccgcucugcgaccucguagacagcaggaggccacagaagugaggcucgagcagaagaugccaacucuucugcgggucuauaucgaugggccgcauggaauggguaaaacgaccacaacucaauuguuaguugcacugggcagucgcgacgauauuguguacguacccgaaccuaugaccuauuggcaagugcuaggggccagcgagacaauagcuaauaucuacaccacucagcacagacucgaccagggagaaauuuccgcaggcgaugccgcugucgugaugacaucugcccagaucaccauggguaugccauaugcgguuacggacgcagugcuggcuccccauauugggggagaggccggcucgucacacgccccuccacccgcacuuacucugaucuuugauaggcacccuauagcugccuugcucuguuacccagcggcccgguaucugaugggcagcaugaccccgcgccccugcuggcgaaguuggccuuccucuagaaggccaugucccgcacagacaagcugcugggggccuuuccggcguacugacaccuccacagcuuggccaaacgccucagcucccgccaguggacugaccuggcucuguuggccgcgcuuugcagccuucacggguugcuuaccuaucagauguggcauuugcagggcugcggggcggggaggccgaaucggugauagcuuucgcgggagacccuguaggccacgggucccuucuccccgcgcaacuagagcccaugacccaauuuccggaacaagguaccugcccugcuucggcccuccaucauguuggccgcccaccgcuacuugcaucacaugccuuccuggcccauggaccagcuggcccaaugccagugugccuuguacgucuuuguccuggauaaccacaaaccguccacccgcagccgggacuccgugcuguaaucugccuccaggauggagccggcccaccucgccuccccaggcuccauaccgaagaucugccacauggagggcacgccuaccuggucgguggggcagacucacugagaccaggaaggaaacaauucccgaggggacccgcgcgaugacugcuaucaaacgacagaacaagacgcacggaugcuggguaguuuguuccuga

SEQ ID NO: 6838 - RNA, 1224 nt, Artificial Sequence
  derived and/or modified sequence opt4 from Thymidine_Kinase_TK__Herpes_Simplex_Virus_1_(HSV-1)__BAB11943
auggccagcuaccccugccaccagcacgccagcgccuucgaccaggccgccagaagcagaggccacagcaacagaagaaccgcccugagacccagaagacagcaggaggccaccgaggugagacuggagcagaagaugcccacccugcugagaguguacaucgacggcccccacggcaugggcaagaccaccaccacccagcugcugguggcccugggcagcagagacgacaucguguacgugcccgagcccaugaccuacuggcaggugcugggcgccagcgagaccaucgccaacaucuacaccacccagcacagacuggaccagggcgagaucagcgccggcgacgccgccguggugaugaccagcgcccagaucaccaugggcaugcccuacgccgugaccgacgccgugcuggccccccacaucggcggcgaggccggcagcagccacgcccccccccccgcccugacccugaucuucgacagacaccccaucgccgcccugcugugcuaccccgccgccagauaccugaugggcagcaugacccccagacccugcuggagaagcuggcccagcagcagaagacccugccccgcccagaccagcugcuggggccccuucagaagaaccgacaccagcaccgccuggcccaacgccagcgcccccgccagcggccugaccuggcugugcuggcccagauucgccgccuucaccggcugccugcccaucagaugcggcaucugcagagccgccggcagaggcggcagaaucggcgacagcuucagaggcagacccugcagacccagagugcccagccccagagccaccagagcccacgaccccaucagcggcaccagauaccugcccugcuucggcccccccagcugcuggccccccaccgccaccugcaucaccugccugcccggccccuggaccagcuggcccaacgccagcgugcccugcaccagccugagcuggaucaccaccaacagaccccccgccgccggcacccccugcugcaaccugccccccggcuggagcagacccaccagccccccccaggcccccuacagaagaagcgccaccuggagagccagacugcccggcagauggggcagacugaccgagaccagaaaggagaccauccccgagggcaccagagccaugaccgccaucaagagacagaacaagacccacggcugcuggguggugugcagcuga

SEQ ID NO: 6839 - RNA, 1224 nt, Artificial Sequence
  derived and/or modified sequence opt5 from Thymidine_Kinase_TK__Herpes_Simplex_Virus_1_(HSV-1)__BAB11943
auggccagcuaccccugccaccagcaugcuuccgccuucgaccaagcggcuagaucucggggccacagcaaccgcagaaccgcccugcggccucgcagacagcaggaggccacagaagugcggcucgagcagaagaugccgacgcugcuucgcgucuauaucgaugggccccauggaaugggcaaaaccacaaccacacaacugcucguugcucugggguccagagacgauauuguguacgugccugaacccaugaccuauuggcagguccuuggagccucugagacaaucgcuaauauuuacaccacgcagcaccggcuggaccagggcgaaaucagcgccggggaugcggccgugguuaugaccuccgcucaaauuacaaugggaaugccuuaugccgugaccgacgcuguccucgcgccccauaucggcggcgaggccgggucuagccacgccccuccgcccgcucugacacugaucuuugaucgccacccuauugccgcucuccuguguuaccccgccgccagauaucuuaugggauccaugaccccucggcccugcuggcgcagcuggccgucuuccagacggccuugucccgcucagacgagcugcuggggcccuuuccgcagaacagacaccucuacagcguggcccaacgccuccgcucccgccagcgggcugaccuggcucuguuggccucgguuugccgcuuucaccggaugccugccgaucagauguggcauuugccgcgccgcggggcggggaggcagaaucggcgauucuuuucgcgggcggcccuguagaccucgcgugcccuccccucgggcuacaagagcccaugaccccauuagcggaacgcgcuaccuuccgugcuucggcccucccuccuguuggccucccaccgccacaugcauuaccugccugccugggcccuggacaucuuggccgaaugcuagcguuccuuguaccucccucagcuggaucacgacaaaccggccucccgccgcuggaacccccugcuguaaucugccgcccggcuggucuagaccuaccuccccuccccaggcccccuaccgccggagcgcgacauggagagcccggcugccugggcgcuggggaagacucaccgagacacggaaggaaacgauccccgagggcaccagagcuaugacagccaucaaacgccagaacaagacccacggcugcuggguggucuguucuuga

SEQ ID NO: 6840 - RNA, 1224 nt, Artificial Sequence
  derived and/or modified sequence opt6 from Thymidine_Kinase_TK__Herpes_Simplex_Virus_1_(HSV-1)__BAB11943
auggcaaguuauccaugucaucaacaugcaucagcauuugaucaagcagcaagaagcaggggacauucaaauagaagaacugcucuuagacccaggagacaacaagaagcaacagaaguuagauuagaacaaaaaaugccuacauuauuacgaguauacauagacggaccacauggaaugggaaaaacaacaacaacgcaauuacuaguagcuuuaggaucaagagaugacauaguauacguuccggaaccaaugacauauuggcaaguacuuggagcaagugaaacaauagcaaacauauauacuacccaacaucgauuagaucaaggagaaauaagcgcaggagaugcugcuguaguaaugacaucagcacaaauaacaauggggaugccauaugcaguuaccgaugcaguauuagcaccucauauaggcggagaagcaggaaguagucaugcaccaccaccagcacuuacuuuaauauuugauaggcauccuauagcagcauuauuauguuaucccgcagcaagauauuuaaugggaagcaugacaccaagaccauguuggagaucauggccgucaucaagaagaccauguccugcacaaacaucauguuggggaccauuuagaagaacagacacuaguacagcuuggccaaaugcaagugcuccagcaucaggacuaacauggcucuguuggccaagauuugcagcauucacaggauguuugccaauaagaugcggaauauguagagcagcaggacgaggaggaagaauaggugauucauucagaggaagaccuuguagaccaagaguaccuaguccaagagcaacuagagcccaugauccaauuagcggaacaagauauuuaccauguuuuggaccaccuaguuguuggccaccaacagcaacauguauaacuuguuuaccaggaccguggacaucauggccuaacgcaaguguaccauguaccucacuaucauggauaacaacaaauagaccaccagccgcagguacaccuugcugcaauuuacccccuggauggucaagaccaacuuccccaccucaagcaccauacagaagguccgcaacauggcgugcaagauuaccaggaagauggggaagacucacagaaacaagaaaagaaacaauaccagaaggaacuagagcuaugacugcaauaaaaagacaaaauaaaacacauggaugcuggguaguauguucauaa

SEQ ID NO: 6841 - protein, 407 aa, Artificial Sequence
  Thymidine_Kinase_TK__Herpes_Simplex_Virus_1_(HSV-1)__Q9ENS5
MASYPCHQHASAFDQAARSRGHSNRRTALRPRRQQEATEVRLEQKMPTLLRVYIDGPHGMGKTTTTQLLVALGSRDDIVYVPEPMTYWQVLGASETIANIYTTQHRLDQGEISAGDAAVVMTSAQITMGMPYAVTDAVLAPHIGGEAGSSHAPPPALTLIFDRHPIAALLCYPAARYLMGSMTPQAVLAFVALIPPTLPGTNIVLGALPEDRHIDRLAKRQRPGERLDLAMLAAIRRVYGLLANTVRYLQGGGSWREDWGQLSGTAVPPQGAEPQSNAGPRPHIGDTLFTLFRAPELLAPNGDLYNVFAWALDVLAKRLRPMHVFILDYDQSPAGCRDALLQLTSGMVQTHVTTQAPYRRSATWRARLPGRWGRLTETRKETIPEGTRAMTAIKRQNKTHGCWVVCS

SEQ ID NO: 6842 - RNA, 1224 nt, Artificial Sequence
  Thymidine_Kinase_TK__Herpes_Simplex_Virus_1_(HSV-1)__BAB11942
auggcuucguaccccugccaucaacacgcgucugcguucgaccaggcugcgcguucucgcggccauagcaaccgacguacggcguugcgcccucgccggcagcaagaagccacggaaguccgccuggagcagaaaaugcccacgcuacugcggguuuauauagacgguccucacgggauggggaaaaccaccaccacgcaacugcugguggcccuggguucgcgcgacgauaucgucuacguacccgagccgaugacuuacuggcaggugcugggggcuuccgagacaaucgcgaacaucuacaccacacaacaccgccucgaccagggugagauaucggccggggacgcggcggugguaaugacaagcgcccagauaacaaugggcaugccuuaugccgugaccgacgccguucuggcuccucauaucgggggggaggcugggagcucacaugccccgcccccggcccucacccucaucuucgaccgccaucccaucgccgcccuccugugcuacccggccgcgcgauaccuuaugggcagcaugaccccccaggccgugcuggcguucguggcccucaucccgccgaccuugcccggcacaaacaucguguugggggcccuuccggaggacagacacaucgaccgccuggccaaacgccagcgccccggcgagcggcuugaccuggcuaugcuggccgcgauucgccgcguuuacgggcugcuugccaauacggugcgguaucugcagggcggcgggucguggcgggaggauuggggacagcuuucggggacggccgugccgccccagggugccgagccccagagcaacgcgggcccacgaccccauaucggggacacguuauuuacccuguuucgggcccccgaguugcuggcccccaacggcgaccuguauaacguguuugccugggccuuggacgucuuggccaaacgccuccgucccaugcacgucuuuauccuggauuacgaccaaucgcccgccggcugccgggacgcccugcugcaacuuaccuccgggaugguccagacccacgucaccacccaggcuccauaccgacgaucugcgaccuggcgcgcacguuugcccgggagaugggggaggcuaacugaaacacggaaggagacaauaccggaaggaacccgcgcuaugacggcaauaaaaagacagaauaaaacgcacggguguugggucguuuguucauaa

SEQ ID NO: 6843 - RNA, 1224 nt, Artificial Sequence
  derived and/or modified sequence opt1 from Thymidine_Kinase_TK__Herpes_Simplex_Virus_1_(HSV-1)__BAB11942
auggccagcuaccccugccaccagcacgccuccgcguucgaccaggccgcccgcagccggggccacuccaaccgccggaccgcccugcgcccgcggcgccagcaggaggccaccgaggugcggcucgagcagaagaugcccacgcugcugcgcgucuacaucgacgggccccacggcauggggaagaccaccaccacgcagcuccugguggcgcugggcagccgggacgacaucguguacguccccgagccgaugaccuacuggcagguccucggggccuccgagaccaucgccaacaucuacaccacgcagcaccgccuggaccagggcgagaucagcgccggcgacgcggccguggugaugaccuccgcccagaucaccauggggaugcccuacgccgugaccgacgccgugcuggcgccccacaucggcggggaggccggcagcucccacgcgcccccgcccgcccucacgcugaucuucgaccggcaccccaucgccgcccugcucugcuaccccgccgcccgcuaccugauggggagcaugaccccgcaggccguccuggccuucguggcgcucaucccgcccacccugcccggcaccaacaucgugcugggcgcccuccccgaggaccggcacaucgaccgccuggccaagcggcagcgccccggggagcggcuggaccucgccaugcuggccgcgauccgccgggucuacggccugcucgccaacacggugcgcuaccugcagggcgggggcuccuggcgggaggacugggggcagcugagcggcaccgccgugccgccccagggggccgagccccaguccaacgcgggcccccgcccccacaucggggacacccucuucacccuguuccgcgcccccgagcugcucgccccgaacggcgaccuguacaacgucuucgccugggcccuggacgugcucgcgaagcggcugcgccccaugcacguguucauccuggacuacgaccagagccccgccggcugccgggacgcccuccugcagcugacguccgggaugguccagacccacgugaccacccaggcccccuaccgccggagcgccacguggcgcgcgcggcucccgggccgcugggggcggcugaccgagacccgcaaggagaccauccccgagggcacgcgggccaugaccgccaucaagcgccagaacaagacccacgggugcuggguggucugcuccuga

SEQ ID NO: 6844 - RNA, 1224 nt, Artificial Sequence
  derived and/or modified sequence opt2 from Thymidine_Kinase_TK__Herpes_Simplex_Virus_1_(HSV-1)__BAB11942
auggccuccuaccccugccaccagcacgccuccgccuucgaccaggccgcccgcucccgcggccacuccaaccgccgcaccgcccuccgcccccgccgccagcaggaggccaccgagguccgccucgagcagaagaugcccacccuccuccgcgucuacaucgacggcccccacggcaugggcaagaccaccaccacccagcuccucgucgcccucggcucccgcgacgacaucgucuacguccccgagcccaugaccuacuggcagguccucggcgccuccgagaccaucgccaacaucuacaccacccagcaccgccucgaccagggcgagaucuccgccggcgacgccgccgucgucaugaccuccgcccagaucaccaugggcaugcccuacgccgucaccgacgccguccucgccccccacaucggcggcgaggccggcuccucccacgcccccccccccgcccucacccucaucuucgaccgccaccccaucgccgcccuccucugcuaccccgccgcccgcuaccucaugggcuccaugaccccccaggccguccucgccuucgucgcccucaucccccccacccuccccggcaccaacaucguccucggcgcccuccccgaggaccgccacaucgaccgccucgccaagcgccagcgccccggcgagcgccucgaccucgccaugcucgccgccauccgccgcgucuacggccuccucgccaacaccguccgcuaccuccagggcggcggcuccuggcgcgaggacuggggccagcucuccggcaccgccguccccccccagggcgccgagccccaguccaacgccggcccccgcccccacaucggcgacacccucuucacccucuuccgcgcccccgagcuccucgcccccaacggcgaccucuacaacgucuucgccugggcccucgacguccucgccaagcgccuccgccccaugcacgucuucauccucgacuacgaccagucccccgccggcugccgcgacgcccuccuccagcucaccuccggcaugguccagacccacgucaccacccaggcccccuaccgccgcuccgccaccuggcgcgcccgccuccccggccgcuggggccgccucaccgagacccgcaaggagaccauccccgagggcacccgcgccaugaccgccaucaagcgccagaacaagacccacggcugcugggucgucugcuccuga

SEQ ID NO: 6845 - RNA, 1224 nt, Artificial Sequence
  derived and/or modified sequence opt3 from Thymidine_Kinase_TK__Herpes_Simplex_Virus_1_(HSV-1)__BAB11942
auggccagcuaccccugccaccagcaugcuuccgcauucgaccaagccgcgagaucuaggggccacucaaaccggcgcaccgcucugcgaccucguagacagcaggaggccacagaagugaggcucgagcagaagaugccaacucuucugcgggucuauaucgaugggccgcauggaauggguaaaacgaccacaacucaauuguuaguugcacugggcagucgcgacgauauuguguacguacccgaaccuaugaccuauuggcaagugcuaggggccagcgagacaauagcuaauaucuacaccacucagcacagacucgaccagggagaaauuuccgcaggcgaugccgcugucgugaugacaucugcccagaucaccauggguaugccauaugcgguuacggacgcagugcuggcuccccauauugggggagaggcuggcucgucacacgccccuccacccgcacuuacucugaucuuugauaggcacccuauagcugccuugcucuguuacccagcggcccgguaucugaugggcagcaugaccccgcaggcaguccuggcuuucguggcccucauucccccuacauuaccagggacuaacaucguacugggagcccuucccgaggaccgccauaucgaucgauuggccaagagacagaggccuggugaacggcuggaccuagcaaugcucgccgcuauucgucgcguuuacggccugcuugcgaauaccgugagauaccugcaagggggaggcaguuggagggaggauuggggucaguuguccgggacagcagucccaccccagggagccgaaccgcagucuaacgcuggcccucggccccacaucggcgacacccucuuuacgcuguuccgagccccagaguuacuggcaccuaauggggaucucuauaacguguuugccugggcucuugacgugcuggccaaacgcuugagacccaugcaugucuucauacuagacuacgaucaaagcccagcaggaugcagggacgcgcugcuccagcugacuuccgguaugguucagacacacgugaccacucaggcucccuaucggcgcucagccacauggagagcaaggcuuccuggccguugggggcggcugaccgagacgcgaaaggaaaccauuccagagggaacaagagccaugacugcuaucaaaaggcaaaauaagacccacggcuguuggguagugugcaguuga

SEQ ID NO: 6846 - RNA, 1224 nt, Artificial Sequence
  derived and/or modified sequence opt4 from Thymidine_Kinase_TK__Herpes_Simplex_Virus_1_(HSV-1)__BAB11942
auggccagcuaccccugccaccagcacgccagcgccuucgaccaggccgccagaagcagaggccacagcaacagaagaaccgcccugagacccagaagacagcaggaggccaccgaggugagacuggagcagaagaugcccacccugcugagaguguacaucgacggcccccacggcaugggcaagaccaccaccacccagcugcugguggcccugggcagcagagacgacaucguguacgugcccgagcccaugaccuacuggcaggugcugggcgccagcgagaccaucgccaacaucuacaccacccagcacagacuggaccagggcgagaucagcgccggcgacgccgccguggugaugaccagcgcccagaucaccaugggcaugcccuacgccgugaccgacgccgugcuggccccccacaucggcggcgaggccggcagcagccacgcccccccccccgcccugacccugaucuucgacagacaccccaucgccgcccugcugugcuaccccgccgccagauaccugaugggcagcaugaccccccaggccgugcuggccuucguggcccugaucccccccacccugcccggcaccaacaucgugcugggcgcccugcccgaggacagacacaucgacagacuggccaagagacagagacccggcgagagacuggaccuggccaugcuggccgccaucagaagaguguacggccugcuggccaacaccgugagauaccugcagggcggcggcagcuggagagaggacuggggccagcugagcggcaccgccgugcccccccagggcgccgagccccagagcaacgccggccccagaccccacaucggcgacacccuguucacccuguucagagcccccgagcugcuggcccccaacggcgaccuguacaacguguucgccugggcccuggacgugcuggccaagagacugagacccaugcacguguucauccuggacuacgaccagagccccgccggcugcagagacgcccugcugcagcugaccagcggcauggugcagacccacgugaccacccaggcccccuacagaagaagcgccaccuggagagccagacugcccggcagauggggcagacugaccgagaccagaaaggagaccauccccgagggcaccagagccaugaccgccaucaagagacagaacaagacccacggcugcuggguggugugcagcuga

SEQ ID NO: 6847 - RNA, 1224 nt, Artificial Sequence
  derived and/or modified sequence opt5 from Thymidine_Kinase_TK__Herpes_Simplex_Virus_1_(HSV-1)__BAB11942
auggccagcuaccccugccaccagcaugcuuccgccuucgaccaagcggcuagaucucggggccacagcaaccgcagaaccgcccugcggccucgcagacagcaggaggccacagaagugcggcucgagcagaagaugccgacgcugcuucgcgucuauaucgaugggccccauggaaugggcaaaaccacaaccacacaacugcucguugcucugggguccagagacgauauuguguacgugccugaacccaugaccuauuggcagguccuuggagccucugagacaaucgcuaauauuuacaccacgcagcaccggcuggaccagggcgaaaucagcgccggggaugcggccgugguuaugaccuccgcucaaauuacaaugggaaugccuuaugccgugaccgacgcuguccucgcgccccauaucggcggcgaggccgggucuagccacgccccuccgcccgcucugacacugaucuuugaucgccacccuauugccgcucuccuguguuaccccgccgccagauaucuuaugggauccaugaccccucaggcugugcuggcguucguugcccucauucccccgacgcugccuggcacaaacaucgugcuuggggcucugcccgaggaccggcauaucgaucgccucgccaagagacagcggccuggagaacgccuggaccuggccaugcucgcugccauuagacgggucuacggccugcuugcgaauaccgugagauaccugcaagggggaggcagcuggcgcgaggauuggggccagcucucugggacagcugugccuccccagggagccgaaccccaguccaacgccggcccgcggccccacaucggggacacccuguuuacccuuuucagagcuccugagcugcucgcccccaauggagaucuguauaacgucuuugcuugggcccuggacguucucgcgaaacgccugcggccuaugcauguguucauucuugacuacgaucaaagccccgccggcugcagagacgcucugcuccagcugacaucugggauggugcagacgcacgucaccacacaggccccguaucgccgguccgcuaccuggagagcccgccuuccuggacgguggggcagacugacagagacccgcaaggaaacgauccccgagggcacacgggcgaugaccgccaucaaaagacaaaauaagacccacggguguugggugguuugcagcuga

SEQ ID NO: 6848 - RNA, 1224 nt, Artificial Sequence
  derived and/or modified sequence opt6 from Thymidine_Kinase_TK__Herpes_Simplex_Virus_1_(HSV-1)__BAB11942
auggcaaguuauccuugccaucaacacgcaagugcauuugaccaagcagcacgaaguagaggucacaguaauagacgaacagcacuuagaccacgaagacaacaagaagccacagaaguacgauuagaacaaaaaaugcccacacuauuaagaguauacauagaugguccucauggaaugggcaaaacaacaacuacacaauuauuaguagcauuaggaaguagagaugauauaguauauguuccggaaccaaugacauauuggcaaguauuaggagccucagaaacgauagcaaacauauacacuacacaacauaggcuagaucaaggagaaauaagugcuggagaugcagcagucguaaugacaucagcccaaauaacaaugggaaugccauaugcaguaacagaugccguauuagcuccacauauaggaggagaagcaggaucaucacaugcuccacccccagcucuaacucucauauuugauagacauccaauagcugcacuauuauguuauccugcagcuagauaucugaugggaagcaugacaccacaagcaguauuagcauucguagcuuuaauucccccaacauuaccaggcacaaauauaguucuuggagcuuuaccagaagauagacauauagauagauuggccaaaagacaaagaccaggagaaagacuagauuuagcuauguuagcagcaauaagaagaguuuacgguuuauuagcaaacacaguaagauaucuacaaggaggagguaguuggagagaagauuggggacaauuaaguggaacagcuguaccaccacaaggagcagaaccacaaucaaaugcuggaccacgaccacauauaggagacacacuauuuacacuauuuagagcaccagaacucuuagcucccaauggagauuuauauaauguuuuugccugggccuuagauguacuagcuaaaagauuaaggccaaugcacguauuuauacuagauuacgaucaaucacccgcaggaugucgagacgcacuacuacaacuaaccucaggaaugguccaaacucauguaacuacacaagcaccauaucgaaggagcgcaacauggagagcaagauuaccaggaagauggggaaggcuaacggaaacuagaaaagaaacaauuccagaaggaacuagagcaaugacagcaauaaaaagacaaaacaaaacacauggauguuggguagucuguaguuaa

SEQ ID NO: 6849 - protein, 227 aa, Artificial Sequence
  Thymidine_Kinase_TK__Herpes_Simplex_Virus_1_(HSV-1)__Q9IYZ7
MASYPCHQHASAFDQAARSRGHSNRRTALRPRRQQEATEVRLEQKMPTLLRVYIDGPHGMGKTTTTQLLVALGSRDNIVYVPEPMTYWQVLGASETIANIYTTQHRLDQGEISAGDAAVVMTSAQITMGMPYAVTDAVLAPHIGGGGWELTCPAPGPHPHLRPPSHRRPPVLPGRAIPYGQHDPPGRAGVRGPHPADLARHKHRVGGPSGGQTHRPPGQTPAPRRAA

SEQ ID NO: 6850 - RNA, 684 nt, Artificial Sequence
  Thymidine_Kinase_TK__Herpes_Simplex_Virus_1_(HSV-1)__AAF72505
auggcuucguaccccugccaucaacacgcgucugcguucgaccaggcugcgcguucucgcggccauagcaaccgacguacggcguugcgcccucgccggcagcaagaagccacggaaguccgccuggagcagaaaaugcccacgcuacugcggguuuauauagacgguccucacgggauggggaaaaccaccaccacgcaacugcugguggcccuggguucgcgcgacaauaucgucuacguacccgagccgaugacuuacuggcaggugcugggggcuuccgagacaaucgcgaacaucuacaccacacaacaccgccucgaccagggugagauaucggccggggacgcggcggugguaaugacaagcgcccagauaacaaugggcaugccuuaugccgugaccgacgccguucuggcuccucauaucggggggggaggcugggagcucacaugccccgcccccggcccucacccucaucuucgaccgccaucccaucgccgcccuccugugcuacccggccgcgcgauaccuuaugggcagcaugaccccccaggccgugcuggcguucguggcccucaucccgccgaccuugcccggcacaaacaucguguugggggcccuuccggaggacagacacaucgaccgccuggccaaacgccagcgccccggcgagcggcuuga

SEQ ID NO: 6851 - RNA, 684 nt, Artificial Sequence
  derived and/or modified sequence opt1 from Thymidine_Kinase_TK__Herpes_Simplex_Virus_1_(HSV-1)__AAF72505
auggccagcuaccccugccaccagcacgccuccgccuucgaccaggccgcccgcagccggggccacuccaaccgccggaccgcccugcgcccgcggcgccagcaggaggccaccgaggugcggcucgagcagaagaugcccacgcugcugcgcgucuacaucgacgggccccacggcauggggaagaccaccaccacgcagcuccugguggcgcugggcagccgggacaacaucguguacguccccgagccgaugaccuacuggcagguccucggggccuccgagaccaucgccaacaucuacaccacgcagcaccgccuggaccagggcgagaucagcgccggcgacgcggccguggugaugaccuccgcccagaucaccauggggaugcccuacgccgugaccgacgccgugcuggcgccccacaucggcgggggcgggugggagcucacgugccccgccccgggcccccacccccaccuccggcccccgagccaccgccggccgcccguccugcccggccgcgccauccccuacgggcagcacgacccgcccggccgggccggggugcgcggcccccaccccgccgaccuggcgcggcacaagcaccgcgugggcgggcccuccggcgggcagacccaccggccgcccggccagacccccgcgccccgccgggccgccuga

SEQ ID NO: 6852 - RNA, 684 nt, Artificial Sequence
  derived and/or modified sequence opt2 from Thymidine_Kinase_TK__Herpes_Simplex_Virus_1_(HSV-1)__AAF72505
auggccuccuaccccugccaccagcacgccuccgccuucgaccaggccgcccgcucccgcggccacuccaaccgccgcaccgcccuccgcccccgccgccagcaggaggccaccgagguccgccucgagcagaagaugcccacccuccuccgcgucuacaucgacggcccccacggcaugggcaagaccaccaccacccagcuccucgucgcccucggcucccgcgacaacaucgucuacguccccgagcccaugaccuacuggcagguccucggcgccuccgagaccaucgccaacaucuacaccacccagcaccgccucgaccagggcgagaucuccgccggcgacgccgccgucgucaugaccuccgcccagaucaccaugggcaugcccuacgccgucaccgacgccguccucgccccccacaucggcggcggcggcugggagcucaccugccccgcccccggcccccacccccaccuccgcccccccucccaccgccgcccccccguccuccccggccgcgccauccccuacggccagcacgacccccccggccgcgccggcguccgcggcccccaccccgccgaccucgcccgccacaagcaccgcgucggcggccccuccggcggccagacccaccgcccccccggccagacccccgccccccgccgcgccgccuga

SEQ ID NO: 6853 - RNA, 684 nt, Artificial Sequence
  derived and/or modified sequence opt3 from Thymidine_Kinase_TK__Herpes_Simplex_Virus_1_(HSV-1)__AAF72505
auggccagcuaccccugccaccagcaugcuuccgcauucgaccaagccgcgagaucuaggggccacucaaaccggcgcaccgcucugcgaccucguagacagcaggaggccacagaagugaggcucgagcagaagaugccaacucuucugcgggucuauaucgaugggccgcauggaauggguaaaacgaccacaacucaauuguuaguugcacugggcagucgcgacaauauuguguacguacccgaaccuaugaccuauuggcaagugcuaggggccagcgagacaauagcuaacaucuacaccacucagcacagacucgaucagggagaaauuuccgcaggcgacgccgcugucgugaugacaucugcccagaucaccauggguaugccauaugcgguuacggaugcagugcuggccccucauauugggggaggcggcugggagcuuacuuguccugcuccagggccccacccucaccugaggccaccgucgcaucggcgacccccugucuugccaggacgcgccauccccuacggucagcacgacccuccaggcagagcaggggugaggggaccccauccggcugaucucgcccggcacaagcaccguguaggcgguccuucagggggacagacccauagacccccaggccagacacccgcgccccgcagggccgcauga

SEQ ID NO: 6854 - RNA, 684 nt, Artificial Sequence
  derived and/or modified sequence opt4 from Thymidine_Kinase_TK__Herpes_Simplex_Virus_1_(HSV-1)__AAF72505
auggccagcuaccccugccaccagcacgccagcgccuucgaccaggccgccagaagcagaggccacagcaacagaagaaccgcccugagacccagaagacagcaggaggccaccgaggugagacuggagcagaagaugcccacccugcugagaguguacaucgacggcccccacggcaugggcaagaccaccaccacccagcugcugguggcccugggcagcagagacaacaucguguacgugcccgagcccaugaccuacuggcaggugcugggcgccagcgagaccaucgccaacaucuacaccacccagcacagacuggaccagggcgagaucagcgccggcgacgccgccguggugaugaccagcgcccagaucaccaugggcaugcccuacgccgugaccgacgccgugcuggccccccacaucggcggcggcggcugggagcugaccugccccgcccccggcccccacccccaccugagaccccccagccacagaagaccccccgugcugcccggcagagccauccccuacggccagcacgacccccccggcagagccggcgugagaggcccccaccccgccgaccuggccagacacaagcacagagugggcggccccagcggcggccagacccacagaccccccggccagacccccgcccccagaagagccgccuga

SEQ ID NO: 6855 - RNA, 684 nt, Artificial Sequence
  derived and/or modified sequence opt5 from Thymidine_Kinase_TK__Herpes_Simplex_Virus_1_(HSV-1)__AAF72505
auggccagcuaccccugccaccagcaugcuuccgccuucgaccaagcggcuagaucucggggccacagcaaccgcagaaccgcccugcggccucgcagacagcaggaggccacagaagugcggcucgagcagaagaugccgacgcugcuucgcgucuauaucgaugggccccauggaaugggcaaaaccacaaccacacaacugcucguugcucugggguccagagacaauauuguguacgugccugaacccaugaccuauuggcagguccuuggagccucugagacaaucgcuaacauuuacaccacgcagcaccggcuggaucagggcgaaaucagcgccggggacgcggccgugguuaugaccuccgcucaaauuacaaugggaaugccuuaugccgugaccgaugcuguccucgcgccccauaucggcggcgggggaugggagcugacauguccugccccgggcccccacccucaccugagacccccuucucaucgccggcccccggugcucccugggcgcgccauccccuacggacagcacgacccucccggcagagcugggguucggggaccccauccugccgaucuggcucgccacaagcacagagugggcggcccgagcgggggacagacccaucggcccccuggccagacgcccgccccuagacgcgccgcuuga

SEQ ID NO: 6856 - RNA, 684 nt, Artificial Sequence
  derived and/or modified sequence opt6 from Thymidine_Kinase_TK__Herpes_Simplex_Virus_1_(HSV-1)__AAF72505
auggcaaguuauccaugccaucaacacgcaucagcauucgaucaagcagcaagaucaagaggacauucaaauagaagaacagcauuaagaccaagaagacaacaagaagcaacagaaguacgauuagaacaaaaaaugccaacauuauuacgaguauacauagacggaccacauggaauggguaaaacaacaacaacacaacuacuaguagcauuaggaucaagagauaauauaguauauguaccagaaccuaugacauacuggcaaguacuaggagcaucagaaacaauagcaaacauuuacacaacacaacacagacuagaucaaggagaaauaagugcaggagaugcagcaguaguaaugacaucagcacaaauaacaaugggaaugccauaugcaguaacagaugcaguacuagcgccacauauagggggcggaggaugggaacuaacauguccagcaccaggaccacauccacauuuaagaccaccaucacauagaagaccaccaguacuaccaggaagagcaauaccauauggucaacaugauccaccaggacgagcagguguaagaggaccucauccagcagacuuagcaagacauaaacauagaguaggaggcccaucaggaggacaaacacauagaccaccaggacaaacacccgcacccagaagagcagcauaa

SEQ ID NO: 6857 - protein, 181 aa, Artificial Sequence
  Thymidine_Kinase_TK__Herpes_Simplex_Virus_1_(HSV-1)__Q9IYZ9
MASYPCHQHASAFDQAARSRGHSNRRTALRPRRQQEATEVRLEQKMPTLLRVYIDGPHGMGKTTTTQLLVALGSRDDIVYVPEPMTYWQVLGASETIANIYTTQHRLDQGEISAGDAAVVMTSAQITMGMPYAVTDAVLAPHIGGRLGAHMPRPRPSPSSSTAIPSPPSCATRPRDTLWAA

SEQ ID NO: 6858 - RNA, 546 nt, Artificial Sequence
  Thymidine_Kinase_TK__Herpes_Simplex_Virus_1_(HSV-1)__AAF72503
auggcuucguaccccugccaucaacacgcgucugcguucgaccaggcugcgcguucucgcggccauagcaaccgacguacggcguugcgcccucgccggcagcaagaagccacggaaguccgccuggagcagaaaaugcccacgcuacugcggguuuauauagacgguccucacgggauggggaaaaccaccaccacgcaacugcugguggcccuggguucgcgcgacgauaucgucuacguacccgagccgaugacuuacuggcaggugcugggggcuuccgagacaaucgcgaacaucuacaccacacaacaccgccucgaccagggugagauaucggccggggacgcggcggugguaaugacaagcgcccagauaacaaugggcaugccuuaugccgugaccgacgccguucuggcuccucauaucggggggaggcugggagcucacaugccccgcccccggcccucacccucaucuucgaccgccaucccaucgccgcccuccugugcuacccggccgcgcgauaccuuaugggcagcauga

SEQ ID NO: 6859 - RNA, 546 nt, Artificial Sequence
  derived and/or modified sequence opt1 from Thymidine_Kinase_TK__Herpes_Simplex_Virus_1_(HSV-1)__AAF72503
auggccagcuaccccugccaccagcacgccuccgcguucgaccaggccgcccgcagccggggccacuccaaccgccggaccgcccugcgcccgcggcgccagcaggaggccaccgaggugcggcucgagcagaagaugcccacgcugcugcgcgucuacaucgacgggccccacggcauggggaagaccaccaccacgcagcuccugguggcgcugggcagccgggacgacaucguguacguccccgagccgaugaccuacuggcagguccucggggccuccgagaccaucgccaacaucuacaccacgcagcaccgccuggaccagggcgagaucagcgccggcgacgcggccguggugaugaccuccgcccagaucaccauggggaugcccuacgccgugaccgacgccgugcuggcgccccacaucggcgggcggcucggcgcccacaugccccgcccgcggcccagccccuccagcuccacggccauccccagcccgcccuccugcgccacccgcccccgggacacccugugggccgcguga

SEQ ID NO: 6860 - RNA, 546 nt, Artificial Sequence
  derived and/or modified sequence opt2 from Thymidine_Kinase_TK__Herpes_Simplex_Virus_1_(HSV-1)__AAF72503
auggccuccuaccccugccaccagcacgccuccgccuucgaccaggccgcccgcucccgcggccacuccaaccgccgcaccgcccuccgcccccgccgccagcaggaggccaccgagguccgccucgagcagaagaugcccacccuccuccgcgucuacaucgacggcccccacggcaugggcaagaccaccaccacccagcuccucgucgcccucggcucccgcgacgacaucgucuacguccccgagcccaugaccuacuggcagguccucggcgccuccgagaccaucgccaacaucuacaccacccagcaccgccucgaccagggcgagaucuccgccggcgacgccgccgucgucaugaccuccgcccagaucaccaugggcaugcccuacgccgucaccgacgccguccucgccccccacaucggcggccgccucggcgcccacaugccccgcccccgccccucccccuccuccuccaccgccauccccuccccccccuccugcgccacccgcccccgcgacacccucugggccgccuga

SEQ ID NO: 6861 - RNA, 546 nt, Artificial Sequence
  derived and/or modified sequence opt3 from Thymidine_Kinase_TK__Herpes_Simplex_Virus_1_(HSV-1)__AAF72503
auggccagcuaccccugccaccagcaugcuuccgcauucgaccaagccgcgagaucuaggggccacucaaaccggcgcaccgcucugcgaccucguagacagcaggaggccacagaagugaggcucgagcagaagaugccaacucuucugcgggucuauaucgaugggccgcauggaauggguaaaacgaccacaacucaauuguuaguugcacugggcagucgcgacgauauuguguacguacccgaaccuaugaccuauuggcaagugcuaggggccagcgagacaauagcuaauaucuacaccacucagcacagacucgaccagggagaaauuuccgcaggcgaugccgcugucgugaugacaucugcccagaucaccauggguaugccauaugcgguuacggacgcagugcuggcuccccauauugggggaaggcuuggcgcccacaugccucggccacgccccucgccuucaagcaguacugccaucccauccccgcccucuugugcaacccgaccuagagauacacugugggcugccuga

SEQ ID NO: 6862 - RNA, 546 nt, Artificial Sequence
  derived and/or modified sequence opt4 from Thymidine_Kinase_TK__Herpes_Simplex_Virus_1_(HSV-1)__AAF72503
auggccagcuaccccugccaccagcacgccagcgccuucgaccaggccgccagaagcagaggccacagcaacagaagaaccgcccugagacccagaagacagcaggaggccaccgaggugagacuggagcagaagaugcccacccugcugagaguguacaucgacggcccccacggcaugggcaagaccaccaccacccagcugcugguggcccugggcagcagagacgacaucguguacgugcccgagcccaugaccuacuggcaggugcugggcgccagcgagaccaucgccaacaucuacaccacccagcacagacuggaccagggcgagaucagcgccggcgacgccgccguggugaugaccagcgcccagaucaccaugggcaugcccuacgccgugaccgacgccgugcuggccccccacaucggcggcagacugggcgcccacaugcccagacccagacccagccccagcagcagcaccgccauccccagcccccccagcugcgccaccagacccagagacacccugugggccgccuga

SEQ ID NO: 6863 - RNA, 546 nt, Artificial Sequence
  derived and/or modified sequence opt5 from Thymidine_Kinase_TK__Herpes_Simplex_Virus_1_(HSV-1)__AAF72503
auggccagcuaccccugccaccagcaugcuuccgccuucgaccaagcggcuagaucucggggccacagcaaccgcagaaccgcccugcggccucgcagacagcaggaggccacagaagugcggcucgagcagaagaugccgacgcugcuucgcgucuauaucgaugggccccauggaaugggcaaaaccacaaccacacaacugcucguugcucugggguccagagacgauauuguguacgugccugaacccaugaccuauuggcagguccuuggagccucugagacaaucgcuaauauuuacaccacgcagcaccggcuggaccagggcgaaaucagcgccggggaugcggccgugguuaugaccuccgcucaaauuacaaugggaaugccuuaugccgugaccgacgcuguccucgcgccccauaucggcggccgccugggggcccacaugccuagaccgcggcccucuccuagcuccagcacagccauccccucuccucccuccugugcuacccgcccgagagauacgcugugggccgcuuga

SEQ ID NO: 6864 - RNA, 546 nt, Artificial Sequence
  derived and/or modified sequence opt6 from Thymidine_Kinase_TK__Herpes_Simplex_Virus_1_(HSV-1)__AAF72503
auggcaucauacccaugccaccaacacgcaucagcauucgaccaagcagcaagaucaagaggacacucaaaccgaagaacagcacuaagaccaagaagacaacaagaagcaacagaaguaagacuagaacaaaaaaugccaacacuacuaagaguauacauagauggcccacacggaaugggaaaaacaacaacaacacaacuacuuguagcauuaggaucaagagacgacauaguauacguaccagaaccaaugacauacuggcaaguacuaggagcaucagaaacaauagcaaacauauacacaacacaacacagacuagaccaaggagaaauaucagcaggagacgcagcaguaguaaugacaucagcacaaauaacaaugggaaugccauacgcaguaacagacgcaguauuagcaccacacauaggaggaagacuaggagcacacaugccaagaccaagaccaucaccaagcucaagcacagcaauaccaucaccaccaucaugcgcaacaagaccaagagacacacuaugggcagcauaa

SEQ ID NO: 6865 - protein, 119 aa, Artificial Sequence
  Thymidine_Kinase_TK__Herpes_Simplex_Virus_1_(HSV-1)__Q9IZ02
MASYPCHQHASAFDQAARSRGHNNRRTALRPRRQQKATEVRLEQKMPTLLRVYIDGPHGMGKTTTTQLLVALGSRDDIVYVPEPMTYWRVLGLPRQSRTSTPHNTASTRVRYRPGTRRW

SEQ ID NO: 6866 - RNA, 360 nt, Artificial Sequence
  Thymidine_Kinase_TK__Herpes_Simplex_Virus_1_(HSV-1)__AAF72499
auggcuucguaccccugccaucaacacgcgucugcguucgaccaggcugcgcguucucgcggccauaacaaccgacguacggcguugcgcccucgccggcagcaaaaagccacggaaguccgccuggagcagaaaaugcccacgcuacugcggguuuauauagacgguccccacgggauggggaaaaccaccaccacgcaacugcugguggcccuggguucgcgcgacgauaucgucuacguacccgagccgaugacuuacuggcggguguuggggcuuccgagacaaucgcgaacaucuacaccacacaacaccgccucgaccagggugagauaucggccggggacgcggcggugguaa

SEQ ID NO: 6867 - RNA, 360 nt, Artificial Sequence
  derived and/or modified sequence opt1 from Thymidine_Kinase_TK__Herpes_Simplex_Virus_1_(HSV-1)__AAF72499
auggccagcuaccccugccaccagcacgccuccgcguucgaccaggccgcccgcagccggggccacaacaaccgccggaccgcccugcgcccgcggcgccagcagaaggccaccgaggugcggcucgagcagaagaugcccacgcugcugcgcgucuacaucgacgggccccacggcauggggaagaccaccaccacgcagcuccugguggcgcugggcucccgggacgacaucguguacguccccgagccgaugaccuacuggcgcgugcucgggcugccccggcagagccgcaccuccacgccccacaacaccgccagcacccgggugcgcuaccggcccggcacccgccggugguga

SEQ ID NO: 6868 - RNA, 360 nt, Artificial Sequence
  derived and/or modified sequence opt2 from Thymidine_Kinase_TK__Herpes_Simplex_Virus_1_(HSV-1)__AAF72499
auggccuccuaccccugccaccagcacgccuccgccuucgaccaggccgcccgcucccgcggccacaacaaccgccgcaccgcccuccgcccccgccgccagcagaaggccaccgagguccgccucgagcagaagaugcccacccuccuccgcgucuacaucgacggcccccacggcaugggcaagaccaccaccacccagcuccucgucgcccucggcucccgcgacgacaucgucuacguccccgagcccaugaccuacuggcgcguccucggccucccccgccagucccgcaccuccaccccccacaacaccgccuccacccgcguccgcuaccgccccggcacccgccgcugguga

SEQ ID NO: 6869 - RNA, 360 nt, Artificial Sequence
  derived and/or modified sequence opt3 from Thymidine_Kinase_TK__Herpes_Simplex_Virus_1_(HSV-1)__AAF72499
auggccagcuaccccugccaccagcaugcuuccgcauucgaccaagccgcgagaucuaggggccacaacaaucggcgcaccgcucugcgaccucguagacagcagaaggccacagaggugaggcucgaacagaaaaugccaacucuucugcgggucuauaucgaugggccgcauggaauggguaagacgaccacaacucaauuguuaguugcacugggcucacgcgacgauauuguguacguacccgagccuaugaccuauuggagagugcuagggcucccaaggcagagucggacaagcacuccccacaacaccgccuccacacgcguccgauacagaccuggaaccaggcggugguga

SEQ ID NO: 6870 - RNA, 360 nt, Artificial Sequence
  derived and/or modified sequence opt4 from Thymidine_Kinase_TK__Herpes_Simplex_Virus_1_(HSV-1)__AAF72499
auggccagcuaccccugccaccagcacgccagcgccuucgaccaggccgccagaagcagaggccacaacaacagaagaaccgcccugagacccagaagacagcagaaggccaccgaggugagacuggagcagaagaugcccacccugcugagaguguacaucgacggcccccacggcaugggcaagaccaccaccacccagcugcugguggcccugggcagcagagacgacaucguguacgugcccgagcccaugaccuacuggagagugcugggccugcccagacagagcagaaccagcaccccccacaacaccgccagcaccagagugagauacagacccggcaccagaagaugguga

SEQ ID NO: 6871 - RNA, 360 nt, Artificial Sequence
  derived and/or modified sequence opt5 from Thymidine_Kinase_TK__Herpes_Simplex_Virus_1_(HSV-1)__AAF72499
auggccagcuaccccugccaccagcaugcuuccgccuucgaccaagcggcuagaucucggggccacaacaaucgcagaaccgcccugcggccucgcagacagcagaaggccacagaggugcggcucgaacagaaaaugccgacgcugcuucgcgucuauaucgaugggccccauggaaugggcaagaccacaaccacacaacugcucguugcucuggggagcagagacgauauuguguacgugccugagcccaugaccuauuggcggguccuuggacugccucgccaguccagaacaucuacgccccacaacaccgccagcacccgggugcgcuacagaccuggcacacggcgcugguga

SEQ ID NO: 6872 - RNA, 360 nt, Artificial Sequence
  derived and/or modified sequence opt6 from Thymidine_Kinase_TK__Herpes_Simplex_Virus_1_(HSV-1)__AAF72499
auggcaagcuauccaugucaccaacacgcaagcgcauucgaucaagcagcaagaagcagaggacauaacaauagaagaacagcauuaagaccaagaagacaacaaaaagcaacagaaguaagauuagaacaaaaaaugccaacacuauuaagaguauacauagacggaccacacggaaugggaaaaacaacaacaacacaauuauuaguagcauuaggaucaagagaugacauaguauauguaccagaaccaaugacauacuggagaguacuaggacuaccaagacaaagcagaacaucaacaccacacaauacagcaagcacaagaguaagauauagaccaggaacaagaagaugguaa

SEQ ID NO: 6873 - protein, 103 aa, Artificial Sequence
  Thymidine_Kinase_TK__Herpes_Simplex_Virus_1_(HSV-1)__Q9IZ03
MASYPCHQHASAFDQAARSRGHSNRRTALRPRRQQEATEVRLEQKMPTLLRVYIDGPHGMGKTTTTQLLVALGSRDDIVYVPEPITYWQVLGASETIANIYTT

SEQ ID NO: 6874 - RNA, 312 nt, Artificial Sequence
  Thymidine_Kinase_TK__Herpes_Simplex_Virus_1_(HSV-1)__AAF72498
auggcuucguaccccugccaucaacacgcgucugcguucgaccaggcugcgcguucucgcggccauagcaaccgacguacggcguugcgcccucgccggcaacaagaagccacggaaguccgccuggagcagaaaaugcccacgcuacugcggguuuauauagacgguccucacgggauggggaaaaccaccaccacgcaacugcugguggcccuggguucgcgcgacgauaucgucuacguacccgagccgauaacuuacuggcaggugcugggggcuuccgagacaaucgcgaacaucuacaccacauaa

SEQ ID NO: 6875 - RNA, 312 nt, Artificial Sequence
  derived and/or modified sequence opt1 from Thymidine_Kinase_TK__Herpes_Simplex_Virus_1_(HSV-1)__AAF72498
auggccagcuaccccugccaccagcacgccuccgcguucgaccaggccgcccgcagccggggccacuccaaccgccggaccgcccugcgcccgcggcgccagcaggaggccaccgaggugcggcucgagcagaagaugcccacgcugcugcgcguguacaucgacgggccccacggcauggggaagaccaccaccacgcagcuccugguggcgcugggcagccgggacgacaucguguacguccccgagccgaucaccuacuggcagguccucggggccuccgagaccaucgccaacaucuacaccacguga

SEQ ID NO: 6876 - RNA, 312 nt, Artificial Sequence
  derived and/or modified sequence opt2 from Thymidine_Kinase_TK__Herpes_Simplex_Virus_1_(HSV-1)__AAF72498
auggccuccuaccccugccaccagcacgccuccgccuucgaccaggccgcccgcucccgcggccacuccaaccgccgcaccgcccuccgcccccgccgccagcaggaggccaccgagguccgccucgagcagaagaugcccacccuccuccgcgucuacaucgacggcccccacggcaugggcaagaccaccaccacccagcuccucgucgcccucggcucccgcgacgacaucgucuacguccccgagcccaucaccuacuggcagguccucggcgccuccgagaccaucgccaacaucuacaccaccuga

SEQ ID NO: 6877 - RNA, 312 nt, Artificial Sequence
  derived and/or modified sequence opt3 from Thymidine_Kinase_TK__Herpes_Simplex_Virus_1_(HSV-1)__AAF72498
auggccagcuaccccugccaccagcaugcuuccgcauucgaccaggccgcgagaucuaggggccacucaaaccggcgcaccgcucugcgaccucguagacagcaggaggccacagaagugaggcucgagcagaagaugccaacucuucugcgggucuauaucgaugggccgcauggaauggguaaaacgaccacaacucaauuguuaguugcacugggcagucgcgacgauauuguguacguacccgaaccuauaaccuauuggcaagugcuaggggccagcgagacaaucgcuaauauuuacaccacuuga

SEQ ID NO: 6878 - RNA, 312 nt, Artificial Sequence
  derived and/or modified sequence opt4 from Thymidine_Kinase_TK__Herpes_Simplex_Virus_1_(HSV-1)__AAF72498
auggccagcuaccccugccaccagcacgccagcgccuucgaccaggccgccagaagcagaggccacagcaacagaagaaccgcccugagacccagaagacagcaggaggccaccgaggugagacuggagcagaagaugcccacccugcugagaguguacaucgacggcccccacggcaugggcaagaccaccaccacccagcugcugguggcccugggcagcagagacgacaucguguacgugcccgagcccaucaccuacuggcaggugcugggcgccagcgagaccaucgccaacaucuacaccaccuga

SEQ ID NO: 6879 - RNA, 312 nt, Artificial Sequence
  derived and/or modified sequence opt5 from Thymidine_Kinase_TK__Herpes_Simplex_Virus_1_(HSV-1)__AAF72498
auggccagcuaccccugccaccagcaugcuuccgccuucgaccaagcggcuagaucucggggccacagcaaccgcagaaccgcccugcggccucgcagacagcaggaggccacagaagugcggcucgagcagaagaugccgacgcugcuucgcgucuauaucgaugggccccauggaaugggcaaaaccacaaccacacaacugcucguugcucugggguccagagacgauauuguguacgugccugaacccaucaccuauuggcagguccuuggagccucugagacaauugcuaauaucuacaccacguga

SEQ ID NO: 6880 - RNA, 312 nt, Artificial Sequence
  derived and/or modified sequence opt6 from Thymidine_Kinase_TK__Herpes_Simplex_Virus_1_(HSV-1)__AAF72498
auggcaucauacccaugccaccaacacgcaucagcauucgaccaagcagcaagaucaagaggacacucaaacagaagaacagcacuaagaccaagaagacaacaagaagcaacagaaguaagacuagaacaaaaaaugccaacacuacuaagaguauacauagacggaccacacggaaugggaaaaacaacaacaacacaacuacuaguagcacuaggaucaagagacgacauaguauacguaccagaaccaauaacauacuggcaaguacuaggagcaucagaaacaauagcaaacauauacacaacauaa

SEQ ID NO: 6881 - protein, 224 aa, Artificial Sequence
  Thymidine_Kinase_TK__Herpes_Simplex_Virus_1_(HSV-1)__Q9IZ07
MASYPGHQHASAFDQAARSRGHSNRRTALRPRRQQEATEVRLEQKMPTLLRVYIDGPHGMGKTTTTQLLVALGSRDDIVYVPEPMTYWRVLGASETIANIYTTQHRLDQGEISAGDAAVVMTSAQITMGMPYAVTDAVLAPHIGGGGWELTCPAPGPHPHLRPASHRRPPVLPGRAVPYGQHDPPGRAGVRGPHPADLARHKHRVGGPSGGQTHRPPGQTPAPR

SEQ ID NO: 6882 - RNA, 675 nt, Artificial Sequence
  Thymidine_Kinase_TK__Herpes_Simplex_Virus_1_(HSV-1)__AAF72494
auggcuucguaccccggccaucaacacgcgucugcguucgaccaggcugcgcguucucgcggccauagcaaccgacguacggcguugcgcccucgccggcagcaagaagccacggaaguccgccuggagcagaaaaugcccacgcuacugcggguuuauauagacgguccucacgggauggggaaaaccaccaccacgcaacugcugguggcccuggguucgcgcgacgauaucgucuacguacccgagccgaugacuuacuggcgggugcugggggcuuccgagacaaucgcgaacaucuacaccacacaacaccgccucgaccagggugagauaucggccggggacgcggcggugguaaugacaagcgcccagauaacaaugggcaugccuuaugccgugaccgacgccguucuggcuccucauaucggggggggaggcugggagcucacaugccccgcccccggcccucacccucaucuucgaccggcaucccaucgccgcccuccugugcuacccggccgcgcgguaccuuaugggcagcaugaccccccaggccgugcuggcguucguggcccucaucccgccgaccuugcccggcacaaacaucguguugggggcccuuccggaggacagacacaucgaccgccuggccaaacgccagcgccccgguga

SEQ ID NO: 6883 - RNA, 675 nt, Artificial Sequence
  derived and/or modified sequence opt1 from Thymidine_Kinase_TK__Herpes_Simplex_Virus_1_(HSV-1)__AAF72494
auggccagcuaccccggccaccagcacgccuccgccuucgaccaggccgcccgcagccgggggcacuccaaccgccggaccgcccugcgcccgcggcgccagcaggaggccaccgaggugcggcucgagcagaagaugcccacgcugcugcgcgucuacaucgacggcccccacgggaugggcaagaccaccaccacgcagcuccugguggcgcuggggagccgggacgacaucguguacguccccgagccgaugaccuacuggcgcgugcucggcgccuccgagaccaucgccaacaucuacaccacgcagcaccggcuggaccagggcgagaucagcgccggggacgcggccguggucaugaccuccgcccagaucaccaugggcaugcccuacgccgugaccgacgccgugcuggcgccccacaucgggggcgggggcugggagcucacgugccccgccccgggcccccacccccaccuccgccccgccagccaccggcgcccgcccguccugcccgggcgggccgugcccuacggccagcacgacccgcccgggcgcgccggcgugcggggcccccaccccgcggaccuggcccgccacaagcaccgggucgggggcccguccgggggccagacccaccgcccgcccgggcagacccccgcgccccgguga

SEQ ID NO: 6884 - RNA, 675 nt, Artificial Sequence
  derived and/or modified sequence opt2 from Thymidine_Kinase_TK__Herpes_Simplex_Virus_1_(HSV-1)__AAF72494
auggccuccuaccccggccaccagcacgccuccgccuucgaccaggccgcccgcucccgcggccacuccaaccgccgcaccgcccuccgcccccgccgccagcaggaggccaccgagguccgccucgagcagaagaugcccacccuccuccgcgucuacaucgacggcccccacggcaugggcaagaccaccaccacccagcuccucgucgcccucggcucccgcgacgacaucgucuacguccccgagcccaugaccuacuggcgcguccucggcgccuccgagaccaucgccaacaucuacaccacccagcaccgccucgaccagggcgagaucuccgccggcgacgccgccgucgucaugaccuccgcccagaucaccaugggcaugcccuacgccgucaccgacgccguccucgccccccacaucggcggcggcggcugggagcucaccugccccgcccccggcccccacccccaccuccgccccgccucccaccgccgcccccccguccuccccggccgcgccguccccuacggccagcacgacccccccggccgcgccggcguccgcggcccccaccccgccgaccucgcccgccacaagcaccgcgucggcggccccuccggcggccagacccaccgcccccccggccagacccccgccccccgcuga

SEQ ID NO: 6885 - RNA, 675 nt, Artificial Sequence
  derived and/or modified sequence opt3 from Thymidine_Kinase_TK__Herpes_Simplex_Virus_1_(HSV-1)__AAF72494
auggccagcuaccccggccaccagcaugcuuccgcauucgaccaagccgcgagaucuagggggcacucaaaccggcgcaccgcucugcgaccucguagacagcaggaggccacagaagugaggcucgagcagaagaugccaacucuucugcgggucuauaucgauggaccgcaugguaugggcaaaacgaccacaacucaauuguuaguugcacuggggagucgcgacgauauuguguacguacccgaaccuaugaccuauuggagagugcuaggagccagcgagacaauagcuaauaucuacaccacucagcacaggcucgaccagggcgaaauuuccgccggugaugccgcugucgugaugacaucugcccagaucaccauggggaugccauaugcgguuacggacgcagugcuggcaccccauauuggaggcggcgggugggagcuuacuugcccugcuccaggaccccacccucaucugcggccagccucgcaccgccgaccgcccgucuugccugguagagcagugccauacggccaacacgaucccccugggagggcuggaguacggggcccacaucccgccgaccucgcgcgucacaagcaccgcguuggugggccgucaggaggccagacccauagaccucccggccagacaccagccccuagguga

SEQ ID NO: 6886 - RNA, 675 nt, Artificial Sequence
  derived and/or modified sequence opt4 from Thymidine_Kinase_TK__Herpes_Simplex_Virus_1_(HSV-1)__AAF72494
auggccagcuaccccggccaccagcacgccagcgccuucgaccaggccgccagaagcagaggccacagcaacagaagaaccgcccugagacccagaagacagcaggaggccaccgaggugagacuggagcagaagaugcccacccugcugagaguguacaucgacggcccccacggcaugggcaagaccaccaccacccagcugcugguggcccugggcagcagagacgacaucguguacgugcccgagcccaugaccuacuggagagugcugggcgccagcgagaccaucgccaacaucuacaccacccagcacagacuggaccagggcgagaucagcgccggcgacgccgccguggugaugaccagcgcccagaucaccaugggcaugcccuacgccgugaccgacgccgugcuggccccccacaucggcggcggcggcugggagcugaccugccccgcccccggcccccacccccaccugagacccgccagccacagaagaccccccgugcugcccggcagagccgugcccuacggccagcacgacccccccggcagagccggcgugagaggcccccaccccgccgaccuggccagacacaagcacagagugggcggccccagcggcggccagacccacagaccccccggccagacccccgcccccagauga

SEQ ID NO: 6887 - RNA, 675 nt, Artificial Sequence
  derived and/or modified sequence opt5 from Thymidine_Kinase_TK__Herpes_Simplex_Virus_1_(HSV-1)__AAF72494
auggccagcuaccccggccaccagcaugcuuccgccuucgaccaagcggcuagaucucgggggcacagcaaccgcagaaccgcccugcggccucgcagacagcaggaggccacagaagugcggcucgagcagaagaugccgacgcugcuucgcgucuauaucgauggaccccauggcauggggaaaaccacaaccacacaacugcucguugcucugggauccagagacgauauuguguacgugccugaacccaugaccuauuggcggguccuuggcgccucugagacaaucgcuaauauuuacaccacgcagcaccgccuggaccagggggaaaucagcgccggagaugcggccgugguuaugaccuccgcucagauuacaaugggcaugccuuaugccgugaccgacgcuguccucgcgccccauaucggcgggggaggcugggagcugacaugcccugccccggggccccacccucaccugagacccgccucucaucggcgcccucccgugcucccgggacgcgcuguuccuuacggccaacacgaucccccugggcgggccggagugcgcggcccccaucccgcugaccuggccagacacaagcaccgggucggcgggccuagcggaggccagacccauagaccgcccgggcagacgccugcccccagauga

SEQ ID NO: 6888 - RNA, 675 nt, Artificial Sequence
  derived and/or modified sequence opt6 from Thymidine_Kinase_TK__Herpes_Simplex_Virus_1_(HSV-1)__AAF72494
auggcaucauauccaggacaccaacacgccagcgcauuugaucaagcagcacgaagcagaggacauucaaauaggagaacagcauuacgaccacgaagacaacaagaagcaacagaaguaagacuagaacaaaaaaugccaacauuacuaagaguauacauagauggaccacauggaaugggaaaaacaacaacaacacaacuauuaguagcauuaggcucaagagacgauauaguauauguaccagaaccaaugaccuacuggagaguacuaggagcaucagaaacaauagcaaacauauauacaacacaacauagauuagaucaaggagaaauaucagcaggagacgcagcaguaguaaugacaucagcacaaauaaccaugggaaugccauaugcaguaacagaugcaguacuagcaccacauauaggaggaggaggaugggaauuaacauguccagcaccaggaccacauccacauuuaagaccagcaucacauagaaggccaccaguauuaccaggaagagcagucccauacggacaacaugauccuccaggaagagcaggaguaagaggaccacauccagcagaccuagcaagacacaaacacagaguaggaggaccaucaggaggacaaacacauagaccaccaggacaaacaccagcaccaagauaa

SEQ ID NO: 6889 - protein, 376 aa, Artificial Sequence
  Thymidine_Kinase_TK__Herpes_Simplex_Virus_1_(HSV-1)__Q9QNF7
MASYPCHQHASAFDQAARSRGHSNRRTALRPRRQQEATEVRLEQKMPTLLRVYIDGPHGMGKTTTTQLLVALGSRDDIVYVPEPMTYWQVLGASETIANIYTTQHRLDQGEISAGDAAVVMTSAQITMGMPYAVTDAVLAPHIGGEAGSSHAPPPALTLIFDRHPIAALLCYPAARYLMGSMTPQAVLAFVALIPPTLPGTNIVLGALPEDRHIDRLAKRQRPGERLDLAMLAAIRRVYGLLANTVRYLQGGGSWREDWGQLSGTAVPPQGAEPQSNAGPRPHIGDTLFTLFRAPELLAPNGDLYNVFAWALDVLAKRLRPMHVFILDYDQSPAGCRDALLQLTSGMVQTHVTTPGSIPTICDLARTFAREMGEAN

SEQ ID NO: 6890 - RNA, 1131 nt, Artificial Sequence
  Thymidine_Kinase_TK__Herpes_Simplex_Virus_1_(HSV-1)__AAF72491
auggcuucguaccccugccaucaacacgcgucugcguucgaccaggcugcgcguucucgcggccauagcaaccgacguacggcguugcgcccucgccggcagcaagaagccacggaaguccgccuggagcagaaaaugcccacgcuacugcggguuuauauagacgguccucacgggauggggaaaaccaccaccacgcaacugcugguggcccuggguucgcgcgacgauaucgucuacguacccgagccgaugacuuacuggcaggugcugggggcuuccgagacaaucgcgaacaucuacaccacacaacaccgccucgaccagggugagauaucggccggggacgcggcggugguaaugacaagcgcccagauaacaaugggcaugccuuaugccgugaccgacgccguucuggcuccucauaucgggggggaggcugggagcucacaugccccgcccccggcccucacccucaucuucgaccgccaucccaucgccgcccuccugugcuacccggccgcgcgauaccuuaugggcagcaugaccccccaggccgugcuggcguucguggcccucaucccgccgaccuugcccggcacaaacaucguguugggggcccuuccggaggacagacacaucgaccgccuggccaaacgccagcgccccggcgagcggcuugaccuggcuaugcuggccgcgauucgccgcguuuacgggcugcuugccaauacggugcgguaucugcagggcggcgggucguggcgggaggauuggggacagcuuucggggacggccgugccgccccagggugccgagccccagagcaacgcgggcccacgaccccauaucggggacacguuauuuacccuguuucgggcccccgaguugcuggcccccaacggcgaccuguauaacguguuugccugggccuuggacgucuuggccaaacgccuccgucccaugcacgucuuuauccuggauuacgaccaaucgcccgccggcugccgggacgcccugcugcaacuuaccuccgggaugguccagacccacgucaccaccccaggcuccauaccgacgaucugcgaccuggcgcgcacguuugcccgggagaugggggaggcuaacuga

SEQ ID NO: 6891 - RNA, 1131 nt, Artificial Sequence
  derived and/or modified sequence opt1 from Thymidine_Kinase_TK__Herpes_Simplex_Virus_1_(HSV-1)__AAF72491
auggccagcuaccccugccaccagcacgccuccgcguucgaccaggccgcccgcagccggggccacuccaaccgccggaccgcccugcgcccgcggcgccagcaggaggccaccgaggugcggcucgagcagaagaugcccacgcugcugcgcgucuacaucgacgggccccacggcauggggaagaccaccaccacgcagcuccugguggcgcugggcagccgggacgacaucguguacguccccgagccgaugaccuacuggcagguccucggggccuccgagaccaucgccaacaucuacaccacgcagcaccgccuggaccagggcgagaucagcgccggcgacgcggccguggugaugaccuccgcccagaucaccauggggaugcccuacgccgugaccgacgccgugcuggcgccccacaucggcggggaggccggcagcucccacgcgcccccgcccgcccucacgcugaucuucgaccggcaccccaucgccgcccugcucugcuaccccgccgcccgcuaccugauggggagcaugaccccgcaggccguccuggccuucguggcgcucaucccgcccacccugcccggcaccaacaucgugcugggcgcccuccccgaggaccggcacaucgaccgccuggccaagcggcagcgccccggggagcggcuggaccucgccaugcuggccgcgauccgccgggucuacggccugcucgccaacacggugcgcuaccugcagggcgggggcuccuggcgggaggacugggggcagcugagcggcaccgccgugccgccccagggggccgagccccaguccaacgcgggcccccgcccccacaucggggacacccucuucacccuguuccgcgcccccgagcugcucgccccgaacggcgaccuguacaacgucuucgccugggcccuggacgugcucgcgaagcggcugcgccccaugcacguguucauccuggacuacgaccagagccccgccggcugccgggacgcccuccugcagcugacguccgggaugguccagacccacgugaccacccccggcagcaucccgacgaucugcgaccucgcccgcaccuucgcccgggagaugggggaggcgaacuga

SEQ ID NO: 6892 - RNA, 1131 nt, Artificial Sequence
  derived and/or modified sequence opt2 from Thymidine_Kinase_TK__Herpes_Simplex_Virus_1_(HSV-1)__AAF72491
auggccuccuaccccugccaccagcacgccuccgccuucgaccaggccgcccgcucccgcggccacuccaaccgccgcaccgcccuccgcccccgccgccagcaggaggccaccgagguccgccucgagcagaagaugcccacccuccuccgcgucuacaucgacggcccccacggcaugggcaagaccaccaccacccagcuccucgucgcccucggcucccgcgacgacaucgucuacguccccgagcccaugaccuacuggcagguccucggcgccuccgagaccaucgccaacaucuacaccacccagcaccgccucgaccagggcgagaucuccgccggcgacgccgccgucgucaugaccuccgcccagaucaccaugggcaugcccuacgccgucaccgacgccguccucgccccccacaucggcggcgaggccggcuccucccacgcccccccccccgcccucacccucaucuucgaccgccaccccaucgccgcccuccucugcuaccccgccgcccgcuaccucaugggcuccaugaccccccaggccguccucgccuucgucgcccucaucccccccacccuccccggcaccaacaucguccucggcgcccuccccgaggaccgccacaucgaccgccucgccaagcgccagcgccccggcgagcgccucgaccucgccaugcucgccgccauccgccgcgucuacggccuccucgccaacaccguccgcuaccuccagggcggcggcuccuggcgcgaggacuggggccagcucuccggcaccgccguccccccccagggcgccgagccccaguccaacgccggcccccgcccccacaucggcgacacccucuucacccucuuccgcgcccccgagcuccucgcccccaacggcgaccucuacaacgucuucgccugggcccucgacguccucgccaagcgccuccgccccaugcacgucuucauccucgacuacgaccagucccccgccggcugccgcgacgcccuccuccagcucaccuccggcaugguccagacccacgucaccacccccggcuccauccccaccaucugcgaccucgcccgcaccuucgcccgcgagaugggcgaggccaacuga

SEQ ID NO: 6893 - RNA, 1131 nt, Artificial Sequence
  derived and/or modified sequence opt3 from Thymidine_Kinase_TK__Herpes_Simplex_Virus_1_(HSV-1)__AAF72491
auggccagcuaccccugccaccagcaugcuuccgcauucgaccaagccgcgagaucuaggggccacucaaaccggcgcaccgcucugcgaccucguagacagcaggaggccacagaagugaggcucgagcagaagaugccaacucuucugcgggucuauaucgaugggccgcauggaauggguaaaacgaccacaacucaauuguuaguugcacugggcagucgcgacgauauuguguacguacccgaaccuaugaccuauuggcaagugcuaggggccagcgagacaauagcuaauaucuacaccacucagcacagacucgaccagggagaaauuuccgcaggcgaugccgcugucgugaugacaucugcccagaucaccauggguaugccauaugcgguuacggacgcagugcuggcuccccauauugggggagaggcuggcucgucacacgccccuccacccgcacuuacucugaucuuugauaggcacccuauagcugccuugcucuguuacccagcggcccgguaucugaugggcagcaugaccccgcaggcaguccuggcuuucguggcccucauucccccuacauuaccagggacuaacaucguacugggagcccuucccgaggaccgccauaucgaucgauuggccaagagacagaggccuggugaacggcuggaccuagcaaugcucgccgcuauucgucgcguuuacggccugcuugcgaauaccgugagauaccugcaagggggaggcaguuggagggaggauuggggucaguuguccgggacagcagucccaccccagggagccgaaccgcagucuaacgcuggcccucggccccacaucggcgacacccucuuuacgcuguuccgagccccagaguuacuggcaccuaauggggaucucuauaacguguuugccugggcucuugacgugcuggccaaacgcuugagacccaugcaugucuucauacuagacuacgaucaaagcccagcaggaugcagggacgcgcugcuccagcugacuuccgguaugguucagacacacgugaccacucccggcucaauuccuacaaucugugaucuugcucggaccuuugcccgcgagaugggggaagcaaauuga

SEQ ID NO: 6894 - RNA, 1131 nt, Artificial Sequence
  derived and/or modified sequence opt4 from Thymidine_Kinase_TK__Herpes_Simplex_Virus_1_(HSV-1)__AAF72491
auggccagcuaccccugccaccagcacgccagcgccuucgaccaggccgccagaagcagaggccacagcaacagaagaaccgcccugagacccagaagacagcaggaggccaccgaggugagacuggagcagaagaugcccacccugcugagaguguacaucgacggcccccacggcaugggcaagaccaccaccacccagcugcugguggcccugggcagcagagacgacaucguguacgugcccgagcccaugaccuacuggcaggugcugggcgccagcgagaccaucgccaacaucuacaccacccagcacagacuggaccagggcgagaucagcgccggcgacgccgccguggugaugaccagcgcccagaucaccaugggcaugcccuacgccgugaccgacgccgugcuggccccccacaucggcggcgaggccggcagcagccacgcccccccccccgcccugacccugaucuucgacagacaccccaucgccgcccugcugugcuaccccgccgccagauaccugaugggcagcaugaccccccaggccgugcuggccuucguggcccugaucccccccacccugcccggcaccaacaucgugcugggcgcccugcccgaggacagacacaucgacagacuggccaagagacagagacccggcgagagacuggaccuggccaugcuggccgccaucagaagaguguacggccugcuggccaacaccgugagauaccugcagggcggcggcagcuggagagaggacuggggccagcugagcggcaccgccgugcccccccagggcgccgagccccagagcaacgccggccccagaccccacaucggcgacacccuguucacccuguucagagcccccgagcugcuggcccccaacggcgaccuguacaacguguucgccugggcccuggacgugcuggccaagagacugagacccaugcacguguucauccuggacuacgaccagagccccgccggcugcagagacgcccugcugcagcugaccagcggcauggugcagacccacgugaccacccccggcagcauccccaccaucugcgaccuggccagaaccuucgccagagagaugggcgaggccaacuga

SEQ ID NO: 6895 - RNA, 1131 nt, Artificial Sequence
  derived and/or modified sequence opt5 from Thymidine_Kinase_TK__Herpes_Simplex_Virus_1_(HSV-1)__AAF72491
auggccagcuaccccugccaccagcaugcuuccgccuucgaccaagcggcuagaucucggggccacagcaaccgcagaaccgcccugcggccucgcagacagcaggaggccacagaagugcggcucgagcagaagaugccgacgcugcuucgcgucuauaucgaugggccccauggaaugggcaaaaccacaaccacacaacugcucguugcucugggguccagagacgauauuguguacgugccugaacccaugaccuauuggcagguccuuggagccucugagacaaucgcuaauauuuacaccacgcagcaccggcuggaccagggcgaaaucagcgccggggaugcggccgugguuaugaccuccgcucaaauuacaaugggaaugccuuaugccgugaccgacgcuguccucgcgccccauaucggcggcgaggccgggucuagccacgccccuccgcccgcucugacacugaucuuugaucgccacccuauugccgcucuccuguguuaccccgccgccagauaucuuaugggauccaugaccccucaggcugugcuggcguucguugcccucauucccccgacgcugccuggcacaaacaucgugcuuggggcucugcccgaggaccggcauaucgaucgccucgccaagagacagcggccuggagaacgccuggaccuggccaugcucgcugccauuagacgggucuacggccugcuugcgaauaccgugagauaccugcaagggggaggcagcuggcgcgaggauuggggccagcucucugggacagcugugccuccccagggagccgaaccccaguccaacgccggcccgcggccccacaucggggacacccuguuuacccuuuucagagcuccugagcugcucgcccccaauggagaucuguauaacgucuuugcuugggcccuggacguucucgcgaaacgccugcggccuaugcauguguucauucuugacuacgaucaaagccccgccggcugcagagacgcucugcuccagcugacaucugggauggugcagacgcacgucaccacaccgggauccaucccuaccaucugugaucuugcccgcacauuugcucgggagaugggcgaagccaauuga

SEQ ID NO: 6896 - RNA, 1131 nt, Artificial Sequence
  derived and/or modified sequence opt6 from Thymidine_Kinase_TK__Herpes_Simplex_Virus_1_(HSV-1)__AAF72491
auggcaaguuacccaugccaucaacacgccucagcauuugaucaagcagcaagaucuagaggucauaguaauagaagaacagcucucagaccaagaagacaacaagaagcaacagaaguacgauuagaacaaaaaaugccaacacuacuaagaguauauauagacggaccacauggaaugggcaaaacaacaacaacacaauuauuaguagcauuagguucacgagaugauauaguauauguaccagaaccaaugacauauuggcaaguauuaggagcaagcgaaacuauagcaaauauauauacaacacaacauagacuagaucaaggugaaauaagcgcaggagaugcagccguaguaaugacaucagcucaaauaacaaugggaaugccauaugcaguaacugaugcaguauuagcaccacacauaggaggagaagcaggcucaucacaugccccacccccagcauuaacacuaauauucgaucgacacccaauagcugcacuauuguguuauccagcagcuagauauuuaaugggaagcaugacuccacaagcaguuuuagcauuuguagcauuaauaccuccaacauuaccaggaacaaacauuguacuaggagcacuaccagaagauagacauauagauagauuagcaaaaagacaaagaccaggagaaagauuagaucuugcaauguuagcugcaauaagaagaguauauggauuauuagcaaacacuguaagauaccuacaaggaggaggauccuggagagaagauuggggacaauuaaguggaacagcaguacccccacaaggugcagaaccucaauccaacgcaggaccaagaccccauauaggagacacuuuauucacauuauuuagagccccagaauuauuagcaccaaauggcgauuuauauaacguauuugcaugggcauuagacguacuugcaaaaagacuaagaccuaugcacguauucauauuagauuaugaccaaucaccagcaggcugucgagaugccuuauuacaacuuacaucuggaaugguacaaacacacguaacaacaccaggguccauaccaacaaucugugauuuagcacgaacauuugcuagagaaaugggugaagccaauuaa

SEQ ID NO: 6897 - protein, 281 aa, Artificial Sequence [sequence omitted]

SEQ ID NO: 6898 - RNA, 846 nt, Artificial Sequence
  Apo2L/TRAIL__Homo_sapiens__AAB01233
auggcuaugauggagguccaggggggacccagccugggacagaccugcgugcugaucgugaucuucacagugcuccugcagucucucuguguggcuguaacuuacguguacuuuaccaacgagcugaagcagaugcaggacaaguacuccaaaaguggcauugcuuguuucuuaaaagaagaugacaguuauugggaccccaaugacgaagagaguaugaacagccccugcuggcaagucaaguggcaacuccgucagcucguuagaaagaugauuuugagaaccucugaggaaaccauuucuacaguucaagaaaagcaacaaaauauuucuccccuagugagagaaagagguccucagagaguagcagcucacauaacugggaccagaggaagaagcaacacauugucuucuccaaacuccaagaaugaaaaggcucugggccgcaaaauaaacuccugggaaucaucaaggagugggcauucauuccugagcaacuugcacuugaggaauggugaacuggucauccaugaaaaaggguuuuacuacaucuauucccaaacauacuuucgauuucaggaggaaauaaaagaaaacacaaagaacgacaaacaaaugguccaauauauuuacaaauacacaaguuauccugacccuauauuguugaugaaaagugcuagaaauaguuguuggucuaaagaugcagaauauggacucuauuccaucuaucaagggggaauauuugagcuuaaggaaaaugacagaauuuuuguuucuguaacaaaugagcacuugauagacauggaccaugaagccaguuuuuucggggccuuuuuaguuggcuaa

SEQ ID NO: 6899 - RNA, 846 nt, Artificial Sequence
  derived and/or modified sequence opt1 from Apo2L/TRAIL__Homo_sapiens__AAB01233
auggccaugauggaggugcagggcgggcccagccugggccagaccugcguccucaucgugaucuucaccgugcugcugcagucccucugcgucgccgugacguacguguacuucaccaacgagcugaagcagaugcaggacaaguacagcaaguccgggaucgcgugcuuccugaaggaggacgacagcuacugggacccgaacgacgaggaguccaugaacagccccugcuggcaggucaaguggcagcuccgccagcuggugcggaagaugauccugcgcaccuccgaggagaccaucagcacggugcaggagaagcagcagaacaucagcccccucguccgggagcgcggcccccagcggguggccgcccacaucaccgggacccgcggccgguccaacacccuguccagcccgaacuccaagaacgagaaggcccugggccgcaagaucaacagcugggaguccagccgguccgggcacagcuuccucuccaaccugcaccuccgcaacggcgagcuggugauccacgagaagggguucuacuacaucuacagccagacguacuuccgguuccaggaggagaucaaggagaacaccaagaacgacaagcagaugguccaguacaucuacaaguacaccagcuaccccgaccccauccugcugaugaaguccgcccgcaacagcugcugguccaaggacgcggaguacggccucuacagcaucuaccagggcgggaucuucgagcugaaggagaacgaccggaucuucguguccgugaccaacgagcaccugaucgacauggaccacgaggccagcuucuucggcgccuuccucgucggguga

SEQ ID NO: 6900 - RNA, 846 nt, Artificial Sequence
  derived and/or modified sequence opt2 from Apo2L/TRAIL__Homo_sapiens__AAB01233
auggccaugauggagguccagggcggccccucccucggccagaccugcguccucaucgucaucuucaccguccuccuccagucccucugcgucgccgucaccuacgucuacuucaccaacgagcucaagcagaugcaggacaaguacuccaaguccggcaucgccugcuuccucaaggaggacgacuccuacugggaccccaacgacgaggaguccaugaacucccccugcuggcaggucaaguggcagcuccgccagcucguccgcaagaugauccuccgcaccuccgaggagaccaucuccaccguccaggagaagcagcagaacaucuccccccucguccgcgagcgcggcccccagcgcgucgccgcccacaucaccggcacccgcggccgcuccaacacccucuccucccccaacuccaagaacgagaaggcccucggccgcaagaucaacuccugggaguccucccgcuccggccacuccuuccucuccaaccuccaccuccgcaacggcgagcucgucauccacgagaagggcuucuacuacaucuacucccagaccuacuuccgcuuccaggaggagaucaaggagaacaccaagaacgacaagcagaugguccaguacaucuacaaguacaccuccuaccccgaccccauccuccucaugaaguccgcccgcaacuccugcugguccaaggacgccgaguacggccucuacuccaucuaccagggcggcaucuucgagcucaaggagaacgaccgcaucuucgucuccgucaccaacgagcaccucaucgacauggaccacgaggccuccuucuucggcgccuuccucgucggcuga

SEQ ID NO: 6901 - RNA, 846 nt, Artificial Sequence
  derived and/or modified sequence opt3 from Apo2L/TRAIL__Homo_sapiens__AAB01233
auggccaugauggaggugcagggcgggcccagccugggacaaaccugcguccucaucguuauuuucacagugcuucugcaguccuuguguguagcugugacuuacgucuauuuuacgaacgaauuaaagcagaugcaggacaaauacucuaagucagguauagcaugcuuccugaaagaggaugacaguuauugggauccuaaugacgaagagagcaugaacuccccauguuggcaagugaaguggcagcuaagacagcucguuaggaaaaugauccugcggaccucugaagagacaauuucgacugugcaggagaagcaacagaauaucucaccgcuuguccgcgaacgaggcccccagcguguggccgcgcacauuaccgggacaagaggaaggagcaacacccugaguuccccuaauucuaagaacgagaaggcuuugggccggaaaaucaauagcugggaauccucacgcaguggucauagcuuucucucuaaccugcaccugagaaauggggagcucguaauacaugagaaaggauucuacuauaucuacucccagacuuauuuuagguuccaagaagagauuaaggaaaacaccaaaaaugauaagcagaugguucaguacaucuacaaguauacaucauacccagaccccauuuuacugaugaaaagcgcccggaacaguugcuggucuaaggaugcagaguauggccuuuacuccaucuaucaaggcgggauauuugaauugaaagagaaugaccgcauuuucgugagcgucacgaacgagcaccugaucgauauggaccaugaagccucguuuuucggagcuuuucuaguggguuga

SEQ ID NO: 6902 - RNA, 846 nt, Artificial Sequence
  derived and/or modified sequence opt4 from Apo2L/TRAIL__Homo_sapiens__AAB01233
auggccaugauggaggugcagggcggccccagccugggccagaccugcgugcugaucgugaucuucaccgugcugcugcagagccugugcguggccgugaccuacguguacuucaccaacgagcugaagcagaugcaggacaaguacagcaagagcggcaucgccugcuuccugaaggaggacgacagcuacugggaccccaacgacgaggagagcaugaacagccccugcuggcaggugaaguggcagcugagacagcuggugagaaagaugauccugagaaccagcgaggagaccaucagcaccgugcaggagaagcagcagaacaucagcccccuggugagagagagaggcccccagagaguggccgcccacaucaccggcaccagaggcagaagcaacacccugagcagccccaacagcaagaacgagaaggcccugggcagaaagaucaacagcugggagagcagcagaagcggccacagcuuccugagcaaccugcaccugagaaacggcgagcuggugauccacgagaagggcuucuacuacaucuacagccagaccuacuucagauuccaggaggagaucaaggagaacaccaagaacgacaagcagauggugcaguacaucuacaaguacaccagcuaccccgaccccauccugcugaugaagagcgccagaaacagcugcuggagcaaggacgccgaguacggccuguacagcaucuaccagggcggcaucuucgagcugaaggagaacgacagaaucuucgugagcgugaccaacgagcaccugaucgacauggaccacgaggccagcuucuucggcgccuuccuggugggcuga

SEQ ID NO: 6903 - RNA, 846 nt, Artificial Sequence
  derived and/or modified sequence opt5 from Apo2L/TRAIL__Homo_sapiens__AAB01233
auggccaugauggaggugcagggcgggcccagccugggacaaaccugcguccucaucguuauuuucacagugcugcuucagucccuguguguggcugucacguacguguauuuuaccaacgaacucaagcagaugcaggacaaauacucuaagagcggcaucgccugcuuccugaaagaggaugacuccuauugggauccuaaugacgaagagucuaugaacagcccguguuggcaaguuaaguggcagcuuagacagcuggugcggaaaaugauucuccgcacauccgaagagaccaucucuacaguccaggagaagcaacagaauauuagcccccuggugagagaacgggggccucagcgcguugcggcucacaucaccggaacaagaggccgguccaacacccugagcucucccaauuccaagaacgagaaagcccucgggcgcaagaucaauagcugggaaucuuccagaagcggacauucuuuucuguccaaccuucaucugcggaauggcgagcucgugauucacgagaaaggcuucuacuauaucuacagccagacguauuuucgcuuccaagaagagauuaaggaaaacaccaaaaaugauaagcagaugguccaguacaucuacaaguauacauccuacccugaccccauucugcuuaugaaaucugccagaaacagcugcugguccaaggaugcugaguaugggcuguacagcaucuaucaaggaggcauuuuugaacucaaagagaaugaccggaucuucgugucugugaccaacgagcaccugaucgauauggaccaugaagccuccuuuuucggggcuuuucuggucggauga

SEQ ID NO: 6904 - RNA, 846 nt, Artificial Sequence
  derived and/or modified sequence opt6 from Apo2L/TRAIL__Homo_sapiens__AAB01233
auggcaaugauggaaguacaaggaggaccaucacuaggccaaacauguguacuaaucguaauauucacaguacuacuacaaucacuaugcguagcaguaacauacguauacuucaccaacgaacuaaaacaaaugcaagauaaauacagcaaaucaggaauagcaugcuuccuaaaagaagacgacucauacugggacccaaaugacgaagaaucaaugaacaguccauguuggcaaguaaaauggcaauuacgacaacuaguaagaaaaaugauauuaagaacuuccgaagaaacaauaucaacaguacaagaaaaacaacaaaacauaucaccauuaguaagagaaagaggaccacaaagaguagcagcccauauaacaggaacaagaggaagaagcaacacacuaucaucaccaaacagcaaaaacgaaaaagcauuaggaagaaaaauaaacucaugggaaucaucaagaucuggacacucauucuuaagcaacuuacaccuaagaaacggagaacuagucauccacgaaaaaggauucuauuacauauacucucaaacauacuuucgcuuccaagaagaaauaaaagaaaacacaaaaaacgacaaacaaaugguacaauacauauacaaauacacaucauauccagacccaaucuuacuaaugaaauccgcacgaaacucauguuggucaaaagacgcagaauacggacuauacucaauauaucaaggaggaauauuugaacuaaaagaaaacgacagaauauucguaucaguaacaaacgaacaccuaauagacauggaccacgaagcaucauucuucggagcauuccuaguaggauaa

SEQ ID NO: 6905 - protein, 249 aa, Artificial Sequence; identical to SEQ ID NO: 4825
  Apo3L__Homo_sapiens__O43508

SEQ ID NO: 6906 - RNA, 750 nt, Artificial Sequence; identical to SEQ ID NO: 4826
  Apo3L__Homo_sapiens__AAC39724

SEQ ID NO: 6907 - RNA, 750 nt, Artificial Sequence; identical to SEQ ID NO: 4827
  derived and/or modified sequence opt1 from Apo3L__Homo_sapiens__AAC39724

SEQ ID NO: 6908 - RNA, 750 nt, Artificial Sequence; identical to SEQ ID NO: 4828
  derived and/or modified sequence opt2 from Apo3L__Homo_sapiens__AAC39724

SEQ ID NO: 6909 - RNA, 750 nt, Artificial Sequence; identical to SEQ ID NO: 4829
  derived and/or modified sequence opt3 from Apo3L__Homo_sapiens__AAC39724

SEQ ID NO: 6910 - RNA, 750 nt, Artificial Sequence; identical to SEQ ID NO: 4830
  derived and/or modified sequence opt4 from Apo3L__Homo_sapiens__AAC39724

SEQ ID NO: 6911 - RNA, 750 nt, Artificial Sequence; identical to SEQ ID NO: 4831
  derived and/or modified sequence opt5 from Apo3L__Homo_sapiens__AAC39724

SEQ ID NO: 6912 - RNA, 750 nt, Artificial Sequence
  derived and/or modified sequence opt6 from Apo3L__Homo_sapiens__AAC39724
auggcagcuagaagaucacaaagaagaagaggaagaagaggagaaccagguacagcccuauuaguaccauuagcauuaggauuaggcuuagcauuagcauguuuaggauuacuauuagcagucguaucacuaggcucaagagcaagucuaucagcacaagaaccagcacaagaagaauuaguagcagaagaagaccaagauccaagcgaauuaaauccacaaacagaagaaucacaagauccagcacccuuucuaaaucgauuaguacgacccagaagaagugcaccaaaaggaagaaaaacaagagcaagacgagcuauagcagcacauuaugaaguacauccaagaccaggacaagauggagcacaagcaggaguugauggaacaguaucaggaugggaagaagcuagaauaaauucaucaucaccacuaagauauaacagacaaauuggagaauuuauaguaacaagagcaggauuauauuauuuauauugucaaguacauuuugaugaaggaaaagcaguauauuuaaaacuagaucuauuaguagauggaguacuagcauuaagaugucuagaagaauuuagugcuacagcagcaucaagucuaggaccucaauuaagauuaugucaaguaaguggacuauuagcauuaagaccaggaagcucauuaagaauacguacauuaccaugggcacauuuaaaagcagcaccauuuuuaacauacuuuggauuauuccaaguacauuaa

SEQ ID NO: 6913 - protein, 168 aa, Artificial Sequence
  Bad__Homo_sapiens__A0A024R562
MFQIPEFEPSEQEDSSSAERGLGPSPAGDGPSGSGKHHRQAPGLLWDASHQQEQPTSSSHHGGAGAVEIRSRHSSYPAGTEDDEGMGEEPSPFRGRSRSAPPNLWAAQRYGRELRRMSDEFVDSFKKGLPRPKSAGTATQMRQSSSWTRVFQSWWDRNLGRGSSAPSQ

SEQ ID NO: 6914 - RNA, 507 nt, Artificial Sequence
  Bad__Homo_sapiens__EAW74236
auguuccagaucccagaguuugagccgagugagcaggaagacuccagcucugcagagaggggccugggccccagccccgcaggggacgggcccucaggcuccggcaagcaucaucgccaggccccaggccuccugugggacgccagucaccagcaggagcagccaaccagcagcagccaucauggaggcgcuggggcuguggagauccggagucgccacagcuccuaccccgcggggacggaggacgacgaagggaugggggaggagcccagccccuuucggggccgcucgcgcucggcgccccccaaccucugggcagcacagcgcuauggccgcgagcuccggaggaugagugacgaguuuguggacuccuuuaagaagggacuuccucgcccgaagagcgcgggcacagcaacgcagaugcggcaaagcuccagcuggacgcgagucuuccaguccuggugggaucggaacuugggcaggggaagcuccgcccccucccaguga

SEQ ID NO: 6915 - RNA, 507 nt, Artificial Sequence
  derived and/or modified sequence opt1 from Bad__Homo_sapiens__EAW74236
auguuccagauccccgaguucgagccgagcgagcaggaggacuccagcuccgccgagcgcggccuggggcccagccccgccggcgacgggcccuccggcagcgggaagcaccaccggcaggcgccgggccuccugugggacgccucccaccagcaggagcagcccaccagcuccagccaccacggcggggccggcgccguggagauccgcucccggcacagcuccuaccccgccgggaccgaggacgacgagggcaugggggaggagcccagcccguuccgcggccggucccgcagcgcgccgcccaaccugugggccgcccagcgguacggccgcgagcuccggcgcauguccgacgaguucgucgacagcuucaagaaggggcugccccggcccaaguccgccggcacggcgacccagaugcgccagagcagcuccuggacccggguguuccagagcuggugggaccgcaaccuggggcggggcuccagcgcccccucccaguga

SEQ ID NO: 6916 - RNA, 507 nt, Artificial Sequence
  derived and/or modified sequence opt2 from Bad__Homo_sapiens__EAW74236
auguuccagauccccgaguucgagcccuccgagcaggaggacuccuccuccgccgagcgcggccucggccccucccccgccggcgacggccccuccggcuccggcaagcaccaccgccaggcccccggccuccucugggacgccucccaccagcaggagcagcccaccuccuccucccaccacggcggcgccggcgccgucgagauccgcucccgccacuccuccuaccccgccggcaccgaggacgacgagggcaugggcgaggagcccucccccuuccgcggccgcucccgcuccgccccccccaaccucugggccgcccagcgcuacggccgcgagcuccgccgcauguccgacgaguucgucgacuccuucaagaagggccucccccgccccaaguccgccggcaccgccacccagaugcgccaguccuccuccuggacccgcgucuuccaguccuggugggaccgcaaccucggccgcggcuccuccgcccccucccaguga

SEQ ID NO: 6917 - RNA, 507 nt, Artificial Sequence
  derived and/or modified sequence opt3 from Bad__Homo_sapiens__EAW74236
auguuccagauccccgaguuugaaccuagcgagcaagaagacuccucuucagccgagagaggccuggggccaaguccggcuggagauggucccagcggcuccgggaagcaccauaggcaggcaccuggacuccuuugggacgccucucaccagcaggaacaaccaaccucgucaagccaucacggcggugcgggggcuguggagauucggagucgccauuccucuuaccccgccggaacagaggaugacgaaggcaugggcgaggaaccuagcccauuccgagggcguuccagaucagcacccccuaaccugugggccgcucagagguauggacgggaguugcgcagaaugagugaugaguuugucgacagcuucaaaaaggguuuaccaaggccgaaaucugcaggcacugccacgcagaugcggcaguccucaagcuggacccgcguuuuucaaaguuggugggaucgaaaucuggggagaggaucuuccgcucccagccaguga

SEQ ID NO: 6918 - RNA, 507 nt, Artificial Sequence
  derived and/or modified sequence opt4 from Bad__Homo_sapiens__EAW74236
auguuccagauccccgaguucgagcccagcgagcaggaggacagcagcagcgccgagagaggccugggccccagccccgccggcgacggccccagcggcagcggcaagcaccacagacaggcccccggccugcugugggacgccagccaccagcaggagcagcccaccagcagcagccaccacggcggcgccggcgccguggagaucagaagcagacacagcagcuaccccgccggcaccgaggacgacgagggcaugggcgaggagcccagccccuucagaggcagaagcagaagcgccccccccaaccugugggccgcccagagauacggcagagagcugagaagaaugagcgacgaguucguggacagcuucaagaagggccugcccagacccaagagcgccggcaccgccacccagaugagacagagcagcagcuggaccagaguguuccagagcuggugggacagaaaccugggcagaggcagcagcgcccccagccaguga

SEQ ID NO: 6919 - RNA, 507 nt, Artificial Sequence
  derived and/or modified sequence opt5 from Bad__Homo_sapiens__EAW74236
auguuccagauccccgaguuugaaccuagcgagcaagaagacuccucuagcgccgagagaggccuggggccgucccccgcuggagauggcccuucugggagcggaaagcaccaucggcaggcccccggccuccugugggacgcgucccaccagcaggaacaaccuaccucuagcucccaucacgggggagcuggcgccguggagauucgcagcagacauucuuccuaccccgccggcacagaggaugacgaagggaugggagaggaaccuagcccguuccggggccgcucuagauccgcucccccuaaccuuugggccgcucagcgguaugggcgcgagcugagacggaugagcgaugaguuugucgacucuuucaaaaagggacucccccgcccuaaauccgccggcacggcgacccagaugagacagagcuccucuuggacacggguuuuucaaagcuggugggaucgcaaucuggggagaggauccagcgcccccucucaguga

SEQ ID NO: 6920 - RNA, 507 nt, Artificial Sequence
  derived and/or modified sequence opt6 from Bad__Homo_sapiens__EAW74236
auguuucaaauaccagaauucgaaccaagugaacaagaagauaguaguagugcagaaagaggauuaggaccaaguccagcaggagauggaccaaguggaaguggaaaacaucauagacaagcuccaggauuauuaugggaugcaagucaucaacaagaacaaccaacaagcaguagucaucauggaggagcaggagcaguagaaauaagaaguagacauaguaguuauccggcaggaacagaagaugaugaaggaaugggagaagaaccaucaccauuuaggggaagaaguagaagugcaccaccaaauuuaugggcagcacaaagauauggaagagaauuaagaagaaugagugaugaauuuguagauaguuuuaaaaaaggauuaccaagaccaaaaagugcaggaacagcaacacaaaugaggcaaaguagcaguuggacaagaguauuucaaaguuggugggauagaaauuuaggaagaggaagcagugcaccaagucaauaa

SEQ ID NO: 6921 - protein, 168 aa, Artificial Sequence; identical to SEQ ID NO: 6913
  Bad__Homo_sapiens__Q92934

SEQ ID NO: 6922 - RNA, 507 nt, Artificial Sequence
  Bad__Homo_sapiens__AAB72092
auguuccagaucccagaguuugagccgagugagcaggaagacuccagcucugcagagaggggccugggccccagccccgcaggggacgggcccucaggcuccggcaagcaucaucgccaggccccaggccuccugugggacgccagucaccagcaggagcagccaaccagcagcagccaucauggaggcgcuggggcuguggagauccggagucgccacagcuccuaccccgcggggacggaggacgacgaagggaugggggaggagcccagccccuuucggggccguucgcgcucggcgccccccaaccucugggcagcacagcgcuauggccgcgagcuccggaggaugagugacgaguuuguggacuccuuuaagaagggacuuccucgcccgaagagcgcgggcacagcaacgcagaugcggcaaagcuccagcuggacgcgagucuuccaguccuggugggaucggaacuugggcaggggaagcuccgcccccucccaguga

SEQ ID NO: 6923 - RNA, 507 nt, Artificial Sequence; identical to SEQ ID NO: 6915
  derived and/or modified sequence opt1 from Bad__Homo_sapiens__AAB72092

SEQ ID NO: 6924 - RNA, 507 nt, Artificial Sequence; identical to SEQ ID NO: 6916
  derived and/or modified sequence opt2 from Bad__Homo_sapiens__AAB72092

SEQ ID NO: 6925 - RNA, 507 nt, Artificial Sequence; identical to SEQ ID NO: 6917
  derived and/or modified sequence opt3 from Bad__Homo_sapiens__AAB72092

SEQ ID NO: 6926 - RNA, 507 nt, Artificial Sequence; identical to SEQ ID NO: 6918
  derived and/or modified sequence opt4 from Bad__Homo_sapiens__AAB72092

SEQ ID NO: 6927 - RNA, 507 nt, Artificial Sequence; identical to SEQ ID NO: 6919
  derived and/or modified sequence opt5 from Bad__Homo_sapiens__AAB72092

SEQ ID NO: 6928 - RNA, 507 nt, Artificial Sequence
  derived and/or modified sequence opt6 from Bad__Homo_sapiens__AAB72092
auguuucaaauaccagaauuugaaccaagugaacaagaagauucaaguagugcagaaagaggauuaggaccaucaccagcaggagauggaccaaguggaaguggaaaacaucauagacaagcaccaggauuauuaugggaugcaucacaucaacaagaacaaccaacaucaagcucacaucauggaggagcaggagcaguagaaauaagaucaagacacaguucauauccagcaggaacagaagaugaugaaggaaugggagaagaaccaucaccauuuagaggaagaucaagaagugcaccaccaaauuuaugggcagcacaaagauauggaagagaauuaagaagaaugagugaugaauuuguagauaguuuuaaaaaaggauuaccaagaccaaaaagugcaggaacagcaacacaaaugagacaaaguucaagcuggacaagaguauuucaaaguuggugggauagaaauuuaggaagaggaucaagcgcaccaucacaauaa

SEQ ID NO: 6929 - protein, 211 aa, Artificial Sequence
  Bak__Homo_sapiens__Q16611
MASGQGPGPPRQECGEPALPSASEEQVAQDTEEVFRSYVFYRHQQEQEAEGVAAPADPEMVTLPLQPSSTMGQVGRQLAIIGDDINRRYDSEFQTMLQHLQPTAENAYEYFTKIATSLFESGINWGRVVALLGFGYRLALHVYQHGLTGFLGQVTRFVVDFMLHHCIARWIAQRGGWVAALNLGNGPILNVLVVLGVVLLGQFVVRRFFKS

SEQ ID NO: 6930 - RNA, 636 nt, Artificial Sequence
  Bak__Homo_sapiens__AAA74466
auggcuucggggcaaggcccagguccucccaggcaggagugcggagagccugcccugcccucugcuucugaggagcagguagcccaggacacagaggagguuuuccgcagcuacguuuuuuaccgccaucagcaggaacaggaggcugaagggguggcugccccugccgacccagagauggucaccuuaccucugcaaccuagcagcaccauggggcaggugggacggcagcucgccaucaucggggacgacaucaaccgacgcuaugacucagaguuccagaccauguugcagcaccugcagcccacggcagagaaugccuaugaguacuucaccaagauugccaccagccuguuugagaguggcaucaauuggggccgugugguggcucuucugggcuucggcuaccgucuggcccuacacgucuaccagcauggccugacuggcuuccuaggccaggugacccgcuucguggucgacuucaugcugcaucacugcauugcccgguggauugcacagagggguggcuggguggcagcccugaacuugggcaauggucccauccugaacgugcuggugguucugggugugguucuguugggccaguuugugguacgaagauucuucaaaucauga

SEQ ID NO: 6931 - RNA, 636 nt, Artificial Sequence
  derived and/or modified sequence opt1 from Bak__Homo_sapiens__AAA74466
auggccagcggccaggggcccggcccgccccgccaggagugcggggagcccgcccugcccuccgcgagcgaggagcaggucgcccaggacaccgaggagguguuccgguccuacguguucuaccgccaccagcaggagcaggaggccgagggcguggccgccccggcggaccccgagauggucacccucccccugcagcccagcuccacgaugggccagguggggcggcagcuggccaucaucggcgacgacaucaaccgccgguacgacagcgaguuccagaccaugcuccagcaccuccagccgaccgccgagaacgccuacgaguacuucaccaagaucgcgacgucccuguucgagagcgggaucaacuggggccgcguggucgcccugcugggguucggcuaccggcuggcccuccacguguaccagcacgggcugaccggcuuccugggccaggugacccgcuucgucguggacuucaugcuccaccacugcaucgcccgguggaucgcccagcgcgggggcuggguggcggcccugaaccuggggaacggccccauccucaacguccugguggugcugggcgucgugcuccuggggcaguucgugguccggcgcuucuucaaguccuga

SEQ ID NO: 6932 - RNA, 636 nt, Artificial Sequence
  derived and/or modified sequence opt2 from Bak__Homo_sapiens__AAA74466
auggccuccggccagggccccggccccccccgccaggagugcggcgagcccgcccuccccuccgccuccgaggagcaggucgcccaggacaccgaggaggucuuccgcuccuacgucuucuaccgccaccagcaggagcaggaggccgagggcgucgccgcccccgccgaccccgagauggucacccucccccuccagcccuccuccaccaugggccaggucggccgccagcucgccaucaucggcgacgacaucaaccgccgcuacgacuccgaguuccagaccaugcuccagcaccuccagcccaccgccgagaacgccuacgaguacuucaccaagaucgccaccucccucuucgaguccggcaucaacuggggccgcgucgucgcccuccucggcuucggcuaccgccucgcccuccacgucuaccagcacggccucaccggcuuccucggccaggucacccgcuucgucgucgacuucaugcuccaccacugcaucgcccgcuggaucgcccagcgcggcggcugggucgccgcccucaaccucggcaacggccccauccucaacguccucgucguccucggcgucguccuccucggccaguucgucguccgccgcuucuucaaguccuga

SEQ ID NO: 6933 - RNA, 636 nt, Artificial Sequence
  derived and/or modified sequence opt3 from Bak__Homo_sapiens__AAA74466
auggccagcggccaggggcccggaccuccaagacaagagugcggugaaccggcucugcccuccgcaucugaggaacagguggcccaggacaccgaggaagucuucaggucauacguuuucuaucggcaccagcaagagcaggaggcggaaggcguggcugccccugcagauccagagaugguaacacucccccuucagccuaguagcacuaugggacagguggggcgccaacuggccaucauuggcgacgauauaaaccgacguuacgacuccgaauuucagacgauguugcagcauuuacagccaaccgcugagaaugcauaugaguacuuuacaaagaucgccacuucucuguucgaaucggguauuaacugggggagagucguggcucuacucggauuuggcuauaggcuggcccuucacguuuaccaacauggccugaccggguucuugggacaggugacacgguuugucguggauuucaugcuccaccauuguaucgcgcgcuggauugcacagagagguggcuggguagccgcucugaaucuggggaacggacccauccucaauguuuuagugguccugggcguggugcuuuugggucaauuugucguuaggcgguucuuuaaaucauga

SEQ ID NO: 6934 - RNA, 636 nt, Artificial Sequence
  derived and/or modified sequence opt4 from Bak__Homo_sapiens__AAA74466
auggccagcggccagggccccggcccccccagacaggagugcggcgagcccgcccugcccagcgccagcgaggagcagguggcccaggacaccgaggagguguucagaagcuacguguucuacagacaccagcaggagcaggaggccgagggcguggccgcccccgccgaccccgagauggugacccugccccugcagcccagcagcaccaugggccaggugggcagacagcuggccaucaucggcgacgacaucaacagaagauacgacagcgaguuccagaccaugcugcagcaccugcagcccaccgccgagaacgccuacgaguacuucaccaagaucgccaccagccuguucgagagcggcaucaacuggggcagagugguggcccugcugggcuucggcuacagacuggcccugcacguguaccagcacggccugaccggcuuccugggccaggugaccagauucgugguggacuucaugcugcaccacugcaucgccagauggaucgcccagagaggcggcuggguggccgcccugaaccugggcaacggccccauccugaacgugcugguggugcugggcguggugcugcugggccaguucguggugagaagauucuucaagagcuga

SEQ ID NO: 6935 - RNA, 636 nt, Artificial Sequence
  derived and/or modified sequence opt5 from Bak__Homo_sapiens__AAA74466
auggccagcggccaggggcccggaccuccgagacaagagugcggcgaacccgcucugccuuccgccucugaggaacagguggcgcaggacaccgaggaagucuuccggagcuacguuuucuaucgccaccagcaagagcaggaggcugaagggguggccgcccccgcugauccugagauggugacacucccccugcagccuuccucuacgaugggacaggucggcagacaacuugccaucauuggggacgauaucaaccggcgcuacgacagcgaauuucagaccaugcugcagcaucuccagccgacagcugagaaugccuaugaguacuuuaccaagauugcgacaucccuguucgaaucuggaaucaacuggggcagagugguugcccuucugggcuuuggguaucggcucgcucugcacguguaccaacauggacugaccggcuuccucgggcaggucacacgcuuugugguugauuucaugcugcaccauuguauugccagauggaucgcucagcggggaggcuggguggccgcgcuuaaucuggggaacggacccauccucaauguccugguggugcuuggcgucguucugcucggccaauuuguggugcgcagauucuuuaaaagcuga

SEQ ID NO: 6936 - RNA, 636 nt, Artificial Sequence
  derived and/or modified sequence opt6 from Bak__Homo_sapiens__AAA74466
auggcaucaggacaaggaccaggaccaccaagacaagaauguggagaaccagcacuaccaucagcaagcgaagaacaaguagcacaagauacagaagaaguauucagaaguuacguauuuuacagacaccaacaagaacaagaagcagaaggaguagcagcaccagcagacccagaaaugguaacacucccacuacaaccaucaaguacaaugggucaaguaggcagacaauuagcaauaauaggagacgacauaaauagaagauacgauagcgaauuccaaacaauguuacaacacuuacaaccaacagcggaaaaugcauaugaauauuucacaaaaauagcaacaaguuuauucgaaagugguauaaauuggggaagaguaguagcauuauuaggcuucggauauagauuagcauuacacguauaccaacacggacuaacaggauuuuuaggacaaguaacuagauucguaguagauuuuauguuacaucacugcauagcuagauggauagcacaaagaggaggauggguagcagcacuaaauuuaggaaacggaccaauacuaaauguauuaguaguauuaggaguaguauuauuaggacaauucguaguaagaagauuuuuuaaaagcuaa

SEQ ID NO: 6937 - protein, 190 aa, Artificial Sequence
  Bak__Homo_sapiens__Q8NFF3
MASGQGPGPPRQECGEPALPSASEEQVAQDTEEVFRSYVFYRHQQPSSTMGQVGRQLAIIGDDINRRYDSEFQTMLQHLQPTAENAYEYFTKIATSLFESGINWGRVVALLGFGYRLALHVYQHGLTGFLGQVTRFVVDFMLHHCIARWIAQRGGWVAALNLGNGPILNVLVVLGVVLLGQFVVRRFFKS

SEQ ID NO: 6938 - RNA, 573 nt, Artificial Sequence
  Bak__Homo_sapiens__AAM74949
auggcuucggggcaaggcccagguccucccaggcaggaguguggagagccugcccugcccucugcuucugaggagcagguagcccaggacacagaggagguuuuccgcagcuacguuuuuuaccgccaucagcaaccuagcagcaccauggggcaggugggacggcagcucgccaucaucggggacgacaucaaccgacgcuaugacucagaguuccagaccauguugcagcaccugcagcccacggcagagaaugccuaugaguacuucaccaagauugccaccagccuguuugagaguggcaucaauuggggccgugugguggcucuucugggcuucggcuaccgucuggcccuacacgucuaccagcauggccugacuggcuuccuaggccaggugacccgcuucguggucgacuucaugcugcaucacugcauugcccgguggauugcacagagggguggcuggguggcagcccugaacuugggcaauggucccauccugaacgugcuggugguucugggugugguucuguugggccaguuugugguacgaagauucuucaaaucauga

SEQ ID NO: 6939 - RNA, 573 nt, Artificial Sequence
  derived and/or modified sequence opt1 from Bak__Homo_sapiens__AAM74949
auggccagcggccaggggcccggcccgccccgccaggagugcggggagcccgcccugcccuccgcgagcgaggagcaggucgcccaggacaccgaggagguguuccgguccuacguguucuaccgccaccagcagccgagcuccaccaugggccagguggggcggcagcucgccaucaucggcgacgacaucaaccgccgguacgacagcgaguuccagacgaugcugcagcaccuccagcccaccgccgagaacgccuacgaguacuucaccaagaucgcgaccucccuguucgagagcggcaucaacugggggcgcgucguggcccugcugggcuucggguaccggcucgcccugcacguguaccagcacggccugacgggguuccucggccaggucacccgcuucgugguggacuucaugcugcaccacugcaucgcccgguggaucgcgcagcgcggcgggugggucgccgcccugaaccucggcaacgggcccauccugaacgugcuggugguccucggcguggugcugcugggccaguucgucgugcggcgcuucuucaaguccuga

SEQ ID NO: 6940 - RNA, 573 nt, Artificial Sequence
  derived and/or modified sequence opt2 from Bak__Homo_sapiens__AAM74949
auggccuccggccagggccccggccccccccgccaggagugcggcgagcccgcccuccccuccgccuccgaggagcaggucgcccaggacaccgaggaggucuuccgcuccuacgucuucuaccgccaccagcagcccuccuccaccaugggccaggucggccgccagcucgccaucaucggcgacgacaucaaccgccgcuacgacuccgaguuccagaccaugcuccagcaccuccagcccaccgccgagaacgccuacgaguacuucaccaagaucgccaccucccucuucgaguccggcaucaacuggggccgcgucgucgcccuccucggcuucggcuaccgccucgcccuccacgucuaccagcacggccucaccggcuuccucggccaggucacccgcuucgucgucgacuucaugcuccaccacugcaucgcccgcuggaucgcccagcgcggcggcugggucgccgcccucaaccucggcaacggccccauccucaacguccucgucguccucggcgucguccuccucggccaguucgucguccgccgcuucuucaaguccuga

SEQ ID NO: 6941 - RNA, 573 nt, Artificial Sequence
  derived and/or modified sequence opt3 from Bak__Homo_sapiens__AAM74949
auggccagcggccaggggcccggaccuccaagacaagagugcggugaaccggcucugcccuccgcaucugaggaacagguggcccaggacaccgaggaagucuucaggucauacguguuuuaucggcaccagcaaccuaguagcacaaugggccagguggggcgccagcucgcgaucauuggagaugacauaaaccgacguuacgauuccgaguuccagacuaugcuucaacaucugcagccaacggcugagaaugccuaugaauacuuuaccaagaucgcaacaucuuuguucgagucgggcauuaacugggguagaguaguggccuuacugggguuuggauauaggcuagcucuccacgucuaccagcauggccugacuggcuuccuugggcagguuacccgguuuguuguggacuucaugcugcaccauuguaucgcacgcuggauugcccaaagaggagguugggucgcugccuugaaucucggcaacgggcccauccugaaugugcugguaguucucggaguggucuuacugggccaguuuguggugaggcgguucuuuaaaucauga

SEQ ID NO: 6942 - RNA, 573 nt, Artificial Sequence
  derived and/or modified sequence opt4 from Bak__Homo_sapiens__AAM74949
auggccagcggccagggccccggcccccccagacaggagugcggcgagcccgcccugcccagcgccagcgaggagcagguggcccaggacaccgaggagguguucagaagcuacguguucuacagacaccagcagcccagcagcaccaugggccaggugggcagacagcuggccaucaucggcgacgacaucaacagaagauacgacagcgaguuccagaccaugcugcagcaccugcagcccaccgccgagaacgccuacgaguacuucaccaagaucgccaccagccuguucgagagcggcaucaacuggggcagagugguggcccugcugggcuucggcuacagacuggcccugcacguguaccagcacggccugaccggcuuccugggccaggugaccagauucgugguggacuucaugcugcaccacugcaucgccagauggaucgcccagagaggcggcuggguggccgcccugaaccugggcaacggccccauccugaacgugcugguggugcugggcguggugcugcugggccaguucguggugagaagauucuucaagagcuga

SEQ ID NO: 6943 - RNA, 573 nt, Artificial Sequence
  derived and/or modified sequence opt5 from Bak__Homo_sapiens__AAM74949
auggccagcggccaggggcccggaccuccgagacaagagugcggcgaacccgcucugccuuccgccucugaggaacagguggcgcaggacaccgaggaagucuuccggagcuacguguuuuaucgccaccagcaacccuccucuacaauggggcagguuggaagacagcucgcuaucauuggcgaugacaucaaccggcgcuacgauagcgaguuccagacgaugcugcaacaucuucagccuaccgccgagaaugccuaugaauacuuuacaaagauugcuaccucccuguucgagucugggaucaacuggggaagaguggucgcccuccugggcuuuggcuaucggcuugcucugcacguguaccagcaugggcucacaggauuccugggccagguuacccgcuuuguggucgacuucaugcugcaccauuguauugccagauggaucgcgcaacgcgggggauggguggccgcucucaaucugggcaacgggcccauccuuaauguucuggugguccucggaguggugcugcuuggccaguuugucguucggagauucuuuaaaagcuga

SEQ ID NO: 6944 - RNA, 573 nt, Artificial Sequence
  derived and/or modified sequence opt6 from Bak__Homo_sapiens__AAM74949
auggcaucaggucaaggaccaggaccaccaagacaagaauguggagaaccagcauuaccaagugcuucagaagaacaaguagcacaagauacagaagaaguauuuagaucauauguauuuuauagacaccaacaaccaucaucaacaaugggacaaguaggaagacaauuagcaauaauaggagacgauauaaauagaagauaugauucagaauuucaaacaauguuacaacauuuacaaccaacagcagaaaaugcauaugaauauuucacaaaaauagcaacaucauuauuugaaucaggaauaaauuggggaagaguaguagcuuuauuaggauucggauaucgauuagcccuacauguauaucaacauggauuaacaggauuuuuaggacaaguuacaagauuuguaguugauuuuauguuacaucauuguauagcuagauggauagcacaaagaggaggauggguagcagcacuaaaucuaggaaauggaccaauacuaaauguauuaguaguauuaggaguaguacuauuaggacaauuuguaguaagaagauuuuuuaaaucauaa

SEQ ID NO: 6945 - protein, 204 aa, Artificial Sequence
  Bax__Homo_sapiens__A0A0C4MVT1
MDGSGEQPRGGVSSRIEQGEWGGEAPELALDPVPQDASTKKLSECLKRIGDELDSNMELQRMIAAVDTDSPREVFFRVAADMFSDGNFNWGRVVALFYFASKLVLKALCTKVPELIRTIMGWTLDFLRERLLGWIQDQGGWGLPLAESLKRLMSLSPGRPPLLLWDAHVADRDHLCGGSAHRLTHHLEEDGLRPPAALDCVFPP

SEQ ID NO: 6946 - RNA, 615 nt, Artificial Sequence
  Bax__Homo_sapiens__AIO10780
auggacggguccggggagcagcccagaggcgggguuucauccaggaucgagcagggcgaaugggggggggaggcacccgagcuggcccuggacccggugccucaggaugcguccaccaagaagcugagcgagugucucaagcgcaucggggacgaacuggacaguaacauggagcugcagaggaugauugccgccguggacacagacuccccccgagaggucuuuuuccgaguggcagcugacauguuuucugacggcaacuucaacuggggccggguugucgcccuuuucuacuuugccagcaaacuggugcucaaggcccugugcaccaaggugccggaacugaucagaaccaucaugggcuggacauuggacuuccuccgggagcggcuguugggcuggauccaagaccagggugguugggggcugccccuggccgagucacugaagcgacugaugucccugucuccaggacggccuccucuccuacuuugggacgcccacguggcagaccgugaccaucuuuguggcgggagugcucaccgccucacucaccaucuggaagaagaugggcugaggcccccagcugccuuggacuguguuuuuccuccauaa

SEQ ID NO: 6947 - RNA, 615 nt, Artificial Sequence
  derived and/or modified sequence opt1 from Bax__Homo_sapiens__AIO10780
auggacggcagcggggagcagccccgcggcgggguguccagccggaucgagcagggcgaguggggcggggaggcccccgagcuggcccucgaccccgucccccaggacgcguccaccaagaagcugagcgagugccugaagcgcaucggcgacgagcucgacuccaacauggagcugcagcggaugaucgccgccguggacaccgacagcccccgcgagguguucuuccgggucgccgccgacauguucuccgacgggaacuucaacuggggccgcgugguggcgcuguucuacuucgccagcaagcucguccugaaggcccugugcacgaaggugccggagcucauccggaccaucaugggguggacccuggacuuccugcgcgagcggcuccugggcuggauccaggaccagggcggguggggccugccccucgccgagucccugaagcgccugaugagccucucccccgggcggcccccgcugcugcucugggacgcgcacguggccgaccgcgaccaccugugcggcgggagcgcccaccggcugacccaccaccucgaggaggacggccugcgcccgcccgccgcccuggacugcgucuucccgcccuga

SEQ ID NO: 6948 - RNA, 615 nt, Artificial Sequence
  derived and/or modified sequence opt2 from Bax__Homo_sapiens__AIO10780
auggacggcuccggcgagcagccccgcggcggcgucuccucccgcaucgagcagggcgaguggggcggcgaggcccccgagcucgcccucgaccccgucccccaggacgccuccaccaagaagcucuccgagugccucaagcgcaucggcgacgagcucgacuccaacauggagcuccagcgcaugaucgccgccgucgacaccgacuccccccgcgaggucuucuuccgcgucgccgccgacauguucuccgacggcaacuucaacuggggccgcgucgucgcccucuucuacuucgccuccaagcucguccucaaggcccucugcaccaagguccccgagcucauccgcaccaucaugggcuggacccucgacuuccuccgcgagcgccuccucggcuggauccaggaccagggcggcuggggccucccccucgccgagucccucaagcgccucaugucccucucccccggccgccccccccuccuccucugggacgcccacgucgccgaccgcgaccaccucugcggcggcuccgcccaccgccucacccaccaccucgaggaggacggccuccgcccccccgccgcccucgacugcgucuucccccccuga

SEQ ID NO: 6949 - RNA, 615 nt, Artificial Sequence
  derived and/or modified sequence opt3 from Bax__Homo_sapiens__AIO10780
auggacggcagcggggagcagcccagaggagguguguccucuaggaucgaacaaggcgaguggggaggggaagccccugagcuggcucucgauccagucccgcaggacgcaucaaccaagaaacuuagugaaugccugaagcggauuggcgaugaguuggacagcaacauggaguuacagcgcaugauagccgcgguugauacagacucuccccgagaaguguucuuucguguagcugccgauauguucuccgacgguaauuuuaacugggggagaguggucgcacuguucuacuuugccucgaagcuagugcucaaagcucuguguacuaaaguuccugagcuuaucaggacgauuaugggauggacccuggauuucuugcgggaacgccuccugggcuggauccaggaccaaggcggguggggacugccacucgcagagucauuaaagagacugaugagccuuagucccgguaggccuccauugcugcuaugggaugcccacguggcugaccgggaucaucucugcggcggguccgcccaccgccugacacaucaccuugaggaagacggacugcgacccccugcggcauuggacugugucuuuccaccguga

SEQ ID NO: 6950 - RNA, 615 nt, Artificial Sequence
  derived and/or modified sequence opt4 from Bax__Homo_sapiens__AIO10780
auggacggcagcggcgagcagcccagaggcggcgugagcagcagaaucgagcagggcgaguggggcggcgaggcccccgagcuggcccuggaccccgugccccaggacgccagcaccaagaagcugagcgagugccugaagagaaucggcgacgagcuggacagcaacauggagcugcagagaaugaucgccgccguggacaccgacagccccagagagguguucuucagaguggccgccgacauguucagcgacggcaacuucaacuggggcagagugguggcccuguucuacuucgccagcaagcuggugcugaaggcccugugcaccaaggugcccgagcugaucagaaccaucaugggcuggacccuggacuuccugagagagagacugcugggcuggauccaggaccagggcggcuggggccugccccuggccgagagccugaagagacugaugagccugagccccggcagacccccccugcugcugugggacgcccacguggccgacagagaccaccugugcggcggcagcgcccacagacugacccaccaccuggaggaggacggccugagaccccccgccgcccuggacugcguguucccccccuga

SEQ ID NO: 6951 - RNA, 615 nt, Artificial Sequence
  derived and/or modified sequence opt5 from Bax__Homo_sapiens__AIO10780
auggacggcagcggggagcagccccgcggaggcguguccucucggaucgaacaaggggaguggggaggcgaagccccugagcuggcucucgauccggucccccaggacgccagcaccaagaaacuguccgaaugccuuaagcgcauuggggaugagcuggacucuaacauggagcuccagagaaugaucgcggcuguugauacagacagcccucgggaaguguucuuucgcguggccgccgauauguucuccgacggaaauuuuaacuggggcagagucguggcucuguucuacuuugccucuaaacuuguucugaaggcucucuguacgaaagugcccgagcugauucggaccaucaugggcuggacacuggauuuccuccgcgaaagacugcuuggguggauucaggaccaaggaggcugggggcugccucucgccgagagccugaagcggcuuaugucccugagccccggacgcccuccgcuccugcugugggaugcgcacgucgccgacagagaucaucucugcggcgggucugcucaccggcugacccaucaccuugaggaagacggacugagacccccugccgcucucgacuguguguuucccccuuga

SEQ ID NO: 6952 - RNA, 615 nt, Artificial Sequence
  derived and/or modified sequence opt6 from Bax__Homo_sapiens__AIO10780
auggauggaagcggagaacaaccaagaggaggaguaaguaguagaauagaacaaggagaauggggaggagaagcaccagaauuagcacuagauccaguaccacaagaugcaucaacgaaaaaauuaucagaauguuuaaaaagaauaggagaugaauuagauaguaauauggaauuacaaagaaugauagcagcaguagauacagauaguccaagagaaguauuuuuuagaguagcagcagauauguuuagugauggaaauuuuaauuggggaagaguaguagcauuauuuuauuuugcaaguaaauuaguauuaaaagcauuauguacaaaagugccagaauuaauaagaacaauaaugggauggacauuagauuuucugagagaaagauuauuaggauggauucaagaucaaggaggauggggauuaccauuagcagaaagcuuaaaaagauuaaugaguuuaaguccaggaagaccaccauuacuauuaugggaugcacauguagcagauagagaucaucuauguggaggaucagcacauagauuaacacaucauuuagaagaagauggauuaagaccaccagcagcauuagauuguguauuuccaccauaa

SEQ ID NO: 6953 - protein, 175 aa, Artificial Sequence
  Bax__Homo_sapiens__A0A0C4MW46
MDGSGEQPRGGVSSRIEQGEWGGEAPELALDPVPQDASTKKLSECLKRIGDELDSNMELQRMIAAVDTDSPREVFFRVAADMFSDGNFNWGRVVALFYFASKLVLKALCTKVPELIRTIMGWTLDFLRERLLGWIQDQGGWDGLLSYFGTPTWQTVTIFVAGVLTASLTIWKKMG

SEQ ID NO: 6954 - RNA, 528 nt, Artificial Sequence
  Bax__Homo_sapiens__AIO10778
auggacggguccggggagcagcccagaggcgggguuucauccaggaucgagcagggcgaaugggggggggaggcacccgagcuggcccuggacccggugccucaggaugcguccaccaagaagcugagcgagugucucaagcgcaucggggacgaacuggacaguaacauggagcugcagaggaugauugccgccguggacacagacuccccccgagaggucuuuuuccgaguggcagcugacauguuuucugacggcaacuucaacuggggccggguugucgcccuuuucuacuuugccagcaaacuggugcucaaggcccugugcaccaaggugccggaacugaucagaaccaucaugggcuggacauuggacuuccuccgggagcggcuguugggcuggauccaagaccagggugguugggacggccuccucuccuacuuugggacgcccacguggcagaccgugaccaucuuuguggcgggagugcucaccgccucacucaccaucuggaagaagaugggcuga

SEQ ID NO: 6955 - RNA, 528 nt, Artificial Sequence
  derived and/or modified sequence opt1 from Bax__Homo_sapiens__AIO10778
auggacggcagcggggagcagccccgcggcgggguguccagccggaucgagcagggcgaguggggcggggaggccccggagcuggcccucgaccccgucccccaggacgcguccaccaagaagcugagcgagugccugaagcgcaucggcgacgagcucgacuccaacauggagcugcagcggaugaucgccgccguggacaccgacagcccccgcgagguguucuuccgggucgccgccgacauguucuccgacgggaacuucaacuggggccgcgugguggcgcuguucuacuucgccagcaagcucguccugaaggcccugugcacgaaggugccggagcucauccggaccaucaugggguggacccuggacuuccugcgcgagcggcuccugggcuggauccaggaccagggcgggugggacggccugcucuccuacuucgggacccccacguggcagaccgugaccaucuucgucgccggcgugcugaccgcgagccugacgaucuggaagaagaugggguga

SEQ ID NO: 6956 - RNA, 528 nt, Artificial Sequence
  derived and/or modified sequence opt2 from Bax__Homo_sapiens__AIO10778
auggacggcuccggcgagcagccccgcggcggcgucuccucccgcaucgagcagggcgaguggggcggcgaggcccccgagcucgcccucgaccccgucccccaggacgccuccaccaagaagcucuccgagugccucaagcgcaucggcgacgagcucgacuccaacauggagcuccagcgcaugaucgccgccgucgacaccgacuccccccgcgaggucuucuuccgcgucgccgccgacauguucuccgacggcaacuucaacuggggccgcgucgucgcccucuucuacuucgccuccaagcucguccucaaggcccucugcaccaagguccccgagcucauccgcaccaucaugggcuggacccucgacuuccuccgcgagcgccuccucggcuggauccaggaccagggcggcugggacggccuccucuccuacuucggcacccccaccuggcagaccgucaccaucuucgucgccggcguccucaccgccucccucaccaucuggaagaagaugggcuga

SEQ ID NO: 6957 - RNA, 528 nt, Artificial Sequence
  derived and/or modified sequence opt3 from Bax__Homo_sapiens__AIO10778
auggacggcagcggggagcagcccagaggagguguguccucuaggaucgaacaaggcgaguggggaggggaagccccugagcuggcucucgauccagucccgcaggacgcaucaaccaagaaacuuagugaaugccugaagcggauuggcgaugaguuggacagcaacauggaguuacagcgcaugauagccgcgguugauacagacucuccccgagaaguguucuuucguguagcugccgauauguucuccgacgguaauuuuaacugggggagaguggucgcacuguucuacuuugccucgaagcuagugcucaaagcucuguguacuaaaguuccugagcuuaucaggacgauuaugggauggacccuggauuucuugcgggaacgccuccugggcuggauccaggaccaaggcgggugggauggacugcucucauauuuugguacaccaacuuggcagaccgugacaauuuucgucgcaggcguguuaaccgccagccugacuaucuggaagaagaugggguga

SEQ ID NO: 6958 - RNA, 528 nt, Artificial Sequence
  derived and/or modified sequence opt4 from Bax__Homo_sapiens__AIO10778
auggacggcagcggcgagcagcccagaggcggcgugagcagcagaaucgagcagggcgaguggggcggcgaggcccccgagcuggcccuggaccccgugccccaggacgccagcaccaagaagcugagcgagugccugaagagaaucggcgacgagcuggacagcaacauggagcugcagagaaugaucgccgccguggacaccgacagccccagagagguguucuucagaguggccgccgacauguucagcgacggcaacuucaacuggggcagagugguggcccuguucuacuucgccagcaagcuggugcugaaggcccugugcaccaaggugcccgagcugaucagaaccaucaugggcuggacccuggacuuccugagagagagacugcugggcuggauccaggaccagggcggcugggacggccugcugagcuacuucggcacccccaccuggcagaccgugaccaucuucguggccggcgugcugaccgccagccugaccaucuggaagaagaugggcuga

SEQ ID NO: 6959 - RNA, 528 nt, Artificial Sequence
  derived and/or modified sequence opt5 from Bax__Homo_sapiens__AIO10778
auggacggcagcggggagcagcccagaggaggcguguccucucggaucgaacaaggggaguggggaggcgaagccccugagcuggcucucgauccggucccccaggacgccagcaccaagaaacuguccgaaugccuuaagcgcauuggggaugagcuggacucuaacauggagcuccagagaaugaucgcggcuguugauacagacagcccucgggaaguguucuuucgcguggccgccgauauguucuccgacggaaauuuuaacuggggcagagucguggcucuguucuacuuugccucuaaacuuguucugaaggcucucuguacgaaagugcccgagcugauucggaccaucaugggcuggacacuggauuuccuccgcgaaagacugcuuggguggauucaggaccaaggaggcugggaugggcugcucagcuauuuuggaaccccuacauggcagaccgucacaaucuucguggccggcguucugaccgcgucccuuacgaucuggaagaagaugggguga

SEQ ID NO: 6960 - RNA, 528 nt, Artificial Sequence
  derived and/or modified sequence opt6 from Bax__Homo_sapiens__AIO10778
auggacggaaguggagaacaaccaagaggaggaguaucaaguagaauagaacaaggagaauggggaggagaagcaccagaauuagcauuagauccaguaccacaagaugcaaguacaaaaaaauuaagugaauguuuaaaaagaauaggagaugaacuagauaguaauauggaauuacaaagaaugauagcagcaguagauacagauaguccaagagaaguauuuuuuagaguagcagcagauauguuuagugauggaaauuuuaauuggggaagaguaguagcauuauuuuauuuugcaaguaaacuaguauuaaaagcauuauguacaaaaguaccagaacuaauaagaacaauaaugggauggacauuagauuuuuuaagagaaagauuguuaggauggauacaagaucaaggaggaugggauggauuauuaaguuauuuuggaacaccaacauggcaaacaguaacaauauuuguagcaggaguauugacagcaaguuuaacaauauggaaaaaaaugggauaa

SEQ ID NO: 6961 - protein, 204 aa, Artificial Sequence
  Bax__Homo_sapiens__A0A0C4MWS3
MDGSGEQPRGGGFHPGSSRANGGEAPELALDPVPQDASTKKLSECLKRIGDELDSNMELQRMIAAVDTDSPREVFFRVAADMFSDGNFNWGRVVALFYFASKLVLKALCTKVPELIRTIMGWTLDFLRERLLGWIQDQGGWGLPLAESLKRLMSLSPGRPPLLLWDAHVADRDHLCGGSAHRLTHHLEEDGLRPPAALDCVFPP

SEQ ID NO: 6962 - RNA, 615 nt, Artificial Sequence
  Bax__Homo_sapiens__AIO10779
auggacggguccggggagcagcccagaggcgggggguuucauccaggaucgagcagggcgaaugggggggaggcacccgagcuggcccuggacccggugccucaggaugcguccaccaagaagcugagcgagugucucaagcgcaucggggacgaacuggacaguaacauggagcugcagaggaugauugccgccguggacacagacuccccccgagaggucuuuuuccgaguggcagcugacauguuuucugacggcaacuucaacuggggccggguugucgcccuuuucuacuuugccagcaaacuggugcucaaggcccugugcaccaaggugccggaacugaucagaaccaucaugggcuggacauuggacuuccuccgggagcggcuguugggcuggauccaagaccagggugguugggggcugccccuggccgagucacugaagcgacugaugucccugucuccaggacggccuccucuccuacuuugggacgcccacguggcagaccgugaccaucuuuguggcgggagugcucaccgccucacucaccaucuggaagaagaugggcugaggcccccagcugccuuggacuguguuuuuccuccauaa

SEQ ID NO: 6963 - RNA, 615 nt, Artificial Sequence
  derived and/or modified sequence opt1 from Bax__Homo_sapiens__AIO10779
auggacggcagcggggagcagccccgcggcgggggcuuccaccccggguccagccgggccaacggcggcgaggcccccgagcuggcgcucgaccccgugccccaggacgccuccaccaagaagcugagcgagugccugaagcgcaucggggacgagcucgacuccaacauggagcugcagcggaugaucgccgccgucgacaccgacagcccgcgcgagguguucuuccggguggccgcggacauguucuccgacggcaacuucaacugggggcgcgucguggcccuguucuacuucgccagcaagcucgugcugaaggcccugugcacgaagguccccgagcucauccggaccaucaugggcuggacccuggacuuccugcgcgagcggcuccugggguggauccaggaccagggcggcugggggcugccccucgcggagucccugaagcgccugaugagccucucccccggccggccgccccugcugcucugggacgcccacguggccgaccgcgaccaccugugcgggggcagcgcccaccggcugacccaccaccucgaggaggacggccugcgcccgcccgccgcgcuggacugcguguucccgcccuga

SEQ ID NO: 6964 - RNA, 615 nt, Artificial Sequence
  derived and/or modified sequence opt2 from Bax__Homo_sapiens__AIO10779
auggacggcuccggcgagcagccccgcggcggcggcuuccaccccggcuccucccgcgccaacggcggcgaggcccccgagcucgcccucgaccccgucccccaggacgccuccaccaagaagcucuccgagugccucaagcgcaucggcgacgagcucgacuccaacauggagcuccagcgcaugaucgccgccgucgacaccgacuccccccgcgaggucuucuuccgcgucgccgccgacauguucuccgacggcaacuucaacuggggccgcgucgucgcccucuucuacuucgccuccaagcucguccucaaggcccucugcaccaagguccccgagcucauccgcaccaucaugggcuggacccucgacuuccuccgcgagcgccuccucggcuggauccaggaccagggcggcuggggccucccccucgccgagucccucaagcgccucaugucccucucccccggccgccccccccuccuccucugggacgcccacgucgccgaccgcgaccaccucugcggcggcuccgcccaccgccucacccaccaccucgaggaggacggccuccgcccccccgccgcccucgacugcgucuucccccccuga

SEQ ID NO: 6965 - RNA, 615 nt, Artificial Sequence
  derived and/or modified sequence opt3 from Bax__Homo_sapiens__AIO10779
auggacggcagcggggagcagcccagaggagguggcuuccacccuggguccucuagggccaacggaggcgaagcuccagagcuggcacucgauccggugccccaggacgccucaaccaagaaacuuagugaaugccugaagcggaucggugaugaguuggacagcaauauggaauuacagcgcaugauugcggcugucgauacagacuccccucgagagguguuuuuccguguugccgcagauauguuuucugacgggaacuucaauuggggaagaguaguggcccuguuuuacuucgcuucgaaauugguccucaaggcacuguguacuaaagugccagagcuuauaaggacgaucaugggcuggacccuggauuuucuacgggaacgccuccugggcuggauucaggaccaagggggauggggucugccccucgccgagucauuaaagagacugaugagccuuaguccuggcaggccacccuugcugcuaugggaugcucauguugccgaccgggaucaccucugcgggggauccgcgcaucgccugacacaccaucuugaagaggacggccugcgaccuccagcagccuuggacuguguguucccgcccuga

SEQ ID NO: 6966 - RNA, 615 nt, Artificial Sequence
  derived and/or modified sequence opt4 from Bax__Homo_sapiens__AIO10779
auggacggcagcggcgagcagcccagaggcggcggcuuccaccccggcagcagcagagccaacggcggcgaggcccccgagcuggcccuggaccccgugccccaggacgccagcaccaagaagcugagcgagugccugaagagaaucggcgacgagcuggacagcaacauggagcugcagagaaugaucgccgccguggacaccgacagccccagagagguguucuucagaguggccgccgacauguucagcgacggcaacuucaacuggggcagagugguggcccuguucuacuucgccagcaagcuggugcugaaggcccugugcaccaaggugcccgagcugaucagaaccaucaugggcuggacccuggacuuccugagagagagacugcugggcuggauccaggaccagggcggcuggggccugccccuggccgagagccugaagagacugaugagccugagccccggcagacccccccugcugcugugggacgcccacguggccgacagagaccaccugugcggcggcagcgcccacagacugacccaccaccuggaggaggacggccugagaccccccgccgcccuggacugcguguucccccccuga

SEQ ID NO: 6967 - RNA, 615 nt, Artificial Sequence
  derived and/or modified sequence opt5 from Bax__Homo_sapiens__AIO10779
auggacggcagcggggagcagcccagaggaggcggguuccacccuggauccucucgggccaacggcggggaagcuccggagcuggcccucgaucccgugccucaagacgcgagcaccaagaaacuguccgaaugccuuaagcgcaucggagaugagcuggacucuaauauggaacuccagagaaugauugcugccgucgauacagacagcccccgggagguguuuuuccgcguugccgcugauauguuuuccgacggcaacuucaauuggggcagaguggucgcccuguuuuacuucgcuucuaaacuugugcugaaggcccucuguacgaaaguuccugagcugauccggaccauuaugggguggacacuggauuuucuccgcgaaagacugcuuggauggauccaggaccagggcggguggggacugccccucgcggagagccugaagcggcuuaugucccugagcccuggccgcccgccccuccugcugugggaugcccauguggcugacagagaucaccucugcgggggaucugcccaucggcugacccaccaucuugaagaggacggccugcgcccucccgcugcccucgacugugucuucccucccuga

SEQ ID NO: 6968 - RNA, 615 nt, Artificial Sequence
  derived and/or modified sequence opt6 from Bax__Homo_sapiens__AIO10779
auggauggaaguggagaacaaccaagaggaggaggauuucauccaggaucaagcagagcaaauggaggagaagcaccagaacuagcguuagauccaguaccacaagaugcaaguacaaaaaaauuaucagaauguuuaaaaagaauaggagaugaauuagauaguaauauggaauuacaaagaaugauagcagcaguagauacagauaguccaagagaaguauuuuuuagaguagcagcagauauguuuagugauggaaauuuuaauuggggaagaguaguagcauuauuuuauuuugcaucaaaauuaguauuaaaagcauuauguacaaaaguaccagaauuaauaagaacaauaaugggauggacacuagauuuuuuaagagaaagauuacuaggguggauacaagaucaaggaggauggggauuaccacuagcagaaaguuuaaaaagauuaaugaguuuaaguccaggaagaccaccauuauuacuaugggaugcacauguugcagacagagaucauuuauguggaggaucagcacauagauuaacacaucaucuagaagaagauggacuuagaccaccagcagcauuagauuguguuuuuccaccauaa

SEQ ID NO: 6969 - protein, 140 aa, Artificial Sequence
  Bax__Homo_sapiens__I6LPK7
MIAAVDTDSPREVFFRVAADMFSDGNFNWGRVVALFYFASKLVLKALCTKVPELIRTIMGWTLDFLRERLLGWIQDQGGWVRLLKPPHPHHRALTTAPAPPSLPPATPLGPWAFWSRSQWCPLPIFRSSDVVYNAFSLRV

SEQ ID NO: 6970 - RNA, 423 nt, Artificial Sequence
  Bax__Homo_sapiens__ADZ05507
augauugccgccguggacacagacuccccccgagaggucuuuuuccgaguggcagcugacauguuuucugacggcaacuucaacuggggccggguugucgcccuuuucuacuuugccagcaaacuggugcucaaggcccugugcaccaaggugccggaacugaucagaaccaucaugggcuggacauuggacuuccuccgggagcggcuguugggcuggauccaagaccagggugguugggugagacuccucaagccuccucacccccaccaccgcgcccucaccaccgccccugccccaccgucccugccccccgccacuccucugggacccugggccuucuggagcaggucacaguggugcccucuccccaucuucagaucaucagauguggucuauaaugcguuuuccuuacgugucuga

SEQ ID NO: 6971 - RNA, 423 nt, Artificial Sequence
  derived and/or modified sequence opt1 from Bax__Homo_sapiens__ADZ05507
augaucgccgccguggacaccgacagcccccgcgaggucuucuuccggguggcggccgacauguucuccgacggcaacuucaacugggggcgcguggucgcccuguucuacuucgccagcaagcucgugcugaaggcccugugcaccaaggugccggagcucauccggacgaucaugggcuggacccuggacuuccugcgcgagcggcuccugggguggauccaggaccagggcggguggguccgccugcucaagccgccccacccccaccaccgggcgcugaccaccgcccccgccccgcccucccugccgcccgccacgccccucggccccugggcguucuggagccgcucccaguggugcccccugcccaucuuccggagcuccgacgugguguacaacgccuucagccugcgcgucuga

SEQ ID NO: 6972 - RNA, 423 nt, Artificial Sequence
  derived and/or modified sequence opt2 from Bax__Homo_sapiens__ADZ05507
augaucgccgccgucgacaccgacuccccccgcgaggucuucuuccgcgucgccgccgacauguucuccgacggcaacuucaacuggggccgcgucgucgcccucuucuacuucgccuccaagcucguccucaaggcccucugcaccaagguccccgagcucauccgcaccaucaugggcuggacccucgacuuccuccgcgagcgccuccucggcuggauccaggaccagggcggcuggguccgccuccucaagcccccccacccccaccaccgcgcccucaccaccgcccccgccccccccucccucccccccgccaccccccucggccccugggccuucuggucccgcucccaguggugcccccuccccaucuuccgcuccuccgacgucgucuacaacgccuucucccuccgcgucuga

SEQ ID NO: 6973 - RNA, 423 nt, Artificial Sequence
  derived and/or modified sequence opt3 from Bax__Homo_sapiens__ADZ05507
augaucgccgcuguggacaccgauagccccagagaggucuucuuuaggguugcagccgacauguucuccgauggcaacuuuaauugggggcgggugguagcgcuguucuacuuugcuucuaagcucgugcuuaaagcccugugcacaaaggucccugaauugauucgcacuauaaugggauggacguuagacuuccugcgagagcgucuacucgguuggauccaggaucaaggcgggugggugagacugcuuaaaccaccgcacccccaucacagggcacugaccacagccccugcuccacccucauugccuccagcaacuccccucggaccuugggccuuuuggagucggagccagugguguccacugccgauuuuccgcuccucugacguuguguauaacgcuuuuucgcugagagucuga

SEQ ID NO: 6974 - RNA, 423 nt, Artificial Sequence
  derived and/or modified sequence opt4 from Bax__Homo_sapiens__ADZ05507
augaucgccgccguggacaccgacagccccagagagguguucuucagaguggccgccgacauguucagcgacggcaacuucaacuggggcagagugguggcccuguucuacuucgccagcaagcuggugcugaaggcccugugcaccaaggugcccgagcugaucagaaccaucaugggcuggacccuggacuuccugagagagagacugcugggcuggauccaggaccagggcggcugggugagacugcugaagcccccccacccccaccacagagcccugaccaccgcccccgccccccccagccugccccccgccaccccccugggccccugggccuucuggagcagaagccaguggugcccccugcccaucuucagaagcagcgacgugguguacaacgccuucagccugagaguguga

SEQ ID NO: 6975 - RNA, 423 nt, Artificial Sequence
  derived and/or modified sequence opt5 from Bax__Homo_sapiens__ADZ05507
augaucgccgcuguggacaccgauagccccagagaggucuucuuucggguugccgcggacauguucuccgauggcaacuuuaauugggggcgcgugguggcucuguucuacuuugccucuaagcucguccugaaagcccuuugcacaaaggugccugaacugauuagaacgaucaugggauggacccucgacuuccugcgggagcgccuucugggcuggauucaggaucaagggggauggguuagacuccugaaaccgccccacccucaucaccgggcucugacaaccgcccccgcuccucccagccucccuccggccacaccccugggcccuugggcguuuuggucccgcucucagugguguccccuuccuaucuucagaagcuccgacguggucuauaacgccuuuucucugcggguguga

SEQ ID NO: 6976 - RNA, 423 nt, Artificial Sequence
  derived and/or modified sequence opt6 from Bax__Homo_sapiens__ADZ05507
augauagcagcaguagauacagauucaccaagagaaguauuuuucagaguagcagcagauauguuuucagauggaaauuucaauuggggaagaguaguagcacuauuuuacuuugcaucaaaauuaguauuaaaagcauuauguacaaaaguaccagaauuaauaagaacaauaaugggauggacacuagauuucuuaagagaaagauuacuaggauggauacaagaucaaggaggauggguaagacuauuaaaaccaccacauccacaucaccgagcauuaacaacagcaccagcaccaccaucacuaccaccagcaacaccacuaggaccaugggcauuuuggucaagaagucaauggugcccacuaccaauauuuagaucaucagauguaguauacaaugcauuuucauuaagaguauaa

SEQ ID NO: 6977 - protein, 175 aa, Artificial Sequence
  Bax__Homo_sapiens__K4JQN1
MDGSGEQPRGGGFHPGSSRANGGEAPELALDPVPQDASTKKLSECLKRIGDELDSNMELQRMIAAVDTDSPREVFFRVAADMFSDGNFNWGRVVALFYFASKLVLKALCTKVPELIRTIMGWTLDFLRERLLGWIQDQGGWDGLLSYFGTPTWQTVTIFVAGVLTASLTIWKKMG

SEQ ID NO: 6978 - RNA, 528 nt, Artificial Sequence
  Bax__Homo_sapiens__AFU81108
auggacggguccggggagcagcccagaggcgggggguuucauccaggaucgagcagggcgaaugggggggaggcacccgagcuggcccuggacccggugccucaggaugcguccaccaagaagcugagcgagugucucaagcgcaucggggacgaacuggacaguaacauggagcugcagaggaugauugccgccguggacacagacuccccccgagaggucuuuuuccgaguggcagcugacauguuuucugacggcaacuucaacuggggccggguugucgcccuuuucuacuuugccagcaaacuggugcucaaggcccugugcaccaaggugccggaacugaucagaaccaucaugggcuggacauuggacuuccuccgggagcggcuguugggcuggauccaagaccagggugguugggacggccuccucuccuacuuugggacgcccacguggcagaccgugaccaucuuuguggcgggagugcucaccgccucacucaccaucuggaagaagaugggcuga

SEQ ID NO: 6979 - RNA, 528 nt, Artificial Sequence
  derived and/or modified sequence opt1 from Bax__Homo_sapiens__AFU81108
auggacggcagcggggagcagccccgcggcgggggcuuccacccgggguccagccgggccaacggcggcgaggcccccgagcuggcgcucgaccccgugccccaggacgccuccaccaagaagcugagcgagugccugaagcgcaucggggacgagcucgacuccaacauggagcugcagcggaugaucgccgccgucgacaccgacagcccgcgcgagguguucuuccggguggccgcggacauguucuccgacggcaacuucaacugggggcgcgucguggcccuguucuacuucgccagcaagcucgugcugaaggcccugugcacgaagguccccgagcucauccggaccaucaugggcuggacccuggacuuccugcgcgagcggcuccugggguggauccaggaccagggcggcugggacgggcugcucuccuacuucggcacccccacguggcagaccgugaccaucuucguggcggggguccugaccgccagccugacgaucuggaagaagaugggcuga

SEQ ID NO: 6980 - RNA, 528 nt, Artificial Sequence
  derived and/or modified sequence opt2 from Bax__Homo_sapiens__AFU81108
auggacggcuccggcgagcagccccgcggcggcggcuuccaccccggcuccucccgcgccaacggcggcgaggcccccgagcucgcccucgaccccgucccccaggacgccuccaccaagaagcucuccgagugccucaagcgcaucggcgacgagcucgacuccaacauggagcuccagcgcaugaucgccgccgucgacaccgacuccccccgcgaggucuucuuccgcgucgccgccgacauguucuccgacggcaacuucaacuggggccgcgucgucgcccucuucuacuucgccuccaagcucguccucaaggcccucugcaccaagguccccgagcucauccgcaccaucaugggcuggacccucgacuuccuccgcgagcgccuccucggcuggauccaggaccagggcggcugggacggccuccucuccuacuucggcacccccaccuggcagaccgucaccaucuucgucgccggcguccucaccgccucccucaccaucuggaagaagaugggcuga

SEQ ID NO: 6981 - RNA, 528 nt, Artificial Sequence
  derived and/or modified sequence opt3 from Bax__Homo_sapiens__AFU81108
auggacggcagcggggagcagcccagaggagguggcuuccacccuggguccucuagggccaacggaggcgaagcuccagagcuggcacucgauccggugccccaagacgccucaaccaagaaacuuagugaaugccugaagcggaucggugaugaguuggacagcaauauggaauuacagcgcaugauugcggcugucgauacagacuccccucgagagguguuuuuccguguugccgcagauauguuuucugacgggaacuucaauuggggaagaguaguggcccuguuuuacuucgcuucgaaauugguccucaaggcacuguguacuaaagugccagagcuuauaaggacgaucaugggcuggacccuggauuuucuacgggaacgccuccugggcuggauucaggaccaagggggaugggauggucugcucucauauuucggcacacccacuuggcagaccguuacaaucuuuguggccggggucuuaaccgcuagccugacuauuuggaagaagaugggauga

SEQ ID NO: 6982 - RNA, 528 nt, Artificial Sequence
  derived and/or modified sequence opt4 from Bax__Homo_sapiens__AFU81108
auggacggcagcggcgagcagcccagaggcggcggcuuccaccccggcagcagcagagccaacggcggcgaggcccccgagcuggcccuggaccccgugccccaggacgccagcaccaagaagcugagcgagugccugaagagaaucggcgacgagcuggacagcaacauggagcugcagagaaugaucgccgccguggacaccgacagccccagagagguguucuucagaguggccgccgacauguucagcgacggcaacuucaacuggggcagagugguggcccuguucuacuucgccagcaagcuggugcugaaggcccugugcaccaaggugcccgagcugaucagaaccaucaugggcuggacccuggacuuccugagagagagacugcugggcuggauccaggaccagggcggcugggacggccugcugagcuacuucggcacccccaccuggcagaccgugaccaucuucguggccggcgugcugaccgccagccugaccaucuggaagaagaugggcuga

SEQ ID NO: 6983 - RNA, 528 nt, Artificial Sequence
  derived and/or modified sequence opt5 from Bax__Homo_sapiens__AFU81108
auggacggcagcggggagcagcccagaggaggcggguuccacccuggauccucucgggccaacggcggggaagcuccggagcuggcccucgaucccgugccucaagacgcgagcaccaagaaacuguccgaaugccuuaagcgcaucggagaugagcuggacucuaauauggaacuccagagaaugauugcugccgucgauacagacagcccccgggagguguuuuuccgcguugccgcugauauguuuuccgacggcaacuucaauuggggcagaguggucgcccuguuuuacuucgcuucuaaacuugugcugaaggcccucuguacgaaaguuccugagcugauccggaccauuaugggguggacacuggauuuucuccgcgaaagacugcuuggauggauccaggaccagggcgggugggauggacugcucagcuauuucggcacccccacauggcaaaccgugacaauuuuugucgcgggggugcugaccgccucccuuacgaucuggaagaagaugggauga

SEQ ID NO: 6984 - RNA, 528 nt, Artificial Sequence
  derived and/or modified sequence opt6 from Bax__Homo_sapiens__AFU81108
auggauggaaguggggaacaaccaagaggaggaggauuucauccaggaaguaguagagcaaauggaggagaagcuccagaauuagcauuagauccaguaccacaagaugcaaguacaaaaaaauuaagugaauguuuaaaaagaauaggagaugaauuagauaguaauauggaauuacaaagaaugauagcagcaguagauacagauucaccaagagaaguauuuuuuagaguagcagcagauauguuuagugauggaaauuuuaauugggguagaguaguagcauuauuuuauuuugcaaguaaauuaguacuaaaagcauuauguacaaaaguaccagaauuaauaagaacaauaaugggauggacauuagauuuuuuaagggaaagauuauuaggauggauacaagaucaaggaggaugggauggauuauuaagcuauuuuggaacaccaacauggcaaacaguaacaauauuuguagcaggaguauuaacagcaaguuuaacaauauggaaaaaaaugggauaa

SEQ ID NO: 6985 - protein, 192 aa, Artificial Sequence
  Bax__Homo_sapiens__Q07812
MDGSGEQPRGGGPTSSEQIMKTGALLLQGFIQDRAGRMGGEAPELALDPVPQDASTKKLSECLKRIGDELDSNMELQRMIAAVDTDSPREVFFRVAADMFSDGNFNWGRVVALFYFASKLVLKALCTKVPELIRTIMGWTLDFLRERLLGWIQDQGGWDGLLSYFGTPTWQTVTIFVAGVLTASLTIWKKMG

SEQ ID NO: 6986 - RNA, 579 nt, Artificial Sequence
  Bax__Homo_sapiens__AAA03619
auggacggguccggggagcagcccagaggcggggggcccaccagcucugagcagaucaugaagacaggggcccuuuugcuucaggguuucauccaggaucgagcagggcgaauggggggggaggcacccgagcuggcccuggacccggugccucaggaugcguccaccaagaagcugagcgagugucucaagcgcaucggggacgaacuggacaguaacauggagcugcagaggaugauugccgccguggacacagacuccccccgagaggucuuuuuccgaguggcagcugacauguuuucugacggcaacuucaacuggggccggguugucgcccuuuucuacuuugccagcaaacuggugcucaaggcccugugcaccaaggugccggaacugaucagaaccaucaugggcuggacauuggacuuccuccgggagcggcuguugggcuggauccaagaccagggugguugggacggccuccucuccuacuuugggacgcccacguggcagaccgugaccaucuuuguggcgggagugcucaccgccucgcucaccaucuggaagaagaugggcuga

SEQ ID NO: 6987 - RNA, 579 nt, Artificial Sequence
  derived and/or modified sequence opt1 from Bax__Homo_sapiens__AAA03619
auggacggcagcggggagcagccccgcggcgggggcccgaccuccagcgagcagaucaugaagaccggggcccugcuccugcagggcuucauccaggaccgggccggccgcaugggcggggaggcgcccgagcuggcccucgaccccgugccccaggacgccuccacgaagaagcugagcgagugccugaagcggaucggggacgagcucgacuccaacauggagcugcagcgcaugaucgccgccgucgacaccgacagcccgcgggagguguucuuccgcguggcggccgacauguucuccgacggcaacuucaacugggggcgggucguggcccuguucuacuucgccagcaagcucgugcugaaggcgcugugcaccaagguccccgagcucauccgcaccaucaugggcuggacgcuggacuuccugcgggagcgccuccugggcuggauccaggaccagggcgggugggacgggcugcucuccuacuucggcacccccaccuggcagaccgugacgaucuucguggccggcguccugaccgccagccugaccaucuggaagaagaugggguga

SEQ ID NO: 6988 - RNA, 579 nt, Artificial Sequence
  derived and/or modified sequence opt2 from Bax__Homo_sapiens__AAA03619
auggacggcuccggcgagcagccccgcggcggcggccccaccuccuccgagcagaucaugaagaccggcgcccuccuccuccagggcuucauccaggaccgcgccggccgcaugggcggcgaggcccccgagcucgcccucgaccccgucccccaggacgccuccaccaagaagcucuccgagugccucaagcgcaucggcgacgagcucgacuccaacauggagcuccagcgcaugaucgccgccgucgacaccgacuccccccgcgaggucuucuuccgcgucgccgccgacauguucuccgacggcaacuucaacuggggccgcgucgucgcccucuucuacuucgccuccaagcucguccucaaggcccucugcaccaagguccccgagcucauccgcaccaucaugggcuggacccucgacuuccuccgcgagcgccuccucggcuggauccaggaccagggcggcugggacggccuccucuccuacuucggcacccccaccuggcagaccgucaccaucuucgucgccggcguccucaccgccucccucaccaucuggaagaagaugggcuga

SEQ ID NO: 6989 - RNA, 579 nt, Artificial Sequence
  derived and/or modified sequence opt3 from Bax__Homo_sapiens__AAA03619
auggacggcagcggggagcagcccagaggagguggcccuaccuccucugaacaaaucaugaagacaggggcccugcuccuucagggauucauucaggauagggcuggccggauggguggggaggcaccagaacuggccuuggacccggugccccaggaugcgucaacuaaaaaguuaagugagugccugaaacgcauaggagacgaacuagauagcaacauggagcuccaacgaaugaucgcugccgucgacacggauuccccucgugagguguuuuucagaguugcagccgacauguuuucugauggcaauuucaacuggggcaggguaguggcucuguuuuacuucgcaucgaaacuuguccugaaggccuuguguaccaaggugccagaacucauucggacaaucaugggguggacucuggacuuucugcgcgagagacucuuaggauggauucaggaucaggguggcugggacgggcugcuuucauauuucggaacccccacauggcagaccguuacuaucuuuguggcuggcgucuugacagccagccugaccauauggaagaaaauggguuga

SEQ ID NO: 6990 - RNA, 579 nt, Artificial Sequence
  derived and/or modified sequence opt4 from Bax__Homo_sapiens__AAA03619
auggacggcagcggcgagcagcccagaggcggcggccccaccagcagcgagcagaucaugaagaccggcgcccugcugcugcagggcuucauccaggacagagccggcagaaugggcggcgaggcccccgagcuggcccuggaccccgugccccaggacgccagcaccaagaagcugagcgagugccugaagagaaucggcgacgagcuggacagcaacauggagcugcagagaaugaucgccgccguggacaccgacagccccagagagguguucuucagaguggccgccgacauguucagcgacggcaacuucaacuggggcagagugguggcccuguucuacuucgccagcaagcuggugcugaaggcccugugcaccaaggugcccgagcugaucagaaccaucaugggcuggacccuggacuuccugagagagagacugcugggcuggauccaggaccagggcggcugggacggccugcugagcuacuucggcacccccaccuggcagaccgugaccaucuucguggccggcgugcugaccgccagccugaccaucuggaagaagaugggcuga

SEQ ID NO: 6991 - RNA, 579 nt, Artificial Sequence
  derived and/or modified sequence opt5 from Bax__Homo_sapiens__AAA03619
auggacggcagcggggagcagcccagaggaggcgggccuaccuccucugaacaaaucaugaagacaggagcccugcuccugcagggcuucauucaggaucgggcugggcgcaugggaggcgaggccccggaacuugcgcuggaccccgugccucaggaugcuagcacgaaaaagcucuccgagugccugaaaagaaucggcgacgaacuugauucuaacauggagcugcaacggaugauugccgccgucgacaccgauagcccccgcgagguguuuuucagaguugcugccgacauguuuuccgaugggaauuucaacuggggacggguggucgcucucuuuuacuucgccucuaagcuggugcugaaagcgcucuguacaaagguuccugaacugauccgcaccauuaugggcuggacacuugacuuucugagagagcggcuccugggguggauccaggaucagggaggcugggacgggcuucugagcuauuucggaacccccacauggcagaccgugacgaucuuugucgccggcgugcucaccgcuucccugacaauuuggaagaaaaugggcuga

SEQ ID NO: 6992 - RNA, 579 nt, Artificial Sequence
  derived and/or modified sequence opt6 from Bax__Homo_sapiens__AAA03619
auggauggaaguggagaacaaccaagaggaggaggaccaacaagcagugaacaaauaaugaaaacaggagcauuauuauuacaaggauuuauacaagauagagcaggaagaaugggaggagaagcaccagaauuagcauuagauccaguaccacaagaugcaagcacaaaaaaacuaagcgaaugcuuaaaaagaauaggagaugaauuagauaguaauauggaauuacaaagaaugauagcagcaguagauacagauaguccaagagaaguauuuuucagaguagcagcagauauguuuagugacggaaauuuuaauuggggaagaguaguagcauuauuuuauuuugcaaguaaauuaguauuaaaagcauuauguacaaaaguaccagaauuaauaagaacaauaaugggauggacauuagauuuucuaagagaaagacuuuuaggauggauacaagaucaaggaggaugggauggacuauuaaguuauuucggaacaccaacauggcaaacaguaacaauauuuguagcaggaguauuaacagcaaguuuaacaauauggaaaaaaauggguuga

SEQ ID NO: 6993 - protein, 233 aa, Artificial Sequence
  Bcl-10__Homo_sapiens__O95999
MEPTAPSLTEEDLTEVKKDALENLRVYLCEKIIAERHFDHLRAKKILSREDTEEISCRTSSRKRAGKLLDYLQENPKGLDTLVESIRREKTQNFLIQKITDEVLKLRNIKLEHLKGLKCSSCEPFPDGATNNLSRSNSDESNFSEKLRASTVMYHPEGESSTTPFFSTNSSLNLPVLEVGRTENTIFSSTTLPRPGDPGAPPLPPDLQLEEEGTCANSSEMFLPLRSRTVSRQ

SEQ ID NO: 6994 - RNA, 702 nt, Artificial Sequence
  Bcl-10__Homo_sapiens__AAC99767
auggagcccaccgcaccgucccucaccgaggaggaccucacugaagugaagaaggacgccuuagaaaauuuacguguauaccugugugagaaaaucauagcugagagacauuuugaucaucuacgugcaaaaaaaauacucaguagagaagacacugaagaaauuucuugucgaacaucaaguagaaaaagggcuggaaaauuguuagacuacuuacaggaaaacccaaaaggucuggacacccuuguugaaucuauucggcgagaaaaaacacagaacuuccugauacagaagauuacagaugaagugcugaaacuuagaaauauaaaacuagaacaucugaaaggacuaaaauguagcaguugugaaccuuuuccagauggagccacgaacaaccucuccagaucaaauucagaugagaguaauuucucugaaaaacugagggcauccacugucauguaccauccagaaggagaauccagcacgacgcccuuuuuuucuacuaauucuucucugaauuugccuguucuagaaguaggcagaacugaaaauaccaucuucucuucaacuacacuucccagaccuggggacccaggggcuccuccuuugccaccagaucuacaguuagaagaagaaggaacuugugcaaacucuagugagauguuucuucccuuaagaucacguacuguuucacgacaauga

SEQ ID NO: 6995 - RNA, 702 nt, Artificial Sequence
  derived and/or modified sequence opt1 from Bcl-10__Homo_sapiens__AAC99767
auggagcccaccgcccccagccugaccgaggaggaccucacggaggugaagaaggacgcccuggagaaccugcgcgucuaccucugcgagaagaucaucgcggagcggcacuucgaccaccuccgcgccaagaagauccugucccgggaggacaccgaggagaucagcugccgcaccuccagccggaagcgcgccggcaagcugcuggacuaccugcaggagaaccccaaggggcucgacacccugguggaguccauccggcgcgagaagacgcagaacuuccugauccagaagaucaccgacgaggugcucaagcugcggaacaucaagcuggagcaccucaagggccugaagugcagcuccugcgagcccuuccccgacggggccaccaacaaccugagccgcuccaacagcgacgaguccaacuucagcgagaagcuccgggccuccaccgucauguaccacccggagggcgagagcuccacgacccccuucuucagcaccaacuccagccugaaccugcccgugcucgagguggggcgcaccgagaacacgaucuucuccagcaccacccugccccggccgggcgaccccggcgcgccgccccugccgcccgaccuccagcuggaggaggaggggaccugcgccaacagcuccgagauguuccugccccuccgcagccggacggucucccgccaguga

SEQ ID NO: 6996 - RNA, 702 nt, Artificial Sequence
  derived and/or modified sequence opt2 from Bcl-10__Homo_sapiens__AAC99767
auggagcccaccgcccccucccucaccgaggaggaccucaccgaggucaagaaggacgcccucgagaaccuccgcgucuaccucugcgagaagaucaucgccgagcgccacuucgaccaccuccgcgccaagaagauccucucccgcgaggacaccgaggagaucuccugccgcaccuccucccgcaagcgcgccggcaagcuccucgacuaccuccaggagaaccccaagggccucgacacccucgucgaguccauccgccgcgagaagacccagaacuuccucauccagaagaucaccgacgagguccucaagcuccgcaacaucaagcucgagcaccucaagggccucaagugcuccuccugcgagcccuuccccgacggcgccaccaacaaccucucccgcuccaacuccgacgaguccaacuucuccgagaagcuccgcgccuccaccgucauguaccaccccgagggcgaguccuccaccacccccuucuucuccaccaacuccucccucaaccuccccguccucgaggucggccgcaccgagaacaccaucuucuccuccaccacccucccccgccccggcgaccccggcgcccccccccucccccccgaccuccagcucgaggaggagggcaccugcgccaacuccuccgagauguuccucccccuccgcucccgcaccgucucccgccaguga

SEQ ID NO: 6997 - RNA, 702 nt, Artificial Sequence
  derived and/or modified sequence opt3 from Bcl-10__Homo_sapiens__AAC99767
auggagcccaccgccccuagccugacagaagaggaccucacugaagugaagaaggaugcucuugagaaccugagagucuacuugugcgaaaagaucauugcagagaggcacuucgaccauuuacgggccaaaaagauacugucccgcgaggauacggaagagaucucuugucgaaccucaagucguaaaagagcgggcaagcuacucgacuaucugcaggaaaauccaaaggggcuugauacacugguugagagcauuaggcgggagaaaacucaaaacuuuuugauccagaagauuaccgacgaagugcucaaacugcgcaauaucaagcuggagcaccucaaaggauuaaagugcuccucuugugaaccguuccccgauggugcuacaaacaaucugucgagaucaaacagcgacgagaguaauuuuuccgaaaaacuuagggccucuaccguaauguaccauccugagggcgagagcuccacuacaccauucuuuucaaccaacaguagcuugaaucugcccgugcuagaagucgggcggacggagaacacuauauucucuuccaccacacucccucgcccaggagaucccggcgcaccuccacugccgcccgaccuucagcuggaagaggaagguacuugcgccaauucaagcgagauguuuuugccucuccgaaguagaaccgugucuaggcaguga

SEQ ID NO: 6998 - RNA, 702 nt, Artificial Sequence
  derived and/or modified sequence opt4 from Bcl-10__Homo_sapiens__AAC99767
auggagcccaccgcccccagccugaccgaggaggaccugaccgaggugaagaaggacgcccuggagaaccugagaguguaccugugcgagaagaucaucgccgagagacacuucgaccaccugagagccaagaagauccugagcagagaggacaccgaggagaucagcugcagaaccagcagcagaaagagagccggcaagcugcuggacuaccugcaggagaaccccaagggccuggacacccugguggagagcaucagaagagagaagacccagaacuuccugauccagaagaucaccgacgaggugcugaagcugagaaacaucaagcuggagcaccugaagggccugaagugcagcagcugcgagcccuuccccgacggcgccaccaacaaccugagcagaagcaacagcgacgagagcaacuucagcgagaagcugagagccagcaccgugauguaccaccccgagggcgagagcagcaccacccccuucuucagcaccaacagcagccugaaccugcccgugcuggaggugggcagaaccgagaacaccaucuucagcagcaccacccugcccagacccggcgaccccggcgcccccccccugccccccgaccugcagcuggaggaggagggcaccugcgccaacagcagcgagauguuccugccccugagaagcagaaccgugagcagacaguga

SEQ ID NO: 6999 - RNA, 702 nt, Artificial Sequence
  derived and/or modified sequence opt5 from Bcl-10__Homo_sapiens__AAC99767
auggagcccaccgccccuagccugacagaagaggaccucacggaagugaagaaagaugcucuggagaaccuuagagucuaccugugcgaaaagaucauugccgagcggcacuucgaccaucuccgcgcgaaaaagauccuguccagagaggauaccgaagagauuucuugucggacaagcucccgcaaaagagcuggcaaacuucuggacuaucuccaggaaaauccgaaggggcuggauacccugguugagucuauccggcgcgagaagacacaaaacuuucucauucagaagaucaccgacgaagugcugaaacuuagaaauaucaagcuggagcaccucaaaggacugaagugcagcuccugugaacccuucccugauggcgccacaaacaaucuuucucggagcaacuccgacgagagcaauuuuucugaaaagcugcgcgccuccaccgugauguaccaucccgagggggagagcucuacgaccccuuucuuuuccacaaacagcucucucaaucugcccguccuggaagugggaagaaccgagaacacaauuuucuccagcaccacgcucccucggccgggcgaucccggggcuccuccccugccucccgaccuucagcuggaagaggaaggaacaugcgccaauuccucugagauguuucucccgcugcgcagcagaaccguuucccggcaguga

SEQ ID NO: 7000 - RNA, 702 nt, Artificial Sequence
  derived and/or modified sequence opt6 from Bcl-10__Homo_sapiens__AAC99767
auggaaccaacagcaccaucacuaaccgaagaagaccuaacagaagucaaaaaagacgcacuagaaaaccuaagaguauaccuaugcgaaaaaauaauagcagaaagacacuucgaccaccuaagagcaaaaaaaauccuauccagagaagacacagaagaaauaucaugcagaacaucaagcagaaaaagagcaggaaaacuauuagacuaccuucaagaaaacccaaaaggcuuagacacucuaguagaauccauaagaagagaaaaaacacaaaacuucuuaauacaaaaaauaacagacgaaguacuaaaauuaagaaacauaaaacuugaacaccuaaaaggacuaaaaugcucaucaugcgaaccauucccagauggagcaacaaacaaccuaucaagaucaaacuccgacgaaucaaacuucuccgaaaaacuacgagcaucaacaguaauguaccacccagaaggagaaagcuccacaacaccauuuuucaguacaaacucaucacuaaaccuaccaguauuagaaguaggaagaacagaaaacacaauauucucaucaacaacacuaccaagaccaggagacccaggagcaccaccacucccaccagaccuacaacuagaagaagaaggaacaugcgccaacucaagcgaaauguuccuaccacuaagaucaagaacaguaucaagacaauaa

SEQ ID NO: 7001 - protein, 195 aa, Artificial Sequence
  Bid__Homo_sapiens__A8ASI8
MDCEVNNGSSLRDECITNLLVFGFLQSCSDNSFRRELDALGHELPVLAPQWEGYDELQTDGNRSSHSRLGRIEADSESQEDIIRNIARHLAQVGDSMDRSIPPGLVNGLALQLRNTSRSEEDRNRDLATALEQLLQAYPRDMEKEKTMLVLALLLAKKVASHTPSLLRDVFHTTVNFINQNLRTYVRSLARNGMD

SEQ ID NO: 7002 - RNA, 588 nt, Artificial Sequence
  Bid__Homo_sapiens__ACD47108
auggacugugaggucaacaacgguuccagccucagggaugagugcaucacaaaccuacugguguuuggcuuccuccaaagcuguucugacaacagcuuccgcagagagcuggacgcacugggccacgagcugccagugcuggcuccccagugggagggcuacgaugagcugcagacugauggcaaccgcagcagccacucccgcuugggaagaauagaggcagauucugaaagucaagaagacaucauccggaauauugccaggcaccucgcccaggucggggacagcauggaccguagcaucccuccgggccuggugaacggccuggcccugcagcucaggaacaccagccggucggaggaggaccggaacagggaccuggccacugcccuggagcagcugcugcaggccuacccuagagacauggagaaggagaagaccaugcuggugcuggcccugcugcuggccaagaagguggccagucacacgccguccuugcuccgugaugucuuucacacaacagugaauuuuauuaaccagaaccuacgcaccuacgugaggagcuuagccagaaaugggauggacuga

SEQ ID NO: 7003 - RNA, 588 nt, Artificial Sequence
  derived and/or modified sequence opt1 from Bid__Homo_sapiens__ACD47108
auggacugcgaggugaacaacggcagcucccugcgcgacgagugcaucaccaaccuccuggucuucggguuccugcagagcugcuccgacaacagcuuccggcgcgagcucgacgcccugggccacgagcugcccgugcucgccccgcagugggagggguacgacgagcugcagaccgacggcaaccgguccagccacucccgccuggggcggaucgaggcggacagcgagucccaggaggacaucauccgcaacaucgcccggcaccucgcccaggugggcgacagcauggaccgcuccaucccgcccggccuggucaacgggcuggcccuccagcugcggaacacgagccgcuccgaggaggaccggaaccgcgaccuggccaccgcgcucgagcagcugcugcaggccuacccccgggacauggagaaggagaagaccaugcucgugcuggcccugcuccuggccaagaagguggcgagccacacccccucccugcuccgcgacgucuuccacacgaccgugaacuucaucaaccagaaccugcggaccuacgugcgcagccuggcccggaacggcauggacuga

SEQ ID NO: 7004 - RNA, 588 nt, Artificial Sequence
  derived and/or modified sequence opt2 from Bid__Homo_sapiens__ACD47108
auggacugcgaggucaacaacggcuccucccuccgcgacgagugcaucaccaaccuccucgucuucggcuuccuccaguccugcuccgacaacuccuuccgccgcgagcucgacgcccucggccacgagcuccccguccucgccccccagugggagggcuacgacgagcuccagaccgacggcaaccgcuccucccacucccgccucggccgcaucgaggccgacuccgagucccaggaggacaucauccgcaacaucgcccgccaccucgcccaggucggcgacuccauggaccgcuccaucccccccggccucgucaacggccucgcccuccagcuccgcaacaccucccgcuccgaggaggaccgcaaccgcgaccucgccaccgcccucgagcagcuccuccaggccuacccccgcgacauggagaaggagaagaccaugcucguccucgcccuccuccucgccaagaaggucgccucccacacccccucccuccuccgcgacgucuuccacaccaccgucaacuucaucaaccagaaccuccgcaccuacguccgcucccucgcccgcaacggcauggacuga

SEQ ID NO: 7005 - RNA, 588 nt, Artificial Sequence
  derived and/or modified sequence opt3 from Bid__Homo_sapiens__ACD47108
auggacugcgaagugaacaauggcagcucccugagagaugaauguaucaccaaccuccuugucuucggguuucugcagucuugcucagacaauaguuucaggcgggaguuggaugccuuaggacacgaacugcccguucuagcuccucaaugggaggguuacgacgaacuccagacagauggcaaccgcagcucccauucucgacuggggcguauugaggcagacucggagucacaggaagauauaaucagaaauauugccaggcaccuugcucaggugggagacagcauggaucggaguaucccaccgggccugguaaacgguuuggcgcuccaacugcgcaauacuuccagaucugaggaagacaggaaccgggaucuggccacggcacucgagcaguuacugcaggccuauccccgcgacauggagaaggagaaaaccaugcuuguguuggcucugcuacucgcaaagaaagucgccagccauacaccuucccugcuucgagauguguuucacacuaccguuaauuucauuaaccagaaucugagaacauacgugaggucauuggcucggaacgggauggacuga

SEQ ID NO: 7006 - RNA, 588 nt, Artificial Sequence
  derived and/or modified sequence opt4 from Bid__Homo_sapiens__ACD47108
auggacugcgaggugaacaacggcagcagccugagagacgagugcaucaccaaccugcugguguucggcuuccugcagagcugcagcgacaacagcuucagaagagagcuggacgcccugggccacgagcugcccgugcuggccccccagugggagggcuacgacgagcugcagaccgacggcaacagaagcagccacagcagacugggcagaaucgaggccgacagcgagagccaggaggacaucaucagaaacaucgccagacaccuggcccaggugggcgacagcauggacagaagcaucccccccggccuggugaacggccuggcccugcagcugagaaacaccagcagaagcgaggaggacagaaacagagaccuggccaccgcccuggagcagcugcugcaggccuaccccagagacauggagaaggagaagaccaugcuggugcuggcccugcugcuggccaagaagguggccagccacacccccagccugcugagagacguguuccacaccaccgugaacuucaucaaccagaaccugagaaccuacgugagaagccuggccagaaacggcauggacuga

SEQ ID NO: 7007 - RNA, 588 nt, Artificial Sequence
  derived and/or modified sequence opt5 from Bid__Homo_sapiens__ACD47108
auggacugcgaagugaacaauggcagcucccugagagaugaauguaucaccaaccuccuggucuucggguuucuucagucuugcagcgacaauuccuuccggcgcgagcuggaugcccucggacacgaacugcccguucuugcuccucaaugggagggcuacgacgaacugcagacagaugggaacagaucuagccauucccggcucggacgcauugaggccgacucugagagccaggaagauaucauuagaaauaucgcgcggcaccuggcucaggugggcgacuccauggaucgcagcauuccgcccgggcuggugaacggacucgcccugcaacuuagaaauacgucucgguccgaggaagaccgcaacagagaucuggccaccgcucucgagcagcugcuucaggccuauccucgggacauggagaaggagaaaacaaugcugguccucgcucugcugcucgccaagaaaguggcgagccauacccccucucugcuucgcgauguuuuucacacaaccgugaauuucaucaaccagaaucugagaacauacguccggucccucgcccgcaacggcauggacuga

SEQ ID NO: 7008 - RNA, 588 nt, Artificial Sequence
  derived and/or modified sequence opt6 from Bid__Homo_sapiens__ACD47108
auggauugcgaaguaaauaacggaucaucacuaagagacgaaugcauaacaaaucuauuaguauuuggauuucuacaaaguuguagcgauaacucauucagaagagaacuagaugcauuaggacaugaauuaccaguacuagcaccacaaugggaaggauaugacgaauuacaaacagauggaaauagaucaagccauaguagacuaggaagaauagaagcagacucagaaucacaagaagacauaauacgaaacauagcaagacacuuagcacaaguaggagacucaauggauagaucgauaccaccaggacuaguaaacggacuagcacuacaacuaagaaacacaaguagaagcgaagaagauagaaauagagaucuagcaacagcacuagaacaacuacuacaagcuuauccaagagacauggaaaaagaaaaaacaaugcuaguacuagcacuauuacucgcaaaaaaaguagcaagucacacaccaagcuuauuaagagacguauuccauacaacaguaaauuucauaaaccaaaacuuaagaacauacguaagaucauuagcaagaaauggaauggacuaa

SEQ ID NO: 7009 - protein, 122 aa, Artificial Sequence
  Bid__Homo_sapiens__B2ZP78
MDCEVNNGSSLRDECITNLLVFGFLQSCSDNSFRRELDALGHELPVLAPQWEGYDELQTDGNRSSHSRLGRIEAGASDNNTASAEEETEAAGSVAVERGLHGAATVVLGQGQHGGCAPEEED

SEQ ID NO: 7010 - RNA, 369 nt, Artificial Sequence
  Bid__Homo_sapiens__ACD47106
auggacugugaggucaacaacgguuccagccucagggaugagugcaucacaaaccuacugguguuuggcuuccuccaaagcuguucugacaacagcuuccgcagagagcuggacgcacugggccacgagcugccagugcuggcuccccagugggagggcuacgaugagcugcagacugauggcaaccgcagcagccacucccgcuugggaagaauagaggcaggggcgucagacaauaacacagcaagugcugaggaagaaacggaggcggcagggagcguggcaguugagcguggccuucauggagcugcgacagugguacucgggcaggggcagcacggaggcugugcgccagaggaggaggacuga

SEQ ID NO: 7011 - RNA, 369 nt, Artificial Sequence
  derived and/or modified sequence opt1 from Bid__Homo_sapiens__ACD47106
auggacugcgaggugaacaacggcagcucccugcgcgacgagugcaucaccaaccuccuggucuucggguuccugcagagcugcuccgacaacagcuuccggcgcgagcucgacgcccugggccacgagcugcccgugcucgccccgcagugggagggguacgacgagcugcagaccgacggcaaccgguccagccacucccgccuggggcggaucgaggcgggcgccagcgacaacaacacggccuccgccgaggaggagaccgaggccgcgggcagcguggccgucgagcgcgggcuccacggcgccgccaccguggugcuggggcagggccagcacgggggcugcgcgcccgaggaggaggacuga

SEQ ID NO: 7012 - RNA, 369 nt, Artificial Sequence
  derived and/or modified sequence opt2 from Bid__Homo_sapiens__ACD47106
auggacugcgaggucaacaacggcuccucccuccgcgacgagugcaucaccaaccuccucgucuucggcuuccuccaguccugcuccgacaacuccuuccgccgcgagcucgacgcccucggccacgagcuccccguccucgccccccagugggagggcuacgacgagcuccagaccgacggcaaccgcuccucccacucccgccucggccgcaucgaggccggcgccuccgacaacaacaccgccuccgccgaggaggagaccgaggccgccggcuccgucgccgucgagcgcggccuccacggcgccgccaccgucguccucggccagggccagcacggcggcugcgcccccgaggaggaggacuga

SEQ ID NO: 7013 - RNA, 369 nt, Artificial Sequence
  derived and/or modified sequence opt3 from Bid__Homo_sapiens__ACD47106
auggacugcgaggugaacaauggcagcucccugagagaugaauguaucaccaaccuccuugucuucggguuucugcagucuugcucagacaauaguuucaggcgggaguuggaugccuuaggacacgaacugcccguucuagcuccucaaugggaggguuacgacgaacuccagacagauggcaaccgcagcucccauucucgacuggggcguauugaggcaggagccucggacaauaacacugcgucagcugaggaagagacggaagccgcaggcagcguggccguagagagaggucuucacggggcugcaaccgugguccugggacagggccagcauggcgggugugccccagaggaagaggauuga

SEQ ID NO: 7014 - RNA, 369 nt, Artificial Sequence
  derived and/or modified sequence opt4 from Bid__Homo_sapiens__ACD47106
auggacugcgaggugaacaacggcagcagccugagagacgagugcaucaccaaccugcugguguucggcuuccugcagagcugcagcgacaacagcuucagaagagagcuggacgcccugggccacgagcugcccgugcuggccccccagugggagggcuacgacgagcugcagaccgacggcaacagaagcagccacagcagacugggcagaaucgaggccggcgccagcgacaacaacaccgccagcgccgaggaggagaccgaggccgccggcagcguggccguggagagaggccugcacggcgccgccaccguggugcugggccagggccagcacggcggcugcgcccccgaggaggaggacuga

SEQ ID NO: 7015 - RNA, 369 nt, Artificial Sequence
  derived and/or modified sequence opt5 from Bid__Homo_sapiens__ACD47106
auggacugcgaggugaacaauggcagcucccugagagaugaauguaucaccaaccuccuggucuucggguuucuucagucuugcagcgacaauuccuuccggcgcgagcuggaugcccucggacacgaacugcccguucuugcuccucaaugggagggcuacgacgaacugcagacagaugggaacagaucuagccauucccggcucggacgcauugaggccggcgcgucugacaauaacacggcuagcgccgaggaagagaccgaagccgcuggguccguggccguggagagaggacugcacggcgcugccacagucgugcugggccaggggcagcauggaggcugugcgccggaggaagaggauuga

SEQ ID NO: 7016 - RNA, 369 nt, Artificial Sequence
  derived and/or modified sequence opt6 from Bid__Homo_sapiens__ACD47106
auggauugugaaguaaauaauggaaguaguuuaagagaugaauguauaacaaauuuauuaguauuuggauuuuuacaaaguuguagugauaauaguuuuagaagagaauuagaugcauuaggacaugaauuaccaguauuagcaccacaaugggaaggauaugaugaacuacaaacagauggaaauagaaguagucauagcagauuaggaagaauagaagcaggagcaagugauaauaauacagcaagugcagaagaagaaacagaagcagcaggaagcguagcaguagaaagaggauuacauggagcagcaacaguaguacuaggacaaggacaacauggaggaugugcaccagaagaagaagauuaa

SEQ ID NO: 7017 - protein, 99 aa, Artificial Sequence
  Bid__Homo_sapiens__B2ZP79
MDRSIPPGLVNGLALQLRNTSRSEEDRNRDLATALEQLLQAYPRDMEKEKTMLVLALLLAKKVASHTPSLLRDVFHTTVNFINQNLRTYVRSLARNGMD

SEQ ID NO: 7018 - RNA, 300 nt, Artificial Sequence
  Bid__Homo_sapiens__ACD47107
auggaccguagcaucccuccgggccuggugaacggccuggcccugcagcucaggaacaccagccggucggaggaggaccggaacagggaccuggccacugcccuggagcagcugcugcaggccuacccuagagacauggagaaggagaagaccaugcuggugcuggcccugcugcuggccaagaagguggccagucacacgccguccuugcuccgugaugucuuucacacaacagugaauuuuauuaaccagaaccuacgcaccuacgugaggagcuuagccagaaaugggauggacuga

SEQ ID NO: 7019 - RNA, 300 nt, Artificial Sequence
  derived and/or modified sequence opt1 from Bid__Homo_sapiens__ACD47107
auggaccgcagcaucccgcccggccuggugaacgggcucgcccugcagcugcggaacaccucccgcagcgaggaggaccggaaccgcgaccucgccaccgcgcuggagcagcugcuccaggccuacccccgggacauggagaaggagaagacgaugcugguccuggcccuccugcuggccaagaagguggccucccacacccccagccuccugcgcgacguguuccacaccaccgucaacuucaucaaccagaaccugcggacguacgugcgcucccucgcgcggaacggcauggacuga

SEQ ID NO: 7020 - RNA, 300 nt, Artificial Sequence
  derived and/or modified sequence opt2 from Bid__Homo_sapiens__ACD47107
auggaccgcuccaucccccccggccucgucaacggccucgcccuccagcuccgcaacaccucccgcuccgaggaggaccgcaaccgcgaccucgccaccgcccucgagcagcuccuccaggccuacccccgcgacauggagaaggagaagaccaugcucguccucgcccuccuccucgccaagaaggucgccucccacacccccucccuccuccgcgacgucuuccacaccaccgucaacuucaucaaccagaaccuccgcaccuacguccgcucccucgcccgcaacggcauggacuga

SEQ ID NO: 7021 - RNA, 300 nt, Artificial Sequence
  derived and/or modified sequence opt3 from Bid__Homo_sapiens__ACD47107
auggacagaagcauucccccuggccuggugaacgggcucgcccuucagcugaggaauaccucccggucugaggaagaucgcaaccgagacuuggcuacagcauuagagcaacugcuacaggccuacccacgugauauggaaaaggagaaaacuaugcucguccuggcgcuucuguuggcuaagaaaguugccucacacacgccgagucuccugagagacguguuccauaccacaguaaauuuuaucaaccagaaucugaggacuuaugugcggagccucgcacgcaacggaauggauuga

SEQ ID NO: 7022 - RNA, 300 nt, Artificial Sequence
  derived and/or modified sequence opt4 from Bid__Homo_sapiens__ACD47107
auggacagaagcaucccccccggccuggugaacggccuggcccugcagcugagaaacaccagcagaagcgaggaggacagaaacagagaccuggccaccgcccuggagcagcugcugcaggccuaccccagagacauggagaaggagaagaccaugcuggugcuggcccugcugcuggccaagaagguggccagccacacccccagccugcugagagacguguuccacaccaccgugaacuucaucaaccagaaccugagaaccuacgugagaagccuggccagaaacggcauggacuga

SEQ ID NO: 7023 - RNA, 300 nt, Artificial Sequence
  derived and/or modified sequence opt5 from Bid__Homo_sapiens__ACD47107
auggacagaagcauucccccuggccuggugaacgggcucgcccugcagcuucggaauaccucccgcucugaggaagauagaaaccgggaccuggcuacagcccucgagcaacugcuucaggcguacccgcgcgauauggaaaaggagaaaacgaugcugguccucgcucugcugcucgccaagaaaguugccagccacacccccucccugcuuagagacguguuccauacaaccgugaauuuuaucaaccagaaucugcggacauauguccgcucucucgcuagaaacggaauggauuga

SEQ ID NO: 7024 - RNA, 300 nt, Artificial Sequence
  derived and/or modified sequence opt6 from Bid__Homo_sapiens__ACD47107
auggacagaucaauaccaccaggacuaguaaacggacucgcacuacaacuaagaaacacaagcagaagcgaagaagacagaaacagagaccuagcaacagcacuagaacaacuacuacaagcauacccaagagacauggaaaaagaaaaaacaaugcuaguauuagcacuacuacuagcaaaaaaaguagcaagccacacaccaagccuacuaagagacguauuccauacaacaguaaacuucauaaaccaaaaccuaagaacauacguaagaucacuagcaagaaacggaauggacuaa

SEQ ID NO: 7025 - protein, 195 aa, Artificial Sequence; identical to SEQ ID NO: 7001
  Bid__Homo_sapiens__P55957

SEQ ID NO: 7026 - RNA, 588 nt, Artificial Sequence; identical to SEQ ID NO: 7002
  Bid__Homo_sapiens__AAC34365

SEQ ID NO: 7027 - RNA, 588 nt, Artificial Sequence; identical to SEQ ID NO: 7003
  derived and/or modified sequence opt1 from Bid__Homo_sapiens__AAC34365

SEQ ID NO: 7028 - RNA, 588 nt, Artificial Sequence; identical to SEQ ID NO: 7004
  derived and/or modified sequence opt2 from Bid__Homo_sapiens__AAC34365

SEQ ID NO: 7029 - RNA, 588 nt, Artificial Sequence; identical to SEQ ID NO: 7005
  derived and/or modified sequence opt3 from Bid__Homo_sapiens__AAC34365

SEQ ID NO: 7030 - RNA, 588 nt, Artificial Sequence; identical to SEQ ID NO: 7006
  derived and/or modified sequence opt4 from Bid__Homo_sapiens__AAC34365

SEQ ID NO: 7031 - RNA, 588 nt, Artificial Sequence; identical to SEQ ID NO: 7007
  derived and/or modified sequence opt5 from Bid__Homo_sapiens__AAC34365

SEQ ID NO: 7032 - RNA, 588 nt, Artificial Sequence
  derived and/or modified sequence opt6 from Bid__Homo_sapiens__AAC34365
auggauugcgaaguaaauaacggaagcucacuaagagacgaaugcauaacaaaucuauuaguauuuggauuuuuacaaagcuguagcgauaacaguuucagaagagaacuagacgcacucggacaugaacuaccaguacuagcaccacaaugggaaggauaugacgaacuacaaacagauggaaauagaucaagccauagcagacuaggaagaauagaagcagacucagaaucacaagaagacauaauaagaaacauagcaagacaccuugcacaaguaggagacuccauggauagaucaauaccaccaggacuaguaaacggacuagcacuacaacuaagaaacacaagcagaucagaagaagacagaaauagagaucuagcaacagcccuagaacaauuacuacaagcauauccaagagacauggaaaaagaaaaaacaauguuaguacuagcacuauuauuagcaaaaaaaguagcaagccauacaccaucauuacuaagagacguauuccauacaacaguaaacuucauaaaccaaaaccuaagaacauacguacgaucucuagcaagaaauggaauggacuaa

SEQ ID NO: 7033 - protein, 160 aa, Artificial Sequence
  Bik__Homo_sapiens__A0A024R4X6
MSEVRPLSRDILMETLLYEQLLEPPTMEVLGMTDSEEDLDPMEDFDSLECMEGSDALALRLACIGDEMDVSLRAPRLAQLSEVAMHSLGLAFIYDQTEDIRDVLRSFMDGFTTLKENIMRFWRSPNPGSWVSCEQVLLALLLLLALLLPLLSGGLHLLLK

SEQ ID NO: 7034 - RNA, 483 nt, Artificial Sequence
  Bik__Homo_sapiens__EAW73284
augucugaaguaagaccccucuccagagacaucuugauggagacccuccuguaugagcagcuccuggaacccccgaccauggagguucuuggcaugacugacucugaagaggaccuggacccuauggaggacuucgauucuuuggaaugcauggagggcagugacgcauuggcccugcggcuggccugcaucggggacgagauggacgugagccucagggccccgcgccuggcccagcucuccgagguggccaugcacagccugggucuggcuuucaucuacgaccagacugaggacaucagggauguucuuagaaguuucauggacgguuucaccacacuuaaggagaacauaaugagguucuggagauccccgaaccccggguccuggguguccugcgaacaggugcugcuggcgcugcugcugcugcuggcgcugcugcugccgcugcucagcgggggccugcaccugcugcucaaguga

SEQ ID NO: 7035 - RNA, 483 nt, Artificial Sequence
  derived and/or modified sequence opt1 from Bik__Homo_sapiens__EAW73284
augagcgaggugcgcccccugucccgggacauccucauggagacccugcuguacgagcagcuccuggagccgcccaccauggaggugcugggcaugacggacagcgaggaggaccucgaccccauggaggacuucgacucccuggagugcauggaggggagcgacgcccuggcccuccgccuggcgugcaucggcgacgagauggacgugucccugcgggcgccccgccucgcccagcugagcgagguggccaugcacucccuggggcucgccuucaucuacgaccagaccgaggacauccgggacguccugcgcagcuucauggacggcuucaccacccugaaggagaacaucaugcgguucuggcgcuccccgaaccccgggagcuggguguccugcgagcagguccuccuggcccugcuccugcugcucgcccugcugcucccccugcugagcggcggccuccaccuccugcugaaguga

SEQ ID NO: 7036 - RNA, 483 nt, Artificial Sequence
  derived and/or modified sequence opt2 from Bik__Homo_sapiens__EAW73284
auguccgagguccgcccccucucccgcgacauccucauggagacccuccucuacgagcagcuccucgagccccccaccauggagguccucggcaugaccgacuccgaggaggaccucgaccccauggaggacuucgacucccucgagugcauggagggcuccgacgcccucgcccuccgccucgccugcaucggcgacgagauggacgucucccuccgcgccccccgccucgcccagcucuccgaggucgccaugcacucccucggccucgccuucaucuacgaccagaccgaggacauccgcgacguccuccgcuccuucauggacggcuucaccacccucaaggagaacaucaugcgcuucuggcgcucccccaaccccggcuccugggucuccugcgagcagguccuccucgcccuccuccuccuccucgcccuccuccucccccuccucuccggcggccuccaccuccuccucaaguga

SEQ ID NO: 7037 - RNA, 483 nt, Artificial Sequence
  derived and/or modified sequence opt3 from Bik__Homo_sapiens__EAW73284
augagcgaggugagaccccuguccagggacauccucauggaaacccuucuguacgagcaguuguuagaaccuccaacaauggagguccugggcaugacugauucugaagaggaccuagauccgauggaggacuucgauucacucgaaugcauggaggggagugacgcccuggcccuucggcuggcauguauuggagaugaaauggacguuagcuugcgcgcuccccgacucgcgcaacuguccgagguggcuaugcacucucugggucucgccuuuauauaugaucagacggaggacauccgugauguauuaagaucguucauggacggcuuuaccacacugaaggaaaacauuaugagguucuggcggucaccuaauccagggagcugggugaguugcgagcagguccuuuuggcacugcuacuccugcuugcccuguugcucccccuguuauccggaggccugcaucuccuucugaaauga

SEQ ID NO: 7038 - RNA, 483 nt, Artificial Sequence
  derived and/or modified sequence opt4 from Bik__Homo_sapiens__EAW73284
augagcgaggugagaccccugagcagagacauccugauggagacccugcuguacgagcagcugcuggagccccccaccauggaggugcugggcaugaccgacagcgaggaggaccuggaccccauggaggacuucgacagccuggagugcauggagggcagcgacgcccuggcccugagacuggccugcaucggcgacgagauggacgugagccugagagcccccagacuggcccagcugagcgagguggccaugcacagccugggccuggccuucaucuacgaccagaccgaggacaucagagacgugcugagaagcuucauggacggcuucaccacccugaaggagaacaucaugagauucuggagaagccccaaccccggcagcugggugagcugcgagcaggugcugcuggcccugcugcugcugcuggcccugcugcugccccugcugagcggcggccugcaccugcugcugaaguga

SEQ ID NO: 7039 - RNA, 483 nt, Artificial Sequence
  derived and/or modified sequence opt5 from Bik__Homo_sapiens__EAW73284
augagcgaggugagaccccugucccgggacauccucauggagacccugcuuuacgagcagcugcucgaaccuccgacaauggagguccugggcaugacggauucugaagaggaccuugaucccauggaggacuucgauagccuggaaugcauggagggguccgacgcccucgcucugcgccuggccuguauuggagaugaaauggacguuucucucagagcgccucggcuggcucaacuuagcgagguggccaugcacucccugggccucgccuuuaucuaugaucagaccgaggacauucgcgaugugcugagaucuuucauggacggguuuacaacccuuaaggaaaacaucaugcgguucuggcgcagccccaauccuggauccugggucagcugcgaacaggugcugcucgcucugcugcuccugcuugcccugcuccugccccuucugucuggcgggcuccaucugcugcucaaauga

SEQ ID NO: 7040 - RNA, 483 nt, Artificial Sequence
  derived and/or modified sequence opt6 from Bik__Homo_sapiens__EAW73284
augucugaaguaagaccacuaucaagagauauauuaauggaaacauuauuauaugaacaacuauuagaaccucccacaauggaaguauuaggaaugacagauagugaagaagaucuagauccaauggaagauuucgauaguuuagaauguauggaaggaucagacgcauuagcacuaagacuagcaugcauaggagaugaaauggacguaagcuuaagagcaccaagauuagcacaacuaagugaaguagcaaugcauagcuuaggauuagcauuuauauaugaccaaacagaagacauaagagauguauuaagaucauucauggacggauucacaacauuaaaagaaaacauaaugagauucuggagaucaccaaauccaggaagcuggguaucaugcgaacaaguacuacuagcauuauuauuacuauuagcauuauuauuaccauuauuaucaggcggacuacaucuauuacuaaaauaa

SEQ ID NO: 7041 - protein, 160 aa, Artificial Sequence; identical to SEQ ID NO: 7033
  Bik__Homo_sapiens__Q13323

SEQ ID NO: 7042 - RNA, 483 nt, Artificial Sequence; identical to SEQ ID NO: 7034
  Bik__Homo_sapiens__AAC50413

SEQ ID NO: 7043 - RNA, 483 nt, Artificial Sequence; identical to SEQ ID NO: 7035
  derived and/or modified sequence opt1 from Bik__Homo_sapiens__AAC50413

SEQ ID NO: 7044 - RNA, 483 nt, Artificial Sequence; identical to SEQ ID NO: 7036
  derived and/or modified sequence opt2 from Bik__Homo_sapiens__AAC50413

SEQ ID NO: 7045 - RNA, 483 nt, Artificial Sequence; identical to SEQ ID NO: 7037
  derived and/or modified sequence opt3 from Bik__Homo_sapiens__AAC50413

SEQ ID NO: 7046 - RNA, 483 nt, Artificial Sequence; identical to SEQ ID NO: 7038
  derived and/or modified sequence opt4 from Bik__Homo_sapiens__AAC50413

SEQ ID NO: 7047 - RNA, 483 nt, Artificial Sequence; identical to SEQ ID NO: 7039
  derived and/or modified sequence opt5 from Bik__Homo_sapiens__AAC50413

SEQ ID NO: 7048 - RNA, 483 nt, Artificial Sequence
  derived and/or modified sequence opt6 from Bik__Homo_sapiens__AAC50413
augucagaaguaagaccacuaucaagagauauauuaauggaaacauuauuauaugaacaacuauuagaaccaccaacaauggaaguauuaggaaugacagauagugaagaagaucuagauccaauggaagauuucgauagcuuagaauguauggaaggaucagacgcauuagcacuaagacuagcaugcauaggagaugaaauggacguaaguuuaagagcaccaagacuagcacaauuaagugaaguagcaaugcauagcuuaggauuagcauuuauauaugaccaaaccgaagacauaagagauguauuaagaucauucauggacggauucacaacauuaaaagaaaacauaaugagauucuggagaucaccaaauccaggaagcuggguaucaugcgaacaaguacuacuagcauuacuauuacuauuagcauuacuauuaccacuacuaucuggaggacuacaucuauuacuaaaauaa

SEQ ID NO: 7049 - protein, 198 aa, Artificial Sequence
  Bim__Homo_sapiens__O43521
MAKQPSDVSSECDREGRQLQPAERPPQLRPGAPTSLQTEPQGNPEGNHGGEGDSCPHGSPQGPLAPPASPGPFATRSPLFIFMRRSSLLSRSSSGYFSFDTDRSPAPMSCDKSTQTPSPPCQAFNHYLSAMASMRQAEPADMRPEIWIAQELRRIGDEFNAYYARRVFLNNYQAAEDHPRMVILRLLRYIVRLVWRMH

SEQ ID NO: 7050 - RNA, 597 nt, Artificial Sequence
  Bim__Homo_sapiens__AAC39593
auggcaaagcaaccuucugauguaaguucugagugugaccgagaagguagacaauugcagccugcggagaggccuccccagcucagaccuggggccccuaccucccuacagacagagccacaagguaauccugaaggcaaucacggaggugaaggggacagcugcccccacggcagcccucagggcccgcuggccccaccugccagcccuggcccuuuugcuaccagauccccgcuuuucaucuuuaugagaagauccucccugcugucucgauccuccaguggguauuucucuuuugacacagacaggagcccagcacccaugaguugugacaaaucaacacaaaccccaaguccuccuugccaggccuucaaccacuaucucagugcaauggcuuccaugaggcaggcugaaccugcagauaugcgcccagagauauggaucgcccaagaguugcggcguaucggagacgaguuuaacgcuuacuaugcaaggaggguauuuuugaauaauuaccaagcagccgaagaccacccacgaaugguuaucuuacgacuguuacguuacauuguccgccugguguggagaaugcauuga

SEQ ID NO: 7051 - RNA, 597 nt, Artificial Sequence
  derived and/or modified sequence opt1 from Bim__Homo_sapiens__AAC39593
auggccaagcagcccagcgacguguccagcgagugcgaccgcgagggccggcagcugcagccggccgagcgcccgccccagcuccggcccggggcgcccaccucccugcagaccgagccccagggcaaccccgaggggaaccacggcggggagggcgacagcugcccccacggcuccccgcaggggccccuggccccgcccgccagccccggccccuucgccacgcgcagcccccucuucaucuucaugcggcgcuccucccugcugagccgguccagcuccggguacuucagcuucgacaccgaccgcucccccgccccgaugagcugcgacaaguccacccagacccccagcccgcccugccaggcguucaaccacuaccucuccgccauggccagcaugcggcaggccgagcccgcggacaugcgccccgagaucuggaucgcccaggagcugcggcgcaucggcgacgaguucaacgccuacuacgcccggcgcgucuuccugaacaacuaccaggccgcggaggaccacccccggauggugauccuccgccugcugcgguacaucgugcgccucgucuggcggaugcacuga

SEQ ID NO: 7052 - RNA, 597 nt, Artificial Sequence
  derived and/or modified sequence opt2 from Bim__Homo_sapiens__AAC39593
auggccaagcagcccuccgacgucuccuccgagugcgaccgcgagggccgccagcuccagcccgccgagcgccccccccagcuccgccccggcgcccccaccucccuccagaccgagccccagggcaaccccgagggcaaccacggcggcgagggcgacuccugcccccacggcuccccccagggcccccucgccccccccgccucccccggccccuucgccacccgcuccccccucuucaucuucaugcgccgcuccucccuccucucccgcuccuccuccggcuacuucuccuucgacaccgaccgcucccccgcccccauguccugcgacaaguccacccagacccccuccccccccugccaggccuucaaccacuaccucuccgccauggccuccaugcgccaggccgagcccgccgacaugcgccccgagaucuggaucgcccaggagcuccgccgcaucggcgacgaguucaacgccuacuacgcccgccgcgucuuccucaacaacuaccaggccgccgaggaccacccccgcauggucauccuccgccuccuccgcuacaucguccgccucgucuggcgcaugcacuga

SEQ ID NO: 7053 - RNA, 597 nt, Artificial Sequence
  derived and/or modified sequence opt3 from Bim__Homo_sapiens__AAC39593
auggccaagcagcccagcgacguguccucugagugcgauagagaaggcaggcaacugcagccugcugagcggccaccgcagcuccgccccggggcaccuaccucacuucagacagaaccacaaggaaaccccgaggguaaucacggcggggaaggagacaguuguccucauggcagcccacaggguccccuggccccuccagcguccccggggcccuucgcuacucgaucuccuuuguuuaucuucaugcguagaucgucauuacugagcaggaguuccucuggauacuuuagcuucgauacggaccgguccccagcccccaugucaugcgauaaaaguacccagacaccuagcccacccugucaggcauuuaaccacuaucuaucugccauggcuuccaugcgccaagcagagccggccgacaugagaccugagauuuggauagcucaggaacucaggcggaucggcgaugaguucaaugccuacuaugcgcgccgagucuuucugaacaauuaccaggcagccgaagaccaucccagaaugguuauucuuaggcuguugcgguauaucgugcgucucguauggcgcaugcacuga

SEQ ID NO: 7054 - RNA, 597 nt, Artificial Sequence
  derived and/or modified sequence opt4 from Bim__Homo_sapiens__AAC39593
auggccaagcagcccagcgacgugagcagcgagugcgacagagagggcagacagcugcagcccgccgagagacccccccagcugagacccggcgcccccaccagccugcagaccgagccccagggcaaccccgagggcaaccacggcggcgagggcgacagcugcccccacggcagcccccagggcccccuggccccccccgccagccccggccccuucgccaccagaagcccccuguucaucuucaugagaagaagcagccugcugagcagaagcagcagcggcuacuucagcuucgacaccgacagaagccccgcccccaugagcugcgacaagagcacccagacccccagcccccccugccaggccuucaaccacuaccugagcgccauggccagcaugagacaggccgagcccgccgacaugagacccgagaucuggaucgcccaggagcugagaagaaucggcgacgaguucaacgccuacuacgccagaagaguguuccugaacaacuaccaggccgccgaggaccaccccagaauggugauccugagacugcugagauacaucgugagacugguguggagaaugcacuga

SEQ ID NO: 7055 - RNA, 597 nt, Artificial Sequence
  derived and/or modified sequence opt5 from Bim__Homo_sapiens__AAC39593
auggccaagcagcccagcgacguguccucugagugcgauagagaaggccggcaacugcagccugcugagcgcccgccccagcucagaccuggggcccccaccagccugcagacagaaccucaaggaaaccccgagggcaaucacgggggagaaggcgacuccuguccucaugggucuccgcagggaccccuugcgccucccgcuagcccuggccccuucgccacgcgguccccgcuguuuaucuucaugcgcagaucuagccuccugucccggucuagcuccggcuacuuuagcuucgauaccgaccgcucuccugcccccauguccugcgauaaaagcacacagaccccuucuccucccugucaggcuuuuaaccacuaucuuuccgccauggcuagcaugagacaagccgagcccgcggacaugcggccggagauuuggaucgcccaggaacugcgcagaauuggggaugaguucaaugcuuacuaugcccggcgcgucuuucucaacaauuaccaggcugccgaagaccaucccagaaugguuauccugcggcugcuccgcuauauugugagacugguguggcggaugcacuga

SEQ ID NO: 7056 - RNA, 597 nt, Artificial Sequence
  derived and/or modified sequence opt6 from Bim__Homo_sapiens__AAC39593
auggcaaaacaaccaagcgacguaucaucagaaugugacagagaaggaagacaauuacaaccagcagaaagaccuccacaauuaagaccaggagcaccaacaucacuacaaacagaaccacaaggcaauccagaaggaaaucacggaggagaaggagacucauguccacacggaucaccacaaggaccauuagcaccaccagcaucaccaggaccauuugcaacaagaucaccacuauucauauucaugcgaagaucaucacuauuaucaagaucaucaucaggauacuuuucauuugacacagacagaaguccagcaccaaugucaugcgauaaaucaacacaaacaccaucaccaccaugucaagcauucaaucacuaucuaucagcaauggcaucaaugagacaagcagaaccagccgacaugagaccagaaauauggauagcacaagaacuaagacgaauaggagaugaauucaacgcauacuaugcaagaagaguauucuuaaacaauuaccaagcagcagaagaucacccaagaaugguaauauuacgacuauuaagauauauaguaagauuaguauggagaaugcacuaa

SEQ ID NO: 7057 - protein, 505 aa, Artificial Sequence
  Blk__Homo_sapiens__P51451
MGLVSSKKPDKEKPIKEKDKGQWSPLKVSAQDKDAPPLPPLVVFNHLTPPPPDEHLDEDKHFVVALYDYTAMNDRDLQMLKGEKLQVLKGTGDWWLARSLVTGREGYVPSNFVARVESLEMERWFFRSQGRKEAERQLLAPINKAGSFLIRESETNKGAFSLSVKDVTTQGELIKHYKIRCLDEGGYYISPRITFPSLQALVQHYSKKGDGLCQRLTLPCVRPAPQNPWAQDEWEIPRQSLRLVRKLGSGQFGEVWMGYYKNNMKVAIKTLKEGTMSPEAFLGEANVMKALQHERLVRLYAVVTKEPIYIVTEYMARGCLLDFLKTDEGSRLSLPRLIDMSAQIAEGMAYIERMNSIHRDLRAANILVSEALCCKIADFGLARIIDSEYTAQEGAKFPIKWTAPEAIHFGVFTIKADVWSFGVLLMEVVTYGRVPYPGMSNPEVIRNLERGYRMPRPDTCPPELYRGVIAECWRSRPEERPTFEFLQSVLEDFYTATERQYELQP

SEQ ID NO: 7058 - RNA, 1518 nt, Artificial Sequence
  Blk__Homo_sapiens__AAH07371
auggggcugguaaguagcaaaaagccggacaaggaaaagccgaucaaagagaaggacaagggccaauggagcccccugaaggucagcgcccaagacaaggacgccccgccacugccgccccugguugucuucaaccaccuuacuccuccaccgcccgaugaacaccuggaugaagacaagcauuucgugguggcucuguaugacuacaccgcuaugaaugaucgggaccugcagaugcugaagggggagaagcuacagguccugaagggaacuggagacugguggcuggccaggucacucgucacaggaagagaaggcuaugugcccagcaacuuuguggcccgaguggagagccuggaaauggaaaggugguucuuuagaucacagggucggaaggaggcugagaggcagcuucuugcuccaaucaacaaggccggcuccuuucuuaucagagagagugaaaccaacaaaggugccuucucccugucugugaaggaugucaccacccagggggagcugaucaagcacuauaagauccgcugccuggaugaagggggcuacuacaucuccccccggaucaccuuccccucgcuccaggcccuggugcagcacuauucuaagaagggggauggucuaugccagaggcugacccugcccugugugcgcccggccccgcagaaucccugggcccaggaugaaugggagaucccccggcagucucucaggcuggucaggaaacucgggucuggacaauucggcgaagucuggauggguuacuacaaaaacaacaugaagguggccauuaagacgcugaaggagggaaccaugucuccagaagccuuucugggugaggccaacgugaugaaggcucugcagcacgagcggcugguccgacucuacgcaguggucaccaaggagcccaucuacauugucaccgaguacauggccagaggaugccugcuggauuuccugaagacagaugaagggagcagauugucacucccaaggcugauugacaugucggcgcagauugcugaagggauggcauacauugagcgcaugaauuccauccaccgcgaccugcgggcggccaacauccuggugucugaggccuugugcugcaaaauugcugauuuuggcuuggcucgaaucaucgacagugaauacacggcccaagagggggccaaguuccccaucaaguggacagccccggaagccauccacuucggggucuucaccaucaaagcagacguguggucguuuggaguccuccugauggaaguugucacuuaugggcgggugccauacccagggaugagcaaccccgaggucauccgcaaccuggagcgcggcuaccgcaugccgcgccccgacaccugcccgcccgagcuguaccgcggcgucaucgccgagugcuggcgcagccggcccgaggagcggcccaccuucgaguuccugcagucggugcuggaggacuucuacacggccaccgagcggcaguacgagcugcagcccuag

SEQ ID NO: 7059 - RNA, 1518 nt, Artificial Sequence
  derived and/or modified sequence opt1 from Blk__Homo_sapiens__AAH07371
augggccuggugagcuccaagaagcccgacaaggagaagccgaucaaggagaaggacaaggggcaguggagcccccucaaggucuccgcccaggacaaggacgccccgccccugccgccccuggugguguucaaccaccucaccccgccgccgcccgacgagcaccuggacgaggacaagcacuucgucguggcgcuguacgacuacaccgccaugaacgaccgcgaccuccagaugcugaagggcgagaagcuccaggugcugaaggggacgggcgacugguggcuggcccggagccuggucaccgggcgcgagggcuacgugcccuccaacuucguggcccgggucgagagccucgagauggagcgcugguucuuccggucccagggccgcaaggaggccgagcggcagcugcuggcgcccaucaacaaggccgggagcuuccucauccgcgaguccgagaccaacaagggcgccuucagccuguccgugaaggacgugaccacgcagggggagcugaucaagcacuacaagauccggugccucgacgagggcggguacuacaucagcccccgcaucaccuuccccucccugcaggcccugguccagcacuacagcaagaagggcgacggccucugccagcggcugacccugcccugcgugcgccccgcgccccagaaccccugggcccaggacgagugggagaucccccggcagucccuccgccuggugcggaagcuggggagcggccaguucggggaggucuggaugggcuacuacaagaacaacaugaagguggccaucaagacccucaaggagggcacgaugucccccgaggccuuccugggggaggccaacgugaugaaggcgcugcagcacgagcgccucguccggcuguacgccguggugaccaaggagcccaucuacaucgucaccgaguacauggcccgcggcugccugcucgacuuccugaagaccgacgaggggagccggcugucccucccccgccugaucgacaugagcgcccagaucgccgagggcauggcguacaucgagcggaugaacagcauccaccgcgaccugcgcgccgccaacauccucguguccgaggcccugugcugcaagaucgccgacuucgggcuggcgcggaucaucgacagcgaguacacggcccaggagggcgccaaguuccccaucaaguggaccgcccccgaggccauccacuucggcguguucaccaucaaggcggacgucugguccuucggggugcuccugauggaggucgugaccuacggccgcgugccguaccccgggaugagcaaccccgaggucauccggaaccuggagcgcggcuaccggaugccccgcccggacacgugcccgcccgagcucuaccgcggggugaucgccgagugcuggcggucccggcccgaggagcgccccaccuucgaguuccugcagagcgugcuggaggacuucuacaccgccaccgagcggcaguacgagcuccagcccuga

SEQ ID NO: 7060 - RNA, 1518 nt, Artificial Sequence
  derived and/or modified sequence opt2 from Blk__Homo_sapiens__AAH07371
augggccucgucuccuccaagaagcccgacaaggagaagcccaucaaggagaaggacaagggccagugguccccccucaaggucuccgcccaggacaaggacgcccccccccuccccccccucgucgucuucaaccaccucaccccccccccccccgacgagcaccucgacgaggacaagcacuucgucgucgcccucuacgacuacaccgccaugaacgaccgcgaccuccagaugcucaagggcgagaagcuccagguccucaagggcaccggcgacugguggcucgcccgcucccucgucaccggccgcgagggcuacguccccuccaacuucgucgcccgcgucgagucccucgagauggagcgcugguucuuccgcucccagggccgcaaggaggccgagcgccagcuccucgcccccaucaacaaggccggcuccuuccucauccgcgaguccgagaccaacaagggcgccuucucccucuccgucaaggacgucaccacccagggcgagcucaucaagcacuacaagauccgcugccucgacgagggcggcuacuacaucuccccccgcaucaccuuccccucccuccaggcccucguccagcacuacuccaagaagggcgacggccucugccagcgccucacccuccccugcguccgccccgccccccagaaccccugggcccaggacgagugggagaucccccgccagucccuccgccucguccgcaagcucggcuccggccaguucggcgaggucuggaugggcuacuacaagaacaacaugaaggucgccaucaagacccucaaggagggcaccaugucccccgaggccuuccucggcgaggccaacgucaugaaggcccuccagcacgagcgccucguccgccucuacgccgucgucaccaaggagcccaucuacaucgucaccgaguacauggcccgcggcugccuccucgacuuccucaagaccgacgagggcucccgccucucccucccccgccucaucgacauguccgcccagaucgccgagggcauggccuacaucgagcgcaugaacuccauccaccgcgaccuccgcgccgccaacauccucgucuccgaggcccucugcugcaagaucgccgacuucggccucgcccgcaucaucgacuccgaguacaccgcccaggagggcgccaaguuccccaucaaguggaccgcccccgaggccauccacuucggcgucuucaccaucaaggccgacgucugguccuucggcguccuccucauggaggucgucaccuacggccgcguccccuaccccggcauguccaaccccgaggucauccgcaaccucgagcgcggcuaccgcaugccccgccccgacaccugcccccccgagcucuaccgcggcgucaucgccgagugcuggcgcucccgccccgaggagcgccccaccuucgaguuccuccaguccguccucgaggacuucuacaccgccaccgagcgccaguacgagcuccagcccuga

SEQ ID NO: 7061 - RNA, 1518 nt, Artificial Sequence
  derived and/or modified sequence opt3 from Blk__Homo_sapiens__AAH07371
augggccuggugagcuccaagaaacccgacaaggagaaaccuaucaaggaaaaagauaaggggcaguggucuccacucaaggucucagcccaagacaaagaugcuccgccccuuccuccacugguuguguucaaccacuugacacccccuccacccgacgagcauuuagaugaagacaagcacuuuguaguggcacuguacgauuauaccgccaugaaugacagagaucuacagaugcucaaaggagagaagcugcagguccuuaaagguacuggcgacugguggcuggcgaggaguuuggugacggggcgggaaggauacguuccuagcaacuucguggcucgcgucgagucccucgagauggaacgaugguuuuuccguucucagggcagaaaggaggccgaaaggcaacugcuggcaccaauuaauaaggccgguucguuucucauacgggagucagagaccaacaaaggggcuuucagcuuaagugugaaggauguaacaacucagggagaacugaucaaacauuauaagauucgcugccuugacgagggcggcuacuauaucuccccgagaauuaccuuucccucuuugcaggcacugguucagcacuacagcaaaaagggggauggacuaugucaaaggcucacacugccuugcgugcggccagcuccccagaauccuugggcccaggacgaaugggagaucccacgccagucccuucgacuggucagaaaauuggguucaggccaauucggggaaguguggaugggauauuacaagaacaauaugaagguggccauaaaaacccucaaggagggcacuaugagucccgaggcguuucugggugaagcaaacgucaugaaagccuuacagcaugagaggcugguucggcucuacgcugugguaacaaaggaaccgaucuauauugugaccgaguacauggcccgugggugucuucuggacuucuugaaaacggaugaaggaagccgccuaucucugccuagacucaucgacauguccgcacagauugcugagggcauggccuauaucgagaggaugaacucaauacaccgggaucugcgagcggccaauauucuugucagcgaagcacugugcuguaagaucgcugacuuuggcuuggcccgcauuaucgauagugaguacacugcucaagaaggggccaaguuccccaucaaauggaccgcaccagaggccauucacuuuggaguguucacaauaaaggcugacguuuggucuuucggugugcuccugauggaagucgugacuuauggcagaguaccuuaccccgggauguccaauccagagguuaucaggaacuuagagcggggauaucgcaugcccagaccugauaccugcccaccggaacuguacaggggcgugauugcggaguguuggcguagccggcccgaggaacgaccuacauuugaguuccuacagucgguccucgaagacuuuuacaccgcaacggagagacaguaugaacugcagccauga

SEQ ID NO: 7062 - RNA, 1518 nt, Artificial Sequence
  derived and/or modified sequence opt4 from Blk__Homo_sapiens__AAH07371
augggccuggugagcagcaagaagcccgacaaggagaagcccaucaaggagaaggacaagggccaguggagcccccugaaggugagcgcccaggacaaggacgcccccccccugcccccccuggugguguucaaccaccugaccccccccccccccgacgagcaccuggacgaggacaagcacuucgugguggcccuguacgacuacaccgccaugaacgacagagaccugcagaugcugaagggcgagaagcugcaggugcugaagggcaccggcgacugguggcuggccagaagccuggugaccggcagagagggcuacgugcccagcaacuucguggccagaguggagagccuggagauggagagaugguucuucagaagccagggcagaaaggaggccgagagacagcugcuggcccccaucaacaaggccggcagcuuccugaucagagagagcgagaccaacaagggcgccuucagccugagcgugaaggacgugaccacccagggcgagcugaucaagcacuacaagaucagaugccuggacgagggcggcuacuacaucagccccagaaucaccuuccccagccugcaggcccuggugcagcacuacagcaagaagggcgacggccugugccagagacugacccugcccugcgugagacccgccccccagaaccccugggcccaggacgagugggagauccccagacagagccugagacuggugagaaagcugggcagcggccaguucggcgagguguggaugggcuacuacaagaacaacaugaagguggccaucaagacccugaaggagggcaccaugagccccgaggccuuccugggcgaggccaacgugaugaaggcccugcagcacgagagacuggugagacuguacgccguggugaccaaggagcccaucuacaucgugaccgaguacauggccagaggcugccugcuggacuuccugaagaccgacgagggcagcagacugagccugcccagacugaucgacaugagcgcccagaucgccgagggcauggccuacaucgagagaaugaacagcauccacagagaccugagagccgccaacauccuggugagcgaggcccugugcugcaagaucgccgacuucggccuggccagaaucaucgacagcgaguacaccgcccaggagggcgccaaguuccccaucaaguggaccgcccccgaggccauccacuucggcguguucaccaucaaggccgacguguggagcuucggcgugcugcugauggagguggugaccuacggcagagugcccuaccccggcaugagcaaccccgaggugaucagaaaccuggagagaggcuacagaaugcccagacccgacaccugcccccccgagcuguacagaggcgugaucgccgagugcuggagaagcagacccgaggagagacccaccuucgaguuccugcagagcgugcuggaggacuucuacaccgccaccgagagacaguacgagcugcagcccuga

SEQ ID NO: 7063 - RNA, 1518 nt, Artificial Sequence
  derived and/or modified sequence opt5 from Blk__Homo_sapiens__AAH07371
augggccuggugagcuccaagaaacccgacaaggagaaaccuaucaaggaaaaagauaaggggcaguggucuccgcucaaggucagcgcccaagacaaagaugcucccccucugcccccucuuguuguguucaaccaccugacacccccuccgcccgacgagcaucucgaugaagacaagcacuuuguggucgcccuguacgauuauaccgcgaugaaugacagagaucuucagaugcugaaaggagagaagcuccaggugcugaaaggcacgggggacugguggcuggcucggucccucguuaccggacgcgaaggcuacgugccuucuaacuucgucgccagaguggagagccuggagauggaacggugguuuuuccgcucccaggggagaaaggaggccgaacggcaacuucuggcucccauuaauaaggccggaucuuuucucauccgcgagagcgagacaaacaaaggcgcuuucucccugagcguuaaggaugugaccacacagggcgaacuuauuaaacauuauaagaucagaugccuggacgaagggggauacuauauuucuccucggaucaccuuucccucccuccaggcccugguccagcacuacagcaaaaagggcgaugggcugugucaacgccucacacugccgugcgugagaccugcgccccagaauccuugggcccaggacgaaugggagaucccccggcagucucuucgccuggugagaaaacucggauccggccaauucggggaagucuggaugggauauuacaagaacaauaugaagguugcuauuaaaacccugaaggagggcacgaugagccccgaggccuuucuuggcgaagcuaacgugaugaaagcccugcagcaugagcggcucgugcgccuguacgcggucgugaccaaggaaccuaucuauauuguuacagaguacauggccagagggugucugcucgacuuccugaaaaccgaugaaggaucucggcuuucccugccgagacucaucgacaugagcgcucagauugccgagggcauggcuuauaucgagcgcaugaacuccauucaccgggaucugagagccgccaauauccuugugucugaagcucugugcuguaagaucgcggacuuugggcucgcccgcauuaucgauagcgaguacacagcucaagaaggagccaaguuccccauuaaauggaccgccccugaggcuauccacuuuggcgucuucacgauuaaggccgacgugugguccuucgggguucugcugauggaaguggucacauauggacgggugcccuacccuggcaugagcaaucccgaggucaucagaaaccucgagcgcggcuaucggaugccgagaccugauaccugucccccugaacuguaccgcggggugaucgcggagugcuggcggucuagacccgaggagcgcccuacauuugaguuccuucaguccguucuggaagacuuuuacaccgcuaccgagcggcaguaugaacuccagcccuga

SEQ ID NO: 7064 - RNA, 1518 nt, Artificial Sequence
  derived and/or modified sequence opt6 from Blk__Homo_sapiens__AAH07371
augggauuaguaucaucaaaaaaaccagauaaagaaaaaccaauaaaagaaaaagauaaaggacaauggagcccauuaaaaguaucagcacaagacaaagacgcaccaccauuaccaccccucgugguguuuaaucaccuuacacccccuccaccagaugaacacuuagacgaagauaaacauuuugucguagcauuauacgauuauacagcaaugaacgacagagaucuacaaaugcugaaaggagaaaaacuacaaguacucaagggaacaggugauuggugguuagcgagaucauuaguaacaggaagagaaggauauguaccaaguaacuuuguagcaagagucgaaagucuagaaauggaacgaugguucuuuagaucacaaggaagaaaagaagcagagcgacaauuauuagcaccaauaaauaaagcaggaagcuuccucauaagagaaagcgaaacuaauaaaggagcauuuucauuaucaguaaaagauguaaccacacaaggagaacuaauaaaacauuauaaaauaagaugccuagaugaaggcggauauuacauaucaccacgcauaacauuucccaguuuacaagcacuaguacagcauuauucaaaaaaaggcgauggauuaugccaaagacuaacauuaccauguguaagaccagcaccacagaacccaugggcacaagaugaaugggaaauaccaagacaaucacuuagauuaguaagaaaauuaggcuccggacaauuuggugaaguauggauggguuacuacaaaaauaacaugaaaguagcuaucaaaacauuaaaagaagguacaaugucaccagaagccuucuuaggagaagcaaauguaaugaaagcucuccaacacgaacgauuagugagacuuuacgcaguaguaacaaaagaaccaauauacauagucacagaauauauggcaaggggaugucuccuagacuuucuaaaaacagaugaaggaucaagacuaucacuaccaagacuaauagauaugagcgcacaaauagcugaaggcauggccuauauugaaagaaugaauaguauccauagagacuuacgagcagcaaacauauuaguuagugaagccuuaugcuguaaaauagcagauuuuggacuagcacgaauaauagacucagaauacacugcacaggaaggugcuaaauucccaauaaaauggacagcuccggaagcaauacacuuuggaguauuuacaauaaaagcggacguuuggucauuuggagucuuacuaauggaaguaguaacauauggaagaguuccauauccaggaaugucaaacccagaaguaauaagaaaccuagaaagaggauauagaaugccaagaccagauacauguccaccagaauuauacagaggcguuauagcggaaugcuggagaaguaggccugaagaaagaccaacauuugaauuuuuacaaucaguacuagaagauuuuuacacugcaacagaaagacaguacgaauuacaaccauaa

SEQ ID NO: 7065 - protein, 277 aa, Artificial Sequence
  Caspase_3__Homo_sapiens__P42574
MENTENSVDSKSIKNLEPKIIHGSESMDSGISLDNSYKMDYPEMGLCIIINNKNFHKSTGMTSRSGTDVDAANLRETFRNLKYEVRNKNDLTREEIVELMRDVSKEDHSKRSSFVCVLLSHGEEGIIFGTNGPVDLKKITNFFRGDRCRSLTGKPKLFIIQACRGTELDCGIETDSGVDDDMACHKIPVEADFLYAYSTAPGYYSWRNSKDGSWFIQSLCAMLKQYADKLEFMHILTRVNRKVATEFESFSFDATFHAKKQIPCIVSMLTKELYFYH

SEQ ID NO: 7066 - RNA, 834 nt, Artificial Sequence
  Caspase_3__Homo_sapiens__AAA74929
auggagaacacugaaaacucaguggauucaaaauccauuaaaaauuuggaaccaaagaucauacauggaagcgaaucaauggacucuggaauaucccuggacaacaguuauaaaauggauuauccugagauggguuuauguauaauaauuaauaauaagaauuuucauaaaagcacuggaaugacaucucggucugguacagaugucgaugcagcaaaccucagggaaacauucagaaacuugaaauaugaagucaggaauaaaaaugaucuuacacgugaagaaauuguggaauugaugcgugauguuucuaaagaagaucacagcaaaaggagcaguuuuguuugugugcuucugagccauggugaagaaggaauaauuuuuggaacaaauggaccuguugaccugaaaaaaauaacaaacuuuuucagaggggaucguuguagaagucuaacuggaaaacccaaacuuuucauuauucaggccugccgugguacagaacuggacuguggcauugagacagacagugguguugaugaugacauggcgugucauaaaauaccaguggaggccgacuucuuguaugcauacuccacagcaccugguuauuauucuuggcgaaauucaaaggauggcuccugguucauccagucgcuuugugccaugcugaaacaguaugccgacaagcuugaauuuaugcacauucuuacccggguuaaccgaaagguggcaacagaauuugaguccuuuuccuuugacgcuacuuuucaugcaaagaaacagauuccauguauuguuuccaugcucacaaaagaacucuauuuuuaucacuaa

SEQ ID NO: 7067 - RNA, 834 nt, Artificial Sequence
  derived and/or modified sequence opt1 from Caspase_3__Homo_sapiens__AAA74929
auggagaacaccgagaacagcguggacuccaagagcaucaagaaccuggagcccaagaucauccacggcuccgagagcauggacuccgggaucagccucgacaacuccuacaagauggacuacccggagaugggccugugcaucaucaucaacaacaagaacuuccacaagagcaccgggaugacgucccgcagcggcaccgacgucgacgccgccaaccugcgggagaccuuccgcaaccucaaguacgaggugcggaacaagaacgaccugacccgcgaggagaucguggagcugaugcgggacgucuccaaggaggaccacagcaagcgcuccagcuucgugugcgugcuccugucccacggggaggagggcaucaucuucggcacgaacgggcccgucgaccugaagaagaucaccaacuucuuccggggcgaccgcugccggagccucaccgggaagcccaagcuguucaucauccaggcgugccgcggcaccgagcuggacugcgggaucgagacggacuccggcguggacgacgacauggccugccacaagauccccguggaggccgacuuccucuacgccuacagcaccgccccgggcuacuacuccuggcggaacagcaaggacgggagcugguucauccagucccugugcgcgaugcugaagcaguacgccgacaagcucgaguucaugcacauccugacccgcgucaaccggaagguggccaccgaguucgagagcuucuccuucgacgccacguuccacgcgaagaagcagauccccugcaucgugagcaugcugaccaaggagcucuacuucuaccacuga

SEQ ID NO: 7068 - RNA, 834 nt, Artificial Sequence
  derived and/or modified sequence opt2 from Caspase_3__Homo_sapiens__AAA74929
auggagaacaccgagaacuccgucgacuccaaguccaucaagaaccucgagcccaagaucauccacggcuccgaguccauggacuccggcaucucccucgacaacuccuacaagauggacuaccccgagaugggccucugcaucaucaucaacaacaagaacuuccacaaguccaccggcaugaccucccgcuccggcaccgacgucgacgccgccaaccuccgcgagaccuuccgcaaccucaaguacgagguccgcaacaagaacgaccucacccgcgaggagaucgucgagcucaugcgcgacgucuccaaggaggaccacuccaagcgcuccuccuucgucugcguccuccucucccacggcgaggagggcaucaucuucggcaccaacggccccgucgaccucaagaagaucaccaacuucuuccgcggcgaccgcugccgcucccucaccggcaagcccaagcucuucaucauccaggccugccgcggcaccgagcucgacugcggcaucgagaccgacuccggcgucgacgacgacauggccugccacaagauccccgucgaggccgacuuccucuacgccuacuccaccgcccccggcuacuacuccuggcgcaacuccaaggacggcuccugguucauccagucccucugcgccaugcucaagcaguacgccgacaagcucgaguucaugcacauccucacccgcgucaaccgcaaggucgccaccgaguucgaguccuucuccuucgacgccaccuuccacgccaagaagcagauccccugcaucgucuccaugcucaccaaggagcucuacuucuaccacuga

SEQ ID NO: 7069 - RNA, 834 nt, Artificial Sequence
  derived and/or modified sequence opt3 from Caspase_3__Homo_sapiens__AAA74929
auggagaacaccgaaaauagcguggacuccaagucuaucaaaaaccuggagcccaagauuauacacggcucagaaaguauggauagcgggaucucccucgacaauucuuacaaaauggauuauccugagaugggacuuugcauuaucauuaacaauaagaacuuccauaaaucgacagguaugacuucaagaagcggcacggacgucgaugccgcuaaucugagggaaaccuuucggaacuugaaguacgagguucgcaauaagaacgacuuaacacgagaggaaaucguggagcugaugcgugauguaaguaaagaagaccacuccaagagaucuagcuucguguguguccuacucucccauggggaggagggaauaaucuuuggcacuaaugguccaguggaucugaaaaagauuaccaacuucuuuaggggagaccggugccgcucacuuacagggaaaccgaagcuguucaucauucaggcauguagaggcaccgaauuggauugcggcaucgagacugacagugggguugaugacgacauggccugucacaagauacccguggaagcggauuuucucuaugcuuacagcacagccccuggauauuacucuuggaggaacuccaaagacgguucaugguucauucaaagccugugcgcaaugcugaagcaguaugccgauaaacucgaguuuaugcauaucuuaacccgggucaaucgcaagguggcuacggaguucgaaaguuuuucuuucgacgcaacuuuucacgccaaaaagcagauuccauguaucguauccaugcugaccaaagagcuuuacuucuaccacuga

SEQ ID NO: 7070 - RNA, 834 nt, Artificial Sequence
  derived and/or modified sequence opt4 from Caspase_3__Homo_sapiens__AAA74929
auggagaacaccgagaacagcguggacagcaagagcaucaagaaccuggagcccaagaucauccacggcagcgagagcauggacagcggcaucagccuggacaacagcuacaagauggacuaccccgagaugggccugugcaucaucaucaacaacaagaacuuccacaagagcaccggcaugaccagcagaagcggcaccgacguggacgccgccaaccugagagagaccuucagaaaccugaaguacgaggugagaaacaagaacgaccugaccagagaggagaucguggagcugaugagagacgugagcaaggaggaccacagcaagagaagcagcuucgugugcgugcugcugagccacggcgaggagggcaucaucuucggcaccaacggccccguggaccugaagaagaucaccaacuucuucagaggcgacagaugcagaagccugaccggcaagcccaagcuguucaucauccaggccugcagaggcaccgagcuggacugcggcaucgagaccgacagcggcguggacgacgacauggccugccacaagauccccguggaggccgacuuccuguacgccuacagcaccgcccccggcuacuacagcuggagaaacagcaaggacggcagcugguucauccagagccugugcgccaugcugaagcaguacgccgacaagcuggaguucaugcacauccugaccagagugaacagaaagguggccaccgaguucgagagcuucagcuucgacgccaccuuccacgccaagaagcagauccccugcaucgugagcaugcugaccaaggagcuguacuucuaccacuga

SEQ ID NO: 7071 - RNA, 834 nt, Artificial Sequence
  derived and/or modified sequence opt5 from Caspase_3__Homo_sapiens__AAA74929
auggagaacaccgaaaauagcguggacuccaagucuaucaaaaaccuggagcccaagauuauccacggcagcgaauccauggauucugggauuagccucgacaauuccuacaaaauggauuauccugagaugggacugugcaucauuaucaacaauaagaacuuccauaaaucuacaggcaugacgagcagauccgggaccgacgucgaugccgcuaaucuucgggaaacauuucgcaaccugaaguacgagguuagaaauaagaacgaccucacccgggaggaaaucguggagcugaugcgcgaugugagcaaagaagaccacucuaagagauccagcuucgucugugugcuucugucucauggagaggagggcauuaucuuugggacaaauggaccgguugaucucaaaaagauuaccaacuucuuucggggcgaccgcugcagaucccugacaggcaaacccaagcuguucaucauucaggccugucgggggaccgaacucgauugcggaaucgagacggacagcggcguggaugacgacauggcgugucacaagauuccugucgaagcugauuuucuguaugccuacucuaccgcccccggguauuacuccuggcgcaauagcaaagacggauccugguucauccaaucucuuugcgcuaugcugaagcaguaugccgauaaacucgaguuuaugcauauccugacaagagugaaccggaagguugcuaccgaauuugagagcuucuccuucgacgccacauuucacgcgaaaaagcagauuccuuguaucgugagcaugcuuaccaaagagcuguacuucuaccacuga

SEQ ID NO: 7072 - RNA, 834 nt, Artificial Sequence
  derived and/or modified sequence opt6 from Caspase_3__Homo_sapiens__AAA74929
auggaaaacacagaaaauagcguagacucaaaaucaauaaaaaaccuagaaccaaaaauaauacacggaucagaaucaauggacucaggaauaagccuagacaacucauacaaaauggauuacccagaaaugggauuaugcauaauaauaaacaacaaaaacuuccauaaaucaacaggaaugaccucaagaagcggcacagacguagacgcagcaaaccuaagagaaacauucagaaaccuaaaauacgaaguaagaaacaaaaacgaccuaacaagagaagaaauaguagaacuaaugagagacguaucaaaagaagaccauuccaaaagaucaucauucguaugcguacuacuaagccacggagaagaaggaauaauauucggaaccaacggaccaguagaccuaaaaaaaauuaccaacuuuuuucgaggagacagaugccgaucacuaaccggaaaaccaaaauuauucauaauacaagcaugcagaggcacagaacuagacugcggaauagaaacagacucaggaguagacgacgacauggcaugccacaaaauacccguagaagcagauuuccuauaugcauacaguacagcaccaggauacuauucauggagaaacucaaaagacggcagcugguucauacaaucacuaugcgcaauguuaaaacaauacgcagacaaacuagaauucaugcacauauuaacaagaguaaacagaaaaguagcaacagaauucgaaucauucagcuucgacgcaacauuccacgcaaaaaaacaaauaccaugcauaguaucaaugcuaacaaaagaacuauacuucuaccacuaa

SEQ ID NO: 7073 - protein, 293 aa, Artificial Sequence
  Caspase_6__Homo_sapiens__P55212
MSSASGLRRGHPAGGEENMTETDAFYKREMFDPAEKYKMDHRRRGIALIFNHERFFWHLTLPERRGTCADRDNLTRRFSDLGFEVKCFNDLKAEELLLKIHEVSTVSHADADCFVCVFLSHGEGNHIYAYDAKIEIQTLTGLFKGDKCHSLVGKPKIFIIQACRGNQHDVPVIPLDVVDNQTEKLDTNITEVDAASVYTLPAGADFLMCYSVAEGYYSHRETVNGSWYIQDLCEMLGKYGSSLEFTELLTLVNRKVSQRRVDFCKDPSAIGKKQVPCFASMLTKKLHFFPKSN

SEQ ID NO: 7074 - RNA, 882 nt, Artificial Sequence
  Caspase_6__Homo_sapiens__AAH00305
augagcucggccucggggcuccgcagggggcacccggcagguggggaagaaaacaugacagaaacagaugccuucuauaaaagagaaauguuugauccggcagaaaaguacaaaauggaccacaggaggagaggaauugcuuuaaucuucaaucaugagagguucuuuuggcacuuaacacugccagaaaggcggggcaccugcgcagauagagacaaucuuacccgcagguuuucagaucuaggauuugaagugaaaugcuuuaaugaucuuaaagcagaagaacuacugcucaaaauucaugaggugucaacuguuagccacgcagaugccgauugcuuugugugugucuuccugagccauggcgaaggcaaucacauuuaugcauaugaugcuaaaaucgaaauucagacauuaacuggcuuguucaaaggagacaagugucacagccugguuggaaaacccaagauauuuaucauucaggcaugucggggaaaccagcacgaugugccagucauuccuuuggauguaguagauaaucagacagagaaguuggacaccaacauaacugagguggaugcagccuccguuuacacgcugccugcuggagcugacuuccucauguguuacucuguugcagaaggauauuauucucaccgggaaacugugaacggcucaugguacauucaagauuugugugagauguugggaaaauauggcuccuccuuagaguucacagaacuccucacacuggugaacaggaaaguuucucagcgccgaguggacuuuugcaaagacccaagugcaauuggaaagaagcagguucccuguuuugccucaaugcuaacuaaaaagcugcauuucuuuccaaaaucuaauuaa

SEQ ID NO: 7075 - RNA, 882 nt, Artificial Sequence
  derived and/or modified sequence opt1 from Caspase_6__Homo_sapiens__AAH00305
augagcuccgccagcggccugcgccgggggcaccccgccggcggggaggagaacaugaccgagaccgacgcguucuacaagcgcgagauguucgacccggccgagaaguacaagauggaccaccggcgccggggcaucgcccucaucuucaaccacgagcgcuucuucuggcaccugacgcugcccgagcggcgcgggaccugcgccgaccgggacaaccucacccgccgguucuccgaccugggcuucgaggugaagugcuucaacgaccugaaggccgaggagcuccugcugaagauccacgaggugagcaccgugucccacgcggacgccgacugcuucgugugcgucuuccucagccacggcgaggggaaccacaucuacgccuacgacgccaagaucgagauccagacgcugaccggccuguucaagggggacaagugccacucccucgugggcaagcccaagaucuucaucauccaggcgugccgcgggaaccagcacgacgugcccgucaucccgcuggacgugguggacaaccagaccgagaagcuggacaccaacaucacggaggucgacgccgccagcguguacacccuccccgccggcgccgacuuccugaugugcuacuccguggcggagggcuacuacagccaccgggagaccgucaacggguccugguacauccaggaccugugcgagaugcucggcaaguacgggagcucccuggaguucaccgagcugcucacgcuggugaaccgcaaggugagccagcggcgcgucgacuucugcaaggaccccuccgccaucggcaagaagcagguccccugcuucgccagcaugcugaccaagaagcuccacuucuucccgaaguccaacuga

SEQ ID NO: 7076 - RNA, 882 nt, Artificial Sequence
  derived and/or modified sequence opt2 from Caspase_6__Homo_sapiens__AAH00305
auguccuccgccuccggccuccgccgcggccaccccgccggcggcgaggagaacaugaccgagaccgacgccuucuacaagcgcgagauguucgaccccgccgagaaguacaagauggaccaccgccgccgcggcaucgcccucaucuucaaccacgagcgcuucuucuggcaccucacccuccccgagcgccgcggcaccugcgccgaccgcgacaaccucacccgccgcuucuccgaccucggcuucgaggucaagugcuucaacgaccucaaggccgaggagcuccuccucaagauccacgaggucuccaccgucucccacgccgacgccgacugcuucgucugcgucuuccucucccacggcgagggcaaccacaucuacgccuacgacgccaagaucgagauccagacccucaccggccucuucaagggcgacaagugccacucccucgucggcaagcccaagaucuucaucauccaggccugccgcggcaaccagcacgacguccccgucaucccccucgacgucgucgacaaccagaccgagaagcucgacaccaacaucaccgaggucgacgccgccuccgucuacacccuccccgccggcgccgacuuccucaugugcuacuccgucgccgagggcuacuacucccaccgcgagaccgucaacggcuccugguacauccaggaccucugcgagaugcucggcaaguacggcuccucccucgaguucaccgagcuccucacccucgucaaccgcaaggucucccagcgccgcgucgacuucugcaaggaccccuccgccaucggcaagaagcagguccccugcuucgccuccaugcucaccaagaagcuccacuucuuccccaaguccaacuga

SEQ ID NO: 7077 - RNA, 882 nt, Artificial Sequence
  derived and/or modified sequence opt3 from Caspase_6__Homo_sapiens__AAH00305
augagcuccgccucuggccuuagaagggggcaccccgcuggaggugaggaaaacaugaccgagacagacgcauucuacaagcgggaaauguuugauccugccgagaaauauaagauggaccaucgccgacguggcaucgcgcucauuuucaaucacgaaagauuuuucuggcaucuuacucugccagagaggcgggggacgugcgcugaucgcgacaacuugaccagaagguuuucagauuuaggauucgaggugaaauguuuuaaugaccugaaggccgaggaacuacuccugaaaauacacgaagucaguacaguuagccaugcagaugccgacugcuucguguguguauuucuuucccacggcgaggguaaccacaucuacgcuuaugaugcaaagauugagauccagacucugaccggguuguucaagggagacaaaugccauucucucgugggcaagccgaaaauuuuuaucauacaagccugucggggcaaucagcacgauguccccgugaucccucuggacguuguggauaaccagacagaaaagcuggacaccaauauuacugaggucgacgcugccucgguguacacacucccagcgggggcagauuucuuaaugugcuauucaguagccgaaggauacuauagccaucgcgagaccguuaacgguaguugguacauccaggaccugugugaaaugcuuggcaaauacggguccucuuuggaguuuacggagcugcuaacucucgugaaucgaaaggucagccaaagaaggguggauuucugcaaggaccccuccgcuauuggaaagaaacaggugccuuguuucgccucaaugcugaccaaaaagcugcacuuuuucccaaaaaguaacuga

SEQ ID NO: 7078 - RNA, 882 nt, Artificial Sequence
  derived and/or modified sequence opt4 from Caspase_6__Homo_sapiens__AAH00305
augagcagcgccagcggccugagaagaggccaccccgccggcggcgaggagaacaugaccgagaccgacgccuucuacaagagagagauguucgaccccgccgagaaguacaagauggaccacagaagaagaggcaucgcccugaucuucaaccacgagagauucuucuggcaccugacccugcccgagagaagaggcaccugcgccgacagagacaaccugaccagaagauucagcgaccugggcuucgaggugaagugcuucaacgaccugaaggccgaggagcugcugcugaagauccacgaggugagcaccgugagccacgccgacgccgacugcuucgugugcguguuccugagccacggcgagggcaaccacaucuacgccuacgacgccaagaucgagauccagacccugaccggccuguucaagggcgacaagugccacagccuggugggcaagcccaagaucuucaucauccaggccugcagaggcaaccagcacgacgugcccgugaucccccuggacgugguggacaaccagaccgagaagcuggacaccaacaucaccgagguggacgccgccagcguguacacccugcccgccggcgccgacuuccugaugugcuacagcguggccgagggcuacuacagccacagagagaccgugaacggcagcugguacauccaggaccugugcgagaugcugggcaaguacggcagcagccuggaguucaccgagcugcugacccuggugaacagaaaggugagccagagaagaguggacuucugcaaggaccccagcgccaucggcaagaagcaggugcccugcuucgccagcaugcugaccaagaagcugcacuucuuccccaagagcaacuga

SEQ ID NO: 7079 - RNA, 882 nt, Artificial Sequence
  derived and/or modified sequence opt5 from Caspase_6__Homo_sapiens__AAH00305
augagcuccgccucuggacuuagacgggggcaccccgcuggaggcgaggaaaacaugaccgagacagacgccuucuacaagcgcgaaauguuugauccugcggagaaauauaagauggaccauagacggcgcgggaucgcucucauuuucaaucacgaaagauuuuucuggcaucugacgcuuccggagcggcgcggaaccugcgccgauagagacaaccugacacggcgcuuuagcgaucucggcuucgaggugaaauguuuuaaugaccugaaggccgaggaacuucugcucaaaauccacgaagucuccaccguuucucaugcugaugccgacugcuucguguguguguuucugagccacggggagggaaaccacauuuacgcuuaugaugccaagaucgagauucagacacugaccggccucuucaagggcgacaaaugccauucccuggucgggaagcccaaaaucuuuaucauucaagcguguagaggaaaucagcacgaugugccuguuaucccccuugacguggucgauaaccagacagaaaagcuggacaccaauauuacggagguggacgccgcuucuguuuacacccucccugccggcgcugauuuccugaugugcuauagcguggccgaaggguacuauucccaucgggagacagucaacggaagcugguacauccaggaccuuugugaaaugcugggcaaauacgggucuucccucgaguuuaccgagcugcugacacucgugaaucgcaaggugagccaaagacgggucgauuucugcaaggaccccucugcgauuggcaaaaagcagguuccuuguuucgccuccaugcugaccaaaaagcugcacuuuuucccgaaaagcaacuga

SEQ ID NO: 7080 - RNA, 882 nt, Artificial Sequence
  derived and/or modified sequence opt6 from Caspase_6__Homo_sapiens__AAH00305
augaguagugcaucaggacuaagaagaggacauccagcaggaggagaagaaaacaugacagaaacagaugcauucuacaaaagagaaauguucgacccagcagaaaaauacaaaauggaucaccgaagaagaggaauagcauuaauauucaaucacgaaagauuuuuuuggcacuuaacacuaccagaaagaagaggaacaugcgcagacagagacaaccuaacacgaagauuuucagacuuaggauucgaagucaaaugcuucaaugaccuaaaagcagaagaacuacuacuaaaaauacacgaaguaagcacaguaucacacgcagaugcagacugcuucguaugcguauuuuuaucacacggugaaggaaaucacauauacgcauacgacgcaaaaauagaaauacaaacacuaacaggacuauuuaaaggagacaaaugccacaguuuaguaggaaaaccaaaaauauucauaauacaagcaugcagaggcaaucaacacgacguaccaguaauaccacuagauguaguagauaaccaaacagaaaaacuagacacaaacauaaccgaaguagacgcagcaagcguauacacacuaccagcaggagcagauuuccuaaugugcuacucaguagcagaaggauauuacucacacagagaaacaguaaauggaucaugguacauacaagaccuuugcgaaaugcuuggaaaauaugggucaucacuagaauucacagaacuauuaacacuaguaaauagaaaaguaucacaaagaagagucgacuuuuguaaagacccaucagcaaucggaaaaaaacaaguacccuguuucgcaagcaugcuaacaaaaaaauuacacuucuucccuaaaucaaacuaa

SEQ ID NO: 7081 - protein, 303 aa, Artificial Sequence
  Caspase_7__Homo_sapiens__P55210
MADDQGCIEEQGVEDSANEDSVDAKPDRSSFVPSLFSKKKKNVTMRSIKTTRDRVPTYQYNMNFEKLGKCIIINNKNFDKVTGMGVRNGTDKDAEALFKCFRSLGFDVIVYNDCSCAKMQDLLKKASEEDHTNAACFACILLSHGEENVIYGKDGVTPIKDLTAHFRGDRCKTLLEKPKLFFIQACRGTELDDGIQADSGPINDTDANPRYKIPVEADFLFAYSTVPGYYSWRSPGRGSWFVQALCSILEEHGKDLEIMQILTRVNDRVARHFESQSDDPHFHEKKQIPCVVSMLTKELYFSQ

SEQ ID NO: 7082 - RNA, 912 nt, Artificial Sequence
  Caspase_7__Homo_sapiens__AAC50303
auggcagaugaucagggcuguauugaagagcaggggguugaggauucagcaaaugaagauucaguggaugcuaagccagaccgguccucguuuguaccgucccucuucaguaagaagaagaaaaaugucaccaugcgauccaucaagaccacccgggaccgagugccuacauaucaguacaacaugaauuuugaaaagcugggcaaaugcaucauaauaaacaacaagaacuuugauaaagugacagguaugggcguucgaaacggaacagacaaagaugccgaggcgcucuucaagugcuuccgaagccuggguuuugacgugauugucuauaaugacugcucuugugccaagaugcaagaucugcuuaaaaaagcuucugaagaggaccauacaaaugccgccugcuucgccugcauccucuuaagccauggagaagaaaauguaauuuaugggaaagauggugucacaccaauaaaggauuugacagcccacuuuaggggggauagaugcaaaacccuuuuagagaaacccaaacucuucuucauucaggcuugccgagggaccgagcuugaugauggcauccaggccgacucggggcccaucaaugacacagaugcuaauccucgauacaagaucccaguggaagcugacuuccucuucgccuauuccacgguuccaggcuauuacucguggaggagcccaggaagaggcuccugguuugugcaagcccucugcuccauccuggaggagcacggaaaagaccuggaaaucaugcagauccucaccagggugaaugacagaguugccaggcacuuugagucucagucugaugacccacacuuccaugagaagaagcagauccccuguguggucuccaugcucaccaaggaacucuacuucagucaauag

SEQ ID NO: 7083 - RNA, 912 nt, Artificial Sequence
  derived and/or modified sequence opt1 from Caspase_7__Homo_sapiens__AAC50303
auggccgacgaccagggcugcaucgaggagcaggggguggaggacagcgccaacgaggacuccgucgacgcgaagcccgaccgcagcuccuucgugccgagccuguucuccaagaagaagaagaacgugaccaugcggagcaucaagaccacgcgcgaccggguccccaccuaccaguacaacaugaacuucgagaagcucggcaagugcaucaucaucaacaacaagaacuucgacaaggugaccgggaugggcgugcgcaacgggaccgacaaggacgccgaggcccuguucaagugcuuccggucccugggcuucgacgucaucguguacaacgacugcagcugcgccaagaugcaggaccuccugaagaaggccuccgaggaggaccacacgaacgcggccugcuucgccugcauccugcucagccacggcgaggagaacgugaucuacgggaaggacggcgucacccccaucaaggaccugaccgcccacuuccgcggggaccggugcaagacccugcucgagaagcccaagcuguucuucauccaggcgugccgcggcacggagcuggacgacgggauccaggccgacuccggcccgaucaacgacaccgacgccaacccccgguacaagauccccguggaggccgacuuccucuucgccuacagcaccgugcccggcuacuacuccuggcgcagcccggggcggggcuccugguucguccaggcgcugugcagcauccuggaggagcacgggaaggaccucgagaucaugcagauccugacccgcgugaacgaccggguggcccgccacuucgagucccagagcgacgacccccacuuccacgagaagaagcagauccccugcgucguguccaugcugacgaaggagcucuacuucagccaguga

SEQ ID NO: 7084 - RNA, 912 nt, Artificial Sequence
  derived and/or modified sequence opt2 from Caspase_7__Homo_sapiens__AAC50303
auggccgacgaccagggcugcaucgaggagcagggcgucgaggacuccgccaacgaggacuccgucgacgccaagcccgaccgcuccuccuucguccccucccucuucuccaagaagaagaagaacgucaccaugcgcuccaucaagaccacccgcgaccgcguccccaccuaccaguacaacaugaacuucgagaagcucggcaagugcaucaucaucaacaacaagaacuucgacaaggucaccggcaugggcguccgcaacggcaccgacaaggacgccgaggcccucuucaagugcuuccgcucccucggcuucgacgucaucgucuacaacgacugcuccugcgccaagaugcaggaccuccucaagaaggccuccgaggaggaccacaccaacgccgccugcuucgccugcauccuccucucccacggcgaggagaacgucaucuacggcaaggacggcgucacccccaucaaggaccucaccgcccacuuccgcggcgaccgcugcaagacccuccucgagaagcccaagcucuucuucauccaggccugccgcggcaccgagcucgacgacggcauccaggccgacuccggccccaucaacgacaccgacgccaacccccgcuacaagauccccgucgaggccgacuuccucuucgccuacuccaccguccccggcuacuacuccuggcgcucccccggccgcggcuccugguucguccaggcccucugcuccauccucgaggagcacggcaaggaccucgagaucaugcagauccucacccgcgucaacgaccgcgucgcccgccacuucgagucccaguccgacgacccccacuuccacgagaagaagcagauccccugcgucgucuccaugcucaccaaggagcucuacuucucccaguga

SEQ ID NO: 7085 - RNA, 912 nt, Artificial Sequence
  derived and/or modified sequence opt3 from Caspase_7__Homo_sapiens__AAC50303
auggccgacgaucagggcugcaucgaggaacaagggguggaggacagcgcuaacgaagauuccgucgacgcaaagcccgauagaucuucauucguuccuagucuguuuagcaaaaagaaaaagaaugugaccaugagguccauuaaaacaacucgggaccgcguaccaacguaccaguauaacaugaauuucgagaagcucggaaaguguauaaucauuaacaauaaaaacuuugauaaggugaccgguaugggcguccgaaaugggacagacaaagaugccgaagcgcuuuucaagugcuuucguucucugggauucgacgugaucguuuacaacgauuguucgugcgcuaaaaugcaggacuuguuaaagaaggccucagaggaggaucacacuaaugcagccuguuuugcuugcauucugcuaagccauggcgaagagaacgugaucuaugguaaagacggggucaccccgauaaaggaccucacagcacacuucagaggagauagguguaaaacccugcuugaaaagcccaaacuguuuuucauccaggccugccggggcacugaguuggacgauggcauucaagcugacagugggccuaucaaugauacagacgccaacccacgcuacaagauucccguggaggcggauuuucucuucgcauauuccaccguaccuggauacuauucuuggagaagcccagguaggggcuccugguuuguucaggcccuguguucaauccuggaggaacaugggaaagaccucgaaauaaugcagauuuuaacgcgggugaaugaucgcgucgcucgacacuucgagagucagagcgacgauccccauuuccacgaaaagaagcaaaucccuugcguggugucuaugcugacuaaagagcuuuacuuuucccaguga

SEQ ID NO: 7086 - RNA, 912 nt, Artificial Sequence
  derived and/or modified sequence opt4 from Caspase_7__Homo_sapiens__AAC50303
auggccgacgaccagggcugcaucgaggagcagggcguggaggacagcgccaacgaggacagcguggacgccaagcccgacagaagcagcuucgugcccagccuguucagcaagaagaagaagaacgugaccaugagaagcaucaagaccaccagagacagagugcccaccuaccaguacaacaugaacuucgagaagcugggcaagugcaucaucaucaacaacaagaacuucgacaaggugaccggcaugggcgugagaaacggcaccgacaaggacgccgaggcccuguucaagugcuucagaagccugggcuucgacgugaucguguacaacgacugcagcugcgccaagaugcaggaccugcugaagaaggccagcgaggaggaccacaccaacgccgccugcuucgccugcauccugcugagccacggcgaggagaacgugaucuacggcaaggacggcgugacccccaucaaggaccugaccgcccacuucagaggcgacagaugcaagacccugcuggagaagcccaagcuguucuucauccaggccugcagaggcaccgagcuggacgacggcauccaggccgacagcggccccaucaacgacaccgacgccaaccccagauacaagauccccguggaggccgacuuccuguucgccuacagcaccgugcccggcuacuacagcuggagaagccccggcagaggcagcugguucgugcaggcccugugcagcauccuggaggagcacggcaaggaccuggagaucaugcagauccugaccagagugaacgacagaguggccagacacuucgagagccagagcgacgacccccacuuccacgagaagaagcagauccccugcguggugagcaugcugaccaaggagcuguacuucagccaguga

SEQ ID NO: 7087 - RNA, 912 nt, Artificial Sequence
  derived and/or modified sequence opt5 from Caspase_7__Homo_sapiens__AAC50303
auggccgacgaucagggcugcaucgaggaacaagggguggaggacagcgcuaacgaagauuccgucgacgccaagcccgauagaucuagcuucguuccuucccuguuuucuaaaaagaaaaagaaugugaccaugcggagcauuaaaacaacgcgcgacagagugccgaccuaccaguauaacaugaauuucgagaagcucggaaaguguaucauuaucaacaauaaaaacuuugauaaggucacaggcaugggggugcggaauggaaccgacaaagaugcggaagcucuguucaagugcuuucgcucccuuggcuucgacguuauuguguacaacgauuguucuugcgccaaaaugcaggaccugcucaagaaggccagcgaggaggaucacacaaaugcugccuguuuugcuugcauccugcuuucccauggggaagagaacgucaucuauggaaaagacggcgugacccccauuaaggaccugacagcccacuucagaggcgaucgguguaaaacccuccuggaaaagccuaaacuguuuuucauccaggcgugccgcgggacggagcucgacgauggcauucaagccgacagcggacccaucaaugauaccgacgcuaacccuagauacaagauucccguugaggccgauuuucuguucgcuuauucuacagugccuggguacuauuccuggcggagcccgggacgcggcucuugguuuguccaggcccuuuguuccauccuggaggaacaugggaaagaccucgaaauuaugcagauccugaccagagugaaugaucggguggcgcgccacuucgagagccagucugacgauccccauuuccacgaaaagaagcaaaucccuugcgucguuuccaugcuuacaaaagagcuguacuuuagccaguga

SEQ ID NO: 7088 - RNA, 912 nt, Artificial Sequence
  derived and/or modified sequence opt6 from Caspase_7__Homo_sapiens__AAC50303
auggcugaugaccaaggaugcaucgaagaacaaggaguagaagacucagcaaaugaagacagcguagacgcaaaaccagacagaucaucauucguaccaucacuuuucagcaaaaaaaaaaaaaacguaacaaugagaucaauaaaaacaacaagagacagaguaccaacauaccaauauaacaugaauuuugaaaaacuaggaaaaugcauaauaauaaacaacaaaaacuucgacaaaguaacaggcaugggaguaagaaacggaacagacaaagacgccgaagcacuauucaaaugcuucagaucccuaggauucgacguaauagucuacaacgacugcucaugugccaaaaugcaagaccuauuaaaaaaagcaucagaagaagaucacacaaacgcagcaugcuuugcauguauacuacuaagccacggagaagaaaacguaauauacggaaaagacggaguuacacccauaaaagauuuaacagcacacuucagaggugacagaugcaaaacacuacuagaaaaaccaaaacucuucuucauacaagcaugcagaggaacagaauuagacgacggaauacaagcagacucaggacccauaaacgacacagacgcaaauccaagauacaaaauaccaguagaagcagauuuccuauucgcauacagcacaguaccaggauacuacucauggagaucaccaggaagaggaucaugguucguacaagcacuauguucaauacuagaagaacacggaaaagacuuagaaauaaugcaaauacuaacaagaguuaacgacagaguagcaagacacuucgaaucacaaagcgacgacccccauuuccacgaaaaaaaacaaauaccauguguaguaaguaugcuaacaaaagaauuauacuucucacaauaa

SEQ ID NO: 7089 - protein, 464 aa, Artificial Sequence [sequence omitted]

SEQ ID NO: 7090 - RNA, 1395 nt, Artificial Sequence
  Caspase_8__Homo_sapiens__BAG70096
auggacuucagcagaaaucuuuaugauauuggggaacaacuggacagugaagaucuggccucccucaaguuccugagccuggacuacauuccgcaaaggaagcaagaacccaucaaggaugccuugauguuauuccagagacuccaggaaaagagaauguuggaggaaagcaaucuguccuuccugagggagcugcucuuccgaauuaauagacuggauuugcugauuaccuaccuaaacacuagaaaggaggagauggaaagggaacuucagacaccaggcagggcucaaauuucugccuacagggucaugcucuaucagauuucagaagaagugagcagaucagaauugaggucuuuuaaguuucuuuugcaagaggaaaucuccaaaugcaaacuggaugaugacaugaaccugcuggauauuuucauagagauggagaagagggucauccugggagaaggaaaguuggacauccugaaaagagucugugcccaaaucaacaagagccugcugaagauaaucaacgacuaugaagaauucagcaaaggggaggaguugugugggguaaugacaaucucggacucuccaagagaacaggauagugaaucacagacuuuggacaaaguuuaccaaaugaaaagcaaaccucggggauacugucugaucaucaacaaucacaauuuugcaaaagcacgggagaaagugcccaaacuucacagcauuagggacaggaauggaacacacuuggaugcaggggcuuugaccacgaccuuugaagagcuucauuuugagaucaagccccacgaugacugcacaguagagcaaaucuaugagauuuugaaaaucuaccaacucauggaccacaguaacauggacugcuucaucugcuguauccucucccauggagacaagggcaucaucuauggcacugauggacaggaggcccccaucuaugagcugacaucucaguucacugguuugaagugcccuucccuugcuggaaaacccaaaguguuuuuuauucaggcuugucagggggauaacuaccagaaagguauaccuguugagacugauucagaggagcaacccuauuuagaaauggauuuaucaucaccucaaacgagauauaucccggaugaggcugacuuucugcuggggauggccacugugaauaacuguguuuccuaccgaaacccugcagagggaaccugguacauccagucacuuugccagagccugggagagcgauguccucgaggcgaugauauucucaccauccugacugaagugaacuaugaaguaagcaacaaggaugacaagaaaaacauggggaaacagaugccucagccuacuugcacacuaagaaaaaaacuugucuucccuucugauuaa

SEQ ID NO: 7091 - RNA, 1395 nt, Artificial Sequence
  derived and/or modified sequence opt1 from Caspase_8__Homo_sapiens__BAG70096
auggacuucagccgcaaccuguacgacaucggcgagcagcucgacuccgaggaccuggccagccugaaguuccucucccuggacuacaucccccagcggaagcaggagccgaucaaggacgcccugaugcuguuccagcgccugcaggagaagcggaugcuggaggagagcaaccucuccuuccugcgcgagcuccucuuccggaucaaccgccuggaccugcucaucaccuaccugaacacccggaaggaggagauggagcgcgagcugcagacgcccgggcgggcgcagaucagcgccuaccgcgugaugcucuaccagaucuccgaggaggucagccgguccgagcugcgcagcuucaaguuccugcuccaggaggagaucuccaagugcaagcuggacgacgacaugaaccugcucgacaucuucaucgagauggagaagcgggugauccugggcgaggggaagcuggacauccucaagcgcgugugcgcccagaucaacaagagccugcugaagaucaucaacgacuacgaggaguucuccaagggcgaggagcucugcggggucaugaccaucagcgacagcccccgggagcaggacagcgagucccagacccuggacaagguguaccagaugaaguccaagccccgcggcuacugccugaucaucaacaaccacaacuucgccaaggcccgggagaaggugccgaagcuccacuccauccgcgaccggaacggcacccaccuggacgcgggggcccugacgaccaccuucgaggagcuccacuucgagaucaagccccacgacgacugcaccgucgagcagaucuacgagauccugaagaucuaccagcugauggaccacagcaacauggacugcuucaucugcugcauccucagccacggcgacaaggggaucaucuacggcacggacgggcaggaggcccccaucuacgagcugaccucccaguucaccggccugaagugccccagccucgccggcaagccgaagguguucuucauccaggcgugccagggggacaacuaccagaagggcauccccguggagaccgacuccgaggagcagcccuaccuggagauggaccugagcagcccccagacgcgcuacaucccggacgaggccgacuuccuccuggggauggccaccgucaacaacugcguguccuaccggaaccccgccgagggcaccugguacauccagucccugugccagagccucggcgagcgcugcccccgcggggacgacauccugaccauccugacggaggugaacuacgaggucuccaacaaggacgacaagaagaacaugggcaagcagaugccccagccgaccugcacccugcggaagaagcucguguuccccagcgacuga

SEQ ID NO: 7092 - RNA, 1395 nt, Artificial Sequence
  derived and/or modified sequence opt2 from Caspase_8__Homo_sapiens__BAG70096
auggacuucucccgcaaccucuacgacaucggcgagcagcucgacuccgaggaccucgccucccucaaguuccucucccucgacuacaucccccagcgcaagcaggagcccaucaaggacgcccucaugcucuuccagcgccuccaggagaagcgcaugcucgaggaguccaaccucuccuuccuccgcgagcuccucuuccgcaucaaccgccucgaccuccucaucaccuaccucaacacccgcaaggaggagauggagcgcgagcuccagacccccggccgcgcccagaucuccgccuaccgcgucaugcucuaccagaucuccgaggaggucucccgcuccgagcuccgcuccuucaaguuccuccuccaggaggagaucuccaagugcaagcucgacgacgacaugaaccuccucgacaucuucaucgagauggagaagcgcgucauccucggcgagggcaagcucgacauccucaagcgcgucugcgcccagaucaacaagucccuccucaagaucaucaacgacuacgaggaguucuccaagggcgaggagcucugcggcgucaugaccaucuccgacuccccccgcgagcaggacuccgagucccagacccucgacaaggucuaccagaugaaguccaagccccgcggcuacugccucaucaucaacaaccacaacuucgccaaggcccgcgagaagguccccaagcuccacuccauccgcgaccgcaacggcacccaccucgacgccggcgcccucaccaccaccuucgaggagcuccacuucgagaucaagccccacgacgacugcaccgucgagcagaucuacgagauccucaagaucuaccagcucauggaccacuccaacauggacugcuucaucugcugcauccucucccacggcgacaagggcaucaucuacggcaccgacggccaggaggcccccaucuacgagcucaccucccaguucaccggccucaagugccccucccucgccggcaagcccaaggucuucuucauccaggccugccagggcgacaacuaccagaagggcauccccgucgagaccgacuccgaggagcagcccuaccucgagauggaccucuccuccccccagacccgcuacauccccgacgaggccgacuuccuccucggcauggccaccgucaacaacugcgucuccuaccgcaaccccgccgagggcaccugguacauccagucccucugccagucccucggcgagcgcugcccccgcggcgacgacauccucaccauccucaccgaggucaacuacgaggucuccaacaaggacgacaagaagaacaugggcaagcagaugccccagcccaccugcacccuccgcaagaagcucgucuuccccuccgacuga

SEQ ID NO: 7093 - RNA, 1395 nt, Artificial Sequence
  derived and/or modified sequence opt3 from Caspase_8__Homo_sapiens__BAG70096
auggacuucagcagaaaccuguacgauaucggcgagcagcucgacuccgaagaucuugccucucugaaguuuuugucauuagacuauauuccccaaaggaaacaggagccuauaaaggaugcucugaugcuauuccagcggcuccaggaaaaacgcaugcuggaggaaaguaaucuuagcuuucugcgagagcucuuguuccguaucaacagacuggaccugcucauuaccuacuuaaauacaaggaaggaggaaauggagcgggaacugcaaacuccagggcgcgcacagaucuccgccuauagagugaugcuuuaccagauuucugaggaggucucgaggucagaauugcggagcuuuaaauuccugcuacaggaggaaaucaguaagugcaagcucgaugacgauaugaaccugcuugacauauuuaucgagauggaaaaacgcguuauucugggagaggguaaguuggauauccucaaacgagugugugcgcaaauuaauaagucccuguuaaaaaucauaaacgacuaugaggaguucucuaagggcgaggaacugugcgggguaaugacgauuagcgauuccccgagagagcaggacucagaaagucagacccucgacaagguguaccagaugaaaagcaagcccaggggauauugucuuaucauuaauaaccacaauuuugcuaaagcccgggagaaggucccuaaacugcauucuauccgugaucgcaacggcacacacuuggacgccggugcacuaacuaccacauucgaggaacugcauuuugagaucaagccacacgaugacugcaccguggaacaaauuuacgagauacucaaaaucuaccagcugauggaucauuccaauauggacuguuucauuugcuguauccuuucacacggggauaagggaauaauuuauggcacugacggccaggaagcucccaucuacgagcugacaagccaauuuaccggguugaagugcccuagucucgcaggaaaaccaaagguuuucuucauccaggccugucagggugauaacuaucagaaaggcauucccguggagacggacucugaagaacaaccuuaccuggaaauggauuuauccagcccacagacuagauauaucccggacgaggcugacuuucugcuagggauggccaccgucaauaacugcgugucguacaggaaucccgcggagggaacaugguauauucagucucucugucagucccugggcgaacggugcccucgaggugaugacauacuuacuaucuugaccgagguaaacuacgaaguuucaaacaaggaugacaaaaagaauauggggaagcaaaugccacagcccacaugcacccugcgcaaaaagcucguguucccuagugauuga

SEQ ID NO: 7094 - RNA, 1395 nt, Artificial Sequence
  derived and/or modified sequence opt4 from Caspase_8__Homo_sapiens__BAG70096
auggacuucagcagaaaccuguacgacaucggcgagcagcuggacagcgaggaccuggccagccugaaguuccugagccuggacuacaucccccagagaaagcaggagcccaucaaggacgcccugaugcuguuccagagacugcaggagaagagaaugcuggaggagagcaaccugagcuuccugagagagcugcuguucagaaucaacagacuggaccugcugaucaccuaccugaacaccagaaaggaggagauggagagagagcugcagacccccggcagagcccagaucagcgccuacagagugaugcuguaccagaucagcgaggaggugagcagaagcgagcugagaagcuucaaguuccugcugcaggaggagaucagcaagugcaagcuggacgacgacaugaaccugcuggacaucuucaucgagauggagaagagagugauccugggcgagggcaagcuggacauccugaagagagugugcgcccagaucaacaagagccugcugaagaucaucaacgacuacgaggaguucagcaagggcgaggagcugugcggcgugaugaccaucagcgacagccccagagagcaggacagcgagagccagacccuggacaagguguaccagaugaagagcaagcccagaggcuacugccugaucaucaacaaccacaacuucgccaaggccagagagaaggugcccaagcugcacagcaucagagacagaaacggcacccaccuggacgccggcgcccugaccaccaccuucgaggagcugcacuucgagaucaagccccacgacgacugcaccguggagcagaucuacgagauccugaagaucuaccagcugauggaccacagcaacauggacugcuucaucugcugcauccugagccacggcgacaagggcaucaucuacggcaccgacggccaggaggcccccaucuacgagcugaccagccaguucaccggccugaagugccccagccuggccggcaagcccaagguguucuucauccaggccugccagggcgacaacuaccagaagggcauccccguggagaccgacagcgaggagcagcccuaccuggagauggaccugagcagcccccagaccagauacauccccgacgaggccgacuuccugcugggcauggccaccgugaacaacugcgugagcuacagaaaccccgccgagggcaccugguacauccagagccugugccagagccugggcgagagaugccccagaggcgacgacauccugaccauccugaccgaggugaacuacgaggugagcaacaaggacgacaagaagaacaugggcaagcagaugccccagcccaccugcacccugagaaagaagcugguguuccccagcgacuga

SEQ ID NO: 7095 - RNA, 1395 nt, Artificial Sequence
  derived and/or modified sequence opt5 from Caspase_8__Homo_sapiens__BAG70096
auggacuucagcagaaaccuguacgauaucggcgagcagcucgacuccgaagaucuggccucucuuaaguuucugagccucgacuauauuccccaacggaaacaggagccuaucaaggaugcucugaugcuuuuccagcgccugcaggagaaaagaaugcucgaggaauccaaucugucuuuucugcgggagcuccuguuccgcauuaacagacuugaccugcucaucaccuaccugaauacacggaaggaggaaauggagcgcgaacuucaaacgccggggagagcccagauuagcgcguaucgggugaugcuguaccagaucuccgaggaggucucucgcagcgaacucagauccuuuaaauuccugcugcaggaggaaaucagcaagugcaagcucgaugacgauaugaaccugcuugacauuuuuaucgagauggaaaaacggguuauucugggagagggcaagcucgauauccugaaacgcgugugugcucaaauuaauaagucucuucugaaaaucauuaacgacuaugaggaguucuccaagggggaagaacucugcggagugaugaccaucagcgauucucccagagagcaggacuccgaaagccagacacuggacaaggucuaccagaugaaaucuaagccucggggcuauugucugaucauuaauaaccacaauuuugccaaagcccgcgagaaggugcccaaacuccauuccaucagagaucggaacgggacccaccuggacgcuggagcccuuacaaccacauucgaggaacugcauuuugagauuaagccucacgaugacugcaccguugaacaaaucuacgagauucucaaaaucuaccagcugauggaucauagcaauauggacuguuucaucugcuguauucuuucccacggcgauaagggcaucauuuaugggacggacggacaggaagcucccaucuacgagcugaccucucaauuuacaggccucaagugcccuagccuggccgggaaaccgaagguguucuucauucaggcgugucagggagauaacuaucagaaaggcauccccgucgagaccgacuccgaagaacaaccuuaccuggaaauggaucucagcucuccccagacaagauauaucccugacgaggccgacuuucugcuugggauggcuaccgugaauaacugcguuuccuaccgcaaucccgccgagggaacgugguauauucagagccugugucagucucucggcgaacggugcccgagaggcgaugacauccugacaauucugaccgaggugaacuacgaagucagcaacaaggaugacaaaaagaauauggggaagcaaaugccucagcccacaugcacccuucgcaaaaagcucguguucccuuccgauuga

SEQ ID NO: 7096 - RNA, 1395 nt, Artificial Sequence
  derived and/or modified sequence opt6 from Caspase_8__Homo_sapiens__BAG70096
auggacuucuccagaaacuuauacgacauaggagaacaauuagauucugaagaccucgccucacuaaaauuccuaucauuagacuauauaccacaaagaaaacaagaaccuauaaaagaugcauuaaugcucuuccaaagauuacaagaaaaacgaaugcuagaagaaaguaacuuaucauucuuaagggaacuauuauuccgcauaaaccgucuagaccuucuaauaacauaucuaaacacuagaaaagaagaaauggaacgagaacuacaaacaccaggaagagcacaaauaucagcauauagaguaauguuauaucaaauaagcgaagaaguaaguagaucagaauuaagaagcuucaaauucuuacuacaagaagaaauaucaaaauguaaacucgacgacgauaugaauuuacuagacauauucaucgaaauggaaaaaagaguaauacuaggcgaaggaaaacuagacauauuaaaacgaguaugugcacaaaucaauaaaucgcuauuaaaaauuauaaacgauuacgaagaauucagcaaaggcgaagaacuaugcggaguaaugacaauaucagacucaccaagagaacaagacucagaaucacaaacucuagacaaaguuuaucaaaugaaauccaaaccacgaggauauugccuaauaauaaacaaucacaacuucgcaaaagccagagaaaaaguaccaaaacuccacucaauaagagacagaaacggaacacaccuagacgccggagcacuaacaaccacauucgaagaacuacacuucgaaauaaaaccacacgacgacuguaccguagaacaaauauaugaaauauuaaaaaucuaccaauuaauggaucacucaaauauggacugcuucauaugcugcaucuugucacacggagacaaagggaucauuuacggaacagacggacaagaagcaccaauauacgaacuaaccucacaauucacaggacucaaaugcccaucauuagcaggcaaaccaaaagucuuuuucauccaagcaugccaaggcgauaauuaccaaaaaggaauaccaguagaaacagacagcgaagaacaaccauaccuagaaauggaucucucaucaccccaaacaagauauauaccagaugaagcagacuuccuacuaggcauggcaacuguaaacaacugcguaagcuacagaaacccagcggaaggaaccugguacauacaaucucuaugccaaucauuaggagaaagaugcccaagaggagacgacauacuaacaauuuuaacagaaguaaacuaugaaguauccaauaaagacgauaaaaaaaauauggguaaacaaaugccacaaccaacaugcacccuaagaaaaaaauuaguauucccuagugauuaa

SEQ ID NO: 7097 - protein, 395 aa, Artificial Sequence [sequence omitted]

SEQ ID NO: 7098 - RNA, 1188 nt, Artificial Sequence
  Caspase_8__Homo_sapiens__ABX09989
auggacuucagcagaaaucuuuaugauauuggggaacaacuggacagugaagaucuggccucccucaaguuccugagccuggacuacauuccgcaaaggaagcaagaacccaucaaggaugccuugauguuauuccagagacuccaggaaaagagaauguuggaggaaagcaaucuguccuuccugaaggagcugcucuuccgaauuaauagacuggauuugcugauuaccuaccuaaacacuagaaaggaggagauggaaagggaacuucagacaccaggcagggcucaaauuucugccuacagggucaugcucuaucagauuucagaagaagugagcagaucagaauugaggucuuuuaaguuucuuuugcaagaggaaaucuccaaaugcaaacuggaugaugacaugaaccugcuggauauuuucauagagauggagaagagggucauccugggagaaggaaaguuggacauccugaaaagagucugugcccaaaucaacaagagccugcugaagauaaucaacgacuaugaagaauucagcaaaggggcuuugaccacgaccuuugaagagcuucauuuugagaucaagccccaccaugacugcacaguagagcaaaucuaugagauuuugaaaaucuaccaacucauggaccacaguaacauggacugcuucaucugcuguauccucucccauggagacaagggcaucaucuauggcacugauggacaggaggcccccaucuaugagcugacaucucaguucacugguuugaagugcccuucccuugcuggaaaacccaaaguguuuuuuauucaggcuugucagggggauaacuaccagaaagguauaccuguugagacugauucagaggagcaacccuauuuagaaauggauuuaucaucaccucaaacgagauauaucccggaugaggcugacuuucugcuggggauggccacugugaauaacuguguuuccuaccgaaacccugcagagggaaccugguacauccagucacuuugccagagccugagagagcgauguccucgaggcgaugauauucucaccauccugacugaagugaacuaugaaguaagcaacaaggaugacaagaaaaacauggggaaacagaugccucagccuacuuucacacuaagaaaaaaacuugucuucccuucugauuga

SEQ ID NO: 7099 - RNA, 1188 nt, Artificial Sequence
  derived and/or modified sequence opt1 from Caspase_8__Homo_sapiens__ABX09989
auggacuucagccgcaaccuguacgacaucggcgagcagcucgacuccgaggaccuggccagccugaaguuccucucccuggacuacaucccccagcggaagcaggagccgaucaaggacgcccugaugcuguuccagcgccugcaggagaagcggaugcuggaggagagcaaccucuccuuccugaaggagcuccucuuccgcaucaaccggcuggaccugcucaucaccuaccugaacacccgcaaggaggagauggagcgggagcugcagacgcccgggcgcgcgcagaucagcgccuaccgggugaugcucuaccagaucuccgaggaggucagccgcuccgagcugcggagcuucaaguuccugcuccaggaggagaucuccaagugcaagcuggacgacgacaugaaccugcucgacaucuucaucgagauggagaagcgcgugauccugggcgaggggaagcuggacauccucaagcgggugugcgcccagaucaacaagagccugcugaagaucaucaacgacuacgaggaguucuccaagggcgcccucaccaccaccuucgaggagcugcacuucgagaucaagccccaccacgacugcacggucgagcagaucuacgagauccugaagaucuaccagcucauggaccacagcaacauggacugcuucaucugcugcauccugucccacggggacaagggcaucaucuacggcaccgacgggcaggaggcccccaucuacgagcugaccagccaguucaccggccucaagugcccgucccuggcggggaagcccaagguguucuucauccaggccugccagggcgacaacuaccagaaggggauccccguggagacggacagcgaggagcagcccuaccuggagauggaccucuccagcccgcagacccgcuacauccccgacgaggccgacuuccugcugggcauggccaccgucaacaacugcgugagcuaccggaaccccgcggagggcaccugguacauccagucccucugccagagccugcgcgagcggugcccccgcggggacgacauccugacgauccucaccgaggugaacuacgaggucuccaacaaggacgacaagaagaacaugggcaagcagaugccgcagcccaccuucacccugcggaagaagcugguguuccccagcgacuga

SEQ ID NO: 7100 - RNA, 1188 nt, Artificial Sequence
  derived and/or modified sequence opt2 from Caspase_8__Homo_sapiens__ABX09989
auggacuucucccgcaaccucuacgacaucggcgagcagcucgacuccgaggaccucgccucccucaaguuccucucccucgacuacaucccccagcgcaagcaggagcccaucaaggacgcccucaugcucuuccagcgccuccaggagaagcgcaugcucgaggaguccaaccucuccuuccucaaggagcuccucuuccgcaucaaccgccucgaccuccucaucaccuaccucaacacccgcaaggaggagauggagcgcgagcuccagacccccggccgcgcccagaucuccgccuaccgcgucaugcucuaccagaucuccgaggaggucucccgcuccgagcuccgcuccuucaaguuccuccuccaggaggagaucuccaagugcaagcucgacgacgacaugaaccuccucgacaucuucaucgagauggagaagcgcgucauccucggcgagggcaagcucgacauccucaagcgcgucugcgcccagaucaacaagucccuccucaagaucaucaacgacuacgaggaguucuccaagggcgcccucaccaccaccuucgaggagcuccacuucgagaucaagccccaccacgacugcaccgucgagcagaucuacgagauccucaagaucuaccagcucauggaccacuccaacauggacugcuucaucugcugcauccucucccacggcgacaagggcaucaucuacggcaccgacggccaggaggcccccaucuacgagcucaccucccaguucaccggccucaagugccccucccucgccggcaagcccaaggucuucuucauccaggccugccagggcgacaacuaccagaagggcauccccgucgagaccgacuccgaggagcagcccuaccucgagauggaccucuccuccccccagacccgcuacauccccgacgaggccgacuuccuccucggcauggccaccgucaacaacugcgucuccuaccgcaaccccgccgagggcaccugguacauccagucccucugccagucccuccgcgagcgcugcccccgcggcgacgacauccucaccauccucaccgaggucaacuacgaggucuccaacaaggacgacaagaagaacaugggcaagcagaugccccagcccaccuucacccuccgcaagaagcucgucuuccccuccgacuga

SEQ ID NO: 7101 - RNA, 1188 nt, Artificial Sequence
  derived and/or modified sequence opt3 from Caspase_8__Homo_sapiens__ABX09989
auggacuucagcagaaaccuguacgauaucggcgagcagcucgacuccgaagaucuugccucucugaaguuuuugucauuagacuauauuccccaaaggaaacaggagccuauaaaggaugcucugaugcuauuccagcggcuccaggaaaaacgcaugcuggaggaaaguaaucuuagcuuucugaaggagcucuuguuccgaaucaaccgucuggaccugcucauuaccuacuuaaauacaagaaaagaggaaauggagagggaacugcaaacuccagggcgggcacagaucuccgccuaucgcgugaugcuuuaccagauuucugaggaggucucgagaucagaauugaggagcuuuaaguuccugcuacaggaggaaaucaguaagugcaaacucgaugacgauaugaaccugcuugacauauuuaucgagauggaaaagcggguuauucugggagaggguaaauuggauauccucaagcgcgugugugcgcaaauuaauaaaucccuguuaaagaucauaaacgacuaugaggaguucucuaagggcgcucugacgaccacauuugaggaacuccacuucgagauuaaaccgcaucacgauugcacuguagaacagaucuacgagauucuuaagaucuaucagcugauggaccauagcaauauggacuguuuuaucugcuguauuuugucccacggggauaaaggaauaaucuacggcaccgacggucaggaggcccccauuuacgaacuaacaucacaauucaccgggcugaagugcccuagucucgcaggaaaaccaaagguguuuuucauccaggccugucagggcgauaacuaucaaaaaggcauacccgucgagacugacagcgaagaacagccuuaccuggaaauggaucuuucuuccccacagacacgauauauucccgacgaggcugauuuccuguuggggauggcaaccgugaauaacugcguuucauacagaaauccugccgagggaacgugguauauccagagccucugucaaagucugagggaacggugcccacguggugacgauaucuuaacuauucugaccgaggugaacuacgaagucucuaauaaggacgauaagaaaaacaugggcaagcagaugccgcagcccacauuuacucuacgcaaaaagcucguguucccuuccgacuga

SEQ ID NO: 7102 - RNA, 1188 nt, Artificial Sequence
  derived and/or modified sequence opt4 from Caspase_8__Homo_sapiens__ABX09989
auggacuucagcagaaaccuguacgacaucggcgagcagcuggacagcgaggaccuggccagccugaaguuccugagccuggacuacaucccccagagaaagcaggagcccaucaaggacgcccugaugcuguuccagagacugcaggagaagagaaugcuggaggagagcaaccugagcuuccugaaggagcugcuguucagaaucaacagacuggaccugcugaucaccuaccugaacaccagaaaggaggagauggagagagagcugcagacccccggcagagcccagaucagcgccuacagagugaugcuguaccagaucagcgaggaggugagcagaagcgagcugagaagcuucaaguuccugcugcaggaggagaucagcaagugcaagcuggacgacgacaugaaccugcuggacaucuucaucgagauggagaagagagugauccugggcgagggcaagcuggacauccugaagagagugugcgcccagaucaacaagagccugcugaagaucaucaacgacuacgaggaguucagcaagggcgcccugaccaccaccuucgaggagcugcacuucgagaucaagccccaccacgacugcaccguggagcagaucuacgagauccugaagaucuaccagcugauggaccacagcaacauggacugcuucaucugcugcauccugagccacggcgacaagggcaucaucuacggcaccgacggccaggaggcccccaucuacgagcugaccagccaguucaccggccugaagugccccagccuggccggcaagcccaagguguucuucauccaggccugccagggcgacaacuaccagaagggcauccccguggagaccgacagcgaggagcagcccuaccuggagauggaccugagcagcccccagaccagauacauccccgacgaggccgacuuccugcugggcauggccaccgugaacaacugcgugagcuacagaaaccccgccgagggcaccugguacauccagagccugugccagagccugagagagagaugccccagaggcgacgacauccugaccauccugaccgaggugaacuacgaggugagcaacaaggacgacaagaagaacaugggcaagcagaugccccagcccaccuucacccugagaaagaagcugguguuccccagcgacuga

SEQ ID NO: 7103 - RNA, 1188 nt, Artificial Sequence
  derived and/or modified sequence opt5 from Caspase_8__Homo_sapiens__ABX09989
auggacuucagcagaaaccuguacgauaucggcgagcagcucgacuccgaagaucuggccucucuuaaguuucugagccucgacuauauuccccaacggaaacaggagccuaucaaggaugcucugaugcuuuuccagcgccugcaggagaaaagaaugcucgaggaauccaaucugucuuuucugaaggagcuccuguuccggauuaaccgccuugaccugcucaucaccuaccugaauacaagaaaagaggaaauggagcgggaacuucaaacgccggggcgcgcccagauuagcgcguauagagugaugcuguaccagaucuccgaggaggucucucggagcgaacuccgcuccuuuaaguuccugcugcaggaggaaaucagcaagugcaaacucgaugacgauaugaaccugcuugacauuuuuaucgagauggaaaagagaguuauucugggagagggcaaacucgauauccugaagcgggugugugcucaaauuaauaaaucucuucugaagaucauuaacgacuaugaggaguucuccaagggggcccucaccacaaccuuugaagaacugcacuucgagaucaaaccccaucacgauugcacaguggaacagaucuacgagauucugaagaucuaucagcucauggaccauagcaauauggacuguuuuauuugcuguauccugucucacggagauaaaggcauuaucuacgggaccgacggacaggaggccccuaucuacgaacuuacaucccaauucaccggccugaagugccccagccucgcuggcaaaccuaaggucuuuuucauucaggccugucagggggauaacuaucaaaaaggaauccccguggagacggacucugaagaacagccuuaccuggaaauggaucuuuccagcccgcagacccgcuauauucccgacgaggcugauuuccugcucggcauggccacaguuaauaacugcguguccuacagaaauccugcggaggggaccugguauauccagucucugugucaaagccugcgggaacgcugccccagaggagacgauauucucacaauccugaccgaggucaacuacgaaguguccaauaaggacgauaagaaaaacaugggcaagcagaugccucagcccacguuuacacuucggaaaaagcugguuuucccgagcgacuga

SEQ ID NO: 7104 - RNA, 1188 nt, Artificial Sequence
  derived and/or modified sequence opt6 from Caspase_8__Homo_sapiens__ABX09989
auggacuucuccagaaaucuauacgacauaggagaacaacuagacucagaagaccuagcuucucuaaaauuucuaucacuagacuacauaccacaacgaaaacaagaaccaauaaaagacgcauuaaugcuauuccaaagauuacaagaaaaaagaaugcuagaagaaucaaaucuaucauuccuaaaagaacuacuauuuagaauaaacagacucgaccuccuaauaacauaccuaaacacaagaaaagaagaaauggaaagagaacuccaaaccccaggaagagcacaaauaucagcauaccgaguaaugcuauaucaaauaucagaagaagucucacgaucagaacuacgauccuucaaauuccuauuacaagaagaaauaucaaaaugcaaacuagacgacgacaugaacuuacuagacauauuuauagaaauggaaaaaagaguaauacuaggagagggcaaacucgacauacuaaaaagaguuugcgcccaaauuaauaaaucacugcuaaaaauaaucaaugacuacgaagaauucucaaaaggagcacuaaccacuacauucgaagaacugcacuucgaaauaaaaccacaccacgacuguacaguagaacaaauauacgaaauauuaaaaauauaccaacugauggaucauuccaauauggacugcuuuauaugcugcauacucucacacggagacaaaggaauaauauacggaacagacggucaagaagcaccaauauacgaacuuacaucacaauucacaggauuaaaaugcccaucauuagccggaaaaccaaaaguauucuucauccaagcaugccaaggcgacaacuaccaaaaaggcauaccaguagaaacagacagugaagaacaaccauacuuagaaauggauuuauccucaccccaaacaagauauauacccgacgaagcagacuucuuacuaggaauggcaacuguuaauaacugcguuucauauagaaauccagcagaaggaacaugguauauacaaucauuaugccaaagccuaagagaaagaugccccagaggagacgauauacuuacaauacuaacagaaguaaacuacgaaguuuccaacaaagacgacaaaaaaaacaugggcaaacaaaugccucaaccaacauucacuuuaagaaaaaaauuaguauucccuagcgauuaa

SEQ ID NO: 7105 - protein, 108 aa, Artificial Sequence
  Caspase_8__Homo_sapiens__C3S3G0
MDFSRNLYDIGEQLDSEDLASLKFLSLDYIPQRKQEPIKDALMLFQRLQEKRMLEESNLSFLKELLFRINRLDLLITYLNTRKEEMERELQTPGRAQISAYRTCWIFS

SEQ ID NO: 7106 - RNA, 327 nt, Artificial Sequence
  Caspase_8__Homo_sapiens__ACF93415
auggacuucagcagaaaucuuuaugauauuggggaacaacuggacagugaagaucuggccucccucaaguuccugagccuggacuacauuccgcaaaggaagcaagaacccaucaaggaugccuugauguuauuccagagacuccaggaaaagagaauguuggaggaaagcaaucuguccuuccugaaggagcugcucuuccgaauuaauagacuggauuugcugauuaccuaccuaaacacuagaaaggaggagauggaaagggaacuucagacaccaggcagggcucaaauuucugccuacagaaccugcuggauauuuucauag

SEQ ID NO: 7107 - RNA, 327 nt, Artificial Sequence
  derived and/or modified sequence opt1 from Caspase_8__Homo_sapiens__ACF93415
auggacuucagccgcaaccuguacgacaucggcgagcagcucgacuccgaggaccuggccagccugaaguuccucucccuggacuacaucccccagcggaagcaggagccgaucaaggacgcccugaugcuguuccagcgccugcaggagaagcggaugcuggaggagagcaaccucuccuuccugaaggagcuccucuuccgcaucaaccggcuggaccugcucaucaccuaccugaacacccgcaaggaggagauggagcgggagcugcagacgcccgggcgcgcgcagaucagcgccuaccggaccugcuggaucuucuccuga

SEQ ID NO: 7108 - RNA, 327 nt, Artificial Sequence
  derived and/or modified sequence opt2 from Caspase_8__Homo_sapiens__ACF93415
auggacuucucccgcaaccucuacgacaucggcgagcagcucgacuccgaggaccucgccucccucaaguuccucucccucgacuacaucccccagcgcaagcaggagcccaucaaggacgcccucaugcucuuccagcgccuccaggagaagcgcaugcucgaggaguccaaccucuccuuccucaaggagcuccucuuccgcaucaaccgccucgaccuccucaucaccuaccucaacacccgcaaggaggagauggagcgcgagcuccagacccccggccgcgcccagaucuccgccuaccgcaccugcuggaucuucuccuga

SEQ ID NO: 7109 - RNA, 327 nt, Artificial Sequence
  derived and/or modified sequence opt3 from Caspase_8__Homo_sapiens__ACF93415
auggacuucagcagaaaccuguacgauaucggcgagcagcucgacuccgaagaucuugccucucugaaguuuuugucauuagacuauauuccccaaaggaaacaggagccuauaaaggaugcucugaugcuauuccagcggcuccaggaaaaacgcaugcuggaggaaaguaaucuuagcuuucugaaggaguugcucuuucgaaucaaccgucuggaccugcucauuaccuacuuaaauacaagaaaagaggaaauggagagggaacugcaaacuccagggcgggcacagaucuccgccuaucgcacgugcuggauuuucucuuga

SEQ ID NO: 7110 - RNA, 327 nt, Artificial Sequence
  derived and/or modified sequence opt4 from Caspase_8__Homo_sapiens__ACF93415
auggacuucagcagaaaccuguacgacaucggcgagcagcuggacagcgaggaccuggccagccugaaguuccugagccuggacuacaucccccagagaaagcaggagcccaucaaggacgcccugaugcuguuccagagacugcaggagaagagaaugcuggaggagagcaaccugagcuuccugaaggagcugcuguucagaaucaacagacuggaccugcugaucaccuaccugaacaccagaaaggaggagauggagagagagcugcagacccccggcagagcccagaucagcgccuacagaaccugcuggaucuucagcuga

SEQ ID NO: 7111 - RNA, 327 nt, Artificial Sequence
  derived and/or modified sequence opt5 from Caspase_8__Homo_sapiens__ACF93415
auggacuucagcagaaaccuguacgauaucggcgagcagcucgacuccgaagaucuggccucucuuaaguuucugagccucgacuauauuccccaacggaaacaggagccuaucaaggaugcucugaugcuuuuccagcgccugcaggagaaaagaaugcucgaagaauccaaucugucuuuucugaaggagcuccuguuccggauuaaccgccuugaccugcucaucaccuaccugaauacaagaaaagaggaaauggagcgggaacuucaaacgccggggcgcgcccagauuagcgcguauagaaccugcuggaucuuuuccuga

SEQ ID NO: 7112 - RNA, 327 nt, Artificial Sequence
  derived and/or modified sequence opt6 from Caspase_8__Homo_sapiens__ACF93415
auggacuucucaagaaaccuauacgacauaggagaacaacuagacucagaagaccuagcaucacuaaaauuccuaucacuagacuacauaccacaaagaaaacaagaaccaauaaaagacgcacuaaugcuauuccaaagacuacaagaaaaaagaaugcuagaagaaucaaaccuaucauuccuaaaagaacuacuauucagaauaaacagacuagaccuacuaauaacauaccuaaacacaagaaaagaagaaauggaaagagaacuacaaacaccaggaagagcacaaauaucagcauacagaacaugcuggauauucucauaa

SEQ ID NO: 7113 - protein, 479 aa, Artificial Sequence
  Caspase_8__Homo_sapiens__Q14790
MDFSRNLYDIGEQLDSEDLASLKFLSLDYIPQRKQEPIKDALMLFQRLQEKRMLEESNLSFLKELLFRINRLDLLITYLNTRKEEMERELQTPGRAQISAYRVMLYQISEEVSRSELRSFKFLLQEEISKCKLDDDMNLLDIFIEMEKRVILGEGKLDILKRVCAQINKSLLKIINDYEEFSKERSSSLEGSPDEFSNGEELCGVMTISDSPREQDSESQTLDKVYQMKSKPRGYCLIINNHNFAKAREKVPKLHSIRDRNGTHLDAGALTTTFEELHFEIKPHDDCTVEQIYEILKIYQLMDHSNMDCFICCILSHGDKGIIYGTDGQEAPIYELTSQFTGLKCPSLAGKPKVFFIQACQGDNYQKGIPVETDSEEQPYLEMDLSSPQTRYIPDEADFLLGMATVNNCVSYRNPAEGTWYIQSLCQSLRERCPRGDDILTILTEVNYEVSNKDDKKNMGKQMPQPTFTLRKKLVFPSD

SEQ ID NO: 7114 - RNA, 1440 nt, Artificial Sequence
  Caspase_8__Homo_sapiens__CAA66853
auggacuucagcagaaaucuuuaugauauuggggaacaacuggacagugaagaucuggccucccucaaguuccugagccuggacuacauuccgcaaaggaagcaagaacccaucaaggaugccuugauguuauuccagagacuccaggaaaagagaauguuggaggaaagcaaucuguccuuccugaaggagcugcucuuccgaauuaauagacuggauuugcugauuaccuaccuaaacacuagaaaggaggagauggaaagggaacuucagacaccaggcagggcucaaauuucugccuacagggucaugcucuaucagauuucagaagaagugagcagaucagaauugaggucuuuuaaguuucuuuugcaagaggaaaucuccaaaugcaaacuggaugaugacaugaaccugcuggauauuuucauagagauggagaagagggucauccugggagaaggaaaguuggacauccugaaaagagucugugcccaaaucaacaagagccugcugaagauaaucaacgacuaugaagaauucagcaaagagagaagcagcagccuugaaggaaguccugaugaauuuucaaauggggaggaguugugugggguaaugacaaucucggacucuccaagagaacaggauagugaaucacagacuuuggacaaaguuuaccaaaugaaaagcaaaccucggggauacugucugaucaucaacaaucacaauuuugcaaaagcacgggagaaagugcccaaacuucacagcauuagggacaggaauggaacacacuuggaugcaggggcuuugaccacgaccuuugaagagcuucauuuugagaucaagccccacgaugacugcacaguagagcaaaucuaugagauuuugaaaaucuaccaacucauggaccacaguaacauggacugcuucaucugcuguauccucucccauggagacaaaggcaucaucuauggcacugauggacaggaggcccccaucuaugagcugacaucucaguucacugguuugaagugcccuucccuugcuggaaaacccaaaguguuuuuuauucaggcuugucagggggauaacuaccagaaagguauaccuguugagacugauucagaggagcaacccuauuuagaaauggauuuaucaucaccucaaacgagauauaucccggaugaggcugacuuucugcuggggauggccacugugaauaacuguguuuccuaccgaaacccugcagagggaaccugguacauccagucacuuugccagagccugagagagcgauguccucgaggcgaugauauucucaccauccugacugaagugaacuaugaaguaagcaacaaggaugacaagaaaaacauggggaaacagaugccucagccuacuuucacacuaagaaaaaaacuugucuucccuucugauuga

SEQ ID NO: 7115 - RNA, 1440 nt, Artificial Sequence
  derived and/or modified sequence opt1 from Caspase_8__Homo_sapiens__CAA66853
auggacuucagccgcaaccuguacgacaucggcgagcagcucgacuccgaggaccuggccagccugaaguuccucucccuggacuacaucccccagcggaagcaggagccgaucaaggacgcccugaugcuguuccagcgccugcaggagaagcggaugcuggaggagagcaaccucuccuuccugaaggagcuccucuuccgcaucaaccggcuggaccugcucaucaccuaccugaacacccgcaaggaggagauggagcgggagcugcagacgcccgggcgcgcgcagaucagcgccuaccgggugaugcucuaccagaucuccgaggaggucagccgcuccgagcugcggagcuucaaguuccugcuccaggaggagaucuccaagugcaagcuggacgacgacaugaaccugcucgacaucuucaucgagauggagaagcgcgugauccugggcgaggggaagcuggacauccucaagcgggugugcgcccagaucaacaagagccugcugaagaucaucaacgacuacgaggaguucuccaaggagcgcagcuccagccucgagggcucccccgacgaguucagcaacggggaggagcugugcggcgucaugaccaucuccgacagcccccgggagcaggacagcgagucccagacccuggacaagguguaccagaugaaguccaagccgcgcggcuacugccucaucaucaacaaccacaacuucgccaaggcccgggagaaggugcccaagcugcacagcauccgcgaccggaacgggacccaccuggacgcgggcgcccucacgaccaccuucgaggagcugcacuucgagaucaagccccacgacgacugcaccgucgagcagaucuacgagauccugaagaucuaccagcucauggaccacagcaacauggacugcuucaucugcugcauccugucccacggggacaagggcaucaucuacgggacggacggccaggaggcccccaucuacgagcugaccagccaguucaccggccucaagugcccgucccuggccgggaagcccaagguguucuucauccaggcgugccagggcgacaacuaccagaaggggauccccguggagaccgacagcgaggagcagcccuaccuggagauggaccucuccagcccgcagacgcgcuacauccccgacgaggccgacuuccugcugggcauggccaccgucaacaacugcguguccuaccggaaccccgccgagggcaccugguacauccagagccucugccagucccugcgcgagcgcugcccccgcggggacgacauccugaccauccugacggaggugaacuacgaggucagcaacaaggacgacaagaagaacaugggcaagcagaugccgcagcccaccuucacccuccggaagaagcugguguuccccuccgacuga

SEQ ID NO: 7116 - RNA, 1440 nt, Artificial Sequence
  derived and/or modified sequence opt2 from Caspase_8__Homo_sapiens__CAA66853
auggacuucucccgcaaccucuacgacaucggcgagcagcucgacuccgaggaccucgccucccucaaguuccucucccucgacuacaucccccagcgcaagcaggagcccaucaaggacgcccucaugcucuuccagcgccuccaggagaagcgcaugcucgaggaguccaaccucuccuuccucaaggagcuccucuuccgcaucaaccgccucgaccuccucaucaccuaccucaacacccgcaaggaggagauggagcgcgagcuccagacccccggccgcgcccagaucuccgccuaccgcgucaugcucuaccagaucuccgaggaggucucccgcuccgagcuccgcuccuucaaguuccuccuccaggaggagaucuccaagugcaagcucgacgacgacaugaaccuccucgacaucuucaucgagauggagaagcgcgucauccucggcgagggcaagcucgacauccucaagcgcgucugcgcccagaucaacaagucccuccucaagaucaucaacgacuacgaggaguucuccaaggagcgcuccuccucccucgagggcucccccgacgaguucuccaacggcgaggagcucugcggcgucaugaccaucuccgacuccccccgcgagcaggacuccgagucccagacccucgacaaggucuaccagaugaaguccaagccccgcggcuacugccucaucaucaacaaccacaacuucgccaaggcccgcgagaagguccccaagcuccacuccauccgcgaccgcaacggcacccaccucgacgccggcgcccucaccaccaccuucgaggagcuccacuucgagaucaagccccacgacgacugcaccgucgagcagaucuacgagauccucaagaucuaccagcucauggaccacuccaacauggacugcuucaucugcugcauccucucccacggcgacaagggcaucaucuacggcaccgacggccaggaggcccccaucuacgagcucaccucccaguucaccggccucaagugccccucccucgccggcaagcccaaggucuucuucauccaggccugccagggcgacaacuaccagaagggcauccccgucgagaccgacuccgaggagcagcccuaccucgagauggaccucuccuccccccagacccgcuacauccccgacgaggccgacuuccuccucggcauggccaccgucaacaacugcgucuccuaccgcaaccccgccgagggcaccugguacauccagucccucugccagucccuccgcgagcgcugcccccgcggcgacgacauccucaccauccucaccgaggucaacuacgaggucuccaacaaggacgacaagaagaacaugggcaagcagaugccccagcccaccuucacccuccgcaagaagcucgucuuccccuccgacuga

SEQ ID NO: 7117 - RNA, 1440 nt, Artificial Sequence
  derived and/or modified sequence opt3 from Caspase_8__Homo_sapiens__CAA66853
auggacuucagcagaaaccuguacgauaucggcgagcagcucgacuccgaagaucuugccucucugaaguuuuugucauuagacuauauuccccaaaggaaacaggagccuauaaaggaugcucugaugcuauuccagcggcuccaggaaaaacgcaugcuggaggaaaguaaucuuagcuuucugaaggagcuccucuuccgaaucaaccgucuggaccugcucauuaccuacuuaaauacaagaaaagaggaaauggagagggaacugcaaacuccagggcgggcacagaucuccgccuaucgcgugaugcuuuaccagauuucugaggaggucucgagaucagaauugaggagcuuuaaguuccugcuacaggaggaaaucaguaagugcaaacucgaugacgauaugaaccugcuugacauauuuaucgagauggaaaagcggguuauucugggagaggguaaauuggauauccucaagcgcgugugugcgcaaauuaauaaaucccuguuaaagaucauaaacgacuaugaggaguucucuaaggagcgaagcuccucacuggaaggcaguccggaugaguuuagcaauggggaagaguugugcggaguaaugacgauuucugacucccccagagagcaggacucagaaagccagacccuugauaaaguguaccagaugaagaguaaaccuaggggcuauugucugaucauuaacaaucacaacuucgcuaaggcccgggagaaagucccaaaguugcauucuauccgugaccgcaaugguacacaccuagaugcaggggcccugacuaccacauuugaagaacuccauuucgaaaucaaaccccacgacgauugcaccguggagcaaauuuacgagauacugaagaucuaccagcuuauggaccauuccaacauggauuguuuuauuugcuguauccugagccacggagacaagggcauaauuuauggcacugaugggcaggaagcuccuaucuacgaguugacaucgcaauucaccggacucaaaugcccaucucuggcagguaagcccaaaguuuucuuuauccaggccugucagggcgacaauuaucagaaggggauuccuguggaaacggauuccgaggagcaaccauacuuagaaauggaccugucaaguccgcagacuagauauauccccgacgaggcugauuuccuacucggaauggccaccgucaacaauugcgugagcuacaggaacccugcggaaggcacaugguauauucagucccugugucagucucuucgggagcgaugcccacgcggugacgauauauugacuauccugaccgaaguaaacuacgagguuagcaauaaagacgauaagaagaacauggggaaacaaaugccccagccuacauuuacccucagaaagaaacugguguucccaucagacuga

SEQ ID NO: 7118 - RNA, 1440 nt, Artificial Sequence
  derived and/or modified sequence opt4 from Caspase_8__Homo_sapiens__CAA66853
auggacuucagcagaaaccuguacgacaucggcgagcagcuggacagcgaggaccuggccagccugaaguuccugagccuggacuacaucccccagagaaagcaggagcccaucaaggacgcccugaugcuguuccagagacugcaggagaagagaaugcuggaggagagcaaccugagcuuccugaaggagcugcuguucagaaucaacagacuggaccugcugaucaccuaccugaacaccagaaaggaggagauggagagagagcugcagacccccggcagagcccagaucagcgccuacagagugaugcuguaccagaucagcgaggaggugagcagaagcgagcugagaagcuucaaguuccugcugcaggaggagaucagcaagugcaagcuggacgacgacaugaaccugcuggacaucuucaucgagauggagaagagagugauccugggcgagggcaagcuggacauccugaagagagugugcgcccagaucaacaagagccugcugaagaucaucaacgacuacgaggaguucagcaaggagagaagcagcagccuggagggcagccccgacgaguucagcaacggcgaggagcugugcggcgugaugaccaucagcgacagccccagagagcaggacagcgagagccagacccuggacaagguguaccagaugaagagcaagcccagaggcuacugccugaucaucaacaaccacaacuucgccaaggccagagagaaggugcccaagcugcacagcaucagagacagaaacggcacccaccuggacgccggcgcccugaccaccaccuucgaggagcugcacuucgagaucaagccccacgacgacugcaccguggagcagaucuacgagauccugaagaucuaccagcugauggaccacagcaacauggacugcuucaucugcugcauccugagccacggcgacaagggcaucaucuacggcaccgacggccaggaggcccccaucuacgagcugaccagccaguucaccggccugaagugccccagccuggccggcaagcccaagguguucuucauccaggccugccagggcgacaacuaccagaagggcauccccguggagaccgacagcgaggagcagcccuaccuggagauggaccugagcagcccccagaccagauacauccccgacgaggccgacuuccugcugggcauggccaccgugaacaacugcgugagcuacagaaaccccgccgagggcaccugguacauccagagccugugccagagccugagagagagaugccccagaggcgacgacauccugaccauccugaccgaggugaacuacgaggugagcaacaaggacgacaagaagaacaugggcaagcagaugccccagcccaccuucacccugagaaagaagcugguguuccccagcgacuga

SEQ ID NO: 7119 - RNA, 1440 nt, Artificial Sequence
  derived and/or modified sequence opt5 from Caspase_8__Homo_sapiens__CAA66853
auggacuucagcagaaaccuguacgauaucggcgagcagcucgacuccgaagaucuggccucucuuaaguuucugagccucgacuauauuccccaacggaaacaggagccuaucaaggaugcucugaugcuuuuccagcgccugcaggagaaaagaaugcucgaggaauccaaucugucuuuucugaaggagcuccuguuccggauuaaccgccuugaccugcucaucaccuaccugaauacaagaaaagaggaaauggagcgggaacuucaaacgccggggcgcgcccagauuagcgcguauagagugaugcuguaccagaucuccgaggaggucucucggagcgaacuccgcuccuuuaaguuccugcugcaggaggaaaucagcaagugcaaacucgaugacgauaugaaccugcuugacauuuuuaucgagauggaaaagagaguuauucugggagagggcaaacucgauauccugaagcgggugugugcucaaauuaauaaaucucuucugaagaucauuaacgacuaugaggaguucuccaaggagcgcagcagcucccucgaagggagccccgaugaguuuucuaauggagaagaacugugcggcgugaugaccaucuccgacagcccuagagagcaggacuccgaaucucagacacuggauaaagucuaccagaugaagucuaaaccccggggguauugucucaucauuaacaaucacaacuucgccaaggcccgcgagaaagugccuaagcugcauuccaucagagaccggaauggaacccaccuugaugcuggcgcccugacaaccacauuugaagaacuccauuucgaaauuaaaccccacgacgauugcaccguugagcaaaucuacgagauucugaagaucuaccagcuuauggaccauagcaacauggauuguuuuaucugcuguauucugucucacggcgacaaggggaucauuuauggaacggauggccaggaagcuccuaucuacgagcucaccucccaauucacagggcugaaaugcccgagccuggccggaaagcccaaaguguucuuuauucaggcgugucagggcgacaauuaucagaaggggaucccugucgaaaccgauucugaggagcaacccuaccucgaaauggaccugagcuccccucagacaagauauauccccgacgaggccgauuuccuucugggaauggcuaccgugaacaauugcguuucuuaccgcaacccggccgaaggcacgugguauauucagagccucugucagucccugcgggagagaugcccucgcggcgacgauauccugacaauucuuaccgaagugaacuacgaggucagcaauaaagacgauaagaagaacauggggaaacaaaugccccagccuacauuuacccuccggaagaaacugguguuccccucugacuga

SEQ ID NO: 7120 - RNA, 1440 nt, Artificial Sequence
  derived and/or modified sequence opt6 from Caspase_8__Homo_sapiens__CAA66853
auggacuucucaagaaauuuauacgacauaggugaacaacuagauucagaagacuuagcaucucuaaaguuucuuucacuagacuacauaccacaaagaaaacaagaaccaauaaaagaugcccuaaugcuauuccaaagauuacaagaaaaacgaaugcuagaagaaucaaauuuaucuuuucucaaagaauuacucuuuagaauaaacagacuagaccuacuaauaacauaccugaacacacgcaaagaagaaauggaacgagaacuacaaaccccaggaagagcacaaauaucagcauauagaguaaugcuauaccaaaucuccgaagaaguauccagaucagaacuaagaucauuuaaauuccuccuacaagaagaaauuucaaaauguaaauuagacgacgacaugaaucuacuagacaucuucauagaaauggaaaaaagaguaauacuaggagaaggaaaauuagauauacuaaaacgaguaugcgcacaaauaaauaaaucauuauuaaaaaucauaaacgacuaugaagaauuuucaaaagaaagaaguucaucauuagaaggaucacccgacgaauucuccaauggagaagaauuaugcggaguaaugacaaucucagacaguccaagagaacaagacucagaaucacaaacccucgacaaaguauaccaaaugaaaucaaaaccaagaggauacugucuaauaauaaacaaccacaacuucgccaaagcaagagaaaaaguacccaaauuacacuccaucagagacagaaacgguacucaucuagaugcaggcgcucuuacaacuacauucgaagaacuacacuucgaaauaaaaccucacgacgacugcacaguagaacaaauauaugaaauacuaaaaaucuaucaacuaauggaucauucaaacauggacugcuucauuugcugcauacuaucucacggagacaaaggaauaaucuacggaacagacggacaagaagcaccaauauaugaauuaacaagccaauuuacaggacuaaaauguccaucacucgcaggaaaaccuaaaguauuuuucauacaagcaugccaaggcgauaauuaccaaaaaggaauacccguagaaacagacuccgaagaacaaccauaccucgaaauggaucuaucaucaccacaaacucgauauauaccagacgaagcagacuuuuuauuaggcauggcaacaguaaauaauugcguaucauauagaaacccagccgaaggcacuugguacauacaaucccuaugucaaucauuaagagaacgaugcccccgaggagacgacauacucacaauauuaacagaaguaaacuaugaaguauccaauaaagacgauaaaaaaaacaugggcaaacaaaugccucaaccuacauuuacacucagaaaaaaacuaguauuuccaagcgacuaa

SEQ ID NO: 7121 - protein, 536 aa, Artificial Sequence
  Caspase_9__Homo_sapiens__A0A024R8F1
MSDYENDDECWSVLEGFRVTLTSVIDPSRITPYLRQCKVLNPDDEEQVLSDPNLVIRKRKVGVLLDILQRTGHKGYVAFLESLELYYPQLYKKVTGKEPARVFSMIIDASGESGLTQLLMTEVMKLQKKVQDLTALLSSKDDFIKELRVKDSLLRKHQERVQRLKEECEAGSRELKRCKEENYDLAMRLAHQSEEKGAALMRNRDLQLEIDQLKHSLMKAEDDCKVERKHTLKLRHAMEQRPSQELLWELQQEKALLQARVQELEASVQEGKLDRSSPYIQVLEEDWRQALRDHQEQANTIFSLRKDLRQGEARRLRCMEEKEMFELQCLALRKDSKMYKDRIEAILLQMEEVAIERDQAIATREELHAQHARGLQEKDALRKQVRELGEKADELQLQVFQCEAQLLAVEGRLRRQQLETLVLSSDLEDGSPRRSQELSLPQDLEDTQLSDKGCLAGGGSPKQPFAALHQEQVLRNPHDAGLSSGEPPEKERRRLKESFENYRRKRALRKMQKGWRQGEEDRENTTGSDNTDTEGS

SEQ ID NO: 7122 - RNA, 1611 nt, Artificial Sequence
  Caspase_9__Homo_sapiens__EAW88222
augucggacuacgagaacgaugacgagugcuggagcguccuggagggcuuccgggugacgcucaccucggucaucgaccccucacgcaucacaccuuaccugcggcagugcaagguccugaaccccgaugaugaggagcaggugcucagcgaccccaaccuggucauccgcaaacggaaagugggugugcuccuggacauccugcagcggaccggccacaagggcuacguggccuuccucgagagccuggagcucuacuacccgcagcuguacaagaaggucacaggcaaggagccggcccgcgucuucuccaugaucaucgacgcguccggggagucaggccugacucagcugcugaugacugaggucaugaagcugcagaagaaggugcaggaccugaccgcgcugcugagcuccaaagaugacuucaucaaggagcugcgggugaaggacagccugcugcgcaagcaccaggagcgugugcagaggcucaaggaggagugcgaggccggcagccgcgagcucaagcgcugcaaggaggagaacuacgaccuggccaugcgccuggcgcaccagagugaggagaagggcgccgcgcucaugcggaaccgugaccugcagcuggagauugaccagcucaagcacagccucaugaaggccgaggacgacugcaagguggagcgcaagcacacgcugaagcucaggcacgccauggagcagcggcccagccaggagcugcugugggagcugcagcaggagaaggcccugcuccaggcccgggugcaggagcuggaggccuccguccaggaggggaagcuggacaggagcagccccuacauccagguacuggaggaggacuggcggcaggcgcugcgggaccaccaggagcaggccaacaccaucuucucccugcgcaaggaccuccgccagggcgaggcccgacgccuccggugcauggaggagaaggagauguucgagcugcagugccuggcacuacguaaggacuccaagauguacaaggaccgcaucgaggccauccugcugcagauggaggaggucgccauugagcgggaccaggccauagccacgcgggaggagcugcacgcacagcacgcccggggccugcaggagaaggacgcgcugcgcaagcaggugcgggagcugggcgagaaggcggaugagcugcagcugcagguguuccagugugaggcgcagcuacuggccguggagggcaggcucaggcggcagcagcuggagacgcucguccugagcuccgaccuggaagauggcucacccaggaggucccaggagcucucacucccccaggaccuggaggacacccagcucucagacaaaggcugccuugccggcggggggagcccgaaacagcccuuugcagcucugcaccaggagcagguuuugcggaacccccaugacgcaggccugagcagcggggagccgcccgagaaggagcggcggcgccucaaagagaguuuugagaacuaccgcaggaagcgcgcccucaggaagaugcagaaaggauggcggcagggggaggaggaccgggagaacaccacgggcagcgacaacaccgacacugagggcuccuag

SEQ ID NO: 7123 - RNA, 1611 nt, Artificial Sequence
  derived and/or modified sequence opt1 from Caspase_9__Homo_sapiens__EAW88222
augagcgacuacgagaacgacgacgagugcugguccgugcuggagggcuuccgcgugacccucaccagcgugaucgaccccucccggaucacgccguaccugcgccagugcaaggugcugaaccccgacgacgaggagcagguccucagcgaccccaaccuggugauccggaagcgcaagguggggguccugcucgacauccugcagcggaccggccacaagggguacguggccuuccuggagucccucgagcuguacuacccccagcuguacaagaaggugaccggcaaggagccggcccgcgucuucagcaugaucaucgacgcguccggggagagcggccucacccagcugcugaugacggaggugaugaagcuccagaagaaggugcaggaccugaccgcccugcucuccagcaaggacgacuucaucaaggagcugcgggucaaggacucccugcuccgcaagcaccaggagcgggugcagcgccugaaggaggagugcgaggccggcagccgggagcugaagcgcugcaaggaggagaacuacgaccucgccaugcggcuggcccaccaguccgaggagaagggggcggcccugaugcgcaaccgggaccuccagcuggagaucgaccagcugaagcacagccucaugaaggccgaggacgacugcaagguggagcgcaagcacacccugaagcugcggcacgccauggagcagcgccccucccaggagcuccugugggagcugcagcaggagaaggcgcuccugcaggcccggguccaggagcuggaggccagcgugcaggagggcaagcucgaccgcuccagccccuacauccaggugcuggaggaggacuggcggcaggcccugcgcgaccaccaggagcaggccaacaccaucuucucccuccgcaaggaccugcggcagggggaggcgcgccggcugcgcugcauggaggagaaggagauguucgagcuccagugccuggcccugcggaaggacagcaagauguacaaggaccgcaucgaggccauccuccugcagauggaggaggucgccaucgagcgggaccaggccaucgcgacgcgcgaggagcugcacgcccagcacgcccggggccugcaggagaaggacgcccuccgcaagcagguccgggagcugggggagaaggccgacgagcugcagcuccagguguuccagugcgaggcgcagcugcuggccguggagggccgccuccggcgccagcagcuggagacccuggugcucagcuccgaccuggaggacggcagcccccggcgcucccaggagcugagccucccgcaggaccuggaggacacccagcuguccgacaaggggugccucgccggcgggggcagccccaagcagcccuucgccgcccugcaccaggagcagguccugcggaacccccacgacgcgggccucuccagcggggagccgcccgagaaggagcgccggcgccugaaggaguccuucgagaacuaccgccggaagcgcgcccugcggaagaugcagaagggcuggcgccagggggaggaggaccgggagaacaccacgggcagcgacaacaccgacaccgagggguccuga

SEQ ID NO: 7124 - RNA, 1611 nt, Artificial Sequence
  derived and/or modified sequence opt2 from Caspase_9__Homo_sapiens__EAW88222
auguccgacuacgagaacgacgacgagugcugguccguccucgagggcuuccgcgucacccucaccuccgucaucgaccccucccgcaucacccccuaccuccgccagugcaagguccucaaccccgacgacgaggagcagguccucuccgaccccaaccucgucauccgcaagcgcaaggucggcguccuccucgacauccuccagcgcaccggccacaagggcuacgucgccuuccucgagucccucgagcucuacuacccccagcucuacaagaaggucaccggcaaggagcccgcccgcgucuucuccaugaucaucgacgccuccggcgaguccggccucacccagcuccucaugaccgaggucaugaagcuccagaagaagguccaggaccucaccgcccuccucuccuccaaggacgacuucaucaaggagcuccgcgucaaggacucccuccuccgcaagcaccaggagcgcguccagcgccucaaggaggagugcgaggccggcucccgcgagcucaagcgcugcaaggaggagaacuacgaccucgccaugcgccucgcccaccaguccgaggagaagggcgccgcccucaugcgcaaccgcgaccuccagcucgagaucgaccagcucaagcacucccucaugaaggccgaggacgacugcaaggucgagcgcaagcacacccucaagcuccgccacgccauggagcagcgccccucccaggagcuccucugggagcuccagcaggagaaggcccuccuccaggcccgcguccaggagcucgaggccuccguccaggagggcaagcucgaccgcuccucccccuacauccagguccucgaggaggacuggcgccaggcccuccgcgaccaccaggagcaggccaacaccaucuucucccuccgcaaggaccuccgccagggcgaggcccgccgccuccgcugcauggaggagaaggagauguucgagcuccagugccucgcccuccgcaaggacuccaagauguacaaggaccgcaucgaggccauccuccuccagauggaggaggucgccaucgagcgcgaccaggccaucgccacccgcgaggagcuccacgcccagcacgcccgcggccuccaggagaaggacgcccuccgcaagcagguccgcgagcucggcgagaaggccgacgagcuccagcuccaggucuuccagugcgaggcccagcuccucgccgucgagggccgccuccgccgccagcagcucgagacccucguccucuccuccgaccucgaggacggcuccccccgccgcucccaggagcucucccucccccaggaccucgaggacacccagcucuccgacaagggcugccucgccggcggcggcucccccaagcagcccuucgccgcccuccaccaggagcagguccuccgcaacccccacgacgccggccucuccuccggcgagccccccgagaaggagcgccgccgccucaaggaguccuucgagaacuaccgccgcaagcgcgcccuccgcaagaugcagaagggcuggcgccagggcgaggaggaccgcgagaacaccaccggcuccgacaacaccgacaccgagggcuccuga

SEQ ID NO: 7125 - RNA, 1611 nt, Artificial Sequence
  derived and/or modified sequence opt3 from Caspase_9__Homo_sapiens__EAW88222
augagcgacuacgagaacgaugacgaaugcugguccgugcuggagggcuucagagucacccucacaucuguuaucgaucccucaaggauuacuccuuaucuucggcaguguaaggugcugaauccagacgaugaggagcaaguauugagugacccgaacuuagugauacgcaaacgaaaggucggggugcugcuagauauccuccagcguacgggacacaaagguuacguugccuuucuggaaagccuugagcuguauuacccccaguuguauaagaaagugaccggcaaggagccugcuagagucuucuccaugauuaucgacgcaucuggggaaucgggacucacacagcugcugaugacugaggugaugaagcuccaaaagaagguacaggauuuaaccgcccugcuuucaagcaaagacgauuuuauuaaggaauugaggguuaaagacagucugcuacggaagcaucaggagcgcgugcagagacucaaggaggaaugcgaggcgggcuccagggaacugaaacgguguaaggaggaaaauuacgaucuugcuaugcgccuggcccaccaaucugaggagaaaggugcagccuugaugcgaaacagagaccuccagcuggaaaucgaccaguuaaagcauagccugaugaaagcugaggaugacugcaaggucgaaaggaaacacacacucaaacuucggcaugcaauggagcagcguccaucccaagaacuguugugggagcuacagcaggagaaggcccugcuccaagcucgcgugcaggaacuggaggccucagugcaggaagggaaacuugauagaaguagccccuauauacagguccuggaggaagacuggaggcaagcguugcgggaucaccaggagcaggcaaauaccaucuucucucuccgaaaggaccugcgccagggagaggccagaagguuacgguguauggaagagaaagaaauguuugagcugcaaugccuagcucuccgcaaggauuccaaaauguacaaggacagaauugaggccauccugcuucagauggaagagguugcaauugaaagggaucaggcuaucgccacucgugaggaauugcacgcgcagcaugcccggggccugcaagagaaggacgcacuccgaaaacaggugagagagcugggcgaaaaggcugaugagcuucagcugcagguauuccaaugugaagcccaguugcucgcuguggaggggaggcugcgccggcagcaauuagaaacacugguccuaucaagcgaccucgaggacggaaguccuagaaggucucaggagcugucccuuccacaggauuuggaagacacccagcugagcgauaaagguugccucgccggcgggggaucgcccaagcaaccuuuugcagcccugcaccaggaacagguguuacgcaacccacaugacgcuggccugucuuccggugaaccgcccgagaaagaacgacggcgucuuaaggagucauucgagaauuacagaaggaagcgcgcguugcggaaaaugcagaagggguggagacaaggagaagaggauagggaaaacacgacuggcagugacaauaccgauacagagggcagcuga

SEQ ID NO: 7126 - RNA, 1611 nt, Artificial Sequence
  derived and/or modified sequence opt4 from Caspase_9__Homo_sapiens__EAW88222
augagcgacuacgagaacgacgacgagugcuggagcgugcuggagggcuucagagugacccugaccagcgugaucgaccccagcagaaucacccccuaccugagacagugcaaggugcugaaccccgacgacgaggagcaggugcugagcgaccccaaccuggugaucagaaagagaaaggugggcgugcugcuggacauccugcagagaaccggccacaagggcuacguggccuuccuggagagccuggagcuguacuacccccagcuguacaagaaggugaccggcaaggagcccgccagaguguucagcaugaucaucgacgccagcggcgagagcggccugacccagcugcugaugaccgaggugaugaagcugcagaagaaggugcaggaccugaccgcccugcugagcagcaaggacgacuucaucaaggagcugagagugaaggacagccugcugagaaagcaccaggagagagugcagagacugaaggaggagugcgaggccggcagcagagagcugaagagaugcaaggaggagaacuacgaccuggccaugagacuggcccaccagagcgaggagaagggcgccgcccugaugagaaacagagaccugcagcuggagaucgaccagcugaagcacagccugaugaaggccgaggacgacugcaagguggagagaaagcacacccugaagcugagacacgccauggagcagagacccagccaggagcugcugugggagcugcagcaggagaaggcccugcugcaggccagagugcaggagcuggaggccagcgugcaggagggcaagcuggacagaagcagccccuacauccaggugcuggaggaggacuggagacaggcccugagagaccaccaggagcaggccaacaccaucuucagccugagaaaggaccugagacagggcgaggccagaagacugagaugcauggaggagaaggagauguucgagcugcagugccuggcccugagaaaggacagcaagauguacaaggacagaaucgaggccauccugcugcagauggaggagguggccaucgagagagaccaggccaucgccaccagagaggagcugcacgcccagcacgccagaggccugcaggagaaggacgcccugagaaagcaggugagagagcugggcgagaaggccgacgagcugcagcugcagguguuccagugcgaggcccagcugcuggccguggagggcagacugagaagacagcagcuggagacccuggugcugagcagcgaccuggaggacggcagccccagaagaagccaggagcugagccugccccaggaccuggaggacacccagcugagcgacaagggcugccuggccggcggcggcagccccaagcagcccuucgccgcccugcaccaggagcaggugcugagaaacccccacgacgccggccugagcagcggcgagccccccgagaaggagagaagaagacugaaggagagcuucgagaacuacagaagaaagagagcccugagaaagaugcagaagggcuggagacagggcgaggaggacagagagaacaccaccggcagcgacaacaccgacaccgagggcagcuga

SEQ ID NO: 7127 - RNA, 1611 nt, Artificial Sequence
  derived and/or modified sequence opt5 from Caspase_9__Homo_sapiens__EAW88222
augagcgacuacgagaacgaugacgaaugcugguccgugcuggagggcuucagagucacccucacaucuguuaucgaucccagccggauuacgccuuaucugcgccaguguaaggugcuuaauccggacgaugaggaacaagugcuguccgaccccaaccucgucaucagaaaacggaagguggggguucugcuugauauucugcagcgcaccggacacaaaggcuacguggccuuucucgaaucucuggagcuguauuacccucagcucuauaagaaagucacagggaaggagcccgcuagaguguucagcaugaucauugacgccuccggagaaucuggccugacccagcuucugaugacagagguuaugaagcuccagaaaaaggugcaagaucugaccgcgcuucugagcuccaaagacgauuuuaucaaggaacuccgggucaaagacagccugcugcgcaagcaucaggagagagugcagcggcucaaggaggaaugcgaggcugggucucgcgaacugaaaagauguaaggaggaaaauuacgaucuugccaugcggcuggcccaccaauccgaggagaaaggagcugcccucaugcgcaacagagaccugcagcuugaaaucgaccagcugaagcauagccucaugaaagcugaggaugacugcaagguggaacggaaacacacacugaagcugcgccaugccauggagcagagaccuucucaagaacuccugugggagcuucagcaggagaaggcgcugcuccaagcccggguccaggaacuggaggcuuccguucaggaaggcaaacuugauagaagcucucccuauauucaggugcuggaggaagacuggcgccaagcccuccgggaucaccaggagcaggcuaauaccaucuucucccugagaaaggaccugcgccagggcgaggcccggagacuccgcuguauggaagagaaagaaauguuugagcugcaaugccuugcgcugcggaaggauagcaaaauguacaaggacagaauugaggccauccuccugcagauggaagagguggcuauugaacgcgaucaggccaucgcuacgcgggaggaacugcacgcccagcaugccagagggcuucaagagaaggacgcucuccgcaaacagguccgggagcugggagaaaaggcggaugagcugcagcuccagguguuccaaugugaagcccagcugcuugcuguugagggcagacugcggcgccagcaacucgaaacccuggugcuguccucugaccuugaggacgggagcccuagacggucccaggagcucagccugccgcaggaucuggaagacacacagcucucugauaaaggaugccuggccggcgggggaucccccaagcaaccuuuugccgcccuucaccaggagcagguccugagaaacccccaugacgcuggccucagcucuggcgaaccucccgagaaagaacgccggagacugaaggagagcuucgagaauuaccgcagaaagcgggcgcugcgcaaaaugcagaagggguggagacaaggagaagaggaucgggaaaacaccacaggcuccgacaauaccgauacggaggggucuuga

SEQ ID NO: 7128 - RNA, 1611 nt, Artificial Sequence
  derived and/or modified sequence opt6 from Caspase_9__Homo_sapiens__EAW88222
augucagauuacgaaaaugaugaugaauguuggucaguuuuagaaggauuuagagugacacuaaccucaguaauagacccaaguaggauaacaccauaucuaagacaauguaaagugcuaaauccagaugacgaagaacaaguauuaagcgauccaaaucuaguaauaagaaaaagaaaaguaggaguucucuuagacauacuccaacgaacaggacacaagggauacguagcauuucuagaaagccuggaauuauauuauccacaacucuacaaaaaagucacaggaaaagaaccagcaagagucuuuagcaugauaauagaugcgaguggagaaucuggacuaacacaauuauuaaugacugaaguuaugaaacuucaaaaaaaaguacaagacuuaacagcuuuauuaagcucaaaagacgacuuuauuaaagaauuacgaguaaaagauagcuuacugagaaaacaccaagaacgaguacaaagacuaaaagaagaaugcgaagcagggagcagagaacuaaaaagauguaaagaagaaaauuaugacuuagccaugagauuagcucaucaaucggaagaaaaaggagcugcauuaaugcgaaaucgagaucuccaacuugaaauagaucaguugaaacauucauuaaugaaagcagaagacgauugcaaaguagaacgaaagcacacacuaaaacuaagacacgcaauggaacaaagacccagucaagaauuacugugggaauuacaacaagaaaaagcacuauuacaagcaaggguacaagaacuagaagccucaguacaagaagggaaacuagaccguagcagcccuuacauacaaguacuagaagaagacuggcgacaagcacuaagagaucaccaggaacaggccaauacaauauuuucacuaaggaaagaucuaaggcaaggugaagcaagacgauuaagauguauggaagaaaaagaaauguuugaauugcaauguuuagcacuaagaaaagauucaaaaauguauaaagauagaauugaagcaauacuuuuacaaauggaagaaguagccauagaaagagaucaggcaaucgcaacaagagaagaauugcacgcacaacaugcaagaggacuacaagaaaaagaugcauuacgcaaacaagugagagaacuaggagaaaaagcagaugaauuacaauuacaaguauuccaaugcgaagcacagcuauuagcaguagaaggaagauuaagaagacaacaauuagaaaccuuagucuuaucaucagacuuagaagauggaucacccagaagaucacaagaauuaucguuaccacaagaucuugaagacacacaauuaagugauaaaggaugcuuagcaggcgggggaagcccaaaacaacccuuugcagcauuacaucaagaacaagugcuccgcaauccgcaugaugccggacucaguagcggugaaccuccagagaaagaaagaagaagauugaaagaaagcuuugaaaauuauaggcgcaaaagagcacucagaaaaaugcaaaaaggauggagacaaggagaagaagaucgagaaaacacaaccgguagcgauaauacagacacagaaggaaguuaa

SEQ ID NO: 7129 - protein, 366 aa, Artificial Sequence
  Caspase_9__Homo_sapiens__A0A024R8I4
MSDYENDDECWSVLEGFRVTLTSVIDPSRITPYLRQCKVLNPDDEEQVLSDPNLVIRKRKVGVLLDILQRTGHKGYVAFLESLELYYPQLYKKVTGKEPARVFSMIIDASGESGLTQLLMTEVMKLQKKVQDLTALLSSKDDFIKELRVKDSLLRKHQERVQRLKEECEAGSRELKRCKEENYDLAMRLAHQSEEKGAALMRNRDLQLEIDQLKHSLMKAEDDCKVERKHTLKLRHAMEQRPSQELLWELQQEKALLQARVQELEASVQEGKLDRSSPYIQVLEEDWRQALRDHQEQANTIFSLRKDLRQGEARRLRCMEEKEMFELQCLALRKDSKMYKDRIEAILLQMEEVAIERDQSTQMEGL

SEQ ID NO: 7130 - RNA, 1101 nt, Artificial Sequence
  Caspase_9__Homo_sapiens__EAW88219
augucggacuacgagaacgaugacgagugcuggagcguccuggagggcuuccgggugacgcucaccucggucaucgaccccucacgcaucacaccuuaccugcggcagugcaagguccugaaccccgaugaugaggagcaggugcucagcgaccccaaccuggucauccgcaaacggaaagugggugugcuccuggacauccugcagcggaccggccacaagggcuacguggccuuccucgagagccuggagcucuacuacccgcagcuguacaagaaggucacaggcaaggagccggcccgcgucuucuccaugaucaucgacgcguccggggagucaggccugacucagcugcugaugacugaggucaugaagcugcagaagaaggugcaggaccugaccgcgcugcugagcuccaaagaugacuucaucaaggagcugcgggugaaggacagccugcugcgcaagcaccaggagcgugugcagaggcucaaggaggagugcgaggccggcagccgcgagcucaagcgcugcaaggaggagaacuacgaccuggccaugcgccuggcgcaccagagugaggagaagggcgccgcgcucaugcggaaccgugaccugcagcuggagauugaccagcucaagcacagccucaugaaggccgaggacgacugcaagguggagcgcaagcacacgcugaagcucaggcacgccauggagcagcggcccagccaggagcugcugugggagcugcagcaggagaaggcccugcuccaggcccgggugcaggagcuggaggccuccguccaggaggggaagcuggacaggagcagccccuacauccagguacuggaggaggacuggcggcaggcgcugcgggaccaccaggagcaggccaacaccaucuucucccugcgcaaggaccuccgccagggcgaggcccgacgccuccggugcauggaggagaaggagauguucgagcugcagugccuggcacuacguaaggacuccaagauguacaaggaccgcaucgaggccauccugcugcagauggaggaggucgccauugagcgggaccagagcacacaaauggaggggcuguga

SEQ ID NO: 7131 - RNA, 1101 nt, Artificial Sequence
  derived and/or modified sequence opt1 from Caspase_9__Homo_sapiens__EAW88219
augagcgacuacgagaacgacgacgagugcugguccgugcuggagggcuuccgcgucacccucaccagcgugaucgaccccucccggaucacgccguaccugcgccagugcaaggugcugaaccccgacgacgaggagcagguccucagcgaccccaaccuggugauccggaagcgcaagguggggguccugcucgacauccugcagcggaccggccacaagggguacguggccuuccuggagucccucgagcuguacuacccccagcuguacaagaaggugaccggcaaggagccggcccgcgucuucagcaugaucaucgacgcguccggggagagcggccucacccagcugcugaugacggaggugaugaagcuccagaagaaggugcaggaccugaccgcccugcucuccagcaaggacgacuucaucaaggagcugcgggucaaggacucccugcuccgcaagcaccaggagcgggugcagcgccugaaggaggagugcgaggccggcagccgggagcugaagcgcugcaaggaggagaacuacgaccucgccaugcggcuggcccaccaguccgaggagaagggggcggcccugaugcgcaaccgggaccuccagcuggagaucgaccagcugaagcacagccucaugaaggccgaggacgacugcaagguggagcgcaagcacacccugaagcugcggcacgccauggagcagcgccccucccaggagcuccugugggagcugcagcaggagaaggcgcuccugcaggcccggguccaggagcuggaggccagcgugcaggagggcaagcucgaccgcuccagccccuacauccaggugcuggaggaggacuggcggcaggcccugcgcgaccaccaggagcaggccaacaccaucuucucccuccgcaaggaccugcggcagggggaggcgcgccggcugcgcugcauggaggagaaggagauguucgagcuccagugccuggcccugcggaaggacagcaagauguacaaggaccgcaucgaggccauccuccugcagauggaggaggucgccaucgagcgggaccagagcacgcagauggagggccuguga

SEQ ID NO: 7132 - RNA, 1101 nt, Artificial Sequence
  derived and/or modified sequence opt2 from Caspase_9__Homo_sapiens__EAW88219
auguccgacuacgagaacgacgacgagugcugguccguccucgagggcuuccgcgucacccucaccuccgucaucgaccccucccgcaucacccccuaccuccgccagugcaagguccucaaccccgacgacgaggagcagguccucuccgaccccaaccucgucauccgcaagcgcaaggucggcguccuccucgacauccuccagcgcaccggccacaagggcuacgucgccuuccucgagucccucgagcucuacuacccccagcucuacaagaaggucaccggcaaggagcccgcccgcgucuucuccaugaucaucgacgccuccggcgaguccggccucacccagcuccucaugaccgaggucaugaagcuccagaagaagguccaggaccucaccgcccuccucuccuccaaggacgacuucaucaaggagcuccgcgucaaggacucccuccuccgcaagcaccaggagcgcguccagcgccucaaggaggagugcgaggccggcucccgcgagcucaagcgcugcaaggaggagaacuacgaccucgccaugcgccucgcccaccaguccgaggagaagggcgccgcccucaugcgcaaccgcgaccuccagcucgagaucgaccagcucaagcacucccucaugaaggccgaggacgacugcaaggucgagcgcaagcacacccucaagcuccgccacgccauggagcagcgccccucccaggagcuccucugggagcuccagcaggagaaggcccuccuccaggcccgcguccaggagcucgaggccuccguccaggagggcaagcucgaccgcuccucccccuacauccagguccucgaggaggacuggcgccaggcccuccgcgaccaccaggagcaggccaacaccaucuucucccuccgcaaggaccuccgccagggcgaggcccgccgccuccgcugcauggaggagaaggagauguucgagcuccagugccucgcccuccgcaaggacuccaagauguacaaggaccgcaucgaggccauccuccuccagauggaggaggucgccaucgagcgcgaccaguccacccagauggagggccucuga

SEQ ID NO: 7133 - RNA, 1101 nt, Artificial Sequence
  derived and/or modified sequence opt3 from Caspase_9__Homo_sapiens__EAW88219
augagcgacuacgagaacgaugacgaaugcugguccgugcuggagggcuucagagucacccucacaucuguuaucgaucccucaaggauuacuccuuaucuucggcaguguaaggugcugaauccagacgaugaggaacaaguauugagugacccgaacuuagugauacgcaaacgaaaggucggggugcugcuagauauccuccagcguacgggacacaaagguuacguugccuuucuggaaagccuugagcuguauuacccccaguuguauaagaaagugaccggcaaggagccugcuagagucuucuccaugauuaucgacgcaucuggggaaucgggacucacacagcugcugaugacugaggugaugaagcuccaaaagaagguacaggauuuaaccgcccugcuuucaagcaaagacgauuuuauuaaggaauugaggguuaaagacagucugcuacggaagcaucaggagcgcgugcagagacucaaggaggaaugcgaggcgggcuccagggaacugaaacgguguaaggaggaaaauuacgaucuugcuaugcgccuggcccaccaaucugaggagaaaggugcagccuugaugcgaaacagagaccuccagcuggaaaucgaccaguuaaagcauagccugaugaaagcugaggaugacugcaaggucgaaaggaaacacacacucaaacuucggcaugcaauggagcagcguccaucccaagaacuguugugggagcuacagcaggagaaggcccugcuccaagcucgcgugcaggaacuggaggccucagugcaggaagggaaacuugauagaaguagccccuauauacagguccuggaggaagacuggaggcaagcguugcgggaucaccaggagcaggcaaauaccaucuucucucuccgaaaggaccugcgccagggagaggccagaagguuacgguguauggaagagaaagaaauguuugagcugcaaugccuagcucuccgcaaggauuccaaaauguacaaggacagaauugaggccauccugcuucagauggaagagguugcaauugaaagggaucagucaacucagauggagggcuuguga

SEQ ID NO: 7134 - RNA, 1101 nt, Artificial Sequence
  derived and/or modified sequence opt4 from Caspase_9__Homo_sapiens__EAW88219
augagcgacuacgagaacgacgacgagugcuggagcgugcuggagggcuucagagugacccugaccagcgugaucgaccccagcagaaucacccccuaccugagacagugcaaggugcugaaccccgacgacgaggagcaggugcugagcgaccccaaccuggugaucagaaagagaaaggugggcgugcugcuggacauccugcagagaaccggccacaagggcuacguggccuuccuggagagccuggagcuguacuacccccagcuguacaagaaggugaccggcaaggagcccgccagaguguucagcaugaucaucgacgccagcggcgagagcggccugacccagcugcugaugaccgaggugaugaagcugcagaagaaggugcaggaccugaccgcccugcugagcagcaaggacgacuucaucaaggagcugagagugaaggacagccugcugagaaagcaccaggagagagugcagagacugaaggaggagugcgaggccggcagcagagagcugaagagaugcaaggaggagaacuacgaccuggccaugagacuggcccaccagagcgaggagaagggcgccgcccugaugagaaacagagaccugcagcuggagaucgaccagcugaagcacagccugaugaaggccgaggacgacugcaagguggagagaaagcacacccugaagcugagacacgccauggagcagagacccagccaggagcugcugugggagcugcagcaggagaaggcccugcugcaggccagagugcaggagcuggaggccagcgugcaggagggcaagcuggacagaagcagccccuacauccaggugcuggaggaggacuggagacaggcccugagagaccaccaggagcaggccaacaccaucuucagccugagaaaggaccugagacagggcgaggccagaagacugagaugcauggaggagaaggagauguucgagcugcagugccuggcccugagaaaggacagcaagauguacaaggacagaaucgaggccauccugcugcagauggaggagguggccaucgagagagaccagagcacccagauggagggccuguga

SEQ ID NO: 7135 - RNA, 1101 nt, Artificial Sequence
  derived and/or modified sequence opt5 from Caspase_9__Homo_sapiens__EAW88219
augagcgacuacgagaacgaugacgaaugcugguccgugcuggagggcuucagagucacccucacaucuguuaucgaucccagccggauuacgccuuaucugcgccaguguaaggugcuuaauccggacgaugaggaacaagugcuguccgaccccaaccucgucaucagaaaacggaagguggggguucugcuugauauucugcagcgcaccggacacaaaggcuacguggccuuucucgaaucucuggagcuguauuacccucagcucuauaagaaagucacagggaaggagcccgcuagaguguucagcaugaucauugacgccuccggagaaucuggccugacccagcuucugaugacagagguuaugaagcuccagaaaaaggugcaagaucugaccgcgcuucugagcuccaaagacgauuuuaucaaggaacuccgggucaaagacagccugcugcgcaagcaucaggagagagugcagcggcucaaggaggaaugcgaggcugggucucgcgaacugaaaagauguaaggaggaaaauuacgaucuugccaugcggcuggcccaccaauccgaggagaaaggagcugcccucaugcgcaacagagaccugcagcuugaaaucgaccagcugaagcauagccucaugaaagcugaggaugacugcaagguggaacggaaacacacacugaagcugcgccaugccauggagcagagaccuucucaagaacuccugugggagcuucagcaggagaaggcgcugcuccaagcccggguccaggaacuggaggcuuccguucaggaaggcaaacuugauagaagcucucccuauauucaggugcuggaggaagacuggcgccaagcccuccgggaucaccaggagcaggcuaauaccaucuucucccugagaaaggaccugcgccagggcgaggcccggagacuccgcuguauggaagagaaagaaauguuugagcugcaaugccuugcgcugcggaaggauagcaaaauguacaaggacagaauugaggccauccuccugcagauggaagagguggcuauugaacgcgaucaguccacgcagauggaggggcuguga

SEQ ID NO: 7136 - RNA, 1101 nt, Artificial Sequence
  derived and/or modified sequence opt6 from Caspase_9__Homo_sapiens__EAW88219
augagugauuacgaaaaugaugaugagugcuggagcguauuagaaggauucagaguaacauuaacaucaguaauagacccaaguagaauaacaccauaccuaagacaaugcaaaguacuaaaucccgaugacgaagaacaaguacuaucagauccaaaucuaguaauaagaaaaagaaaaguaggaguacuauuagacauauuacagagaacaggacauaaaggauacguagcauuccuagaaaguuuagaauuauacuauccacaacuauauaaaaaaguaacuggaaaagaaccagcaagaguauuuaguaugauaauagacgcaaguggggaaaguggauuaacacaacuauugaugacagaaguaaugaaacuacagaaaaaaguacaagaccuaacagcgcuacuaagcucaaaagacgacuuuauaaaggaacugagaguaaaagacaguuuacuaagaaaacaccaagaacgaguucaacgacucaaagaagaaugcgaagcaggaagcagagaauugaaaagaugcaaagaagaaaacuaugauuuagcaaugagauuagcacaucaaucagaagaaaaaggagccgcacuaaugcgaaacagagaucuccaacuagagauagaucaauuaaaacauagucuaaugaaagcagaagacgauugcaaaguagaaagaaaacacacgcuaaagcuaagacaugcaauggaacaaagaccaucacaagaacuacuaugggaacuacaacaagaaaaagcacuauuacaagcaagaguacaagaacuagaagcaucaguccaagaaggaaaauuagacagaagcucacccuauauccaaguccuggaagaagauuggcgacaggcauuaagagaucaccaagaacaagcaaacacaauauucucauuaagaaaagauuuaagacaaggugaggcaagaagacuaagaugcauggaggaaaaggaaauguucgaauuacaaugucuagcacuaagaaaagauagcaagauguauaaagauagaauagaagcuauauuacuacaaauggaagaaguagcaauagaaagagaucaaucaacacaaauggaaggacuauaa

SEQ ID NO: 7137 - protein, 416 aa, Artificial Sequence
  Caspase_9__Homo_sapiens__P55211
MDEADRRLLRRCRLRLVEELQVDQLWDALLSRELFRPHMIEDIQRAGSGSRRDQARQLIIDLETRGSQALPLFISCLEDTGQDMLASFLRTNRQAAKLSKPTLENLTPVVLRPEIRKPEVLRPETPRPVDIGSGGFGDVGALESLRGNADLAYILSMEPCGHCLIINNVNFCRESGLRTRTGSNIDCEKLRRRFSSLHFMVEVKGDLTAKKMVLALLELAQQDHGALDCCVVVILSHGCQASHLQFPGAVYGTDGCPVSVEKIVNIFNGTSCPSLGGKPKLFFIQACGGEQKDHGFEVASTSPEDESPGSNPEPDATPFQEGLRTFDQLDAISSLPTPSDIFVSYSTFPGFVSWRDPKSGSWYVETLDDIFEQWAHSEDLQSLLLRVANAVSVKGIYKQMPGCFNFLRKKLFFKTS

SEQ ID NO: 7138 - RNA, 1251 nt, Artificial Sequence
  Caspase_9__Homo_sapiens__AAH02452
auggacgaagcggaucggcggcuccugcggcggugccggcugcggcugguggaagagcugcagguggaccagcucugggacgcccugcugagccgcgagcuguucaggccccauaugaucgaggacauccagcgggcaggcucuggaucucggcgggaucaggccaggcagcugaucauagaucuggagacucgagggagucaggcucuuccuuuguucaucuccugcuuagaggacacaggccaggacaugcuggcuucguuucugcgaacuaacaggcaagcagcaaaguugucgaagccaacccuagaaaaccuuaccccaguggugcucagaccagagauucgcaaaccagagguucucagaccggaaacacccagaccaguggacauugguucuggaggauuuggugaugucggugcucuugagaguuugaggggaaaugcagauuuggcuuacauccugagcauggagcccuguggccacugccucauuaucaacaaugugaacuucugccgugaguccgggcuccgcacccgcacuggcuccaacaucgacugugagaaguugcggcgucgcuucuccucgcugcauuucaugguggaggugaagggcgaccugacugccaagaaaauggugcuggcuuugcuggagcuggcgcagcaggaccacggugcucuggacugcugcgugguggucauucucucucacggcugucaggccagccaccugcaguucccaggggcugucuacggcacagauggaugcccugugucggucgagaagauugugaacaucuucaaugggaccagcugccccagccugggagggaagcccaagcucuuuuucauccaggccugugguggggagcagaaagaccauggguuugagguggccuccacuuccccugaagacgaguccccuggcaguaaccccgagccagaugccaccccguuccaggaagguuugaggaccuucgaccagcuggacgccauaucuaguuugcccacacccagugacaucuuuguguccuacucuacuuucccagguuuuguuuccuggagggaccccaagaguggcuccugguacguugagacccuggacgacaucuuugagcagugggcucacucugaagaccugcagucccuccugcuuagggucgcuaaugcuguuucggugaaagggauuuauaaacagaugccugguugcuuuaauuuccuccggaaaaaacuuuucuuuaaaacaucauaa

SEQ ID NO: 7139 - RNA, 1251 nt, Artificial Sequence
  derived and/or modified sequence opt1 from Caspase_9__Homo_sapiens__AAH02452
auggacgaggccgaccgccggcugcuccgccggugccgccugcggcugguggaggagcuccaggucgaccagcugugggacgcccugcucagccgcgagcuguuccggccccacaugaucgaggacauccagcgcgcgggcuccgggagccggcgcgaccaggcccggcagcugaucaucgaccucgagacccgcggcucccaggcccugccgcuguucaucagcugccucgaggacaccgggcaggacaugcuggccuccuuccugcggacgaaccgccaggccgcgaagcucagcaagcccacccuggagaaccugacccccguggugcuccggcccgagauccgcaagccggagguccugcggcccgagacgccccgccccguggacaucggcuccgggggcuucggcgacgugggggcccuggagagccuccggggcaacgccgaccuggccuacauccuguccauggagccgugcgggcacugccucaucaucaacaacgucaacuucugccgcgagagcggccugcggacccgcaccggguccaacaucgacugcgagaagcugcgccggcgcuucagcucccuccacuucaugguggaggugaagggcgaccugaccgcgaagaagaugguccuggcccuccuggagcuggcccagcaggaccacggcgcccucgacugcugcgugguggucauccugagccacgggugccaggccucccaccuccaguuccccggcgcgguguacgggaccgacggcugccccgugagcgucgagaagaucgugaacaucuucaacggcacguccugccccagccucgggggcaagccgaagcuguucuucauccaggccugcgggggcgagcagaaggaccacggguucgagguggccuccaccagccccgaggacgagagccccggcuccaaccccgagccggacgccacccccuuccaggagggccugcggaccuucgaccagcuggacgccaucagcucccugcccacgcccagcgacaucuucgucuccuacagcaccuucccgggguucguguccuggcgcgaccccaagagcggcuccugguacguggagacccuggacgacaucuucgagcagugggcgcacagcgaggaccuccagucccugcugcuccgggucgccaacgccgugagcgugaaggggaucuacaagcagaugcccggcugcuucaacuuccugcgcaagaagcuguucuucaagaccuccuga

SEQ ID NO: 7140 - RNA, 1251 nt, Artificial Sequence
  derived and/or modified sequence opt2 from Caspase_9__Homo_sapiens__AAH02452
auggacgaggccgaccgccgccuccuccgccgcugccgccuccgccucgucgaggagcuccaggucgaccagcucugggacgcccuccucucccgcgagcucuuccgcccccacaugaucgaggacauccagcgcgccggcuccggcucccgccgcgaccaggcccgccagcucaucaucgaccucgagacccgcggcucccaggcccucccccucuucaucuccugccucgaggacaccggccaggacaugcucgccuccuuccuccgcaccaaccgccaggccgccaagcucuccaagcccacccucgagaaccucacccccgucguccuccgccccgagauccgcaagcccgagguccuccgccccgagaccccccgccccgucgacaucggcuccggcggcuucggcgacgucggcgcccucgagucccuccgcggcaacgccgaccucgccuacauccucuccauggagcccugcggccacugccucaucaucaacaacgucaacuucugccgcgaguccggccuccgcacccgcaccggcuccaacaucgacugcgagaagcuccgccgccgcuucuccucccuccacuucauggucgaggucaagggcgaccucaccgccaagaagaugguccucgcccuccucgagcucgcccagcaggaccacggcgcccucgacugcugcgucgucgucauccucucccacggcugccaggccucccaccuccaguuccccggcgccgucuacggcaccgacggcugccccgucuccgucgagaagaucgucaacaucuucaacggcaccuccugccccucccucggcggcaagcccaagcucuucuucauccaggccugcggcggcgagcagaaggaccacggcuucgaggucgccuccaccucccccgaggacgagucccccggcuccaaccccgagcccgacgccacccccuuccaggagggccuccgcaccuucgaccagcucgacgccaucuccucccuccccacccccuccgacaucuucgucuccuacuccaccuuccccggcuucgucuccuggcgcgaccccaaguccggcuccugguacgucgagacccucgacgacaucuucgagcagugggcccacuccgaggaccuccagucccuccuccuccgcgucgccaacgccgucuccgucaagggcaucuacaagcagaugcccggcugcuucaacuuccuccgcaagaagcucuucuucaagaccuccuga

SEQ ID NO: 7141 - RNA, 1251 nt, Artificial Sequence
  derived and/or modified sequence opt3 from Caspase_9__Homo_sapiens__AAH02452
auggacgaggccgauagaaggcugcuccggcgcugccgacuucgucugguggaagaguugcaggucgaccaauuaugggaugcucugcuaagcagagaacucuucaggccccacaugaucgaggacauucagcgggcaggcuccgggucucgcagagaucaggccaggcagcugauaaucgaccuugaaacccggggaucacaagcgcugccuuuguuuauuaguugucucgaggauacaggucaggacaugcuggcuagcuuccugcgcacuaaccgacaggccgcaaagcucuccaaaccaacguuagagaaucugaccccgguugugcuuagacccgaaaucaggaagccugagguauugcggccagaaacaccccguccuguggauauuggcucugggggauuuggcgacgucggugcccuggagucgcuacgcgggaacgcugaucucgcauacauccugucaauggagccaugcggacauugucuuauaaucaauaacgugaauuucugcagagaaagcggccugaggacucggaccggcaguaacauugacugugagaaauugcgacgcagauuuuccucucuccacuucaugguugaagugaagggggaucugacagccaaaaagauggucuuagcucugcucgagcuugcccagcaagaccauggagcgcuggacugcugugugguaguuaucuugagccacgguugccaggcaucccaucuacaguuucccggcgccguguaugggaccgauggauguccugucucaguggaaaagauugugaauaucuucaacggcacaaguugcccaagccugggugggaaaccgaagcucuuuuucauacaggcuuguggaggcgagcaaaaagaccacggcuuugaggucgccucuacuucccccgaagaugagucaccugggagcaauccagaacccgacgcaaccccuuuccaggagggacugaggacguuugaucagcuugacgcuauuaguucucugccaacucccuccgauaucuucguuagcuacucgaccuucccggguuuugugucuuggcgggacccuaaguccggcucaugguauguagaaacauuggaugacauuuucgagcaaugggcccacagugaggaucuccagagccuguuacugcgcguggcgaacgccgucuccgugaaagggaucuacaagcagaugcccggaugcuuuaauuuccuaagaaagaaacucuuuuucaagacuucuuga

SEQ ID NO: 7142 - RNA, 1251 nt, Artificial Sequence
  derived and/or modified sequence opt4 from Caspase_9__Homo_sapiens__AAH02452
auggacgaggccgacagaagacugcugagaagaugcagacugagacugguggaggagcugcagguggaccagcugugggacgcccugcugagcagagagcuguucagaccccacaugaucgaggacauccagagagccggcagcggcagcagaagagaccaggccagacagcugaucaucgaccuggagaccagaggcagccaggcccugccccuguucaucagcugccuggaggacaccggccaggacaugcuggccagcuuccugagaaccaacagacaggccgccaagcugagcaagcccacccuggagaaccugacccccguggugcugagacccgagaucagaaagcccgaggugcugagacccgagacccccagacccguggacaucggcagcggcggcuucggcgacgugggcgcccuggagagccugagaggcaacgccgaccuggccuacauccugagcauggagcccugcggccacugccugaucaucaacaacgugaacuucugcagagagagcggccugagaaccagaaccggcagcaacaucgacugcgagaagcugagaagaagauucagcagccugcacuucaugguggaggugaagggcgaccugaccgccaagaagauggugcuggcccugcuggagcuggcccagcaggaccacggcgcccuggacugcugcgugguggugauccugagccacggcugccaggccagccaccugcaguuccccggcgccguguacggcaccgacggcugccccgugagcguggagaagaucgugaacaucuucaacggcaccagcugccccagccugggcggcaagcccaagcuguucuucauccaggccugcggcggcgagcagaaggaccacggcuucgagguggccagcaccagccccgaggacgagagccccggcagcaaccccgagcccgacgccacccccuuccaggagggccugagaaccuucgaccagcuggacgccaucagcagccugcccacccccagcgacaucuucgugagcuacagcaccuuccccggcuucgugagcuggagagaccccaagagcggcagcugguacguggagacccuggacgacaucuucgagcagugggcccacagcgaggaccugcagagccugcugcugagaguggccaacgccgugagcgugaagggcaucuacaagcagaugcccggcugcuucaacuuccugagaaagaagcuguucuucaagaccagcuga

SEQ ID NO: 7143 - RNA, 1251 nt, Artificial Sequence
  derived and/or modified sequence opt5 from Caspase_9__Homo_sapiens__AAH02452
auggacgaggccgauagacggcugcuccgcagaugccggcugcgccuuguggaggaacugcaggucgaccaacucugggaugcucugcuuagcagagaacuguuccggccccacaugaucgaggacauucagcgcgccggcuccgggucuagacgggaucaggcgcgccagcucaucauugaccuggaaaccagaggaagccaagcucugccucucuuuaucuccugucuggaggauacaggccaggacaugcuugccucuuuccugcggacgaaccgccaggccgcuaagcucagcaaaccgacccuggagaaucuuacacccguugugcugagaccugaaauucggaagcccgaggugcuccgcccugaaacccccagaccugucgauaucggguccggaggcuuuggggacgugggagcccuggagucucugcggggcaacgcugaucucgccuacauccugagcauggagccgugcggccauugucuuauuaucaauaacguuaauuucugcagagaauccgggcugcgcacacggaccggaagcaacauugacugugagaaacucagacgccgguuuucuucccugcacuucaugguggaagucaagggcgaucuuacagcgaaaaagauggugcuggcccuccuggagcuggcucagcaagaccauggggcccucgacugcuguguuguggucauccugagccacggaugccaggcuucucaucuucaguuucccggcgccguguaugggaccgauggauguccuguguccgucgaaaagauuguuaauaucuucaacggcacgagcugccccucucugggcgggaaaccuaagcucuuuuucauucaggcguguggaggcgagcaaaaagaccacggguuugagguggccuccaccagccccgaagaugaguccccgggaucuaauccugaacccgacgcuacaccuuuccaggagggccugagaaccuuugaucagcuugacgccaucagcucccugcccacacccagcgauaucuucgugucuuacuccaccuucccuggguuugucagcuggcgcgacccgaagucuggaagcugguauguggaaacgcucgaugacauuuucgagcaaugggcucacuccgaggaucugcagucucugcuccugcggguugccaacgccgugagcgucaaaggcaucuacaagcagaugcccggcugcuuuaauuuccuuagaaagaaacuguuuuucaagacauccuga

SEQ ID NO: 7144 - RNA, 1251 nt, Artificial Sequence
  derived and/or modified sequence opt6 from Caspase_9__Homo_sapiens__AAH02452
auggaugaagccgauagaagacuacuaagaagaugcagauuaagacuaguagaagaguuacaaguagaccaacuaugggacgcuuuauuaucaagagaauuauucagaccccauaugauugaagauauacaaagagcaggaucaggaucaagacgagaucaagcuagacaacuaauaauagaccuagaaacuagaggaucacaagcuuuaccacuauucauaucauguuuggaagauacgggacaagauauguuagccucauucuuaagaacuaauagacaagcagcaaaacuaucaaaaccaacauuagaaaacuuaacaccaguuguauuacgaccagaaauacgaaaaccugaaguacuaagaccagaaacuccccgaccaguagacauaggaucaggagguuuuggagacguaggagcacuagaaucauuaagagguaacgcugauuuagcuuauauauuaagcauggaacccugcggacauugucuaauaauaaauaacguaaauuuuuguagagaaucaggauuaagaacgcgcacaggaucuaauauagauugugaaaaauuaagaagaagauucucaagcuuacauuucaugguagaaguaaaaggugaccuaacagcaaaaaaaaugguacuagcauuacuagaauuagcucaacaagaucacggagcacuagauuguuguguaguaguaauauuaucucauggaugucaagcaagucaucuccaauucccaggugcaguauauggaacagacggaugcccaguaucaguagaaaaaauaguaaauaucuuuaacggaaccucauguccaagccuuggaggaaaaccaaaauuauucuuuauucaagcaugcggaggagaacaaaaagaucacggauuugaagucgcaucaacaucaccugaagaugaauccccagggucaaauccagaaccugacgcaacaccuuuccaagaaggauuaagaacauucgaucaauuagaugccauaagcucauuaccaacaccaucagauauauucguaaguuauucaacauucccaggauuuguauccuggcgagauccaaaaaguggaaguugguauguagaaacacuagacgacauauuugaacaaugggcacauucagaagaucuacaaucauuacuccuuagagucgccaaugcaguaucuguaaaaggaauauauaaacaaaugccuggauguuuuaauuucuuaagaaaaaaauuauuuuuuaaaacaaguuaa

SEQ ID NO: 7145 - protein, 536 aa, Artificial Sequence; identical to SEQ ID NO: 7121
  Caspase_9__Homo_sapiens__Q9H257

SEQ ID NO: 7146 - RNA, 1611 nt, Artificial Sequence; identical to SEQ ID NO: 7122
  Caspase_9__Homo_sapiens__BAF84770

SEQ ID NO: 7147 - RNA, 1611 nt, Artificial Sequence; identical to SEQ ID NO: 7123
  derived and/or modified sequence opt1 from Caspase_9__Homo_sapiens__BAF84770

SEQ ID NO: 7148 - RNA, 1611 nt, Artificial Sequence; identical to SEQ ID NO: 7124
  derived and/or modified sequence opt2 from Caspase_9__Homo_sapiens__BAF84770

SEQ ID NO: 7149 - RNA, 1611 nt, Artificial Sequence; identical to SEQ ID NO: 7125
  derived and/or modified sequence opt3 from Caspase_9__Homo_sapiens__BAF84770

SEQ ID NO: 7150 - RNA, 1611 nt, Artificial Sequence; identical to SEQ ID NO: 7126
  derived and/or modified sequence opt4 from Caspase_9__Homo_sapiens__BAF84770

SEQ ID NO: 7151 - RNA, 1611 nt, Artificial Sequence; identical to SEQ ID NO: 7127
  derived and/or modified sequence opt5 from Caspase_9__Homo_sapiens__BAF84770

SEQ ID NO: 7152 - RNA, 1611 nt, Artificial Sequence
  derived and/or modified sequence opt6 from Caspase_9__Homo_sapiens__BAF84770
augagugacuacgaaaacgacgaugaauguuggagcguguuagaaggauuuaggguaacuuugaccucaguaauugacccaucaagaauaacaccauaucugagacaauguaaaguacuaaacccagaugaugaagaacaaguacuaucagauccaaaucuaguaauaagaaaaaggaaaguaggaguacuacuugauauucugcaaagaacaggacauaaaggauacguugcauuucucgagucauuagaacuauauuacccacaacuauauaaaaaaguaacaggaaaagaaccagcaagaguuuucaguaugauaauagaugcaaguggagaaaguggacuaacacaacuauugaugaccgaaguaaugaaauugcaaaaaaaaguacaagacuuaacagcauuauugucaucaaaagacgauuuuauaaaagaacuaagaguaaaagacagucuacuaagaaaacaccaagaacgaguacaacgacuaaaagaagaaugcgaagcaggcaguagagaauuaaaaagaugcaaagaagaaaacuaugaucuagcaaugagacuagcacaucaaagugaagaaaaaggagccgcauuaaugcggaaucgagauuuacaacucgaaauagaccaguuaaaacacagucuaaugaaagcggaagaugauuguaaaguagaacgcaaacacacucuuaaacucagacacgccauggagcaaaggccaagucaagaacuauuaugggaauuacaacaagaaaaagcucuauuacaagcacgaguacaagaacuagaagcauccguacaagaagggaaacuugauagaaguaguccauauauacaaguacuagaagaagacuggagacaagcauugcgagaccaucaggaacaagcaaacacaauauucagucuuaggaaagaucuaagacagggggaagcacgaagacuuagaugcauggaagaaaaagaaauguuugaacuacaaugccuggcccuaagaaaagacucaaaaauguauaaagauagaauugaagcaauauuacuucaaauggaagaaguggcaauugaaagagaccaagcaauagcaacucgagaagaauuacacgcacaacaugcaaggggauuacaagaaaaagaugccuuaagaaaacaaguaagagaacuaggggaaaaagcagaugaacuccaauuacaaguauuccagugcgaggcacaacuccuagcuguagaaggaagauuaagaaggcagcaacuagaaacauuaguauuaagcucagacuuagaagaugggucaccaagacgaagccaagaauuaucuuuaccgcaagaccuagaagacacacaguuaucagauaagggaugcuuagccgguggaggaagcccgaaacaaccauuugcagcguuacaucaagaacaagugcuaagaaacccacaugaugcuggacuaucaagcggagaaccaccagaaaaagaaagaagaagacuaaaagaaaguuucgaaaauuauaggagaaaaagagcacuaagaaaaaugcaaaaagguuggagacagggagaagaagauagagaaaacacgacaggaagcgauaacacugacacagaagggucauaa

SEQ ID NO: 7153 - protein, 75 aa, Artificial Sequence
  Cytochrome_c__Homo_sapiens__A0A024R9B7
MAPEVLPKPRMRGLLARRLRNHMAVAFVLSLGVAALYKFRVADQRKKAYADFYRNYDVMKDFEEMRKAGIFQSVK

SEQ ID NO: 7154 - RNA, 228 nt, Artificial Sequence
  Cytochrome_c__Homo_sapiens__EAW91792
auggcucccgaaguuuugccaaaaccucggaugcguggccuucuggccaggcgucugcgaaaucauauggcuguagcauucgugcuaucccuggggguugcagcuuuguauaaguuucguguggcugaucaaagaaagaaggcauacgcagauuucuacagaaacuacgaugucaugaaagauuuugaggagaugaggaaggcugguaucuuucagaguguaaaguaa

SEQ ID NO: 7155 - RNA, 228 nt, Artificial Sequence
  derived and/or modified sequence opt1 from Cytochrome_c__Homo_sapiens__EAW91792
auggcccccgaggugcugccgaagccccgcaugcggggccuccuggcccgccggcugcgcaaccacauggcggucgccuucgugcucagccuggggguggccgcccuguacaaguuccgggucgccgaccagcgcaagaaggcguacgccgacuucuaccggaacuacgacgugaugaaggacuucgaggagaugcgcaaggccggcaucuuccaguccgugaaguga

SEQ ID NO: 7156 - RNA, 228 nt, Artificial Sequence
  derived and/or modified sequence opt2 from Cytochrome_c__Homo_sapiens__EAW91792
auggcccccgagguccuccccaagccccgcaugcgcggccuccucgcccgccgccuccgcaaccacauggccgucgccuucguccucucccucggcgucgccgcccucuacaaguuccgcgucgccgaccagcgcaagaaggccuacgccgacuucuaccgcaacuacgacgucaugaaggacuucgaggagaugcgcaaggccggcaucuuccaguccgucaaguga

SEQ ID NO: 7157 - RNA, 228 nt, Artificial Sequence
  derived and/or modified sequence opt3 from Cytochrome_c__Homo_sapiens__EAW91792
auggcccccgaggugcugccuaagccaagaaugaggggccuccuugcucggcgccugcgaaaccacauggcagucgccuucguuuugagcuuagggguggcggcucuguacaaauuucguguagccgaccagagaaagaaagcauaugccgauuucuacaggaauuaugacgugaugaaggauuuugaagagaugcggaaagcuggaaucuuccaauccgucaaguga

SEQ ID NO: 7158 - RNA, 228 nt, Artificial Sequence
  derived and/or modified sequence opt4 from Cytochrome_c__Homo_sapiens__EAW91792
auggcccccgaggugcugcccaagcccagaaugagaggccugcuggccagaagacugagaaaccacauggccguggccuucgugcugagccugggcguggccgcccuguacaaguucagaguggccgaccagagaaagaaggccuacgccgacuucuacagaaacuacgacgugaugaaggacuucgaggagaugagaaaggccggcaucuuccagagcgugaaguga

SEQ ID NO: 7159 - RNA, 228 nt, Artificial Sequence
  derived and/or modified sequence opt5 from Cytochrome_c__Homo_sapiens__EAW91792
auggcccccgaggugcugccuaagccgagaaugcggggccuccuggcucgcagacuucggaaccacauggccgucgcguucguucugagccucgggguggcugcccuguacaaauuucgcguggccgaccagagaaagaaggcuuaugccgauuucuaccggaauuaugacgucaugaaagauuuugaagagaugcgcaaagcuggaaucuuccaauccgugaaguga

SEQ ID NO: 7160 - RNA, 228 nt, Artificial Sequence
  derived and/or modified sequence opt6 from Cytochrome_c__Homo_sapiens__EAW91792
auggcaccagaaguacuaccaaaaccaagaaugagaggacuauuagcaagaagauuaagaaaucacauggcaguagcauuuguauuaagcuuaggaguagcagcacuauauaaauuuagaguagcagaucaaagaaaaaaagcauaugcagauuucuauagaaauuacgauguaaugaaagauuucgaagaaaugagaaaagcaggaauauuucaaucaguaaaauaa

SEQ ID NO: 7161 - protein, 23 aa, Artificial Sequence
  Cytochrome_c__Homo_sapiens__A0A024RAP6
MCLYFGSAFATPFLVVRHQLLKT

SEQ ID NO: 7162 - RNA, 72 nt, Artificial Sequence
  Cytochrome_c__Homo_sapiens__EAW95922
auguguuuguacuuuggaucugcauuugcuacacccuuccuuguaguaagacaccaacugcuuaaaacauaa

SEQ ID NO: 7163 - RNA, 72 nt, Artificial Sequence
  derived and/or modified sequence opt1 from Cytochrome_c__Homo_sapiens__EAW95922
augugccuguacuucggcagcgccuucgccacccccuuccucgugguccgccaccagcugcugaagaccuga

SEQ ID NO: 7164 - RNA, 72 nt, Artificial Sequence
  derived and/or modified sequence opt2 from Cytochrome_c__Homo_sapiens__EAW95922
augugccucuacuucggcuccgccuucgccacccccuuccucgucguccgccaccagcuccucaagaccuga

SEQ ID NO: 7165 - RNA, 72 nt, Artificial Sequence
  derived and/or modified sequence opt3 from Cytochrome_c__Homo_sapiens__EAW95922
augugccuguacuucggcagcgccuuugcuacccccuuccucguggucagacaccagcuucugaagacauga

SEQ ID NO: 7166 - RNA, 72 nt, Artificial Sequence
  derived and/or modified sequence opt4 from Cytochrome_c__Homo_sapiens__EAW95922
augugccuguacuucggcagcgccuucgccacccccuuccugguggugagacaccagcugcugaagaccuga

SEQ ID NO: 7167 - RNA, 72 nt, Artificial Sequence
  derived and/or modified sequence opt5 from Cytochrome_c__Homo_sapiens__EAW95922
augugccuguacuucggcagcgccuuugcuacccccuuccucguggucagacaccagcugcuuaagacauga

SEQ ID NO: 7168 - RNA, 72 nt, Artificial Sequence
  derived and/or modified sequence opt6 from Cytochrome_c__Homo_sapiens__EAW95922
augugucuauauuucgguucagcuuucgcuacaccuuuccuuguaguuagacaucaacuucuaaaaacauaa

SEQ ID NO: 7169 - protein, 152 aa, Artificial Sequence
  Cytochrome_c__Homo_sapiens__A0A024RBN6
MIVLRLMPVGGRRPIVTSFGGCSTAPRANFPLPLPALRQSRSKMAVVGVSSVSRLLGRSRPQLGRPMSSGAHGEEGSARMWKTLTFFVALPGVAVSMLNVYLKSHHGEHERPEFIAYPHLRIRTKPFPWGDGNHTLFHNPHVNPLPTGYEDE

SEQ ID NO: 7170 - RNA, 459 nt, Artificial Sequence
  Cytochrome_c__Homo_sapiens__EAW98190
augauagugcucagguuaaugccagugggagggcggcgcccaauaguaacuuccuuuggagguuguaguaccgcccccagagccaauuuuccacuuccgcuuccggcgcugcggcaguccagaucaaaaauggcgguaguugguguguccucgguuucucggcugcugggucggucccgcccacagcuggggcggccuaugucgaguggcgcccauggcgaagagggcucagcucgcauguggaagacucucaccuucuucgucgcgcuccccgggguggcagucagcaugcugaauguguaccugaagucgcaccacggagagcacgagagacccgaguucaucgccuacccccaucuccgcaucaggaccaagccguuucccuggggagaugguaaccauacucuauuccauaacccucaugugaauccacuuccaacuggcuacgaagaugaauaa

SEQ ID NO: 7171 - RNA, 459 nt, Artificial Sequence
  derived and/or modified sequence opt1 from Cytochrome_c__Homo_sapiens__EAW98190
augaucgugcugcgccugaugcccgucggcgggcggcgcccgaucgugaccagcuucggcgggugcuccaccgcgccccgggccaacuucccccugccccugccggcccuccgccagagccgguccaagauggccguggucggcgugagcuccgugagccgccugcuggggcggucccgcccccagcucggccggcccaugagcuccggcgcccacggggaggagggcagcgcccgcauguggaagacgcugaccuucuucgucgcccugcccgggguggcgguguccaugcucaacgucuaccucaagagccaccacggcgagcacgagcggccggaguucaucgccuacccccaccuccgcauccggaccaagcccuuccccuggggcgacgggaaccacacccuguuccacaacccgcacgugaacccccugcccacgggcuacgaggacgaguga

SEQ ID NO: 7172 - RNA, 459 nt, Artificial Sequence
  derived and/or modified sequence opt2 from Cytochrome_c__Homo_sapiens__EAW98190
augaucguccuccgccucaugcccgucggcggccgccgccccaucgucaccuccuucggcggcugcuccaccgccccccgcgccaacuucccccucccccuccccgcccuccgccagucccgcuccaagauggccgucgucggcgucuccuccgucucccgccuccucggccgcucccgcccccagcucggccgccccauguccuccggcgcccacggcgaggagggcuccgcccgcauguggaagacccucaccuucuucgucgcccuccccggcgucgccgucuccaugcucaacgucuaccucaagucccaccacggcgagcacgagcgccccgaguucaucgccuacccccaccuccgcauccgcaccaagcccuuccccuggggcgacggcaaccacacccucuuccacaacccccacgucaacccccuccccaccggcuacgaggacgaguga

SEQ ID NO: 7173 - RNA, 459 nt, Artificial Sequence
  derived and/or modified sequence opt3 from Cytochrome_c__Homo_sapiens__EAW98190
augaucgugcugagacucaugcccgucggcgggaggcggccuauuguuaccagcuucggagguugcuccacagccccacgcgcuaacuuuccgcuuccccugccugcauugcgacagucucguucaaagauggccgugguaggcgugaguagcgucuccagauuacuggggaggucucggccacaacuaggacgccccaugucgucaggcgcgcacggugaggaagggagcgcuagaauguggaaaacucucacguucuuuguggcccugccuggaguugcagugaguaugcuuaaugucuaccugaagucccaucacggcgagcaugaaaggccagaguucauagccuauccccacuugcggauccgcaccaaaccuuuuccauggggcgacgggaaccauacacucuuccacaauccgcacgugaacccccugccuacuggauacgaagaugaguga

SEQ ID NO: 7174 - RNA, 459 nt, Artificial Sequence
  derived and/or modified sequence opt4 from Cytochrome_c__Homo_sapiens__EAW98190
augaucgugcugagacugaugcccgugggcggcagaagacccaucgugaccagcuucggcggcugcagcaccgcccccagagccaacuucccccugccccugcccgcccugagacagagcagaagcaagauggccguggugggcgugagcagcgugagcagacugcugggcagaagcagaccccagcugggcagacccaugagcagcggcgcccacggcgaggagggcagcgccagaauguggaagacccugaccuucuucguggcccugcccggcguggccgugagcaugcugaacguguaccugaagagccaccacggcgagcacgagagacccgaguucaucgccuacccccaccugagaaucagaaccaagcccuuccccuggggcgacggcaaccacacccuguuccacaacccccacgugaacccccugcccaccggcuacgaggacgaguga

SEQ ID NO: 7175 - RNA, 459 nt, Artificial Sequence
  derived and/or modified sequence opt5 from Cytochrome_c__Homo_sapiens__EAW98190
augaucgugcugagacucaugcccgucggcgggcggcgcccuauuguuaccagcuucggaggcugcuccacagccccgagagcuaacuuuccccugccucuucccgcccugcggcagucucgcagcaagauggcgguggugggggucuccucugugagcagacuccugggacggucccgcccucaacuuggcagacccaugucuagcggggcucacggagaggaaggcuccgcccggauguggaaaacgcugaccuucuuuguugcccucccuggcguggcugucagcaugcugaauguguaccugaagucucaucacggggagcaugaacgcccggaguucaucgccuauccccaccuccggauuagaacaaaaccuuuucccuggggagacggcaaccauacccuguuccacaauccucacguuaacccccuuccgacaggguacgaagaugaguga

SEQ ID NO: 7176 - RNA, 459 nt, Artificial Sequence
  derived and/or modified sequence opt6 from Cytochrome_c__Homo_sapiens__EAW98190
augauaguauuaagacuaaugccaguaggaggaagaagaccaauaguaacaucauucggaggaugcucaacagcaccaagagcaaacuucccacuaccacuaccagcacuaagacaaucaagaucaaaaauggcaguaguaggaguaucaucaguaaguagacuauuaggaagaucaagaccacaacuaggaagaccaaugucaucaggagcacacggagaagaaggaucagcaagaauguggaaaacacuaacauucuucguagcauuaccaggagucgcaguaucaauguuaaacguauacuuaaaaucacaccacggcgaacacgaaagaccagaauuuauagcauacccacacuuaagaauacgaacaaaaccauucccauggggagauggaaaucacacacuauuccacaacccacacguaaacccacuaccaacaggauacgaagacgaauaa

SEQ ID NO: 7177 - protein, 268 aa, Artificial Sequence
  Cytochrome_c__Homo_sapiens__A0A024RBY9
MGLSPSAPAVAVQASNASASPPSGCPMHEGKMKGCPVNTEPSGPTCEKKTYSVPAHQERAYEYVECPIRGTAAENKENLDPSNLMPPPNQTPAPDQPFALSTVREESSIPRADSEKKWVYPSEQMFWNAMLKKGWKWKDEDISQKDMYNIIRIHNQNNEQAWKEILKWEALHAAECPCGPSLIRFGGKAKEYSPRARIRSWMGYELPFDRHDWIINRCGTEVRYVIDYYDGGEVNKDYQFTILDVRPALDSLSAVWDRMKVAWWRWTS

SEQ ID NO: 7178 - RNA, 807 nt, Artificial Sequence
  Cytochrome_c__Homo_sapiens__EAW98784
auggguuugucuccaucugcuccugcuguugcaguucaggccucaaaugcuucagcguccccaccuucaggaugcccgaugcaugaagggaaaaugaaaggcuguccagugaauacagagccaucuggcccaaccugugagaagaaaacauacucugugccugcccaccaggaacgcgccuaugaguacguggagugucccauuaggggcacugcggcugagaauaaggagaaccuagauccuucaaaucugaugccaccaccaaaucaaacaccagcuccagaucagccauuugcauugucuacugucagagaagagucauccauuccgagagcagauucagagaaaaaguggguuuacccuucugagcagauguucuggaaugcaauguuaaagaaaggguggaaguggaaggaugaggauaucagucagaaggauauguauaauaucauuagaauucacaaucagaauaacgagcaggcuuggaaggagauuuugaagugggaagcccuucaugcugcagaguguccuugugguccaucauugauccgguuuggagggaaagcaaaagaguauucaccaagggcacgaauucguuccuggaugggguaugaguugccuuuugauaggcacgauuggaucauaaaccguugcgggacagaaguuagauaugugauugauuauuaugaugguggugaagucaacaaggacuaccaguucaccauccuggacguccguccugccuuagauucacuuucggcaguaugggacagaaugaaagucgcuugguggcguuggaccucguaa

SEQ ID NO: 7179 - RNA, 807 nt, Artificial Sequence
  derived and/or modified sequence opt1 from Cytochrome_c__Homo_sapiens__EAW98784
augggccugagccccuccgccccggccguggcgguccaggccagcaacgccuccgccagcccgcccuccgggugccccaugcacgagggcaagaugaaggggugccccgugaacaccgagcccagcggcccgaccugcgagaagaagacguacuccgugcccgcccaccaggagcgcgcguacgaguacgucgagugccccauccgggggaccgccgccgagaacaaggagaaccucgaccccagcaaccugaugcccccgcccaaccagacccccgcccccgaccagcccuucgcgcuguccaccgugcgcgaggagagcuccaucccgcgggccgacagcgagaagaaguggguguaccccuccgagcagauguucuggaacgccaugcucaagaagggcuggaaguggaaggacgaggacaucagccagaaggacauguacaacaucauccgcauccacaaccagaacaacgagcaggccuggaaggagauccugaagugggaggcccugcacgcggccgagugccccugcggccccucccucauccgguucgggggcaaggccaaggaguacagcccgcgcgcccggauccgcuccuggaugggguacgagcugcccuucgaccggcacgacuggaucaucaaccgcugcggcacggagguccgguacgugaucgacuacuacgacgggggcgaggugaacaaggacuaccaguucaccauccuggacguccgccccgcccucgacagccuguccgcggugugggaccggaugaagguggccugguggcgcuggaccagcuga

SEQ ID NO: 7180 - RNA, 807 nt, Artificial Sequence
  derived and/or modified sequence opt2 from Cytochrome_c__Homo_sapiens__EAW98784
augggccucucccccuccgcccccgccgucgccguccaggccuccaacgccuccgccuccccccccuccggcugccccaugcacgagggcaagaugaagggcugccccgucaacaccgagcccuccggccccaccugcgagaagaagaccuacuccguccccgcccaccaggagcgcgccuacgaguacgucgagugccccauccgcggcaccgccgccgagaacaaggagaaccucgaccccuccaaccucaugcccccccccaaccagacccccgcccccgaccagcccuucgcccucuccaccguccgcgaggaguccuccaucccccgcgccgacuccgagaagaagugggucuaccccuccgagcagauguucuggaacgccaugcucaagaagggcuggaaguggaaggacgaggacaucucccagaaggacauguacaacaucauccgcauccacaaccagaacaacgagcaggccuggaaggagauccucaagugggaggcccuccacgccgccgagugccccugcggccccucccucauccgcuucggcggcaaggccaaggaguacuccccccgcgcccgcauccgcuccuggaugggcuacgagcuccccuucgaccgccacgacuggaucaucaaccgcugcggcaccgagguccgcuacgucaucgacuacuacgacggcggcgaggucaacaaggacuaccaguucaccauccucgacguccgccccgcccucgacucccucuccgccgucugggaccgcaugaaggucgccugguggcgcuggaccuccuga

SEQ ID NO: 7181 - RNA, 807 nt, Artificial Sequence
  derived and/or modified sequence opt3 from Cytochrome_c__Homo_sapiens__EAW98784
augggccugagccccuccgccccugcuguggcaguccaggccucuaacgcgucagcuaguccaccgagcgggugccccaugcacgagggaaagaugaaagguuguccuguuaauaccgaaccauccggccccacaugcgagaagaaaacuuacucugugccugcccaucaagaaagagcauaugaguacguagaauguccaaucagggggacggccgcugagaacaaggagaaucucgaccccucgaaccuuaugccuccaccgaaucagacccccgcaccugaucagccauucgcccugucaacagugcgggaagagagcaguauuccccgcgcugacuccgagaaaaagugggucuauccuucugaacagauguuuuggaacgccauguugaagaaaggauggaaguggaaagaugaggacauaagccaaaaggauauguacaauaucauucgaauccacaaccagaauaacgaacaggcguggaaagagauuuuaaagugggaagcacugcaugccgcugagugcccauguggccccucccuaauccguuucggugggaaggccaaagaauauucaccgagagcaaggauacggaguuggaugggauacgagcucccuuuugaccgccacgauuggaucauuaauagaugcggcacugaggugagguauguuaucgacuacuacgauggcggggaagugaacaaggacuaucaguucaccauucuggauguccggcccgcucuugacagccugucugccgugugggaucgcaugaaaguagcgugguggcgauggacauccuga

SEQ ID NO: 7182 - RNA, 807 nt, Artificial Sequence
  derived and/or modified sequence opt4 from Cytochrome_c__Homo_sapiens__EAW98784
augggccugagccccagcgcccccgccguggccgugcaggccagcaacgccagcgccagcccccccagcggcugccccaugcacgagggcaagaugaagggcugccccgugaacaccgagcccagcggccccaccugcgagaagaagaccuacagcgugcccgcccaccaggagagagccuacgaguacguggagugccccaucagaggcaccgccgccgagaacaaggagaaccuggaccccagcaaccugaugcccccccccaaccagacccccgcccccgaccagcccuucgcccugagcaccgugagagaggagagcagcauccccagagccgacagcgagaagaaguggguguaccccagcgagcagauguucuggaacgccaugcugaagaagggcuggaaguggaaggacgaggacaucagccagaaggacauguacaacaucaucagaauccacaaccagaacaacgagcaggccuggaaggagauccugaagugggaggcccugcacgccgccgagugccccugcggccccagccugaucagauucggcggcaaggccaaggaguacagccccagagccagaaucagaagcuggaugggcuacgagcugcccuucgacagacacgacuggaucaucaacagaugcggcaccgaggugagauacgugaucgacuacuacgacggcggcgaggugaacaaggacuaccaguucaccauccuggacgugagacccgcccuggacagccugagcgccgugugggacagaaugaagguggccugguggagauggaccagcuga

SEQ ID NO: 7183 - RNA, 807 nt, Artificial Sequence
  derived and/or modified sequence opt5 from Cytochrome_c__Homo_sapiens__EAW98784
augggccugagccccuccgccccugcuguggccguccaggcgucuaacgcuagcgccuccccgcccucugggugcccuaugcacgagggaaagaugaaaggcugucccguuaauaccgaaccuagcgggcccacaugcgagaagaaaacguacuccgugccugcccaucaagaaagagcuuaugaguacguggaauguccgauccggggaaccgccgcugagaacaaggagaaucucgaccccucuaaccugaugccucccccuaaucagacacccgccccggaucagccuuucgcgcuuagcaccguccgcgaagaguccagcauucccagagccgacucugagaaaaaguggguguauccuuccgaacagauguuuuggaacgcuaugcugaagaaaggcuggaaguggaaagaugaggacaucagccaaaaggauauguacaauauuauccggauucacaaccagaauaacgaacaggccuggaaagagauccucaagugggaagcucugcaugccgcggagugccccugugggcccucucuuauccgcuucggaggcaaggccaaagaauauuccccuagagcucggauucgcagcuggaugggcuacgagcugccguuugacagacacgauuggaucauuaaucggugcgggacagagguucgcuaugugaucgacuacuacgauggaggcgaagucaacaaggacuaucaguucaccauucucgaugugagacccgcccuggacucucuguccgcuguuugggaucggaugaaaguggccugguggcgcuggacaagcuga

SEQ ID NO: 7184 - RNA, 807 nt, Artificial Sequence
  derived and/or modified sequence opt6 from Cytochrome_c__Homo_sapiens__EAW98784
augggacuaaguccaagcgcaccagcaguagcaguacaagcaaguaacgcaagcgcaucaccgccaucaggauguccaaugcacgaaggaaaaaugaaaggauguccaguaaacacagaaccaagcggaccaacaugcgaaaaaaaaacauauagcgugccagcacaccaagaaagagcauaugaauauguagaaugcccaauaagaggaacagcagcagaaaauaaagaaaauuuagacccaagcaaucuaaugcccccaccaaaucaaacaccagcaccagaucaaccauucgcauuaucaacaguaagagaagaaucaaguauaccaagagcagacagcgaaaaaaaauggguauacccaagugaacaaauguuuuggaacgcaaugcuaaaaaaaggauggaaauggaaagaugaagauauaucacaaaaagacauguacaauauaauaagaauacacaaucaaaauaaugaacaagcauggaaggaaauacuaaaaugggaagcacuacacgcagcagaaugcccaugcggaccaaguuuaauaagauuuggaggaaaagcaaaagaauacagcccaagagcaagaauaagaagcuggaugggauacgaacuaccauuugauagacaugacuggauaauaaacagaugcggaacagaaguaagauacguaauagauuacuaugacggaggagaaguaaauaaagauuaccaauuuacaauacuagauguaagaccagcauuagacucacuaucagcaguaugggauagaaugaaaguagcaugguggagauggacaaguuaa

SEQ ID NO: 7185 - protein, 106 aa, Artificial Sequence
  Cytochrome_c__Homo_sapiens__B8XYC5
MFAPAVMRAFRKNKTLGYGVPMLLLIVGGSFGLREFSQIRYDAVKSKMDPELEKKLKENKISLESEYEKIKDSKFDDWKNIRGPRPWEDPDLLQGRNPESLKTKTT

SEQ ID NO: 7186 - RNA, 321 nt, Artificial Sequence
  Cytochrome_c__Homo_sapiens__ACJ76681
auguuugcacccgcggugaugcgugcuuuucgcaagaacaagacucucggcuauggaguccccauguuguugcugauuguuggagguucuuuuggucuucgugaguuuucucaaauccgauaugaugcugugaagaguaaaauggauccugagcuugaaaaaaaacugaaagagaauaaaauaucuuuagagucggaauaugagaaaaucaaagacuccaaguuugaugacuggaagaauauucgaggacccaggccuugggaagauccugaccuccuccaaggaagaaauccagaaagccuuaagacuaagacaacuuga

SEQ ID NO: 7187 - RNA, 321 nt, Artificial Sequence
  derived and/or modified sequence opt1 from Cytochrome_c__Homo_sapiens__ACJ76681
auguucgcccccgccgugaugcgcgcguuccggaagaacaagacccugggcuacggggugccgaugcuccugcugaucgugggcgggagcuucggccuccgcgaguucucccagauccgguacgacgccgucaagagcaagauggaccccgagcuggagaagaagcugaaggagaacaagaucucccucgagagcgaguacgagaagaucaaggacuccaaguucgacgacuggaagaacauccgcgggccccggcccugggaggacccggaccugcugcagggccgcaaccccgagagccucaagaccaagacgaccuga

SEQ ID NO: 7188 - RNA, 321 nt, Artificial Sequence
  derived and/or modified sequence opt2 from Cytochrome_c__Homo_sapiens__ACJ76681
auguucgcccccgccgucaugcgcgccuuccgcaagaacaagacccucggcuacggcguccccaugcuccuccucaucgucggcggcuccuucggccuccgcgaguucucccagauccgcuacgacgccgucaaguccaagauggaccccgagcucgagaagaagcucaaggagaacaagaucucccucgaguccgaguacgagaagaucaaggacuccaaguucgacgacuggaagaacauccgcggcccccgccccugggaggaccccgaccuccuccagggccgcaaccccgagucccucaagaccaagaccaccuga

SEQ ID NO: 7189 - RNA, 321 nt, Artificial Sequence
  derived and/or modified sequence opt3 from Cytochrome_c__Homo_sapiens__ACJ76681
auguucgcccccgcugugaugagagcauuuaggaagaacaaaacccugggcuacggggucccuaugcuccuucugaucguuggagguagcuucggcuugcgggaguuuucccagauucgcuaugacgccgugaagucuaaaauggauccagaauuagagaagaaacugaaggaaaauaagauaucacuagagagugaauacgagaaaaucaaggacagcaaauucgaugacuggaagaacauucgagggccgcgucccugggaggauccugaccuccugcaaggaagaaauccagaaucccuuaaaacaaagacuacguga

SEQ ID NO: 7190 - RNA, 321 nt, Artificial Sequence
  derived and/or modified sequence opt4 from Cytochrome_c__Homo_sapiens__ACJ76681
auguucgcccccgccgugaugagagccuucagaaagaacaagacccugggcuacggcgugcccaugcugcugcugaucgugggcggcagcuucggccugagagaguucagccagaucagauacgacgccgugaagagcaagauggaccccgagcuggagaagaagcugaaggagaacaagaucagccuggagagcgaguacgagaagaucaaggacagcaaguucgacgacuggaagaacaucagaggccccagacccugggaggaccccgaccugcugcagggcagaaaccccgagagccugaagaccaagaccaccuga

SEQ ID NO: 7191 - RNA, 321 nt, Artificial Sequence
  derived and/or modified sequence opt5 from Cytochrome_c__Homo_sapiens__ACJ76681
auguucgcccccgcugugaugagagccuuucggaagaacaaaacccugggcuacggggucccuaugcuccugcuuaucguuggaggcagcuucgggcugcgcgaguuuucccagauuagauaugacgcggugaagucuaaaauggauccggaacucgagaagaaacugaaggaaaauaagaucagccuugaguccgaauacgagaaaauuaaggacucuaaauucgaugacuggaagaacauccggggaccccgcccuugggaggaucccgaccugcuccaaggcagaaauccugaaagccugaaaacaaagacgaccuga

SEQ ID NO: 7192 - RNA, 321 nt, Artificial Sequence
  derived and/or modified sequence opt6 from Cytochrome_c__Homo_sapiens__ACJ76681
auguucgcaccagcaguaaugagagcauucagaaaaaacaaaacacuaggauacggaguaccaaugcuacuauuaauaguaggaggaagcuucggacuaagagaauucucacaaauaagauacgacgcaguaaaaagcaaaauggacccagaacuagaaaaaaaacuaaaagaaaacaaaauaagccuagaaucagaauacgaaaaaauaaaagacucaaaauucgacgacuggaaaaacauaagaggaccaagaccaugggaagacccagaccuacuacaaggaagaaacccagaaagccuaaaaacaaaaacaacauaa

SEQ ID NO: 7193 - protein, 105 aa, Artificial Sequence
  Cytochrome_c__Homo_sapiens__G4XXL9
MGDVEKGKKIFIMKCSQCHTVEKGGKHKTGPNLHGLFGRKTGQAPGYSYTAANKNKGIIWGEDTLMEYLENPKKYIPGTKMIFVGIKKKEERADLIAYLKKATNE

SEQ ID NO: 7194 - RNA, 318 nt, Artificial Sequence
  Cytochrome_c__Homo_sapiens__AEP27189
augggugauguugagaaaggcaagaagauuuuuauuaugaaguguucccagugccacaccguugaaaagggaggcaagcacaagacugggccaaaucuccauggucucuuugggcggaagacaggucaggccccuggauacucuuacacagccgccaauaagaacaaaggcaucaucuggggagaggauacacugauggaguauuuggagaaucccaagaaguacaucccuggaacaaaaaugaucuuugucggcauuaagaagaaggaagaaagggcagacuuaauagcuuaucucaaaaaagcuacuaaugaguaa

SEQ ID NO: 7195 - RNA, 318 nt, Artificial Sequence
  derived and/or modified sequence opt1 from Cytochrome_c__Homo_sapiens__AEP27189
augggcgacguggagaaggggaagaagaucuucaucaugaagugcagccagugccacaccgucgagaagggcgggaagcacaagaccggccccaaccugcacggccucuucgggcgcaagacgggccaggccccgggguacuccuacaccgccgcgaacaagaacaagggcaucaucuggggcgaggacacccugauggaguaccuggagaaccccaagaaguacauccccgggaccaagaugaucuucguggggaucaagaagaaggaggagcgggccgaccucaucgccuaccugaagaaggccacgaacgaguga

SEQ ID NO: 7196 - RNA, 318 nt, Artificial Sequence
  derived and/or modified sequence opt2 from Cytochrome_c__Homo_sapiens__AEP27189
augggcgacgucgagaagggcaagaagaucuucaucaugaagugcucccagugccacaccgucgagaagggcggcaagcacaagaccggccccaaccuccacggccucuucggccgcaagaccggccaggcccccggcuacuccuacaccgccgccaacaagaacaagggcaucaucuggggcgaggacacccucauggaguaccucgagaaccccaagaaguacauccccggcaccaagaugaucuucgucggcaucaagaagaaggaggagcgcgccgaccucaucgccuaccucaagaaggccaccaacgaguga

SEQ ID NO: 7197 - RNA, 318 nt, Artificial Sequence
  derived and/or modified sequence opt3 from Cytochrome_c__Homo_sapiens__AEP27189
augggcgacguggagaaggggaaaaagaucuucauuaugaaaugcagccagugucacaccgucgaaaagggagguaaacauaagacaggccccaaccugcacgggcucuuuggaagaaagacuggccaagccccugguuacuccuauacggcugcaaauaaaaacaaggggauaaucuggggagaggauacccuuauggaauaccuggagaauccgaaaaaguauauuccaggcacaaaaaugaucuucguuggcauuaagaagaaagaagagagggccgacuugaucgcguacuuaaagaaagcuacuaacgaguga

SEQ ID NO: 7198 - RNA, 318 nt, Artificial Sequence
  derived and/or modified sequence opt4 from Cytochrome_c__Homo_sapiens__AEP27189
augggcgacguggagaagggcaagaagaucuucaucaugaagugcagccagugccacaccguggagaagggcggcaagcacaagaccggccccaaccugcacggccuguucggcagaaagaccggccaggcccccggcuacagcuacaccgccgccaacaagaacaagggcaucaucuggggcgaggacacccugauggaguaccuggagaaccccaagaaguacauccccggcaccaagaugaucuucgugggcaucaagaagaaggaggagagagccgaccugaucgccuaccugaagaaggccaccaacgaguga

SEQ ID NO: 7199 - RNA, 318 nt, Artificial Sequence
  derived and/or modified sequence opt5 from Cytochrome_c__Homo_sapiens__AEP27189
augggcgacguggagaaggggaaaaagaucuucauuaugaaaugcagccagugucacaccgucgaaaagggaggcaaacauaagacagggcccaaccugcacggacucuuuggcagaaagacggggcaagccccuggauacuccuauaccgcugccaauaaaaacaagggcaucauuuggggcgaggauacacugauggaauaccuugagaauccgaaaaaguauauccccgggaccaaaaugauuuucguuggaaucaagaagaaagaggaacgggcggaccugaucgcuuaccucaagaaagccacaaacgaguga

SEQ ID NO: 7200 - RNA, 318 nt, Artificial Sequence
  derived and/or modified sequence opt6 from Cytochrome_c__Homo_sapiens__AEP27189
augggagacguagaaaaaggaaaaaaaauauucauaaugaaaugcagccaaugccacacaguagaaaaaggaggaaaacacaaaacaggaccaaaccuacacggacuauucggaagaaaaacaggacaagcaccaggauacagcuacacagcagcaaacaaaaacaaaggaauaauauggggagaagacacacuaauggaauaccuagaaaacccaaaaaaauacauaccaggaacaaaaaugauauucguaggaauaaaaaaaaaagaagaaagagcagaccuaauagcauaccuaaaaaaagcaacaaacgaauaa

SEQ ID NO: 7201 - protein, 115 aa, Artificial Sequence
  Cytochrome_c__Homo_sapiens__H0UI06
MHTQDSEVVPVPAWPFSLVVFSCGGCWSVTAKMLRNLLALRQIGQRTISTASRRHFKNKVPEKQKLFQEDDEIPLYLKGGVADALLYRATMILTVGGTAYAIYELAVASFPKKQE

SEQ ID NO: 7202 - RNA, 348 nt, Artificial Sequence
  Cytochrome_c__Homo_sapiens__CCF23109
augcauacgcaagacucggagguaguuccgguuccggcguggccauuuucguuggugguguucaguuguggcgguugcuggucaguaacagccaagaugcugcggaaucugcuggcucuucgucagauugggcagaggacgauaagcacugcuucccgcaggcauuuuaaaaauaaaguuccggagaagcaaaaacuguuccaggaggaugaugaaauuccacuguaucuaaagggugggguagcugaugcccuccuguauagagccaccaugauucuuacaguugguggaacagcauaugccauauaugagcuggcuguggcuucauuucccaagaagcaggaguga

SEQ ID NO: 7203 - RNA, 348 nt, Artificial Sequence
  derived and/or modified sequence opt1 from Cytochrome_c__Homo_sapiens__CCF23109
augcacacccaggacagcgagguggugcccgugccggccuggcccuucucccugguggucuucagcugcggcgggugcugguccgugaccgccaagaugcuccgcaaccugcuggcgcuccggcagaucggccagcgcacgaucagcaccgccucccggcgccacuucaagaacaaggugcccgagaagcagaagcuguuccaggaggacgacgagaucccccuguaccucaagggcggggucgccgacgcccugcuguaccgggccaccaugauccucaccgucgggggcacggcguacgccaucuacgagcuggccguggccagcuucccgaagaagcaggaguga

SEQ ID NO: 7204 - RNA, 348 nt, Artificial Sequence
  derived and/or modified sequence opt2 from Cytochrome_c__Homo_sapiens__CCF23109
augcacacccaggacuccgaggucguccccguccccgccuggcccuucucccucgucgucuucuccugcggcggcugcugguccgucaccgccaagaugcuccgcaaccuccucgcccuccgccagaucggccagcgcaccaucuccaccgccucccgccgccacuucaagaacaagguccccgagaagcagaagcucuuccaggaggacgacgagaucccccucuaccucaagggcggcgucgccgacgcccuccucuaccgcgccaccaugauccucaccgucggcggcaccgccuacgccaucuacgagcucgccgucgccuccuuccccaagaagcaggaguga

SEQ ID NO: 7205 - RNA, 348 nt, Artificial Sequence
  derived and/or modified sequence opt3 from Cytochrome_c__Homo_sapiens__CCF23109
augcacacccaggacagcgaggugguccccguuccugccuggccauucucccuggugguauuuucuugcggcggguguuggucagugacagcuaagaugcucagaaaccuucuggcauugaggcaaaucggacagcggacuauuaguacggccagccgccgacauuucaaaaauaaggucccggaaaaacagaaguuauuucaggaggaugacgaaauaccccuguaccuaaaagguggcguggcggaugcucuccuguaucgugccaccaugauccuuacaguugggggaacugcauacgccauuuaugagcuggcuguggcauccuucccuaagaagcaagaauga

SEQ ID NO: 7206 - RNA, 348 nt, Artificial Sequence
  derived and/or modified sequence opt4 from Cytochrome_c__Homo_sapiens__CCF23109
augcacacccaggacagcgagguggugcccgugcccgccuggcccuucagccuggugguguucagcugcggcggcugcuggagcgugaccgccaagaugcugagaaaccugcuggcccugagacagaucggccagagaaccaucagcaccgccagcagaagacacuucaagaacaaggugcccgagaagcagaagcuguuccaggaggacgacgagaucccccuguaccugaagggcggcguggccgacgcccugcuguacagagccaccaugauccugaccgugggcggcaccgccuacgccaucuacgagcuggccguggccagcuuccccaagaagcaggaguga

SEQ ID NO: 7207 - RNA, 348 nt, Artificial Sequence
  derived and/or modified sequence opt5 from Cytochrome_c__Homo_sapiens__CCF23109
augcacacccaggacagcgaggugguccccguuccugccuggccguucucccuggugguguuuucuugcggcggguguuggagcgucacagcuaagaugcucagaaaccugcuugcccugcggcaaaucggacagcgcacgauuuccaccgcgucuagacggcauuucaaaaauaaggugcccgaaaaacagaagcucuuucaggaggaugacgaaaucccucuguaccuuaaaggcgggguugcugaugcccugcucuaucgcgccacaaugauucugaccgugggaggcacagcuuacgccaucuaugagcuggcugucgccagcuuccccaagaagcaagaauga

SEQ ID NO: 7208 - RNA, 348 nt, Artificial Sequence
  derived and/or modified sequence opt6 from Cytochrome_c__Homo_sapiens__CCF23109
augcacacacaagauagcgaaguaguaccaguaccagcauggccauucucacuaguagucuuuagcuguggaggaugcuggaguguaacagcaaaaaugcuaagaaacuuauuagcacuaagacaaauaggacaaagaacaauaucaacagcaagcagaagacauuucaaaaacaaaguaccagaaaaacaaaaacuauuucaagaagacgaugaaauaccauuauaccuaaaaggaggaguagcagaugcauuacuauauagagcaacaaugauauuaacaguaggaggaacagcauacgcaauauaugaacuagcaguagcaucauucccaaaaaaacaagaauaa

SEQ ID NO: 7209 - protein, 78 aa, Artificial Sequence
  Cytochrome_c__Homo_sapiens__H6SG12
MQALRVSQALIRSFSSTARNRFQNRVREKQLFQEDNDIPLYLKGGIVDNILYRVTMTLCLGGTVYSLYSLGWASFPRN

SEQ ID NO: 7210 - RNA, 237 nt, Artificial Sequence
  Cytochrome_c__Homo_sapiens__CCF23103
augcaggcccuucgggugucccaggcgcugauccgcuccuucagcuccaccgcccggaaccgcuuucagaaccgagugcgcgagaaacagcucuuccaggaggacaaugacaucccguuguaccugaagggcggcaucguugacaacauccuguaccgagugacaaugacgcugugucugggcggcacugucuacagcuuguacucccuuggcugggccuccuuccccaggaauuaa

SEQ ID NO: 7211 - RNA, 237 nt, Artificial Sequence
  derived and/or modified sequence opt1 from Cytochrome_c__Homo_sapiens__CCF23103
augcaggcccugcgcgugagccaggcccucauccgguccuucagcuccaccgcgcgcaaccgguuccagaaccgcguccgggagaagcagcuguuccaggaggacaacgacaucccccuguaccucaagggcgggaucguggacaacauccuguaccgcgugaccaugacgcugugccucggcgggaccgucuacagccuguacucccugggcugggccagcuucccgcggaacuga

SEQ ID NO: 7212 - RNA, 237 nt, Artificial Sequence
  derived and/or modified sequence opt2 from Cytochrome_c__Homo_sapiens__CCF23103
augcaggcccuccgcgucucccaggcccucauccgcuccuucuccuccaccgcccgcaaccgcuuccagaaccgcguccgcgagaagcagcucuuccaggaggacaacgacaucccccucuaccucaagggcggcaucgucgacaacauccucuaccgcgucaccaugacccucugccucggcggcaccgucuacucccucuacucccucggcugggccuccuucccccgcaacuga

SEQ ID NO: 7213 - RNA, 237 nt, Artificial Sequence
  derived and/or modified sequence opt3 from Cytochrome_c__Homo_sapiens__CCF23103
augcaggcccugagagugagccaagcucucaucagguccuucucuucaaccgcacggaaccgcuuucagaaucgaguccgugagaagcagcuuuuccaggaagacaacgauauuccccuguacuugaaaggcgggauaguugacaauaucuuauauagagugacaaugacucugugccuaggagguacgguauacagucucuauagccugggcugggccuccuuuccuaggaacuga

SEQ ID NO: 7214 - RNA, 237 nt, Artificial Sequence
  derived and/or modified sequence opt4 from Cytochrome_c__Homo_sapiens__CCF23103
augcaggcccugagagugagccaggcccugaucagaagcuucagcagcaccgccagaaacagauuccagaacagagugagagagaagcagcuguuccaggaggacaacgacaucccccuguaccugaagggcggcaucguggacaacauccuguacagagugaccaugacccugugccugggcggcaccguguacagccuguacagccugggcugggccagcuuccccagaaacuga

SEQ ID NO: 7215 - RNA, 237 nt, Artificial Sequence
  derived and/or modified sequence opt5 from Cytochrome_c__Homo_sapiens__CCF23103
augcaggcccugagagugagccaagcucucauccgguccuucucuagcaccgcccgcaacagauuucagaaucggguccgcgagaagcagcuguuccaggaagacaacgauauuccccuuuaccugaaaggcgggaucguugacaauauucucuauagagugacaaugacgcugugccuuggaggcaccguguacucccuguauucucucgggugggcgagcuuuccucggaacuga

SEQ ID NO: 7216 - RNA, 237 nt, Artificial Sequence
  derived and/or modified sequence opt6 from Cytochrome_c__Homo_sapiens__CCF23103
augcaagcauuaagaguaagccaagcauuaauaagaagcuuuagcucaacagcaagaaauagauuucaaaauagaguaagagaaaaacaacuauuucaagaagacaaugacauaccauuauacuuaaaaggaggaauaguagauaacauacuauauagaguaacaaugacauuaugcuuaggaggaacaguauacucacuauauagcuuaggaugggcaucauucccaagaaauuaa

SEQ ID NO: 7217 - protein, 97 aa, Artificial Sequence [sequence omitted]

SEQ ID NO: 7218 - RNA, 294 nt, Artificial Sequence
  Cytochrome_c__Homo_sapiens__CCF23106
auggcuuugccucugaggccccugacccggggcguggccagcgcugccaaaggaggccacggaggagcaggagcucguaccuggcgucugcugaccuucgugcuggcgcugcccagcguggcccucugcaccuucaacuccuaucuccacucgggccaccgcccgcgccccgaguuccgucccuaccaacaccuccgcauccgcaccaagcccuaccccuggggggacggcaaccacacucuguuccacaauagccacgugaacccucugcccacgggcuacgaacaccccuga

SEQ ID NO: 7219 - RNA, 294 nt, Artificial Sequence
  derived and/or modified sequence opt1 from Cytochrome_c__Homo_sapiens__CCF23106
auggcccugccccuccgcccgcugacccggggcguggccagcgcggccaagggcgggcacgggggcgccggggcccgcaccuggcggcugcucacguucguccuggcccugcccuccguggcgcucugcaccuucaacagcuaccugcacuccggccaccgcccccggcccgaguuccgcccguaccagcaccuccggauccgcaccaagcccuaccccuggggcgacgggaaccacacccuguuccacaacagccacgugaacccccugccgacgggcuacgagcaccccuga

SEQ ID NO: 7220 - RNA, 294 nt, Artificial Sequence
  derived and/or modified sequence opt2 from Cytochrome_c__Homo_sapiens__CCF23106
auggcccucccccuccgcccccucacccgcggcgucgccuccgccgccaagggcggccacggcggcgccggcgcccgcaccuggcgccuccucaccuucguccucgcccuccccuccgucgcccucugcaccuucaacuccuaccuccacuccggccaccgcccccgccccgaguuccgccccuaccagcaccuccgcauccgcaccaagcccuaccccuggggcgacggcaaccacacccucuuccacaacucccacgucaacccccuccccaccggcuacgagcaccccuga

SEQ ID NO: 7221 - RNA, 294 nt, Artificial Sequence
  derived and/or modified sequence opt3 from Cytochrome_c__Homo_sapiens__CCF23106
auggcccugccccucagaccucuuaccaggggcguggcuagcgcagccaaagggggacacgguggcgcgggggcucggacauggcgccuguugacuuucgucuuagcccugccauccguugcacuaugcacguuuaacucuuaccuccauucaggacaccgaccgcgucccgaguucagaccuuaucagcaucugaggauccggaccaagccauaccccuggggcgacgguaaucacacacuuuuucauaacagucacgugaauccucugccaacuggguaugaacaccccuga

SEQ ID NO: 7222 - RNA, 294 nt, Artificial Sequence
  derived and/or modified sequence opt4 from Cytochrome_c__Homo_sapiens__CCF23106
auggcccugccccugagaccccugaccagaggcguggccagcgccgccaagggcggccacggcggcgccggcgccagaaccuggagacugcugaccuucgugcuggcccugcccagcguggcccugugcaccuucaacagcuaccugcacagcggccacagacccagacccgaguucagacccuaccagcaccugagaaucagaaccaagcccuaccccuggggcgacggcaaccacacccuguuccacaacagccacgugaacccccugcccaccggcuacgagcaccccuga

SEQ ID NO: 7223 - RNA, 294 nt, Artificial Sequence
  derived and/or modified sequence opt5 from Cytochrome_c__Homo_sapiens__CCF23106
auggcccugccccucagaccucugacccggggcguggcuagcgccgcgaaagggggacacggcggggcuggagcccgcacauggagacuucugacguucguccucgcccugccguccguugcucuuugcaccuuuaacucuuaccugcauagcggccaccggccccgcccugaguucagacccuaucagcaucuccggauccgcacaaagccuuaccccuggggagacgggaaucacacccuguuucauaacucccacgugaauccucugccgacaggcuaugaacaccccuga

SEQ ID NO: 7224 - RNA, 294 nt, Artificial Sequence
  derived and/or modified sequence opt6 from Cytochrome_c__Homo_sapiens__CCF23106
auggcacuaccacuaagaccauuaacaagaggaguagcaucagcagcaaaaggaggacacggaggagcaggagcaagaacauggagacuacuaacauucguacuagcacuaccaucaguagcacuaugcacauucaacucauaccuacacucaggacacagaccaagaccagaauucagaccauaccaacaccuaagaauaagaacaaaaccauacccauggggagacggaaaccacacacuauuccacaacucacacguaaacccacuaccaacaggauacgaacacccauaa

SEQ ID NO: 7225 - protein, 171 aa, Artificial Sequence
  Cytochrome_c__Homo_sapiens__H6SG14
MLPRAAWSLVLRKGGGGRRGMHSSEGTTRGGGKMSPYTNCYAQRYYPMPEEPFCTELNAEEQALKEKEKGSWTQLTHAEKVALYRLQFNETFAEMNRRSNEWKTVMGCVFFFIGFAALVIWWQRVYVFPPKPITLTDERKAQQLQRMLDMKVNPVQGLASRWDYEKKQWKK

SEQ ID NO: 7226 - RNA, 516 nt, Artificial Sequence
  Cytochrome_c__Homo_sapiens__CCF23107
augcuccccagagcugccuggagcuuggugcugaggaaagguggagguggaagacgagggaugcacagcucagaaggcaccacccgugguggggggaagaugucccccuacaccaacugcuaugcccagcgcuacuaccccaugccagaagagcccuucugcacagaacucaacgcugaggagcaggcccugaaggagaaggagaagggaagcuggacccagcugacccacgccgaaaagguggccuuguaccggcuccaguucaaugagaccuuugcggagaugaaccgucgcuccaaugaguggaagacagugauggguugugucuucuucuucauuggauucgcagcucuggugauuugguggcagcgggucuacguauuuccuccaaagccgaucaccuugacggacgagcggaaagcccagcagcugcagcgcaugcuggacaugaaggugaauccugugcagggccuggccucccgcugggacuaugagaagaagcaguggaagaaguga

SEQ ID NO: 7227 - RNA, 516 nt, Artificial Sequence
  derived and/or modified sequence opt1 from Cytochrome_c__Homo_sapiens__CCF23107
augcugccccgcgccgccuggagccucgugcugcggaagggcgggggcgggcgccggggcaugcacuccagcgaggggaccacccgcggcggcgggaagauguccccguacacgaacugcuacgcgcagcgguacuaccccaugcccgaggagcccuucugcaccgagcugaacgccgaggagcaggcccucaaggagaaggagaagggcagcuggacccagcugacccacgccgagaaggucgcccuguaccgccuccaguucaacgagacguucgcggagaugaaccggcgcuccaacgaguggaagaccgugauggggugcguguucuucuucaucggcuucgccgcccuggucaucugguggcagcggguguacguguucccgcccaagcccaucacccugaccgacgagcgcaaggcccagcagcuccagcggaugcuggacaugaaggucaaccccgugcaggggcuggcgagccgcugggacuacgagaagaagcaguggaagaaguga

SEQ ID NO: 7228 - RNA, 516 nt, Artificial Sequence
  derived and/or modified sequence opt2 from Cytochrome_c__Homo_sapiens__CCF23107
augcucccccgcgccgccuggucccucguccuccgcaagggcggcggcggccgccgcggcaugcacuccuccgagggcaccacccgcggcggcggcaagaugucccccuacaccaacugcuacgcccagcgcuacuaccccaugcccgaggagcccuucugcaccgagcucaacgccgaggagcaggcccucaaggagaaggagaagggcuccuggacccagcucacccacgccgagaaggucgcccucuaccgccuccaguucaacgagaccuucgccgagaugaaccgccgcuccaacgaguggaagaccgucaugggcugcgucuucuucuucaucggcuucgccgcccucgucaucugguggcagcgcgucuacgucuucccccccaagcccaucacccucaccgacgagcgcaaggcccagcagcuccagcgcaugcucgacaugaaggucaaccccguccagggccucgccucccgcugggacuacgagaagaagcaguggaagaaguga

SEQ ID NO: 7229 - RNA, 516 nt, Artificial Sequence
  derived and/or modified sequence opt3 from Cytochrome_c__Homo_sapiens__CCF23107
augcugcccagagccgcuuggagccucgugcuuaggaagggcgggggaggucggcgcggcaugcacuccucugaggggaccacacgaggaggcgguaaaaugucaccuuacacuaacugcuaugcacagcguuacuauccaaugccggaagaacccuucuguacggaacugaaugccgaggaacaagcguugaaggagaaagagaaggggaguuggacccaguuaacacaugcugaaaaagucgcccuguacagacuacaguuuaacgagacuuucgcagaaaugaauaggcggagcaacgaguggaagaccguuaugggaugcguguuuuucuuuaucggcuucgccgcucucguaauuugguggcagcgcguguaugucuuuccuccaaagcccauaacacugaccgacgagagaaaagcacaacagcuucagaggaugcuggauaugaaggugaauccuguucagggcuuggccucccggugggacuacgagaaaaagcaauggaaaaaguga

SEQ ID NO: 7230 - RNA, 516 nt, Artificial Sequence
  derived and/or modified sequence opt4 from Cytochrome_c__Homo_sapiens__CCF23107
augcugcccagagccgccuggagccuggugcugagaaagggcggcggcggcagaagaggcaugcacagcagcgagggcaccaccagaggcggcggcaagaugagccccuacaccaacugcuacgcccagagauacuaccccaugcccgaggagcccuucugcaccgagcugaacgccgaggagcaggcccugaaggagaaggagaagggcagcuggacccagcugacccacgccgagaagguggcccuguacagacugcaguucaacgagaccuucgccgagaugaacagaagaagcaacgaguggaagaccgugaugggcugcguguucuucuucaucggcuucgccgcccuggugaucugguggcagagaguguacguguucccccccaagcccaucacccugaccgacgagagaaaggcccagcagcugcagagaaugcuggacaugaaggugaaccccgugcagggccuggccagcagaugggacuacgagaagaagcaguggaagaaguga

SEQ ID NO: 7231 - RNA, 516 nt, Artificial Sequence
  derived and/or modified sequence opt5 from Cytochrome_c__Homo_sapiens__CCF23107
augcugcccagagccgcuuggagccucgugcugcggaagggcgggggaggccgcagagggaugcacuccucugagggaaccacacggggcgggggaaaaaugagcccuuacacgaacugcuaugcccagcgcuacuauccgaugcccgaagaaccuuucuguaccgaacuuaaugcggaggaacaagcucugaaggagaaagagaagggcuccuggacacagcucacccaugccgaaaaagucgcccuguacagacuucaguuuaacgagacauucgcugaaaugaaucggcgcucuaacgaguggaagaccguuaugggcugcguguuuuucuuuaucggguucgccgcucuggugauuugguggcagagagucuauguguuucccccuaagcccaucacacucaccgacgagcggaaagcccaacagcugcagcgcaugcuggauaugaagguuaauccugugcagggacucgcgagcagaugggacuacgagaaaaagcaauggaaaaaguga

SEQ ID NO: 7232 - RNA, 516 nt, Artificial Sequence
  derived and/or modified sequence opt6 from Cytochrome_c__Homo_sapiens__CCF23107
augcuaccgagagcagcauggagccuaguauuaagaaaaggagguggaggaagaagaggaaugcacucaagcgaaggaacaacaagaggaggaggaaaaaugucaccauauacaaauugcuaugcacaaagauauuacccaaugccagaagaaccauucugcacggaauuaaacgcagaagaacaagcacuaaaagaaaaagaaaaaggaucauggacacaauuaacacaugcagaaaaaguagcauuauacagacuacaauucaaugaaacauucgcagaaaugaacagaagaucaaacgaauggaaaacaguaaugggaugcguauucuuuuucauagguuuugcagcacuaguaauaugguggcaaagaguauacguauucccaccaaaaccaauaacauuaacagaugaaagaaaagcacaacaacuacaaagaauguuagauaugaaagucaauccaguacaaggacuagcaagcagaugggauuacgaaaaaaaacaauggaaaaaauaa

SEQ ID NO: 7233 - protein, 109 aa, Artificial Sequence
  Cytochrome_c__Homo_sapiens__H6SG15
MAVVGVSSVSRLLGRSRPQLGRPMSSGAHGEEGSARMWKTLTFFVALPGVAVSMLNVYLKSHHGEHERPEFIAYPHLRIRTKPFPWGDGNHTLFHNPHVNPLPTGYEDE

SEQ ID NO: 7234 - RNA, 330 nt, Artificial Sequence
  Cytochrome_c__Homo_sapiens__CCF23108
auggcgguaguugguguguccucgguuucucggcugcugggucggucccgcccacagcuggggcggccuaugucgaguggcgcccauggcgaagagggcucagcucgcauguggaagacucucaccuucuucgucgcgcuccccgggguggcagucagcaugcugaauguguaccugaagucgcaccacggagagcacgagagacccgaguucaucgccuacccccaucuccgcaucaggaccaagccguuucccuggggagaugguaaccauacucuauuccauaacccucaugugaauccacuuccaacuggcuacgaagaugaauaa

SEQ ID NO: 7235 - RNA, 330 nt, Artificial Sequence
  derived and/or modified sequence opt1 from Cytochrome_c__Homo_sapiens__CCF23108
auggccguggucggcgugagcagcgugagccgccugcucgggcggucccgcccccagcugggccggccgaugagcuccggggcccacggcgaggaggggagcgcgcgcauguggaagacccugaccuucuucgucgcccuccccggcguggccguguccaugcugaacgucuaccugaagucccaccacggcgagcacgagcggcccgaguucaucgccuacccccaccuccgcauccggacgaagccguuccccuggggcgacgggaaccacacccuguuccacaacccccacgugaacccccugccgaccggguacgaggacgaguga

SEQ ID NO: 7236 - RNA, 330 nt, Artificial Sequence
  derived and/or modified sequence opt2 from Cytochrome_c__Homo_sapiens__CCF23108
auggccgucgucggcgucuccuccgucucccgccuccucggccgcucccgcccccagcucggccgccccauguccuccggcgcccacggcgaggagggcuccgcccgcauguggaagacccucaccuucuucgucgcccuccccggcgucgccgucuccaugcucaacgucuaccucaagucccaccacggcgagcacgagcgccccgaguucaucgccuacccccaccuccgcauccgcaccaagcccuuccccuggggcgacggcaaccacacccucuuccacaacccccacgucaacccccuccccaccggcuacgaggacgaguga

SEQ ID NO: 7237 - RNA, 330 nt, Artificial Sequence
  derived and/or modified sequence opt3 from Cytochrome_c__Homo_sapiens__CCF23108
auggccguggucggcguuagcuccgugucuagacugcucgggaggucacggccccagcuuggacgcccuaugaguagcggugcucacggcgaggaaggguccgcacgaauguggaagacccugacauucuuuguagccuugccaggaguggcggucucuauguuaaacguguaccugaaaucgcaucacggcgagcaugaacguccggaguucaucgcuuauccccaccuaagaauuaggacuaagccuuuuccauggggugacgggaaucauacccucuuccacaacccccacguuaauccucugccaacgggauacgaagaugaguga

SEQ ID NO: 7238 - RNA, 330 nt, Artificial Sequence
  derived and/or modified sequence opt4 from Cytochrome_c__Homo_sapiens__CCF23108
auggccguggugggcgugagcagcgugagcagacugcugggcagaagcagaccccagcugggcagacccaugagcagcggcgcccacggcgaggagggcagcgccagaauguggaagacccugaccuucuucguggcccugcccggcguggccgugagcaugcugaacguguaccugaagagccaccacggcgagcacgagagacccgaguucaucgccuacccccaccugagaaucagaaccaagcccuuccccuggggcgacggcaaccacacccuguuccacaacccccacgugaacccccugcccaccggcuacgaggacgaguga

SEQ ID NO: 7239 - RNA, 330 nt, Artificial Sequence
  derived and/or modified sequence opt5 from Cytochrome_c__Homo_sapiens__CCF23108
auggccguggucggcguuagcuccgugucuagacugcucgggcggagccgcccccagcugggaagaccuauguccucuggcgcucacggggaggaaggaagcgcccggauguggaagacccuuacauucuuuguggcgcugccgggcgucgcuguguccaugcucaacguuuaccugaaaucucaucacggggagcaugaacgccccgaguucaucgccuauccucaccuucggauuagaacgaagcccuuuccuuggggagacggcaaucauacccuguuccacaacccccacgugaauccucucccgacaggcuacgaagaugaguga

SEQ ID NO: 7240 - RNA, 330 nt, Artificial Sequence
  derived and/or modified sequence opt6 from Cytochrome_c__Homo_sapiens__CCF23108
auggcaguaguaggaguaucaucaguaucaagacuacuaggaagaucaagaccacaacucggaagaccaaugucaucaggagcacacggagaagaaggaucagcaagaauguggaaaacacuaacauucuucguagcauuaccaggaguagcaguaucaaugcuaaacguauaccuaaaaucacaucacggagaacaugaaagaccagaauucauagcauacccacaccuaagaauaagaacaaaaccauucccauggggagacggaaaucacacacuauuccacaacccacacguaaacccacuaccaacaggauaugaagacgaauaa

SEQ ID NO: 7241 - protein, 86 aa, Artificial Sequence [sequence omitted]

SEQ ID NO: 7242 - RNA, 261 nt, Artificial Sequence
  Cytochrome_c__Homo_sapiens__AAC98895
augucgaguggcgcccacggcgaggaggguucagcucggauguggaaggcccucaccuacuucguggcgcugcccggggugggagugagcaugcucaacguguuccucaagucgcggcacgaagagcacgagagacccccguucguugccuacccucaccugcgcaucaggaccaagcccuuccccuggggagacgguaaccauacccucuuccacaacccucaugugaacccacuuccgaccggcuaugaagaugaguaa

SEQ ID NO: 7243 - RNA, 261 nt, Artificial Sequence
  derived and/or modified sequence opt1 from Cytochrome_c__Homo_sapiens__AAC98895
augagcagcggcgcccacggggaggagggcagcgcccgcauguggaaggcgcugaccuacuucguggcccuccccggggucggcguguccaugcugaacguguuccugaagucccggcacgaggagcacgagcgcccgcccuucgucgccuacccccaccuccggauccgcaccaagcccuucccguggggcgacgggaaccacacgcuguuccacaacccccacgugaacccccugcccaccggcuacgaggacgaguga

SEQ ID NO: 7244 - RNA, 261 nt, Artificial Sequence
  derived and/or modified sequence opt2 from Cytochrome_c__Homo_sapiens__AAC98895
auguccuccggcgcccacggcgaggagggcuccgcccgcauguggaaggcccucaccuacuucgucgcccuccccggcgucggcgucuccaugcucaacgucuuccucaagucccgccacgaggagcacgagcgcccccccuucgucgccuacccccaccuccgcauccgcaccaagcccuuccccuggggcgacggcaaccacacccucuuccacaacccccacgucaacccccuccccaccggcuacgaggacgaguga

SEQ ID NO: 7245 - RNA, 261 nt, Artificial Sequence
  derived and/or modified sequence opt3 from Cytochrome_c__Homo_sapiens__AAC98895
augagcuccggcgcccacggggaggaaggaucugcuagaauguggaaggcacugaccuacuucguggcccuccccggugucggcguuucaaugcuuaacguguuucugaaaaguaggcaugaggaacacgagcggccuccauucguagcguauccgcauuugcgcauccgaacaaagcccuuuccuuggggagacgggaaucacacuuuauuccauaacccacacgugaauccccugccuacgggcuacgaagaugaguga

SEQ ID NO: 7246 - RNA, 261 nt, Artificial Sequence
  derived and/or modified sequence opt4 from Cytochrome_c__Homo_sapiens__AAC98895
augagcagcggcgcccacggcgaggagggcagcgccagaauguggaaggcccugaccuacuucguggcccugcccggcgugggcgugagcaugcugaacguguuccugaagagcagacacgaggagcacgagagaccccccuucguggccuacccccaccugagaaucagaaccaagcccuuccccuggggcgacggcaaccacacccuguuccacaacccccacgugaacccccugcccaccggcuacgaggacgaguga

SEQ ID NO: 7247 - RNA, 261 nt, Artificial Sequence
  derived and/or modified sequence opt5 from Cytochrome_c__Homo_sapiens__AAC98895
augagcuccggcgcccacggggaggaaggaucugcuagaauguggaaggcccugaccuacuucguggcgcuccccggcgucgggguuagcaugcugaacguguuucuuaaaucccggcaugaggaacacgagcgcccuccguucguggcuuauccccaucugagaauccggacaaagccuuuucccuggggagacggcaaucacacccucuuccauaacccucacgucaauccccugccuacgggguacgaagaugaguga

SEQ ID NO: 7248 - RNA, 261 nt, Artificial Sequence
  derived and/or modified sequence opt6 from Cytochrome_c__Homo_sapiens__AAC98895
augucaucaggagcacacggagaagaaggaucagcaagaauguggaaagcacuaacauacuucguagcacuaccaggaguaggaguaucaaugcuaaacguauuccuaaaaucaagacacgaagaacacgaaagaccaccauucguagcauacccacaccuaagaauaagaacaaaaccauucccauggggagacggaaaccacacacuauuccacaacccacacguaaacccacuaccaacaggauacgaagacgaauaa

SEQ ID NO: 7249 - protein, 325 aa, Artificial Sequence
  Cytochrome_c__Homo_sapiens__P08574
MAAAAASLRGVVLGPRGAGLPGARARGLLCSARPGQLPLRTPQAVALSSKSGLSRGRKVMLSALGMLAAGGAGLAMALHSAVSASDLELHPPSYPWSHRGLLSSLDHTSIRRGFQVYKQVCASCHSMDFVAYRHLVGVCYTEDEAKELAAEVEVQDGPNEDGEMFMRPGKLFDYFPKPYPNSEAARAANNGALPPDLSYIVRARHGGEDYVFSLLTGYCEPPTGVSLREGLYFNPYFPGQAIAMAPPIYTDVLEFDDGTPATMSQIAKDVCTFLRWASEPEHDHRKRMGLKMLMMMALLVPLVYTIKRHKWSVLKSRKLAYRPPK

SEQ ID NO: 7250 - RNA, 978 nt, Artificial Sequence
  Cytochrome_c__Homo_sapiens__AAV38601
auggcggcagcugcggcuucgcuucgcgggguaguguugggcccgcggggcgcggggcucccgggcgcgcgugcccggggucugcugugcagcgcgcgucccgggcagcucccgcuacggacaccucaggcaguggccuugucgucgaagucuggccuuucccgaggccggaaagugaugcugucagcgcugggcaugcuggcggcagggggugcggggcuggccauggcucugcauucggcugugagugccagugaccuggagcugcacccccccagcuauccguggucucaccguggccuccucucuuccuuggaccacaccagcauccggagggguuuccagguauauaagcaggugugcgccuccugccacagcauggacuucguggccuaccgccaccuggugggcgugugcuacacggaggaugaagcuaaggagcuggcugcggagguggagguucaagacggccccaaugaagauggggagauguucaugcggccagggaagcuguucgacuauuucccaaaaccauaccccaacagugaggcugcucgagcugccaacaacggagcauugcccccugaccucagcuacaucgugcgagcuaggcaugguggugaggacuacgucuucucccugcucacgggcuacugcgagccacccaccggggugucacugcgggaaggucucuacuucaaccccuacuuuccuggccaggccauugccauggccccucccaucuacacagaugucuuagaguuugacgauggcaccccagcuaccaugucccagauagccaaggaugugugcaccuuccugcgcugggcaucugagccagagcacgaccaucgaaaacgcauggggcucaagauguugaugaugauggcucugcuggugccccuggucuacaccauaaagcggcacaaguggucaguccugaagagucggaagcuggcauaucggccgcccaaguag

SEQ ID NO: 7251 - RNA, 978 nt, Artificial Sequence
  derived and/or modified sequence opt1 from Cytochrome_c__Homo_sapiens__AAV38601
auggccgccgcggccgccagccugcgcggcgugguccucgggccccgcggcgccgggcugccgggcgcccgcgcgcgggggcugcucugcuccgcccgccccggccagcugccccugcggacgccccaggccguggcccucagcuccaagagcggccugucccgcgggcggaaggugaugcugagcgcgcucggcaugcuggccgccgggggcgccgggcuggccauggcgcuccacuccgccgucagcgccuccgaccuggagcugcacccgcccagcuaccccuggucccaccgcggccuccugagcucccuggaccacaccagcauccggcgcggcuuccagguguacaagcaggucugcgccuccugccacagcauggacuucguggccuaccggcaccucgugggggugugcuacaccgaggacgaggcgaaggagcuggccgccgaggucgaggugcaggacggccccaacgaggacggggagauguucaugcgcccgggcaagcuguucgacuacuuccccaagcccuaccccaacuccgaggccgcccgggcggccaacaacggcgcccucccgcccgaccugagcuacaucgugcgcgcccggcacgggggcgaggacuacgucuucucccugcucaccggguacugcgagccgcccaccggcgugagccugcgcgaggggcuguacuucaaccccuacuuccccggccaggccaucgcgauggccccgcccaucuacaccgacgugcucgaguucgacgacggcacgcccgccaccaugagccagaucgccaaggacgucugcaccuuccugcggugggcguccgagcccgagcacgaccaccgcaagcggauggggcugaagaugcucaugaugauggcccugcuggugccccucguguacaccaucaagcgccacaaguggagcguccugaagucccggaagcuggccuaccggcccccgaaguga

SEQ ID NO: 7252 - RNA, 978 nt, Artificial Sequence
  derived and/or modified sequence opt2 from Cytochrome_c__Homo_sapiens__AAV38601
auggccgccgccgccgccucccuccgcggcgucguccucggcccccgcggcgccggccuccccggcgcccgcgcccgcggccuccucugcuccgcccgccccggccagcucccccuccgcaccccccaggccgucgcccucuccuccaaguccggccucucccgcggccgcaaggucaugcucuccgcccucggcaugcucgccgccggcggcgccggccucgccauggcccuccacuccgccgucuccgccuccgaccucgagcuccacccccccuccuaccccuggucccaccgcggccuccucuccucccucgaccacaccuccauccgccgcggcuuccaggucuacaagcaggucugcgccuccugccacuccauggacuucgucgccuaccgccaccucgucggcgucugcuacaccgaggacgaggccaaggagcucgccgccgaggucgagguccaggacggccccaacgaggacggcgagauguucaugcgccccggcaagcucuucgacuacuuccccaagcccuaccccaacuccgaggccgcccgcgccgccaacaacggcgcccucccccccgaccucuccuacaucguccgcgcccgccacggcggcgaggacuacgucuucucccuccucaccggcuacugcgagccccccaccggcgucucccuccgcgagggccucuacuucaaccccuacuuccccggccaggccaucgccauggccccccccaucuacaccgacguccucgaguucgacgacggcacccccgccaccaugucccagaucgccaaggacgucugcaccuuccuccgcugggccuccgagcccgagcacgaccaccgcaagcgcaugggccucaagaugcucaugaugauggcccuccucgucccccucgucuacaccaucaagcgccacaagugguccguccucaagucccgcaagcucgccuaccgcccccccaaguga

SEQ ID NO: 7253 - RNA, 978 nt, Artificial Sequence
  derived and/or modified sequence opt3 from Cytochrome_c__Homo_sapiens__AAV38601
auggccgcugcagccgcgagccugagaggcgugguccucgggcccaggggagcuggucuuccuggcgcccgggcacgcgggcuguugugcuccgcccgaccaggacaguuaccgcugcguacaccccaagcuguugcacuaucuucaaagaguggccucagcagagguaggaaagugaugcuguccgcccuugggaugcuggcugccggaggcgcgggcuuggcaauggcccuccacucugcuguaucggccucagaccuggagcugcauccuccaagcuaccccuggagucaccgggggcucuuauccucucuggaucauaccagcauccgcagaggauuccagguguauaagcaggucugugcauccugccacucaauggacuuuguggcuuacaggcaucuuguugguguguguuauacugaagaugaggccaaagaauuggcggccgaggucgaagugcaggacggcccuaacgaggauggggagauguucaugcggccaggaaagcuguuugacuacuuccccaaaccuuauccaaauagugaagcagcucgcgccgcuaacaauggcgcccuaccgcccgaucucagcuacauuguacgagcaagacacgguggggaggacuauguguuuucucugcuuacgggauacugcgaaccuccaaccggcguuucccugagggagggcuuguacuucaaccccuauuuuccugggcaagccauagcuauggcgccacccaucuacacagauguccucgaguucgacgauggaacuccggcaaccaugucacagauugccaaggacguguguacauuucugcggugggcuagcgaaccugagcacgaucaucguaagcgcauggguuuaaaaaugcugaugaugauggcccuccuugugccccuggucuauaccaucaagagacacaaauggaguguuuugaagucuaggaaacuagcauaccggccaccuaaguga

SEQ ID NO: 7254 - RNA, 978 nt, Artificial Sequence
  derived and/or modified sequence opt4 from Cytochrome_c__Homo_sapiens__AAV38601
auggccgccgccgccgccagccugagaggcguggugcugggccccagaggcgccggccugcccggcgccagagccagaggccugcugugcagcgccagacccggccagcugccccugagaaccccccaggccguggcccugagcagcaagagcggccugagcagaggcagaaaggugaugcugagcgcccugggcaugcuggccgccggcggcgccggccuggccauggcccugcacagcgccgugagcgccagcgaccuggagcugcacccccccagcuaccccuggagccacagaggccugcugagcagccuggaccacaccagcaucagaagaggcuuccagguguacaagcaggugugcgccagcugccacagcauggacuucguggccuacagacaccuggugggcgugugcuacaccgaggacgaggccaaggagcuggccgccgagguggaggugcaggacggccccaacgaggacggcgagauguucaugagacccggcaagcuguucgacuacuuccccaagcccuaccccaacagcgaggccgccagagccgccaacaacggcgcccugccccccgaccugagcuacaucgugagagccagacacggcggcgaggacuacguguucagccugcugaccggcuacugcgagccccccaccggcgugagccugagagagggccuguacuucaaccccuacuuccccggccaggccaucgccauggccccccccaucuacaccgacgugcuggaguucgacgacggcacccccgccaccaugagccagaucgccaaggacgugugcaccuuccugagaugggccagcgagcccgagcacgaccacagaaagagaaugggccugaagaugcugaugaugauggcccugcuggugccccugguguacaccaucaagagacacaaguggagcgugcugaagagcagaaagcuggccuacagaccccccaaguga

SEQ ID NO: 7255 - RNA, 978 nt, Artificial Sequence
  derived and/or modified sequence opt5 from Cytochrome_c__Homo_sapiens__AAV38601
auggccgcugccgcggcuagccugagaggcgugguccucgggccccggggagccggccugccuggggcccgcgcuagaggacuucugugcuccgcccggccgggccagcucccccugcgcaccccucaagcuguugcccuuucuagcaaguccgggcugucuagaggacggaaagugaugcucagcgcgcugggcaugcuggccgcuggcggggccggacucgcuauggcccugcacuccgcggugucugccagcgaccuugagcugcaucccccuuccuaccccuggagccaccgcggccuccugucuucccuugaucauacaagcaucagacggggguuccaggucuauaaacaggugugugcuucuugccacuccauggacuuuguugccuaccgccaucuggugggagucuguuauacggaagaugaggcuaaggaacucgccgccgagguggaaguucaggacggcccuaacgaggauggggagauguucaugagaccgggaaagcuguuugacuacuuccccaaaccuuaucccaauagcgaagcugcgcgggccgcuaacaauggcgcccugccucccgaucucucuuacauugugcgcgccagacacggcggggaggacuaugucuuuucccugcuuaccggauacugcgaaccgccuacaggcgugagccugcgggaggggcucuacuucaaccccuauuuuccuggacaagcuaucgccauggcgccucccauuuacaccgaugugcuggaguucgacgauggcacacccgcuaccaugucccagaucgccaaggacgucuguacauuucuucgcugggccucugaaccggagcacgaucauagaaagcggauggggcugaaaaugcucaugaugauggcucugcugguuccccucguguauaccauuaagagacacaaauggagcgugcugaagucccgcaaacuugccuaccggccucccaaguga

SEQ ID NO: 7256 - RNA, 978 nt, Artificial Sequence
  derived and/or modified sequence opt6 from Cytochrome_c__Homo_sapiens__AAV38601
auggcagcagcagcagcaucauuacguggaguaguacuaggaccuagaggagcaggauuaccaggagcuagagcaagaggauuauuauguucugcacgaccaggacaacuuccauuaagaacuccacaagccguugcauuaucaucaaaaucuggacuuucacgaggaagaaaaguaauguuaucagcacuaggaaugcuagccgcaggaggagcaggauuagcaauggccuuacauucagcaguaucagcuucagacuuagaacuacacccuccgucauauccauggagucaucgaggacuacuaaguucauuagaucauacaucaauaagaagaggauuucaaguauauaaacaaguaugugcaucaugucauucaauggauuuuguagccuacagacauuuaguuggaguauguuauacagaagacgaagcaaaagaauuagccgcagaaguugaaguacaagauggaccaaaugaagauggagaaauguuuaugagaccuggaaaauuauuugacuauuuuccaaaaccauacccaaauagcgaagcagcaagagccgcaaauaauggagcacuaccuccugaucuuucauauauugucagagcaagacaugguggugaagauuauguauuuucauuacuaacaggauauugugaaccaccuacaggaguaucauuaagagaaggauuauacuuuaacccauauuuuccaggacaagcaauagcuauggcaccaccaauauauacagauguauuagaauuugacgauggaacaccugcaacaaugucacaaauagcaaaagauguauguacauuuuuacgaugggcaucagaaccagaacaugaucaucguaaaagaaugggauuaaaaauguuaaugaugauggcauuauuaguuccuuuaguuuauacuauaaaacgacauaaauggaguguuuuaaaauccagaaaauuagcauauagaccuccaaaauaa

SEQ ID NO: 7257 - protein, 105 aa, Artificial Sequence; identical to SEQ ID NO: 7193
  Cytochrome_c__Homo_sapiens__P99999

SEQ ID NO: 7258 - RNA, 318 nt, Artificial Sequence; identical to SEQ ID NO: 7194
  Cytochrome_c__Homo_sapiens__AAA35732

SEQ ID NO: 7259 - RNA, 318 nt, Artificial Sequence; identical to SEQ ID NO: 7195
  derived and/or modified sequence opt1 from Cytochrome_c__Homo_sapiens__AAA35732

SEQ ID NO: 7260 - RNA, 318 nt, Artificial Sequence; identical to SEQ ID NO: 7196
  derived and/or modified sequence opt2 from Cytochrome_c__Homo_sapiens__AAA35732

SEQ ID NO: 7261 - RNA, 318 nt, Artificial Sequence; identical to SEQ ID NO: 7197
  derived and/or modified sequence opt3 from Cytochrome_c__Homo_sapiens__AAA35732

SEQ ID NO: 7262 - RNA, 318 nt, Artificial Sequence; identical to SEQ ID NO: 7198
  derived and/or modified sequence opt4 from Cytochrome_c__Homo_sapiens__AAA35732

SEQ ID NO: 7263 - RNA, 318 nt, Artificial Sequence; identical to SEQ ID NO: 7199
  derived and/or modified sequence opt5 from Cytochrome_c__Homo_sapiens__AAA35732

SEQ ID NO: 7264 - RNA, 318 nt, Artificial Sequence; identical to SEQ ID NO: 7200
  derived and/or modified sequence opt6 from Cytochrome_c__Homo_sapiens__AAA35732

SEQ ID NO: 7265 - protein, 83 aa, Artificial Sequence [sequence omitted]

SEQ ID NO: 7266 - RNA, 252 nt, Artificial Sequence
  Cytochrome_c__Homo_sapiens__AAI00853
augcuguggaaucugcuggcucuucgucagauugggcagaggacgauaagcacugcuucccgcaggcauuuuaaaaauaaaguuccggagaagcaaaaacuguuccaggaggaugaugaaauuccacuguaucuaaagggugggguagcugaugcccuccuguauagagccaccaugauucuuacaguugguggaacagcauaugccauauaugagcuggcuguggcuucauuucccaagaagcaggaguga

SEQ ID NO: 7267 - RNA, 252 nt, Artificial Sequence
  derived and/or modified sequence opt1 from Cytochrome_c__Homo_sapiens__AAI00853
augcuguggaaccuccuggcccugcgccagaucggccagcggaccaucagcaccgccucccgccggcacuucaagaacaaggugcccgagaagcagaagcuguuccaggaggacgacgagaucccgcucuaccugaagggcgggguggcggacgcccuccuguaccgcgccacgaugauccugaccgucgggggcaccgccuacgccaucuacgagcucgcgguggccagcuuccccaagaagcaggaguga

SEQ ID NO: 7268 - RNA, 252 nt, Artificial Sequence
  derived and/or modified sequence opt2 from Cytochrome_c__Homo_sapiens__AAI00853
augcucuggaaccuccucgcccuccgccagaucggccagcgcaccaucuccaccgccucccgccgccacuucaagaacaagguccccgagaagcagaagcucuuccaggaggacgacgagaucccccucuaccucaagggcggcgucgccgacgcccuccucuaccgcgccaccaugauccucaccgucggcggcaccgccuacgccaucuacgagcucgccgucgccuccuuccccaagaagcaggaguga

SEQ ID NO: 7269 - RNA, 252 nt, Artificial Sequence
  derived and/or modified sequence opt3 from Cytochrome_c__Homo_sapiens__AAI00853
augcuguggaaccuccuugcccugagacagaucggccaaaggaccauuagcacagcuucccggcgccacuucaagaauaaagugcccgagaagcagaaauuguuucaggaagacgaugagauaccuuuauaccugaaagggggagucgcagacgcccuacucuaucgagcgacuaugauccugacgguugguggcaccgcuuacgccauuuaugaacuugcaguggccucuuucccaaagaagcaggaguga

SEQ ID NO: 7270 - RNA, 252 nt, Artificial Sequence
  derived and/or modified sequence opt4 from Cytochrome_c__Homo_sapiens__AAI00853
augcuguggaaccugcuggcccugagacagaucggccagagaaccaucagcaccgccagcagaagacacuucaagaacaaggugcccgagaagcagaagcuguuccaggaggacgacgagaucccccuguaccugaagggcggcguggccgacgcccugcuguacagagccaccaugauccugaccgugggcggcaccgccuacgccaucuacgagcuggccguggccagcuuccccaagaagcaggaguga

SEQ ID NO: 7271 - RNA, 252 nt, Artificial Sequence
  derived and/or modified sequence opt5 from Cytochrome_c__Homo_sapiens__AAI00853
augcuguggaaccuccuggcccuuagacagaucggccaacggaccauuagcacagcuucccgcagacacuucaagaauaaagugcccgagaagcagaaacuguuucaggaagacgaugagaucccucucuaccugaaagggggagucgccgacgcgcuucuguaucgggcuacgaugauucucaccguuggcgggacagccuacgccaucuaugaacuggcuguggccucuuucccgaagaagcaggaguga

SEQ ID NO: 7272 - RNA, 252 nt, Artificial Sequence
  derived and/or modified sequence opt6 from Cytochrome_c__Homo_sapiens__AAI00853
augcuauggaaccuacuagcacuaagacaaauaggacaaagaacaauaucaacagcaagcagaagacacuucaaaaacaaaguaccagaaaaacaaaaacuauuccaagaagacgacgaaauaccacuauaccuaaaaggaggaguagcagacgcacuacuauacagagcaacaaugauacuaacaguaggaggaacagcauacgcaauauacgaacuagcaguagcaucauucccaaaaaaacaagaauaa

SEQ ID NO: 7273 - protein, 69 aa, Artificial Sequence
  Cytochrome_c__Homo_sapiens__Q53XN1
MSVLTPLLLRGLTGSARRLPVPRAKIHSLPPEGKLGIMELAVGLTSCFVTFLLPAGWILSHLETYRRPE

SEQ ID NO: 7274 - RNA, 210 nt, Artificial Sequence
  Cytochrome_c__Homo_sapiens__AAP88805
auguccguccugacgccgcugcugcugcggggcuugacaggcucggcccggcggcucccagugccgcgcgccaagauccauucguugccgccggaggggaagcuugggaucauggaauuggccguugggcuuaccuccugcuucgugaccuuccuccugccagcgggcuggauccugucacaccuggagaccuacaggaggccagaguag

SEQ ID NO: 7275 - RNA, 210 nt, Artificial Sequence
  derived and/or modified sequence opt1 from Cytochrome_c__Homo_sapiens__AAP88805
augagcgugcugacgccccuccugcugcgcggccucaccggguccgcccggcgccugccggucccccgggccaagauccacagccugccgcccgagggcaagcucgggaucauggagcuggcggugggccugaccuccugcuucgugaccuuccuccugcccgccggguggauccugagccaccucgagaccuaccgccggcccgaguga

SEQ ID NO: 7276 - RNA, 210 nt, Artificial Sequence
  derived and/or modified sequence opt2 from Cytochrome_c__Homo_sapiens__AAP88805
auguccguccucaccccccuccuccuccgcggccucaccggcuccgcccgccgccuccccgucccccgcgccaagauccacucccucccccccgagggcaagcucggcaucauggagcucgccgucggccucaccuccugcuucgucaccuuccuccuccccgccggcuggauccucucccaccucgagaccuaccgccgccccgaguga

SEQ ID NO: 7277 - RNA, 210 nt, Artificial Sequence
  derived and/or modified sequence opt3 from Cytochrome_c__Homo_sapiens__AAP88805
augagcgugcugacaccccuccuucugagaggcuugaccggguccgccaggcgguuaccugucccacgcgcuaagauccacucucugccgcccgagggaaaacuagguauuauggaacucgcaguuggccugacuucaugcuucgugacguuucuucugccugccggguggauauugagucaucucgagaccuaccgacguccagaauga

SEQ ID NO: 7278 - RNA, 210 nt, Artificial Sequence
  derived and/or modified sequence opt4 from Cytochrome_c__Homo_sapiens__AAP88805
augagcgugcugaccccccugcugcugagaggccugaccggcagcgccagaagacugcccgugcccagagccaagauccacagccugccccccgagggcaagcugggcaucauggagcuggccgugggccugaccagcugcuucgugaccuuccugcugcccgccggcuggauccugagccaccuggagaccuacagaagacccgaguga

SEQ ID NO: 7279 - RNA, 210 nt, Artificial Sequence
  derived and/or modified sequence opt5 from Cytochrome_c__Homo_sapiens__AAP88805
augagcgugcugacaccccuccugcuuagaggccugaccggguccgcccggcgccucccugucccgagagcuaagauccacucucugcccccugagggaaaacuuggcauuauggaacuggccguugggcucacgagcugcuucgugaccuuucugcugcccgcgggauggauccucucccaucuggagacauaccggcgcccugaauga

SEQ ID NO: 7280 - RNA, 210 nt, Artificial Sequence
  derived and/or modified sequence opt6 from Cytochrome_c__Homo_sapiens__AAP88805
augucaguacuaacaccacuacuacuaagaggacuaacaggaucagcaagaagacuaccaguaccaagagcaaaaauacacucacuaccaccagaaggaaaauuaggcauaauggaacuagcaguaggacuaacaucauguuucguaacauuccuacuaccagcaggauggauacuaucacaccuagaaacauacagaagaccagaauaa

SEQ ID NO: 7281 - protein, 114 aa, Artificial Sequence
  Cytochrome_c__Homo_sapiens__Q6FGA0
MYYKFSGFTQKLAGAWASEAYSPQGLKPVVSTEAPPIIFATPTKLTSDSTVYDYAGKNKVPELQKFFQKADGVPVYLKRGLPDQMLYRTTMALTVGGTIYCLIALYMASQPKNK

SEQ ID NO: 7282 - RNA, 345 nt, Artificial Sequence
  Cytochrome_c__Homo_sapiens__AAY15087
auguacuacaaguuuaguggcuucacgcagaaguuggcaggagcaugggcuucggaggccuauagcccgcagggauuaaagccugugguuuccacagaagcaccaccuaucauauuugccacaccaacuaaacugaccuccgauuccacaguguaugauuaugcugggaaaaacaaaguuccagagcuacaaaaguuuuuccagaaagcugauggugugcccgucuaccugaaacgaggccugccugaccaaaugcuuuaccggaccaccauggcgcugacugugggagggaccaucuacugccugaucgcccucuacauggcuucgcagcccaaaaacaaauga

SEQ ID NO: 7283 - RNA, 345 nt, Artificial Sequence
  derived and/or modified sequence opt1 from Cytochrome_c__Homo_sapiens__AAY15087
auguacuacaaguucagcggcuucacccagaagcuggccggggccugggcguccgaggccuacagcccccagggccucaagccgguggucuccaccgaggccccgcccaucaucuucgccacgcccaccaagcugaccagcgacuccaccguguacgacuacgccgggaagaacaaggugcccgagcugcagaaguucuuccagaaggcggacggcguccccguguaccucaagcgcgggcugcccgaccagaugcuguaccggacgaccauggcccucaccgugggcggcaccaucuacugccugaucgcccuguacauggccagccagcccaagaacaaguga

SEQ ID NO: 7284 - RNA, 345 nt, Artificial Sequence
  derived and/or modified sequence opt2 from Cytochrome_c__Homo_sapiens__AAY15087
auguacuacaaguucuccggcuucacccagaagcucgccggcgccugggccuccgaggccuacuccccccagggccucaagcccgucgucuccaccgaggccccccccaucaucuucgccacccccaccaagcucaccuccgacuccaccgucuacgacuacgccggcaagaacaagguccccgagcuccagaaguucuuccagaaggccgacggcguccccgucuaccucaagcgcggccuccccgaccagaugcucuaccgcaccaccauggcccucaccgucggcggcaccaucuacugccucaucgcccucuacauggccucccagcccaagaacaaguga

SEQ ID NO: 7285 - RNA, 345 nt, Artificial Sequence
  derived and/or modified sequence opt3 from Cytochrome_c__Homo_sapiens__AAY15087
auguacuauaaguucagcggcuuuacccagaaacuggccggggcuugggcauccgaggccuacucuccccaaggacucaagccuguggucucaacagaagcgccaccgaucauuuucgcuacucccacgaaacuuaccagugacagcacaguuuaugauuacgccgguaagaacaaagugccugagcugcagaaguuuuuccagaaggcagacggcguaccaguguauuugaaaagaggguuacccgaucagaugcuguacaggacuaccauggcccuaacagucggaggcaccauauauugccucaucgcucuguacauggcaucccaaccuaagaauaaauga

SEQ ID NO: 7286 - RNA, 345 nt, Artificial Sequence
  derived and/or modified sequence opt4 from Cytochrome_c__Homo_sapiens__AAY15087
auguacuacaaguucagcggcuucacccagaagcuggccggcgccugggccagcgaggccuacagcccccagggccugaagcccguggugagcaccgaggccccccccaucaucuucgccacccccaccaagcugaccagcgacagcaccguguacgacuacgccggcaagaacaaggugcccgagcugcagaaguucuuccagaaggccgacggcgugcccguguaccugaagagaggccugcccgaccagaugcuguacagaaccaccauggcccugaccgugggcggcaccaucuacugccugaucgcccuguacauggccagccagcccaagaacaaguga

SEQ ID NO: 7287 - RNA, 345 nt, Artificial Sequence
  derived and/or modified sequence opt5 from Cytochrome_c__Homo_sapiens__AAY15087
auguacuauaaguucagcggcuuuacccagaaacuggccggggcuugggccuccgaggcguacucuccccaaggacucaagccuguggucagcacagaagcuccgcccaucauuuucgccacgccuaccaaacugacauccgacucuaccguuuaugauuacgccggcaagaacaaagugcccgagcuucagaaguuuuuccagaaggcugacggggugccugucuaucugaaaagaggacuccccgaucagaugcuguaccggacaaccauggcccuuacagugggcgggaccaucuauugccugauugcucucuacauggccagccaaccuaagaauaaauga

SEQ ID NO: 7288 - RNA, 345 nt, Artificial Sequence
  derived and/or modified sequence opt6 from Cytochrome_c__Homo_sapiens__AAY15087
auguacuacaaauucucaggauucacacaaaaacuagcaggagcaugggcaucagaagcauacucaccacaaggacuaaaaccaguaguaucaacagaagcaccaccaauaauauucgcaacaccaacaaaacuaacaucagacucaacaguauacgacuacgcaggaaaaaacaaaguaccagaacuacaaaaauucuuccaaaaagcagacggaguaccaguauacuuaaaaagaggacuaccagaccaaaugcuauacagaacaacaauggcacuaacaguaggaggaacaauauacugccuaauagcacuauacauggcaucacaaccaaaaaacaaauaa

SEQ ID NO: 7289 - protein, 79 aa, Artificial Sequence
  Cytochrome_c__Homo_sapiens__Q6FGI7
MQALRVSQALIRSFSSTARNRFQNRVREKQKLFQEDNDIPLYLKGGIVDNILYRVTMTLCLGGTVYSLYSLGWASFPRN

SEQ ID NO: 7290 - RNA, 240 nt, Artificial Sequence
  Cytochrome_c__Homo_sapiens__AAP35570
augcaggcccuucgggugucccaggcgcugauccgcuccuucagcuccaccgcccggaaccgcuuucagaaccgagugcgcgagaaacagaagcucuuccaggaggacaaugacaucccguuguaccugaagggcggcaucguugacaacauccuguaccgagugacaaugacgcugugucugggcggcacugucuacagcuuguacucccuuggcugggccuccuuccccaggaauuag

SEQ ID NO: 7291 - RNA, 240 nt, Artificial Sequence
  derived and/or modified sequence opt1 from Cytochrome_c__Homo_sapiens__AAP35570
augcaggcccugcgcgugagccaggcccucauccgguccuucagcuccaccgcgcgcaaccgguuccagaaccgcguccgggagaagcagaagcuguuccaggaggacaacgacaucccccuguaccucaagggcgggaucguggacaacauccuguaccgcgugaccaugacgcugugccucggcgggaccgucuacagccuguacucccugggcugggccagcuucccgcggaacuga

SEQ ID NO: 7292 - RNA, 240 nt, Artificial Sequence
  derived and/or modified sequence opt2 from Cytochrome_c__Homo_sapiens__AAP35570
augcaggcccuccgcgucucccaggcccucauccgcuccuucuccuccaccgcccgcaaccgcuuccagaaccgcguccgcgagaagcagaagcucuuccaggaggacaacgacaucccccucuaccucaagggcggcaucgucgacaacauccucuaccgcgucaccaugacccucugccucggcggcaccgucuacucccucuacucccucggcugggccuccuucccccgcaacuga

SEQ ID NO: 7293 - RNA, 240 nt, Artificial Sequence
  derived and/or modified sequence opt3 from Cytochrome_c__Homo_sapiens__AAP35570
augcaggcccugagagugagccaagcucucaucagguccuucucuucaaccgcacggaaccgcuuucagaaucgaguccgugagaagcagaaacuuuuccaggaagacaacgauauuccccuguacuugaagggcgggauaguugacaauaucuuauauagagugacaaugacucugugccuaggagguacgguauacagucucuauagccugggcugggccuccuuuccuaggaacuga

SEQ ID NO: 7294 - RNA, 240 nt, Artificial Sequence
  derived and/or modified sequence opt4 from Cytochrome_c__Homo_sapiens__AAP35570
augcaggcccugagagugagccaggcccugaucagaagcuucagcagcaccgccagaaacagauuccagaacagagugagagagaagcagaagcuguuccaggaggacaacgacaucccccuguaccugaagggcggcaucguggacaacauccuguacagagugaccaugacccugugccugggcggcaccguguacagccuguacagccugggcugggccagcuuccccagaaacuga

SEQ ID NO: 7295 - RNA, 240 nt, Artificial Sequence
  derived and/or modified sequence opt5 from Cytochrome_c__Homo_sapiens__AAP35570
augcaggcccugagagugagccaagcucucauccgguccuucucuagcaccgcccgcaacagauuucagaaucggguccgcgagaagcagaaacuguuccaggaagacaacgauauuccccuuuaccugaagggcgggaucguugacaauauucucuauagagugacaaugacgcugugccuuggaggcaccguguacucccuguauucucucgggugggcgagcuuuccucggaacuga

SEQ ID NO: 7296 - RNA, 240 nt, Artificial Sequence
  derived and/or modified sequence opt6 from Cytochrome_c__Homo_sapiens__AAP35570
augcaagcacuaagaguaucacaagcacuaauaagaucauucucaucaacagcaagaaacagauuccaaaacagaguaagagaaaaacaaaaacuauuccaagaagacaacgacauaccacuauaccuaaaaggaggaauaguagacaacauacuauacagaguaacaaugacacuaugccuaggaggaacaguauacucacuauacucacuaggaugggcaucauucccaagaaacuaa

SEQ ID NO: 7297 - protein, 63 aa, Artificial Sequence
  Cytochrome_c__Homo_sapiens__Q71U45
MLGQSIRRFTTSVVRRSHYEEGPGKNLPFSVENKWRLLAMMTVYFGSGFAAPFFIVRHQLLKK

SEQ ID NO: 7298 - RNA, 192 nt, Artificial Sequence
  Cytochrome_c__Homo_sapiens__AAP97260
auguugggccagaguauccggagguucacgaccuccgugguccgucgcagccacuaugaggaggguccggggaagaauuugccauuuucaguggaaaacaaguggcgguugcuggcuaugaugaccguguacuuuggaucuggguuugccgcaccuuucuuuauaguaagacaccagcuacuuaaaaaauaa

SEQ ID NO: 7299 - RNA, 192 nt, Artificial Sequence
  derived and/or modified sequence opt1 from Cytochrome_c__Homo_sapiens__AAP97260
augcugggccagagcauccgccgguucaccaccuccgugguccgccggagccacuacgaggaggggcccggcaagaaccucccguucuccguggagaacaaguggcgccugcuggccaugaugacgguguacuucgggagcggcuucgccgcgcccuucuucaucguccggcaccagcuccugaagaaguga

SEQ ID NO: 7300 - RNA, 192 nt, Artificial Sequence
  derived and/or modified sequence opt2 from Cytochrome_c__Homo_sapiens__AAP97260
augcucggccaguccauccgccgcuucaccaccuccgucguccgccgcucccacuacgaggagggccccggcaagaaccuccccuucuccgucgagaacaaguggcgccuccucgccaugaugaccgucuacuucggcuccggcuucgccgcccccuucuucaucguccgccaccagcuccucaagaaguga

SEQ ID NO: 7301 - RNA, 192 nt, Artificial Sequence
  derived and/or modified sequence opt3 from Cytochrome_c__Homo_sapiens__AAP97260
augcugggccagagcaucagaagguucaccacauccgugguccggcgcucucacuacgaggaagggcccggaaagaaccucccuuuuucaguugagaauaaauggcgacuucuggccaugaugacuguguauuucgguaguggcuuugcugcaccauucuuuauuguacgucaucaauuguuaaagaaauga

SEQ ID NO: 7302 - RNA, 192 nt, Artificial Sequence
  derived and/or modified sequence opt4 from Cytochrome_c__Homo_sapiens__AAP97260
augcugggccagagcaucagaagauucaccaccagcguggugagaagaagccacuacgaggagggccccggcaagaaccugcccuucagcguggagaacaaguggagacugcuggccaugaugaccguguacuucggcagcggcuucgccgcccccuucuucaucgugagacaccagcugcugaagaaguga

SEQ ID NO: 7303 - RNA, 192 nt, Artificial Sequence
  derived and/or modified sequence opt5 from Cytochrome_c__Homo_sapiens__AAP97260
augcugggccagagcaucagacgguucaccacauccgugguccgcagaucucacuacgaggaagggcccggaaagaaccucccuuuuagcguugagaauaaauggcggcugcuugccaugaugacgguguauuucggcuccggguuugcugccccguucuuuauugugcgccaucaacugcucaagaaauga

SEQ ID NO: 7304 - RNA, 192 nt, Artificial Sequence
  derived and/or modified sequence opt6 from Cytochrome_c__Homo_sapiens__AAP97260
augcuaggacaaucaauaagaagauucacaacaucaguaguaagaagaucacacuacgaagaaggaccaggaaaaaaccuaccauucucaguagaaaacaaauggagacuacuagcaaugaugacaguauacuucggaucaggauucgcagcaccauucuucauaguaagacaccaacuacuaaaaaaauaa

SEQ ID NO: 7305 - protein, 83 aa, Artificial Sequence
  Cytochrome_c__Homo_sapiens__Q86WV2
MLATRVFSLVGKRAISTSVCVRAHESVVKSEDFSLPAYMDRRDHPLPEVAHVKHLSASQKALKEKEKASWSSLSMDEKVECGY

SEQ ID NO: 7306 - RNA, 252 nt, Artificial Sequence
  Cytochrome_c__Homo_sapiens__AAH47869
auguuggcuaccaggguauuuagccuaguuggcaagcgagcaauuuccaccucuguguguguacgagcucaugaaaguguugugaagagcgaagacuuuucgcucccagcuuauauggaucggcgugaccaccccuugccggagguggcccaugucaagcaccugucugccagccagaaggcacugaaggagaaggagaaggccuccuggagcagccucuccauggaugagaaagucgaguguggguauuga

SEQ ID NO: 7307 - RNA, 252 nt, Artificial Sequence
  derived and/or modified sequence opt1 from Cytochrome_c__Homo_sapiens__AAH47869
augcuggccacccgcguguucagccucgucggcaagcgggccaucuccaccagcgugugcgugcgcgcgcacgaguccgucgucaagagcgaggacuucucccugcccgccuacauggaccggcgcgaccacccgcugcccgagguggcccacgugaagcaccucagcgccucccagaaggcccugaaggagaaggagaaggcgagcugguccagccuguccauggacgagaagguggagugcggguacuga

SEQ ID NO: 7308 - RNA, 252 nt, Artificial Sequence
  derived and/or modified sequence opt2 from Cytochrome_c__Homo_sapiens__AAH47869
augcucgccacccgcgucuucucccucgucggcaagcgcgccaucuccaccuccgucugcguccgcgcccacgaguccgucgucaaguccgaggacuucucccuccccgccuacauggaccgccgcgaccacccccuccccgaggucgcccacgucaagcaccucuccgccucccagaaggcccucaaggagaaggagaaggccuccugguccucccucuccauggacgagaaggucgagugcggcuacuga

SEQ ID NO: 7309 - RNA, 252 nt, Artificial Sequence
  derived and/or modified sequence opt3 from Cytochrome_c__Homo_sapiens__AAH47869
augcuggccaccagaguguucagccucgucggcaagagggcuaucuccacaucuguuugcgugcgggcacacgagucaguagugaaaagugaagacuuuagccuucccgccuacauggaucgccgagaccauccucugccagaggucgcgcacgugaagcauuuguccgcuucucagaaagccuuaaaggaaaaagagaaggcaucguggucaagccugaguauggaugaaaagguugaguguggguauuga

SEQ ID NO: 7310 - RNA, 252 nt, Artificial Sequence
  derived and/or modified sequence opt4 from Cytochrome_c__Homo_sapiens__AAH47869
augcuggccaccagaguguucagccuggugggcaagagagccaucagcaccagcgugugcgugagagcccacgagagcguggugaagagcgaggacuucagccugcccgccuacauggacagaagagaccacccccugcccgagguggcccacgugaagcaccugagcgccagccagaaggcccugaaggagaaggagaaggccagcuggagcagccugagcauggacgagaagguggagugcggcuacuga

SEQ ID NO: 7311 - RNA, 252 nt, Artificial Sequence
  derived and/or modified sequence opt5 from Cytochrome_c__Homo_sapiens__AAH47869
augcuggccaccagaguguucagccucgucggcaagcgggcuaucuccacaucuguuugcgugcgcgcccacgagagcguggucaaauccgaagacuuuucucugcccgcguacauggauagacgggaccauccucuuccggagguggcucacguuaagcaucugagcgccucccagaaagcccucaaggaaaaagagaaggcuucuuggagcucccugagcauggaugaaaagguggaguguggguauuga

SEQ ID NO: 7312 - RNA, 252 nt, Artificial Sequence
  derived and/or modified sequence opt6 from Cytochrome_c__Homo_sapiens__AAH47869
augcuagcaacaagaguauuuagccuaguaggaaaaagagcaauaagcacaagcguaugcguaagagcacacgaaagcguaguaaaaagcgaagacuuuagcuuaccagcauacauggacagaagagaucacccacuaccagaaguagcacauguaaaacacuuaagcgcaagccaaaaagcacuaaaagaaaaagaaaaagcaucauggucaagcuuaagcauggacgaaaaaguagaauguggauauuaa

SEQ ID NO: 7313 - protein, 86 aa, Artificial Sequence
  Cytochrome_c__Homo_sapiens__Q9UEG9
MSSGAHGEEGSARMWKTLTFFVALPGVAVSMLNVYLKSHHGEHERPEFIAYPHLRIRTKPFPWGDGNHTLFHNPHVNPLPTGYEDE

SEQ ID NO: 7314 - RNA, 261 nt, Artificial Sequence
  Cytochrome_c__Homo_sapiens__AAD00554
augucgaguggcgcccauggcgaagagggcucagcucgcauguggaagacucucaccuucuucgucgcgcuccccgggguggcagucagcaugcugaauguguaccugaagucgcaccacggagagcacgagagacccgaguucaucgccuacccccaucuccgcaucaggaccaagccguuucccuggggagaugguaaccauacucuauuccauaacccucaugugaauccacuuccaacuggcuacgaagaugaauaa

SEQ ID NO: 7315 - RNA, 261 nt, Artificial Sequence
  derived and/or modified sequence opt1 from Cytochrome_c__Homo_sapiens__AAD00554
augagcagcggcgcccacggggaggagggcagcgcccgcauguggaagacccugaccuucuucguggcgcuccccggggucgccguguccaugcugaacguguaccugaagucccaccacggcgagcacgagcggccggaguucaucgccuacccccaccuccgcauccggacgaagcccuuccccuggggcgacgggaaccacacccuguuccacaacccgcacgucaacccccugcccaccggcuacgaggacgaguga

SEQ ID NO: 7316 - RNA, 261 nt, Artificial Sequence
  derived and/or modified sequence opt2 from Cytochrome_c__Homo_sapiens__AAD00554
auguccuccggcgcccacggcgaggagggcuccgcccgcauguggaagacccucaccuucuucgucgcccuccccggcgucgccgucuccaugcucaacgucuaccucaagucccaccacggcgagcacgagcgccccgaguucaucgccuacccccaccuccgcauccgcaccaagcccuuccccuggggcgacggcaaccacacccucuuccacaacccccacgucaacccccuccccaccggcuacgaggacgaguga

SEQ ID NO: 7317 - RNA, 261 nt, Artificial Sequence
  derived and/or modified sequence opt3 from Cytochrome_c__Homo_sapiens__AAD00554
augagcuccggcgcccacggggaggaaggaucugcuagaauguggaagacccugacauucuuuguggcacuccccggugucgccguuucaaugcuuaacguguaccugaaaagucaucacggcgagcaugaaaggccugaguucaucgcguauccacacuugcggauucgcacuaagccguuucccuggggagacgggaaucauacguuauuccacaacccucacguaaauccacugcccaccggcuacgaagaugaguga

SEQ ID NO: 7318 - RNA, 261 nt, Artificial Sequence
  derived and/or modified sequence opt4 from Cytochrome_c__Homo_sapiens__AAD00554
augagcagcggcgcccacggcgaggagggcagcgccagaauguggaagacccugaccuucuucguggcccugcccggcguggccgugagcaugcugaacguguaccugaagagccaccacggcgagcacgagagacccgaguucaucgccuacccccaccugagaaucagaaccaagcccuuccccuggggcgacggcaaccacacccuguuccacaacccccacgugaacccccugcccaccggcuacgaggacgaguga

SEQ ID NO: 7319 - RNA, 261 nt, Artificial Sequence
  derived and/or modified sequence opt5 from Cytochrome_c__Homo_sapiens__AAD00554
augagcuccggcgcccacggggaggaaggaucugcuagaauguggaagacccugacauucuuuguggcccuccccggcgucgcgguuagcaugcugaacguguaccuuaaaucccaucacggggagcaugaacggccugaguucaucgcuuauccgcaucugcgcauuagaacgaagcccuuuccuuggggagacggcaaucacacccucuuccacaacccccacgugaauccucugcccacaggguacgaagaugaguga

SEQ ID NO: 7320 - RNA, 261 nt, Artificial Sequence
  derived and/or modified sequence opt6 from Cytochrome_c__Homo_sapiens__AAD00554
augucaucaggagcacacggagaagaaggaucagcaagaauguggaaaacacuaacauucuucguagcacuaccaggaguagcaguaucaaugcuaaacguauaccuaaaaucacaccacggagaacacgaaagaccagaauucauagcauacccacaccuaagaauaagaacaaaaccauucccauggggagacggaaaccacacacuauuccacaacccacacguaaacccacuaccaacaggauacgaagacgaauaa

SEQ ID NO: 7321 - protein, 281 aa, Artificial Sequence
  FasL__Homo_sapiens__P48023
MQQPFNYPYPQIYWVDSSASSPWAPPGTVLPCPTSVPRRPGQRRPPPPPPPPPLPPPPPPPPLPPLPLPPLKKRGNHSTGLCLLVMFFMVLVALVGLGLGMFQLFHLQKELAELRESTSQMHTASSLEKQIGHPSPPPEKKELRKVAHLTGKSNSRSMPLEWEDTYGIVLLSGVKYKKGGLVINETGLYFVYSKVYFRGQSCNNLPLSHKVYMRNSKYPQDLVMMEGKMMSYCTTGQMWARSSYLGAVFNLTSADHLYVNVSELSLVNFEESQTFFGLYKL

SEQ ID NO: 7322 - RNA, 846 nt, Artificial Sequence
  FasL__Homo_sapiens__AAC50071
augcagcagcccuucaauuacccauauccccagaucuacuggguggacagcagugccagcucucccugggccccuccaggcacaguucuucccuguccaaccucugugcccagaaggccuggucaaaggaggccaccaccaccaccgccaccgccaccacuaccaccuccgccgccgccgccaccacugccuccacuaccgcugccaccccugaagaagagagggaaccacagcacaggccugugucuccuugugauguuuuucaugguucugguugccuugguaggauugggccuggggauguuucagcucuuccaccuacagaaggagcuggcagaacuccgagagucuaccagccagaugcacacagcaucaucuuuggagaagcaaauaggccaccccaguccacccccugaaaaaaaggagcugaggaaaguggcccauuuaacaggcaaguccaacucaagguccaugccucuggaaugggaagacaccuauggaauuguccugcuuucuggagugaaguauaagaaggguggccuugugaucaaugaaacugggcuguacuuuguauauuccaaaguauacuuccggggucaaucuugcaacaaccugccccugagccacaaggucuacaugaggaacucuaaguauccccaggaucuggugaugauggaggggaagaugaugagcuacugcacuacugggcagaugugggcccgcagcagcuaccugggggcaguguucaaucuuaccagugcugaucauuuauaugucaacguaucugagcucucucuggucaauuuugaggaaucucagacguuuuucggcuuauauaagcucuaa

SEQ ID NO: 7323 - RNA, 846 nt, Artificial Sequence
  derived and/or modified sequence opt1 from FasL__Homo_sapiens__AAC50071
augcagcagcccuucaacuacccguacccccagaucuacuggguggacagcuccgccagcucccccugggcccccccgggcaccguccugcccugccccaccagcgugccccgccggccggggcagcgccggcccccccccccgcccccccccccgccccucccccccccgcccccccccccgccccugcccccccugccgcuccccccccugaagaagcgcggcaaccacuccacggggcugugccuccuggugauguucuucaugguccugguggcgcucgugggccuggggcugggcauguuccagcucuuccaccugcagaaggagcuggccgagcuccgggagagcaccucccagaugcacaccgccagcucccuggagaagcagaucggccacccgagccccccccccgagaagaaggagcugcgcaaggucgcccaccucaccgggaaguccaacagccgguccaugccgcuggagugggaggacacguacggcaucgugcugcucagcggggugaaguacaagaagggcgggcuggucaucaacgagaccggccuguacuucguguacuccaagguguacuuccgcggccagagcugcaacaaccucccccugucccacaaggucuacaugcggaacagcaaguacccccaggaccuggugaugauggaggggaagaugauguccuacugcaccaccggccagaugugggcccgcagcagcuaccucggggcgguguucaaccugacguccgccgaccaccuguacgucaacgugagcgagcucucccuggugaacuucgaggagagccagaccuucuucggccuguacaagcucuga

SEQ ID NO: 7324 - RNA, 846 nt, Artificial Sequence
  derived and/or modified sequence opt2 from FasL__Homo_sapiens__AAC50071
augcagcagcccuucaacuaccccuacccccagaucuacugggucgacuccuccgccuccucccccugggccccccccggcaccguccuccccugccccaccuccgucccccgccgccccggccagcgccgcccccccccccccccccccccccccccccuccccccccccccccccccccccccccuccccccccucccccuccccccccucaagaagcgcggcaaccacuccaccggccucugccuccucgucauguucuucaugguccucgucgcccucgucggccucggccucggcauguuccagcucuuccaccuccagaaggagcucgccgagcuccgcgaguccaccucccagaugcacaccgccuccucccucgagaagcagaucggccaccccucccccccccccgagaagaaggagcuccgcaaggucgcccaccucaccggcaaguccaacucccgcuccaugccccucgagugggaggacaccuacggcaucguccuccucuccggcgucaaguacaagaagggcggccucgucaucaacgagaccggccucuacuucgucuacuccaaggucuacuuccgcggccaguccugcaacaaccucccccucucccacaaggucuacaugcgcaacuccaaguacccccaggaccucgucaugauggagggcaagaugauguccuacugcaccaccggccagaugugggcccgcuccuccuaccucggcgccgucuucaaccucaccuccgccgaccaccucuacgucaacgucuccgagcucucccucgucaacuucgaggagucccagaccuucuucggccucuacaagcucuga

SEQ ID NO: 7325 - RNA, 846 nt, Artificial Sequence
  derived and/or modified sequence opt3 from FasL__Homo_sapiens__AAC50071
augcagcaacccuucaacuacccuuauccacagaucuacuggguggacagcuccgccucuucaccgugggcucccccuggcaccguccugccaugccccacaaguguuccuagaaggccagggcagcggcgacccccuccaccgcccccuccacccccucucccacccccgccucccccaccuccccuuccaccccugccuuugccaccguuaaagaaacgcggaaaucacagcacuggucugugucuacucgugauguuuuucaugguacugguggcacuugucggccugggguugggaauguuucaacucuuccaucugcagaaggagcuggccgaacuccgugaguccacgucucagaugcacaccgcgucgucauuagaaaaacagauuggccaucccagcccuccacccgagaagaaagaacugagaaagguggcucaccuuacagguaagaguaacuccaggucuaugccuuuggagugggaggauacuuaugggauaguucugcuaagcggagugaaauacaagaaaggcggccucgucaucaaugaaaccgggcuguauuuuguguacuccaagguauauuuccggggacagucaugcaacaaucuuccacugagucauaaaguuuacaugcgcaacagcaaguacccccaagacuuggugaugauggaggguaagaugaugucuuauuguacaaccggccagaugugggccagauccucauaccucggggcagucuuuaaucugacuagcgccgaucacuuauaugugaacgugagugaacugucucucgucaauuucgaggagucccagacauuuuucggacuuuacaaacuguga

SEQ ID NO: 7326 - RNA, 846 nt, Artificial Sequence
  derived and/or modified sequence opt4 from FasL__Homo_sapiens__AAC50071
augcagcagcccuucaacuaccccuacccccagaucuacuggguggacagcagcgccagcagccccugggccccccccggcaccgugcugcccugccccaccagcgugcccagaagacccggccagagaagaccccccccccccccccccccccccccccugcccccccccccccccccccccccccugcccccccugccccugcccccccugaagaagagaggcaaccacagcaccggccugugccugcuggugauguucuucauggugcugguggcccuggugggccugggccugggcauguuccagcuguuccaccugcagaaggagcuggccgagcugagagagagcaccagccagaugcacaccgccagcagccuggagaagcagaucggccaccccagccccccccccgagaagaaggagcugagaaagguggcccaccugaccggcaagagcaacagcagaagcaugccccuggagugggaggacaccuacggcaucgugcugcugagcggcgugaaguacaagaagggcggccuggugaucaacgagaccggccuguacuucguguacagcaagguguacuucagaggccagagcugcaacaaccugccccugagccacaagguguacaugagaaacagcaaguacccccaggaccuggugaugauggagggcaagaugaugagcuacugcaccaccggccagaugugggccagaagcagcuaccugggcgccguguucaaccugaccagcgccgaccaccuguacgugaacgugagcgagcugagccuggugaacuucgaggagagccagaccuucuucggccuguacaagcuguga

SEQ ID NO: 7327 - RNA, 846 nt, Artificial Sequence
  derived and/or modified sequence opt5 from FasL__Homo_sapiens__AAC50071
augcagcaacccuucaacuacccuuauccgcagaucuacuggguggacagcuccgccucuagccccugggcuccucccggcaccguccugccuugccccacauccguuccuagacggccggggcagcgcagacccccucccccucccccgccucccccucugcccccucccccgcccccucccccucugcccccgcuuccucugcccccucucaagaaacggggaaaucacucuacgggccugugucuucuggugauguuuuucauggugcucgucgcccugguggggcucggacucggcauguuucagcuguuccaucuucaaaaggagcuggcggaacuccgcgagagcaccucccagaugcacacagcuucuagccuggaaaaacagauugggcaucccuccccucccccggagaagaaagaacuuagaaagguugcccaccugaccggaaagagcaacucucgguccaugccucucgagugggaggauacauauggcaucgugcugcugagcggcgucaaauacaagaaagggggacucgugauuaaugaaaccggccuguauuuuguuuacucuaagguguauuuccgcgggcaguccugcaacaaucuuccccugagccauaaagucuacaugagaaacucuaaguacccccaagaccucgugaugauggagggaaagaugauguccuauuguacaaccggccagaugugggcccggagcuccuaccugggggcuguguuuaaucuuacgucugccgaucaccuguaugucaacguuagcgaacucucccuggugaauuucgaggagagccagaccuuuuucggacuguacaaacucuga

SEQ ID NO: 7328 - RNA, 846 nt, Artificial Sequence
  derived and/or modified sequence opt6 from FasL__Homo_sapiens__AAC50071
augcaacaaccauucaacuacccauauccacaaauauacuggguagacucuucagcaucaucaccaugggcaccaccaggaacaguacucccuugcccaacaucuguaccaagaagaccaggacaaagaagacccccacccccaccaccaccaccaccucuuccaccccccccaccaccaccacccuuaccaccacuaccccuaccaccauuaaaaaaaagagguaaccacuccacaggccuaugcuuacuaguaauguucuucaugguacuagucgcccuuguaggacuaggacucggaauguuucaauuauuccacuuacaaaaagaacuagcagaacuaagagaaucuacaucacaaaugcacaccgccucaucacuagaaaaacaaauuggacacccaucaccaccaccagaaaaaaaagaacucagaaaagucgcacacuuaacaggaaaaucaaacuccagaucaaugccacuagaaugggaagacacauacggaauaguacuacuuucaggaguaaaauacaaaaaaggaggacuaguaauaaacgaaacaggauuauacuucguauacucaaaaguauacuuucgaggacaaucaugcaacaaccuaccacuaucacacaaaguauacaugagaaacucaaaauacccacaagaccuaguaaugauggaaggaaaaaugaugucauauugcacaacaggacaaaugugggcaagaucaucuuaccuaggagcagucuucaacuuaacaucagcugaccaccuauacguaaacguauccgaacuaucauuaguaaacuucgaagaaucacaaacuuucuucggacucuacaaacuauaa

SEQ ID NO: 7329 - protein, 235 aa, Artificial Sequence
  Granzyme_B__Homo_sapiens__J3KQ52
MQTFPSGEIIGGHEAKPHSRPYMAYLMIWDQKSLKRCGGFLIRDDFVLTAAHCWGSSINVTLGAHNIKEQEPTQQFIPVKRPIPHPAYNPKNFSNDIMLLQLERKAKRTRAVQPLRLPSNKAQVKPGQTCSVAGWGQTAPLGKHSHTLQEVKMTVQEDRKCESDLRHYYDSTIELCVGDPEIKKTSFKGDSGGPLVCNKVAQGIVSYGRNNGMPPRACTKVSSFVHWIKKTMKRY

SEQ ID NO: 7330 - RNA, 708 nt, Artificial Sequence
  Granzyme_B__Homo_sapiens__EAW66003
augcagacuuuuccuucaggggagaucaucgggggacaugaggccaagccccacucccgccccuacauggcuuaucuuaugaucugggaucagaagucucugaagaggugcgguggcuuccugauacgagacgacuucgugcugacagcugcucacuguuggggaagcuccauaaaugucaccuugggggcccacaauaucaaagaacaggagccgacccagcaguuuaucccugugaaaagacccaucccccauccagccuauaauccuaagaacuucuccaacgacaucaugcuacugcagcuggagagaaaggccaagcggaccagagcugugcagccccucaggcuaccuagcaacaaggcccaggugaagccagggcagacaugcaguguggccggcugggggcagacggccccccugggaaaacacucacacacacuacaagaggugaagaugacagugcaggaagaucgaaagugcgaaucugacuuacgccauuauuacgacaguaccauugaguugugcgugggggacccagagauuaaaaagacuuccuuuaagggggacucuggaggcccucuuguguguaacaagguggcccagggcauugucuccuauggacgaaacaauggcaugccuccacgagccugcaccaaagucucaagcuuuguacacuggauaaagaaaaccaugaaacgcuacuaa

SEQ ID NO: 7331 - RNA, 708 nt, Artificial Sequence
  derived and/or modified sequence opt1 from Granzyme_B__Homo_sapiens__EAW66003
augcagaccuuccccagcggcgagaucaucgggggccacgaggccaagccccacucccgccccuacauggccuaccugaugaucugggaccagaagucccucaagcggugcgggggcuuccugauccgcgacgacuucgugcugaccgcggcccacugcugggggagcagcaucaacgucacgcucggcgcccacaacaucaaggagcaggagcccacccagcaguucauccccgugaagcggccgaucccccaccccgccuacaaccccaagaacuucuccaacgacaucaugcugcugcagcucgagcgcaaggccaagcggacccgcgcggugcagccgcugcggcugcccagcaacaaggcccaggucaagcccggccagaccugcuccguggccggguggggccagacggcgccccucgggaagcacagccacacccugcaggaggugaagaugaccguccaggaggaccgcaagugcgaguccgaccugcggcacuacuacgacagcaccaucgagcucugcgugggcgacccggagaucaagaagacguccuucaagggggacagcggcggcccccuggugugcaacaaggucgcccaggggaucguguccuacggccgcaacaacgggaugccgccccgggccugcaccaaggugagcuccuucguccacuggaucaagaagaccaugaagcgcuacuga

SEQ ID NO: 7332 - RNA, 708 nt, Artificial Sequence
  derived and/or modified sequence opt2 from Granzyme_B__Homo_sapiens__EAW66003
augcagaccuuccccuccggcgagaucaucggcggccacgaggccaagccccacucccgccccuacauggccuaccucaugaucugggaccagaagucccucaagcgcugcggcggcuuccucauccgcgacgacuucguccucaccgccgcccacugcuggggcuccuccaucaacgucacccucggcgcccacaacaucaaggagcaggagcccacccagcaguucauccccgucaagcgccccaucccccaccccgccuacaaccccaagaacuucuccaacgacaucaugcuccuccagcucgagcgcaaggccaagcgcacccgcgccguccagccccuccgccuccccuccaacaaggcccaggucaagcccggccagaccugcuccgucgccggcuggggccagaccgccccccucggcaagcacucccacacccuccaggaggucaagaugaccguccaggaggaccgcaagugcgaguccgaccuccgccacuacuacgacuccaccaucgagcucugcgucggcgaccccgagaucaagaagaccuccuucaagggcgacuccggcggcccccucgucugcaacaaggucgcccagggcaucgucuccuacggccgcaacaacggcaugcccccccgcgccugcaccaaggucuccuccuucguccacuggaucaagaagaccaugaagcgcuacuga

SEQ ID NO: 7333 - RNA, 708 nt, Artificial Sequence
  derived and/or modified sequence opt3 from Granzyme_B__Homo_sapiens__EAW66003
augcagaccuuccccagcggcgagaucauugggggacacgaagccaagccucauuccagaccauacauggcuuaucugaugauaugggaccaaaaaucucucaagaggugcgguggcuuucuuauccgggaugacuucgugcugacagcagcccacuguugggggucaaguauuaacgucacuuugggagcgcauaauaucaaagagcaggaaccgacgcagcaguuuauucccguuaagcgcccuaucccacaccccgcuuacaacccuaaaaauuucagcaacgauauaauguuacugcaacuagagcgaaaggccaagcguaccagagcagugcagccacucaggcugcccuccaauaaagcccagguaaagccuggccagacaugcucuguggcugguugggggcaaacugcaccacuuggaaaacauucgcacacccugcaggaagucaagaugacagugcaggaggaccggaaaugugagucagauuugcgccacuauuacgacagcaccaucgaacucugcguuggcgauccggagauuaagaagacaaguuuuaaaggcgacuccgggggaccccugguguguaacaaggucgcccaggguaucgugucuuauggcagaaauaacgggaugccuccaagggcuugcacuaaaguaagcuccuucguucauuggauuaagaaaaccaugaagcgguacuga

SEQ ID NO: 7334 - RNA, 708 nt, Artificial Sequence
  derived and/or modified sequence opt4 from Granzyme_B__Homo_sapiens__EAW66003
augcagaccuuccccagcggcgagaucaucggcggccacgaggccaagccccacagcagacccuacauggccuaccugaugaucugggaccagaagagccugaagagaugcggcggcuuccugaucagagacgacuucgugcugaccgccgcccacugcuggggcagcagcaucaacgugacccugggcgcccacaacaucaaggagcaggagcccacccagcaguucauccccgugaagagacccaucccccaccccgccuacaaccccaagaacuucagcaacgacaucaugcugcugcagcuggagagaaaggccaagagaaccagagccgugcagccccugagacugcccagcaacaaggcccaggugaagcccggccagaccugcagcguggccggcuggggccagaccgccccccugggcaagcacagccacacccugcaggaggugaagaugaccgugcaggaggacagaaagugcgagagcgaccugagacacuacuacgacagcaccaucgagcugugcgugggcgaccccgagaucaagaagaccagcuucaagggcgacagcggcggcccccuggugugcaacaagguggcccagggcaucgugagcuacggcagaaacaacggcaugccccccagagccugcaccaaggugagcagcuucgugcacuggaucaagaagaccaugaagagauacuga

SEQ ID NO: 7335 - RNA, 708 nt, Artificial Sequence
  derived and/or modified sequence opt5 from Granzyme_B__Homo_sapiens__EAW66003
augcagaccuuccccagcggcgagaucauugggggacacgaagccaagccucauuccagaccguacauggcuuaucugaugaucugggaccaaaaaucucucaagcggugcggcggguuucugauucgcgaugacuucgugcuuacagccgcgcacuguuggggaagcuccaucaacgucacgcugggcgcucauaauauuaaagagcaggaacccacccagcaguuuaucccuguuaagagacccaucccucaccccgccuacaacccuaaaaauuucucuaacgauauuaugcuccugcaacuugagcggaaggccaagcgcacaagagcugugcagccgcugcggcuccccagcaauaaagcccaggugaagccugggcagaccugcuccgucgcuggauggggccaaacagcgccccugggcaaacauucucacacccugcaggaagugaagaugacaguucaggaggaccgcaaaugugagagcgaucucagacacuauuacgacuccaccaucgaacugugcgugggggauccugagauuaagaagacgagcuuuaaaggagacucuggcgggccccuugucuguaacaagguggcccagggaaucguuuccuauggccggaauaacgggaugccgccucgcgccugcaccaaagugagcucuuucguccauuggauuaagaaaacaaugaagagauacuga

SEQ ID NO: 7336 - RNA, 708 nt, Artificial Sequence
  derived and/or modified sequence opt6 from Granzyme_B__Homo_sapiens__EAW66003
augcaaacauucccaaguggagaaauaauaggaggacacgaagcaaaaccacacucacgaccauacauggcauaccuaaugaucugggaccaaaaaucacuaaaacgcugcggaggauuccuaauaagagacgacuucguacuaacagcagcacacugcuggggaucaucaauaaacgucacauuaggcgcccacaacauaaaagaacaagaaccaacacaacaauucauaccaguaaaaagaccaauaccacacccagcauacaacccaaaaaacuucagcaacgacaucauguuacuacaacuagaaagaaaagcaaaaagaacaagagcaguacaaccacuaagacuaccaucaaacaaagcacaaguaaaaccaggacaaacauguucaguagcaggauggggacaaacagcaccauuaggaaaacacucacacacacuacaagaaguaaaaaugacaguacaagaagacagaaaaugcgaaucagaucuaagacacuacuacgacucaacaauagaacuaugcguaggagacccagaaauaaaaaaaacaagcuucaaaggcgacucaggcggaccauuaguauguaacaaaguagcacaaggaauaguaagcuacggaagaaacaacggaaugccaccaagagcaugcacaaaaguaucaucauucguccacuggauaaaaaaaacaaugaaaagauacuaa

SEQ ID NO: 7337 - protein, 281 aa, Artificial Sequence
  Granzyme_B__Homo_sapiens__Q67BC3
MKSLSLLHLFPLPRAKREQGGNNSSSNQGSLPEKMQPILLLLAFLLLPRADAGEIIGGHEAKPHSRPYMAYLMIWDQKSLKRCGGFLIQDDFVLTAAHCWGSSINVTLGAHNIKEQEPTQQFIPVKRPIPHPAYNPKNFSNDIMLLQLERKAKRTRAVQPLRLPSNKAQVKPGQTCSVAGWGQTAPLGKHSHTLQEVKMTVQEDRKCESDLRHYYDSTIELCVGDPEIKKTSFKGDSGGPLVCNKVAQGIVSYGRNNGMPPRACTKVSSFVHWIKKTMKRY

SEQ ID NO: 7338 - RNA, 846 nt, Artificial Sequence
  Granzyme_B__Homo_sapiens__AAR23323
augaagucacugagccugcuccaccucuuuccucucccaagagcuaaaagagagcaaggaggaaacaacagcagcuccaaccagggcagccuuccugagaagaugcaaccaauccugcuucugcuggccuuccuccugcugcccagggcagaugcaggggagaucaucgggggacaugaggccaagccccacucccgccccuacauggcuuaucuuaugaucugggaucagaagucucugaagaggugcgguggcuuccugauacaagacgacuucgugcugacagcugcucacuguuggggaagcuccauaaaugucaccuugggggcccacaauaucaaagaacaggagccgacccagcaguuuaucccugugaaaagacccaucccccauccagccuauaauccuaagaacuucuccaacgacaucaugcuacugcagcuggagagaaaggccaagcggaccagagcugugcagccccucaggcuaccuagcaacaaggcccaggugaagccagggcagacaugcaguguggccggcugggggcagacggccccccugggaaaacacucacacacacuacaagaggugaagaugacagugcaggaagaucgaaagugcgaaucugacuuacgccauuauuacgacaguaccauugaguugugcgugggggacccagagauuaaaaagacuuccuuuaagggggacucuggaggcccucuuguguguaacaagguggcccagggcauugucuccuauggacgaaacaauggcaugccuccacgagccugcaccaaagucucaagcuuuguacacuggauaaagaaaaccaugaaacgcuacuaa

SEQ ID NO: 7339 - RNA, 846 nt, Artificial Sequence
  derived and/or modified sequence opt1 from Granzyme_B__Homo_sapiens__AAR23323
augaagucccugagccuccugcaccuguucccccucccccgcgccaagcgggagcagggcgggaacaacagcuccagcaaccagggcucccugcccgagaagaugcagcccauccugcuccugcuggccuuccuccugcugccccgcgcggacgccggggagaucaucggcgggcacgaggccaagccgcacagccggcccuacauggccuaccucaugaucugggaccagaagucccugaagcgcugcggcggcuuccugauccaggacgacuucgugcucaccgccgcgcacugcugggggagcuccaucaacgucacccugggcgcccacaacaucaaggagcaggagcccacgcagcaguucauccccgugaagcggccgaucccccaccccgccuacaaccccaagaacuucagcaacgacaucaugcugcuccagcuggagcgcaaggccaagcggacccgcgcggugcagccgcugcggcuccccuccaacaaggcccaggucaagcccgggcagaccugcagcguggccggcugggggcagaccgcgccccugggcaagcacucccacacgcugcaggaggugaagaugaccguccaggaggaccgcaagugcgagagcgaccuccggcacuacuacgacuccaccaucgagcugugcgugggcgacccggagaucaagaagaccagcuucaagggggacuccggcgggccccuggugugcaacaaggucgcccagggcaucgugagcuacggccgcaacaacgggaugccgccccgggccugcacgaagguguccagcuucguccacuggaucaagaagaccaugaagcgcuacuga

SEQ ID NO: 7340 - RNA, 846 nt, Artificial Sequence
  derived and/or modified sequence opt2 from Granzyme_B__Homo_sapiens__AAR23323
augaagucccucucccuccuccaccucuucccccucccccgcgccaagcgcgagcagggcggcaacaacuccuccuccaaccagggcucccuccccgagaagaugcagcccauccuccuccuccucgccuuccuccuccucccccgcgccgacgccggcgagaucaucggcggccacgaggccaagccccacucccgccccuacauggccuaccucaugaucugggaccagaagucccucaagcgcugcggcggcuuccucauccaggacgacuucguccucaccgccgcccacugcuggggcuccuccaucaacgucacccucggcgcccacaacaucaaggagcaggagcccacccagcaguucauccccgucaagcgccccaucccccaccccgccuacaaccccaagaacuucuccaacgacaucaugcuccuccagcucgagcgcaaggccaagcgcacccgcgccguccagccccuccgccuccccuccaacaaggcccaggucaagcccggccagaccugcuccgucgccggcuggggccagaccgccccccucggcaagcacucccacacccuccaggaggucaagaugaccguccaggaggaccgcaagugcgaguccgaccuccgccacuacuacgacuccaccaucgagcucugcgucggcgaccccgagaucaagaagaccuccuucaagggcgacuccggcggcccccucgucugcaacaaggucgcccagggcaucgucuccuacggccgcaacaacggcaugcccccccgcgccugcaccaaggucuccuccuucguccacuggaucaagaagaccaugaagcgcuacuga

SEQ ID NO: 7341 - RNA, 846 nt, Artificial Sequence
  derived and/or modified sequence opt3 from Granzyme_B__Homo_sapiens__AAR23323
augaaaagccugucccuccuucaccuguuccccuugccuagagccaaaagggagcagggcgggaacaauucuucaaguaaccaagguagcuuaccagaaaagaugcagccgauccugcuacuccuggcuuuucuucuguugccccgggcagacgccggagagauuauaggcgggcaugaagcgaaaccucacucccgcccauacauggcuuaucucaugaucugggaucagaagucucugaaacgaugcggaggcuuccugauucaggacgauuuugugcucaccgccgcacauuguugggguucgucaaucaaugucacauuaggggcccacaacauuaaggagcaagaacccacucagcaguucaucccuguuaagcguccaauaccccauccugcuuacaauccaaagaacuuuagcaaugacaucaugcugcuucaguuggagagaaaggcaaaaaggacgcgggccgugcaaccgcugcgccuacccaguaacaaggcucagguaaaaccuggacagaccugcuccguggccggcuggggccagacagcgccacucgggaagcacucucacacucugcaagaggucaagaugaccgugcaggaagauagaaaaugugagagcgaccuuaggcauuauuacgauuccacaauugaacugugcguuggagaccccgagaucaagaaaaccucauucaagggugauaguggcgggccuuugguguguaauaaagucgcacagggaauugugagcuauggccggaacaaugguaugccaccccgcgccugcacuaagguaucuuccuuuguucacuggaucaaaaagacaaugaagcgauacuga

SEQ ID NO: 7342 - RNA, 846 nt, Artificial Sequence
  derived and/or modified sequence opt4 from Granzyme_B__Homo_sapiens__AAR23323
augaagagccugagccugcugcaccuguucccccugcccagagccaagagagagcagggcggcaacaacagcagcagcaaccagggcagccugcccgagaagaugcagcccauccugcugcugcuggccuuccugcugcugcccagagccgacgccggcgagaucaucggcggccacgaggccaagccccacagcagacccuacauggccuaccugaugaucugggaccagaagagccugaagagaugcggcggcuuccugauccaggacgacuucgugcugaccgccgcccacugcuggggcagcagcaucaacgugacccugggcgcccacaacaucaaggagcaggagcccacccagcaguucauccccgugaagagacccaucccccaccccgccuacaaccccaagaacuucagcaacgacaucaugcugcugcagcuggagagaaaggccaagagaaccagagccgugcagccccugagacugcccagcaacaaggcccaggugaagcccggccagaccugcagcguggccggcuggggccagaccgccccccugggcaagcacagccacacccugcaggaggugaagaugaccgugcaggaggacagaaagugcgagagcgaccugagacacuacuacgacagcaccaucgagcugugcgugggcgaccccgagaucaagaagaccagcuucaagggcgacagcggcggcccccuggugugcaacaagguggcccagggcaucgugagcuacggcagaaacaacggcaugccccccagagccugcaccaaggugagcagcuucgugcacuggaucaagaagaccaugaagagauacuga

SEQ ID NO: 7343 - RNA, 846 nt, Artificial Sequence
  derived and/or modified sequence opt5 from Granzyme_B__Homo_sapiens__AAR23323
augaaaagccugucccuccugcaccuuuucccccugcccagagccaagcgggagcagggcgggaacaauucuagcuccaaccaaggaucucucccggaaaagaugcagcccauccugcuucugcucgcuuuucugcugcucccucgcgccgacgcgggcgagauuaucgggggacaugaagcuaaaccccacagcagaccuuacauggccuaucugaugauuugggaucagaagucccuuaaacggugcggcggguuccugauccaggacgauuuugugcucaccgccgcucauuguuggggaucuagcauuaaugucacacugggcgcccacaacaucaaggagcaagaacccacgcagcaguucaucccuguuaagcgcccgauuccccauccugcuuacaaucccaaaaacuuuuccaaugacaucaugcuucugcagcucgagagaaaggccaaacggacccgcgcggugcaaccucugagacugcccagcaacaaggcccaggugaaaccgggccagacaugcucugucgcuggguggggacagaccgccccucucggcaagcacucccacacacugcaagaggugaagaugaccguucaggaagaucggaaaugugagagcgaccuucgccauuauuacgauucuacaauugaacugugcgugggggaccccgagaucaagaaaaccuccuucaagggagauagcggcgggccucucgucuguaauaaaguggcucagggaauuguuucuuauggcagaaacaauggcaugccuccccgggccugcacgaagguguccagcuuuguccacuggaucaaaaagaccaugaagcgcuacuga

SEQ ID NO: 7344 - RNA, 846 nt, Artificial Sequence
  derived and/or modified sequence opt6 from Granzyme_B__Homo_sapiens__AAR23323
augaaaucacuaagccuacuccacuuauucccacuaccacgagcaaaaagagaacaaggaggaaacaacucaucuucuaaccaaggaucauuaccagaaaaaaugcaaccaauacuauuacuacucgcauucuuacuacuaccaagagcagacgccggagaaauaauaggaggacacgaagcaaaaccacacucaagaccauacauggcauacuuaaugauaugggaccaaaaaucacuaaaaagauguggugguuuucugauacaagacgacuucguacuaacagcagcacacugcugggguagcucaauaaacguaacacuaggagcacacaacauaaaagaacaagaaccaacacaacaauucauaccaguaaaaagaccaauaccacacccagcauauaacccaaaaaauuucucaaacgacauaauguuacuacaacuagaacgaaaagcaaaaagaacacgagcaguacaaccacuaagacuaccaucaaacaaagcacaaguaaaaccaggacaaacaugcucaguagcaggauggggacaaacugcaccacuaggaaaacacucacacacacuacaagaaguaaaaaugacaguacaagaagacagaaaaugcgaaucagaccuaagacacuauuacgacucaacaauagaacucugugucggagaccccgaaauaaaaaaaacaucauucaaaggagacucaggaggaccacuagucugcaacaaaguagcacaaggaauaguaaguuacggaagaaacaacggaaugccaccaagagcaugcacaaaaguaucaucauuuguacacuggauaaaaaaaacaaugaaaagauacuaa

SEQ ID NO: 7345 - protein, 152 aa, Artificial Sequence
  Granzyme_B__Homo_sapiens__Q6XGZ2
MQPILLLLAFLLLPRADQLERKAKRTRAVQPLRLPSNKAQVKPGQTCSVAGWGQTAPLGKHSHTLQEVKMTVQEDRKCESDLRHYYDSTIELCVGDPEIKKTSFKGDSGGPLVCNKVAQGIVSYGRNNGMPPRACTKVSSFVHWIKKTMKRY

SEQ ID NO: 7346 - RNA, 459 nt, Artificial Sequence
  Granzyme_B__Homo_sapiens__AAP70246
augcaaccaauccugcuucugcuggccuuccuccugcugcccagggcagaucagcuggagagaaaggccaagcggaccagagcugugcagccccucaggcuaccuagcaacaaggcccaggugaagccagggcagacaugcaguguggccggcugggggcagacggccccccugggaaaacacucacacacacuacaagaggugaagaugacagugcaggaagaucgaaagugcgaaucugacuuacgccauuauuacgacaguaccauugaguugugcgugggggacccagagauuaaaaagacuuccuuuaagggggacucuggaggcccucuuguguguaacaagguggcccagggcauugucuccuauggacgaaacaauggcaugccuccacgagccugcaccaaagucucaagcuuuguacacuggauaaagaaaaccaugaaacgcuacuaa

SEQ ID NO: 7347 - RNA, 459 nt, Artificial Sequence
  derived and/or modified sequence opt1 from Granzyme_B__Homo_sapiens__AAP70246
augcagcccauccugcuccugcuggccuuccuccugcugccgcgcgccgaccagcucgagcggaaggcgaagcgcacccgggccgugcagccccugcgccugcccagcaacaaggcccaggucaagcccggccagaccugcuccguggccggguggggccagacggccccgcucgggaagcacagccacacccugcaggaggugaagaugaccguccaggaggaccggaagugcgaguccgaccugcgccacuacuacgacagcaccaucgagcucugcgugggcgaccccgagaucaagaagacguccuucaagggggacagcggcggcccccuggugugcaacaaggucgcgcaggggaucguguccuacggccggaacaacgggaugcccccgcgcgccugcaccaaggugagcuccuucguccacuggaucaagaagaccaugaagcgguacuga

SEQ ID NO: 7348 - RNA, 459 nt, Artificial Sequence
  derived and/or modified sequence opt2 from Granzyme_B__Homo_sapiens__AAP70246
augcagcccauccuccuccuccucgccuuccuccuccucccccgcgccgaccagcucgagcgcaaggccaagcgcacccgcgccguccagccccuccgccuccccuccaacaaggcccaggucaagcccggccagaccugcuccgucgccggcuggggccagaccgccccccucggcaagcacucccacacccuccaggaggucaagaugaccguccaggaggaccgcaagugcgaguccgaccuccgccacuacuacgacuccaccaucgagcucugcgucggcgaccccgagaucaagaagaccuccuucaagggcgacuccggcggcccccucgucugcaacaaggucgcccagggcaucgucuccuacggccgcaacaacggcaugcccccccgcgccugcaccaaggucuccuccuucguccacuggaucaagaagaccaugaagcgcuacuga

SEQ ID NO: 7349 - RNA, 459 nt, Artificial Sequence
  derived and/or modified sequence opt3 from Granzyme_B__Homo_sapiens__AAP70246
augcagcccauccugcuccuucuggccuucuuguuacugccuagagcugaccaacuagagaggaaggcaaaacggacccgcgccgugcagccacuccgacugccgagcaacaaggcgcaggucaaacccggccagacaugcuccguugcuggguggggacaaacugccccucuugguaagcacucucauacgcugcaggaagugaaaaugaccguacaggaggaucguaagugugaaucagacuugagacacuacuaugauaguacaauugagcucugcgugggcgacccagaaauaaagaaaacuagcuuuaagggggauuccggaggcccccuggucuguaauaaaguggcacaggguaucguuucuuacgggaggaacaauggaaugccuccacgggccugcaccaaggugucgucauucguccauuggauuaaaaagacaaugaagcgcuauuga

SEQ ID NO: 7350 - RNA, 459 nt, Artificial Sequence
  derived and/or modified sequence opt4 from Granzyme_B__Homo_sapiens__AAP70246
augcagcccauccugcugcugcuggccuuccugcugcugcccagagccgaccagcuggagagaaaggccaagagaaccagagccgugcagccccugagacugcccagcaacaaggcccaggugaagcccggccagaccugcagcguggccggcuggggccagaccgccccccugggcaagcacagccacacccugcaggaggugaagaugaccgugcaggaggacagaaagugcgagagcgaccugagacacuacuacgacagcaccaucgagcugugcgugggcgaccccgagaucaagaagaccagcuucaagggcgacagcggcggcccccuggugugcaacaagguggcccagggcaucgugagcuacggcagaaacaacggcaugccccccagagccugcaccaaggugagcagcuucgugcacuggaucaagaagaccaugaagagauacuga

SEQ ID NO: 7351 - RNA, 459 nt, Artificial Sequence
  derived and/or modified sequence opt5 from Granzyme_B__Homo_sapiens__AAP70246
augcagcccauccugcuccugcuugccuuccugcuccugccuagagcugaccaacuugagcggaaggccaaacgcaccagagcggugcagccgcugcggcuccccagcaacaaggcucaggucaaaccuggccagacaugcuccguugccggguggggacaaacggcuccccugggcaagcacucucauacccugcaggaagugaaaaugacagugcaggaggaucgcaagugugaaagcgaccucagacacuacuaugauuccaccauugagcugugcgucggggacccugaaaucaagaaaacaucuuuuaagggagauagcggcgggccccuuguguguaauaaaguugcccagggaauuguguccuacggccggaacaauggcaugccuccgcgcgccugcaccaaggucucuagcuucgugcauuggaucaaaaagacaaugaagagauauuga

SEQ ID NO: 7352 - RNA, 459 nt, Artificial Sequence
  derived and/or modified sequence opt6 from Granzyme_B__Homo_sapiens__AAP70246
augcaaccaauacuacuacuacuagcauuccuacuauuaccaagagcagaccaacuagaacgaaaagcaaaaagaacaagagcaguacaaccacuaagacuaccaucaaacaaagcacaaguaaaaccaggacaaacaugcucaguagcaggauggggacaaacagcaccacuaggaaaacacucacacacauuacaagaaguaaaaaugacaguacaagaagacagaaaaugcgaaucagaccuaagacacuacuacgacucaacaauagaacuaugcguaggagacccagaaauaaaaaaaacaagcuucaaaggagacucaggaggaccauuaguaugcaacaaaguagcacaaggaauaguaagcuacggaagaaacaacggaaugccaccaagagcaugcacaaaaguaagcucauucguacacuggauaaaaaaaacaaugaaaagauacuaa

SEQ ID NO: 7353 - protein, 202 aa, Artificial Sequence
  Granzyme_B__Homo_sapiens__Q6XGZ3
MQPILLLLAFLLLPRADAGEIIGGHEAKPHSRPYMAYLMIWDQKSLKRCGGFLIRDDFVLTAAHCWGSLERKAKRTRAVQPLRLPSNKAQVKPGQTCSVAGWGQTAPLGKHSHTLQEVKMTVQEDRKCESDLRHYYDSTIELCVGDPEIKKTSFKGDSGGPLVCNKVAQGIVSYGRNNGMPPRACTKVSSFVHWIKKTMKRY

SEQ ID NO: 7354 - RNA, 609 nt, Artificial Sequence
  Granzyme_B__Homo_sapiens__AAP70245
augcaaccaauccugcuucugcuggccuuccuccugcugcccagggcagaugcaggggagaucaucgggggacaugaggccaagccccacucccgccccuacauggcuuaucuuaugaucugggaucagaagucucugaagaggugcgguggcuuccugauacgagacgacuucgugcugacagcugcucacuguuggggaagccuggagagaaaggccaagcggaccagagcugugcagccccucaggcuaccuagcaacaaggcccaggugaagccagggcagacaugcaguguggccggcugggggcagacggccccccugggaaaacacucacacacacuacaagaggugaagaugacagugcaggaagaucgaaagugcgaaucugacuuacgccauuauuacgacaguaccauugaguugugcgugggggacccagagauuaaaaagacuuccuuuaagggggacucuggaggcccucuuguguguaacaagguggcccagggcauugucuccuauggacgaaacaauggcaugccuccacgagccugcaccaaagucucaagcuuuguacacuggauaaagaaaaccaugaaacgcuacuaa

SEQ ID NO: 7355 - RNA, 609 nt, Artificial Sequence
  derived and/or modified sequence opt1 from Granzyme_B__Homo_sapiens__AAP70245
augcagcccauccugcuccugcuggccuuccuccugcugccccgcgccgacgcgggcgagaucaucgggggccacgaggccaagccccacagccggcccuacauggccuaccucaugaucugggaccagaagucccugaagcgcugcgggggcuuccugauccgggacgacuucgugcucaccgccgcccacugcugggggagccuggagcgcaaggcgaagcggacccgcgccguccagccccugcggcucccguccaacaaggcccaggugaagcccggccagacgugcagcguggccggcugggggcagaccgcgccccugggcaagcacucccacacccugcaggaggucaagaugaccgugcaggaggaccgcaagugcgagagcgaccuccggcacuacuacgacuccacgaucgagcugugcgugggggaccccgagaucaagaagaccagcuucaagggcgacuccgggggcccgcuggucugcaacaagguggcccagggcaucgugagcuacgggcgcaacaacggcaugccgccccgggccugcaccaaggucuccagcuucgugcacuggaucaagaagaccaugaagcgcuacuga

SEQ ID NO: 7356 - RNA, 609 nt, Artificial Sequence
  derived and/or modified sequence opt2 from Granzyme_B__Homo_sapiens__AAP70245
augcagcccauccuccuccuccucgccuuccuccuccucccccgcgccgacgccggcgagaucaucggcggccacgaggccaagccccacucccgccccuacauggccuaccucaugaucugggaccagaagucccucaagcgcugcggcggcuuccucauccgcgacgacuucguccucaccgccgcccacugcuggggcucccucgagcgcaaggccaagcgcacccgcgccguccagccccuccgccuccccuccaacaaggcccaggucaagcccggccagaccugcuccgucgccggcuggggccagaccgccccccucggcaagcacucccacacccuccaggaggucaagaugaccguccaggaggaccgcaagugcgaguccgaccuccgccacuacuacgacuccaccaucgagcucugcgucggcgaccccgagaucaagaagaccuccuucaagggcgacuccggcggcccccucgucugcaacaaggucgcccagggcaucgucuccuacggccgcaacaacggcaugcccccccgcgccugcaccaaggucuccuccuucguccacuggaucaagaagaccaugaagcgcuacuga

SEQ ID NO: 7357 - RNA, 609 nt, Artificial Sequence
  derived and/or modified sequence opt3 from Granzyme_B__Homo_sapiens__AAP70245
augcagcccauacugcuccuucuggccuucuuguuacugccuagagcugacgcaggcgagauuauagggggacacgaagccaagccacauagcaggccguacauggcguaucuaaugaucugggaucaaaaaucccucaagcggugcgguggcuuucugauucgcgacgauuucgugcuuaccgcugcccacuguugggggucucuggagcgaaaagcaaagcguacaagagccguccagcccuugaggcucccuucaaacaaagcucagguuaagccaggacagacuugcaguguggcaggcuggggucaaacggcuccccuggggaagcauagccacacccugcaggaaguaaaaaugacagugcaggaggaccggaagugugaauccgaucuccgccauuacuaugacucuacuaucgaguuaugcgucggagauccugagauuaaaaagaccucguuuaaaggcgacucaggcgggccacugguguguaauaagguugcccagggaaucgugagcuacgguagaaacaauggcaugcccccuagggccugcacaaaggucaguuccuucgugcacuggaucaaaaagaccaugaaacgguauuga

SEQ ID NO: 7358 - RNA, 609 nt, Artificial Sequence
  derived and/or modified sequence opt4 from Granzyme_B__Homo_sapiens__AAP70245
augcagcccauccugcugcugcuggccuuccugcugcugcccagagccgacgccggcgagaucaucggcggccacgaggccaagccccacagcagacccuacauggccuaccugaugaucugggaccagaagagccugaagagaugcggcggcuuccugaucagagacgacuucgugcugaccgccgcccacugcuggggcagccuggagagaaaggccaagagaaccagagccgugcagccccugagacugcccagcaacaaggcccaggugaagcccggccagaccugcagcguggccggcuggggccagaccgccccccugggcaagcacagccacacccugcaggaggugaagaugaccgugcaggaggacagaaagugcgagagcgaccugagacacuacuacgacagcaccaucgagcugugcgugggcgaccccgagaucaagaagaccagcuucaagggcgacagcggcggcccccuggugugcaacaagguggcccagggcaucgugagcuacggcagaaacaacggcaugccccccagagccugcaccaaggugagcagcuucgugcacuggaucaagaagaccaugaagagauacuga

SEQ ID NO: 7359 - RNA, 609 nt, Artificial Sequence
  derived and/or modified sequence opt5 from Granzyme_B__Homo_sapiens__AAP70245
augcagcccauccugcuccugcuugccuuccugcuccugccuagagcugacgccggcgagauuaucgggggacacgaagcgaagccgcauagccggcccuacauggcuuaucuuaugauuugggaucaaaaaucccugaagcgcugcggcggguuucucaucagagacgauuucgugcugaccgccgcccacuguuggggaucucuggagcggaaagcuaagcgcacaagagccguccagccucuccggcugcccagcaacaaagcucagguuaagccuggccagacgugcuccguggccggguggggacaaaccgcgccccuuggcaagcauucucacacacugcaggaagugaaaaugaccguccaggaggaccgcaagugugaaagcgaucucagacauuacuaugacuccacaauugagcugugcgugggcgauccugagaucaaaaagaccucuuuuaaaggggacagcggaggcccgcuuguuuguaauaagguggcccaggggaucgucuccuacggacggaacaauggcaugcccccucgcgcuugcacaaaggugagcucuuucguucacuggauuaaaaagaccaugaaaagauauuga

SEQ ID NO: 7360 - RNA, 609 nt, Artificial Sequence
  derived and/or modified sequence opt6 from Granzyme_B__Homo_sapiens__AAP70245
augcaaccaauauuauuacuacuagcauuccuauuacuaccaagagcagacgcaggagaaauaauaggcggacacgaagcaaaaccccauagcagaccauauauggcauacuuaaugauaugggaccaaaaaagccuaaaaagaugcggaggauuuuuaauaagagaugacuuuguauuaacagcagcacacuguuggggaucacucgaaagaaaagcaaaaagaacaagagcaguccaaccacuaagauuaccaucaaacaaagcacaaguaaaaccaggacaaacaugcucaguagcaggauggggacaaacagcgccauuaggaaaacacucacacacacuacaagaaguaaaaaugacaguacaagaagacagaaaaugugaaucagacuuaagacauuacuaugacucaacaauagaauuaugcguaggagacccagaaauaaaaaaaacaagcuuuaaaggagacucaggaggaccauuaguauguaacaaaguagcacaaggaauaguaagcuacggaagaaacaauggaaugccaccaagagcaugcacaaaaguaagcucauucguacacuggauaaaaaaaacaaugaaaagauauuaa

SEQ ID NO: 7361 - protein, 235 aa, Artificial Sequence [sequence omitted]

SEQ ID NO: 7362 - RNA, 708 nt, Artificial Sequence
  Granzyme_B__Homo_sapiens__AAP70244
augcagacuuuuccuucaggggagaucaucgggggacaugaggccaagccccacucccgccccuacauggcuuaucuuaugaucugggaucagaagucucugaagaggugcgguggcuuccugauacaagacgacuucgugcugacagcugcucacuguuggggaagcuccauaaaugucaccuugggggcccacaauaucaaagaacaggagccgacccagcaguuuaucccugugaaaagacccaucccccauccagccuauaauccuaagaacuucuccaacgacaucaugcuacugcagcuggagagaaaggccaagcggaccagagcugugcagccccucaggcuaccuagcaacaaggcccaggugaagccagggcagacaugcaguguggccggcugggggcagacggccccccugggaaaacacucacacacacuacaagaggugaagaugacagugcaggaagaucgaaagugcgaaucugacuuacgccauuauuacgacaguaccauugaguugugcgugggggacccagagauuaaaaagacuuccuuuaagggggacucuggaggcccucuuguguguaacaagguggcccagggcauugucuccuauggacgaaacaauggcaugccuccacgagccugcaccaaagucucaagcuuuguacacuggauaaagaaaaccaugaaacgcuacuaa

SEQ ID NO: 7363 - RNA, 708 nt, Artificial Sequence
  derived and/or modified sequence opt1 from Granzyme_B__Homo_sapiens__AAP70244
augcagaccuuccccagcggcgagaucaucgggggccacgaggccaagccccacucccgccccuacauggccuaccugaugaucugggaccagaagucccucaagcggugcgggggcuuccugauccaggacgacuucgugcugaccgcggcccacugcugggggagcagcaucaacgucacgcucggcgcccacaacaucaaggagcaggagcccacccagcaguucauccccgugaagcgcccgaucccccaccccgccuacaaccccaagaacuucuccaacgacaucaugcugcugcagcucgagcggaaggccaagcgcacccgggcggugcagccgcugcgccugcccagcaacaaggcccaggucaagcccggccagaccugcuccguggccggguggggccagacggcgccccucgggaagcacagccacacccugcaggaggugaagaugaccguccaggaggaccggaagugcgaguccgaccugcgccacuacuacgacagcaccaucgagcucugcgugggcgacccggagaucaagaagacguccuucaagggggacagcggcggcccccuggugugcaacaaggucgcccaggggaucguguccuacggccggaacaacgggaugccgccccgcgccugcaccaaggugagcuccuucguccacuggaucaagaagaccaugaagcgguacuga

SEQ ID NO: 7364 - RNA, 708 nt, Artificial Sequence
  derived and/or modified sequence opt2 from Granzyme_B__Homo_sapiens__AAP70244
augcagaccuuccccuccggcgagaucaucggcggccacgaggccaagccccacucccgccccuacauggccuaccucaugaucugggaccagaagucccucaagcgcugcggcggcuuccucauccaggacgacuucguccucaccgccgcccacugcuggggcuccuccaucaacgucacccucggcgcccacaacaucaaggagcaggagcccacccagcaguucauccccgucaagcgccccaucccccaccccgccuacaaccccaagaacuucuccaacgacaucaugcuccuccagcucgagcgcaaggccaagcgcacccgcgccguccagccccuccgccuccccuccaacaaggcccaggucaagcccggccagaccugcuccgucgccggcuggggccagaccgccccccucggcaagcacucccacacccuccaggaggucaagaugaccguccaggaggaccgcaagugcgaguccgaccuccgccacuacuacgacuccaccaucgagcucugcgucggcgaccccgagaucaagaagaccuccuucaagggcgacuccggcggcccccucgucugcaacaaggucgcccagggcaucgucuccuacggccgcaacaacggcaugcccccccgcgccugcaccaaggucuccuccuucguccacuggaucaagaagaccaugaagcgcuacuga

SEQ ID NO: 7365 - RNA, 708 nt, Artificial Sequence
  derived and/or modified sequence opt3 from Granzyme_B__Homo_sapiens__AAP70244
augcagaccuuccccagcggcgagaucauugggggacacgaagccaagccucauuccagaccauacauggcuuaucugaugauaugggaccaaaaaucucucaagaggugcgguggcuuucuuauccaggaugacuucgugcugacagcagcccacuguugggggucaaguauuaacgucacuuugggagcgcauaauaucaaagagcaggaaccgacgcagcaauuuauucccguuaagcggccuaucccacaccccgcuuacaacccuaaaaauuucagcaacgauauaauguuacugcagcuagagcgcaaggccaagcgaacccgugcagugcagccacucagacugcccuccaauaaagcccagguaaagccuggccaaacaugcucuguggcugguugggggcagacugcaccacuuggaaaacauucgcacacccugcaggaagucaagaugacagugcaggaggacaggaaaugugagucagauuugcggcacuauuacgacagcaccaucgaacucugcguuggcgauccggagauuaagaagacaaguuuuaaaggcgacuccgggggaccccugguguguaacaaggucgcccaagguaucgugucuuauggccgcaauaacgggaugccuccaagagcuugcacuaaaguaagcuccuucguucauuggauuaagaaaaccaugaagagguacuga

SEQ ID NO: 7366 - RNA, 708 nt, Artificial Sequence
  derived and/or modified sequence opt4 from Granzyme_B__Homo_sapiens__AAP70244
augcagaccuuccccagcggcgagaucaucggcggccacgaggccaagccccacagcagacccuacauggccuaccugaugaucugggaccagaagagccugaagagaugcggcggcuuccugauccaggacgacuucgugcugaccgccgcccacugcuggggcagcagcaucaacgugacccugggcgcccacaacaucaaggagcaggagcccacccagcaguucauccccgugaagagacccaucccccaccccgccuacaaccccaagaacuucagcaacgacaucaugcugcugcagcuggagagaaaggccaagagaaccagagccgugcagccccugagacugcccagcaacaaggcccaggugaagcccggccagaccugcagcguggccggcuggggccagaccgccccccugggcaagcacagccacacccugcaggaggugaagaugaccgugcaggaggacagaaagugcgagagcgaccugagacacuacuacgacagcaccaucgagcugugcgugggcgaccccgagaucaagaagaccagcuucaagggcgacagcggcggcccccuggugugcaacaagguggcccagggcaucgugagcuacggcagaaacaacggcaugccccccagagccugcaccaaggugagcagcuucgugcacuggaucaagaagaccaugaagagauacuga

SEQ ID NO: 7367 - RNA, 708 nt, Artificial Sequence
  derived and/or modified sequence opt5 from Granzyme_B__Homo_sapiens__AAP70244
augcagaccuuccccagcggcgagaucauugggggacacgaagccaagccucauuccagaccguacauggcuuaucugaugaucugggaccaaaaaucucucaagcggugcggcggguuucugauucaggaugacuucgugcuuacagccgcgcacuguuggggaagcuccaucaacgucacgcugggcgcucauaauauuaaagagcaggaacccacccagcaauuuaucccuguuaagcgccccaucccucaccccgccuacaacccuaaaaauuucucuaacgauauuaugcuccugcagcuugagagaaaggccaagcggacacgcgcugugcagccgcugagacuccccagcaauaaagcccaggugaagccugggcaaaccugcuccgucgcuggauggggccagacagcgccccugggcaaacauucucacacccugcaggaagugaagaugacaguucaggaggaccggaaaugugagagcgaucuccgccacuauuacgacuccaccaucgaacugugcgugggggauccugagauuaagaagacgagcuuuaaaggagacucuggcgggccccuugucuguaacaagguggcccaaggaaucguuuccuauggcagaaauaacgggaugccgccucgggccugcaccaaagugagcucuuucguccauuggauuaagaaaacaaugaagcgcuacuga

SEQ ID NO: 7368 - RNA, 708 nt, Artificial Sequence
  derived and/or modified sequence opt6 from Granzyme_B__Homo_sapiens__AAP70244
augcaaacauucccaucaggagaaauaauaggaggacaugaagcaaaaccacacucaagaccguacauggcauacuuaaugauaugggaucaaaaaucacuaaaaagaugcggaggauuucuaauccaagacgacuucguacuaacagcagcucacugcuggggaucaucaauaaacguaacacuaggagcacacaacauaaaagaacaagaacccacacaacaauuuauaccaguaaaaagaccaaucccacacccagcauacaacccaaaaaacuucucaaacgacauaauguuauuacaauuagaaagaaaagcaaaaagaacaagagcaguacaaccauuaagacuaccaucaaacaaagcacaagucaaaccaggacaaacaugcucaguagcuggauggggacaaacagcaccacuaggaaaacacagucacacacuacaagaaguaaaaaugaccguacaagaagacagaaaaugcgaaucagaccuaagacacuacuacgacucaacaauagaacuaugcguaggagacccagaaauaaaaaaaacaagcuucaaaggagacagcggagguccauuaguaugcaacaaaguagcucaaggaauaguaaguuacggaagaaacaacggaaugccacccagagcaugcacaaaagucucaucauucguacacuggauaaaaaaaacaaugaaaagauacuaa

SEQ ID NO: 7369 - protein, 233 aa, Artificial Sequence
  TNF__Homo_sapiens__P01375
MSTESMIRDVELAEEALPKKTGGPQGSRRCLFLSLFSFLIVAGATTLFCLLHFGVIGPQREEFPRDLSLISPLAQAVRSSSRTPSDKPVAHVVANPQAEGQLQWLNRRANALLANGVELRDNQLVVPSEGLYLIYSQVLFKGQGCPSTHVLLTHTISRIAVSYQTKVNLLSAIKSPCQRETPEGAEAKPWYEPIYLGGVFQLEKGDRLSAEINRPDYLDFAESGQVYFGIIAL

SEQ ID NO: 7370 - RNA, 702 nt, Artificial Sequence
  TNF__Homo_sapiens__AAA36758
augagcacugaaagcaugauccgggacguggagcuggccgaggaggcgcuccccaagaagacaggggggccccagggcuccaggcggugcuuguuccucagccucuucuccuuccugaucguggcaggcgccaccacgcucuucugccugcugcacuuuggagugaucggcccccagagggaagaguuccccagggaccucucucuaaucagcccucuggcccaggcagucagaucaucuucucgaaccccgagugacaagccuguagcccauguuguagcaaacccucaagcugaggggcagcuccaguggcugaaccgccgggccaaugcccuccuggccaauggcguggagcugagagauaaccagcugguggugccaucagagggccuguaccucaucuacucccagguccucuucaagggccaaggcugccccuccacccaugugcuccucacccacaccaucagccgcaucgccgucuccuaccagaccaaggucaaccuccucucugccaucaagagccccugccagagggagaccccagagggggcugaggccaagcccugguaugagcccaucuaucugggaggggucuuccagcuggagaagggugaccgacucagcgcugagaucaaucggcccgacuaucucgacuuugccgagucugggcaggucuacuuugggaucauugcccuguga

SEQ ID NO: 7371 - RNA, 702 nt, Artificial Sequence
  derived and/or modified sequence opt1 from TNF__Homo_sapiens__AAA36758
augagcaccgaguccaugauccgcgacguggagcuggccgaggaggcccuccccaagaagaccggcgggccgcagggcagccggcgcugccuguuccugucccucuucagcuuccugaucgucgcgggggccacgacccuguucugccuccugcacuucggcgugaucgggccccagcgggaggaguucccccgcgaccugucccucaucagcccccuggcccaggccgugcgguccagcucccgcaccccgagcgacaagcccgucgcccacgugguggcgaacccccaggccgagggccagcugcaguggcucaaccggcgcgccaacgcccugcuggcgaacggcgucgagcuccgggacaaccagcugguggugcccuccgaggggcuguaccucaucuacagccagguccuguucaagggccaggggugcccguccacccacgugcugcucacgcacaccaucagccgcaucgccguguccuaccagaccaaggucaaccugcugagcgccaucaagucccccugccagcgggagacccccgagggcgccgaggccaagcccugguacgagccgaucuaccucgggggcguguuccagcuggagaagggcgaccgccugagcgcggagaucaaccggcccgacuaccucgacuucgccgaguccggccagguguacuucgggaucaucgcccuguga

SEQ ID NO: 7372 - RNA, 702 nt, Artificial Sequence
  derived and/or modified sequence opt2 from TNF__Homo_sapiens__AAA36758
auguccaccgaguccaugauccgcgacgucgagcucgccgaggaggcccuccccaagaagaccggcggcccccagggcucccgccgcugccucuuccucucccucuucuccuuccucaucgucgccggcgccaccacccucuucugccuccuccacuucggcgucaucggcccccagcgcgaggaguucccccgcgaccucucccucaucuccccccucgcccaggccguccgcuccuccucccgcacccccuccgacaagcccgucgcccacgucgucgccaacccccaggccgagggccagcuccaguggcucaaccgccgcgccaacgcccuccucgccaacggcgucgagcuccgcgacaaccagcucgucguccccuccgagggccucuaccucaucuacucccagguccucuucaagggccagggcugccccuccacccacguccuccucacccacaccaucucccgcaucgccgucuccuaccagaccaaggucaaccuccucuccgccaucaagucccccugccagcgcgagacccccgagggcgccgaggccaagcccugguacgagcccaucuaccucggcggcgucuuccagcucgagaagggcgaccgccucuccgccgagaucaaccgccccgacuaccucgacuucgccgaguccggccaggucuacuucggcaucaucgcccucuga

SEQ ID NO: 7373 - RNA, 702 nt, Artificial Sequence
  derived and/or modified sequence opt3 from TNF__Homo_sapiens__AAA36758
augagcaccgaguccaugaucagagacguggaacuggccgaggaagcucuccccaagaaaacaggcgggccucagggaucuaggcggugccuuuuccugucauuguuuaguuucuuaauugucgccggugcaacuacgcuguuuugucuacuccacuucggcguuauagggccacaacgcgaggaauuuccgcgagaucugagccuuaucucuccccuggcgcaggcugugcguuccucgucaagaaccccuagcgacaagccaguagcccauguggucgcaaacccccaggccgagggacaguugcaauggcucaauaggcgggcuaacgcacugcuggccaauggcguggagcuccgcgauaaccaguuaguugugccuagugaaggucuguaccuuauuuauucccaggucuuguucaaagggcagggaugcccaucuacacacgugcugcuaacucauaccaucagcagaauugcuguauccuaccaaacaaagguuaaucuccugucagccaucaaaagucccugucagagggagaccccugaaggcgcggaggcaaagccaugguaugagccgauauaccuuggcgggguguuucagcuggaaaagggagaccgguugagcgccgagaucaaccgccccgauuaucucgacuucgcugaaucuggucaggucuacuuuggcauuaucgcccuguga

SEQ ID NO: 7374 - RNA, 702 nt, Artificial Sequence
  derived and/or modified sequence opt4 from TNF__Homo_sapiens__AAA36758
augagcaccgagagcaugaucagagacguggagcuggccgaggaggcccugcccaagaagaccggcggcccccagggcagcagaagaugccuguuccugagccuguucagcuuccugaucguggccggcgccaccacccuguucugccugcugcacuucggcgugaucggcccccagagagaggaguuccccagagaccugagccugaucagcccccuggcccaggccgugagaagcagcagcagaacccccagcgacaagcccguggcccacgugguggccaacccccaggccgagggccagcugcaguggcugaacagaagagccaacgcccugcuggccaacggcguggagcugagagacaaccagcugguggugcccagcgagggccuguaccugaucuacagccaggugcuguucaagggccagggcugccccagcacccacgugcugcugacccacaccaucagcagaaucgccgugagcuaccagaccaaggugaaccugcugagcgccaucaagagccccugccagagagagacccccgagggcgccgaggccaagcccugguacgagcccaucuaccugggcggcguguuccagcuggagaagggcgacagacugagcgccgagaucaacagacccgacuaccuggacuucgccgagagcggccagguguacuucggcaucaucgcccuguga

SEQ ID NO: 7375 - RNA, 702 nt, Artificial Sequence
  derived and/or modified sequence opt5 from TNF__Homo_sapiens__AAA36758
augagcaccgaguccaugaucagagacguggaacuggccgaggaagcucuccccaagaaaacaggcgggccucagggaucucggcgcugccuguuccuuagccuguuuuccuuccucauugucgccggcgcgacgacccuguuuugucuucugcacuucgggguuaucggaccgcaaagagaggaauuuccccgggaucucucucugauuagcccucuggcucaggccgugcgcuccucuagcagaacacccuccgacaagccuguggcccaugucguggcuaacccccaggccgagggccagcuccaauggcugaaucggcgcgcuaacgcccuucuggcgaaugggguugagcucagagauaaccagcugguggucccuagcgaaggacuuuaccugaucuauucucagguucucuucaaaggccagggcugcccguccacccacgugcugcugacacauaccauuagccggaucgccgugucuuaccaaacaaaggucaaucuccuguccgcuaucaaaagccccugucagcgcgagaccccugaaggggccgaggcuaagcccugguaugagccuauuuaccuuggaggcguguuucagcuggaaaagggggacagacucucugccgagaucaaccggcccgauuaucuggacuucgcggaauccggacagguguacuuuggcauuaucgcccuuuga

SEQ ID NO: 7376 - RNA, 702 nt, Artificial Sequence
  derived and/or modified sequence opt6 from TNF__Homo_sapiens__AAA36758
augucaacagaaucuaugauaagagacgucgaacuagcagaagaagcauuaccaaaaaaaaccggaggaccacaaggcucaagaagaugccuauuccuaucauuauucucauuccuaauaguagcaggcgcaacaacacuauuuugccuauuacauuucggaguaaucggaccacaaagagaagaauucccacgcgaccuaucauuaauaucuccacuagcacaagccguuagaucaucaucaagaacaccaucagacaaaccaguagcccacgucguagcaaacccccaagccgaaggacaacuacaauggcuaaaccgcagagcaaacgcacuauuagccaacggaguagaauuaagagacaaccaacuaguaguaccaucagaaggacuauaccuaauauacucacaaguacuauucaaaggacaaggcugcccaucaacccacguacuacuaacacacacaauaucaagaauagcaguaucauaccaaacaaaaguaaaccuacuaucagcaauaaaaucaccaugccaaagagaaacacccgaaggagcagaagccaaaccaugguacgaaccuauauaccuaggaggaguauuccaauuagaaaaaggagacagacuaucagcagaaauaaacagaccagauuaccuagauuucgcagaauccggacaaguauacuucggaauaauagcacuauaa

SEQ ID NO: 7377 - protein, 233 aa, Artificial Sequence; identical to SEQ ID NO: 7369
  TNF__Homo_sapiens__Q5STB3

SEQ ID NO: 7378 - RNA, 702 nt, Artificial Sequence
  TNF__Homo_sapiens__ADV31546
augagcacugaaagcaugauccgggacguggagcuggccgaggaggcgcuccccaagaagacaggggggccccagggcuccaggcggugcuuguuccucagccucuucuccuuccugaucguggcaggcgccaccacgcucuucugccugcugcacuuuggggugaucggcccccagagggaagaguuccccagggaccucucucuaaucagcccucuggcccaggcagucagaucaucuucucgaaccccgagugacaagccuguagcccauguuguagcaaacccucaagcugaggggcagcuccaguggcugaaccgccgggccaaugcccuccuggccaauggcguggagcugagagauaaccaguugguggugccaucagagggccuguaccucaucuacucccagguccucuucaagggccaaggcugccccuccacccaugugcuccucacccacaccaucagccgcaucgccgucuccuaccagaccaaggucaaccuccucucugccaucaagagccccugccagagggagaccccagagggggcugaggccaagcccugguaugagcccaucuaucugggaggggucuuccagcuggagaagggugaccgacucagcgcugagaucaaucggcccgacuaucucgacuuugccgagucugggcaggucuacuuugggaucauugcccuguga

SEQ ID NO: 7379 - RNA, 702 nt, Artificial Sequence; identical to SEQ ID NO: 7371
  derived and/or modified sequence opt1 from TNF__Homo_sapiens__ADV31546

SEQ ID NO: 7380 - RNA, 702 nt, Artificial Sequence; identical to SEQ ID NO: 7372
  derived and/or modified sequence opt2 from TNF__Homo_sapiens__ADV31546

SEQ ID NO: 7381 - RNA, 702 nt, Artificial Sequence; identical to SEQ ID NO: 7373
  derived and/or modified sequence opt3 from TNF__Homo_sapiens__ADV31546

SEQ ID NO: 7382 - RNA, 702 nt, Artificial Sequence; identical to SEQ ID NO: 7374
  derived and/or modified sequence opt4 from TNF__Homo_sapiens__ADV31546

SEQ ID NO: 7383 - RNA, 702 nt, Artificial Sequence; identical to SEQ ID NO: 7375
  derived and/or modified sequence opt5 from TNF__Homo_sapiens__ADV31546

SEQ ID NO: 7384 - RNA, 702 nt, Artificial Sequence
  derived and/or modified sequence opt6 from TNF__Homo_sapiens__ADV31546
augucaacagaaucaaugauaagagacguagaacuagcagaagaagcauuaccaaaaaaaacaggaggaccacaaggaagcagacgaugcuuauuccuaucacuauucucauuuuuaauaguagcaggagcaacaacacuauucugccuauuacauuucggagucauaggaccacaaagagaagaauucccuagagaccuaucacuaauaucaccacuagcacaagcaguaagaucaucaagcagaacaccaucagacaaaccaguagcccacguaguagcaaacccacaagcagaaggacaacuccaauggcuaaaccgaagagccaacgcauuacucgcaaacggaguagaauuaagagacaaccaauuaguaguaccaucagaaggccucuaucuaauauacucacaaguauuauucaaaggacaaggauguccaucaacccacguacuacuaacacacacaauaucaagaauagcaguaucauaccaaacaaaaguaaaccuacuaagcgcaauaaaaucacccugccaaagagaaacaccugaaggagccgaagcaaaaccaugguaugaaccaauauaccuaggaggaguauuccaauuagaaaaaggagaccgacuauccgcagaaauaaauagaccagacuaccuagacuucgcagaaucaggacaaguauacuucggaauaauagcacuauaa

SEQ ID NO: 7385 - protein, 496 aa, Artificial Sequence [sequence omitted]

SEQ ID NO: 7386 - RNA, 1491 nt, Artificial Sequence
  Angiopoietin-2__Homo_sapiens__BAG35440
auguggcagauuguuuucuuuacucugagcugugaucuugucuuggccgcagccuauaacaacuuucggaagagcauggacagcauaggaaagaagcaauaucagguccagcauggguccugcagcuacacuuuccuccugccagagauggacaacugccgcucuuccuccagccccuacguguccaaugcugugcagagggacgcgccgcucgaauacgaugacucggugcagaggcugcaagugcuggagaacaucauggaaaacaacacucaguggcuaaugaagcuugagaauuauauccaggacaacaugaagaaagaaaugguagagauacagcagaaugcaguacagaaccagacggcugugaugauagaaauagggacaaaccuguugaaccaaacagcggagcaaacgcggaaguuaacugauguggaagcccaaguauuaaaucagaccacgagacuugaacuucagcucuuggaacacucccucucgacaaacaaauugggaaaacagauuuuggaccagaccagugaaauaaacaaauuucaagauaagaacaguuuccuagaaaagaaggugcuagcuauggaagacaagcacaucauccaacuacagucaauaaaagaagagaaagaucagcuacagguguuaguauccaagcaaaauuccaucauugaagaacuagaaaaaaaaauagugacugccacugugaauaauucaguucuucagaagcagcaacaugaucucauggagacaguuaauaacuuacugacuaugauguccacaucaaacucagcuaaggaccccacuguugcuaaagaagaacaaaucagcuucagagacugugcugaaguauucaaaucaggacacaccacgaauggcaucuacacguuaacauucccuaauucuacagaagagaucaaggccuacugugacauggaagcuggaggaggcggguggacaauuauucagcgacgugaggauggcagcguugauuuucagaggacuuggaaagaauauaaagugggauuugguaacccuucaggagaauauuggcugggaaaugaguuuguuucgcaacugacuaaucagcaacgcuaugugcuuaaaauacaccuuaaagacugggaagggaaugaggcuuacucauuguaugaacauuucuaucucucaagugaagaacucaauuauaggauucaccuuaaaggacuuacagggacagccggcaaaauaagcagcaucagccaaccaggaaaugauuuuagcacaaaggauggagacaacgacaaauguauuugcaaauguucacaaaugcuaacaggaggcuggugguuugaugcaugugguccuuccaacuugaacggaauguacuauccacagaggcagaacacaaauaaguucaacggcauuaaaugguacuacuggaaaggcucaggcuauucgcucaaggccacaaccaugaugauccgaccagcagauuucuaa

SEQ ID NO: 7387 - RNA, 1491 nt, Artificial Sequence
  derived and/or modified sequence opt1 from Angiopoietin-2__Homo_sapiens__BAG35440
auguggcagaucguguucuucacccugagcugcgaccucguccuggccgccgcguacaacaacuuccgcaaguccauggacagcaucggcaagaagcaguaccaggugcagcacggguccugcagcuacaccuuccugcuccccgagauggacaacugccgguccagcuccagcccguacguguccaacgccguccagcgcgacgcgccccuggaguacgacgacagcgugcagcggcuccaggugcuggagaacaucauggagaacaacacgcaguggcugaugaagcuggagaacuacauccaggacaacaugaagaaggagauggucgagauccagcagaacgccgugcagaaccagaccgccgugaugaucgagaucggcaccaaccuccugaaccagaccgccgagcagacgcgcaagcugaccgacgucgaggcccaggugcucaaccagaccacccggcuggagcugcagcuccuggagcacucccugagcacgaacaagcucgggaagcagauccuggaccagaccuccgagaucaacaaguuccaggacaagaacagcuuccuggagaagaaggugcucgccauggaggacaagcacaucauccagcugcaguccaucaaggaggagaaggaccagcugcagguccucgugagcaagcagaacuccaucaucgaggagcuggagaagaagaucgugaccgccaccgucaacaacagcgugcugcagaagcagcagcacgaccucauggagacggugaacaaccugcugaccaugauguccaccagcaacagcgcgaaggaccccaccgucgccaaggaggagcagaucuccuuccgcgacugcgccgagguguucaagagcggccacacgaccaacgggaucuacacccucaccuuccccaacuccacggaggagaucaaggccuacugcgacauggaggccggcggcgggggcuggaccaucauccagcggcgcgaggacgggagcguggacuuccagcggaccuggaaggaguacaaggucggcuucgggaacccguccggcgaguacuggcugggcaacgaguucgugagccagcugaccaaccagcagcgcuacgugcucaagauccaccugaaggacugggaggggaacgaggcguacucccuguacgagcacuucuaccucagcuccgaggagcugaacuaccggauccaccugaagggccucacggggaccgccggcaagaucagcuccaucagccagcccggcaacgacuucuccaccaaggacggggacaacgacaagugcaucugcaagugcagccagaugcugaccggcggguggugguucgacgccugcggccccuccaaccugaacgggauguacuacccccagcgccagaacacgaacaaguucaacggcaucaagugguacuacuggaagggcagcggguacucccucaaggccaccaccaugaugauccggccggccgacuucuga

SEQ ID NO: 7388 - RNA, 1491 nt, Artificial Sequence
  derived and/or modified sequence opt2 from Angiopoietin-2__Homo_sapiens__BAG35440
auguggcagaucgucuucuucacccucuccugcgaccucguccucgccgccgccuacaacaacuuccgcaaguccauggacuccaucggcaagaagcaguaccagguccagcacggcuccugcuccuacaccuuccuccuccccgagauggacaacugccgcuccuccuccucccccuacgucuccaacgccguccagcgcgacgccccccucgaguacgacgacuccguccagcgccuccagguccucgagaacaucauggagaacaacacccaguggcucaugaagcucgagaacuacauccaggacaacaugaagaaggagauggucgagauccagcagaacgccguccagaaccagaccgccgucaugaucgagaucggcaccaaccuccucaaccagaccgccgagcagacccgcaagcucaccgacgucgaggcccagguccucaaccagaccacccgccucgagcuccagcuccucgagcacucccucuccaccaacaagcucggcaagcagauccucgaccagaccuccgagaucaacaaguuccaggacaagaacuccuuccucgagaagaagguccucgccauggaggacaagcacaucauccagcuccaguccaucaaggaggagaaggaccagcuccagguccucgucuccaagcagaacuccaucaucgaggagcucgagaagaagaucgucaccgccaccgucaacaacuccguccuccagaagcagcagcacgaccucauggagaccgucaacaaccuccucaccaugauguccaccuccaacuccgccaaggaccccaccgucgccaaggaggagcagaucuccuuccgcgacugcgccgaggucuucaaguccggccacaccaccaacggcaucuacacccucaccuuccccaacuccaccgaggagaucaaggccuacugcgacauggaggccggcggcggcggcuggaccaucauccagcgccgcgaggacggcuccgucgacuuccagcgcaccuggaaggaguacaaggucggcuucggcaaccccuccggcgaguacuggcucggcaacgaguucgucucccagcucaccaaccagcagcgcuacguccucaagauccaccucaaggacugggagggcaacgaggccuacucccucuacgagcacuucuaccucuccuccgaggagcucaacuaccgcauccaccucaagggccucaccggcaccgccggcaagaucuccuccaucucccagcccggcaacgacuucuccaccaaggacggcgacaacgacaagugcaucugcaagugcucccagaugcucaccggcggcuggugguucgacgccugcggccccuccaaccucaacggcauguacuacccccagcgccagaacaccaacaaguucaacggcaucaagugguacuacuggaagggcuccggcuacucccucaaggccaccaccaugaugauccgccccgccgacuucuga

SEQ ID NO: 7389 - RNA, 1491 nt, Artificial Sequence
  derived and/or modified sequence opt3 from Angiopoietin-2__Homo_sapiens__BAG35440
auguggcagaucguguucuuuacccugagcugcgaccucguccuugccgcugcauacaacaauuucagaaaguccauggauucuauuggcaaaaagcaauaucagguucagcacgggucauguaguuacacauuucuguugcccgagauggacaacugcaggagcuccucuucgccuuaugugucaaaugccguacagcgggaugcgccauuagaauacgacgauagcgugcaacgccugcagguccuagagaacauaauggaaaauaacacucaguggcucaugaaacuggagaauuauauccaggacaacaugaagaaagaaaugguggagauucaacagaaugcuguucagaaccagacggccgugaugaucgagauuggaaccaaucuucugaaccaaacagcagaacagacucgaaaguugaccgaugucgaggcccaggugcucaaucaaacaacccgucuggaacugcagcucuuagagcauagucuguccacuaacaaacuugguaagcagaucuuggaccagacaucugagauaaauaaguuccaagauaaaaacagcuuucuggaaaagaaaguacuagcuauggaggacaagcacaucauucagcuccaguccaucaaggaagagaaagaucagcugcaaguucuugugucaaagcagaacaguauuaucgaagaacuggagaaaaagauagucaccgcaacggugaauaacagcguguugcagaaacagcaacaugaccucauggaaacugucaauaaccuguuaaccaugaugucuacauccaauucagccaaggauccgacuguugcuaaagaggaacagauuagcuucagagacugugccgagguguuuaagaguggccacaccacaaacgggaucuacacccugacguuccccaauucuacugaagagauuaaggcguauugcgacauggaggcaggaggcgguggguggacaaucauccagaggcgggaagauggauccguagacuuucagcgcaccuggaaagaguacaaggugggcuucggcaacccuagcggggaauacuggcucggaaaugaguuugucucgcaacuuacuaaccagcagagauaugugcugaaaauucauuugaaggauugggaagguaaugaggccuacucucuauaugagcacuucuaccuguccucagaggagcucaacuauaggauacaccugaaaggccuuacagggaccgcuggaaagaucaguagcauuucccaaccaggcaaugacuuuucuacgaaggauggugacaacgauaaauguaucugcaaguguagccagaugcugaccgggggauggugguucgacgccugcggccccucaaauuugaacggcauguacuauccucagcggcagaacacaaauaaauucaacgggauaaagugguacuacuggaaaggaagugguuauucccucaaggcaacuaccaugaugauucgcccagcugauuuuuga

SEQ ID NO: 7390 - RNA, 1491 nt, Artificial Sequence
  derived and/or modified sequence opt4 from Angiopoietin-2__Homo_sapiens__BAG35440
auguggcagaucguguucuucacccugagcugcgaccuggugcuggccgccgccuacaacaacuucagaaagagcauggacagcaucggcaagaagcaguaccaggugcagcacggcagcugcagcuacaccuuccugcugcccgagauggacaacugcagaagcagcagcagccccuacgugagcaacgccgugcagagagacgccccccuggaguacgacgacagcgugcagagacugcaggugcuggagaacaucauggagaacaacacccaguggcugaugaagcuggagaacuacauccaggacaacaugaagaaggagaugguggagauccagcagaacgccgugcagaaccagaccgccgugaugaucgagaucggcaccaaccugcugaaccagaccgccgagcagaccagaaagcugaccgacguggaggcccaggugcugaaccagaccaccagacuggagcugcagcugcuggagcacagccugagcaccaacaagcugggcaagcagauccuggaccagaccagcgagaucaacaaguuccaggacaagaacagcuuccuggagaagaaggugcuggccauggaggacaagcacaucauccagcugcagagcaucaaggaggagaaggaccagcugcaggugcuggugagcaagcagaacagcaucaucgaggagcuggagaagaagaucgugaccgccaccgugaacaacagcgugcugcagaagcagcagcacgaccugauggagaccgugaacaaccugcugaccaugaugagcaccagcaacagcgccaaggaccccaccguggccaaggaggagcagaucagcuucagagacugcgccgagguguucaagagcggccacaccaccaacggcaucuacacccugaccuuccccaacagcaccgaggagaucaaggccuacugcgacauggaggccggcggcggcggcuggaccaucauccagagaagagaggacggcagcguggacuuccagagaaccuggaaggaguacaaggugggcuucggcaaccccagcggcgaguacuggcugggcaacgaguucgugagccagcugaccaaccagcagagauacgugcugaagauccaccugaaggacugggagggcaacgaggccuacagccuguacgagcacuucuaccugagcagcgaggagcugaacuacagaauccaccugaagggccugaccggcaccgccggcaagaucagcagcaucagccagcccggcaacgacuucagcaccaaggacggcgacaacgacaagugcaucugcaagugcagccagaugcugaccggcggcuggugguucgacgccugcggccccagcaaccugaacggcauguacuacccccagagacagaacaccaacaaguucaacggcaucaagugguacuacuggaagggcagcggcuacagccugaaggccaccaccaugaugaucagacccgccgacuucuga

SEQ ID NO: 7391 - RNA, 1491 nt, Artificial Sequence
  derived and/or modified sequence opt5 from Angiopoietin-2__Homo_sapiens__BAG35440
auguggcagaucguguucuuuacccugagcugcgaccucguccuggccgcugccuacaacaauuucagaaaguccauggauucuauuggcaaaaagcaauaucagguucagcacgggagcuguuccuacacauuucuucugcccgagauggacaacugccggucuagcuccucuccuuaugugagcaaugcggugcagcgcgaugcuccgcucgaauacgacgauuccguccaaagacuucaggugcuggagaacaucauggaaaauaacacgcaguggcugaugaaacucgagaauuauauucaggacaacaugaagaaagaaaugguugagauccaacagaaugccgugcagaaccagaccgccgucaugauugagaucggaacaaaucugcugaaccaaaccgcugaacagacacggaagcucaccgauguggaggcccagguucugaaucaaacaacccgccuugaacugcagcuccuggagcauagccuuucuacgaacaagcugggcaaacagauccucgaccagaccuccgagauuaauaaguuccaagauaaaaacagcuuucuggaaaagaaagugcuggcuauggaggacaagcacaucauucagcuccagucuaucaaggaagagaaagaucagcugcaaguccuuguguccaagcagaacagcauuaucgaagaacuggagaaaaagauugugacagccaccgucaauaacucuguucuccagaaacagcaacaugaccugauggaaacagugaauaaccuucugaccaugauguccacgagcaauuccgcgaaggaucccacaguggccaaagaggaacagaucucuuucagagacugugcugaggucuuuaagagcgggcacaccacaaacggaaucuacacccucaccuucccuaauuccacagaagagauuaaggccuauugcgacauggaggcuggcgggggaggcuggacgaucauucagcggcgcgaagauggcagcguggacuuucagagaaccuggaaagaguacaagguuggguucggaaaccccucuggcgaauacuggcuggggaaugaguuugugucccaacugacaaaccagcagcgguauguccucaaaauccaucugaaggauugggaaggaaaugaggccuacagccuuuaugagcacuucuaccugucuagcgaggagcucaacuaucgcauucaccugaaaggccuuaccgggacagcgggaaagaucuccucuaucagccaaccuggcaaugacuuuuccaccaaggauggcgacaacgauaaauguauuugcaaguguagccagaugcugacagggggauggugguucgacgccugcggccccucuaaucucaacgggauguacuauccucagagacagaacacgaauaaauucaacggaaucaagugguacuacuggaaaggcuccggguauagccugaaggcuaccaccaugaugauucggccggccgauuuuuga

SEQ ID NO: 7392 - RNA, 1491 nt, Artificial Sequence
  derived and/or modified sequence opt6 from Angiopoietin-2__Homo_sapiens__BAG35440
auguggcaaauaguauucuuuaccuuaucuugcgauuuaguauuagccgccgcauauaacaacuuuagaaaaagcauggacucaaucggaaaaaaacaauaucaagugcaacacggaucaugcagcuauacauuucuacucccagaaauggacaacugcagaucaagcagcucaccauaugucucaaacgccguccaaagagacgcaccacuagaauaugacgacucaguacaaagauuacaaguauuagagaauauaauggaaaacaauacacaauggcuaaugaaacuagaaaauuacauacaagacaauaugaaaaaagaaaugguagaaauacaacaaaacgcaguccaaaaccaaacagcaguaaugaucgaaauaggaaccaacuuacuuaaccaaacagcagaacaaacaagaaaacuaacagacguagaagcacaaguccuaaaucaaacuacaagacuugaauuacaacuucuagaacauucauuaucaacaaacaaacucggaaaacaaauacucgaccaaacaucagaaauaaauaaauuucaagacaaaaauucauuccucgaaaaaaaaguauuagccauggaagacaaacacauaauacaacuucaaagcauaaaggaagaaaaagaccaacuacaaguccuaguaucaaaacaaaauucaauaauagaagaauuagaaaaaaaaauaguaacagcaacaguaaacaacucaguauuacagaaacaacaacacgaccuaauggaaacagucaacaacuuauuaacaaugauguccacaucaaacucagcaaaagaucccacaguagcaaaagaagaacaaaucucauuuagagacugugcagaaguuuucaaauccggacacacaacaaacggcauauauaccuuaacuuucccaaauucaacugaagaaauaaaagcauacugugauauggaagcaggaggaggcggauggacaauaauacaacgaagagaagacgguucuguagauuuccaaagaacauggaaagaauacaaaguagguuucggaaauccaagcggagaauacuggcuagguaaugaauucguaucacaacuaacaaaccaacaaagauacguacuaaaaauacacuuaaaagacugggaaggcaaugaagcauacucacuauacgaacacuuuuacuuaucaucagaagagcuaaauuauagaauucaccugaaaggccucacaggcaccgcaggaaaaauauccucaaucucacaaccagguaacgacuucucaacaaaagacggagacaacgacaaaugcauaugcaaaugcucucaaaugcuaacaggcgguuggugguucgacgcaugcggaccgagcaaucuaaacggaauguacuauccccaaagacaaaauacaaacaaauucaacggaaucaaaugguauuacuggaaaggcuccggauauagccuaaaagcaacaacaaugaugauaagaccugcagacuuuuaa

SEQ ID NO: 7393 - protein, 496 aa, Artificial Sequence
  Angiopoietin-2__Homo_sapiens__O15123
MWQIVFFTLSCDLVLAAAYNNFRKSMDSIGKKQYQVQHGSCSYTFLLPEMDNCRSSSSPYVSNAVQRDAPLEYDDSVQRLQVLENIMENNTQWLMKLENYIQDNMKKEMVEIQQNAVQNQTAVMIEIGTNLLNQTAEQTRKLTDVEAQVLNQTTRLELQLLEHSLSTNKLEKQILDQTSEINKLQDKNSFLEKKVLAMEDKHIIQLQSIKEEKDQLQVLVSKQNSIIEELEKKIVTATVNNSVLQKQQHDLMETVNNLLTMMSTSNSAKDPTVAKEEQISFRDCAEVFKSGHTTNGIYTLTFPNSTEEIKAYCDMEAGGGGWTIIQRREDGSVDFQRTWKEYKVGFGNPSGEYWLGNEFVSQLTNQQRYVLKIHLKDWEGNEAYSLYEHFYLSSEELNYRIHLKGLTGTAGKISSISQPGNDFSTKDGDNDKCICKCSQMLTGGWWFDACGPSNLNGMYYPQRQNTNKFNGIKWYYWKGSGYSLKATTMMIRPADF

SEQ ID NO: 7394 - RNA, 1491 nt, Artificial Sequence
  Angiopoietin-2__Homo_sapiens__AAB63190
auguggcagauuguuuucuuuacucugagcugugaucuugucuuggccgcagccuauaacaacuuucggaagagcauggacagcauaggaaagaagcaauaucagguccagcauggguccugcagcuacacuuuccuccugccagagauggacaacugccgcucuuccuccagccccuacguguccaaugcugugcagagggacgcgccgcucgaauacgaugacucggugcagaggcugcaagugcuggagaacaucauggaaaacaacacucaguggcuaaugaagcuugagaauuauauccaggacaacaugaagaaagaaaugguagagauacagcagaaugcaguacagaaccagacggcugugaugauagaaauagggacaaaccuguugaaccaaacagcugagcaaacgcggaaguuaacugauguggaagcccaaguauuaaaucagaccacgagacuugaacuucagcucuuggaacacucccucucgacaaacaaauuggaaaaacagauuuuggaccagaccagugaaauaaacaaauugcaagauaagaacaguuuccuagaaaagaaggugcuagcuauggaagacaagcacaucauccaacuacagucaauaaaagaagagaaagaucagcuacagguguuaguauccaagcaaaauuccaucauugaagaacuagaaaaaaaaauagugacugccacggugaauaauucaguucuucaaaagcagcaacaugaucucauggagacaguuaauaacuuacugacuaugauguccacaucaaacucagcuaaggaccccacuguugcuaaagaagaacaaaucagcuucagagacugugcugaaguauucaaaucaggacacaccacaaauggcaucuacacguuaacauucccuaauucuacagaagagaucaaggccuacugugacauggaagcuggaggaggcggguggacaauuauucagcgacgugaggauggcagcguugauuuucagaggacuuggaaagaauauaaagugggauuugguaacccuucaggagaauauuggcugggaaaugaguuuguuucgcaacugacuaaucagcaacgcuaugugcuuaaaauacaccuuaaagacugggaagggaaugaggcuuacucauuguaugaacauuucuaucucucaagugaagaacucaauuauaggauucaccuuaaaggacuuacagggacagccggcaaaauaagcagcaucagccaaccaggaaaugauuuuagcacaaaggauggagacaacgacaaauguauuugcaaauguucacaaaugcuaacaggaggcuggugguuugaugcaugugguccuuccaacuugaacggaauguacuauccacagaggcagaacacaaauaaguucaacggcauuaaaugguacuacuggaaaggcucaggcuauucgcucaaggccacaaccaugaugauccgaccagcagauuucuaa

SEQ ID NO: 7395 - RNA, 1491 nt, Artificial Sequence
  derived and/or modified sequence opt1 from Angiopoietin-2__Homo_sapiens__AAB63190
auguggcagaucguguucuucacccugagcugcgaccucguccuggccgccgcguacaacaacuuccgcaaguccauggacagcaucggcaagaagcaguaccaggugcagcacggguccugcagcuacaccuuccugcuccccgagauggacaacugccgguccagcuccagcccguacguguccaacgccguccagcgcgacgcgccccuggaguacgacgacagcgugcagcggcuccaggugcuggagaacaucauggagaacaacacgcaguggcugaugaagcuggagaacuacauccaggacaacaugaagaaggagauggucgagauccagcagaacgccgugcagaaccagaccgccgugaugaucgagaucggcaccaaccuccugaaccagaccgccgagcagacgcgcaagcugaccgacgucgaggcccaggugcucaaccagaccacccggcuggagcugcagcuccuggagcacucccugagcacgaacaagcucgagaagcagauccuggaccagaccuccgagaucaacaagcugcaggacaagaacagcuuccucgagaagaaggugcuggccauggaggacaagcacaucauccagcugcaguccaucaaggaggagaaggaccagcuccagguccuggugagcaagcagaacuccaucaucgaggagcuggagaagaagaucgugaccgccaccgucaacaacagcgugcuccagaagcagcagcacgaccugauggagacggugaacaaccugcucaccaugauguccaccagcaacagcgcgaaggaccccaccgucgccaaggaggagcagaucuccuuccgcgacugcgccgagguguucaagagcgggcacacgaccaacggcaucuacacccugaccuuccccaacuccacggaggagaucaaggccuacugcgacauggaggccgggggcggcggguggaccaucauccagcggcgcgaggacggcagcguggacuuccagcggaccuggaaggaguacaaggucggguucggcaacccguccggggaguacuggcugggcaacgaguucgugagccagcucaccaaccagcagcgcuacgugcugaagauccaccugaaggacugggagggcaacgaggcguacucccucuacgagcacuucuaccugagcuccgaggagcugaacuaccggauccaccucaaggggcugacgggcaccgccgggaagaucagcuccaucagccagcccggcaacgacuucuccaccaaggacggcgacaacgacaagugcaucugcaagugcagccagaugcugaccgggggcuggugguucgacgccugcgggcccuccaaccucaacggcauguacuacccccagcgccagaacacgaacaaguucaacgggaucaagugguacuacuggaagggcagcggcuacucccugaaggccaccaccaugaugauccggccggccgacuucuga

SEQ ID NO: 7396 - RNA, 1491 nt, Artificial Sequence
  derived and/or modified sequence opt2 from Angiopoietin-2__Homo_sapiens__AAB63190
auguggcagaucgucuucuucacccucuccugcgaccucguccucgccgccgccuacaacaacuuccgcaaguccauggacuccaucggcaagaagcaguaccagguccagcacggcuccugcuccuacaccuuccuccuccccgagauggacaacugccgcuccuccuccucccccuacgucuccaacgccguccagcgcgacgccccccucgaguacgacgacuccguccagcgccuccagguccucgagaacaucauggagaacaacacccaguggcucaugaagcucgagaacuacauccaggacaacaugaagaaggagauggucgagauccagcagaacgccguccagaaccagaccgccgucaugaucgagaucggcaccaaccuccucaaccagaccgccgagcagacccgcaagcucaccgacgucgaggcccagguccucaaccagaccacccgccucgagcuccagcuccucgagcacucccucuccaccaacaagcucgagaagcagauccucgaccagaccuccgagaucaacaagcuccaggacaagaacuccuuccucgagaagaagguccucgccauggaggacaagcacaucauccagcuccaguccaucaaggaggagaaggaccagcuccagguccucgucuccaagcagaacuccaucaucgaggagcucgagaagaagaucgucaccgccaccgucaacaacuccguccuccagaagcagcagcacgaccucauggagaccgucaacaaccuccucaccaugauguccaccuccaacuccgccaaggaccccaccgucgccaaggaggagcagaucuccuuccgcgacugcgccgaggucuucaaguccggccacaccaccaacggcaucuacacccucaccuuccccaacuccaccgaggagaucaaggccuacugcgacauggaggccggcggcggcggcuggaccaucauccagcgccgcgaggacggcuccgucgacuuccagcgcaccuggaaggaguacaaggucggcuucggcaaccccuccggcgaguacuggcucggcaacgaguucgucucccagcucaccaaccagcagcgcuacguccucaagauccaccucaaggacugggagggcaacgaggccuacucccucuacgagcacuucuaccucuccuccgaggagcucaacuaccgcauccaccucaagggccucaccggcaccgccggcaagaucuccuccaucucccagcccggcaacgacuucuccaccaaggacggcgacaacgacaagugcaucugcaagugcucccagaugcucaccggcggcuggugguucgacgccugcggccccuccaaccucaacggcauguacuacccccagcgccagaacaccaacaaguucaacggcaucaagugguacuacuggaagggcuccggcuacucccucaaggccaccaccaugaugauccgccccgccgacuucuga

SEQ ID NO: 7397 - RNA, 1491 nt, Artificial Sequence
  derived and/or modified sequence opt3 from Angiopoietin-2__Homo_sapiens__AAB63190
auguggcagaucguguucuuuacccugagcugcgaccucguccuugccgcugcauacaacaauuucagaaaguccauggauucuauuggcaaaaagcaauaucagguucagcacgggucauguaguuacacauuucuguugcccgagauggacaacugcaggagcuccucuucgccuuaugugucaaaugccguacagcgggaugcgccauuagaauacgacgauagcgugcaacgccugcagguccuagagaacauaauggaaaauaacacucaguggcucaugaaacuggagaauuauauccaggacaacaugaagaaagaaaugguggagauucaacagaaugcuguucagaaccagacggccgugaugaucgagauuggaaccaaucuucugaaccaaacagcagaacagacucgaaaguugaccgaugucgaggcccaggugcucaaucaaacaacccgucuggaacugcagcucuuagagcauagucuguccacuaacaaacuugagaaacagaucuuggaccagacaucugaaauaaauaagcugcaagauaaaaacagcuuccuagagaagaaaguacucgcuauggaagacaagcacaucauucagcugcaguccaucaaggaggaaaaagaucagcuucaaguucuggugucaaagcagaacaguauuaucgaggaguuggaaaagaagauagucaccgcaacggugaauaacagcgugcuccagaaacagcaacaugaccugauggagacugucaauaacuuacugaccaugaugucuacauccaauucagccaaggauccgacuguugcuaaagaagaacagauuagcuuuagagacugugccgaaguguucaagaguggucacaccacaaacggcaucuacacccucacguuucccaauucuacugaggagauuaaggcguauugcgacauggaagcagggggaggcgguuggacaaucauccagaggcgggaggauggguccguagacuuccagcgcaccuggaaagaauacaaggugggauuuggcaacccuagcggcgaguacuggcuugggaaugaguucgucucgcaacugacuaaccagcagagauauguguugaaaauucaucuaaaggauugggagggaaaugaggccuacucucuguaugaacacuuuuaccucuccucagaggaacugaacuauaggauacaccuuaaaggucugacaggcaccgcugggaagaucaguagcauuucccaaccaggaaaugacuucucuacgaaggauggcgacaacgauaaauguaucugcaaguguagccagauguugaccgguggguggugguuugacgccugcggacccucaaaucucaacggcauguacuauccucagcggcagaacacaaauaaauucaacggcauaaagugguacuacuggaaagggaguggauauucccugaaggcaacuaccaugaugauucgcccagcugauuucuga

SEQ ID NO: 7398 - RNA, 1491 nt, Artificial Sequence
  derived and/or modified sequence opt4 from Angiopoietin-2__Homo_sapiens__AAB63190
auguggcagaucguguucuucacccugagcugcgaccuggugcuggccgccgccuacaacaacuucagaaagagcauggacagcaucggcaagaagcaguaccaggugcagcacggcagcugcagcuacaccuuccugcugcccgagauggacaacugcagaagcagcagcagccccuacgugagcaacgccgugcagagagacgccccccuggaguacgacgacagcgugcagagacugcaggugcuggagaacaucauggagaacaacacccaguggcugaugaagcuggagaacuacauccaggacaacaugaagaaggagaugguggagauccagcagaacgccgugcagaaccagaccgccgugaugaucgagaucggcaccaaccugcugaaccagaccgccgagcagaccagaaagcugaccgacguggaggcccaggugcugaaccagaccaccagacuggagcugcagcugcuggagcacagccugagcaccaacaagcuggagaagcagauccuggaccagaccagcgagaucaacaagcugcaggacaagaacagcuuccuggagaagaaggugcuggccauggaggacaagcacaucauccagcugcagagcaucaaggaggagaaggaccagcugcaggugcuggugagcaagcagaacagcaucaucgaggagcuggagaagaagaucgugaccgccaccgugaacaacagcgugcugcagaagcagcagcacgaccugauggagaccgugaacaaccugcugaccaugaugagcaccagcaacagcgccaaggaccccaccguggccaaggaggagcagaucagcuucagagacugcgccgagguguucaagagcggccacaccaccaacggcaucuacacccugaccuuccccaacagcaccgaggagaucaaggccuacugcgacauggaggccggcggcggcggcuggaccaucauccagagaagagaggacggcagcguggacuuccagagaaccuggaaggaguacaaggugggcuucggcaaccccagcggcgaguacuggcugggcaacgaguucgugagccagcugaccaaccagcagagauacgugcugaagauccaccugaaggacugggagggcaacgaggccuacagccuguacgagcacuucuaccugagcagcgaggagcugaacuacagaauccaccugaagggccugaccggcaccgccggcaagaucagcagcaucagccagcccggcaacgacuucagcaccaaggacggcgacaacgacaagugcaucugcaagugcagccagaugcugaccggcggcuggugguucgacgccugcggccccagcaaccugaacggcauguacuacccccagagacagaacaccaacaaguucaacggcaucaagugguacuacuggaagggcagcggcuacagccugaaggccaccaccaugaugaucagacccgccgacuucuga

SEQ ID NO: 7399 - RNA, 1491 nt, Artificial Sequence
  derived and/or modified sequence opt5 from Angiopoietin-2__Homo_sapiens__AAB63190
auguggcagaucguguucuuuacccugagcugcgaccucguccuggccgcugccuacaacaauuucagaaaguccauggauucuauuggcaaaaagcaauaucagguucagcacgggagcuguuccuacacauuucuucugcccgagauggacaacugccggucuagcuccucuccuuaugugagcaaugcggugcagcgcgaugcuccgcucgaauacgacgauuccguccaaagacuucaggugcuggagaacaucauggaaaauaacacgcaguggcugaugaaacucgagaauuauauucaggacaacaugaagaaagaaaugguugagauccaacagaaugccgugcagaaccagaccgccgucaugauugagaucggaacaaaucugcugaaccaaaccgcugaacagacacggaagcucaccgauguggaggcccagguucugaaucaaacaacccgccuugaacugcagcuccuggagcauagccuuucuacgaacaagcuggagaaacagauccucgaccagaccuccgaaauuaauaagcugcaagauaaaaacagcuuccuggagaagaaagugcucgcuauggaagacaagcacaucauucagcugcagucuaucaaggaggaaaaagaucagcuucaaguccugguguccaagcagaacagcauuaucgaggagcucgagaaaaagauugugacagccaccgucaauaacucuguucugcagaaacagcaacaugaccuuauggagacagugaauaaccugcucaccaugauguccacgagcaauuccgcgaaggaucccacaguggccaaagaagaacagaucucuuuuagagacugugcugaagucuucaagagcggccacaccacaaacgggaucuacacccugaccuuuccuaauuccacagaggagauuaaggccuauugcgacauggaagcuggaggcgggggauggacgaucauucagcggcgcgaggauggcagcguggacuuccagagaaccuggaaagaauacaagguuggcuuugggaaccccucuggagaguacuggcugggcaaugaguucgugucccaacucacaaaccagcagcgguauguccugaaaauccaucuuaaggauugggaagggaaugaggccuacagccuguaugaacacuuuuaccucucuagcgaggaacugaacuaucgcauucaccuuaaaggacugaccggcacagcggggaagaucuccucuaucagccaaccuggaaaugacuucuccaccaaggauggcgacaacgauaaauguauuugcaaguguagccagaugcucacgggcggguggugguuugacgccugcggacccucuaaucugaacggcauguacuauccucagagacagaacacaaauaaauucaacgggaucaagugguacuacuggaaaggauccggcuauagccugaaggcuaccaccaugaugauucggccggccgauuucuga

SEQ ID NO: 7400 - RNA, 1491 nt, Artificial Sequence
  derived and/or modified sequence opt6 from Angiopoietin-2__Homo_sapiens__AAB63190
auguggcaaauagucuuuuucacucuaucaugugaccuaguacuagcagcagcauauaacaauuuuagaaaaucaauggacaguauaggaaaaaaacaauaccaaguacaacacgguuccugcuccuauacauucuuacuaccagaaauggacaauugcagaagcucaaguucaccauacguaucuaacgcaguacaaagagacgcaccauuagaauacgacgacucaguacaacgacuacaaguacuagaaaacauaauggaaaacaauacacaauggcuaaugaaauuagaaaauuauauccaagacaacaugaaaaaagaaaugguagaaauacaacaaaacgcaguccaaaaccaaacagcaguaaugauagaaaucggaacaaaccuacuaaaccaaacagcagaacaaacaagaaaacuuacagacguagaagcucaaguauuaaaccaaacaacaagacuagaacuacaacuacuagaacacucacuaaguacaaauaaacucgaaaaacaaauauuagaucaaacaagcgaaauaaauaaauuacaggauaaaaacucauuccucgagaaaaaaguauuagcaauggaagauaaacacauaauacaacuacaaucaauaaaagaagaaaaagaccaacuccaaguauuaguaaguaaacaaaauagcauaauagaagaauuagaaaaaaaaauaguaacugcaacaguaaacaacucaguacuacaaaaacaacaacacgaccuaauggaaacaguaaacaacuuacuaacaaugaugagcacaucaaacucagcaaaagacccaaccguagcaaaagaagaacaaaucucauuccgugauugcgccgaaguauucaaaucaggccacacaacaaacggcaucuauacauuaacauucccaaacucaacugaagaaauaaaagcauacugcgauauggaagccggaggaggcggauggaccauaauacaaagaagagaagacggaagcguagauuuucaaaggacauggaaagaauacaaaguaggauucgguaacccaaguggagaauacugguuaggaaacgaauucguaagccaacuaacaaaccaacaaagguacguacucaaaauacaccuuaaagauugggaaggaaacgaagcauauucccuauacgaacacuucuacuuaagcuccgaagaacuaaauuaucgaauacauuuaaaagggcuaacaggcacagccggaaaaauaucaaguauaagucaaccaggaaacgacuucucaacaaaagacggagacaacgacaaaugcauaugcaaaugcucacaaaugcuaaccggaggauggugguucgacgcaugcggaccaucaaaccucaacggaauguacuauccccagagacaaaacacaaacaaauuuaacggaauaaaaugguauuacuggaaaggaucaggauacagucucaaagcuacaacaaugaugauuagaccagcagauuucuaa

SEQ ID NO: 7401 - protein, 809 aa, Artificial Sequence [sequence omitted]

SEQ ID NO: 7402 - RNA, 2430 nt, Artificial Sequence
  Angiostatin__Homo_sapiens__AKG50977
auggaccauaaagagguaguucuucuccuucuuuuauuucugaaaucaggucucggggacucucuggaugacuacgucaauacucagggagcuuuccuguucaguuugucucggaagcagguggcagccaggagcguggaagaaugugcagccaagugugaggcggaaacaaacuucauuugcagggcuuuccaguaucacaguaaagaucagcaguguguggugauggcugagaacagcaagaccucccccaucgcuaggaugagagacgugguucuauucgagaagagaaucuaucucuccgagugcaagacuggaaaugggaagaacuacagagggaccacguccaaaacgaaaaguggugucaucugucaaaaauggagugucagcucuccgcacauacccaaguauucaccugaaaaguuuccuuuagcgggacuggaggagaacuacugcaggaacccagacaacgaugaaaagggacccugguguuacaccacugacccagagacccgauucgacuacugcgacaucccugagugugaagaugaaugcaugcacugcaguggagaacauuaugagggcaaaauuuccaagaccaugucggggauugaaugccagucuuggggcucucagagcccacaugcucacggauaccuuccuuccaaauuuccaaacaagaaucugaagaugaauuacugccguaacccggauggggagccccgcccauggugcuucaccacggaucccaacaaacgcugggaauucugugacaucccgagaugcaccacacccccaccaacuuccgggccaacguaucagugucugaagggaagaggugaaaacuaccgagggacagugucugucacugcaucugggcacaccugucaacgcuggagugcgcagagcccccacaagcacaacaggacccccgaaaacuuucccugcaaaaaucuggaggagaacuacugccguaacccugauggagaaacggcuccguggugcuacacaaccgacagcgaggugaggugggauuacugcaagauaccguccuguggguccuccacgacauccacggagcaucuggaugcccccgugccacccgagcaaaccccugucgcccaggacugcuacagaggcaauggggagaguuaccgaggcacgucuuccacaaccaucacgggaagaaaaugucaguccuggguauccaugacgccacaucggcaugagaagaccccaggaaacuucccaaaugcuggcuugacaaugaacuacugcaggaacccagacgcugauaaaagcccuuggugcuacaccacugauccaagagugagaugggaguacugcaaccugaagaaaugcucagagacagaacagcaggucacaaacuuuccagcuauugcgcagguucccaguguagaggaucuuucggaagacugcauguucgggaaugggaaaagguaccggggcaagagggccaccacgguggccggcguccccugccaggagugggcugcccaggagccccacagacacagcaucuucacuccagagacaaauccacgggcaggucuggagaaaaauuacugccguaauccugacggcgacgacaacggucccuggugcuacacgacaaacccacaaaagcucuuugacuacugcgacgucccucaguguguaaccucuucauuugauugcgggaagcccaagguggagccaaagaaguguccugcgagggugguagguggguguguguccaucccacacuccuggcccuggcaaauuagccuucgauacagguacagagggcacuucugcggaggcacuuuaauauccccggagugggugcugacugcuaagcacugccuggaaaaguccucaaguccuucaucauacaaggucauuuugggugcacacgaagaguaccaccuuggagaaggaguucaggagauagacguguccaagcuguucaaggagcccucuggggcggacauagccuugcucaagcugagcagcccugccgucaucacugacaagguaaucccggcuugucugccaaccccgaacuauguggucgccgaccggacagcguguuacaucacuggcuggggagaaaccaaaggcacguacggcgcuggcuuacuuaaggaagcccggcugcccgugauugagaacaaaguguguaaucgcuacgaguaucugggcgggaaggucagccccaacgagcugugugcggggcaucuggcuggaggcaucgacagcugccagggugacagcggagggccucuggugugcuuugagaaggacaaauacauuuuacaaggagucacuucuuggggucuuggcugugcgcuccccaauaagccugguguguauguccguguuucaagguuuguuacuuggauugaggaaauaaugagaagaaauuaa

SEQ ID NO: 7403 - RNA, 2430 nt, Artificial Sequence
  derived and/or modified sequence opt1 from Angiostatin__Homo_sapiens__AKG50977
auggaccacaaggaggugguccugcuccugcuccuguuccucaagagcggccugggggacucccuggacgacuacgugaacacccagggcgccuuccuguucagccugucccgcaagcaggucgccgcgcggagcguggaggagugcgccgccaagugcgaggccgagaccaacuucaucugccgcgccuuccaguaccacuccaaggaccagcagugcguggugauggcggagaacagcaagacgucccccaucgcccggaugcgcgacgucguccucuucgagaagcggaucuaccugagcgagugcaagaccgggaacggcaagaacuaccgcgggaccaccuccaagaccaagagcggcgugaucugccagaagugguccgugagcuccccgcacauccccaaguacagccccgagaaguucccccuggccggccucgaggagaacuacugccggaacccggacaacgacgagaaggggcccuggugcuacaccaccgaccccgagacccgcuucgacuacugcgacauccccgagugcgaggacgagugcaugcacugcuccggcgagcacuacgaggggaagaucagcaagacgauguccggcaucgagugccagagcugggggucccagagcccgcacgcccacggcuaccugcccagcaaguuccccaacaagaaccugaagaugaacuacugccggaaccccgacggcgagccgcgccccuggugcuucaccaccgaccccaacaagcggugggaguucugcgacaucccccgcugcaccacgccgccgcccaccuccgggcccaccuaccagugccucaagggccgcggggagaacuaccggggcaccgugagcgugacggcguccggccacacgugccagcgguggagcgcccagagcccccacaagcacaaccgcacccccgagaacuuccccugcaagaaccuggaggagaacuacugccggaaccccgacggggagaccgccccguggugcuacacgaccgacuccgagguccgcugggacuacugcaagauccccuccugcggcagcuccaccaccagcacggagcaccuggacgcccccgugcccccggagcagacccccguggcccaggacugcuaccgggggaacggcgaguccuaccgcgggaccagcuccaccacgaucaccggccggaagugccagagcugggucuccaugacgccccaccgccacgagaagaccccgggcaacuuccccaacgcggggcucaccaugaacuacugccgcaaccccgacgccgacaagagccccuggugcuacaccaccgacccgcgggugcgcugggaguacugcaaccugaagaagugcuccgagaccgagcagcaggucacgaacuuccccgccaucgcccaggugcccagcguggaggaccuguccgaggacugcauguucggcaacgggaagcgguaccgcggcaagcgggccaccaccguggcggggguccccugccaggagugggccgcccaggagccgcaccgccacagcaucuucacccccgagaccaacccccgggccggccucgagaagaacuacugccgcaaccccgacggcgacgacaacgggccguggugcuacacgaccaacccccagaagcuguucgacuacugcgacgugccccagugcgugaccagcuccuucgacugcggcaagcccaaggucgagccgaagaagugccccgcccggguggucgggggcugcgugagcaucccccacuccuggcccuggcagaucagccugcgcuaccgguaccgcgggcacuucugcggcggcacccucaucuccccggagugggugcugacggcgaagcacugccuggagaaguccagcagccccuccagcuacaaggucauccucggggcccacgaggaguaccaccugggcgagggggugcaggagaucgacguguccaagcuguucaaggagcccagcggcgccgacaucgcccuccugaagcuguccagccccgccgucaucaccgacaaggugaucccggcgugccuccccacccccaacuacguggucgccgaccggaccgccugcuacaucacgggcuggggcgagaccaaggggaccuacggggccggccugcugaaggaggcgcgccucccggugaucgagaacaaggugugcaaccgguacgaguaccucgggggcaaggucucccccaacgagcugugcgccggccaccuggccgggggcaucgacagcugccagggggacuccggcgggccccuggugugcuucgagaaggacaaguacauccugcagggcgugaccagcuggggccucgggugcgcccugcccaacaagccgggcgucuacgugcgcgugagccgguucgucacguggaucgaggagaucaugcgccggaacuga

SEQ ID NO: 7404 - RNA, 2430 nt, Artificial Sequence
  derived and/or modified sequence opt2 from Angiostatin__Homo_sapiens__AKG50977
auggaccacaaggaggucguccuccuccuccuccucuuccucaaguccggccucggcgacucccucgacgacuacgucaacacccagggcgccuuccucuucucccucucccgcaagcaggucgccgcccgcuccgucgaggagugcgccgccaagugcgaggccgagaccaacuucaucugccgcgccuuccaguaccacuccaaggaccagcagugcgucgucauggccgagaacuccaagaccucccccaucgcccgcaugcgcgacgucguccucuucgagaagcgcaucuaccucuccgagugcaagaccggcaacggcaagaacuaccgcggcaccaccuccaagaccaaguccggcgucaucugccagaagugguccgucuccuccccccacauccccaaguacucccccgagaaguucccccucgccggccucgaggagaacuacugccgcaaccccgacaacgacgagaagggccccuggugcuacaccaccgaccccgagacccgcuucgacuacugcgacauccccgagugcgaggacgagugcaugcacugcuccggcgagcacuacgagggcaagaucuccaagaccauguccggcaucgagugccaguccuggggcucccaguccccccacgcccacggcuaccuccccuccaaguuccccaacaagaaccucaagaugaacuacugccgcaaccccgacggcgagccccgccccuggugcuucaccaccgaccccaacaagcgcugggaguucugcgacaucccccgcugcaccacccccccccccaccuccggccccaccuaccagugccucaagggccgcggcgagaacuaccgcggcaccgucuccgucaccgccuccggccacaccugccagcgcugguccgcccaguccccccacaagcacaaccgcacccccgagaacuuccccugcaagaaccucgaggagaacuacugccgcaaccccgacggcgagaccgcccccuggugcuacaccaccgacuccgagguccgcugggacuacugcaagauccccuccugcggcuccuccaccaccuccaccgagcaccucgacgcccccgucccccccgagcagacccccgucgcccaggacugcuaccgcggcaacggcgaguccuaccgcggcaccuccuccaccaccaucaccggccgcaagugccaguccugggucuccaugaccccccaccgccacgagaagacccccggcaacuuccccaacgccggccucaccaugaacuacugccgcaaccccgacgccgacaagucccccuggugcuacaccaccgacccccgcguccgcugggaguacugcaaccucaagaagugcuccgagaccgagcagcaggucaccaacuuccccgccaucgcccagguccccuccgucgaggaccucuccgaggacugcauguucggcaacggcaagcgcuaccgcggcaagcgcgccaccaccgucgccggcguccccugccaggagugggccgcccaggagccccaccgccacuccaucuucacccccgagaccaacccccgcgccggccucgagaagaacuacugccgcaaccccgacggcgacgacaacggccccuggugcuacaccaccaacccccagaagcucuucgacuacugcgacgucccccagugcgucaccuccuccuucgacugcggcaagcccaaggucgagcccaagaagugccccgcccgcgucgucggcggcugcgucuccaucccccacuccuggcccuggcagaucucccuccgcuaccgcuaccgcggccacuucugcggcggcacccucaucucccccgaguggguccucaccgccaagcacugccucgagaaguccuccucccccuccuccuacaaggucauccucggcgcccacgaggaguaccaccucggcgagggcguccaggagaucgacgucuccaagcucuucaaggagcccuccggcgccgacaucgcccuccucaagcucuccucccccgccgucaucaccgacaaggucauccccgccugccuccccacccccaacuacgucgucgccgaccgcaccgccugcuacaucaccggcuggggcgagaccaagggcaccuacggcgccggccuccucaaggaggcccgccuccccgucaucgagaacaaggucugcaaccgcuacgaguaccucggcggcaaggucucccccaacgagcucugcgccggccaccucgccggcggcaucgacuccugccagggcgacuccggcggcccccucgucugcuucgagaaggacaaguacauccuccagggcgucaccuccuggggccucggcugcgcccuccccaacaagcccggcgucuacguccgcgucucccgcuucgucaccuggaucgaggagaucaugcgccgcaacuga

SEQ ID NO: 7405 - RNA, 2430 nt, Artificial Sequence
  derived and/or modified sequence opt3 from Angiostatin__Homo_sapiens__AKG50977
auggaccacaaggaggugguccugcuccuucuguuguucuuaaaaagcggccugggggauucccuagacgauuacguuaacacccagggagccuuucucuucucucugucaagaaagcaaguggcugcaaggaguguagaagagugcgccgcgaaaugugaagcugagacaaauuuuaucugccgggccuuccaguaucauagcaaggaccagcaguguguggucauggcagaaaacuccaaaacuucucccauugcccgcaugcgagaugugguucuuuuugagaagcguauauaccugucggagugcaagacggguaauggcaaaaacuauagagggaccacaucaaagacuaaaagcggagugaucugucaaaaguggagugucuccucuccucacauuccaaaauacagcccggaaaaguuccccuuggcuggccucgaggaaaauuauugcaggaacccugacaaugaugagaaggguccaugguguuacaccacagaccccgagacccgguuugauuauugcgacaucccugaaugugaggaugaaugcaugcauuguuccggggagcacuacgaaggaaaaauuucaaagacuaugaguggcaucgagugccagagcuggggcucucaguccccacaugcacacggguaccugcccucaaaauucccuaacaagaaucugaaaaugaacuauugccgcaauccagacggagagccgagacccugguguuuuacaaccgauccuaacaagaggugggaguucugcgacauaccacgguguacgacucccccuccaaccagcggucccacauaccagugccucaaaggccgcggggaaaauuaucgaggaacugugaguguaaccgccucuggccacacaugucaaagaugguccgcucagagcccgcauaagcacaacaggaccccugaaaauuuucccugcaagaacuuagaggaaaacuacugucggaauccagacggugagacggccccuuggugcuauacuacagauucggagguucguugggacuacuguaaaauccccucuugcggguccucaaccacaaguacugaacaucuggaugcgccagugcccccugagcagaccccagucgcacaggacuguuaucgcggaaacggcgaaagcuacagaggcacguccucuaccacaauuacugggaggaagugccaaagcugggugucaaugaccccgcaccggcacgagaaaacacccggaaauuucccuaacgccggucuuacuaugaauuacugccgaaacccagaugcugacaagagucccugguguuauaccacagauccucgcgugagaugggaauacugcaauuugaaaaaguguuccgagaccgagcagcaggucacuaacuuuccagccaucgcacaaguucccagcguggaagaccugucugaggauugcauguucggcaaugggaagagguaucggggaaaacgcgcuacgacaguagccggcgugccgugucaggaaugggcggcccaggagccucauagacacucaauuuucaccccagagacuaaccccagggcaggucuagaaaagaauuacugccguaacccugacggggaugacaauggccccugguguuauaccacaaacccacagaaacucuuugacuacugcgaugucccucaaugugugaccaguagcuucgacugcggaaagcccaaaguugagccaaagaaguguccggcucggguggucggcgggugcguguccaucccucauucuuggcccuggcagauaucgcugcgauauagauacaggggacacuuuugcgguggcacucuuauuagcccagaauggguacugacagccaaacauuguuuggagaaguccucaagucccucuagcuacaaaguuauccucggggcucacgaagaguaucaccugggagagggcgugcaggaaauugaugucuccaaguuauucaaagagccuucaggugccgacaucgcacugcucaaacuuagcucuccagccgugaucacggauaaggucauucccgcuugccugccuaccccgaauuacgugguugcggaccgcacugcauguuauauaacaggguggggcgaaaccaagggaacauacggcgccggguugcuaaaggaggcucggcugccagugaucgaaaacaaaguaugcaacagauaugaguaccucggagguaaggucucccccaaugagcugugugccggccaucuugcagggggaauugauaguugccagggcgacagcggugggccucugguguguuuugaaaaagauaaguauaucuugcaaggcguuacuucuuggggacucggcugcgcccugccaaacaaacccgggguguacgucagggugucccgcuucguaaccuggauagaggaaauuaugcgacggaauuga

SEQ ID NO: 7406 - RNA, 2430 nt, Artificial Sequence
  derived and/or modified sequence opt4 from Angiostatin__Homo_sapiens__AKG50977
auggaccacaaggagguggugcugcugcugcugcuguuccugaagagcggccugggcgacagccuggacgacuacgugaacacccagggcgccuuccuguucagccugagcagaaagcagguggccgccagaagcguggaggagugcgccgccaagugcgaggccgagaccaacuucaucugcagagccuuccaguaccacagcaaggaccagcagugcguggugauggccgagaacagcaagaccagccccaucgccagaaugagagacguggugcuguucgagaagagaaucuaccugagcgagugcaagaccggcaacggcaagaacuacagaggcaccaccagcaagaccaagagcggcgugaucugccagaaguggagcgugagcagcccccacauccccaaguacagccccgagaaguucccccuggccggccuggaggagaacuacugcagaaaccccgacaacgacgagaagggccccuggugcuacaccaccgaccccgagaccagauucgacuacugcgacauccccgagugcgaggacgagugcaugcacugcagcggcgagcacuacgagggcaagaucagcaagaccaugagcggcaucgagugccagagcuggggcagccagagcccccacgcccacggcuaccugcccagcaaguuccccaacaagaaccugaagaugaacuacugcagaaaccccgacggcgagcccagacccuggugcuucaccaccgaccccaacaagagaugggaguucugcgacauccccagaugcaccacccccccccccaccagcggccccaccuaccagugccugaagggcagaggcgagaacuacagaggcaccgugagcgugaccgccagcggccacaccugccagagauggagcgcccagagcccccacaagcacaacagaacccccgagaacuuccccugcaagaaccuggaggagaacuacugcagaaaccccgacggcgagaccgcccccuggugcuacaccaccgacagcgaggugagaugggacuacugcaagauccccagcugcggcagcagcaccaccagcaccgagcaccuggacgcccccgugccccccgagcagacccccguggcccaggacugcuacagaggcaacggcgagagcuacagaggcaccagcagcaccaccaucaccggcagaaagugccagagcugggugagcaugaccccccacagacacgagaagacccccggcaacuuccccaacgccggccugaccaugaacuacugcagaaaccccgacgccgacaagagccccuggugcuacaccaccgaccccagagugagaugggaguacugcaaccugaagaagugcagcgagaccgagcagcaggugaccaacuuccccgccaucgcccaggugcccagcguggaggaccugagcgaggacugcauguucggcaacggcaagagauacagaggcaagagagccaccaccguggccggcgugcccugccaggagugggccgcccaggagccccacagacacagcaucuucacccccgagaccaaccccagagccggccuggagaagaacuacugcagaaaccccgacggcgacgacaacggccccuggugcuacaccaccaacccccagaagcuguucgacuacugcgacgugccccagugcgugaccagcagcuucgacugcggcaagcccaagguggagcccaagaagugccccgccagaguggugggcggcugcgugagcaucccccacagcuggcccuggcagaucagccugagauacagauacagaggccacuucugcggcggcacccugaucagccccgagugggugcugaccgccaagcacugccuggagaagagcagcagccccagcagcuacaaggugauccugggcgcccacgaggaguaccaccugggcgagggcgugcaggagaucgacgugagcaagcuguucaaggagcccagcggcgccgacaucgcccugcugaagcugagcagccccgccgugaucaccgacaaggugauccccgccugccugcccacccccaacuacgugguggccgacagaaccgccugcuacaucaccggcuggggcgagaccaagggcaccuacggcgccggccugcugaaggaggccagacugcccgugaucgagaacaaggugugcaacagauacgaguaccugggcggcaaggugagccccaacgagcugugcgccggccaccuggccggcggcaucgacagcugccagggcgacagcggcggcccccuggugugcuucgagaaggacaaguacauccugcagggcgugaccagcuggggccugggcugcgcccugcccaacaagcccggcguguacgugagagugagcagauucgugaccuggaucgaggagaucaugagaagaaacuga

SEQ ID NO: 7407 - RNA, 2430 nt, Artificial Sequence
  derived and/or modified sequence opt5 from Angiostatin__Homo_sapiens__AKG50977
auggaccacaaggaggugguccugcuccugcuucuguuccucaaaagcggccugggggauucccuugacgauuacguuaacacccagggagccuuucuguucucucucagcagaaagcaaguggcugcccgguccguggaagagugcgcggcuaaaugugaagccgagacaaauuuuaucugccgcgccuuccaguaucauucuaaggaccagcagugugucgugauggcugaaaacagcaaaacgucccccauugccagaaugcgggauguugugcuguuugagaagcgcaucuaccugucugagugcaagaccggcaaugggaaaaacuauagaggaacaaccagcaagacaaaauccggcgucauuugucaaaaguggagcgugucuuccccucacaucccgaaauacagccccgaaaaguucccucucgcugggcuggaggaaaauuauugccggaaccccgacaaugaugagaagggaccuugguguuacaccacagaccccgagacccgcuuugauuauugcgacauuccugaaugugaggaugaaugcaugcauuguucuggcgagcacuacgaaggcaaaaucuccaagacgaugagcgggaucgagugccagucuuggggaucccagagcccgcaugcccacggcuaccuucccuccaaauucccuaacaagaaucugaaaaugaacuauugcagaaaucccgacggggagccucggcccugguguuuuaccacagauccgaacaagcgcugggaguucugcgacauuccuagauguaccacacccccucccaccucuggacccacguaccagugccucaaaggccgcggggaaaauuaucggggaacaguuagcgugaccgcguccggccacacaugucaaagauggagcgcccagucuccucauaagcacaaccggaccccggaaaauuuucccugcaagaaccuggaggaaaacuacugucgcaauccugacggcgagaccgcucccuggugcuauacaacggauuccgaggucagaugggacuacuguaaaaucccuagcugcgggucuagcaccacauccaccgaacaucuugaugcccccgugccgccugagcagacacccguggcucaggacuguuaucggggaaacggcgaaucuuacagagggaccagcuccacgacaauuaccggacgcaagugccaaagcugggucucuaugaccccucaccggcacgagaaaacacccggcaauuucccuaacgccgggcugaccaugaauuacugcagaaaccccgaugcggacaaguccccgugguguuauacaacggauccucgcguucggugggaauacugcaaucucaaaaaguguagcgagaccgagcaacaggugacaaacuuucccgccaucgcucaggugcccucugucgaagaccuguccgaggauugcauguucggaaauggcaagagauaucgcggcaaacgggccaccacaguggcugggguuccuugucaggaaugggccgcccaggagccgcauagacacagcauuuucacccccgagacgaacccucgcgcuggacuggaaaagaauuacugccggaaccccgacggcgaugacaaugggccuugguguuauaccacaaacccccagaaacucuuugacuacugcgaugugccucaaugugucaccuccucuuucgacugcggaaagcccaaaguggagccgaagaaguguccugcgagaguugugggcgggugcgucagcaucccccauuccuggccuuggcagauuucucugcgcuaucgguacagaggccacuuuugcggaggcacacuuaucagccccgaaugggugcugaccgccaaacauugucucgagaaguccagcucuccguccagcuacaaagucauccugggggcucacgaagaguaucaccuuggagagggcgugcaggaaauugauguuucuaagcuguucaaagagccuuccggggccgacaucgcccuccugaagcugagcucucccgcugugauuacggauaaggucaucccugccugccuccccacacccaauuacgugguugcggaccggaccgcuuguuauauuacaggauggggcgaaaccaaagggaccuacggcgccggacugcuuaaggaggcccgccugccugugaucgaaaacaaagucugcaacagauaugaguaccucggcgggaaggugagcccgaaugagcugugugcuggacaucuugccggcgggaucgauuccugccagggagacagcggcgggccccugguguguuuugaaaaagauaaguauauucuccaaggcguuacaucuuggggacugggcugcgcucugccuaacaaacccggggucuacgugcggguguccagauucgucacguggaucgaggaaauuaugcgccggaauuga

SEQ ID NO: 7408 - RNA, 2430 nt, Artificial Sequence
  derived and/or modified sequence opt6 from Angiostatin__Homo_sapiens__AKG50977
auggaucauaaagagguaguauuacuauuguuacuauuuuuaaaauccggacuaggagacagucucgacgacuauguaaauacccagggugcauuucuauuuucauuaucaagaaaacaaguagcagcacgaagcguggaagaaugcgcagcuaaaugugaggcugaaacaaauuuuauauguagagcauuccaauaucauagcaaagaucaacaaugcguuguaauggccgaaaacucaaaaacaaguccuaucgcgagaaugagagauguaguacuuuucgaaaaaagaauuuaucuuagcgaauguaaaaccggaaauggcaaaaauuacagaggaacaacaucaaaaaccaaaagugguguuaucugucaaaaauggucuguaucuagcccacauauuccaaaauauucaccugaaaaauucccguuagcaggucuagaagagaauuauuguagaaauccugauaacgaugaaaaagguccauggugcuacacgacagaucccgaaacuagauucgauuacugugauauaccugaaugcgaagaugaguguaugcacugcucaggugaacauuacgaaggcaaaauuucaaaaacaaugucagguauagaaugucaaucauggggaucucaaucaccacacgcacaugguuauuuacccaguaaauucccaaauaaaaaucuaaaaaugaacuauuguagaaacccggacggugaacccagaccaugguguuuuacuacagauccaaacaaaagaugggaauuuugugauauaccaagauguacaacaccucccccuacaucaggaccuacauaucaauguuuaaaagggagaggagaaaacuauagagguacagucucaguaacagcaaguggacauacaugucaaagauggucagcacaaaguccccauaaacauaauagaacucccgaaaauuucccuugcaaaaaucuagaagaaaacuauugcagaaacccagacggagaaacagcaccguggugcuacacuacagacagugaaguaagaugggauuacuguaagauaccuucauguggaagcucaacuacaaguacagaacaccuagacgcaccuguuccaccugaacaaacuccggucgcacaagauuguuaucgcgguaauggagaaucauacagggguacaagcucaacuaccauaacaggcagaaaaugccaaaguuggguaaguaugacuccucaucgacacgaaaaaaccccaggaaauuuuccaaacgcaggacugacaaugaacuacugcagaaacccagaugccgauaaauccccaugguguuacacaacagauccgagaguacgaugggaguauuguaaccuuaaaaaauguagugaaacagaacaacaaguaacaaauuucccagcaauugcacaaguuccuucuguagaagaccuaucagaagauuguauguuuggcaacggaaaaagauaucgcgguaaaagagcaacaacaguagcaggcguaccaugucaagaaugggcugcucaagaaccacaccgacauaguauauucacgccagaaacaaaucccagagcuggcuuagagaaaaauuauuguagaaauccagauggagacgauaaugggcccugguguuauacaacaaauccucaaaaacuuuucgauuacugcgauguaccacaaugcguuacaucaucauuugacuguggaaaaccaaaaguggaaccuaagaaauguccagcaagaguaguaggaggcuguguaucgauaccacacucauggccauggcagauuagucuaagauauagguacagaggucauuucuguggaggaacccuaauuaguccagaauggguccuaacagcaaaacauugucuggaaaaaucuagcagucccucuagcuacaaaguaauacucggugcccacgaagaauaucacuuaggagaagguguccaagaaauugauguaucaaaacuauucaaagaaccaagcggcgcagauauagcauuauuaaaacuaaguagcccugcagucauaaccgauaaagucauaccugcaugucuaccaaccccaaauuauguaguagcagauagaacugcuuguuacauaacaggcuggggugaaaccaaaggaacauauggagccggacuacuaaaagaagccagguuaccaguaauugaaaauaaaguauguaacagauaugaauaucuaggaggaaaaguaucaccaaacgaauuaugugcaggacaccuagcgggaggaauugauucaugccaaggugauucagguggaccauuaguauguuucgaaaaagauaaauacauauuacaaggaguaacaucauggggucugggaugcgcauuaccaaauaagccagguguuuaugucagagucucucgcuuuguaacuuggauagaagaaauaaugaggagaaauuaa

SEQ ID NO: 7409 - protein, 810 aa, Artificial Sequence
  Angiostatin__Homo_sapiens__P00747
MEHKEVVLLLLLFLKSGQGEPLDDYVNTQGASLFSVTKKQLGAGSIEECAAKCEEDEEFTCRAFQYHSKEQQCVIMAENRKSSIIIRMRDVVLFEKKVYLSECKTGNGKNYRGTMSKTKNGITCQKWSSTSPHRPRFSPATHPSEGLEENYCRNPDNDPQGPWCYTTDPEKRYDYCDILECEEECMHCSGENYDGKISKTMSGLECQAWDSQSPHAHGYIPSKFPNKNLKKNYCRNPDRELRPWCFTTDPNKRWELCDIPRCTTPPPSSGPTYQCLKGTGENYRGNVAVTVSGHTCQHWSAQTPHTHNRTPENFPCKNLDENYCRNPDGKRAPWCHTTNSQVRWEYCKIPSCDSSPVSTEQLAPTAPPELTPVVQDCYHGDGQSYRGTSSTTTTGKKCQSWSSMTPHRHQKTPENYPNAGLTMNYCRNPDADKGPWCFTTDPSVRWEYCNLKKCSGTEASVVAPPPVVLLPDVETPSEEDCMFGNGKGYRGKRATTVTGTPCQDWAAQEPHRHSIFTPETNPRAGLEKNYCRNPDGDVGGPWCYTTNPRKLYDYCDVPQCAAPSFDCGKPQVEPKKCPGRVVGGCVAHPHSWPWQVSLRTRFGMHFCGGTLISPEWVLTAAHCLEKSPRPSSYKVILGAHQEVNLEPHVQEIEVSRLFLEPTRKDIALLKLSSPAVITDKVIPACLPSPNYVVADRTECFITGWGETQGTFGAGLLKEAQLPVIENKVCNRYEFLNGRVQSTELCAGHLAGGTDSCQGDSGGPLVCFEKDKYILQGVTSWGLGCARPNKPGVYVRVSRFVTWIEGVMRNN

SEQ ID NO: 7410 - RNA, 2433 nt, Artificial Sequence
  Angiostatin__Homo_sapiens__AAN85555
auggaacauaaggaagugguucuucuacuucuuuuauuucugaaaucaggucaaggagagccucuggaugacuaugugaauacccagggggcuucacuguucagugucacuaagaagcagcugggagcaggaaguauagaagaaugugcagcaaaaugugaggaggacgaagaauucaccugcagggcauuccaauaucacaguaaagagcaacaaugugugauaauggcugaaaacaggaaguccuccauaaucauuaggaugagagauguaguuuuauuugaaaagaaaguguaucucucagagugcaagacugggaauggaaagaacuacagagggacgauguccaaaacaaaaaauggcaucaccugucaaaaauggaguuccacuucuccccacagaccuagauucucaccugcuacacaccccucagagggacuggaggagaacuacugcaggaauccagacaacgauccgcaggggcccuggugcuauacuacugauccagaaaagagauaugacuacugcgacauucuugagugugaagaggaauguaugcauugcaguggagaaaacuaugacggcaaaauuuccaagaccaugucuggacuggaaugccaggccugggacucucagagcccacacgcucauggauacauuccuuccaaauuuccaaacaagaaccugaagaagaauuacugucguaaccccgauagggagcugcggccuugguguuucaccaccgaccccaacaagcgcugggaacuuugcgacaucccccgcugcacaacaccuccaccaucuucuggucccaccuaccagugucugaagggaacaggugaaaacuaucgcgggaauguggcuguuaccguguccgggcacaccugucagcacuggagugcacagaccccucacacacauaacaggacaccagaaaacuuccccugcaaaaauuuggaugaaaacuacugccgcaauccugacggaaaaagggccccauggugccauacaaccaacagccaagugcggugggaguacuguaagauaccguccugugacuccuccccaguauccacggaacaauuggcucccacagcaccaccugagcuaaccccugugguccaggacugcuaccauggugauggacagagcuaccgaggcacauccuccaccaccaccacaggaaagaagugucagucuuggucaucuaugacaccacaccggcaccagaagaccccagaaaacuacccaaaugcuggccugacaaugaacuacugcaggaauccagaugccgauaaaggccccugguguuuuaccacagaccccagcgucaggugggaguacugcaaccugaaaaaaugcucaggaacagaagcgaguguuguagcaccuccgccuguuguccugcuuccagauguagagacuccuuccgaagaagacuguauguuugggaaugggaaaggauaccgaggcaagagggcgaccacuguuacugggacgccaugccaggacugggcugcccaggagccccauagacacagcauuuucacuccagagacaaauccacgggcgggucuggaaaaaaauuacugccguaacccugauggugauguagguggucccuggugcuacacgacaaauccaagaaaacuuuacgacuacugugaugucccucagugugcggccccuucauuugauugugggaagccucaaguggagccgaagaaauguccuggaaggguuguagggggguguguggcccacccacauuccuggcccuggcaagucagucuuagaacaagguuuggaaugcacuucuguggaggcaccuugauauccccagaguggguguugacugcugcccacugcuuggagaaguccccaaggccuucauccuacaaggucauccugggugcacaccaagaagugaaucucgaaccgcauguucaggaaauagaagugucuaggcuguucuuggagcccacacgaaaagauauugccuugcuaaagcuaagcaguccugccgucaucacugacaaaguaaucccagcuugucugccauccccaaauuauguggucgcugaccggaccgaauguuucaucacuggcuggggagaaacccaagguacuuuuggagcuggccuucucaaggaagcccagcucccugugauugagaauaaagugugcaaucgcuaugaguuucugaauggaagaguccaauccaccgaacucugugcugggcauuuggccggaggcacugacaguugccagggugacaguggagggccucugguuugcuucgagaaggacaaauacauuuuacaaggagucacuucuuggggucuuggcugugcacgccccaauaagccuggugucuauguucguguuucaagguuuguuacuuggauugagggagugaugagaaauaauuaa

SEQ ID NO: 7411 - RNA, 2433 nt, Artificial Sequence
  derived and/or modified sequence opt1 from Angiostatin__Homo_sapiens__AAN85555
auggagcacaaggaggugguccugcuccugcugcuguuccucaagagcggccagggggagccccuggacgacuacgugaacacccagggcgccucccucuucagcgugaccaagaagcagcugggggccggcuccaucgaggagugcgcggccaagugcgaggaggacgaggaguucacgugccgcgccuuccaguaccacagcaaggagcagcagugcgucaucauggccgagaaccggaaguccagcaucaucauccgcaugcgggacguggugcuguucgagaagaaggucuaccucuccgagugcaagaccgggaacggcaagaacuaccgcggcaccaugagcaagaccaagaacgggaucacgugccagaagugguccagcaccuccccgcaccggccccgcuucagccccgccacccaccccuccgagggccuggaggagaacuacugccggaacccggacaacgacccccaggggcccuggugcuacaccacggaccccgagaagcgcuacgacuacugcgacauccuggagugcgaggaggagugcaugcacugcagcggcgagaacuacgacgggaagaucuccaagaccaugagcggccucgagugccaggcgugggacucccagagcccgcacgcccacggcuacauccccuccaaguuccccaacaagaaccugaagaagaacuacugccggaaccccgaccgcgagcugcggccguggugcuucaccaccgaccccaacaagcgcugggagcucugcgacaucccccggugcacgacgcccccgcccagcagcgggcccaccuaccagugccucaagggcaccggggagaacuaccgcggcaacguggccgugaccgucuccggccacacgugccagcacuggagcgcccagacgccccacacccacaaccggaccccggagaacuuccccugcaagaaccuggacgagaacuacugccgcaaccccgacgggaagcgggcgcccuggugccacaccaccaacucccaggugcgcugggaguacugcaagaucccgagcugcgacuccagccccguguccaccgagcagcuggcccccaccgcgcccccggagcugacccccgucgugcaggacugcuaccacggcgacgggcagagcuaccggggcaccuccagcaccacgaccaccgggaagaagugccaguccuggagcuccaugacgccccaccgccaccagaagaccccggagaacuaccccaacgccggccugaccaugaacuacugccggaaccccgacgccgacaagggccccuggugcuucaccaccgacccgagcgugcgcugggaguacugcaaccucaagaagugcuccgggacggaggccagcgucguggccccgccgcccgugguccugcugcccgacguggagacccccuccgaggaggacugcauguucggcaacgggaagggcuaccgcgggaagcgggccaccaccgugaccggcacgcccugccaggacugggccgcccaggagccccaccgccacagcaucuucacccccgagaccaacccccgggcgggccucgagaagaacuacugccgcaaccccgacggggacgucggcgggcccuggugcuacaccacgaacccgcggaagcuguacgacuacugcgacgugccccagugcgccgcccccuccuucgacugcggcaagccccagguggagccgaagaagugccccgggcgcgucgugggcggcugcgucgcccacccccacagcuggcccuggcaggucagccugcggacccgcuucgggaugcacuucugcggcgggacccucaucuccccggagugggugcugaccgccgcgcacugccuggagaaguccccgcggcccagcagcuacaaggugauccucggcgcccaccaggaggugaaccuggagccccacgugcaggagaucgaggucucccgccuguuccucgagcccacgcggaaggacaucgcccugcugaagcucagcucccccgccgugaucaccgacaaggugauccccgccugccugccgagccccaacuacgucguggcggaccgcaccgagugcuucaucaccggcuggggcgagacgcaggggaccuucggggccggccugcucaaggaggcccagcugcccgugaucgagaacaaggucugcaaccgguacgaguuccugaacgggcgcgugcaguccaccgagcucugcgccggccaccuggcgggcgggaccgacagcugccagggcgacuccgggggcccccuggugugcuucgagaaggacaaguacauccuccagggggucacgagcuggggccugggcugcgcccggccgaacaagcccgggguguacgugcgcgucucccgguucgugaccuggaucgagggcgugaugcgcaacaacuga

SEQ ID NO: 7412 - RNA, 2433 nt, Artificial Sequence
  derived and/or modified sequence opt2 from Angiostatin__Homo_sapiens__AAN85555
auggagcacaaggaggucguccuccuccuccuccucuuccucaaguccggccagggcgagccccucgacgacuacgucaacacccagggcgccucccucuucuccgucaccaagaagcagcucggcgccggcuccaucgaggagugcgccgccaagugcgaggaggacgaggaguucaccugccgcgccuuccaguaccacuccaaggagcagcagugcgucaucauggccgagaaccgcaaguccuccaucaucauccgcaugcgcgacgucguccucuucgagaagaaggucuaccucuccgagugcaagaccggcaacggcaagaacuaccgcggcaccauguccaagaccaagaacggcaucaccugccagaagugguccuccaccuccccccaccgcccccgcuucucccccgccacccaccccuccgagggccucgaggagaacuacugccgcaaccccgacaacgacccccagggccccuggugcuacaccaccgaccccgagaagcgcuacgacuacugcgacauccucgagugcgaggaggagugcaugcacugcuccggcgagaacuacgacggcaagaucuccaagaccauguccggccucgagugccaggccugggacucccaguccccccacgcccacggcuacauccccuccaaguuccccaacaagaaccucaagaagaacuacugccgcaaccccgaccgcgagcuccgccccuggugcuucaccaccgaccccaacaagcgcugggagcucugcgacaucccccgcugcaccacccccccccccuccuccggccccaccuaccagugccucaagggcaccggcgagaacuaccgcggcaacgucgccgucaccgucuccggccacaccugccagcacugguccgcccagaccccccacacccacaaccgcacccccgagaacuuccccugcaagaaccucgacgagaacuacugccgcaaccccgacggcaagcgcgcccccuggugccacaccaccaacucccagguccgcugggaguacugcaagauccccuccugcgacuccucccccgucuccaccgagcagcucgcccccaccgccccccccgagcucacccccgucguccaggacugcuaccacggcgacggccaguccuaccgcggcaccuccuccaccaccaccaccggcaagaagugccaguccugguccuccaugaccccccaccgccaccagaagacccccgagaacuaccccaacgccggccucaccaugaacuacugccgcaaccccgacgccgacaagggccccuggugcuucaccaccgaccccuccguccgcugggaguacugcaaccucaagaagugcuccggcaccgaggccuccgucgucgcccccccccccgucguccuccuccccgacgucgagacccccuccgaggaggacugcauguucggcaacggcaagggcuaccgcggcaagcgcgccaccaccgucaccggcacccccugccaggacugggccgcccaggagccccaccgccacuccaucuucacccccgagaccaacccccgcgccggccucgagaagaacuacugccgcaaccccgacggcgacgucggcggccccuggugcuacaccaccaacccccgcaagcucuacgacuacugcgacgucccccagugcgccgcccccuccuucgacugcggcaagccccaggucgagcccaagaagugccccggccgcgucgucggcggcugcgucgcccacccccacuccuggcccuggcaggucucccuccgcacccgcuucggcaugcacuucugcggcggcacccucaucucccccgaguggguccucaccgccgcccacugccucgagaaguccccccgccccuccuccuacaaggucauccucggcgcccaccaggaggucaaccucgagccccacguccaggagaucgaggucucccgccucuuccucgagcccacccgcaaggacaucgcccuccucaagcucuccucccccgccgucaucaccgacaaggucauccccgccugccuccccucccccaacuacgucgucgccgaccgcaccgagugcuucaucaccggcuggggcgagacccagggcaccuucggcgccggccuccucaaggaggcccagcuccccgucaucgagaacaaggucugcaaccgcuacgaguuccucaacggccgcguccaguccaccgagcucugcgccggccaccucgccggcggcaccgacuccugccagggcgacuccggcggcccccucgucugcuucgagaaggacaaguacauccuccagggcgucaccuccuggggccucggcugcgcccgccccaacaagcccggcgucuacguccgcgucucccgcuucgucaccuggaucgagggcgucaugcgcaacaacuga

SEQ ID NO: 7413 - RNA, 2433 nt, Artificial Sequence
  derived and/or modified sequence opt3 from Angiostatin__Homo_sapiens__AAN85555
auggagcacaaggaagugguccugcuccuucuguuguucuuaaaaagcggccagggggagccccuggacgauuacguuaacacccaaggagccucccuauuuucugugacaaagaaacagcucggugcuggcucaaucgaagagugcgcagccaagugugaagaggacgaggaguucacuugcagagcguuucaguaucauaguaaagaacagcaauguguaauuauggcugaaaauaggaaaagcuccauaaucauucggaugcgcgaugugguccuguucgagaagaaaguguaccuuucugagugcaagacggggaacggaaagaauuaucgaggcaccaugucgaagaccaaaaacgguaucacuugucagaaguggucaagcaccaguccucaccguccaagauuuuccccggccacacaucccucugaagggcuggaggaaaauuacugcaggaacccugacaaugauccacagggacccugguguuauaccacugacccugagaagcgguacgauuauugcgacauuuuggaaugugaggaggaaugcaugcacuguagcggcgagaacuacgauggcaaaaucuccaagacaaugucagggcucgaaugccaggcaugggacagucaaagcccacaugcccacggauacauacccucuaaauucccuaauaagaaccugaaaaagaauuauugccgcaacccagauagagagcugaggccgugguguuuuaccacggaccccaauaaacggugggaacucugcgauaucccucgcuguacuaccccacccccuuccucagguccaacauaccagugcuuaaagggcacuggggagaacuaucgaggaaauguugcugugaccgucagcggccacacaugucagcauuggagugcacagacaccccacacgcauaacagaacuccggagaacuucccuugcaagaaucuggacgaaaacuacuguaggaaucccgacgguaaacgggccccauggugccacacaaccaacucucaagugcguugggaguauuguaagauuccuuccugcgauagcucgcccguaucuacugaacagcuugcuccaacagccccuccugaguugaccccaguugugcaggacuguuaccacggggauggacaauccuaucgcggcacgucaaguaccacaacuaccggcaaaaagugccagagcugguccucuaugacaccgcauagacaccagaaaacucccgaaaauuacccuaacgcggggcugaccaugaauuacugcaggaacccagacgcagauaagggacccugguguuuuacaaccgacccuagcguccggugggaguauugcaaucuaaagaaauguucagguacugaggccagugugguggcuccacccccggucguucuccugccugauguggaaacgccauccgaggaagacugcauguucggcaacgggaagggauaccgaggcaaacgcgccacaaccguaacugguacccccugucaggauugggcagcucaagagccucauagacacagcaucuuuacacccgagaccaauccaagggccgggcuugaaaagaacuauugccggaauccugacggcgaugugggaggccccugguguuacacuacaaacccacgcaaacuguaugacuacugcgacgucccgcagugugcggccccuucuuucgauugcgggaagccccagguggagccaaagaaaugucccggaagaguuguggguggcugcgucgcacauccucacucauggccauggcaagugaguuugaggacgcguuuugggaugcacuucugcggaggcacccucauuagccccgaauggguacugacugcugcccauuguuuagagaaguccccucggccgucuucguauaaaguuauccugggugcucaccaggaagugaaucucgagccacauguccaggagauagaagugagccgacuuuuccuggagcccacaagaaaggacauugccuugcuaaaacuguccucacccgcagucaucaccgauaaggugauuccagccugccuccccaguccuaacuacguuguggcugacaggacagaauguuuuaucacuggguggggcgagacccagggaacguucggcgcggggcugcuuaaggaagcacagcugccgguaaucgagaacaaagucugcaaucgcuacgaguuuuugaacggacgggugcaaucuaccgaacucugugccggucaccuggcuggcgggacagauagcugccagggagacuccggcggucccuuaguuuguuucgagaaggauaaauauauucugcagggggugacuucauggggccuaggaugcgccagaccaaauaagccuggcgucuacgugaggguaagccgcuuugugaccuggauagaagggguuaugcgaaacaauuga

SEQ ID NO: 7414 - RNA, 2433 nt, Artificial Sequence
  derived and/or modified sequence opt4 from Angiostatin__Homo_sapiens__AAN85555
auggagcacaaggagguggugcugcugcugcugcuguuccugaagagcggccagggcgagccccuggacgacuacgugaacacccagggcgccagccuguucagcgugaccaagaagcagcugggcgccggcagcaucgaggagugcgccgccaagugcgaggaggacgaggaguucaccugcagagccuuccaguaccacagcaaggagcagcagugcgugaucauggccgagaacagaaagagcagcaucaucaucagaaugagagacguggugcuguucgagaagaagguguaccugagcgagugcaagaccggcaacggcaagaacuacagaggcaccaugagcaagaccaagaacggcaucaccugccagaaguggagcagcaccagcccccacagacccagauucagccccgccacccaccccagcgagggccuggaggagaacuacugcagaaaccccgacaacgacccccagggccccuggugcuacaccaccgaccccgagaagagauacgacuacugcgacauccuggagugcgaggaggagugcaugcacugcagcggcgagaacuacgacggcaagaucagcaagaccaugagcggccuggagugccaggccugggacagccagagcccccacgcccacggcuacauccccagcaaguuccccaacaagaaccugaagaagaacuacugcagaaaccccgacagagagcugagacccuggugcuucaccaccgaccccaacaagagaugggagcugugcgacauccccagaugcaccacccccccccccagcagcggccccaccuaccagugccugaagggcaccggcgagaacuacagaggcaacguggccgugaccgugagcggccacaccugccagcacuggagcgcccagaccccccacacccacaacagaacccccgagaacuuccccugcaagaaccuggacgagaacuacugcagaaaccccgacggcaagagagcccccuggugccacaccaccaacagccaggugagaugggaguacugcaagauccccagcugcgacagcagccccgugagcaccgagcagcuggcccccaccgccccccccgagcugacccccguggugcaggacugcuaccacggcgacggccagagcuacagaggcaccagcagcaccaccaccaccggcaagaagugccagagcuggagcagcaugaccccccacagacaccagaagacccccgagaacuaccccaacgccggccugaccaugaacuacugcagaaaccccgacgccgacaagggccccuggugcuucaccaccgaccccagcgugagaugggaguacugcaaccugaagaagugcagcggcaccgaggccagcgugguggcccccccccccguggugcugcugcccgacguggagacccccagcgaggaggacugcauguucggcaacggcaagggcuacagaggcaagagagccaccaccgugaccggcacccccugccaggacugggccgcccaggagccccacagacacagcaucuucacccccgagaccaaccccagagccggccuggagaagaacuacugcagaaaccccgacggcgacgugggcggccccuggugcuacaccaccaaccccagaaagcuguacgacuacugcgacgugccccagugcgccgcccccagcuucgacugcggcaagccccagguggagcccaagaagugccccggcagaguggugggcggcugcguggcccacccccacagcuggcccuggcaggugagccugagaaccagauucggcaugcacuucugcggcggcacccugaucagccccgagugggugcugaccgccgcccacugccuggagaagagccccagacccagcagcuacaaggugauccugggcgcccaccaggaggugaaccuggagccccacgugcaggagaucgaggugagcagacuguuccuggagcccaccagaaaggacaucgcccugcugaagcugagcagccccgccgugaucaccgacaaggugauccccgccugccugcccagccccaacuacgugguggccgacagaaccgagugcuucaucaccggcuggggcgagacccagggcaccuucggcgccggccugcugaaggaggcccagcugcccgugaucgagaacaaggugugcaacagauacgaguuccugaacggcagagugcagagcaccgagcugugcgccggccaccuggccggcggcaccgacagcugccagggcgacagcggcggcccccuggugugcuucgagaaggacaaguacauccugcagggcgugaccagcuggggccugggcugcgccagacccaacaagcccggcguguacgugagagugagcagauucgugaccuggaucgagggcgugaugagaaacaacuga

SEQ ID NO: 7415 - RNA, 2433 nt, Artificial Sequence
  derived and/or modified sequence opt5 from Angiostatin__Homo_sapiens__AAN85555
auggagcacaaggaagugguccugcuccugcuucuguuccucaaaagcggccagggggagccccuggacgauuacguuaacacccaaggagccucccucuuuucugugacaaagaaacagcugggcgcugggagcaucgaagagugcgccgcgaagugugaagaggacgaggaguucacgugcagagcuuuucaguaucauuccaaagagcagcaaugugugauuauggccgaaaaucggaagucuagcaucauuauccgcaugagagaugucgugcuuuucgagaagaaaguuuaccuguccgagugcaagaccggaaacggcaaaaauuaucgggggacaaugucuaagaccaaaaacggaauuacaugucagaaguggagcuccaccagcccucaccgcccgagauuuucucccgccacacauccuuccgaaggccuggaggaaaauuacugccggaaccccgacaaugauccucagggccccugguguuauaccacggacccugagaagcgcuacgauuauugcgacauccucgaaugugaggaggaaugcaugcacuguagcggggagaacuacgauggaaaaaucucuaagaccauguccggccuggaaugccaggcuugggacagccaaucuccgcaugcccacggguacauucccuccaaauucccuaauaagaaccuuaaaaagaauuauugcagaaaccccgaucgggagcugcgcccuugguguuuuacaaccgaccccaauaaaagaugggaacucugcgauaucccgcgguguacaaccccucccccuagcuccggacccacguaccagugccugaagggcacaggggagaacuaucgcggaaauguggcugucaccgugucuggccacacaugucagcauuggagcgcccagacaccccacacccauaacagaaccccugagaacuucccgugcaagaaucuugacgaaaacuacugucggaaucccgacggcaaacgcgcgccuuggugccacacgaccaacucccaaguuagaugggaguauuguaagauucccagcugcgauucuuccccugugagcacagaacagcuggcccccaccgcuccgccugagcucacacccgucgugcaggacuguuaccacggggauggacaaucuuaucggggcaccagcuccacgacaaccaccgggaaaaagugccagucuuggagcuccaugacaccucauagacaccagaaaacccccgaaaauuacccuaacgccggacugacaaugaauuacugccgcaaccccgacgcugauaagggcccgugguguuuuacgaccgacccuagcgugcggugggaguauugcaaucugaagaaauguucugggacagaggccuccgucguugcgcccccucccguggugcuccugccggaugucgaaacccccagcgaggaagacugcauguucggaaacggcaagggcuacagagggaaacgcgccacaaccgugacgggaaccccuugucaggauugggcugcccaagagccccaucggcacucuaucuuuacaccugagaccaaucccagagcuggccuugaaaagaacuauugccgcaauccugacggggauguuggaggccccugguguuacacaaccaacccgcggaaacuguaugacuacugcgacgugccucagugugccgcccccuccuucgauugcgggaagccucaggucgagcccaagaaauguccgggcagagugguuggaggcugcguggcucauccucacagcuggcccuggcaggucucccuccgcacgcgguuugggaugcacuucugcggaggcacacugauuucuccugaaugggugcuuaccgcggcccauugucuggaaaagagccccagacccuccucuuauaaagucauccucggggcucaccaagaagugaaucuggagccucauguucaggagauugaagugagccgccuguuccucgagccgacacggaaggacaucgcccugcuuaaacuguccagccccgccgucaucaccgauaaggugauuccugcuugccuccccucuccuaacuacguuguggccgacagaaccgaauguuuuaucacaggauggggcgagacgcaggggaccuucggcgcgggacugcuuaaggaagcucagcugcccgucauugagaacaaagugugcaaucgguacgaguuucucaacggccgcgugcaauccacagaacugugugccgggcaccuggccggaggcaccgauagcugccagggggacucuggaggcccucucguuuguuucgagaaggauaaauauauccugcagggggucacauccuggggccuuggaugcgcuagaccgaauaagcccggcguguacgugcgggucagcagauuugugaccuggauugaagggguuaugcgcaacaauuga

SEQ ID NO: 7416 - RNA, 2433 nt, Artificial Sequence
  derived and/or modified sequence opt6 from Angiostatin__Homo_sapiens__AAN85555
auggaacauaaagaaguuguauuauuacuauuauuauuuuuaaaaucuggucaaggagaaccauuagacgauuauguaaauacccagggagcuucauuauucagugucacgaaaaaacaacuuggagcaggcucaauagaagaaugcgcugcuaaaugcgaagaagacgaagaauuuacaugcagggcauuucaauaucauagcaaagaacaacaauguguaaucauggcagaaaaucgaaaaucuucaauaauaauaagaaugagagauguaguauuauucgaaaaaaaaguauacuuauccgaaugcaaaaccggaaacggaaaaaauuacagaggaacaaugaguaaaacuaaaaacgguauuacaugucaaaaauggucuaguaccucaccacauagacccagauuuaguccagcaacacacccaucagaaggccuagaagaaaauuacugcagaaaucccgauaaugacccucaaggcccuuggugcuacacaacugacccugaaaaacgauacgauuauugcgacauacucgaaugcgaagaagaauguaugcauugcuccggagaaaacuaugaugguaaaauaucaaagacaaugucuggguuagaaugccaagcaugggauucacaauccccucaugcacauggauauauaccaaguaaauucccuaacaaaaaucuaaagaaaaacuacuguagaaauccagacagagaguuaagaccaugguguuuuacuacagauccuaauaaaagaugggaauuaugcgauauaccuagaugcacaacaccaccucccaguucugguccaacuuaccaaugcuuaaaaggaacaggugaaaacuacagagguaauguagcuguuacaguaucaggacauacaugucaacacuggagcgcucaaacuccacauacucauaacagaacaccugaaaauuuuccuuguaaaaaucuagaugaaaauuauuguaggaaucccgauggaaaacgagcuccguggugucacacaaccaauucacaagugagaugggaauauugcaaaauaccgucaugugauucauccccaguaucuacugaacaacuagcgccuacagcccccccagaauuaacuccagucguacaagauuguuaucacggagaugggcaaucauacagaggaacaucaaguacaacaaccaccggcaaaaaaugucaaucauggucuucaaugaccccgcauagacaucaaaagacgccagaaaauuacccaaaugccggauuaaccaugaauuauugcagaaaucccgaugcugauaaagguccauggugcuucacaacagauccaucaguacgaugggaauacuguaaucuaaagaaaugcaguggaaccgaagccucgguuguagcaccaccaccagugguauuacuaccugauguugaaacaccuagcgaagaagauuguauguuuggaaauggaaaaggcuaucgaggaaaaagagcgacaacuguaacaggaacuccgugucaagauugggcugcacaggaaccacauagacacucaauuuuuacaccugaaacaaauccaagagcaggcuuagaaaaaaauuacuguagaaacccugacggugauguaggaggaccaugguguuauacaacuaauccucgaaaacuauacgacuacugugacguuccucaaugcgcugcucccucauucgacuguggaaaaccacaaguagaaccaaaaaaauguccaggcagaguagucggagguugcguagcacacccgcacucauggccuuggcaaguaucauuaagaacaagauuuggcaugcacuuuuguggugggacauuaauauccccagaauggguauuaacagcugcccauugcuuagagaaaucuccaagaccaucaucauacaaggugauauuaggugcacaucaagaaguaaaucucgagccacacgugcaagagauagaaguaaguagacuauuuuuagaaccaacaagaaaagauauagcacuauuaaaacucucuucgccagccgucauuaccgauaaaguuauaccugcuuguuuaccaagucccaauuauguagucgcagauagaacugaauguuuuauuacaggauggggggaaacacaagguacuuuuggugcugggcuacuuaaagaagcucaacuuccaguuauagaaaauaaaguauguaaucgauaugaauuucuuaauggaagaguacaaucaacagaauuaugcgcaggucaucuagcaggcggaacagacucaugccaaggagacaguggcgguccacucguauguuuugaaaaagauaaauauauacuucaaggugucacaucauggggauugggaugugcucgaccaaauaaaccagguguauaugucagaguauccagauucguaacauggauagaaggugucaugagaaauaacuaa

SEQ ID NO: 7417 - protein, 136 aa, Artificial Sequence
  Angiostatin__Homo_sapiens__Q5TEH5
MEHKEVVLLLLLFLKSGQGEPLDDYVNTQGASLFSVTKKQLGAGSIEECAAKCEEDEEFTCRAFQYHSKEQQCVIMAENRKSSIIIRMRDVVLFEKKVYLSECKTGNGKNYRGTMSKTKNGITCQKWSSTSPHRPR

SEQ ID NO: 7418 - RNA, 411 nt, Artificial Sequence
  Angiostatin__Homo_sapiens__EAW47592
auggaacauaaggaagugguucuucuacuucuuuuauuucugaaaucaggucaaggagagccucuggaugacuaugugaauacccagggggcuucacuguucagugucacuaagaagcagcugggagcaggaaguauagaagaaugugcagcaaaaugugaggaggacgaagaauucaccugcagggcauuccaauaucacaguaaagagcaacaaugugugauaauggcugaaaacaggaaguccuccauaaucauuaggaugagagauguaguuuuauuugaaaagaaaguguaucucucagagugcaagacugggaauggaaagaacuacagagggacgauguccaaaacaaaaaauggcaucaccugucaaaaauggaguuccacuucuccccacagaccuagguaa

SEQ ID NO: 7419 - RNA, 411 nt, Artificial Sequence
  derived and/or modified sequence opt1 from Angiostatin__Homo_sapiens__EAW47592
auggagcacaaggaggugguccugcuccugcugcuguuccucaagagcggccagggggagccccuggacgacuacgugaacacccagggcgccucccucuucagcgugaccaagaagcagcugggggccggcuccaucgaggagugcgcggccaagugcgaggaggacgaggaguucacgugccgcgccuuccaguaccacagcaaggagcagcagugcgucaucauggccgagaaccggaaguccagcaucaucauccgcaugcgggacguggugcuguucgagaagaaggucuaccucuccgagugcaagaccgggaacggcaagaacuaccgcggcaccaugagcaagaccaagaacgggaucacgugccagaagugguccagcaccuccccgcaccggccccgcuga

SEQ ID NO: 7420 - RNA, 411 nt, Artificial Sequence
  derived and/or modified sequence opt2 from Angiostatin__Homo_sapiens__EAW47592
auggagcacaaggaggucguccuccuccuccuccucuuccucaaguccggccagggcgagccccucgacgacuacgucaacacccagggcgccucccucuucuccgucaccaagaagcagcucggcgccggcuccaucgaggagugcgccgccaagugcgaggaggacgaggaguucaccugccgcgccuuccaguaccacuccaaggagcagcagugcgucaucauggccgagaaccgcaaguccuccaucaucauccgcaugcgcgacgucguccucuucgagaagaaggucuaccucuccgagugcaagaccggcaacggcaagaacuaccgcggcaccauguccaagaccaagaacggcaucaccugccagaagugguccuccaccuccccccaccgcccccgcuga

SEQ ID NO: 7421 - RNA, 411 nt, Artificial Sequence
  derived and/or modified sequence opt3 from Angiostatin__Homo_sapiens__EAW47592
auggagcacaaggaagugguccugcuccuucuguuguucuuaaaaagcggccagggggagccccuggacgauuacguuaacacccaaggagccucccuauuuucugugacaaagaaacagcucggugcuggcucaaucgaagagugcgcagccaagugugaagaggacgaggaguucacuugcagagcguuucaguaucauaguaaagaacagcaauguguaauuauggcugaaaauaggaaaagcuccauaaucauucggaugcgcgaugugguccuguucgagaagaaaguguaccuuucugagugcaagacggggaacggaaagaauuaucgaggcaccaugucgaagacuaaaaacgguaucacaugucagaaguggucaagcaccaguccucaccguccaagauga

SEQ ID NO: 7422 - RNA, 411 nt, Artificial Sequence
  derived and/or modified sequence opt4 from Angiostatin__Homo_sapiens__EAW47592
auggagcacaaggagguggugcugcugcugcugcuguuccugaagagcggccagggcgagccccuggacgacuacgugaacacccagggcgccagccuguucagcgugaccaagaagcagcugggcgccggcagcaucgaggagugcgccgccaagugcgaggaggacgaggaguucaccugcagagccuuccaguaccacagcaaggagcagcagugcgugaucauggccgagaacagaaagagcagcaucaucaucagaaugagagacguggugcuguucgagaagaagguguaccugagcgagugcaagaccggcaacggcaagaacuacagaggcaccaugagcaagaccaagaacggcaucaccugccagaaguggagcagcaccagcccccacagacccagauga

SEQ ID NO: 7423 - RNA, 411 nt, Artificial Sequence
  derived and/or modified sequence opt5 from Angiostatin__Homo_sapiens__EAW47592
auggagcacaaggaagugguccugcuccugcuucuguuccucaaaagcggccagggggagccccuggacgauuacguuaacacccaaggagccucccuuuucucugugacaaagaaacagcugggcgcugggagcaucgaagagugcgccgcgaagugugaagaggacgaggaauuuacgugcagagcuuuucaguaucauuccaaagagcagcaaugugugauuauggccgaaaaucggaagucuagcaucauuauccgcaugagagaugucguucucuucgagaagaaaguguaccuguccgagugcaagaccggaaacggcaaaaauuaucgggggacaaugucuaagaccaaaaacggaauuacaugucagaaguggagcuccaccagcccucaccgcccgagauga

SEQ ID NO: 7424 - RNA, 411 nt, Artificial Sequence
  derived and/or modified sequence opt6 from Angiostatin__Homo_sapiens__EAW47592
auggaacacaaagaaguaguacuacuacuacuauuauuccuaaaaucaggacaaggagaaccacuagacgacuacguaaacacacaaggagcaucacuauucagcguaacaaaaaaacaacuaggagcaggaagcauagaagaaugcgcagcaaaaugcgaagaagacgaagaauucacaugcagagcauuccaauaccacucaaaagaacaacaaugcguaauaauggcagaaaacagaaaaagcagcauaauaauaagaaugagagacguaguauuauucgaaaaaaaaguauaccuaagcgaaugcaaaacaggaaacggaaaaaacuacagaggaacaaugucaaaaacaaaaaacggaauaacaugccaaaaauggucaagcacaagcccacacagaccaagauaa

SEQ ID NO: 7425 - protein, 1712 aa, Artificial Sequence
  Canstatin__Homo_sapiens__P08572
MGRDQRAVAGPALRRWLLLGTVTVGFLAQSVLAGVKKFDVPCGGRDCSGGCQCYPEKGGRGQPGPVGPQGYNGPPGLQGFPGLQGRKGDKGERGAPGVTGPKGDVGARGVSGFPGADGIPGHPGQGGPRGRPGYDGCNGTQGDSGPQGPPGSEGFTGPPGPQGPKGQKGEPYALPKEERDRYRGEPGEPGLVGFQGPPGRPGHVGQMGPVGAPGRPGPPGPPGPKGQQGNRGLGFYGVKGEKGDVGQPGPNGIPSDTLHPIIAPTGVTFHPDQYKGEKGSEGEPGIRGISLKGEEGIMGFPGLRGYPGLSGEKGSPGQKGSRGLDGYQGPDGPRGPKGEAGDPGPPGLPAYSPHPSLAKGARGDPGFPGAQGEPGSQGEPGDPGLPGPPGLSIGDGDQRRGLPGEMGPKGFIGDPGIPALYGGPPGPDGKRGPPGPPGLPGPPGPDGFLFGLKGAKGRAGFPGLPGSPGARGPKGWKGDAGECRCTEGDEAIKGLPGLPGPKGFAGINGEPGRKGDRGDPGQHGLPGFPGLKGVPGNIGAPGPKGAKGDSRTITTKGERGQPGVPGVPGMKGDDGSPGRDGLDGFPGLPGPPGDGIKGPPGDPGYPGIPGTKGTPGEMGPPGLGLPGLKGQRGFPGDAGLPGPPGFLGPPGPAGTPGQIDCDTDVKRAVGGDRQEAIQPGCIGGPKGLPGLPGPPGPTGAKGLRGIPGFAGADGGPGPRGLPGDAGREGFPGPPGFIGPRGSKGAVGLPGPDGSPGPIGLPGPDGPPGERGLPGEVLGAQPGPRGDAGVPGQPGLKGLPGDRGPPGFRGSQGMPGMPGLKGQPGLPGPSGQPGLYGPPGLHGFPGAPGQEGPLGLPGIPGREGLPGDRGDPGDTGAPGPVGMKGLSGDRGDAGFTGEQGHPGSPGFKGIDGMPGTPGLKGDRGSPGMDGFQGMPGLKGRPGFPGSKGEAGFFGIPGLKGLAGEPGFKGSRGDPGPPGPPPVILPGMKDIKGEKGDEGPMGLKGYLGAKGIQGMPGIPGLSGIPGLPGRPGHIKGVKGDIGVPGIPGLPGFPGVAGPPGITGFPGFIGSRGDKGAPGRAGLYGEIGATGDFGDIGDTINLPGRPGLKGERGTTGIPGLKGFFGEKGTEGDIGFPGITGVTGVQGPPGLKGQTGFPGLTGPPGSQGELGRIGLPGGKGDDGWPGAPGLPGFPGLRGIRGLHGLPGTKGFPGSPGSDIHGDPGFPGPPGERGDPGEANTLPGPVGVPGQKGDQGAPGERGPPGSPGLQGFPGITPPSNISGAPGDKGAPGIFGLKGYRGPPGPPGSAALPGSKGDTGNPGAPGTPGTKGWAGDSGPQGRPGVFGLPGEKGPRGEQGFMGNTGPTGAVGDRGPKGPKGDPGFPGAPGTVGAPGIAGIPQKIAVQPGTVGPQGRRGPPGAPGEMGPQGPPGEPGFRGAPGKAGPQGRGGVSAVPGFRGDEGPIGHQGPIGQEGAPGRPGSPGLPGMPGRSVSIGYLLVKHSQTDQEPMCPVGMNKLWSGYSLLYFEGQEKAHNQDLGLAGSCLARFSTMPFLYCNPGDVCYYASRNDKSYWLSTTAPLPMMPVAEDEIKPYISRCSVCEAPAIAIAVHSQDVSIPHCPAGWRSLWIGYSFLMHTAAGDEGGGQSLVSPGSCLEDFRATPFIECNGGRGTCHYYANKYSFWLTTIPEQSFQGSPSADTLKAGLIRTHISRCQVCMKNL

SEQ ID NO: 7426 - RNA, 5139 nt, Artificial Sequence
  Canstatin__Homo_sapiens__CCDS41907.1
auggggagagaccagcgcgcgguggccggcccugcccuacggcgguggcugcugcuggggacagugaccgugggguuccucgcccagagcgucuuggcgggugugaagaaguuugaugugccguguggaggaagagauugcagugggggcugccagugcuacccugagaaagguggacguggucagccugggccagugggcccccagggguacaaugggccaccaggauuacaaggauucccgggacugcagggacguaaaggagacaagggugaaaggggagcccccggaguaacgggacccaagggcgacgugggagcaagaggcguuucuggauucccuggugccgauggaauuccuggacacccggggcaaggugggcccaggggaaggccgggcuacgauggcugcaacggaacccagggagacucagguccacaggggccccccggcucugagggguucaccgggccucccgggccccaaggaccaaaagggcagaaaggugagccuuaugcacugccuaaagaggagcgcgacagauaucggggugaaccuggagagccuggauuggucgguuuccagggaccucccggccgcccugggcaugugggacagauggguccaguuggagcuccagggagaccaggaccaccuggacccccuggaccaaaaggacagcaaggcaacagaggacuugguuucuacggaguuaagggugaaaagggugacguagggcagccgggacccaacgggauuccaucagacacccuccaccccaucaucgcgcccacaggagucaccuuccacccagaucaguacaagggugaaaaaggcagugagggggaaccaggaauaagaggcauuuccuugaagggagaagaaggaaucaugggcuuuccuggacugagggguuacccuggcuugaguggugaaaaaggaucaccaggacagaagggaagccgaggccuggauggcuaucaagggccugauggaccccggggacccaagggagaagccggagacccagggcccccuggacuaccugccuacuccccucacccuucccuagcaaaaggugccagaggugacccgggauucccaggggcccaaggggagccaggaagccagggugagccaggagacccgggccucccaggucccccuggccucuccaucggagauggagaucagaggagaggccugccgggugagaugggacccaagggcuucaucggagaccccggcaucccugcgcucuacgggggcccaccuggaccugauggaaagcgagggccuccaggaccccccgggcucccuggaccaccuggaccugauggcuuccuguuugggcugaaaggagcaaaaggaagagcaggcuucccugggcuucccggcuccccuggagcccgcggaccaaagggguggaaaggugacgcuggggaaugcagauguacagaaggcgacgaagcuaucaaaggucuuccgggacugccaggacccaagggcuucgcaggcaucaacggggagccggggaggaaaggggacagaggagaccccggccaacacggccucccuggguucccagggcucaagggagugccuggcaacauuggugcucccggacccaaaggagcaaaaggagauuccagaacaaucacaaccaaaggugagcggggacagcccggcgucccaggugugcccgggaugaaaggugacgauggcagcccaggccgcgaugggcucgauggauuccccggccucccaggcccucccggugauggcaucaagggcccuccaggggacccaggcuauccaggaauaccuggaacgaaggguacuccaggagaaaugggccccccaggacugggccuucccggccucaaaggccaacgugguuucccuggagacgccggcuuaccuggaccaccaggcuuccugggcccuccuggccccgcagggaccccaggacaaauagauugugacacagaugugaaaagggccguuggaggugacagacaggaggccauccagccagguugcauaggagggcccaagggauugccaggccugccaggacccccaggccccacaggugccaaaggccuccgaggaaucccaggcuucgcaggagcugauggaggaccagggcccaggggcuugccaggagacgcaggucgugaaggguucccaggacccccaggguucauaggaccccgaggauccaaaggugcagugggccucccuggcccagauggauccccaggucccaucggccugccagggccagaugggcccccuggggaaaggggccucccuggagaaguccugggagcucagcccgggccacggggagaugcuggugugccuggacagccugggcuuaaaggccuucccggagacagaggccccccuggauucagaggaagccaagggaugccugggaugccagggcugaagggccagccaggccucccaggaccuuccggccagccaggccuguaugggccuccaggacugcauggauucccaggagcuccuggccaagaggggcccuuggggcugccaggaaucccaggccgugaaggucugccuggugauagaggggacccuggggacacaggcgcuccuggcccugugggcaugaaaggucucucuggugacagaggagaugcuggcuucacaggggagcaaggccauccaggaagcccuggauuuaaaggaauugauggaaugccugggacccccgggcuaaaaggagauagaggcucaccugggauggaugguuuccaaggcaugccuggacucaaagggagacccggguuuccagggagcaaaggcgaggcuggauuuuucggaauacccggucugaagggucuggcuggugagccagguuuuaaaggcagccgaggggacccugggcccccaggaccaccuccugucauccugccaggaaugaaagacauuaaaggagagaaaggagaugaagggccuauggggcugaaaggauaccugggcgcaaaagguauccaaggaaugccaggcaucccagggcugucaggaaucccugggcugccugggaggcccggccacaucaaaggagucaagggagacaucggaguccccggcauccccgguuugccaggauucccugggguggcuggccccccuggaauuacgggauucccaggauucauaggaagccggggugacaaaggugccccagggagagcaggccuguauggcgagauuggcgcgacuggugauuucggugacaucggggacacuauaaauuuaccaggaagaccaggccugaagggggagcggggcaccacuggaauaccaggucugaagggauucuuuggagagaagggaacagaaggugacaucggcuucccugggauaacaggcgugacuggaguccaaggcccuccuggacuuaaaggacaaacaggcuuuccagggcugacugggccuccagggucgcagggagagcuggggcggauuggacugccugguggcaaaggagaugauggcuggccgggagcuccgggcuuaccagguuuuccgggacuccgugggauccgcggcuuacacggcuugccaggcaccaagggcuuuccaggauccccagguucugacauccacggagacccaggcuucccaggcccuccuggggaaagaggugacccaggagaggccaacacccuuccaggcccugugggagucccaggacagaaaggagaccaaggagcuccaggggaacgaggcccaccugggagcccaggacuucagggguucccugguaucacacccccuuccaacaucucuggggcaccuggugacaaaggggcgccagggauauuuggccugaaagguuaucggggcccaccagggccaccagguucugcugcucuuccuggaagcaaaggugacacagggaacccaggagcuccaggaaccccagggaccaaaggaugggccggggacuccgggccccagggcaggccugguguguuuggucucccaggagaaaaagggcccaggggugaacaaggcuucauggggaacacuggacccacuggggcggugggcgacagaggccccaagggacccaagggagacccaggauucccuggugcccccgggacugugggagcccccgggauugcaggaaucccccagaagauugccguccaaccagggacaguggguccccaggggaggcgaggccccccuggggcaccgggggagauggggccccagggcccccccggagaaccagguuuccguggggcuccagggaaagcugggccccaaggaagagguggugugucugcuguucccggcuuccggggagaugaaggacccauaggccaccaggggccgauuggccaagaaggugcaccaggccguccagggagcccgggccugccggguaugccaggccgcagcgucagcaucggcuaccuccuggugaagcacagccagacggaccaggagcccaugugcccagugggcaugaacaaacucuggaguggauacagccugcuguacuucgagggccaggagaaggcgcacaaccaggaccuggggcuggcgggcuccugccuggcgcgguucagcaccaugcccuuccuguacugcaacccuggugaugucugcuacuaugccagccggaacgacaaguccuacuggcucucuaccacugcgccgcugcccaugaugcccguggccgaggacgagaucaagcccuacaucagccgcuguucugugugugaggccccggccaucgccaucgcgguccacagucaggaugucuccaucccacacugcccagcuggguggcggaguuuguggaucggauauuccuuccucaugcacacggcggcgggagacgaaggcgguggccaaucacuggugucaccgggcagcugucuagaggacuuccgcgccacaccauucaucgaaugcaauggaggccgcggcaccugccacuacuacgccaacaaguacagcuucuggcugaccaccauucccgagcagagcuuccagggcucgcccuccgccgacacgcucaaggccggccucauccgcacacacaucagccgcugccaggugugcaugaagaaccuguga

SEQ ID NO: 7427 - RNA, 5139 nt, Artificial Sequence
  derived and/or modified sequence opt1 from Canstatin__Homo_sapiens__CCDS41907.1
augggccgcgaccagcgggccguggccgggcccgcgcugcgccgguggcuccugcugggcaccgucaccgugggguuccucgcccagagcgugcuggccggcgucaagaaguucgacgugccgugcgggggccgcgacugcuccggcgggugccagugcuaccccgagaagggcgggcggggccagcccgggcccgugggcccgcagggcuacaacgggccgcccggccugcagggguuccccggccuccagggccgcaagggggacaagggcgagcgcggggcccccggcgucacggggcccaagggcgacgugggcgcccggggcgugagcggcuuccccggggcggacggcauccccgggcacccgggccagggcgggccccggggccgccccggguacgacggcugcaacgggacccagggcgacuccggcccccaggggccgcccggcagcgagggguucaccggcccgcccggcccccaggggcccaagggccagaagggggagcccuacgcccugcccaaggaggagcgggaccgcuaccggggcgagccgggggagcccggccuggucggcuuccaggggccgcccggccgccccgggcacgugggccagauggggcccgugggcgcccccggccggccggggccgcccggcccgcccgggcccaagggccagcaggggaaccgcggccucggcuucuacggggucaagggcgagaagggggacgugggccagcccgggcccaacggcauccccuccgacacccugcaccccaucaucgcccccacgggcgugaccuuccaccccgaccaguacaagggggagaagggcagcgagggggagccgggcauccggggcaucucccugaagggggaggagggcaucaugggguuccccggccuccgcggguaccccggccugagcggcgagaaggggucccccggccagaaggggagccggggccuggacggguaccagggcccggacggcccccgcgggcccaagggcgaggcgggggaccccggcccgcccgggcuccccgccuacagcccccacccgucccuggccaagggcgcccggggcgaccccggguuccccggcgcccagggggagccgggcucccagggcgagcccggggaccccggccugcccgggccgcccggccucagcaucggggacggcgaccagcgccgcggccugcccggggagaugggccccaagggguucaucggcgacccggggauccccgcgcuguacggcggcccgcccgggcccgacggcaagcgggggccgcccggcccgcccgggcuccccggcccgcccggccccgacggguuccuguucggccugaagggggccaagggccgcgccggguuccccggccuccccggcucccccggggcccggggccccaagggguggaagggcgacgccggcgagugccgcugcaccgagggggacgaggcgaucaagggccugcccgggcugcccggccccaagggguucgccggcaucaacggcgagccggggcggaagggcgaccgcggggaccccggccagcacgggcuccccggcuucccgggccugaaggggguccccggcaacaucggggcccccggccccaagggggccaagggcgacagccggaccaucacgaccaagggcgagcgcgggcagccgggcgugcccggggugcccggcaugaagggggacgacggcucccccggccgggacgggcuggacggcuucccggggcuccccggcccgcccggcgacgggaucaagggcccgcccggggaccccggcuaccccgggauccccggcaccaagggcacccccggggagaugggcccgcccgggcugggccugcccgggcucaagggccagcgcggcuuccccggggacgccggccugcccgggcccccgggcuuccuggggccgcccggccccgcgggcacgcccgggcagaucgacugcgacaccgacgucaagcgggccgugggcggggaccgccaggaggccauccagcccggcugcaucggcgggcccaagggccucccggggcugcccggcccgcccgggcccaccggcgccaagggccugcgggggauccccggcuucgccggggcggacggcgggcccggcccccgcggccucccgggggacgccggccgggagggguuccccggcccgcccggguucaucggcccccgcggcagcaagggggccgugggccugcccgggcccgacggcucccccgggccgaucggccugcccggccccgacgggcccccgggcgagcgggggcuccccggcgagguccugggcgcccagcccgggccccgcggcgacgcgggggugccgggccagcccgggcugaagggccuccccggcgaccgggggccgcccggcuuccgcgggagccagggcaugcccgggaugcccggccugaagggccagccggggcugcccggccccagcgggcagcccggccucuacgggccgcccggccugcacggcuuccccggggcccccggccaggaggggccgcugggccugcccggcauccccgggcgcgagggccuccccggggaccggggcgacccgggggacaccggcgcccccggccccguggggaugaagggccuguccggggaccgcggcgacgccggguucacgggcgagcagggccaccccgggagcccgggcuucaaggggaucgacggcaugcccgggacccccggccugaagggcgaccgggggucccccggcauggacggguuccagggcaugccggggcucaagggccgccccggcuuccccgggagcaagggcgaggccggguucuucggcauccccggccugaaggggcuggcgggcgagccgggguucaagggcucccgcggggaccccgggcccccggggcccccgcccgucauccuccccggcaugaaggacaucaagggcgagaagggggacgagggccccauggggcugaagggcuaccugggcgccaaggggauccagggcaugcccgggauccccggccucagcgggaucccgggccugcccggccggcccgggcacaucaagggcgugaagggggacaucggcguccccggcaucccggggcugcccggcuuccccgggguggccgggcccccgggcaucaccggcuuccccggcuucaucgggucccggggcgacaagggggcccccggccgcgccgggcucuacggcgagaucggcgcgaccggggacuucggcgacaucggggacacgaucaaccugcccggccggccggggcugaagggcgagcgcggcaccaccgggauccccggccucaagggguucuucggcgagaaggggaccgagggcgacaucggcuuccccgggaucacgggcgugaccgggguccaggggcccccgggccugaagggccagaccggcuuccccgggcugaccggcccgcccgggagccagggcgagcucggccggaucgggcugcccggcgggaagggcgacgacggguggcccggcgcccccggccugccgggguuccccggccuccgcgggauccggggccugcacgggcugcccggcacgaagggcuuccccggguccccgggcagcgacauccacggggaccccggcuuccccgggcccccgggcgagcgcggcgaccccggggaggccaacacccuccccggccccgugggggugccgggccagaagggcgaccagggggcccccggcgagcgggggccgcccggcucccccgggcugcagggcuuccccggcaucaccccgcccagcaacaucuccggggcccccggcgacaagggggcgcccggcaucuucgggcugaagggcuaccgcggcccgcccgggccgcccggcagcgccgcccuccccggguccaagggcgacaccgggaaccccggcgcccccggcacgcccgggaccaagggcugggcgggggacagcggcccccagggccggccgggggucuucggccugcccggggagaagggcccccgcggggagcagggcuucaugggcaacaccgggcccaccggcgccgugggggaccggggcccgaaggggcccaagggcgaccccggcuuccccggggccccgggcacggugggggcccccggcaucgccgggaucccccagaagaucgcgguccagcccggcaccgugggcccgcaggggcgccggggcccgcccggggcccccggcgagauggggccccagggcccgcccggcgagcccggguuccgcggcgcccccgggaaggccggcccccagggccgcgggggcguguccgccguccccggguuccggggcgacgaggggcccaucggccaccagggcccgaucgggcaggagggcgcgcccgggcgccccggcagcccggggcugcccggcaugcccggccgguccgugagcaucggguaccuccuggugaagcacagccagaccgaccaggagcccaugugcccggucggcaugaacaagcugugguccggguacagccuccuguacuucgagggccaggagaaggcccacaaccaggaccuggggcucgccggcuccugccuggcccgcuucagcaccaugcccuuccuguacugcaaccccggcgacgugugcuacuacgccucccggaacgacaagagcuacuggcucuccaccacggcgccccugccgaugaugcccguggccgaggacgagaucaagcccuacaucagccgcugcuccgucugcgaggcccccgccaucgcgaucgccgugcacagccaggacguguccaucccgcacugccccgccggguggcggagccuguggaucggcuacuccuuccucaugcacaccgccgccggggacgagggcggcgggcagagccuggucucccccggcagcugccuggaggacuuccgcgcgacccccuucaucgagugcaacgggggccgggggaccugccacuacuacgccaacaaguacuccuucuggcucacgaccaucccggagcagagcuuccagggcagccccuccgccgacacccugaaggccggccugauccgcacccacaucagccggugccaggugugcaugaagaaccucuga

SEQ ID NO: 7428 - RNA, 5139 nt, Artificial Sequence
  derived and/or modified sequence opt2 from Canstatin__Homo_sapiens__CCDS41907.1
augggccgcgaccagcgcgccgucgccggccccgcccuccgccgcuggcuccuccucggcaccgucaccgucggcuuccucgcccaguccguccucgccggcgucaagaaguucgacguccccugcggcggccgcgacugcuccggcggcugccagugcuaccccgagaagggcggccgcggccagcccggccccgucggcccccagggcuacaacggcccccccggccuccagggcuuccccggccuccagggccgcaagggcgacaagggcgagcgcggcgcccccggcgucaccggccccaagggcgacgucggcgcccgcggcgucuccggcuuccccggcgccgacggcauccccggccaccccggccagggcggcccccgcggccgccccggcuacgacggcugcaacggcacccagggcgacuccggcccccagggcccccccggcuccgagggcuucaccggcccccccggcccccagggccccaagggccagaagggcgagcccuacgcccuccccaaggaggagcgcgaccgcuaccgcggcgagcccggcgagcccggccucgucggcuuccagggcccccccggccgccccggccacgucggccagaugggccccgucggcgcccccggccgccccggcccccccggcccccccggccccaagggccagcagggcaaccgcggccucggcuucuacggcgucaagggcgagaagggcgacgucggccagcccggccccaacggcauccccuccgacacccuccaccccaucaucgcccccaccggcgucaccuuccaccccgaccaguacaagggcgagaagggcuccgagggcgagcccggcauccgcggcaucucccucaagggcgaggagggcaucaugggcuuccccggccuccgcggcuaccccggccucuccggcgagaagggcucccccggccagaagggcucccgcggccucgacggcuaccagggccccgacggcccccgcggccccaagggcgaggccggcgaccccggcccccccggccuccccgccuacuccccccaccccucccucgccaagggcgcccgcggcgaccccggcuuccccggcgcccagggcgagcccggcucccagggcgagcccggcgaccccggccuccccggcccccccggccucuccaucggcgacggcgaccagcgccgcggccuccccggcgagaugggccccaagggcuucaucggcgaccccggcauccccgcccucuacggcggcccccccggccccgacggcaagcgcggcccccccggcccccccggccuccccggcccccccggccccgacggcuuccucuucggccucaagggcgccaagggccgcgccggcuuccccggccuccccggcucccccggcgcccgcggccccaagggcuggaagggcgacgccggcgagugccgcugcaccgagggcgacgaggccaucaagggccuccccggccuccccggccccaagggcuucgccggcaucaacggcgagcccggccgcaagggcgaccgcggcgaccccggccagcacggccuccccggcuuccccggccucaagggcguccccggcaacaucggcgcccccggccccaagggcgccaagggcgacucccgcaccaucaccaccaagggcgagcgcggccagcccggcguccccggcguccccggcaugaagggcgacgacggcucccccggccgcgacggccucgacggcuuccccggccuccccggcccccccggcgacggcaucaagggcccccccggcgaccccggcuaccccggcauccccggcaccaagggcacccccggcgagaugggcccccccggccucggccuccccggccucaagggccagcgcggcuuccccggcgacgccggccuccccggcccccccggcuuccucggcccccccggccccgccggcacccccggccagaucgacugcgacaccgacgucaagcgcgccgucggcggcgaccgccaggaggccauccagcccggcugcaucggcggccccaagggccuccccggccuccccggcccccccggccccaccggcgccaagggccuccgcggcauccccggcuucgccggcgccgacggcggccccggcccccgcggccuccccggcgacgccggccgcgagggcuuccccggcccccccggcuucaucggcccccgcggcuccaagggcgccgucggccuccccggccccgacggcucccccggccccaucggccuccccggccccgacggcccccccggcgagcgcggccuccccggcgagguccucggcgcccagcccggcccccgcggcgacgccggcguccccggccagcccggccucaagggccuccccggcgaccgcggcccccccggcuuccgcggcucccagggcaugcccggcaugcccggccucaagggccagcccggccuccccggccccuccggccagcccggccucuacggcccccccggccuccacggcuuccccggcgcccccggccaggagggcccccucggccuccccggcauccccggccgcgagggccuccccggcgaccgcggcgaccccggcgacaccggcgcccccggccccgucggcaugaagggccucuccggcgaccgcggcgacgccggcuucaccggcgagcagggccaccccggcucccccggcuucaagggcaucgacggcaugcccggcacccccggccucaagggcgaccgcggcucccccggcauggacggcuuccagggcaugcccggccucaagggccgccccggcuuccccggcuccaagggcgaggccggcuucuucggcauccccggccucaagggccucgccggcgagcccggcuucaagggcucccgcggcgaccccggcccccccggccccccccccgucauccuccccggcaugaaggacaucaagggcgagaagggcgacgagggccccaugggccucaagggcuaccucggcgccaagggcauccagggcaugcccggcauccccggccucuccggcauccccggccuccccggccgccccggccacaucaagggcgucaagggcgacaucggcguccccggcauccccggccuccccggcuuccccggcgucgccggcccccccggcaucaccggcuuccccggcuucaucggcucccgcggcgacaagggcgcccccggccgcgccggccucuacggcgagaucggcgccaccggcgacuucggcgacaucggcgacaccaucaaccuccccggccgccccggccucaagggcgagcgcggcaccaccggcauccccggccucaagggcuucuucggcgagaagggcaccgagggcgacaucggcuuccccggcaucaccggcgucaccggcguccagggcccccccggccucaagggccagaccggcuuccccggccucaccggcccccccggcucccagggcgagcucggccgcaucggccuccccggcggcaagggcgacgacggcuggcccggcgcccccggccuccccggcuuccccggccuccgcggcauccgcggccuccacggccuccccggcaccaagggcuuccccggcucccccggcuccgacauccacggcgaccccggcuuccccggcccccccggcgagcgcggcgaccccggcgaggccaacacccuccccggccccgucggcguccccggccagaagggcgaccagggcgcccccggcgagcgcggcccccccggcucccccggccuccagggcuuccccggcaucaccccccccuccaacaucuccggcgcccccggcgacaagggcgcccccggcaucuucggccucaagggcuaccgcggcccccccggcccccccggcuccgccgcccuccccggcuccaagggcgacaccggcaaccccggcgcccccggcacccccggcaccaagggcugggccggcgacuccggcccccagggccgccccggcgucuucggccuccccggcgagaagggcccccgcggcgagcagggcuucaugggcaacaccggccccaccggcgccgucggcgaccgcggccccaagggccccaagggcgaccccggcuuccccggcgcccccggcaccgucggcgcccccggcaucgccggcaucccccagaagaucgccguccagcccggcaccgucggcccccagggccgccgcggcccccccggcgcccccggcgagaugggcccccagggcccccccggcgagcccggcuuccgcggcgcccccggcaaggccggcccccagggccgcggcggcgucuccgccguccccggcuuccgcggcgacgagggccccaucggccaccagggccccaucggccaggagggcgcccccggccgccccggcucccccggccuccccggcaugcccggccgcuccgucuccaucggcuaccuccucgucaagcacucccagaccgaccaggagcccaugugccccgucggcaugaacaagcucugguccggcuacucccuccucuacuucgagggccaggagaaggcccacaaccaggaccucggccucgccggcuccugccucgcccgcuucuccaccaugcccuuccucuacugcaaccccggcgacgucugcuacuacgccucccgcaacgacaaguccuacuggcucuccaccaccgccccccuccccaugaugcccgucgccgaggacgagaucaagcccuacaucucccgcugcuccgucugcgaggcccccgccaucgccaucgccguccacucccaggacgucuccaucccccacugccccgccggcuggcgcucccucuggaucggcuacuccuuccucaugcacaccgccgccggcgacgagggcggcggccagucccucgucucccccggcuccugccucgaggacuuccgcgccacccccuucaucgagugcaacggcggccgcggcaccugccacuacuacgccaacaaguacuccuucuggcucaccaccauccccgagcaguccuuccagggcucccccuccgccgacacccucaaggccggccucauccgcacccacaucucccgcugccaggucugcaugaagaaccucuga

SEQ ID NO: 7429 - RNA, 5139 nt, Artificial Sequence
  derived and/or modified sequence opt3 from Canstatin__Homo_sapiens__CCDS41907.1
augggcagagaccagagggccguggcugggcccgcacugcggcgcuggcuccuucugggaaccgucacaguugguuucuuggcccaaagcguguuagcgggcguaaagaaauuugaugugccuugcgggggacgagacuguuccggcgguugccaguguuacccagagaagggaggacguggccagccgggccccgucgggccucagggauauaacgguccacccggccugcaaggguucccuggacuacagggcagaaaaggugauaagggggaaaggggagcuccaggcgugacuggccccaaaggggacguuggagcccggggugugucuggcuuuccuggggcagauggaaucccaggccacccgggucagggcggcccccgcggaagaccuggcuacgacgggugcaauggaacgcagggugauucaggcccacaagggcccccuggaagugagggcuucaccgguccacccgggccgcagggcccuaagggacagaagggcgaacccuaugcccucccaaaagaggaaagggaccgguaccgcggggagccuggagagcccggucuggucggcuuucaggggccacccggacgaccuggccaugugggucaaauggggccaguaggcgcuccgggaagacccggcccuccagggcccccuggaccaaagggccagcaggguaacagggggcuuggauucuauggcguuaaaggugaaaagggcgauguggggcaacccggaccgaauggcauuccuagcgacacacugcacccaauaaucgcacccacuggggucaccuuucauccugaucaguacaaaggagagaagggcuccgaaggugagcccgggauucggggaaucucuuugaagggcgaggaagguauuaugggcuucccagggcuccguggauauccuggccugucgggggagaaaggaucacccggccagaaggguagccgcgggcuggacggauaccagggcccagaugguccgagaggcccuaaaggggaagccggagaccccggcccacccgggcucccugcuuacaguccacaccccuccuuagccaagggagcgaggggcgacccugguuuuccgggggcacaaggagagccaggcucucagggcgaacccggggauccuggacugccaggucccccuggccuuagcaucggggacggagaucagcggcgaggcuugccgggugagauggggcccaaaggauucauaggcgacccaggcaucccugcccuguaugggggacccccagguccugauggcaagcgcgggcccccaggaccgccuggccuacccgguccacccgggccugacggauuucucuucggccugaaaggcgcuaaggggagagccggauuuccaggucuucccggcuccccuggggcaaggggaccgaagggcuggaaaggugaugcuggggagugucggugcacagaaggagacgaggccauuaagggccugccaggcuugcccgggccuaaaggauucgcggguaucaacggcgaacccgggcgcaagggagauagaggcgacccaggucagcaugggcucccuggauuccccggccugaaaggcgugccagggaauauuggagccccugguccgaagggcgcaaagggggauucaaggaccaucacuacaaaaggagagcguggccaacccggugugccaggggucccuggcaugaagggagacgacggcagucccgggcgggauggauuagacgguuuuccaggccugccugggcccccgggagauggcauaaaagguccaccuggggaccccggcuacccagggauucccggcaccaaggggacgccuggagaaauggguccgcccggccucgggcuuccaggacugaaaggccagcgagguuucccuggggaugcuggcuugcccggaccuccaggcuuucuagggcccccuggaccagccggcacucccggucagaucgacugugauaccgacguuaagagagcuguagggggagauaggcaggaggccauucaaccgggcugcaucgguggcccuaaggggcugccaggacuccccggcccuccagggcccacaggagcaaaaggccugcgcgguaucccgggguucgccggagcugacggcgguccuggcccccgggggcuuccaggagaugcgggcagagagggguuuccuggacccccaggcuucauuggucccagggggagcaagggagcagugggccugccuggcccagacgggucuccgggacccauagguuugccuggcccagaugggcccccuggagaacgcggccucccaggugaggugcugggggcccagcccggaccucgaggcgacgcuggcgucccggggcagccaggauuaaaaggucugcccggcgaccgggggccucccggauuucguggcucccaggguaugccagggaugccuggacuaaagggccaacccggccucccagggccgucaggacagccuggucuguaugggcccccagggcuucacggauuccccggcgccccuggucaggaagggccauugggacugcccggcaucccuggcagagaggggcucccgggagauaggggugacccaggcgauacuggggcacccggaccugugggcaugaaaggucugagcggggaccgcggagaugccggcuuuaccggcgaacaagggcacccaggaagucccgguuucaagggcauugacgggaugccuggaacacccggccuuaagggugaucgggggucuccaggaauggacggcuuucagggcaugccggggcugaaaggaagaccugguuuccccggcuccaagggggaggcuggauuuuucggcaucccagguuugaaagggcucgccggcgagccuggauucaagggcagccgaggggaucccggaccaccuggucccccgccaguuauacugccuggcaugaaagacauuaagggggaaaaaggagaugagggccccauggguuuaaagggguaccugggcgcaaagggaauccagggcaugccagggauccccggacuaucggguauuccuggccucccggggaggccaggacauaucaaaggcgugaagggugacauuggcguccccgggauaccuggacugcccggcuuuccagggguggcgggaccucccggcaucaccgguuucccaggguuuauuggaucucgcggcgauaaaggugcuccuggccgggccgggcuuuauggagaaaucggcgcaacgggggacuucggagacaucggcgauacuauuaacuugccggguagacccgggcugaagggagagaggggcacaaccgguauaccaggccucaaaggguuuuucggagagaagggcacugaaggggacaucggauuuccuggcauuacagguguaaccgggguucagggacccccaggccugaagggccaaacgggguucccuggauuaaccggucccccgggcucccagggggagcugggacguaucggccuuccaggugggaaaggagaugacggcuggccuggcgcccccggguugccaggauuucccggucuccgcggcauucgggggcugcacggacuaccuggcacaaaggguuuccccgggucaccaggaagugauauccauggcgacccuggcuuuccggggcccccaggagaaagaggugauccuggcgaggcuaauacucugcccgggccagugggagucccuggccagaaaggugaccagggggcccccggagaaaggggcccgccuggcagcccagggcuccaaggauuccccgguauaaccccuccauccaacaucucuggcgcacccggggauaagggagcuccuggcauuuuuggucugaaaggguaccgaggaccacccggcccgccuggcagcgccgcgcuucccgggucaaagggagacacagguaauccaggcgcccccgggacuccuggaaccaagggcugggcuggugauagugggccacagggccggcccggaguguucggcuugccuggggagaaaggaccacgcggugagcagggcuucauggggaacacaggaccgaccggcgcagucggugacagagggcccaagggcccuaaaggagacccaggcuuucccggggccccuggaacugugggugcuccaggcaucgccgggauuccccagaagaucgcaguucaaccgggaacggugggcccucaggguaggcgggggccacccggcgcgccuggagaaaugggcccccaggggccaccgggagagccugguuuccgaggcgcccccgggaaagcuggaccacaaggcagagguggcguauccgccguccccggguuucgcggagaugaaggcccuauagggcaccagggaccaauuggccaggagggugcacccgggaggccuggaagcccaggccugccggguaugcccggccguucugugucaaucggguauuuacucguuaagcacagucagacagaccaagaaccuauguguccagugggaaugaauaagcuguggagcggcuacucccuucuguacuucgaggggcaggagaaagcucauaaccaggauuugggacucgccggcucuugccuggcacgguuuucgaccaugcccuuccuauauuguaauccuggugacgucugcuacuaugccagcagaaacgauaaguccuacuggcugucaacuaccgcuccacuccccaugaugccuguggcggaagacgagauuaaaccguauaucaguaggugcucuguaugugaagcccccgcaauagcuaucgccgugcacagccaggauguuuccauuccacauugcccugccggguggcgcucacuguggaucggauacagcuuucuuaugcacacagcugcaggcgacgaggguggcgggcaaucuuuggucucccccggaaguugucuggaagauuuccgagccaccccauuuauugagugcaauggcgggagaggaacuugucauuauuacgcgaacaaguacagcuucugguuaacaacgaucccugagcagucuuuucagggcucccccucagcugacacccucaaagccggucugauacggacucacauuaguaggugccagguguguaugaagaaccuuuga

SEQ ID NO: 7430 - RNA, 5139 nt, Artificial Sequence
  derived and/or modified sequence opt4 from Canstatin__Homo_sapiens__CCDS41907.1
augggcagagaccagagagccguggccggccccgcccugagaagauggcugcugcugggcaccgugaccgugggcuuccuggcccagagcgugcuggccggcgugaagaaguucgacgugcccugcggcggcagagacugcagcggcggcugccagugcuaccccgagaagggcggcagaggccagcccggccccgugggcccccagggcuacaacggcccccccggccugcagggcuuccccggccugcagggcagaaagggcgacaagggcgagagaggcgcccccggcgugaccggccccaagggcgacgugggcgccagaggcgugagcggcuuccccggcgccgacggcauccccggccaccccggccagggcggccccagaggcagacccggcuacgacggcugcaacggcacccagggcgacagcggcccccagggcccccccggcagcgagggcuucaccggcccccccggcccccagggccccaagggccagaagggcgagcccuacgcccugcccaaggaggagagagacagauacagaggcgagcccggcgagcccggccuggugggcuuccagggcccccccggcagacccggccacgugggccagaugggccccgugggcgcccccggcagacccggcccccccggcccccccggccccaagggccagcagggcaacagaggccugggcuucuacggcgugaagggcgagaagggcgacgugggccagcccggccccaacggcauccccagcgacacccugcaccccaucaucgcccccaccggcgugaccuuccaccccgaccaguacaagggcgagaagggcagcgagggcgagcccggcaucagaggcaucagccugaagggcgaggagggcaucaugggcuuccccggccugagaggcuaccccggccugagcggcgagaagggcagccccggccagaagggcagcagaggccuggacggcuaccagggccccgacggccccagaggccccaagggcgaggccggcgaccccggcccccccggccugcccgccuacagcccccaccccagccuggccaagggcgccagaggcgaccccggcuuccccggcgcccagggcgagcccggcagccagggcgagcccggcgaccccggccugcccggcccccccggccugagcaucggcgacggcgaccagagaagaggccugcccggcgagaugggccccaagggcuucaucggcgaccccggcauccccgcccuguacggcggcccccccggccccgacggcaagagaggcccccccggcccccccggccugcccggcccccccggccccgacggcuuccuguucggccugaagggcgccaagggcagagccggcuuccccggccugcccggcagccccggcgccagaggccccaagggcuggaagggcgacgccggcgagugcagaugcaccgagggcgacgaggccaucaagggccugcccggccugcccggccccaagggcuucgccggcaucaacggcgagcccggcagaaagggcgacagaggcgaccccggccagcacggccugcccggcuuccccggccugaagggcgugcccggcaacaucggcgcccccggccccaagggcgccaagggcgacagcagaaccaucaccaccaagggcgagagaggccagcccggcgugcccggcgugcccggcaugaagggcgacgacggcagccccggcagagacggccuggacggcuuccccggccugcccggcccccccggcgacggcaucaagggcccccccggcgaccccggcuaccccggcauccccggcaccaagggcacccccggcgagaugggcccccccggccugggccugcccggccugaagggccagagaggcuuccccggcgacgccggccugcccggcccccccggcuuccugggcccccccggccccgccggcacccccggccagaucgacugcgacaccgacgugaagagagccgugggcggcgacagacaggaggccauccagcccggcugcaucggcggccccaagggccugcccggccugcccggcccccccggccccaccggcgccaagggccugagaggcauccccggcuucgccggcgccgacggcggccccggccccagaggccugcccggcgacgccggcagagagggcuuccccggcccccccggcuucaucggccccagaggcagcaagggcgccgugggccugcccggccccgacggcagccccggccccaucggccugcccggccccgacggcccccccggcgagagaggccugcccggcgaggugcugggcgcccagcccggccccagaggcgacgccggcgugcccggccagcccggccugaagggccugcccggcgacagaggcccccccggcuucagaggcagccagggcaugcccggcaugcccggccugaagggccagcccggccugcccggccccagcggccagcccggccuguacggcccccccggccugcacggcuuccccggcgcccccggccaggagggcccccugggccugcccggcauccccggcagagagggccugcccggcgacagaggcgaccccggcgacaccggcgcccccggccccgugggcaugaagggccugagcggcgacagaggcgacgccggcuucaccggcgagcagggccaccccggcagccccggcuucaagggcaucgacggcaugcccggcacccccggccugaagggcgacagaggcagccccggcauggacggcuuccagggcaugcccggccugaagggcagacccggcuuccccggcagcaagggcgaggccggcuucuucggcauccccggccugaagggccuggccggcgagcccggcuucaagggcagcagaggcgaccccggcccccccggccccccccccgugauccugcccggcaugaaggacaucaagggcgagaagggcgacgagggccccaugggccugaagggcuaccugggcgccaagggcauccagggcaugcccggcauccccggccugagcggcauccccggccugcccggcagacccggccacaucaagggcgugaagggcgacaucggcgugcccggcauccccggccugcccggcuuccccggcguggccggcccccccggcaucaccggcuuccccggcuucaucggcagcagaggcgacaagggcgcccccggcagagccggccuguacggcgagaucggcgccaccggcgacuucggcgacaucggcgacaccaucaaccugcccggcagacccggccugaagggcgagagaggcaccaccggcauccccggccugaagggcuucuucggcgagaagggcaccgagggcgacaucggcuuccccggcaucaccggcgugaccggcgugcagggcccccccggccugaagggccagaccggcuuccccggccugaccggcccccccggcagccagggcgagcugggcagaaucggccugcccggcggcaagggcgacgacggcuggcccggcgcccccggccugcccggcuuccccggccugagaggcaucagaggccugcacggccugcccggcaccaagggcuuccccggcagccccggcagcgacauccacggcgaccccggcuuccccggcccccccggcgagagaggcgaccccggcgaggccaacacccugcccggccccgugggcgugcccggccagaagggcgaccagggcgcccccggcgagagaggcccccccggcagccccggccugcagggcuuccccggcaucaccccccccagcaacaucagcggcgcccccggcgacaagggcgcccccggcaucuucggccugaagggcuacagaggcccccccggcccccccggcagcgccgcccugcccggcagcaagggcgacaccggcaaccccggcgcccccggcacccccggcaccaagggcugggccggcgacagcggcccccagggcagacccggcguguucggccugcccggcgagaagggccccagaggcgagcagggcuucaugggcaacaccggccccaccggcgccgugggcgacagaggccccaagggccccaagggcgaccccggcuuccccggcgcccccggcaccgugggcgcccccggcaucgccggcaucccccagaagaucgccgugcagcccggcaccgugggcccccagggcagaagaggcccccccggcgcccccggcgagaugggcccccagggcccccccggcgagcccggcuucagaggcgcccccggcaaggccggcccccagggcagaggcggcgugagcgccgugcccggcuucagaggcgacgagggccccaucggccaccagggccccaucggccaggagggcgcccccggcagacccggcagccccggccugcccggcaugcccggcagaagcgugagcaucggcuaccugcuggugaagcacagccagaccgaccaggagcccaugugccccgugggcaugaacaagcuguggagcggcuacagccugcuguacuucgagggccaggagaaggcccacaaccaggaccugggccuggccggcagcugccuggccagauucagcaccaugcccuuccuguacugcaaccccggcgacgugugcuacuacgccagcagaaacgacaagagcuacuggcugagcaccaccgccccccugcccaugaugcccguggccgaggacgagaucaagcccuacaucagcagaugcagcgugugcgaggcccccgccaucgccaucgccgugcacagccaggacgugagcaucccccacugccccgccggcuggagaagccuguggaucggcuacagcuuccugaugcacaccgccgccggcgacgagggcggcggccagagccuggugagccccggcagcugccuggaggacuucagagccacccccuucaucgagugcaacggcggcagaggcaccugccacuacuacgccaacaaguacagcuucuggcugaccaccauccccgagcagagcuuccagggcagccccagcgccgacacccugaaggccggccugaucagaacccacaucagcagaugccaggugugcaugaagaaccuguga

SEQ ID NO: 7431 - RNA, 5139 nt, Artificial Sequence
  derived and/or modified sequence opt5 from Canstatin__Homo_sapiens__CCDS41907.1
augggcagagaccagcgggccguggcugggcccgcccugcgcagauggcuccugcuuggaaccgucacaguuggcuuccuggcgcaaagcgugcucgcuggggugaagaaauuugaugucccuugcggaggccgggacuguuccgggggaugccaguguuacccggagaagggcggccgcgggcagcccggaccugugggcccccagggguauaacggaccucccggccugcaaggguucccuggacuucagggcagaaaaggcgauaagggggaacggggagccccgggcguuacggggcccaaaggagacgugggcgcccgcggggucucuggauuuccuggcgcugauggcauccccgggcacccuggacagggcgggcccagaggacggccgggcuacgacgggugcaauggcacccagggagauagcggcccucaagggcccccuggauccgagggcuucacagggccucccggaccccagggcccgaaggggcagaagggcgaacccuaugcccugccuaaagaggaacgcgacagauaccggggagagcccggcgagccugggcucgugggauuucagggacccccggggcgcccuggacauguuggccaaauggggcccgugggcgcuccuggaagacccggcccucccgggccgccuggacccaagggccagcaggggaaccggggacugggcuucuauggggucaaaggcgaaaagggagaugugggccaacccgggccuaauggcauuccgucugacacccugcaccccaucauugccccuacaggcgugaccuuucaucccgaucaguacaaaggggagaagggaagcgaaggcgagccuggcauccgcgggauuucccucaagggagaggaaggcaucaugggguuccccggacugagaggcuauccugggcuuucuggagagaaaggcagccccggccagaaggggucccggggacuggacggcuaccaggggccggauggaccuagaggccccaaaggggaagcgggagacccugggcccccgggccucccugccuacagcccccacccuucucuggcuaagggcgcccgcggagaccccggcuuucccggggcucaaggagagccuggcucccagggggaaccgggagaucccggccuuccugggcccccuggccugagcaucggagacggcgaucagcggagagggcuccccggagagaugggcccuaaaggguucauuggagacccgggcauccccgcccuguauggcgggccucccggaccugauggcaagcgcgggcccccgggaccucccggccugcccgggccucccggaccugacggcuuucucuucggccugaaaggggcgaagggacgggccggcuuuccggggcuucccggaucuccuggcgcuagagggcccaagggauggaaaggcgaugccggcgagugucgcugcacagaaggggacgaggcuauuaagggacugccuggccuccccgggccgaaaggauucgccggcaucaacggggaaccuggccggaagggagauagaggcgaccccgggcagcauggacugccuggcuuccccgggcuuaaaggagucccuggcaauauuggggcccccggcccgaagggagcuaagggcgauucccgcaccaucacgaccaaaggggagcggggacaaccuggcguucccggggugcccggaaugaagggcgacgacgggagcccuggcagagauggacuggacggcuuuccggggcuccccggaccucccggcgaugggauuaaaggaccucccggcgacccuggcuacccggggauccccggaacaaagggcaccccuggggaaaugggacccccuggccuggggcugcccggacucaaaggccagcgcggcuucccgggggaugcgggacugccuggcccucccggguuucuuggaccucccggccccgccgggacaccgggacagaucgacugugauaccgacgugaagcgggcugucggcggcgauagacaggaggccauucaacccgggugcaucggaggcccuaaggggcugcccggacucccugggcccccgggcccuacgggagccaaaggccugcggggcauucccggguucgcuggagccgacggcgggccuggaccccgcggccuuccuggggaugcgggaagagagggcuuucccggcccgccuggguucaucggaccccggggcucuaagggggcugugggacugcccggcccugacggguccccgggacccauuggccucccuggccccgaugggccucccggagaaagaggccugccuggggagguucugggagcccagcccggcccgcgcggggacgccggagugccuggccagcccggccucaaagggcugccuggagaccgggggcccccgggcuuuagaggaagccagggcaugccugggaugcccggccuuaagggacaacccggccugccugggcccuccggacagccuggccucuaugggccgcccggacugcacggcuucccuggggcucccggccaggaaggaccucugggccuucccgggaucccuggacgcgagggccucccgggggauagaggagaccccggcgauacaggggccccuggccccgucggaaugaaaggccugucuggggaccggggagaugcuggcuuuaccggggaacaaggacacccuggcagccccggguucaagggcaucgacggaaugccgggcacaccugggcugaagggagaucgcggcucccccgggauggacggauuucagggcaugcccggccucaaagggagaccuggauuccccggcagcaagggggaggccggauuuuucggcauuccugggcugaaaggacuugcgggcgagccgggcuucaaggggucucggggagaucccggcccucccgggccucccccggugauccugccuggaaugaaagacauuaagggcgaaaaaggggaugagggacccaugggccucaagggcuaccugggggccaagggaauccagggcaugccugggauucccggacuguccggcaucccggggcuuccuggacgccccggccauaucaaaggcguuaagggggacauuggagugcccggcaucccugggcuccccggauuuccuggcgucgcugggccgcccggaauuaccggcuucccuggcuuuaucgggagcagaggagauaaaggcgcccccgggcgggcuggacuguauggcgaaauuggggccaccggagacuucggcgacaucggcgauacaauuaaccugccugggcgccccggacucaagggcgagagagggacgaccggaaucccuggccugaaaggguuuuucggagagaagggcacagaaggcgacaucggguuuccgggaauuaccggcgugacagggguccagggacccccuggccuuaaggggcaaaccggcuuccccggacugacgggcccucccgggucucagggagagcucggccggaucgggcugccgggaggcaaaggggaugacggcuggccuggagcgcccggccugcccggguuuccuggacuucgcggcauuagagggcuccacggacugcccggcacaaagggguucccuggcagcccgggauccgauauccauggcgaccccggguuuccuggacccccuggcgaaagaggggaucccggagaggccaauacccugccgggcccuguggggguucccggccagaaaggagaccagggcgcuccuggggaacggggacccccuggcucucccgggcuccaaggauucccgggcauuacacccccuagcaacaucuccggcgcccccggggauaagggagcuccuggcaucuuugggcugaaaggauaccgcggcccgcccgggccucccggaagcgccgcccuuccuggcucuaagggcgacaccgggaaucccggagcuccuggcacccccgggacaaagggaugggcgggcgauuccgggccgcagggacggccuggcguguucggccugcccggggagaaaggaccuagaggcgagcagggguucaugggaaacacgggccccaccggggccgucggagaccgcggcccgaagggcccuaaaggggaccccggauuucccggcgcuccugggacagugggagcccccggcauugccgggaucccucagaagauugcuguucaaccgggaaccgugggcccccagggccggagagggccucccggagccccuggcgaaauggggccccagggaccgccuggcgagcccggguuccgcggagcgccuggcaaagcuggcccccaagggcggggaggcgucagcgccgugccuggguuuagaggagaugaaggccccaucgggcaccagggaccgauuggccaggagggcgcccccgggcgcccuggaucucccggccucccugggaugcccggacgguccgugagcaucggcuaucugcugguuaagcacucccagacagaccaagaaccuauguguccggucgggaugaauaaacuuuggucuggcuacagccuccuguacuucgagggacaggagaaggcucauaaccaggaucugggccucgccggguccugccuggcgagauuuucuaccaugcccuuccuuuauuguaauccuggagacgugugcuacuaugcuagccggaacgauaaguccuacuggcugagcacgaccgcuccccucccuaugaugcccguggccgaagacgagaucaaaccguauauuucucgcugcuccgucugugaagccccugccaucgcuauugccgugcacagccaggauguuucuaucccccauugcccugcgggcuggagaucccuguggauuggguacagcuuucugaugcacacagccgcuggagacgagggcgggggccaaucucuugugagccccggauccugucuggaagauuuccgggccaccccguuuaucgagugcaauggcgggcgcggaacaugucauuauuacgcuaacaaguacagcuucuggcucaccacgaucccugagcagucuuuucagggcucccccagcgccgacacacugaaagccgggcucauuagaacccacaucucccggugccaggucuguaugaagaaccuguga

SEQ ID NO: 7432 - RNA, 5139 nt, Artificial Sequence
  derived and/or modified sequence opt6 from Canstatin__Homo_sapiens__CCDS41907.1
augggaagagaucaaagggcaguggcgggaccugcacuacgaagaugguuauuauuaggaacaguuacaguaggauucuuggcacaaucuguacuugcagggguaaaaaaauuugauguacccugcggaggacgugauuguaguggcgguugccaauguuacccagaaaaaggugguaggggucaaccgggaccaguuggaccacaaggauauaauggaccaccaggacuacaaggauuuccuggcuuacaggguagaaaaggcgauaagggggaaagaggagcuccaggugucacagguccaaaaggcgacguuggagcaagagggguuuccggauuucccggggcagauggaaucccgggacauccaggucaaggagguccucgcggucgaccaggauaugacggaugcaacgguacucagggugacaguggaccucaagguccaccagggagugagggauuuacuggaccuccggguccgcaagggccgaaaggacagaagggagaaccauacgcguuaccaaaagaggaaagggaucgcuauagaggggaaccaggggaaccaggcuuagugggauuucaaggaccaccuggacgcccaggccauguaggacaaaugggaccuguaggagccccuggaagacccgguccgccaggaccaccagguccaaaaggacaacaggggaaucgcggcuuagguuucuauggaguaaaaggugaaaaaggagauguuggucaacccggucccaauggaauaccuucagauacacuacauccaauaauagccccaacaggcguaacauuucaucccgaccaauauaaaggagaaaaagguagugaaggggaaccuggaauccgcgguauauccuuaaaaggagaggaaggaaucaugggauuuccaggacuccgagguuauccuggcuuaagcggagaaaaagggucuccgggacaaaaaggaucgagaggacuagacggauaucaaggaccggacgguccuagagggccaaagggagaagcaggcgacccggggccaccaggacucccagcauauucaccacaucccagcuuagccaaaggagcacguggggacccgggguucccaggagcgcaaggagaaccaggaagucaaggugaaccaggugauccugguuuaccuggaccaccugguuuaaguauaggagauggugaucaaaggcgaggauugcccggugaaauggggccuaagggauuuauaggagauccaggaauaccagcacuauauggagggccucccgguccagauggaaaaagaggaccaccgggcccuccggggcuaccuggaccaccaggcccugaugguuucuuauuugguuuaaaaggagcaaagggcagagcagguuuccccggacuuccaggaaguccuggagccagagggccuaagggauggaaaggagaugccggugaauguagaugcacugaaggcgaugaagcaauaaaaggucuuccugguuuaccuggcccgaagggauuugcugguauuaauggagagccuggaagaaaaggagauagaggggauccaggacaacacgguuuaccuggauuuccaggccuaaaaggagucccaggaaauaucggcgcaccaggucccaaaggagcaaaaggggauaguagaacaauuacaacuaagggagaaaggggucaaccaggaguaccgggaguaccaggaaugaagggugacgauggaagucccgggagagacggccuagauggauuuccagguuugccgggaccuccaggggacggaauaaaagguccuccaggagauccagguuaucccggcauaccagguaccaaaggaacgccuggcgagauggguccaccaggcuuagguuuaccaggauuaaaaggacaaaggggauucccaggcgaugcaggguuaccgggucccccaggguucuuaggaccaccgggaccggcagguacuccagggcaaauugacugugauacagauguaaagagagcaguugguggagacaggcaagaagcuauacagccugguuguauuggugguccuaaagggcuaccgggacucccagggcccccaggaccuacaggcgcaaaggguuuacgagguauuccuggcuuugccggagcugacggaggaccugguccgaggggguuaccgggugaugcugguagagaaggauuuccaggcccaccaggcuucauugguccuagagguucgaaaggggcagugggacugccggguccugacggaaguccugggccaauuggacugccugguccugaugggccuccaggggagagaggacuaccaggcgaaguucuuggagcgcaaccggguccgaggggggacgccggagugcccggacaaccaggacuuaaaggucuaccuggugacagaggcccuccugguuucagaggaagucaaggcaugcccgggaugccaggauugaaaggccaaccaggccucccaggaccuagcggucaacccgggcuauaugguccucccggauuacauggauuccccggagcaccggggcaggaagguccauuaggauuaccagguauaccuggccgugagggucuuccaggagacagaggugacccaggagauacgggggcgccuggaccgguagguaugaaagguuuaaguggagaucgaggugaugcagguuuuaccggcgaacaaggucauccuggcagucccggguuuaaagguauugaugguaugccgggaacucccggauuaaagggagaucgaggguccccgggaauggauggauuccaaggaaugcccggauuaaaggggaggccgggcuucccaggaucuaaaggagaagcaggguuuuucggaauaccaggcuuaaaaggacuggcgggagagccaggguucaaagguaguagaggggauccgggaccaccugggccaccaccagugauauugccugguaugaaggauauaaaaggggagaagggggaugagggacccaugggacuaaaaggauacuuaggagcuaaagggauacagggaaugcccgguauaccgggcuugucaggaauaccuggucucccuggcaggccgggacauauuaaaggaguaaaaggagauauagggguuccaggaauacccggauuaccuggauuuccugguguugcuggaccacccggaauaaccggcuuuccagguuuuauuggcaguagaggagauaaaggagcgccuggacgugccggacuuuauggagaaauaggugccacgggugauuuuggagauaucggagauacaauaaauuuaccuggaagaccuggucuaaaaggugaaagggggacuacaggaauacccggccuuaagggauuuuuuggggaaaaggguacagagggagauauagguuuuccaggaauuacuggagucacaggcguccaggggccgcccgguuuaaagggacaaacaggauuuccaggacuaacgggcccuccugguagucaaggagaacugggaagaauaggacuaccaggcggcaagggugacgauggauggccaggagcaccaggucuacccggcuuuccaggacuuagagggauaagaggacuucauggucuaccuggaacuaaaggauuuccaggaagucccggaucagacauacauggcgauccugguuuuccagguccaccgggagaacgaggggacccaggagaagcaaauacguugccuggaccggucgguguuccaggucaaaaaggugaucaaggggcuccaggagagcgaggaccaccagguucacccggauuacaaggguuuccuggcauuaccccgccaucuaauauaaguggugcaccaggagauaaaggugccccagguauauucggguugaaaggcuauagagggccaccagguccaccaggcuccgccgcauuaccaggcucaaaaggugauacuggaaacccuggugcaccgggaacuccaggcacgaaggguugggcgggggauagugguccgcaagguagaccaggaguguuuggucuuccaggagaaaaaggaccacguggagaacaaggauuuaugggaaacacaggucccacuggagcugugggagauagagguccaaaaggacccaaaggggacccuggauuuccaggggcuccgggaacggugggggcuccugguauagcaggcauuccucagaaaauagcgguccaaccaggaacaguaggaccucaaggucgcagaggaccaccaggugcaccaggugaaaugggaccgcaaggccccccaggcgaaccuggauuuagaggagcuccugguaaagcagggccacaaggccgugguggaguuagugcaguuccaggcuuccgaggagaugaagguccuauagggcaucaaggaccgauaggacaggaaggagcuccaggacgcccugguaguccuggauuaccggguaugccaggucguucgguaaguauuggauaccuauuaguaaagcauucucaaacagaucaagagcccaugugucccguuggaaugaauaaauuguggaguggguacagcuuauuauauuucgagggucaagaaaaagcacauaaucaggauuuaggauuagccggguccuguuuagcaagauucucgaccaugccuuucuuguacugcaauccgggugauguuugcuauuaugcaucacgcaacgauaagucauauugguuaaguacaacugcuccuuugcccaugaugccaguagcugaggaugaaauaaaaccauauauauccagauguagugucugcgaagcaccggcuauagccauagcgguacauucacaagacgucagcaucccacauuguccagcgggauggagaucauuguggauaggauacucauuucuaaugcacaccgcggcaggagaugaaggcgguggacaaagcuuaguuucgccaggaucuugccuagaagacuuuagagcuacuccguuuauagaaugcaacgggggaaggggaaccugucauuauuaugcaaauaaguauagcuuuugguuaacuacgauuccagaacaaaguuuccaaggcucuccaagcgcagacaccuugaaagcaggguugaucagaacucacauuucacgaugucaaguauguaugaagaauuuauag

SEQ ID NO: 7433 - protein, 184 aa, Artificial Sequence
  Endostatin__Homo_sapiens__Endostatin__Homo_sapiens_
MHSHRDFQPVLHLVALNSPLSGGMRGIRGADFQCFQQARAVGLAGTFRAFLSSRLQDLYSIVRRADRAAVPIVNLKDELLFPSWEALFSGSEGPLKPGARIFSFDGKDVLRHPTWPQKSVWHGSDPNGRRLTESYCETWRTEAPSATGQASSLLGGRLLGQSAASCHHAYIVLCIENSFMTASK

SEQ ID NO: 7434 - RNA, 555 nt, Artificial Sequence
  Endostatin__Homo_sapiens__NM_030582.3
augcacagccaccgcgacuuccagccggugcuccaccugguugcgcucaacagcccccugucaggcggcaugcggggcauccgcggggccgacuuccagugcuuccagcaggcgcgggccguggggcuggcgggcaccuuccgcgccuuccuguccucgcgccugcaggaccuguacagcaucgugcgccgugccgaccgcgcagccgugcccaucgucaaccucaaggacgagcugcuguuucccagcugggaggcucuguucucaggcucugaggguccgcugaagcccggggcacgcaucuucuccuuugacggcaaggacguccugaggcaccccaccuggccccagaagagcguguggcauggcucggaccccaacgggcgcaggcugaccgagagcuacugugagacguggcggacggaggcucccucggccacgggccaggccuccucgcugcuggggggcaggcuccuggggcagagugccgcgagcugccaucacgccuacaucgugcucugcauugagaacagcuucaugacugccuccaaguag

SEQ ID NO: 7435 - RNA, 555 nt, Artificial Sequence
  derived and/or modified sequence opt1 from Endostatin__Homo_sapiens__NM_030582.3
augcacagccaccgcgacuuccagcccgugcugcaccucgucgcccugaacuccccgcugagcggcgggaugcggggcauccgcggggccgacuuccagugcuuccagcaggcgcgggccgugggccucgccgggaccuuccgcgccuuccuguccagccggcugcaggaccucuacuccaucgugcgccgggccgaccgcgcggccguccccaucgugaaccugaaggacgagcuccuguuccccagcugggaggcccuguucuccggcagcgagggcccccugaagccgggggcccggaucuucuccuucgacggcaaggacgugcuccgccaccccaccuggccccagaaguccgucuggcacgggagcgaccccaacggccggcgccugacggagagcuacugcgagaccuggcggaccgaggcgccguccgccaccgggcaggccagcucccugcucggcggccgccugcuggggcagagcgccgccuccugccaccacgcguacaucgugcucugcaucgagaacagcuucaugacggccuccaaguga

SEQ ID NO: 7436 - RNA, 555 nt, Artificial Sequence
  derived and/or modified sequence opt2 from Endostatin__Homo_sapiens__NM_030582.3
augcacucccaccgcgacuuccagcccguccuccaccucgucgcccucaacuccccccucuccggcggcaugcgcggcauccgcggcgccgacuuccagugcuuccagcaggcccgcgccgucggccucgccggcaccuuccgcgccuuccucuccucccgccuccaggaccucuacuccaucguccgccgcgccgaccgcgccgccguccccaucgucaaccucaaggacgagcuccucuuccccuccugggaggcccucuucuccggcuccgagggcccccucaagcccggcgcccgcaucuucuccuucgacggcaaggacguccuccgccaccccaccuggccccagaaguccgucuggcacggcuccgaccccaacggccgccgccucaccgaguccuacugcgagaccuggcgcaccgaggcccccuccgccaccggccaggccuccucccuccucggcggccgccuccucggccaguccgccgccuccugccaccacgccuacaucguccucugcaucgagaacuccuucaugaccgccuccaaguga

SEQ ID NO: 7437 - RNA, 555 nt, Artificial Sequence
  derived and/or modified sequence opt3 from Endostatin__Homo_sapiens__NM_030582.3
augcacagccauagagacuuccagcccgugcugcaccucgucgcccuuaacuccccucugucuggcgggaugaggggaauccggggugcugauuuucaaugcuuccagcaggcacgcgccguuggcuuggcggggaccuuucgagcuuucuuaucaagucgucugcaggaccuauacagcauugugagaagggccgaucgggcagccguaccaauagugaaucucaaggacgagcugcuuuuuccguccugggaagcucuguucucuggaucggagggccccuugaaaccuggugcacgcaucuuuucauucgaugggaaggacguccucagacauccaacauggccccagaaaagcguguggcacggaagugauccuaacggcaggcggcugacugaauccuauugugagacguggcgcaccgaagccccaucugcuacaggccaagccagcucccugcucgggggacgauuacugggucagucagcggcaaguugccaucacgccuacauuguucuuuguaucgagaauagcuuuaugacugcuucuaaguga

SEQ ID NO: 7438 - RNA, 555 nt, Artificial Sequence
  derived and/or modified sequence opt4 from Endostatin__Homo_sapiens__NM_030582.3
augcacagccacagagacuuccagcccgugcugcaccugguggcccugaacagcccccugagcggcggcaugagaggcaucagaggcgccgacuuccagugcuuccagcaggccagagccgugggccuggccggcaccuucagagccuuccugagcagcagacugcaggaccuguacagcaucgugagaagagccgacagagccgccgugcccaucgugaaccugaaggacgagcugcuguuccccagcugggaggcccuguucagcggcagcgagggcccccugaagcccggcgccagaaucuucagcuucgacggcaaggacgugcugagacaccccaccuggccccagaagagcguguggcacggcagcgaccccaacggcagaagacugaccgagagcuacugcgagaccuggagaaccgaggcccccagcgccaccggccaggccagcagccugcugggcggcagacugcugggccagagcgccgccagcugccaccacgccuacaucgugcugugcaucgagaacagcuucaugaccgccagcaaguga

SEQ ID NO: 7439 - RNA, 555 nt, Artificial Sequence
  derived and/or modified sequence opt5 from Endostatin__Homo_sapiens__NM_030582.3
augcacagccauagagacuuccagcccgugcugcaccucgucgcccugaacuccccucuuucuggcgggaugcggggaauccgcggcgcugauuuucaaugcuuccagcaggccagagcgguugggcuggcuggaaccuuucgggccuuccucagcucccgccugcaggaccuuuacucuauugugagacgggccgaucgcgcugccgugccgaucgucaaucugaaggacgagcuccuguuucccagcugggaggcucuguucuccggcucugaggggccucucaaacccggagccagaauuuuuagcuucgauggcaaggacgugcugcggcauccuacauggccccaaaaauccguuuggcacggcagcgauccuaacgggcgcagacuuacggaaucuuauugugagaccuggcggacagaagcgccguccgccaccggacaggcuagcucucugcucggcgggcgccugcuuggacaguccgccgcuagcugccaucacgccuacaucgugcuguguauugaaaauucuuuuaugacagcguccaaguga

SEQ ID NO: 7440 - RNA, 555 nt, Artificial Sequence
  derived and/or modified sequence opt6 from Endostatin__Homo_sapiens__NM_030582.3
augcauucacauagagauuuccaacccguacuacauuuaguagcauuaaauucaccauuaucaggaggaaugagaggaauaagaggagcagacuuucaauguuuccaacaagcaagagcuguaggacuagcuggaacauucagagcauuuuuaagcucaagacuacaagacuuauacaguauaguaagacgagcugauagagcagcaguaccaauaguaaauuuaaaagacgaacuauuauuuccaucaugggaagcacuauuuucaggaucagaaggaccauuaaaaccaggagcaagaauauuuucauuugacggaaaagacguauuaagacaucccacauggccacaaaaaagcguauggcauggaucagacccaaacggaagaagacuaacagaaucauacugugaaacauggagaacagaagcaccaucagcaacaggacaagcaucaucauuauuaggaggaagacuauuaggacaaucagcagcaucaugucaccaugcauauauaguacuauguauagaaaacucauucaugacagcaagcaaauaa

SEQ ID NO: 7441 - protein, 1356 aa, Artificial Sequence
  FLK-1__Homo_sapiens__P35968
MQSKVLLAVALWLCVETRAASVGLPSVSLDLPRLSIQKDILTIKANTTLQITCRGQRDLDWLWPNNQSGSEQRVEVTECSDGLFCKTLTIPKVIGNDTGAYKCFYRETDLASVIYVYVQDYRSPFIASVSDQHGVVYITENKNKTVVIPCLGSISNLNVSLCARYPEKRFVPDGNRISWDSKKGFTIPSYMISYAGMVFCEAKINDESYQSIMYIVVVVGYRIYDVVLSPSHGIELSVGEKLVLNCTARTELNVGIDFNWEYPSSKHQHKKLVNRDLKTQSGSEMKKFLSTLTIDGVTRSDQGLYTCAASSGLMTKKNSTFVRVHEKPFVAFGSGMESLVEATVGERVRIPAKYLGYPPPEIKWYKNGIPLESNHTIKAGHVLTIMEVSERDTGNYTVILTNPISKEKQSHVVSLVVYVPPQIGEKSLISPVDSYQYGTTQTLTCTVYAIPPPHHIHWYWQLEEECANEPSQAVSVTNPYPCEEWRSVEDFQGGNKIEVNKNQFALIEGKNKTVSTLVIQAANVSALYKCEAVNKVGRGERVISFHVTRGPEITLQPDMQPTEQESVSLWCTADRSTFENLTWYKLGPQPLPIHVGELPTPVCKNLDTLWKLNATMFSNSTNDILIMELKNASLQDQGDYVCLAQDRKTKKRHCVVRQLTVLERVAPTITGNLENQTTSIGESIEVSCTASGNPPPQIMWFKDNETLVEDSGIVLKDGNRNLTIRRVRKEDEGLYTCQACSVLGCAKVEAFFIIEGAQEKTNLEIIILVGTAVIAMFFWLLLVIILRTVKRANGGELKTGYLSIVMDPDELPLDEHCERLPYDASKWEFPRDRLKLGKPLGRGAFGQVIEADAFGIDKTATCRTVAVKMLKEGATHSEHRALMSELKILIHIGHHLNVVNLLGACTKPGGPLMVIVEFCKFGNLSTYLRSKRNEFVPYKTKGARFRQGKDYVGAIPVDLKRRLDSITSSQSSASSGFVEEKSLSDVEEEEAPEDLYKDFLTLEHLICYSFQVAKGMEFLASRKCIHRDLAARNILLSEKNVVKICDFGLARDIYKDPDYVRKGDARLPLKWMAPETIFDRVYTIQSDVWSFGVLLWEIFSLGASPYPGVKIDEEFCRRLKEGTRMRAPDYTTPEMYQTMLDCWHGEPSQRPTFSELVEHLGNLLQANAQQDGKDYIVLPISETLSMEEDSGLSLPTSPVSCMEEEEVCDPKFHYDNTAGISQYLQNSKRKSRPVSVKTFEDIPLEEPEVKVIPDDNQTDSGMVLASEELKTLEDRTKLSPSFGGMVPSKSRESVASEGSNQTSGYQSGYHSDDTDTTVYSSEEAELLKLIEIGVQTGSTAQILQPDSGTTLSSPPV

SEQ ID NO: 7442 - RNA, 4071 nt, Artificial Sequence
  FLK-1__Homo_sapiens__AAB88005
augcagagcaaggugcugcuggccgucgcccuguggcucugcguggagacccgggccgccucuguggguuugccuaguguuucucuugaucugcccaggcucagcauacaaaaagacauacuuacaauuaaggcuaauacaacucuucaaauuacuugcaggggacagagggacuuggacuggcuuuggcccaauaaucagaguggcagugagcaaaggguggaggugacugagugcagcgauggccucuucuguaagacacucacaauuccaaaagugaucggaaaugacacuggagccuacaagugcuucuaccgggaaacugacuuggccucggucauuuaugucuauguucaagauuacagaucuccauuuauugcuucuguuagugaccaacauggagucguguacauuacugagaacaaaaacaaaacuguggugauuccaugucucggguccauuucaaaucucaacgugucacuuugugcaagauacccagaaaagagauuuguuccugaugguaacagaauuuccugggacagcaagaagggcuuuacuauucccagcuacaugaucagcuaugcuggcauggucuucugugaagcaaaaauuaaugaugaaaguuaccagucuauuauguacauaguugucguuguaggguauaggauuuaugaugugguucugaguccgucucauggaauugaacuaucuguuggagaaaagcuugucuuaaauuguacagcaagaacugaacuaaauguggggauugacuucaacugggaauacccuucuucgaagcaucagcauaagaaacuuguaaaccgagaccuaaaaacccagucugggagugagaugaagaaauuuuugagcaccuuaacuauagaugguguaacccggagugaccaaggauuguacaccugugcagcauccagugggcugaugaccaagaagaacagcacauuugucaggguccaugaaaaaccuuuuguugcuuuuggaaguggcauggaaucucugguggaagccacggugggggagcgugucagaaucccugcgaaguaccuugguuacccacccccagaaauaaaaugguauaaaaauggaauaccccuugaguccaaucacacaauuaaagcggggcauguacugacgauuauggaagugagugaaagagacacaggaaauuacacugucauccuuaccaaucccauuucaaaggagaagcagagccauguggucucucugguuguguaugucccaccccagauuggugagaaaucucuaaucucuccuguggauuccuaccaguacggcaccacucaaacgcugacauguacggucuaugccauuccucccccgcaucacauccacugguauuggcaguuggaggaagagugcgccaacgagcccagccaagcugucucagugacaaacccauacccuugugaagaauggagaaguguggaggacuuccagggaggaaauaaaauugaaguuaauaaaaaucaauuugcucuaauugaaggaaaaaacaaaacuguaaguacccuuguuauccaagcggcaaaugugucagcuuuguacaaaugugaagcggucaacaaagucgggagaggagagagggugaucuccuuccacgugaccagggguccugaaauuacuuugcaaccugacaugcagcccacugagcaggagagcgugucuuuguggugcacugcagacagaucuacguuugagaaccucacaugguacaagcuuggcccacagccucugccaauccaugugggagaguugcccacaccuguuugcaagaacuuggauacucuuuggaaauugaaugccaccauguucucuaauagcacaaaugacauuuugaucauggagcuuaagaaugcauccuugcaggaccaaggagacuaugucugccuugcucaagacaggaagaccaagaaaagacauugcguggucaggcagcucacaguccuagagcguguggcacccacgaucacaggaaaccuggagaaucagacgacaaguauuggggaaagcaucgaagucucaugcacggcaucugggaaucccccuccacagaucaugugguuuaaagauaaugagacccuuguagaagacucaggcauuguauugaaggaugggaaccggaaccucacuauccgcagagugaggaaggaggacgaaggccucuacaccugccaggcaugcaguguucuuggcugugcaaaaguggaggcauuuuucauaauagaaggugcccaggaaaagacgaacuuggaaaucauuauucuaguaggcacggcggugauugccauguucuucuggcuacuucuugucaucauccuacggaccguuaagcgggccaauggaggggaacugaagacaggcuacuuguccaucgucauggauccagaugaacucccauuggaugaacauugugaacgacugccuuaugaugccagcaaaugggaauuccccagagaccggcugaagcuagguaagccucuuggccguggugccuuuggccaagugauugaagcagaugccuuuggaauugacaagacagcaacuugcaggacaguagcagucaaaauguugaaagaaggagcaacacacagugagcaucgagcucucaugucugaacucaagauccucauucauauuggucaccaucucaauguggucaaccuucuaggugccuguaccaagccaggagggccacucauggugauuguggaauucugcaaauuuggaaaccuguccacuuaccugaggagcaagagaaaugaauuuguccccuacaagaccaaaggggcacgauuccgucaagggaaagacuacguuggagcaaucccuguggaucugaaacggcgcuuggacagcaucaccaguagccagagcucagccagcucuggauuuguggaggagaagucccucagugauguagaagaagaggaagcuccugaagaucuguauaaggacuuccugaccuuggagcaucucaucuguuacagcuuccaaguggcuaagggcauggaguucuuggcaucgcgaaaguguauccacagggaccuggcggcacgaaauauccucuuaucggagaagaacgugguuaaaaucugugacuuuggcuuggcccgggauauuuauaaagauccagauuaugucagaaaaggagaugcucgccucccuuugaaauggauggccccagaaacaauuuuugacagaguguacacaauccagagugacgucuggucuuuugguguuuugcugugggaaauauuuuccuuaggugcuucuccauauccugggguaaagauugaugaagaauuuuguaggcgauugaaagaaggaacuagaaugagggccccugauuauacuacaccagaaauguaccagaccaugcuggacugcuggcacggggagcccagucagagacccacguuuucagaguugguggaacauuugggaaaucucuugcaagcuaaugcucagcaggauggcaaagacuacauuguucuuccgauaucagagacuuugagcauggaagaggauucuggacucucucugccuaccucaccuguuuccuguauggaggaggaggaaguaugugaccccaaauuccauuaugacaacacagcaggaaucagucaguaucugcagaacaguaagcgaaagagccggccugugaguguaaaaacauuugaagauaucccguuagaagaaccagaaguaaaaguaaucccagaugacaaccagacggacagugguaugguucuugccucagaagagcugaaaacuuuggaagacagaaccaaauuaucuccaucuuuugguggaauggugcccagcaaaagcagggagucuguggcaucugaaggcucaaaccagacaagcggcuaccaguccggauaucacuccgaugacacagacaccaccguguacuccagugaggaagcagaacuuuuaaagcugauagagauuggagugcaaaccgguagcacagcccagauucuccagccugacucggggaccacacugagcucuccuccuguuuaa

SEQ ID NO: 7443 - RNA, 4071 nt, Artificial Sequence
  derived and/or modified sequence opt1 from FLK-1__Homo_sapiens__AAB88005
augcagagcaaggugcugcucgccgucgcccuguggcugugcguggagacccgcgcggccuccgugggccuccccagcgucucccuggaccugccccggcucagcauccagaaggacauccugaccaucaaggccaacacgacccugcagaucacgugccgcgggcagcgggaccucgacuggcuguggcccaacaaccaguccggcagcgagcagcgcguggaggugaccgagugcuccgacgggcuguucugcaagacccucaccauccccaaggucaucggcaacgacaccggggccuacaagugcuucuaccgggagaccgaccuggccagcgugaucuacguguacguccaggacuaccgcucccccuucaucgcgagcguguccgaccagcacggcguggucuacaucacggagaacaagaacaagaccguggugaucccgugccugggcagcaucuccaaccucaacgucagccugugcgcccgguaccccgagaagcgcuucgugcccgacgggaaccggaucuccugggacagcaagaagggcuucaccauccccuccuacaugaucagcuacgccgggaugguguucugcgaggccaagaucaacgacgaguccuaccagagcaucauguacaucgucgugguggucggcuaccgcaucuacgacguggugcugagcccgucccacgggaucgagcucagcgucggcgagaagcuggugcugaacugcaccgcgcggacggagcucaacgucggcaucgacuucaacugggaguaccccuccagcaagcaccagcacaagaagcuggugaaccgcgaccugaagacccaguccgggagcgagaugaagaaguuccucuccacccugaccaucgacggcgugacgcggagcgaccaggggcuguacacgugcgccgccuccagcggccucaugaccaagaagaacuccaccuucguccgcgugcacgagaagcccuucguggccuucggcagcgggauggagucccuggucgaggccaccgugggcgagcgggugcgcauccccgcgaaguaccugggguacccgccgcccgagaucaagugguacaagaacggcaucccccucgagagcaaccacaccaucaaggccgggcacguccugaccaucauggagguguccgagcgggacaccggcaacuacacggugauccugaccaacccgaucagcaaggagaagcagucccacgucgugagccucguggucuacgugccgccccagaucggcgagaagucccugaucagccccguggacagcuaccaguacgggaccacccagacgcugaccugcaccgucuacgccaucccgccgccccaccacauccacugguacuggcagcucgaggaggagugcgccaacgagcccucccaggccgugagcgugaccaaccccuaccccugcgaggaguggcgcuccgucgaggacuuccagggcgggaacaagaucgaggugaacaagaaccaguucgcgcugaucgagggcaagaacaagacggugagcacccuggucauccaggccgccaacguguccgcccucuacaagugcgaggccgugaacaaggucgggcggggcgagcgcgugaucagcuuccacgugacccggggccccgagaucacccugcagcccgacaugcagcccacggagcaggaguccgucagccuguggugcaccgcggaccgcuccaccuucgagaaccucaccugguacaagcuggggccccagccccugccgauccacgugggcgagcuccccacccccgugugcaagaaccuggacacgcuguggaagcucaacgccaccauguucagcaacuccaccaacgacauccugaucauggagcugaagaacgccagccugcaggaccagggggacuacgucugccucgcccaggaccgcaagaccaagaagcggcacugcguggugcgccagcugacgguccuggagcggguggcccccaccaucaccggcaaccucgagaaccagaccacguccaucggggagagcaucgagguguccugcaccgcgagcggcaacccgccgccccagaucaugugguucaaggacaacgagacccuggucgaggacuccggcaucgugcugaaggacgggaaccgcaaccucaccauccggcgcgugcggaaggaggacgagggccuguacacgugccaggccugcagcguccuggggugcgccaagguggaggccuucuucaucaucgagggcgcgcaggagaagaccaaccucgagaucaucauccuggugggcaccgccgucaucgccauguucuucuggcugcuccuggugaucauccugcgcaccgugaagcgggccaacgggggcgagcucaagacgggguaccugagcaucgucauggaccccgacgagcugccccucgacgagcacugcgagcgccugcccuacgacgccuccaagugggaguucccccgggaccgccugaagcucggcaagccccuggggcggggcgcguucggccaggugaucgaggccgacgccuucgggaucgacaagaccgcgaccugccgcaccguggccgucaagaugcugaaggagggcgccacgcacagcgagcaccgggcccucauguccgagcugaagauccugauccacaucgggcaccaccucaacguggucaaccugcugggcgccugcaccaagcccgggggcccccucauggugaucguggaguucugcaaguucggcaaccugagcaccuaccugcgcuccaagcggaacgaguucguccccuacaagaccaagggggcccgcuuccggcagggcaaggacuacgugggggccauccccguggaccucaagcgccgccuggacagcaucacguccagccaguccagcgcguccagcggcuucgucgaggagaagucccugagcgacguggaggaggaggaggccccggaggaccucuacaaggacuuccugacccuggagcaccucaucugcuacuccuuccagguggccaaggggauggaguuccuggccagccggaagugcauccaccgcgaccuggcggcccggaacauccuccuguccgagaagaacgucgugaagaucugcgacuucggccuggcccgcgacaucuacaaggaccccgacuacgugcggaagggcgacgcccgccucccccugaaguggauggcccccgagaccaucuucgaccgggucuacaccauccagagcgacgugugguccuucggggugcugcucugggagaucuucagccugggcgcgagcccguaccccggggucaagaucgacgaggaguucugccgccggcugaaggagggcacgcgcaugcgggcccccgacuacaccacccccgagauguaccagaccaugcucgacugcuggcacggggagccgucccagcgccccacguucagcgagcugguggagcaccugggcaaccuccugcaggccaacgcccagcaggacggcaaggacuacaucgugcugcccaucuccgagacccucagcauggaggaggacuccgggcugagccugccgaccucccccgucagcugcauggaggaggaggaggugugcgaccccaaguuccacuacgacaacaccgccggcaucucccaguaccuccagaacagcaagcggaagucccgccccgugagcgucaagacguucgaggacaucccgcuggaggagcccgaggugaaggugauccccgacgacaaccagaccgacuccgggaugguccuggcgagcgaggagcucaagacccuggaggaccggaccaagcugucccccagcuucggcggcauggugccguccaagagccgcgaguccguggccagcgaggggagcaaccagaccuccggcuaccagagcggguaccacuccgacgacacggacaccaccgucuacagcuccgaggaggccgagcuccugaagcugaucgagaucggcgugcagaccgggagcacggcccagauccuccagcccgacuccggcaccacccugagcuccccgcccguguga

SEQ ID NO: 7444 - RNA, 4071 nt, Artificial Sequence
  derived and/or modified sequence opt2 from FLK-1__Homo_sapiens__AAB88005
augcaguccaagguccuccucgccgucgcccucuggcucugcgucgagacccgcgccgccuccgucggccuccccuccgucucccucgaccucccccgccucuccauccagaaggacauccucaccaucaaggccaacaccacccuccagaucaccugccgcggccagcgcgaccucgacuggcucuggcccaacaaccaguccggcuccgagcagcgcgucgaggucaccgagugcuccgacggccucuucugcaagacccucaccauccccaaggucaucggcaacgacaccggcgccuacaagugcuucuaccgcgagaccgaccucgccuccgucaucuacgucuacguccaggacuaccgcucccccuucaucgccuccgucuccgaccagcacggcgucgucuacaucaccgagaacaagaacaagaccgucgucauccccugccucggcuccaucuccaaccucaacgucucccucugcgcccgcuaccccgagaagcgcuucguccccgacggcaaccgcaucuccugggacuccaagaagggcuucaccauccccuccuacaugaucuccuacgccggcauggucuucugcgaggccaagaucaacgacgaguccuaccaguccaucauguacaucgucgucgucgucggcuaccgcaucuacgacgucguccucucccccucccacggcaucgagcucuccgucggcgagaagcucguccucaacugcaccgcccgcaccgagcucaacgucggcaucgacuucaacugggaguaccccuccuccaagcaccagcacaagaagcucgucaaccgcgaccucaagacccaguccggcuccgagaugaagaaguuccucuccacccucaccaucgacggcgucacccgcuccgaccagggccucuacaccugcgccgccuccuccggccucaugaccaagaagaacuccaccuucguccgcguccacgagaagcccuucgucgccuucggcuccggcauggagucccucgucgaggccaccgucggcgagcgcguccgcauccccgccaaguaccucggcuaccccccccccgagaucaagugguacaagaacggcaucccccucgaguccaaccacaccaucaaggccggccacguccucaccaucauggaggucuccgagcgcgacaccggcaacuacaccgucauccucaccaaccccaucuccaaggagaagcagucccacgucgucucccucgucgucuacguccccccccagaucggcgagaagucccucaucucccccgucgacuccuaccaguacggcaccacccagacccucaccugcaccgucuacgccaucccccccccccaccacauccacugguacuggcagcucgaggaggagugcgccaacgagcccucccaggccgucuccgucaccaaccccuaccccugcgaggaguggcgcuccgucgaggacuuccagggcggcaacaagaucgaggucaacaagaaccaguucgcccucaucgagggcaagaacaagaccgucuccacccucgucauccaggccgccaacgucuccgcccucuacaagugcgaggccgucaacaaggucggccgcggcgagcgcgucaucuccuuccacgucacccgcggccccgagaucacccuccagcccgacaugcagcccaccgagcaggaguccgucucccucuggugcaccgccgaccgcuccaccuucgagaaccucaccugguacaagcucggcccccagccccuccccauccacgucggcgagcuccccacccccgucugcaagaaccucgacacccucuggaagcucaacgccaccauguucuccaacuccaccaacgacauccucaucauggagcucaagaacgccucccuccaggaccagggcgacuacgucugccucgcccaggaccgcaagaccaagaagcgccacugcgucguccgccagcucaccguccucgagcgcgucgcccccaccaucaccggcaaccucgagaaccagaccaccuccaucggcgaguccaucgaggucuccugcaccgccuccggcaacccccccccccagaucaugugguucaaggacaacgagacccucgucgaggacuccggcaucguccucaaggacggcaaccgcaaccucaccauccgccgcguccgcaaggaggacgagggccucuacaccugccaggccugcuccguccucggcugcgccaaggucgaggccuucuucaucaucgagggcgcccaggagaagaccaaccucgagaucaucauccucgucggcaccgccgucaucgccauguucuucuggcuccuccucgucaucauccuccgcaccgucaagcgcgccaacggcggcgagcucaagaccggcuaccucuccaucgucauggaccccgacgagcucccccucgacgagcacugcgagcgccuccccuacgacgccuccaagugggaguucccccgcgaccgccucaagcucggcaagccccucggccgcggcgccuucggccaggucaucgaggccgacgccuucggcaucgacaagaccgccaccugccgcaccgucgccgucaagaugcucaaggagggcgccacccacuccgagcaccgcgcccucauguccgagcucaagauccucauccacaucggccaccaccucaacgucgucaaccuccucggcgccugcaccaagcccggcggcccccucauggucaucgucgaguucugcaaguucggcaaccucuccaccuaccuccgcuccaagcgcaacgaguucguccccuacaagaccaagggcgcccgcuuccgccagggcaaggacuacgucggcgccauccccgucgaccucaagcgccgccucgacuccaucaccuccucccaguccuccgccuccuccggcuucgucgaggagaagucccucuccgacgucgaggaggaggaggcccccgaggaccucuacaaggacuuccucacccucgagcaccucaucugcuacuccuuccaggucgccaagggcauggaguuccucgccucccgcaagugcauccaccgcgaccucgccgcccgcaacauccuccucuccgagaagaacgucgucaagaucugcgacuucggccucgcccgcgacaucuacaaggaccccgacuacguccgcaagggcgacgcccgccucccccucaaguggauggcccccgagaccaucuucgaccgcgucuacaccauccaguccgacgucugguccuucggcguccuccucugggagaucuucucccucggcgccucccccuaccccggcgucaagaucgacgaggaguucugccgccgccucaaggagggcacccgcaugcgcgcccccgacuacaccacccccgagauguaccagaccaugcucgacugcuggcacggcgagcccucccagcgccccaccuucuccgagcucgucgagcaccucggcaaccuccuccaggccaacgcccagcaggacggcaaggacuacaucguccuccccaucuccgagacccucuccauggaggaggacuccggccucucccuccccaccucccccgucuccugcauggaggaggaggaggucugcgaccccaaguuccacuacgacaacaccgccggcaucucccaguaccuccagaacuccaagcgcaagucccgccccgucuccgucaagaccuucgaggacaucccccucgaggagcccgaggucaaggucauccccgacgacaaccagaccgacuccggcaugguccucgccuccgaggagcucaagacccucgaggaccgcaccaagcucucccccuccuucggcggcaugguccccuccaagucccgcgaguccgucgccuccgagggcuccaaccagaccuccggcuaccaguccggcuaccacuccgacgacaccgacaccaccgucuacuccuccgaggaggccgagcuccucaagcucaucgagaucggcguccagaccggcuccaccgcccagauccuccagcccgacuccggcaccacccucuccuccccccccgucuga

SEQ ID NO: 7445 - RNA, 4071 nt, Artificial Sequence
  derived and/or modified sequence opt3 from FLK-1__Homo_sapiens__AAB88005
augcagagcaaggugcugcucgccgucgcucuuuggcugugcguugagaccagagcagccuccgugggcuugcccucuguaucauuagaccugccuaggcuaaguauccaaaaagauauucucacaauaaaggcgaacacuacgcugcagaucaccugucgggggcagcgcgaccuugauuggcuguggccaaauaaccagagcggauccgaacaacgaguggaggucacagaaugcucugacgguuuguucuguaaaacucucaccauuccgaaggugaucggcaaugauacaggggcuuacaaaugcuuuuaucgugagaccgaccuggccucgguuauuuacguguauguccaggauuacagaucacccuucaucgcaagcgugagugaccagcacggaguaguuuauauaacugaaaacaagaauaagacaguggucaucccuugucugggcuccauuucuaaccucaaugugagcuuaugcgccagguacccagagaaacgguuugugcccgaugguaaccgcaucuccugggacucaaagaaaggguucaccauuccuaguuauaugaucagcuacgcuggaauggucuuuugugaggcaaagauaaaugaugaaucuuaccaguccauuauguauaucguugugguagugggcuacagaauuuaugacgucgugcugucaccaagccauggcaucgagcuuaguguuggggaaaaauuggugcugaacugcacggccaggacugagcuaaaugucggaaucgauuucaacugggaguaccccucuuccaagcaccaacauaagaaacucgugaaucgggaccugaagacccagagcgguucggaaaugaaaaaguuucuuucuacacugacuauugacggcguaacccgcuccgaucagggguuguauacaugugcugccucaaguggacucaugaccaaaaagaacagcacguucguucgagugcacgagaaaccuuuugucgcguucggcuccgguauggaaucucugguggaggcaacugucggggaaagagugaggauaccagccaaguacuuaggauauccgcccccugagaucaagugguacaaaaauggcauuccacuggagagcaaccauacaaucaaggcuggccacguucucaccauaauggaagugucagagcgggacacugggaacuacacaguaauucuuaccaaucccaucaguaaagaaaagcagucccacgucgugagccugguuguguaugucccuccacaaaucggagagaaaucuuugauuucacccguggauaguuaccaguaugguacgacccagacacuaacuugcaccguauacgccaucccgccuccccaucacauucauugguauuggcaacuggaagaggagugugcaaacgaaccaagccaggcuguguccguuacaaauccuuaccccugcgaggaauggcguucugucgaggacuuucagggcgggaacaagauagaagugaauaagaaccaguucgcccucaucgagggcaaaaauaagacugugucgacccuggucauucaagcggccaacguuagcgcacuuuauaaaugcgaggcugugaauaaggugggacgcggugaaagaguaaucuccuuucacgucacaagggggccagagaucacccugcagcccgauaugcagccuacugaacaggagucagugaguuugugguguacggccgaccggucuacauucgagaaccucaccugguacaaacugggcccacaaccguuacccauucacguuggagaacugccuacuccagugugcaagaaucuagauacccucuggaagcugaacgcuacaauguucagcaauuccaccaacgacauacuuaucauggaguugaaaaaugccucacugcaggaucagggcgacuacgucugucucgcacaggaucgaaagacuaaaaagcgccauugcgugguuagacaacugacagugcuugaaaggguagcccccacgauuaccgggaaccuggagaaccagacuacaagcaucggagaaucuauugaggucuccuguaccgcuagugguaauccuccaccccagaucaugugguuuaaagacaacgagacauugguggaagacagcggcauagugcucaaggaugggaaucggaaccugacuauccgcagagucaggaaggaggacgaaggauuauauaccugccaggcguguucuguucugggcugcgcaaaaguggaggccuucuuuauuaucgaaggugcucaagagaagacgaaucuagagauuaucauacucguagggaccgccgugauugcaauguucuuuuggcugcuuuuggucaucauucugcguacagugaaacgggccaacggcggagaacucaagacuggcuaccuguccaucguuauggauccggacgaguuaccucuggaugaacacugugagcgacuuccauaugacgcuucaaaaugggaauuucccagagauagguugaagcucgggaaaccucugggacgcggugccuuuggccaggugauagaggcagacgcguucgggaucgauaagaccgcuacaugccggacugucgccgugaagaugcuaaaagagggagcaacccauagugaacacagagcccugaugagcgagcucaagauucugauccauauuggccaccaccuuaauguugugaacuugcugggugcuuguacgaaacccgggggcccauuaauggucaucguagaauuuugcaaguucggaaaucucucgacauaccugagguccaaacgcaacgaguuugugccuuauaagaccaagggcgcccgauuccggcaggggaaagacuacguuggagcaauacccguggaucuuaagcguagacuggacucuauuacuagcucacaaaguuccgcuucuagcggcuuugucgaggaaaaauccuugucagauguggaggaagaggaagccccagaggaccucuauaaggacuuccugacacuagagcaucugaucugcuacagcuuccagguagcgaaagguauggaauuucucgccaguaggaaguguauccaccgcgaucuggcugcacggaauauucuuuugucugagaagaacguggucaaaaucugcgacuucgggcuggccagagauauuuacaaggacccggauuauguuaggaaaggagacgcucgauuaccucucaaguggauggcccccgaaaccauauuugaucgcguguacacuauccaguccgacguguggagcuucggcguccugcuuugggagauuuucucgcugggugcaucaccauaucccggcgugaaaaucgaugaagaguucugucggagacuaaaggaggggaccaggaugcgugcgccugacuacacaacgccagaaauguaucagaccaugcucgauugcuggcauggagagcccucucaacgcccuacuuuuagugaacugguugagcacuugggcaaucuguuacaggccaacgcucagcaggacgggaaggauuacauuguacucccgaucuccgaaacacugagcauggaggaggacucuggacuuagccugccaaccucccccgugucauguauggaagaggaagaggucugcgacccuaaauuccacuaugauaauacagccggcauaagucaauacuugcagaacagcaagcggaaaucuagaccaguguccguuaagacuuuugaggacaucccccucgaggaaccugaagugaaagucauuccggaugacaaccagaccgauucagguauggugcuggcaagugaggaacuaaagacgcuggaggacaggacaaaacuuagccccuccuucgggggaaugguaccaucuaagucgcgagagagcgucgcuucagaaggcuccaaucagaccagugguuaccaaucuggcuaucauagcgaugacacugauaccacaguguacuccucagaggaagccgagcuccugaaguugaucgaaauugggguucagacuggaucuaccgcacagauccugcaaccugacagcggcacaacguuaaguuccccacccguguga

SEQ ID NO: 7446 - RNA, 4071 nt, Artificial Sequence
  derived and/or modified sequence opt4 from FLK-1__Homo_sapiens__AAB88005
augcagagcaaggugcugcuggccguggcccuguggcugugcguggagaccagagccgccagcgugggccugcccagcgugagccuggaccugcccagacugagcauccagaaggacauccugaccaucaaggccaacaccacccugcagaucaccugcagaggccagagagaccuggacuggcuguggcccaacaaccagagcggcagcgagcagagaguggaggugaccgagugcagcgacggccuguucugcaagacccugaccauccccaaggugaucggcaacgacaccggcgccuacaagugcuucuacagagagaccgaccuggccagcgugaucuacguguacgugcaggacuacagaagccccuucaucgccagcgugagcgaccagcacggcgugguguacaucaccgagaacaagaacaagaccguggugauccccugccugggcagcaucagcaaccugaacgugagccugugcgccagauaccccgagaagagauucgugcccgacggcaacagaaucagcugggacagcaagaagggcuucaccauccccagcuacaugaucagcuacgccggcaugguguucugcgaggccaagaucaacgacgagagcuaccagagcaucauguacaucguggugguggugggcuacagaaucuacgacguggugcugagccccagccacggcaucgagcugagcgugggcgagaagcuggugcugaacugcaccgccagaaccgagcugaacgugggcaucgacuucaacugggaguaccccagcagcaagcaccagcacaagaagcuggugaacagagaccugaagacccagagcggcagcgagaugaagaaguuccugagcacccugaccaucgacggcgugaccagaagcgaccagggccuguacaccugcgccgccagcagcggccugaugaccaagaagaacagcaccuucgugagagugcacgagaagcccuucguggccuucggcagcggcauggagagccugguggaggccaccgugggcgagagagugagaauccccgccaaguaccugggcuaccccccccccgagaucaagugguacaagaacggcaucccccuggagagcaaccacaccaucaaggccggccacgugcugaccaucauggaggugagcgagagagacaccggcaacuacaccgugauccugaccaaccccaucagcaaggagaagcagagccacguggugagccuggugguguacgugcccccccagaucggcgagaagagccugaucagccccguggacagcuaccaguacggcaccacccagacccugaccugcaccguguacgccaucccccccccccaccacauccacugguacuggcagcuggaggaggagugcgccaacgagcccagccaggccgugagcgugaccaaccccuaccccugcgaggaguggagaagcguggaggacuuccagggcggcaacaagaucgaggugaacaagaaccaguucgcccugaucgagggcaagaacaagaccgugagcacccuggugauccaggccgccaacgugagcgcccuguacaagugcgaggccgugaacaaggugggcagaggcgagagagugaucagcuuccacgugaccagaggccccgagaucacccugcagcccgacaugcagcccaccgagcaggagagcgugagccuguggugcaccgccgacagaagcaccuucgagaaccugaccugguacaagcugggcccccagccccugcccauccacgugggcgagcugcccacccccgugugcaagaaccuggacacccuguggaagcugaacgccaccauguucagcaacagcaccaacgacauccugaucauggagcugaagaacgccagccugcaggaccagggcgacuacgugugccuggcccaggacagaaagaccaagaagagacacugcguggugagacagcugaccgugcuggagagaguggcccccaccaucaccggcaaccuggagaaccagaccaccagcaucggcgagagcaucgaggugagcugcaccgccagcggcaacccccccccccagaucaugugguucaaggacaacgagacccugguggaggacagcggcaucgugcugaaggacggcaacagaaaccugaccaucagaagagugagaaaggaggacgagggccuguacaccugccaggccugcagcgugcugggcugcgccaagguggaggccuucuucaucaucgagggcgcccaggagaagaccaaccuggagaucaucauccuggugggcaccgccgugaucgccauguucuucuggcugcugcuggugaucauccugagaaccgugaagagagccaacggcggcgagcugaagaccggcuaccugagcaucgugauggaccccgacgagcugccccuggacgagcacugcgagagacugcccuacgacgccagcaagugggaguuccccagagacagacugaagcugggcaagccccugggcagaggcgccuucggccaggugaucgaggccgacgccuucggcaucgacaagaccgccaccugcagaaccguggccgugaagaugcugaaggagggcgccacccacagcgagcacagagcccugaugagcgagcugaagauccugauccacaucggccaccaccugaacguggugaaccugcugggcgccugcaccaagcccggcggcccccugauggugaucguggaguucugcaaguucggcaaccugagcaccuaccugagaagcaagagaaacgaguucgugcccuacaagaccaagggcgccagauucagacagggcaaggacuacgugggcgccauccccguggaccugaagagaagacuggacagcaucaccagcagccagagcagcgccagcagcggcuucguggaggagaagagccugagcgacguggaggaggaggaggcccccgaggaccuguacaaggacuuccugacccuggagcaccugaucugcuacagcuuccagguggccaagggcauggaguuccuggccagcagaaagugcauccacagagaccuggccgccagaaacauccugcugagcgagaagaacguggugaagaucugcgacuucggccuggccagagacaucuacaaggaccccgacuacgugagaaagggcgacgccagacugccccugaaguggauggcccccgagaccaucuucgacagaguguacaccauccagagcgacguguggagcuucggcgugcugcugugggagaucuucagccugggcgccagccccuaccccggcgugaagaucgacgaggaguucugcagaagacugaaggagggcaccagaaugagagcccccgacuacaccacccccgagauguaccagaccaugcuggacugcuggcacggcgagcccagccagagacccaccuucagcgagcugguggagcaccugggcaaccugcugcaggccaacgcccagcaggacggcaaggacuacaucgugcugcccaucagcgagacccugagcauggaggaggacagcggccugagccugcccaccagccccgugagcugcauggaggaggaggaggugugcgaccccaaguuccacuacgacaacaccgccggcaucagccaguaccugcagaacagcaagagaaagagcagacccgugagcgugaagaccuucgaggacaucccccuggaggagcccgaggugaaggugauccccgacgacaaccagaccgacagcggcauggugcuggccagcgaggagcugaagacccuggaggacagaaccaagcugagccccagcuucggcggcauggugcccagcaagagcagagagagcguggccagcgagggcagcaaccagaccagcggcuaccagagcggcuaccacagcgacgacaccgacaccaccguguacagcagcgaggaggccgagcugcugaagcugaucgagaucggcgugcagaccggcagcaccgcccagauccugcagcccgacagcggcaccacccugagcagcccccccguguga

SEQ ID NO: 7447 - RNA, 4071 nt, Artificial Sequence
  derived and/or modified sequence opt5 from FLK-1__Homo_sapiens__AAB88005
augcagagcaaggugcugcucgccgucgcucuguggcuuugcguugagaccagagccgcguccgugggccugcccucugugagccucgaccugccucggcuuuccauccaaaaagauauucugacaaucaaggcuaacacgacccuccagauuacaugucgcgggcagagagaccuggauuggcuguggccgaauaaccagucuggaagcgaacaacgggucgaggugaccgaaugcuccgacggccucuucuguaaaacacugaccauccccaagguuauugggaaugauacaggagccuacaaaugcuuuuaucgcgagaccgaccuugccucugugaucuacgucuaugugcaggauuacagaagcccuuucaucgcuuccguuagcgaccagcacggcguggucuauauuacggaaaacaagaauaagaccguggugauccccugucuggggucuauuuccaaccucaaugucagccugugcgcccgguacccugagaaacgcuuuguucccgauggaaacagaaucucuugggacuccaagaaaggcuucacaauuccuagcuauaugaucucuuacgcuggcaugguguuuugugaggccaagauuaaugaugaauccuaccagagcaucauguauaucguggucgugguuggguaccggauuuaugacgugguccuuuccccgucucauggaaucgagcugagcgugggcgaaaaacucguucugaacugcaccgcgcgcacagagcugaauguggggauugauuucaacugggaguaccccuccagcaagcaccaacauaagaaacucgucaauagagaccugaagacccagucuggauccgaaaugaaaaaguuucuuagcacgcugacaaucgacggcgugacccggucugaucaggggcucuauacaugugccgcuagcuccggacugaugaccaaaaagaacucuaccuucguccgcgugcacgagaaaccuuuuguugccuucggcagcggcauggaaucccuuguggaggcuacagucggggaaagagugcggauucccgccaaguaccugggauauccucccccggagaucaagugguacaaaaauggcaucccucucgagagcaaccauacgauuaaggcggggcacguucugaccaucauggaagugucugagcgcgacacaggaaacuacaccgucauucugacaaaucccaucuccaaagaaaagcagagccacguggugucucucguugucuaugugccuccccaaauuggcgagaaaucccugaucagccccguggauuccuaccaguaugggaccacgcagacacuuaccugcaccgucuacgccaucccuccgccccaucacauucauugguauuggcaacuggaagaggagugugcuaacgaaccuucucaggccgugagcguuacaaaucccuacccuugcgaggaauggagauccguggaggacuuucagggaggcaacaagaucgaagucaauaagaaccaguucgcucucauugagggcaaaaauaagaccgugucuacacugguuauccaagccgccaacgugagcgcucuuuauaaaugcgaggcggucaauaagguggggcggggagaaagaguuauuuccuuucacgugacgcgcggccccgagaucacccugcagccggauaugcagccuacagaacaggagagcgucucucucugguguaccgccgaccgguccacauucgagaaccugaccugguacaaacuggggccccaaccucuccccauucacgugggagaacugccuacgcccgugugcaagaaucuugauacccuguggaagcucaacgcuacaauguucagcaauucuaccaacgacauccugaucauggagcugaaaaaugccucccuucaggaucagggcgacuacgucugucucgcccaggauagaaagacaaagaagcgccauugcguugugcggcaacugaccgugcuggaaagagucgcuccgacgauuacagggaaccucgagaaccagaccacaagcaucggcgaaucuauugaggugagcuguaccgccuccggaaauccuccuccccagaucaugugguuuaaagacaacgagacccugguugaagacagcggcauugugcuuaaggaugggaaucgcaaccugacaauccggagaguccgcaaggaggacgaaggacucuauacgugccaggcguguucugugcugggcugcgcuaaaguugaggccuucuuuaucauugaaggggcccaagagaagaccaaucuggagaucauuauccuugugggaacagcugucauugccauguucuuuuggcuccugcuggugaucauccuccggaccguuaaaagagcuaacggcggggaacugaagacaggcuaccuuuccauugugauggaucccgacgagcugccgcucgaugaacacugugagcgccugcccuaugacgccagcaaaugggaauuuccucgggauagacugaaacuuggaaaaccccucggccgcggggcguuuggacaggucaucgaggccgacgcuuucggcauugauaagaccgccacgugccggacaguggcugugaagaugcugaaagagggggccacccauuccgaacacagagcgcugaugucugagcucaagauccugauucauaucggacaccaccuuaaugucguuaaccugcucggcgccuguaccaaaccugggggcccccugauggugaucguggaauuuugcaaguucggaaaucugagcacauaccuucgguccaaaagaaacgaguuugucccuuauaagaccaagggcgcucgcuuccggcaggggaaagacuacgugggagccauucccguugaucucaagagacgccuggacucuaucacaagcucccaaucuagcgcuuccagcggcuuuguggaggaaaaaucucuguccgaugucgaggaagaggaagccccggaggaccucuauaaggacuuccugacgcuugagcaucugauuugcuacagcuuccagguggccaaagggauggaauuucucgcuucuagaaaguguauccaccgggaucuggcggcccgcaauauucugcuuuccgagaagaacguugugaaaaucugcgacuucggacuggcuagagauauuuacaaggacccugauuauguccggaaaggcgacgcccgccucccccugaaguggauggccccugaaaccaucuuugauagaguguacacaauccagagcgacgucuggucuuucggggugcuccugugggagauuuucucccuuggcgcuagccccuauccgggaguuaaaaucgaugaagaguucugucggcgccugaaggagggcaccagaaugcgggccccugacuacacaacccccgaaauguaucagacgaugcucgauugcuggcauggggagccuucccaacgccccaccuuuagcgaacugguggagcaccugggaaaucuucugcaggcgaacgcucagcaggacggcaaggauuacauuguccuccccaucucugaaacacugagcauggaggaggacuccgggcucucucugccuaccagcccgguguccuguauggaagaggaagagguuugcgaccccaaauuccacuaugauaauacagccggaauuucucaauaccuucagaacagcaagagaaaaucccggccugugucugucaagaccuuugaggacaucccccuggaggaaccugaagugaaagugauccccgaugacaaccagacagauagcggcaugguucucgccuccgaggaacugaagacccuggaggacagaacgaaacuuagcccuucuuucggcgggauggucccguccaagagccgcgagucuguggcuuccgaaggaagcaaucagacauccggcuaccaaucuggguaucauagcgaugacaccgauaccacaguguacuccagcgaggaagccgagcugcucaagcugauugaaaucggaguccagaccggcucuacggcgcagauucuccaacccgacuccgggacaacccugagcucuccucccguguga

SEQ ID NO: 7448 - RNA, 4071 nt, Artificial Sequence
  derived and/or modified sequence opt6 from FLK-1__Homo_sapiens__AAB88005
augcaauccaaagugcuacuugccgucgcuuuguggcuauguguagaaacacgagcagcaucuguuggcuuacccuccgucucacuagaccugccaagacuauccauacagaaagauauauuaacaauaaaagcuaacacaacccuucaaaucacuugucgaggacaaagagaucuagacuggcuguggccuaauaaucaauccgguagugaacaaagagucgaaguaacggagugcucagauggacuauucuguaaaacucuaacgauaccaaaaguaauaggaaaugauacuggugcauauaaauguuuuuauagagaaacugacuuagcaucgguaauauauguauacguacaagauuauagaucgccauucauagcuucuguuucagaccagcauggagucguauauauaacugagaauaaaaauaaaaccgucgucauaccuugccuaggaucaauuaguaauuuaaacguuagccuuugugcaagauaucccgaaaaacgcuucgucccagauggaaaucgaauaaguugggauucuaaaaaaggauuuacaauaccgagcuacaugauaucuuacgcaggaaugguauuuugugaagcaaaaaucaaugaugaaucuuaccaaucaauuauguauauagugguaguaguuggcuacaggauauaugauguaguucuaucacccucccaugguauagaauuaucgguaggagaaaaauuaguacuuaauuguaccgcaagaacagaacuaaauguugggauagacuucaauugggaauacccguccaguaagcaucaacacaaaaaacuaguuaauagagaccucaaaacacaaucggguuccgagaugaaaaaguucuugucaacacucacgauugacggaguuacaaggucggaccaaggucucuauacaugcgcagcaaguucaggcuuaaugaccaaaaaaaacucuacauuuguuagaguucaugaaaaaccuuuuguugcauuuggaucgggcauggaaagccuaguagaagcaacuguaggggaacggguaagaauacccgcuaaguacuuaggauacccacccccugaaauaaaaugguauaaaaacggaauaccauuagaauccaaucauacaauuaaagcaggacacguacucacaauaauggaaguaagugaaagagauacaggaaauuacaccgucauccuaacuaaccccauaucaaaagaaaaacaaucucacguagucucacugguuguuuauguaccaccacaaauaggagaaaaaucacuaaucucaccugucgauucauaucaguauggaacaacccaaacauuaaccuguacaguuuaugccauaccaccuccacaccacauacauugguacuggcaauuagaagaagaaugugccaaugaaccuucacaagcugugagcgugacaaauccuuauccgugugaagaguggcguucaguagaggacuuucaaggugguaacaaaauugagguaaauaaaaaccaauuugcauuaauugaaggcaaaaacaaaacaguuucuacucuaguuauacaagcugcaaaugucuccgcacuauauaagugcgaagcaguaaauaagguaggucgcggagaaaggguaaucuccuuucacguaacacguggaccagaaauuacccuacaaccggauaugcaaccuacagaacaggaaucgguuucacuaugguguacagcagacagaucuacuuucgagaaccucacaugguacaaacuaggcccacaaccauuacccauucacguaggugaauuaccgacaccaguauguaaaaaucuagacacauuauggaaacuaaacgcuaccauguuuuccaauucaacaaaugacauacucauuauggaguuaaaaaacgcaucauuacaagaucaaggagauuacguuugccuagcacaagacaggaaaacuaaaaaaaggcacugcguggucagacaacuuacaguccuagaaagaguagcuccaacaauuacaggaaaucuggaaaaucagacaacaucuaucggugaaagcauagaagucucaugcacagcaucuggaaaccccccaccacagauuaugugguuuaaagacaaugaaacauuaguagaggauucaggaauugucuuaaaggacgggaauagaaaucuaacaaucaggagaguuaggaaagaagaugaaggauuauacacaugucaagcauguucaguauuaggaugugcaaagguagaagcuuuuuucaucaucgaaggagcccaagaaaaaacaaaucuugaaauaauaauauuaguuggaacagcaguaauugcuauguuuuucugguuacuccuuguaauaauacuucguacaguaaaaagagcuaauggaggagaacucaaaacugguuauuuaaguauaguaauggauccagaugagcuaccccuagaugaacauugugaacgucuaccauacgaugccucuaaaugggaauuucccagagaccgguuaaaacuaggaaaacccuuaggacgcggcgcauucggacagguuauagaagcagaugcuuuugguauagauaaaaccgcaacaugcagaacaguugcggugaaaauguuaaaagaaggcgccacacacucggaacacagagcauuaaugucagaacuaaaaauccuuauccauauuggucaccaccuaaacguaguaaacuuacuaggagcguguacuaagccuggcggaccauuaaugguaauugucgaauuuugcaaauuuggaaauuuaucaacuuauuuaagaucuaaacgaaaugaauuuguaccauacaaaacaaaaggagcacgcuuuagacaaggaaaagauuauguaggagcaauaccaguagaccuaaaaaggagacucgauuccauaacaaguagucaaucaagcgcauccaguggauucguggaagaaaaaagccuaucagauguagaagaggaagaagcaccagaagaccuauauaaagauuuucuaaccuuagaacaucuuauauguuacuccuuucaaguugcaaaagguauggaauuucuagcuucacguaaaugcauacaucgagaucuugcggcaagaaacauauuacuaucggaaaaaaauguagucaaaauaugugauuucggucucgcuagggauauauacaaagacccugacuauguacgaaaaggagaugcaagacuaccacuaaaauggauggcacccgaaacgauuuucgacaggguauacacaauccaaucagauguaugguccuuugguguauuacugugggaaauuuuuucucuaggcgcaagcccuuauccgggcgucaaaaucgacgaagaauuuugcagaagauuaaaagaggggacacggaugcgugcuccagauuauacaacaccagaaauguaccagacaauguuggacugcuggcacggagagcccagucaaagacccacuuucucagaguugguugagcaccuuggaaaucuuuugcaagcuaaugcucaacaagauggaaaggauuacauaguacuaccuauaagugaaacuuuauccauggaagaagacaguggguuaucacuaccaaccaguccaguaucuugcauggaggaagaagaagucugugauccuaaauuucacuaugacaacacagcuggaaucucacaguaucuacaaaauucaaaaagaaaaucacgaccuguguccgucaaaacauuugaggauauaccucuagaagaacccgaaguaaagguaauaccagacgauaaucagacagauucgggaaugguucucgcaucagaagaauuaaaaacauuagaagaucguaccaaacuaucuccaagcuuuggcgguaugguaccuucaaaaucccgcgaaucuguagcaucagaaggaucgaaccaaacuucaggcuaccaaucaggguaccauucagacgauacagauacaacgguauacucaagcgaggaagcagaacuacuaaaauuaauagaaauaggaguccaaacgggcucaaccgcacaaauuuuacaaccggacagcgguacaacguuaaguagcccaccuguguaa

SEQ ID NO: 7449 - protein, 749 aa, Artificial Sequence
  PEX__Homo_sapiens__P78562
MEAETGSSVETGKKANRGTRIALVVFVGGTLVLGTILFLVSQGLLSLQAKQEYCLKPECIEAAAAILSKVNLSVDPCDNFFRFACDGWISNNPIPEDMPSYGVYPWLRHNVDLKLKELLEKSISRRRDTEAIQKAKILYSSCMNEKAIEKADAKPLLHILRHSPFRWPVLESNIGPEGVWSERKFSLLQTLATFRGQYSNSVFIRLYVSPDDKASNEHILKLDQATLSLAVREDYLDNSTEAKSYRDALYKFMVDTAVLLGANSSRAEHDMKSVLRLEIKIAEIMIPHENRTSEAMYNKMNISELSAMIPQFDWLGYIKKVIDTRLYPHLKDISPSENVVVRVPQYFKDLFRILGSERKKTIANYLVWRMVYSRIPNLSRRFQYRWLEFSRVIQGTTTLLPQWDKCVNFIESALPYVVGKMFVDVYFQEDKKEMMEELVEGVRWAFIDMLEKENEWMDAGTKRKAKEKARAVLAKVGYPEFIMNDTHVNEDLKAIKFSEADYFGNVLQTRKYLAQSDFFWLRKAVPKTEWFTNPTTVNAFYSASTNQIRFPAGELQKPFFWGTEYPRSLSYGAIGVIVGHEFTHGFDNNGRKYDKNGNLDPWWSTESEEKFKEKTKCMINQYSNYYWKKAGLNVKGKRTLGENIADNGGLREAFRAYRKWINDRRQGLEEPLLPGITFTNNQLFFLSYAHVRCNSYRPEAAREQVQIGAHSPPQFRVNGAISNFEEFQKAFNCPPNSTMNRGMDSCRLW

SEQ ID NO: 7450 - RNA, 2250 nt, Artificial Sequence
  PEX__Homo_sapiens__AAB47562
auggaagcagaaacagggagcagcguggagacuggaaagaaggccaacagaggcacucgaauugcccuggucguguuugucgguggcacccuaguucugggcacgauccucuuucuagugagucaaggucucuuaagucuccaagcuaaacaggaguacugccugaagccagaaugcaucgaagcggcugcugccaucuuaaguaaaguaaaucugucuguggauccuugugauaauuucuuccgguucgcuugugauggcuggauaagcaauaauccaauucccgaagauaugccaagcuaugggguuuauccuuggcugagacauaauguugaccucaaguugaaggaacuuuuggagaaaucaaucaguagaaggcgggacaccgaagccauacagaaagccaaaauccuuuauucauccugcaugaaugagaaagcgauugaaaaagcagaugccaagccacugcuacacauccuacggcauucaccuuuccgcuggcccgugcuugaaucuaauauuggcccugaagggguuuggucagagagaaaguucagccuucugcagacacuugcaacguuucguggucaauacagcaauucuguguucauccguuuguauguguccccugaugacaaagcauccaaugaacauaucuugaagcuggaccaagcaacacucucccuggccgugagggaagacuaccuugauaacaguacagaagccaagucuuaucgggaugcccuuuacaaguucaugguggauacugccgugcuuuuaggagcuaacaguuccagagcagagcaugacaugaagucagugcucagauuggaaauuaagauagcugagauaaugauuccacaugaaaaccgaaccagcgaggccauguacaacaaaaugaacauuucugaacugagugcuaugauuccccaguucgacuggcugggcuacaucaagaaggucauugacaccagacucuacccccaucugaaagacaucagccccuccgagaauguggugguccgcgucccgcaguacuuuaaagauuuguuuaggauauuagggucugagagaaagaagaccauugccaacuauuugguguggagaaugguuuauuccagaauuccaaaccuuagcaggcgcuuucaguauagauggcuggaauucucaaggguaauccaggggaccacaacuuugcugccucaaugggacaaauguguaaacuuuauugaaagugcccucccuuauguuguuggaaagauguuuguagauguguacuuccaggaagauaagaaggaaaugauggaggaauugguugagggcguucgcugggccuuuauugacaugcuagagaaagaaaaugaguggauggaugcaggaacgaaaaggaaagccaaagaaaaggcgagagcuguuuuggcaaaaguuggcuauccagaguuuauaaugaaugauacucauguuaaugaagaccucaaagcuaucaaguuuucagaagccgacuacuuuggcaacguccuacaaacucgcaaguauuuagcacagucugauuucuucuggcuaagaaaagccguuccaaaaacagagugguuuacaaauccgacgacugucaaugccuucuacagugcauccaccaaccagauccgauuuccagcaggagagcuccagaagccuuucuuuuggggaacagaauauccucgaucucugaguuauggugcuauaggaguaauugucggacaugaauuuacacauggauucgauaauaaugguagaaaauaugauaaaaauggaaaccuggauccuugguggucuacugaaucagaagaaaaguuuaaggaaaaaacaaaaugcaugauuaaccaguauagcaacuauuauuggaagaaagcuggcuuaaaugucaaggggaagaggacccugggagaaaauauugcugauaauggaggccugcgggaagcuuuuagggcuuacaggaaauggauaaaugacagaaggcagggacuugaggagccucuucuaccaggcaucacauucaccaacaaccagcucuucuuccugaguuaugcucaugugaggugcaauuccuacagaccagaagcugcccgagaacaaguccaaauuggugcucacagucccccucaguuuagggucaauggugcaauuaguaacuuugaagaauuccagaaagcuuuuaacuguccacccaauuccacgaugaacagaggcauggacuccugccgacucugguag

SEQ ID NO: 7451 - RNA, 2250 nt, Artificial Sequence
  derived and/or modified sequence opt1 from PEX__Homo_sapiens__AAB47562
auggaggccgagaccggcagcuccguggagaccgggaagaaggccaaccgcggcacgcggaucgcgcuggugguguucgucgggggcacccucgugcuggggaccauccuguuccucgugagccagggccugcugucccuccaggccaagcaggaguacugccugaagcccgagugcaucgaggccgccgccgcgauccugagcaaggugaaccucuccgucgacccgugcgacaacuucuuccgcuucgccugcgacggcuggaucagcaacaaccccauccccgaggacaugcccuccuacgggguguacccguggcugcggcacaacguggaccugaagcucaaggagcugcuggagaaguccaucagccgccggcgcgacaccgaggccauccagaaggccaagauccucuacagcuccugcaugaacgagaaggcgaucgagaaggccgacgccaagccccugcugcacauccuccggcacagccccuuccgcuggcccguccuggaguccaacaucggcccggaggggguguggagcgagcggaaguucucccugcuccagacgcuggccaccuuccgcggccaguacagcaacuccguguucauccggcuguacgucagccccgacgacaaggccuccaacgagcacauccucaagcuggaccaggcgacccugagccucgccgugcgcgaggacuaccuggacaacagcaccgaggccaaguccuaccgggacgcccuguacaaguucaugguggacacggccguccuccugggggcgaacagcucccgcgccgagcacgacaugaaguccgugcugcggcucgagaucaagaucgccgagaucaugaucccccacgagaaccgcaccagcgaggccauguacaacaagaugaacaucagcgagcuguccgccaugaucccccaguucgacuggcugggcuacaucaagaaggugaucgacacccggcucuacccgcaccugaaggacaucagccccuccgagaacgucguggugcgcgucccccaguacuucaaggaccuguuccggauccucggcagcgagcgcaagaagaccaucgcgaacuaccugguguggcggaugguguacucccgcauccccaaccugagccgccgguuccaguaccgcuggcucgaguucucccgggucauccaggggacgaccacccugcugccgcagugggacaagugcgugaacuucaucgagagcgcccuccccuacgucgugggcaagauguucguggacgucuacuuccaggaggacaagaaggagaugauggaggagcugguggagggggugcgcugggccuucaucgacaugcuggagaaggagaacgaguggauggacgccggcaccaagcggaaggccaaggagaaggcgcgcgccguccucgccaaggugggcuaccccgaguucaucaugaacgacacgcacgugaacgaggaccugaaggccaucaaguucuccgaggcggacuacuucgggaacguccugcagacccggaaguaccuggcccagagcgacuucuucuggcuccgcaaggccgugcccaagaccgagugguucaccaacccgacgaccgugaacgccuucuacuccgccagcaccaaccagauccgguuccccgcgggcgagcugcagaagcccuucuucugggggaccgaguacccccgcucccugagcuacggcgccaucggggucaucgugggccacgaguucacgcacggcuucgacaacaacgggcggaaguacgacaagaacggcaaccucgacccgugguggagcaccgaguccgaggagaaguucaaggagaagaccaagugcaugaucaaccaguacagcaacuacuacuggaagaaggccgggcugaacgugaagggcaagcgcacccugggggagaacaucgccgacaacggcggccuccgggaggccuuccgcgcguaccggaaguggaucaacgaccgccggcaggggcuggaggagccccugcuccccggcaucacguucaccaacaaccagcuguucuuccuguccuacgcccacguccgcugcaacagcuaccggcccgaggccgcccgcgagcagguccagaucggggcccacuccccgccccaguuccgcgugaacggcgcgaucagcaacuucgaggaguuccagaaggccuucaacugcccgcccaacuccaccaugaaccgggggauggacagcugccgccucugguga

SEQ ID NO: 7452 - RNA, 2250 nt, Artificial Sequence
  derived and/or modified sequence opt2 from PEX__Homo_sapiens__AAB47562
auggaggccgagaccggcuccuccgucgagaccggcaagaaggccaaccgcggcacccgcaucgcccucgucgucuucgucggcggcacccucguccucggcaccauccucuuccucgucucccagggccuccucucccuccaggccaagcaggaguacugccucaagcccgagugcaucgaggccgccgccgccauccucuccaaggucaaccucuccgucgaccccugcgacaacuucuuccgcuucgccugcgacggcuggaucuccaacaaccccauccccgaggacaugcccuccuacggcgucuaccccuggcuccgccacaacgucgaccucaagcucaaggagcuccucgagaaguccaucucccgccgccgcgacaccgaggccauccagaaggccaagauccucuacuccuccugcaugaacgagaaggccaucgagaaggccgacgccaagccccuccuccacauccuccgccacucccccuuccgcuggcccguccucgaguccaacaucggccccgagggcgucugguccgagcgcaaguucucccuccuccagacccucgccaccuuccgcggccaguacuccaacuccgucuucauccgccucuacgucucccccgacgacaaggccuccaacgagcacauccucaagcucgaccaggccacccucucccucgccguccgcgaggacuaccucgacaacuccaccgaggccaaguccuaccgcgacgcccucuacaaguucauggucgacaccgccguccuccucggcgccaacuccucccgcgccgagcacgacaugaaguccguccuccgccucgagaucaagaucgccgagaucaugaucccccacgagaaccgcaccuccgaggccauguacaacaagaugaacaucuccgagcucuccgccaugaucccccaguucgacuggcucggcuacaucaagaaggucaucgacacccgccucuacccccaccucaaggacaucucccccuccgagaacgucgucguccgcgucccccaguacuucaaggaccucuuccgcauccucggcuccgagcgcaagaagaccaucgccaacuaccucgucuggcgcauggucuacucccgcauccccaaccucucccgccgcuuccaguaccgcuggcucgaguucucccgcgucauccagggcaccaccacccuccucccccagugggacaagugcgucaacuucaucgaguccgcccuccccuacgucgucggcaagauguucgucgacgucuacuuccaggaggacaagaaggagaugauggaggagcucgucgagggcguccgcugggccuucaucgacaugcucgagaaggagaacgaguggauggacgccggcaccaagcgcaaggccaaggagaaggcccgcgccguccucgccaaggucggcuaccccgaguucaucaugaacgacacccacgucaacgaggaccucaaggccaucaaguucuccgaggccgacuacuucggcaacguccuccagacccgcaaguaccucgcccaguccgacuucuucuggcuccgcaaggccguccccaagaccgagugguucaccaaccccaccaccgucaacgccuucuacuccgccuccaccaaccagauccgcuuccccgccggcgagcuccagaagcccuucuucuggggcaccgaguacccccgcucccucuccuacggcgccaucggcgucaucgucggccacgaguucacccacggcuucgacaacaacggccgcaaguacgacaagaacggcaaccucgaccccuggugguccaccgaguccgaggagaaguucaaggagaagaccaagugcaugaucaaccaguacuccaacuacuacuggaagaaggccggccucaacgucaagggcaagcgcacccucggcgagaacaucgccgacaacggcggccuccgcgaggccuuccgcgccuaccgcaaguggaucaacgaccgccgccagggccucgaggagccccuccuccccggcaucaccuucaccaacaaccagcucuucuuccucuccuacgcccacguccgcugcaacuccuaccgccccgaggccgcccgcgagcagguccagaucggcgcccacucccccccccaguuccgcgucaacggcgccaucuccaacuucgaggaguuccagaaggccuucaacugcccccccaacuccaccaugaaccgcggcauggacuccugccgccucugguga

SEQ ID NO: 7453 - RNA, 2250 nt, Artificial Sequence
  derived and/or modified sequence opt3 from PEX__Homo_sapiens__AAB47562
auggaagccgaaaccggcagcuccguggagacagggaagaaagcuaacagaggaacuaggaucgcacuggucguuuucguggguggcacgcucguacuugggaccauucuguuuuuggugucucagggauuacugucacuacaagccaagcaggaauacugccucaaacccgaguguauagaagcggcugccgcaauccugaguaaggucaaucuuagcguggacccuugcgauaacuucuuucgguucgccugugacggcuggauuuccaauaacccaaucccggaggauaugcccucuuaugguguuuacccuuggcugcgccacaauguggacuugaaacucaaggagcugcuggaaaagucgauuucacgacguagagauacagaggcuauccagaaagcaaagauacucuauagcaguugcaugaacgaaaaagccaucgagaaggcugacgccaaaccauuacugcauauucuuaggcacucccccuuucgguggccugucuuggagucuaauaucgggccagaaggaguguggagcgagcgcaaguucucccugcuacagacucucgcgaccuuuagaggccaauacucaaacaguguauucauuaggcuguauguuagccccgaugacaaggcaucuaaugaacauauccuuaaacuggaucaggccacauugucccucgcugugcgggaggacuaccuggauaacucaaccgaagccaagagcuaucgcgacgcauuauacaaauuuauggucgauacugcugugcugcucggcgccaauaguucucgagcggagcacgacaugaaguccgugcuuagacuggagauaaaaauugccgaaaucaugauuccucaugagaacaggacaagcgaagcaauguacaauaagaugaacaucucggaguugucugcuaugaucccacaguucgacuggcuaggguauauuaaaaaggucauagauacccggcuguacccgcaccucaaggacaucucccccucagaaaauguugugguacgugugccucaguauuuuaaagaucuguuccgcauucuuggaagugagagaaagaaaacgaucgccaacuaccuggucuggaggaugguguauagccggauaccaaacuugucccgacgcuuucaauacagauggcucgaguucucuaggguuauucaggguacuaccacacuguuaccccagugggacaagugugugaauuucaucgaaagcgcucugccuuaugucgugggcaaaauguuuguagauguuuacuuccaggaggacaagaaggaaaugauggaggaacucguggaggggguccggugggccuuuaucgauaugcucgagaaagaaaacgaguggauggacgcaggaacuaagcgcaaagccaaggaaaaagcuagagcggugcuggcaaaggucggcuacccagaguucauuaugaaugauacccacgugaacgaggaccuuaaggccaucaaauuuucagaagcugauuauuucgguaauguuuugcaaacaaggaaguaccuggcccagagugacuuuuucuggcuccguaaagcagugcccaagaccgagugguuuacgaacccgacuacaguaaaugccuucuauuccgcuagcaccaaccagauucgguuuccugccggggaacugcaaaaacccuucuuuuggggaacugaguacccacgaucucuuucauauggcgcaauaggcgucaucguggggcaugaguucacacacggauucgacaauaacgguagaaaguacgauaagaauggcaaccuggacccuugguggaguaccgagagcgaggaaaaauuuaaggagaaaacgaagugcaugauuaaucaguauuccaacuacuacuggaaaaaggcgggguugaauguuaaaggaaagaggacccucggcgaaaacaucgcugauaacggugggcugcgcgaggccuuccgggcauauagaaaguggaucaaugacaggcgccagggcuuagaagaaccccugcuaccaggaauuacauuuacuaacaaucagcuauucuuucugucuuacgcccaugugcgauguaacucguaucggcccgaggcugcccgugaacaaguccagauaggcgcacacagcccuccacaguucagagugaauggggcuaucuccaacuuugaggaguuccagaaagccuuuaauugcccgcccaacucaaccaugaauaggggaauggauaguugucgccuuugguga

SEQ ID NO: 7454 - RNA, 2250 nt, Artificial Sequence
  derived and/or modified sequence opt4 from PEX__Homo_sapiens__AAB47562
auggaggccgagaccggcagcagcguggagaccggcaagaaggccaacagaggcaccagaaucgcccuggugguguucgugggcggcacccuggugcugggcaccauccuguuccuggugagccagggccugcugagccugcaggccaagcaggaguacugccugaagcccgagugcaucgaggccgccgccgccauccugagcaaggugaaccugagcguggaccccugcgacaacuucuucagauucgccugcgacggcuggaucagcaacaaccccauccccgaggacaugcccagcuacggcguguaccccuggcugagacacaacguggaccugaagcugaaggagcugcuggagaagagcaucagcagaagaagagacaccgaggccauccagaaggccaagauccuguacagcagcugcaugaacgagaaggccaucgagaaggccgacgccaagccccugcugcacauccugagacacagccccuucagauggcccgugcuggagagcaacaucggccccgagggcguguggagcgagagaaaguucagccugcugcagacccuggccaccuucagaggccaguacagcaacagcguguucaucagacuguacgugagccccgacgacaaggccagcaacgagcacauccugaagcuggaccaggccacccugagccuggccgugagagaggacuaccuggacaacagcaccgaggccaagagcuacagagacgcccuguacaaguucaugguggacaccgccgugcugcugggcgccaacagcagcagagccgagcacgacaugaagagcgugcugagacuggagaucaagaucgccgagaucaugaucccccacgagaacagaaccagcgaggccauguacaacaagaugaacaucagcgagcugagcgccaugaucccccaguucgacuggcugggcuacaucaagaaggugaucgacaccagacuguacccccaccugaaggacaucagccccagcgagaacgugguggugagagugccccaguacuucaaggaccuguucagaauccugggcagcgagagaaagaagaccaucgccaacuaccugguguggagaaugguguacagcagaauccccaaccugagcagaagauuccaguacagauggcuggaguucagcagagugauccagggcaccaccacccugcugccccagugggacaagugcgugaacuucaucgagagcgcccugcccuacguggugggcaagauguucguggacguguacuuccaggaggacaagaaggagaugauggaggagcugguggagggcgugagaugggccuucaucgacaugcuggagaaggagaacgaguggauggacgccggcaccaagagaaaggccaaggagaaggccagagccgugcuggccaaggugggcuaccccgaguucaucaugaacgacacccacgugaacgaggaccugaaggccaucaaguucagcgaggccgacuacuucggcaacgugcugcagaccagaaaguaccuggcccagagcgacuucuucuggcugagaaaggccgugcccaagaccgagugguucaccaaccccaccaccgugaacgccuucuacagcgccagcaccaaccagaucagauuccccgccggcgagcugcagaagcccuucuucuggggcaccgaguaccccagaagccugagcuacggcgccaucggcgugaucgugggccacgaguucacccacggcuucgacaacaacggcagaaaguacgacaagaacggcaaccuggaccccugguggagcaccgagagcgaggagaaguucaaggagaagaccaagugcaugaucaaccaguacagcaacuacuacuggaagaaggccggccugaacgugaagggcaagagaacccugggcgagaacaucgccgacaacggcggccugagagaggccuucagagccuacagaaaguggaucaacgacagaagacagggccuggaggagccccugcugcccggcaucaccuucaccaacaaccagcuguucuuccugagcuacgcccacgugagaugcaacagcuacagacccgaggccgccagagagcaggugcagaucggcgcccacagccccccccaguucagagugaacggcgccaucagcaacuucgaggaguuccagaaggccuucaacugcccccccaacagcaccaugaacagaggcauggacagcugcagacugugguga

SEQ ID NO: 7455 - RNA, 2250 nt, Artificial Sequence
  derived and/or modified sequence opt5 from PEX__Homo_sapiens__AAB47562
auggaagccgaaaccggcagcuccguggagacagggaagaaagcuaacagaggaacgcggaucgcccuggucguuuucgugggcgggacccucgugcugggaacaauucuuuuucuggucucucagggccuccugagccuucaagcgaagcaggaauacugccugaaacccgaguguaucgaagcugccgccgcuauucucuccaaggugaaucugucuguugacccuugcgauaacuucuuucgcuucgccugugacggguggaucagcaauaacccgauucccgaggauaugccuuccuauggaguguaccccuggcugagacacaaugucgaccucaaacugaaggagcuucuggaaaagucuaucagccggcgcagagauaccgaggcuauccagaaagccaagauucucuauuccagcugcaugaacgaaaaagcgaucgagaaggccgacgcuaaaccucugcuucauauucugcggcacucucccuuucgcuggccugugcucgaguccaauaucggcccggaaggcguuuggagcgagagaaaguucucucugcugcagacacucgccaccuuucgggggcaauacuccaacagcguguucauucgccuguaugucucucccgaugacaaggcuuccaaugaacauauccuuaaacuggaucaggccacacucagccuggcggugagagaggacuaccuugauaacuccaccgaagccaagucuuaucgggacgcucuguacaaauuuaugguggauacggccguccuccugggagcuaauagcucccgcgccgagcacgacaugaaaagcguucugagacucgagauuaagaucgccgaaaucaugauuccucaugagaaccggaccucugaagcuauguacaauaagaugaacaucuccgagcugagcgcgaugauuccccaguucgacuggcuuggcuauaucaaaaaggugauugauacacgccuguacccucaccucaaggacaucucucccagcgaaaauguggucgugagaguuccgcaguauuuuaaagaucuguuccggauccuuggguccgagagaaagaaaaccauugccaacuaccugguguggcgcauggucuauucucggaucccuaaccucagcagacgcuuucaauaccgguggcuggaguucuccagagugauucagggaacaaccacgcugcucccccagugggacaaguguguuaauuucaucgaaagcgcucugccuuauguggucggcaaaauguuuguggaugucuacuuccaggaggacaagaaggaaaugauggaggaacuuguggaggggguucgcugggccuuuauugauaugcuggagaaagaaaacgaguggauggacgccggaacaaagcggaaagcuaaggaaaaagccagagcggugcucgcuaaggucggcuaccccgaguucaucaugaaugauacccacgugaacgaggaccugaaggccaucaaauuuucugaagccgauuauuucggcaauguucugcaaacacgcaaguaccuugcucaguccgacuuuuucuggcuccggaaagccgugcccaagaccgagugguuuaccaacccuacaacggucaaugcuuucuauagcgccucuaccaaccagauuagauuuccggcgggggaacugcaaaaacccuucuuuuggggaacagaguacccucgcucccugagcuauggcgccaucggggugauugugggacaugaguucacccacggcuucgacaauaacgggcggaaguacgauaagaauggaaaccucgaccccuggugguccacagagucugaggaaaaauuuaaggagaaaaccaagugcaugaucaaucaguauagcaacuacuacuggaaaaaggcuggccugaauguuaaaggcaagagaacgcuuggggaaaacauugccgauaacggaggccugcgggaggcuuuccgcgccuauagaaaguggaucaaugaccggagacaggggcucgaagaaccucugcugcccggaauuacauuuaccaacaaucagcuuuucuuucucuccuacgcgcauguccgcuguaacucuuaucggccggaggccgcuagagaacaagugcagaucggcgcccacagcccuccccaguuccgcgugaauggggcuaucuccaacuuugaggaguuccagaaagccuuuaauugcccucccaacagcaccaugaauagaggcauggauucuugucggcugugguga

SEQ ID NO: 7456 - RNA, 2250 nt, Artificial Sequence
  derived and/or modified sequence opt6 from PEX__Homo_sapiens__AAB47562
auggaagcagaaaccggcucaagcguagaaacagguaaaaaagcaaauagaggaacaagaauagcauuaguaguauucguaggaggaacauuaguauuaggcaccauacuauuccuaguaagucagggacuccuuagccuucaagccaaacaagaauacuguuuaaaaccagaauguauugaagcagcagcagcaauauuaucaaaaguaaacuuaucaguagacccaugcgacaacuucuuccgcuuugcaugcgauggauggauuagcaauaaucccauacccgaagacaugccgagcuauggcguauauccauggcuuagacauaacguagacuuaaaauuaaaagaacuucucgaaaaaucaauaucaagaagaagagacacagaagcaauacaaaaagcaaaaauucucuacucuucauguaugaaugaaaaagcuauagaaaaagcugaugcaaaaccuuuacuacacauauuaagacauucaccauuucgcuggcccguacuagaaagcaacauagggccggaaggcguauggucagaaagaaaauuuucccuucuacaaacuuuagcaacauuuagaggacaguacucuaacagcguauuuauaagauuauacguuucaccagaugacaaagcaucaaacgaacacauacuaaaacuagaucaagcaaccuuaucauuagcaguaagagaagacuacuuagauaacucaacagaagccaaaagcuauagagacgcauuauauaaauucaugguagacacagcaguuuuguuaggugcaaauaguucgagagccgaacacgacaugaaaucaguacuaagacuugaaaucaaaauugcugaaaucaugauaccacacgaaaacagaacuucagaagcuauguauaauaaaaugaacaucucagaacucucugcaaugauaccacaauucgacugguuagguuacauuaaaaaagugauagacacccgauuauacccucaucuuaaagauaucagcccaagcgaaaacgucguaguacguguaccucaauacuuuaaagaccuguucaggauauuaggaagcgaaagaaaaaaaacgauugcaaauuauuuagucuggcguaugguuuauucgagaauaccaaaccuuagcagaagauuccaauauagauggcucgaauucaguagagucauacaaggaacaacaacauuacuaccacaaugggacaaauguguaaauuucaucgaauccgcauuacccuauguaguaggaaaaauguucguagauguauauuuucaagaagacaaaaaagaaaugauggaagaacuagucgaaggaguaagaugggcauuuauagacaugcuugaaaaagaaaaugaauggauggaugcaggcacaaaacgaaaagcaaaagaaaaagcaagagcaguauuagcaaaaguaggauauccugaauucauaaugaacgacacacauguaaaugaagaucuaaaagcaauaaaauuuagcgaggccgacuacuuugguaacguacuacaaacuagaaaauacuuggcacaaucagauuuuuuuuggcuacgaaaagcuguaccaaaaacggaaugguuuaccaauccuacaacaguaaacgcuuucuauucagcaucaacaaaucaaauaagguucccagccggagaauuacaaaaaccauuuuucugggguacugaauaccccagaagucuuuccuauggagccauuggaguaauaguaggccacgaauucacacauggcuucgauaacaauggucgaaaauaugacaaaaauggaaaucuggauccauggugguccacagaaucugaagaaaaauuuaaagaaaaaacaaaauguaugauaaaucaauacucuaacuauuacuggaaaaaagcuggauuaaauguaaaaggaaaaagaacccuaggagaaaacauagcagacaauggaggucucagggaagcuuuucgagcuuaucgaaaauggauuaacgauagaaggcaaggacuugaagaaccacuauugccaggaauaacauuuacaaauaaucaauuauuuuuucuuagcuaugcacacguaagauguaauucauacagaccagaagcagcaagagaacaaguacaaauaggcgcacacaguccaccucaauucagagucaacggcgcaauaucaaauuucgaggaauuucaaaaagcauucaacugucccccgaacucaaccaugaaccgagguauggacucaugcagacuaugguaa

SEQ ID NO: 7457 - protein, 227 aa, Artificial Sequence
  PRL__Homo_sapiens__P01236
MNIKGSPWKGSLLLLLVSNLLLCQSVAPLPICPGGAARCQVTLRDLFDRAVVLSHYIHNLSSEMFSEFDKRYTHGRGFITKAINSCHTSSLATPEDKEQAQQMNQKDFLSLIVSILRSWNEPLYHLVTEVRGMQEAPEAILSKAVEIEEQTKRLLEGMELIVSQVHPETKENEIYPVWSGLPSLQMADEESRLSAYYNLLHCLRRDSHKIDNYLKLLKCRIIHNNNC

SEQ ID NO: 7458 - RNA, 684 nt, Artificial Sequence
  PRL__Homo_sapiens__AAH15850
augaacaucaaaggaucgccauggaaagggucccuccugcugcugcuggugucaaaccugcuccugugccagagcguggcccccuugcccaucugucccggcggggcugcccgaugccaggugacccuucgagaccuguuugaccgcgccgucguccugucccacuacauccauaaccucuccucagaaauguucagcgaauucgauaaacgguauacccauggccggggguucauuaccaaggccaucaacagcugccacacuucuucccuugccacccccgaagacaaggagcaagcccaacagaugaaucaaaaagacuuucugagccugauagucagcauauugcgauccuggaaugagccucuguaucaucuggucacggaaguacgugguaugcaagaagccccggaggcuauccuauccaaagcuguagagauugaggagcaaaccaaacggcuucuagagggcauggagcugauagucagccagguucauccugaaaccaaagaaaaugagaucuacccugucuggucgggacuuccaucccugcagauggcugaugaagagucucgccuuucugcuuauuauaaccugcuccacugccuacgcagggauucacauaaaaucgacaauuaucucaagcuccugaagugccgaaucauccacaacaacaacugcuaa

SEQ ID NO: 7459 - RNA, 684 nt, Artificial Sequence
  derived and/or modified sequence opt1 from PRL__Homo_sapiens__AAH15850
augaacaucaagggcagccccuggaaggggucccugcuccugcugcucgugagcaaccugcugcucugccaguccgucgccccgcugcccaucugccccggcggggccgcgcgcugccaggugacccugcgggaccucuucgaccgcgccgugguccugagccacuacauccacaaccuguccagcgagauguucuccgaguucgacaagcgguacacccacggccgcggguucaucacgaaggccaucaacagcugccacaccuccagccucgccacccccgaggacaaggagcaggcccagcagaugaaccagaaggacuuccugucccugaucgugagcauccuccgguccuggaacgagccgcuguaccaccuggugaccgagguccgcggcaugcaggaggcgcccgaggccauccucagcaaggccguggagaucgaggagcagacgaagcggcugcuggagggcauggagcucaucgugucccagguccaccccgagaccaaggagaacgagaucuaccccguguggagcgggcugccgucccugcagauggccgacgaggagagccgccucuccgcguacuacaaccugcugcacugccuccggcgcgacagccacaagaucgacaacuaccugaagcugcucaagugccggaucauccacaacaacaacugcuga

SEQ ID NO: 7460 - RNA, 684 nt, Artificial Sequence
  derived and/or modified sequence opt2 from PRL__Homo_sapiens__AAH15850
augaacaucaagggcucccccuggaagggcucccuccuccuccuccucgucuccaaccuccuccucugccaguccgucgccccccuccccaucugccccggcggcgccgcccgcugccaggucacccuccgcgaccucuucgaccgcgccgucguccucucccacuacauccacaaccucuccuccgagauguucuccgaguucgacaagcgcuacacccacggccgcggcuucaucaccaaggccaucaacuccugccacaccuccucccucgccacccccgaggacaaggagcaggcccagcagaugaaccagaaggacuuccucucccucaucgucuccauccuccgcuccuggaacgagccccucuaccaccucgucaccgagguccgcggcaugcaggaggcccccgaggccauccucuccaaggccgucgagaucgaggagcagaccaagcgccuccucgagggcauggagcucaucgucucccagguccaccccgagaccaaggagaacgagaucuaccccgucugguccggccuccccucccuccagauggccgacgaggagucccgccucuccgccuacuacaaccuccuccacugccuccgccgcgacucccacaagaucgacaacuaccucaagcuccucaagugccgcaucauccacaacaacaacugcuga

SEQ ID NO: 7461 - RNA, 684 nt, Artificial Sequence
  derived and/or modified sequence opt3 from PRL__Homo_sapiens__AAH15850
augaacaucaagggcagccccuggaaagggucccugcuccuucuguuggugucuaauuuacugcuaugccagucagucgccccucucccaauuuguccgggaggugcugcaagaugccaaguuacccugagggaccuuuucgaucgggccgugguacugagucacuacauacauaacuugagcuccgagauguuuucugaguucgacaagcgcuauacacacggccgaggguuuaucacuaaagcgauuaauucgugucauacgucaagccucgcuacccccgaagauaaggaacaggcccagcagaugaaccaaaaagacuuccugagucugaucguguccauucuccguucuuggaaugagccuuuauaccaccuggucacagaagugagaggaaugcaggaggcaccagaggccauccuuagcaaggcuguugaaauagaggaacagacuaagagguugcuggagggcauggagcuaaucgugucccagguccaucccgaaaccaaagagaacgaaauuuauccuguguggucaggucucccaagucugcaaauggcagaugaggaaagccggcuuucugccuacuauaaucuguugcacugccuccgcagagacucccacaagaucgauaacuaccugaaauuacugaaguguaggauuauccauaauaacaauugcuga

SEQ ID NO: 7462 - RNA, 684 nt, Artificial Sequence
  derived and/or modified sequence opt4 from PRL__Homo_sapiens__AAH15850
augaacaucaagggcagccccuggaagggcagccugcugcugcugcuggugagcaaccugcugcugugccagagcguggccccccugcccaucugccccggcggcgccgccagaugccaggugacccugagagaccuguucgacagagccguggugcugagccacuacauccacaaccugagcagcgagauguucagcgaguucgacaagagauacacccacggcagaggcuucaucaccaaggccaucaacagcugccacaccagcagccuggccacccccgaggacaaggagcaggcccagcagaugaaccagaaggacuuccugagccugaucgugagcauccugagaagcuggaacgagccccuguaccaccuggugaccgaggugagaggcaugcaggaggcccccgaggccauccugagcaaggccguggagaucgaggagcagaccaagagacugcuggagggcauggagcugaucgugagccaggugcaccccgagaccaaggagaacgagaucuaccccguguggagcggccugcccagccugcagauggccgacgaggagagcagacugagcgccuacuacaaccugcugcacugccugagaagagacagccacaagaucgacaacuaccugaagcugcugaagugcagaaucauccacaacaacaacugcuga

SEQ ID NO: 7463 - RNA, 684 nt, Artificial Sequence
  derived and/or modified sequence opt5 from PRL__Homo_sapiens__AAH15850
augaacaucaagggcagccccuggaaagggucccugcuccugcuucuggugucuaaucuccugcuuugccagagcgucgccccucugccgauuugucccggaggcgcugccagaugccaaguuacccuccgggaccuguucgaucgcgcgguggugcugucccacuacauccauaaccucucuagcgagauguuuuccgaguucgacaagagauauacacacgggcggggauuuauuacgaaagcuaucaauucuugucauaccagcucccuggccacaccugaagauaaggaacaggcccagcagaugaaccaaaaagacuuccuuagccugauugucucuauccuccgcuccuggaaugagccccuguaccaccuugugaccgaaguuagaggcaugcaggaggcuccugaggccauccugagcaaggcuguggaaauugaggaacagacaaagcggcuccuggaggggauggagcugaucgucucucaggugcaucccgaaaccaaagagaacgaaauuuauccuguuugguccggacucccgagccugcaaauggccgaugaggaaucucgccuuuccgcguacuauaaucugcuccacugccugagacgggacagccacaagaucgauaacuaccuuaaacugcucaagugucgcauuauccauaauaacaauugcuga

SEQ ID NO: 7464 - RNA, 684 nt, Artificial Sequence
  derived and/or modified sequence opt6 from PRL__Homo_sapiens__AAH15850
augaauauaaaaggaucaccauggaaaggaucacuacuacuacuacuaguaucaaaccuacuacuaugccaaucaguagcaccacuaccaaucugcccaggaggagcagcaagaugccaaguaacacuaagagaccuauucgacagagcaguaguacuaucacacuacauacacaaccuaucaucagaaauguucucagaauucgacaaaagauacacacacggaagaggauucauaacaaaagcaauaaacucaugucauacaucaucacuagcuacaccagaagacaaagaacaagcacaacaaaugaaccaaaaagacuuccuaucauuaauaguaucaauacuaagaucauggaacgaaccucuauaccaucuaguaacagaaguccgaggaaugcaagaagcaccagaagcaauacuaucaaaagcaguagaaauagaagaacaaacaaaaagacuauuagaaggaauggaauuaauaguaucacaaguacauccagaaacaaaagaaaacgaaauauacccaguauggucaggccuaccuagccuucaaauggcagacgaagaaucacgacuaucagcauacuauaaccuacuacacugucuaagaagagacucacacaaaauagacaacuaccuaaaacuauuaaaaugcagaauaauacacaauaacaacugcuaa

SEQ ID NO: 7465 - protein, 375 aa, Artificial Sequence
  SERPINB5__Homo_sapiens__P36952
MDALQLANSAFAVDLFKQLCEKEPLGNVLFSPICLSTSLSLAQVGAKGDTANEIGQVLHFENVKDVPFGFQTVTSDVNKLSSFYSLKLIKRLYVDKSLNLSTEFISSTKRPYAKELETVDFKDKLEETKGQINNSIKDLTDGHFENILADNSVNDQTKILVVNAAYFVGKWMKKFSESETKECPFRVNKTDTKPVQMMNMEATFCMGNIDSINCKIIELPFQNKHLSMFILLPKDVEDESTGLEKIEKQLNSESLSQWTNPSTMANAKVKLSIPKFKVEKMIDPKACLENLGLKHIFSEDTSDFSGMSETKGVALSNVIHKVCLEITEDGGDSIEVPGARILQHKDELNADHPFIYIIRHNKTRNIIFFGKFCSP

SEQ ID NO: 7466 - RNA, 1128 nt, Artificial Sequence
  SERPINB5__Homo_sapiens__CCDS32839.1
auggaugcccugcaacuagcaaauucggcuuuugccguugaucuguucaaacaacuaugugaaaaggagccacugggcaauguccucuucucuccaaucugucucuccaccucucugucacuugcucaagugggugcuaaaggugacacugcaaaugaaauuggacagguucuucauuuugaaaaugucaaagauguacccuuuggauuucaaacaguaacaucggauguaaacaaacuuaguuccuuuuacucacugaaacuaaucaagcggcucuacguagacaaaucucugaaucuuucuacagaguucaucagcucuacgaagagaccguaugcaaaggaauuggaaacuguugacuucaaagauaaauuggaagaaacgaaaggucagaucaacaacucaauuaaggaucucacagauggccacuuugagaacauuuuagcugacaacagugugaacgaccagaccaaaauccuugugguuaaugcugccuacuuuguuggcaaguggaugaagaaauuuucugaaucagaaacaaaagaauguccuuucagagucaacaagacagacaccaaaccagugcagaugaugaacauggaggccacguucuguaugggaaacauugacaguaucaauuguaagaucauagagcuuccuuuucaaaauaagcaucucagcauguucauccuacuacccaaggauguggaggaugaguccacaggcuuggagaagauugaaaaacaacucaacucagagucacugucacaguggacuaaucccagcaccauggccaaugccaaggucaaacucuccauuccaaaauuuaagguggaaaagaugauugaucccaaggcuugucuggaaaaucuagggcugaaacauaucuucagugaagacacaucugauuucucuggaaugucagagaccaagggaguggcccuaucaaauguuauccacaaagugugcuuagaaauaacugaagaugguggggauuccauagaggugccaggagcacggauccugcagcacaaggaugaauugaaugcugaccaucccuuuauuuacaucaucaggcacaacaaaacucgaaacauuauuuucuuuggcaaauucuguucuccuuaa

SEQ ID NO: 7467 - RNA, 1128 nt, Artificial Sequence
  derived and/or modified sequence opt1 from SERPINB5__Homo_sapiens__CCDS32839.1
auggacgcccugcagcucgccaacagcgcguucgccguggaccuguucaagcagcugugcgagaaggagccccucggcaacguccuguucuccccgaucugccugagcaccucccucagccuggcccaggugggggccaagggcgacaccgccaacgagaucggccaggugcugcacuucgagaacgucaaggacgugcccuucggguuccagacggugaccuccgacgucaacaagcucagcuccuucuacagccugaagcugaucaagcgccucuacguggacaagucccugaaccugagcaccgaguucaucuccagcaccaagcggcccuacgcgaaggagcucgagacgguggacuucaaggacaagcuggaggagaccaaggggcagaucaacaacuccaucaaggaccugaccgacggccacuucgagaacauccucgccgacaacagcgucaacgaccagaccaagauccugguggugaacgccgccuacuucgucggcaaguggaugaagaaguucuccgagagcgagacgaaggagugccccuuccgcgugaacaagaccgacaccaagccggugcagaugaugaacauggaggcgaccuucugcauggggaacaucgacuccaucaacugcaagaucaucgagcugcccuuccagaacaagcaccucagcauguucauccugcugcccaaggacgucgaggacgaguccacgggccucgagaagaucgagaagcagcugaacagcgagagccugucccaguggaccaaccccagcaccauggccaacgccaaggugaagcucuccaucccgaaguucaagguggagaagaugaucgaccccaaggccugccuggagaaccuggggcucaagcacaucuucagcgaggacaccuccgacuucagcggcauguccgagacgaagggggucgcccugagcaacgugauccacaaggugugccuggagaucaccgaggacggcggcgacuccaucgagguccccggggcgcggauccuccagcacaaggacgagcugaacgccgaccaccccuucaucuacaucauccgccacaacaagacccggaacaucaucuucuucggcaaguucugcagcccguga

SEQ ID NO: 7468 - RNA, 1128 nt, Artificial Sequence
  derived and/or modified sequence opt2 from SERPINB5__Homo_sapiens__CCDS32839.1
auggacgcccuccagcucgccaacuccgccuucgccgucgaccucuucaagcagcucugcgagaaggagccccucggcaacguccucuucucccccaucugccucuccaccucccucucccucgcccaggucggcgccaagggcgacaccgccaacgagaucggccagguccuccacuucgagaacgucaaggacguccccuucggcuuccagaccgucaccuccgacgucaacaagcucuccuccuucuacucccucaagcucaucaagcgccucuacgucgacaagucccucaaccucuccaccgaguucaucuccuccaccaagcgccccuacgccaaggagcucgagaccgucgacuucaaggacaagcucgaggagaccaagggccagaucaacaacuccaucaaggaccucaccgacggccacuucgagaacauccucgccgacaacuccgucaacgaccagaccaagauccucgucgucaacgccgccuacuucgucggcaaguggaugaagaaguucuccgaguccgagaccaaggagugccccuuccgcgucaacaagaccgacaccaagcccguccagaugaugaacauggaggccaccuucugcaugggcaacaucgacuccaucaacugcaagaucaucgagcuccccuuccagaacaagcaccucuccauguucauccuccuccccaaggacgucgaggacgaguccaccggccucgagaagaucgagaagcagcucaacuccgagucccucucccaguggaccaaccccuccaccauggccaacgccaaggucaagcucuccauccccaaguucaaggucgagaagaugaucgaccccaaggccugccucgagaaccucggccucaagcacaucuucuccgaggacaccuccgacuucuccggcauguccgagaccaagggcgucgcccucuccaacgucauccacaaggucugccucgagaucaccgaggacggcggcgacuccaucgagguccccggcgcccgcauccuccagcacaaggacgagcucaacgccgaccaccccuucaucuacaucauccgccacaacaagacccgcaacaucaucuucuucggcaaguucugcucccccuga

SEQ ID NO: 7469 - RNA, 1128 nt, Artificial Sequence
  derived and/or modified sequence opt3 from SERPINB5__Homo_sapiens__CCDS32839.1
auggacgcccugcagcucgcuaacagcgcauucgccguggaucuuuuuaagcaacugugcgagaaagaacccuugggcaaugucuuauucuccccuaucugucugucuaccucacuaagucucgcgcagguuggggcuaagggagacacagccaacgagauuggucaggugcugcacuuugaaaauguaaaagaugugccauucggcuuucagacugucacgagcgacgugaacaaacuuuccucuuucuacucgcugaaauugauaaagagacucuauguugauaagucacugaaucugagcaccgaguuuaucaguuccacaaaaaggccguacgcaaaggaacucgagacuguggacuucaaagauaaguuagaggaaaccaaagggcaaauuaacaauucuaucaaggaccugacagauggacauuuugagaacauucuugccgacaauagcgucaacgaucagaccaagaucuuggugguaaaugcugcauauuucguuggcaaauggaugaagaaauuuuccgaaucagagacuaaggagugccccuuccgggugaacaaaacagacaccaagccuguccagaugaugaauauggaagccacguuuuguauggguaacauagauaguaucaauugcaaaauuaucgagcugccauuccagaacaagcaccuaagcauguucauucuccugcccaaggacguggaagacgagucuacugggcuugaaaagaucgagaagcaacugaacuccgagucauugagccaguggaccaauccuaguacaauggcuaacgccaaagugaagcucucuauaccaaaauuuaaggucgaaaagaugauugaucccaaagcgugucuggagaauuuaggacugaagcauaucuucuccgaagacacuagcgauuuuucgggcaugucugagaccaaaggcguugcacucuccaacgugauucacaagguaugccuugaaaucacagaggacgggggagauucaaucgaggugccuggugcccgcauucugcagcauaaagacgaauugaaugcugaucacccauucauauacaucauucgacacaacaagacccguaauaucauauuuuucggcaaguuuuguaguccguga

SEQ ID NO: 7470 - RNA, 1128 nt, Artificial Sequence
  derived and/or modified sequence opt4 from SERPINB5__Homo_sapiens__CCDS32839.1
auggacgcccugcagcuggccaacagcgccuucgccguggaccuguucaagcagcugugcgagaaggagccccugggcaacgugcuguucagccccaucugccugagcaccagccugagccuggcccaggugggcgccaagggcgacaccgccaacgagaucggccaggugcugcacuucgagaacgugaaggacgugcccuucggcuuccagaccgugaccagcgacgugaacaagcugagcagcuucuacagccugaagcugaucaagagacuguacguggacaagagccugaaccugagcaccgaguucaucagcagcaccaagagacccuacgccaaggagcuggagaccguggacuucaaggacaagcuggaggagaccaagggccagaucaacaacagcaucaaggaccugaccgacggccacuucgagaacauccuggccgacaacagcgugaacgaccagaccaagauccugguggugaacgccgccuacuucgugggcaaguggaugaagaaguucagcgagagcgagaccaaggagugccccuucagagugaacaagaccgacaccaagcccgugcagaugaugaacauggaggccaccuucugcaugggcaacaucgacagcaucaacugcaagaucaucgagcugcccuuccagaacaagcaccugagcauguucauccugcugcccaaggacguggaggacgagagcaccggccuggagaagaucgagaagcagcugaacagcgagagccugagccaguggaccaaccccagcaccauggccaacgccaaggugaagcugagcauccccaaguucaagguggagaagaugaucgaccccaaggccugccuggagaaccugggccugaagcacaucuucagcgaggacaccagcgacuucagcggcaugagcgagaccaagggcguggcccugagcaacgugauccacaaggugugccuggagaucaccgaggacggcggcgacagcaucgaggugcccggcgccagaauccugcagcacaaggacgagcugaacgccgaccaccccuucaucuacaucaucagacacaacaagaccagaaacaucaucuucuucggcaaguucugcagccccuga

SEQ ID NO: 7471 - RNA, 1128 nt, Artificial Sequence
  derived and/or modified sequence opt5 from SERPINB5__Homo_sapiens__CCDS32839.1
auggacgcccugcagcucgcuaacagcgccuucgcgguggaucuguuuaagcaacuuugcgagaaagaaccccugggcaauguccucuucuccccuaucugucugucuaccagccuuucccuggcucagguuggggccaagggagacacagccaacgagauuggccaggugcuccacuuugaaaaugugaaagaugucccguucggguuucagacggugaccucugacguuaacaagcugagcuccuucuacucucugaaacucaucaagagacuguauguggauaagagccuuaaucuguccacagaguuuauuagcucuaccaaacggcccuacgcuaaggaacucgagacagucgacuucaaagauaagcuggaggaaaccaaaggacaaaucaacaauuccauuaaggaccuuacagauggccauuuugagaacauccuggccgacaauagcgugaacgaucagaccaagauccucguugugaaugcugccuauuucgucgggaaauggaugaagaaauuuucugaauccgagacgaaggagugcccuuuccgcgugaacaaaaccgacacaaagcccgugcagaugaugaauauggaagcgaccuuuuguaugggaaacauugauagcaucaauugcaaaauuaucgagcugccuuuccagaacaagcaccugucuauguucauucuccugcccaaggacgucgaagacgaguccacaggccuugagaaaaucgaaaagcaacugaacagcgagucccucucucaguggaccaauccuagcacgauggccaacgcuaaaguuaagcuguccauuccgaaauuuaagguggaaaagaugaucgaucccaaagccugucuugagaaucugggccucaagcauaucuucagcgaagacacaucugauuuuuccgggaugagcgagaccaaaggaguggcucugucuaacgucauucacaaggugugccuggaaaucacagaggacggcggggauagcauugagguuccuggagccagaauccuccagcauaaagacgaacugaaugcggaucaccccuucauuuacaucauccggcacaacaagacccgcaauauuaucuuuuucggcaaguuuuguuccccuuga

SEQ ID NO: 7472 - RNA, 1128 nt, Artificial Sequence
  derived and/or modified sequence opt6 from SERPINB5__Homo_sapiens__CCDS32839.1
auggacgcacuucaacucgcaaacucagcauucgccguagaccuauucaaacaauuaugcgaaaaagaaccauuaggcaacguccuauucucaccaauaugccuaaguacaagccuaucccucgcccaagucggagccaaaggagauacagcaaaugaaauaggacaaguacuccacuucgaaaacguaaaagaugucccauucggauuucaaacagucacaucagacgucaacaaacuaucaucauucuacucacucaaacuaauaaaaagacuauacgucgauaaaucccuaaaccuauccacagaauucauaucaucaacaaaaagaccauaugcaaaagaacuagaaacuguugauuucaaagacaaauuagaagaaacaaaaggacaaauaaacaacucaaucaaagaccuaacagacggacacuuugaaaacauacucgccgacaauagcguaaaugaccaaacaaaaauauuaguagucaacgcagcauacuucguagguaaauggaugaaaaaauucucagaaucagaaacaaaagaaugcccauucagaguaaacaaaaccgauacaaaaccaguccaaaugaugaacauggaagcaacauucuguaugggaaacauagacucaauaaacugcaaaauaauagaacuaccauuccaaaauaaacaucucaguauguucauacuacuaccaaaagacgucgaagacgaauccacaggacuagaaaaaaucgaaaaacaacuaaacucagaaucacucucccaauggacaaacccaucaacaauggcaaaugcaaaaguaaaacuaucaauaccaaaauucaaaguagaaaaaaugauagacccaaaagcuugccuagaaaaccuaggacuaaaacacauuuucucugaagacacuucagacuucucaggaaugucagaaacaaaaggaguagcacuaagcaauguaauucacaaagucugcuuagaaauaacagaagacggaggagacucaauagaaguaccuggagccagaauacuccaacacaaagacgaacuaaaugcagaucacccauucauauacauaauacgacauaacaaaacuagaaacauaauauucuucggcaaauucuguucaccauaa

SEQ ID NO: 7473 - protein, 433 aa, Artificial Sequence
  sFLT-1__Homo_sapiens__H9N1E7
MVIVEYCKYGNLSNYLKSKRDLFFLNKDAALHMEPKKEKMEPGLEQGKKPRLDSVTSSESFASSGFQEDKSLSDVEEEEDSDGFYKEPITMEDLISYSFQVARGMEFLSSRKCIHRDLAARNILLSENNVVKICDFGLARDIYKNPDYVRKGDTRLPLKWMAPESIFDKIYSTKSDVWSYGVLLWEIFSLGGSPYPGVQMDEDFCSRLREGMRMRAPEYSTPEIYQIMLDCWHRDPKERPRFAELVEKLGDLLQANVQQDGKDYIPINAILTGNSGFTYSTPAFSEDFFKESISAPKFNSGSSDDVRYVNAFKFMSLERIKTFEELLPNATSMFDDYQGDSSTLLASPMLKRFTWTDSKPKASLKIDLRVTSKSKESGLSDVSRPSFCHSSCGHVSEGKRRFTYDHAELERKIACCSPPPDYNSVVLYSTPPI

SEQ ID NO: 7474 - RNA, 1302 nt, Artificial Sequence
  sFLT-1__Homo_sapiens__AFC77954
auggugauuguugaauacugcaaauauggaaaucucuccaacuaccucaagagcaaacgugacuuauuuuuucucaacaaggaugcagcacuacacauggagccuaagaaagaaaaaauggagccaggccuggaacaaggcaagaaaccaagacuagauagcgucaccagcagcgaaagcuuugcgagcuccggcuuucaggaagauaaaagucugagugauguugaggaagaggaggauucugacgguuucuacaaggagcccaucacuauggaagaucugauuucuuacaguuuucaaguggccagaggcauggaguuccugucuuccagaaagugcauucaucgggaccuggcagcgagaaacauucuuuuaucugagaacaacguggugaagauuugugauuuuggccuugcccgggauauuuauaagaaccccgauuaugugagaaaaggagauacucgacuuccucugaaauggauggcuccugaaucuaucuuugacaaaaucuacagcaccaagagcgacguguggucuuacggaguauugcugugggaaaucuucuccuuaggugggucuccauacccaggaguacaaauggaugaggacuuuugcagucgccugagggaaggcaugaggaugagagcuccugaguacucuacuccugaaaucuaucagaucaugcuggacugcuggcacagagacccaaaagaaaggccaagauuugcagaacuuguggaaaaacuaggugauuugcuucaagcaaauguacaacaggaugguaaagacuacaucccaaucaaugccauacugacaggaaauaguggguuuacauacucaacuccugccuucucugaggacuucuucaaggaaaguauuucagcuccgaaguuuaauucaggaagcucugaugaugucagauauguaaaugcuuucaaguucaugagccuggaaagaaucaaaaccuuugaagaacuuuuaccgaaugccaccuccauguuugaugacuaccagggcgacagcagcacucuguuggccucucccaugcugaagcgcuucaccuggacugacagcaaacccaaggccucgcucaagauugacuugagaguaaccaguaaaaguaaggagucggggcugucugaugucagcaggcccaguuucugccauuccagcugugggcacgucagcgaaggcaagcgcagguucaccuacgaccacgcugagcuggaaaggaaaaucgcgugcugcuccccgcccccagacuacaacucggugguccuguacuccaccccacccaucuag

SEQ ID NO: 7475 - RNA, 1302 nt, Artificial Sequence
  derived and/or modified sequence opt1 from sFLT-1__Homo_sapiens__AFC77954
auggugaucgucgaguacugcaaguacggcaaccugagcaacuaccucaaguccaagcgcgaccuguucuuccugaacaaggacgccgcccuccacauggagcccaagaaggagaagauggagcccgggcuggagcagggcaagaagccccggcuggacagcgugaccuccagcgaguccuucgcgagcuccggguuccaggaggacaagagccucuccgacguggaggaggaggaggacagcgacggcuucuacaaggagcccaucaccauggaggaccugaucuccuacagcuuccaggucgcccgcgggauggaguuccuguccagccggaagugcauccaccgcgaccucgccgcccggaacauccugcuguccgagaacaacguggugaagaucugcgacuucggccucgcccgcgacaucuacaagaaccccgacuacguccggaagggcgacacgcgccugccccugaaguggauggcgcccgagagcaucuucgacaagaucuacuccaccaagagcgacgugugguccuacggggugcuccugugggagaucuucagccugggcgggagccccuaccccggcguccagauggacgaggacuucugcucccggcuccgcgaggggaugcggaugcgcgccccggaguacagcacccccgagaucuaccagaucaugcuggacugcuggcaccgggaccccaaggagcgcccccgguucgccgagcugguggagaagcucggcgaccugcugcaggccaacgugcagcaggacggcaaggacuacaucccgaucaacgcgauccucaccgggaacuccggcuucacguacagcacccccgccuucuccgaggacuucuucaaggagagcaucuccgcccccaaguucaacagcggguccagcgacgacguccgcuacgugaacgccuucaaguucaugucccuggagcggaucaagaccuucgaggagcugcuccccaacgccaccagcauguucgacgacuaccagggcgacuccagcacgcugcuggcguccccgaugcucaagcgcuucaccuggaccgacagcaagcccaaggccucccugaagaucgaccugcgggugaccagcaaguccaaggagagcggccucagcgacgucucccgccccagcuucugccacuccagcugcgggcacguguccgagggcaagcggcgcuucacguacgaccacgccgagcuggagcgcaagaucgccugcugcagcccgccgcccgacuacaacuccgugguccuguacagcaccccgcccaucuga

SEQ ID NO: 7476 - RNA, 1302 nt, Artificial Sequence
  derived and/or modified sequence opt2 from sFLT-1__Homo_sapiens__AFC77954
auggucaucgucgaguacugcaaguacggcaaccucuccaacuaccucaaguccaagcgcgaccucuucuuccucaacaaggacgccgcccuccacauggagcccaagaaggagaagauggagcccggccucgagcagggcaagaagccccgccucgacuccgucaccuccuccgaguccuucgccuccuccggcuuccaggaggacaagucccucuccgacgucgaggaggaggaggacuccgacggcuucuacaaggagcccaucaccauggaggaccucaucuccuacuccuuccaggucgcccgcggcauggaguuccucuccucccgcaagugcauccaccgcgaccucgccgcccgcaacauccuccucuccgagaacaacgucgucaagaucugcgacuucggccucgcccgcgacaucuacaagaaccccgacuacguccgcaagggcgacacccgccucccccucaaguggauggcccccgaguccaucuucgacaagaucuacuccaccaaguccgacgucugguccuacggcguccuccucugggagaucuucucccucggcggcucccccuaccccggcguccagauggacgaggacuucugcucccgccuccgcgagggcaugcgcaugcgcgcccccgaguacuccacccccgagaucuaccagaucaugcucgacugcuggcaccgcgaccccaaggagcgcccccgcuucgccgagcucgucgagaagcucggcgaccuccuccaggccaacguccagcaggacggcaaggacuacauccccaucaacgccauccucaccggcaacuccggcuucaccuacuccacccccgccuucuccgaggacuucuucaaggaguccaucuccgcccccaaguucaacuccggcuccuccgacgacguccgcuacgucaacgccuucaaguucaugucccucgagcgcaucaagaccuucgaggagcuccuccccaacgccaccuccauguucgacgacuaccagggcgacuccuccacccuccucgccucccccaugcucaagcgcuucaccuggaccgacuccaagcccaaggccucccucaagaucgaccuccgcgucaccuccaaguccaaggaguccggccucuccgacgucucccgccccuccuucugccacuccuccugcggccacgucuccgagggcaagcgccgcuucaccuacgaccacgccgagcucgagcgcaagaucgccugcugcucccccccccccgacuacaacuccgucguccucuacuccaccccccccaucuga

SEQ ID NO: 7477 - RNA, 1302 nt, Artificial Sequence
  derived and/or modified sequence opt3 from sFLT-1__Homo_sapiens__AFC77954
auggugaucgucgaguacugcaaguauggcaaccugagcaauuaccucaaauccaagagagaccuuuucuuucugaacaaagaugccgcuuugcacauggaacccaagaaagagaagauggaaccuggguuagagcagggaaagaaaccaaggcuggacucuguuaccucaagugagagcuucgcauccucugguuuucaagaagauaagucgcuaucagacguggaggaagaggaagauagcgacggcuucuauaaagagccgauuaccauggaggaucucauaaguuacuccuuucagguagcccgggggauggaguuccugucuagccgcaaguguauccaucgagaccuugcggcucguaauauucuguuguccgaaaacaauguggucaaaaucugcgauuuuggacucgccagagacauuuauaagaaccccgauuacgugaggaagggcgacacucggcugccucugaaauggauggcaccagaaucaaucuucgauaagauauauaguacgaaaagcgacguuuggucuuacggugugcucuuaugggagaucuuuucccuugggggaucacccuacccuggcguccagauggacgaagauuucuguagccgccugagagagggcaugaggaugcgggccccagaguauaguacccccgaaauuuaccagaucauguuggacugcuggcaccgcgauccuaaggagcgaccaagauuugcugaacugguggagaaacuaggggaccuccugcaagcaaauguacagcaggauggaaaggacuauauuccgaucaacgccauacuuacagguaauucuggcuucacuuacuccacccccgcuuuuagcgaagauuucuucaaagagucgauuucugccccuaaguuuaacuccgggucaagugacgauguuagguaugugaaugcguucaaguuuaugagccuggagcggaucaaaacauucgaagaguugcucccaaacgcaaccuccauguuugacgauuaccagggagacucuagcacucuguuagccucacccaugcugaagcguuucacauggaccgacaguaaaccuaaggcuucccucaaaauugaucuucgcgucacgagcaagucuaaggaaucaggccugagugacgugagcagaccauccuuuugucauucuucgugcggucacgugagcgaggggaaaaggcgguucacuuaugaucaugccgaauuggagcgaaagaucgcauguugcucacccccgccugacuacaauuccgucguucuauacaguacacccccaaucuga

SEQ ID NO: 7478 - RNA, 1302 nt, Artificial Sequence
  derived and/or modified sequence opt4 from sFLT-1__Homo_sapiens__AFC77954
auggugaucguggaguacugcaaguacggcaaccugagcaacuaccugaagagcaagagagaccuguucuuccugaacaaggacgccgcccugcacauggagcccaagaaggagaagauggagcccggccuggagcagggcaagaagcccagacuggacagcgugaccagcagcgagagcuucgccagcagcggcuuccaggaggacaagagccugagcgacguggaggaggaggaggacagcgacggcuucuacaaggagcccaucaccauggaggaccugaucagcuacagcuuccagguggccagaggcauggaguuccugagcagcagaaagugcauccacagagaccuggccgccagaaacauccugcugagcgagaacaacguggugaagaucugcgacuucggccuggccagagacaucuacaagaaccccgacuacgugagaaagggcgacaccagacugccccugaaguggauggcccccgagagcaucuucgacaagaucuacagcaccaagagcgacguguggagcuacggcgugcugcugugggagaucuucagccugggcggcagccccuaccccggcgugcagauggacgaggacuucugcagcagacugagagagggcaugagaaugagagcccccgaguacagcacccccgagaucuaccagaucaugcuggacugcuggcacagagaccccaaggagagacccagauucgccgagcugguggagaagcugggcgaccugcugcaggccaacgugcagcaggacggcaaggacuacauccccaucaacgccauccugaccggcaacagcggcuucaccuacagcacccccgccuucagcgaggacuucuucaaggagagcaucagcgcccccaaguucaacagcggcagcagcgacgacgugagauacgugaacgccuucaaguucaugagccuggagagaaucaagaccuucgaggagcugcugcccaacgccaccagcauguucgacgacuaccagggcgacagcagcacccugcuggccagccccaugcugaagagauucaccuggaccgacagcaagcccaaggccagccugaagaucgaccugagagugaccagcaagagcaaggagagcggccugagcgacgugagcagacccagcuucugccacagcagcugcggccacgugagcgagggcaagagaagauucaccuacgaccacgccgagcuggagagaaagaucgccugcugcagccccccccccgacuacaacagcguggugcuguacagcaccccccccaucuga

SEQ ID NO: 7479 - RNA, 1302 nt, Artificial Sequence
  derived and/or modified sequence opt5 from sFLT-1__Homo_sapiens__AFC77954
auggugaucgucgaguacugcaaguauggcaaccugagcaauuaccucaaauccaagagagaccuguucuuucuuaacaaagaugccgcucugcacauggaacccaagaaagagaagauggaaccugggcucgagcagggaaagaaaccgcggcuggacucuguuaccagcuccgaaucuuucgccagcuccggcuuucaagaggauaagucucuuagcgacguggaggaagaggaagauuccgacggguucuauaaagagcccauuaccauggaggaucugaucagcuacucuuuucagguggcgcgcggaauggaguuccucuccagcagaaaguguauucaucgggaccuggcugcccgcaauauccugcucucugagaacaaugucgugaaaauuugcgauuuuggccuggccagagacaucuauaagaacccugauuacguucggaagggggacacgcgccuuccccugaaauggauggcuccugaauccaucuucgauaagauuuauagcaccaaaucugacgugugguccuacggaguccuccugugggagaucuuuagccuuggcggcucccccuacccuggggugcagauggacgaagauuucuguucuagacugcgggagggaaugcgcaugagagccccggaguauagcacacccgaaauuuaccagaucaugcucgacugcuggcaccgggauccuaaggagcgccccagauuugcugaacugguugagaaacugggcgaccuccugcaagccaaugugcagcaggaugggaaggacuauauuccuaucaacgcgauucuuaccggaaauuccggcuucacauacagcacccccgccuuuucugaagauuucuucaaagaguccaucagcgcuccgaaguuuaacucugggagcuccgacgauguccgguaugugaaugccuucaaguuuaugucucuggagcgcaucaaaacauucgaagaacuccugccuaacgcuaccagcauguuugacgauuaccagggagacuccagcacgcuucuggccucucccaugcucaagagauucaccuggacagacuccaaaccuaaggcgagccugaaaauugaucugcgggugaccucuaaguccaaggaaagcggccucuccgacgucucuagacccagcuuuugucauuccucuugcggccacguuagcgaggggaaacgccgguucacauaugaucaugccgaacuggagagaaagaucgcuuguugcuccccucccccggacuacaauagcguggugcuuuacucuacacccccuauuuga

SEQ ID NO: 7480 - RNA, 1302 nt, Artificial Sequence
  derived and/or modified sequence opt6 from sFLT-1__Homo_sapiens__AFC77954
augguaauaguagaauauugcaaauauggaaacuuauccaacuaccuaaaaaguaaaagagaucuauuuuuccuaaauaaagacgcagcuuuacauauggaaccaaaaaaagaaaaaauggaaccaggacuagaacaaggaaaaaaaccaagacucgauaguguuacaucauccgaaucauucgcaagcucaggauuucaggaagauaaaucauuaagcgacguagaagaagaagaagacuccgacgguuucuacaaagaaccaauaacuauggaagacuuaauaucauacucauuccaagucgcgagaggcauggaauucuuaucaagccgaaaaugcauacacagagaccuagcagcaagaaacauacuacuuucagaaaauaacguaguaaaaauaugugacuucggacuagcaagagauauauacaaaaauccagacuauguaaggaaaggagacacaagacuaccacuaaaauggauggcacccgaaagcauauucgacaaaauauauucaacaaaaucagauguauggucauacggaguacuacuaugggaaauauuuagcuuaggaggcucaccauaccccggaguacaaauggacgaagacuuuuguucaagauuaagagaaggaaugagaaugagagcaccagaauacaguacuccagaaauauaccaaauaaugcuagacuguuggcacagagauccuaaagaacgaccaagauuugcagaacuuguagaaaaauuaggagaucuccuacaagcaaauguccaacaagacggaaaagacuacauaccaauaaacgcaauccuaacaggcaacagcggauucacauacagcacaccagcauucucagaagacuucuucaaagaaucaauaucagcaccaaaauucaacucaggaaguucagacgacgucagauaugucaacgcauuuaaauucaugucacuagaacgaauaaaaacauuugaagaguuacuaccaaacgcaacaucaauguuugacgauuaccaaggagacucaucaacauuacuagccucaccaaugcucaaaagauucacauggacagacucaaaaccaaaagcaucacuaaaaaucgauuuaagaguuacaucaaaauccaaagaaucaggccuaucagacguaucaagaccaagcuuuugccauucaucaugcggacauguaucagaaggaaaaagaagauuuaccuacgaccacgcagaacucgaacgcaaaauagcaugcugcucaccaccaccagacuacaacaguguaguauuauacucaacaccaccaauauaa

SEQ ID NO: 7481 - protein, 85 aa, Artificial Sequence
  sFLT-1__Homo_sapiens__H9N1E8
MLKRFTWTDSKPKASLKIDLRVTSKSKESGLSDVSRPSFCHSSCGHVSEGKRRFTYDHAELERKIACCSPPPDYNSVVLYSTPPI

SEQ ID NO: 7482 - RNA, 258 nt, Artificial Sequence
  sFLT-1__Homo_sapiens__AFC77955
augcugaagcgcuucaccuggacugacagcaaacccaaggccucgcucaagauugacuugagaguaaccaguaaaaguaaggagucggggcugucugaugucagcaggcccaguuucugccauuccagcugugggcacgucagcgaaggcaagcgcagguucaccuacgaccacgcugagcuggaaaggaaaaucgcgugcugcuccccgcccccagacuacaacucggugguccuguacuccaccccacccaucuag

SEQ ID NO: 7483 - RNA, 258 nt, Artificial Sequence
  derived and/or modified sequence opt1 from sFLT-1__Homo_sapiens__AFC77955
augcugaagcgcuucaccuggaccgacagcaagcccaaggccucccucaagaucgaccugcgggugacgagcaaguccaaggagagcggccuguccgacgucagccgcccguccuucugccacagcuccugcgggcacgugagcgagggcaagcggcgcuucaccuacgaccacgccgagcucgagcggaagaucgcgugcugcucccccccccccgacuacaacagcgugguccuguacuccaccccgcccaucuga

SEQ ID NO: 7484 - RNA, 258 nt, Artificial Sequence
  derived and/or modified sequence opt2 from sFLT-1__Homo_sapiens__AFC77955
augcucaagcgcuucaccuggaccgacuccaagcccaaggccucccucaagaucgaccuccgcgucaccuccaaguccaaggaguccggccucuccgacgucucccgccccuccuucugccacuccuccugcggccacgucuccgagggcaagcgccgcuucaccuacgaccacgccgagcucgagcgcaagaucgccugcugcucccccccccccgacuacaacuccgucguccucuacuccaccccccccaucuga

SEQ ID NO: 7485 - RNA, 258 nt, Artificial Sequence
  derived and/or modified sequence opt3 from sFLT-1__Homo_sapiens__AFC77955
augcugaagagauucaccuggacagacagcaaacccaaggccucccucaaaaucgaucuuagggugacuucuaagucaaaagagaguggccugagcgacgucucccggccuucuuuuugccacucgucaugugggcauguuagcgaaggaaagcgccgauucacguacgaucacgcugaguuggaacguaagauugcaugcuguaguccaccgcccgacuauaacuccgugguauuauacucuaccccuccaauauga

SEQ ID NO: 7486 - RNA, 258 nt, Artificial Sequence
  derived and/or modified sequence opt4 from sFLT-1__Homo_sapiens__AFC77955
augcugaagagauucaccuggaccgacagcaagcccaaggccagccugaagaucgaccugagagugaccagcaagagcaaggagagcggccugagcgacgugagcagacccagcuucugccacagcagcugcggccacgugagcgagggcaagagaagauucaccuacgaccacgccgagcuggagagaaagaucgccugcugcagccccccccccgacuacaacagcguggugcuguacagcaccccccccaucuga

SEQ ID NO: 7487 - RNA, 258 nt, Artificial Sequence
  derived and/or modified sequence opt5 from sFLT-1__Homo_sapiens__AFC77955
augcugaagagauucaccuggacagacagcaaacccaaggccucccucaaaaucgaucugcgggugacgucuaagagcaaagaguccggccuuucugacgucagccgcccuuccuuuugccacucuagcugugggcauguuuccgaaggaaagagacgguucaccuacgaucacgcugagcuggaacgcaagauugccugcuguagcccgcccccugacuauaacucuguggugcucuacuccacacccccuaucuga

SEQ ID NO: 7488 - RNA, 258 nt, Artificial Sequence
  derived and/or modified sequence opt6 from sFLT-1__Homo_sapiens__AFC77955
augcuaaaaagauucacauggacagacucaaaaccaaaagcaucacuaaaaauagaccuaagaguaacaucaaaaucaaaagaaucaggacuaucagacguaucaagaccaucauucugccacucaucaugcggacacguaucagaaggaaaaagaagauucacauacgaccacgcagaacuagaaagaaaaauagcaugcugcucaccaccaccagacuacaacucaguaguacuauacucaacaccaccaauauaa

SEQ ID NO: 7489 - protein, 1338 aa, Artificial Sequence
  sFLT-1__Homo_sapiens__L7RSL3
MVSYWDTGVLLCALLSCLLLTGSSSGSKLKDPELSLKGTQHIMQAGQTLHLQCRGEAAHKWSLPEMVSKESERLSITKSACGRNGKQFCSTLTLNTAQANHTGFYSCKYLAVPTSKKKETESAIYIFISDTGRPFVEMYSEIPEIIHMTEGRELVIPCRVTSPNITVTLKKFPLDTLIPDGKRIIWDSRKGFIISNATYKEIGLLTCEATVNGHLYKTNYLTHRQTNTIIDVQISTPRPVKLLRGHTLVLNCTATTPLNTRVQMTWSYPDEKNKRASVRRRIDQSNSHANIFYSVLTIDKMQNKDKGLYTCRVRSGPSFKSVNTSVHIYDKAFITVKHRKQQVLETVAGKRSYRLSMKVKAFPSPEVVWLKDGLPATEKSARYLTRGYSLIIKDVTEEDAGNYTILLSIKQSNVFKNLTATLIVNVKPQIYEKAVSSFPDPALYPLGSRQILTCTAYGIPQPTIKWFWHPCNHNHSEARCDFCSNNEESFILDADSNMGNRIESITQRMAIIEGKNKMASTLVVADSRISGIYICIASNKVGTVGRNISFYITDVPNGFHVNLEKMPTEGEDLKLSCTVNKFLYRDVTWILLRTVNNRTMHYSISKQKMAITKEHSITLNLTIMNVSLQDSGTYACRARNVYTGEEILQKKEITIRDQEAPYLLRNLSDHTVAISSSTTLDCHANGVPEPQITWFKNNHKIQQEPGIILGPGSSTLFIERVTEEDEGVYHCKATNQKGSVESSAYLTVQGTSDKSNLELITLTCTCVAATLFWLLLTLFIRKMKRSSSEIKTDYLSIIMDPDEVPLDEQCERLPYDASKWEFARERLKLGKSLGRGAFGKVVQASAFGIKKSPTCRTVAVKMLKEGATASEYKALMTELKILTHIGHHLNVVNLLGACTKQGGPLMVIVEYCKYGNLSNYLKSKRDLFFLNKDAALHMEPKKEKMEPGLEQGKKPRLDSVTSSESFASSGFQEDKSLSDVEEEEDSDGFYKEPITMEDLISYSFQVARGMEFLSSRKCIHRDLAARNILLSENNVVKICDFGLARDIYKNPDYVRKGDTRLPLKWMAPESIFDKIYSTKSDVWSYGVLLWEIFSLGGSPYPGVQMDEDFCSRLREGMRMRAPEYSTPEIYQIMLDCWHRDPKERPRFAELVEKLGDLLQANVQQDGKDYIPINAILTGNSGFTYSTPAFSEDFFKESISAPKFNSGSSDDVRYVNAFKFMSLERIKTFEELLPNATSMFDDYQGDSSTLLASPMLKRFTWTDSKPKASLKIDLRVTSKSKESGLSDVSRPSFCHSSCGHVSEGKRRFTYDHAELERKIACCSPPPDYNSVVLYSTPPI

SEQ ID NO: 7490 - RNA, 4017 nt, Artificial Sequence
  sFLT-1__Homo_sapiens__AGC09589
auggucagcuacugggacaccgggguccugcugugcgcgcugcucagcugucugcuucucacaggaucuaguucagguucaaaauuaaaagauccugaacugaguuuaaaaggcacccagcacaucaugcaagcaggccagacacugcaucuccaaugcaggggggaagcagcccauaaauggucuuugccugaaauggugaguaaggaaagcgaaaggcugagcauaacuaaaucugccuguggaagaaauggcaaacaauucugcaguacuuuaaccuugaacacagcucaagcaaaccacacuggcuucuacagcugcaaauaucuagcuguaccuacuucaaagaagaaggaaacagaaucugcaaucuauauauuuauuagugauacagguagaccuuucguagagauguacagugaaauccccgaaauuauacacaugacugaaggaagggagcucgucauucccugccggguuacgucaccuaacaucacuguuacuuuaaaaaaguuuccacuugacacuuugaucccugauggaaaacgcauaaucugggacaguagaaagggcuucaucauaucaaaugcaacguacaaagaaauagggcuucugaccugugaagcaacagucaaugggcauuuguauaagacaaacuaucucacacaucgacaaaccaauacaaucauagauguccaaauaagcacaccacgcccagucaaauuacuuagaggccauacucuuguccucaauuguacugcuaccacucccuugaacacgagaguucaaaugaccuggaguuacccugaugaaaaaaauaagagagcuuccguaaggcgacgaauugaccaaagcaauucccaugccaacauauucuacaguguucuuacuauugacaaaaugcagaacaaagacaaaggacuuuauacuugucguguaaggaguggaccaucauucaaaucuguuaacaccucagugcauauauaugauaaagcauucaucacugugaaacaucgaaaacagcaggugcuugaaaccguagcuggcaagcggucuuaccggcucucuaugaaagugaaggcauuucccucgccggaaguuguaugguuaaaagauggguuaccugcgacugagaaaucugcucgcuauuugacucguggcuacucguuaauuaucaaggacguaacugaagaggaugcagggaauuauacaaucuugcugagcauaaaacagucaaauguguuuaaaaaccucacugccacucuaauugucaaugugaaaccccagauuuacgaaaaggccgugucaucguuuccagacccggcucucuacccacugggcagcagacaaauccugacuuguaccgcauaugguaucccucaaccuacaaucaagugguucuggcaccccuguaaccauaaucauuccgaagcaaggugugacuuuuguuccaauaaugaagaguccuuuauccuggaugcugacagcaacaugggaaacagaauugagagcaucacucagcgcauggcaauaauagaaggaaagaauaagauggcuagcaccuugguuguggcugacucuagaauuucuggaaucuacauuugcauagcuuccaauaaaguugggacugugggaagaaacauaagcuuuuauaucacagaugugccaaauggguuucauguuaacuuggaaaaaaugccgacggaaggagaggaccugaaacugucuugcacaguuaacaaguucuuauacagagacguuacuuggauuuuacugcggacaguuaauaacagaacaaugcacuacaguauuagcaagcaaaaaauggccaucacuaaggagcacuccaucacucuuaaucuuaccaucaugaauguuucccugcaagauucaggcaccuaugccugcagagccaggaauguauacacaggggaagaaauccuccagaagaaagaaauuacaaucagagaucaggaagcaccauaccuccugcgaaaccucagugaucacacaguggccaucagcaguuccaccacuuuagacugucaugcuaaugguguccccgagccucagaucacuugguuuaaaaacaaccacaaaauacaacaagagccuggaauuauuuuaggaccaggaagcagcacgcuguuuauugaaagagucacagaagaggaugaaggugucuaucacugcaaagccaccaaccagaagggcucuguggaaaguucagcauaccucacuguucaaggaaccucggacaagucuaaucuggagcugaucacucuaacaugcaccuguguggcugcgacucucuucuggcuccuauuaacccucuuuauccgaaaaaugaaaaggucuucuucugaaauaaagacugacuaccuaucaauuauaauggacccagaugaaguuccuuuggaugagcagugugagcggcucccuuaugaugccagcaagugggaguuugcccgggagagacuuaaacugggcaaaucacuuggaagaggggcuuuuggaaaagugguucaagcaucagcauuuggcauuaagaaaucaccuacgugccggacuguggcugugaaaaugcugaaagagggggccacggccagcgaguacaaagcucugaugacugagcuaaaaaucuugacccacauuggccaccaucugaacgugguuaaccugcugggagccugcaccaagcaaggagggccucugauggugauuguugaauacugcaaauauggaaaucucuccaacuaccucaagagcaaacgugacuuauuuuuucucaacaaggaugcagcacuacacauggagccuaagaaagaaaaaauggagccaggccuggaacaaggcaagaaaccaagacuagauagcgucaccagcagcgaaagcuuugcgagcuccggcuuucaggaagauaaaagucugagugauguugaggaagaggaggauucugacgguuucuacaaggagcccaucacuauggaagaucugauuucuuacaguuuucaaguggccagaggcauggaguuccugucuuccagaaagugcauucaucgggaccuggcagcgagaaacauucuuuuaucugagaacaacguggugaagauuugugauuuuggccuugcccgggauauuuauaagaaccccgauuaugugagaaaaggagauacucgacuuccucugaaauggauggcuccugaaucuaucuuugacaaaaucuacagcaccaagagcgacguguggucuuacggaguauugcugugggaaaucuucuccuuaggugggucuccauacccaggaguacaaauggaugaggacuuuugcagucgccugagggaaggcaugaggaugagagcuccugaguacucuacuccugaaaucuaucagaucaugcuggacugcuggcacagagacccaaaagaaaggccaagauuugcagaacuuguggaaaaacuaggugauuugcuucaagcaaauguacaacaggaugguaaagacuacaucccaaucaaugccauacugacaggaaauaguggguuuacauacucaacuccugccuucucugaggacuucuucaaggaaaguauuucagcuccgaaguuuaauucaggaagcucugaugaugucagauacguaaaugcuuucaaguucaugagccuggaaagaaucaaaaccuuugaagaacuuuuaccgaaugccaccuccauguuugaugacuaccagggcgacagcagcacucuguuggccucucccaugcugaagcgcuucaccuggacugacagcaaacccaaggccucgcucaagauugacuugagaguaaccaguaaaaguaaggagucggggcugucugaugucagcaggcccaguuucugccauuccagcugugggcacgucagcgaaggcaagcgcagguucaccuacgaccacgcugagcuggaaaggaaaaucgcgugcugcuccccgcccccagacuacaacucggugguccuguacuccaccccacccaucuag

SEQ ID NO: 7491 - RNA, 4017 nt, Artificial Sequence
  derived and/or modified sequence opt1 from sFLT-1__Homo_sapiens__AGC09589
auggugagcuacugggacaccggcguccugcucugcgcccugcuguccugccuccugcugaccgggagcuccagcggcuccaagcucaaggaccccgagcugagccugaaggggacgcagcacaucaugcaggccggccagacccuccaccuccagugccgcggggaggcggcccacaaguggucccugcccgagauggugagcaaggaguccgagcggcugagcaucaccaaguccgccugcggccgcaacggcaagcaguucugcagcacccugacgcugaacaccgcccaggccaaccacaccggguucuacuccugcaaguaccucgcggugcccaccagcaagaagaaggagacggaguccgccaucuacaucuucaucagcgacaccggccggcccuucgucgagauguacuccgagauccccgagaucauccacaugaccgaggggcgcgagcuggugaucccgugccgggugaccagccccaacaucacggucacccugaagaaguucccccucgacacccugauccccgacggcaagcgcaucaucugggacucccggaagggguucaucaucagcaacgccaccuacaaggagaucggccugcucacgugcgaggccaccgugaacggccaccuguacaagaccaacuaccugacccaccgccagacgaacaccaucaucgacgugcagaucagcaccccgcggcccgucaagcuccugcgcgggcacacccuggugcucaacugcacggcgaccacgccccugaacacccgggugcagaugaccugguccuaccccgacgagaagaacaagcgcgccagcguccggcgccggaucgaccaguccaacagccacgccaacaucuucuacuccgugcugaccaucgacaagaugcagaacaaggacaagggccucuacacgugccgcgugcggagcgggccguccuucaagagcgucaacaccuccgugcacaucuacgacaaggccuucaucaccgugaagcaccgcaagcagcagguccuggagaccguggccggcaagcggagcuaccgccuguccaugaaggugaaggcguuccccagccccgaggucguguggcucaaggacggccugcccgccaccgagaaguccgcccgguaccugacccgcggguacagccucaucaucaaggacgugacggaggaggacgccggcaacuacaccauccugcuguccaucaagcagagcaacgucuucaagaaccucaccgccacccugaucgugaacgucaagccgcagaucuacgagaaggcgguguccagcuuccccgaccccgcccuguacccccucgggucccgccagauccugaccugcacggccuacggcaucccgcagcccaccaucaagugguucuggcaccccugcaaccacaaccacagcgaggcccggugcgacuucugcagcaacaacgaggaguccuucauccuggacgccgacagcaacauggggaaccgcaucgaguccaucacccagcggauggcgaucaucgagggcaagaacaagauggccagcacccucguggucgccgacucccgcaucagcggcaucuacaucugcaucgccuccaacaagguggggacggugggccggaacaucagcuucuacaucaccgacguccccaacggguuccacgugaaccuggagaagaugccgaccgagggcgaggaccugaagcucuccugcaccgugaacaaguuccuguaccgcgacgucacguggauccugcugcggaccgugaacaaccgcaccaugcacuacagcaucuccaagcagaagauggccaucaccaaggagcacagcaucacgcucaaccugaccaucaugaacgugucccugcaggacagcgggaccuacgcgugccgggcccgcaacgucuacaccggcgaggagauccuccagaagaaggagaucacgauccgggaccaggaggcccccuaccugcugcgcaaccucuccgaccacaccguggccaucagcuccagcaccacccuggacugccacgcgaacggcgugcccgagccccagaucacgugguucaagaacaaccacaagauccagcaggagccggggaucauccugggccccgggagcuccacccucuucaucgagcgggucaccgaggaggacgagggcguguaccacugcaaggccaccaaccagaaggggagcguggaguccagcgccuaccugacgguccagggcaccuccgacaagagcaaccuggagcucaucacccugaccugcacgugcguggccgccacccuguucuggcuccugcugacccucuucauccgcaagaugaagcgguccagcuccgagaucaagaccgacuaccugagcaucaucauggaccccgacgaggugccgcuggacgagcagugcgagcgccuccccuacgacgcguccaagugggaguucgcccgggagcgccugaagcugggcaagagccucgggcggggcgccuucgggaaggucgugcaggccuccgccuucggcaucaagaagucccccacgugccgcaccguggcggucaagaugcugaaggagggcgccaccgccagcgaguacaaggcccugaugaccgagcucaagauccugacgcacaucgggcaccaccugaacguggugaaccuccugggcgccugcaccaagcagggcgggccccugauggucaucguggaguacugcaaguacgggaaccucagcaacuaccugaaguccaagcgcgaccuguucuuccucaacaaggacgcggcccugcacauggagccgaagaaggagaagauggagcccggccuggagcagggcaagaagccccggcucgacagcgugaccuccagcgagagcuucgccuccagcggguuccaggaggacaagucccugagcgacgucgaggaggaggaggacuccgacggcuucuacaaggagcccaucaccauggaggaccugaucagcuacuccuuccagguggcccgcgggauggaguuccucagcucccggaagugcauccaccgcgaccuggcggcccggaacauccugcucagcgagaacaacguggucaagaucugcgacuucggccuggcccgcgacaucuacaagaacccggacuacgugcggaagggggacacccgccugccccucaaguggauggcccccgaguccaucuucgacaagaucuacagcacgaaguccgacguguggagcuacggcguccugcugugggagaucuucucccucggcgggagccccuacccgggcgugcagauggacgaggacuucugcucccggcugcgcgaggggaugcggaugcgcgcccccgaguacagcacccccgagaucuaccagaucaugcuggacugcuggcaccgggaccccaaggagcgcccgcgguucgcggagcucguggagaagcugggcgaccugcuccaggccaacguccagcaggacgggaaggacuacauccccaucaacgccauccugaccggcaacuccggcuucaccuacagcacgcccgccuucagcgaggacuucuucaaggaguccaucagcgcccccaaguucaacuccgggagcuccgacgacgugcgcuacgugaacgcguucaaguucaugagccuggagcggaucaagaccuucgaggagcuccugccgaacgccaccuccauguucgacgacuaccagggcgacagcuccacccugcucgccagccccaugcugaagcgcuucacguggaccgacuccaagcccaaggccagccugaagaucgaccuccgggucaccuccaagagcaaggaguccgggcugagcgacgugucccgccccagcuucugccacuccagcugcggccacgugagcgaggggaagcggcgcuucaccuacgaccacgccgagcuggagcgcaagaucgcgugcugcuccccgccgcccgacuacaacagcgucgugcucuacuccacgccgcccaucuga

SEQ ID NO: 7492 - RNA, 4017 nt, Artificial Sequence
  derived and/or modified sequence opt2 from sFLT-1__Homo_sapiens__AGC09589
auggucuccuacugggacaccggcguccuccucugcgcccuccucuccugccuccuccucaccggcuccuccuccggcuccaagcucaaggaccccgagcucucccucaagggcacccagcacaucaugcaggccggccagacccuccaccuccagugccgcggcgaggccgcccacaaguggucccuccccgagauggucuccaaggaguccgagcgccucuccaucaccaaguccgccugcggccgcaacggcaagcaguucugcuccacccucacccucaacaccgcccaggccaaccacaccggcuucuacuccugcaaguaccucgccguccccaccuccaagaagaaggagaccgaguccgccaucuacaucuucaucuccgacaccggccgccccuucgucgagauguacuccgagauccccgagaucauccacaugaccgagggccgcgagcucgucauccccugccgcgucaccucccccaacaucaccgucacccucaagaaguucccccucgacacccucauccccgacggcaagcgcaucaucugggacucccgcaagggcuucaucaucuccaacgccaccuacaaggagaucggccuccucaccugcgaggccaccgucaacggccaccucuacaagaccaacuaccucacccaccgccagaccaacaccaucaucgacguccagaucuccaccccccgccccgucaagcuccuccgcggccacacccucguccucaacugcaccgccaccaccccccucaacacccgcguccagaugaccugguccuaccccgacgagaagaacaagcgcgccuccguccgccgccgcaucgaccaguccaacucccacgccaacaucuucuacuccguccucaccaucgacaagaugcagaacaaggacaagggccucuacaccugccgcguccgcuccggccccuccuucaaguccgucaacaccuccguccacaucuacgacaaggccuucaucaccgucaagcaccgcaagcagcagguccucgagaccgucgccggcaagcgcuccuaccgccucuccaugaaggucaaggccuuccccucccccgaggucgucuggcucaaggacggccuccccgccaccgagaaguccgcccgcuaccucacccgcggcuacucccucaucaucaaggacgucaccgaggaggacgccggcaacuacaccauccuccucuccaucaagcaguccaacgucuucaagaaccucaccgccacccucaucgucaacgucaagccccagaucuacgagaaggccgucuccuccuuccccgaccccgcccucuacccccucggcucccgccagauccucaccugcaccgccuacggcaucccccagcccaccaucaagugguucuggcaccccugcaaccacaaccacuccgaggcccgcugcgacuucugcuccaacaacgaggaguccuucauccucgacgccgacuccaacaugggcaaccgcaucgaguccaucacccagcgcauggccaucaucgagggcaagaacaagauggccuccacccucgucgucgccgacucccgcaucuccggcaucuacaucugcaucgccuccaacaaggucggcaccgucggccgcaacaucuccuucuacaucaccgacguccccaacggcuuccacgucaaccucgagaagaugcccaccgagggcgaggaccucaagcucuccugcaccgucaacaaguuccucuaccgcgacgucaccuggauccuccuccgcaccgucaacaaccgcaccaugcacuacuccaucuccaagcagaagauggccaucaccaaggagcacuccaucacccucaaccucaccaucaugaacgucucccuccaggacuccggcaccuacgccugccgcgcccgcaacgucuacaccggcgaggagauccuccagaagaaggagaucaccauccgcgaccaggaggcccccuaccuccuccgcaaccucuccgaccacaccgucgccaucuccuccuccaccacccucgacugccacgccaacggcguccccgagccccagaucaccugguucaagaacaaccacaagauccagcaggagcccggcaucauccucggccccggcuccuccacccucuucaucgagcgcgucaccgaggaggacgagggcgucuaccacugcaaggccaccaaccagaagggcuccgucgaguccuccgccuaccucaccguccagggcaccuccgacaaguccaaccucgagcucaucacccucaccugcaccugcgucgccgccacccucuucuggcuccuccucacccucuucauccgcaagaugaagcgcuccuccuccgagaucaagaccgacuaccucuccaucaucauggaccccgacgaggucccccucgacgagcagugcgagcgccuccccuacgacgccuccaagugggaguucgcccgcgagcgccucaagcucggcaagucccucggccgcggcgccuucggcaaggucguccaggccuccgccuucggcaucaagaagucccccaccugccgcaccgucgccgucaagaugcucaaggagggcgccaccgccuccgaguacaaggcccucaugaccgagcucaagauccucacccacaucggccaccaccucaacgucgucaaccuccucggcgccugcaccaagcagggcggcccccucauggucaucgucgaguacugcaaguacggcaaccucuccaacuaccucaaguccaagcgcgaccucuucuuccucaacaaggacgccgcccuccacauggagcccaagaaggagaagauggagcccggccucgagcagggcaagaagccccgccucgacuccgucaccuccuccgaguccuucgccuccuccggcuuccaggaggacaagucccucuccgacgucgaggaggaggaggacuccgacggcuucuacaaggagcccaucaccauggaggaccucaucuccuacuccuuccaggucgcccgcggcauggaguuccucuccucccgcaagugcauccaccgcgaccucgccgcccgcaacauccuccucuccgagaacaacgucgucaagaucugcgacuucggccucgcccgcgacaucuacaagaaccccgacuacguccgcaagggcgacacccgccucccccucaaguggauggcccccgaguccaucuucgacaagaucuacuccaccaaguccgacgucugguccuacggcguccuccucugggagaucuucucccucggcggcucccccuaccccggcguccagauggacgaggacuucugcucccgccuccgcgagggcaugcgcaugcgcgcccccgaguacuccacccccgagaucuaccagaucaugcucgacugcuggcaccgcgaccccaaggagcgcccccgcuucgccgagcucgucgagaagcucggcgaccuccuccaggccaacguccagcaggacggcaaggacuacauccccaucaacgccauccucaccggcaacuccggcuucaccuacuccacccccgccuucuccgaggacuucuucaaggaguccaucuccgcccccaaguucaacuccggcuccuccgacgacguccgcuacgucaacgccuucaaguucaugucccucgagcgcaucaagaccuucgaggagcuccuccccaacgccaccuccauguucgacgacuaccagggcgacuccuccacccuccucgccucccccaugcucaagcgcuucaccuggaccgacuccaagcccaaggccucccucaagaucgaccuccgcgucaccuccaaguccaaggaguccggccucuccgacgucucccgccccuccuucugccacuccuccugcggccacgucuccgagggcaagcgccgcuucaccuacgaccacgccgagcucgagcgcaagaucgccugcugcucccccccccccgacuacaacuccgucguccucuacuccaccccccccaucuga

SEQ ID NO: 7493 - RNA, 4017 nt, Artificial Sequence
  derived and/or modified sequence opt3 from sFLT-1__Homo_sapiens__AGC09589
auggugagcuacugggacaccggcguccugcucugcgcccuucuguccuguuuguuacugacagggucuucaaguggaagcaagcuaaaagaucccgagcucucccugaaggguacucagcacaucaugcaagcuggccagacgcuucaucugcagugcagaggggaagcagcccacaaauggucuuugccugagaugguuucgaaggaaucagagaggcucagcauuaccaaaagugcguguggacggaacggcaagcaguucugcuccacacugacucugaauaccgcucaagccaaccauacagguuuuuauucuuguaaguaccucgcagugccaaccagcaaaaagaaagaaacugaguccgccauauauaucuucauuucagacacagggcgcccguuuguagagauguacagugaaauccccgagauuauccacaugaccgaaggacgagaguuagugauaccuugccgugucacgagcccaaauaucacugugacccugaagaaauucccccuugauacauugauuccugacggcaagagaaucauuugggauucuaggaagggcuuuaucauauccaacgcuacuuauaaagagauugggcugcuaaccugugaagcaacaguuaauggacaucucuacaagaccaacuaucugacgcaccggcagacuaauacaaucauugacgugcagaucucaaccccacgccccgucaaacuucugagaggucacacuuuggugcucaacugcacagccaccacgccucugaauaccaggguacagaugacauggagcuacccagaugagaagaacaaacgggcuaguguucgccgaagaaucgaccaaucuaauucccaugccaacauuuucuacagcguguuaacuauagauaagaugcagaauaaagacaagggccuguauaccuguaggguccggucggggccgucuuuuaaguccgugaacacaucagugcacaucuacgauaaagcguucauuacugucaagcaucguaaacagcagguucucgaaaccguggcaggaaagcgcaguuauagacuuagcaugaaaguaaaggccuuucccuccccugagguggucuggcugaaggacggcuugccagcuacagaaaaaucugccagguaccuaacccgggguuauagccugaucauaaaggaugugacugaggaggacgcagggaauuacacgauucuccugucaaucaaacaaaguaacguuuucaagaaccuuacagcuacccugaucgugaaugucaaaccccagauuuaugaaaaggccguguccagcuuuccugacccagcguuguacccccucggaucucgacagauccugacuugcaccgccuacggcauuccgcaaccuacaauaaagugguucuggcaccccuguaaccacaaucauucagaggcacgcugcgauuuuugcaguaacaaugaagagagcuucaucuuagacgcugauuccaacaugggcaauagaauugaaucuaucacccagaggauggccaucauugaggggaaaaacaagauggcuucgacucugguaguugccgacagccggauauccggaaucuauauuuguaucgcaucaaauaaaguggguacagucggccgcaacauuaguuucuacaucacggaugugccaaauggguuucacgucaaccuagagaagaugccuaccgaaggagaggaccucaaacugucuugcacugugaauaaguuccuuuauagagauguuacauggauauugcugaggaccgugaacaaucguacaaugcauuacagcaucuccaagcagaaaauggccauuacuaaggaacacucaaucacccucaaccugacgauuaugaacguaagccuucaggacucuggcaccuaugcuugucgggcgcgaaaugucuacacaggugaggaaauccugcagaaaaaggagauaacuauuagagaucaagaggcacccuauuugcucaggaaccuguccgaccauaccguggccaucaguagcucuacaacuuuagauugccacgcuaaugggguuccagaaccccagauuaccugguuuaaaaacaaucacaagauccagcaagagccuggcauaauccugggaccaggcuccucaacgcuauucauugaacgcgugacagaggaggacgaaggggucuaccauuguaaagccaccaaccagaagggaaguguggagagcucggcauaccucacuguacaggguacauccgacaagucuaaucuggaacuuaucaccuugacuugcaccuguguggccgcuacacuguuuuggcuccuguuaacgcuguucauucggaaaaugaagagaagcucaagugagaucaaaaccgauuaucuuuccauaauuauggacccggaugaaguucccuuggacgagcagugcgagaggcucccuuacgaugccucuaagugggaauuugcacgcgagcgacugaaacuaggcaagagccuggggcggggagcguucggcaaggucgugcaggcuuccgccuuugguaucaaaaagucaccaacuugucguacaguggcagucaaaaugcucaaggaaggggccaccgcuagcgaguauaaagcccugaugacagaacuuaagaucuugacucacauuggccaucaccugaacguugugaauuuacucggagcaugcaccaagcaaggcgggccccugauggugaucguagaguacuguaaauauggaaaccuuaguaauuaccugaagucuaaaagagacuuguucuuucucaacaaggaugcugcccugcacauggagccuaaaaaggaaaagauggagccaggucuagaacagggcaaaaagcccaggcuggacuccgucacgagcucggagucauucgcgucuaguggguuucaggaagauaaaucccucagcgacguggaggaggaagaggauucugacggauucuauaaggaaccgauuacaauggaggaucugauaagcuacuccuuccaaguugcccgcggcauggaguuucuuucaagucggaaaugcauccauagagacuuggcugcaaggaauauucuguuaagcgaaaacaauguggucaagaucugcgacuucggucucgcccgagauauuuacaaaaacccugacuaugugcgcaagggggauacccggcugccacuuaaguggauggcucccgagucuaucuuugacaaaauauacuccacuaagucagauguuuggaguuauggcgugcugcuaugggaaaucuucagccucggaggcuccccuuaccccgggguacagauggacgaggauuuuuguucuagacugagggaaggaaugcguaugcgcgccccagaguauucgaccccugagauuuaccagaucauguuggacugcuggcaccgggaucccaaagaaagaccaagguucgcagagcuggucgaaaaguuaggcgaccuccugcaagcgaacgugcagcaggaugguaaagacuauauuccgaucaaugccauacuuacagggaacagcggauuuacuuacucaaccccugcuuucuccgaggacuuuuucaaggaaaguauuucugcccccaaguuuaauagcggcuccucagaugacgugcgauacgucaacgcauucaaauuuaugucucuggagcggaucaagacauucgaggaauugcucccaaaugcuacgagcauguucgaugacuaucagggugauaguuccacccugcuagccagccccaugcugaaacgcuuuacuuggacagacucuaagccuaaagcaucacuuaagaucgaucucagaguuaccuccaagaguaaagagagcggccugucggacgugucuaggccauccuucugucauagcucaugcgggcacguaagugaaggaaagcggcgauuuacuuacgaucaugccgaguuggaaagaaaaauugcuuguugcucucccccuccggacuauaacuccgugguccuguacagcacaccacccauauga

SEQ ID NO: 7494 - RNA, 4017 nt, Artificial Sequence
  derived and/or modified sequence opt4 from sFLT-1__Homo_sapiens__AGC09589
auggugagcuacugggacaccggcgugcugcugugcgcccugcugagcugccugcugcugaccggcagcagcagcggcagcaagcugaaggaccccgagcugagccugaagggcacccagcacaucaugcaggccggccagacccugcaccugcagugcagaggcgaggccgcccacaaguggagccugcccgagauggugagcaaggagagcgagagacugagcaucaccaagagcgccugcggcagaaacggcaagcaguucugcagcacccugacccugaacaccgcccaggccaaccacaccggcuucuacagcugcaaguaccuggccgugcccaccagcaagaagaaggagaccgagagcgccaucuacaucuucaucagcgacaccggcagacccuucguggagauguacagcgagauccccgagaucauccacaugaccgagggcagagagcuggugauccccugcagagugaccagccccaacaucaccgugacccugaagaaguucccccuggacacccugauccccgacggcaagagaaucaucugggacagcagaaagggcuucaucaucagcaacgccaccuacaaggagaucggccugcugaccugcgaggccaccgugaacggccaccuguacaagaccaacuaccugacccacagacagaccaacaccaucaucgacgugcagaucagcacccccagacccgugaagcugcugagaggccacacccuggugcugaacugcaccgccaccaccccccugaacaccagagugcagaugaccuggagcuaccccgacgagaagaacaagagagccagcgugagaagaagaaucgaccagagcaacagccacgccaacaucuucuacagcgugcugaccaucgacaagaugcagaacaaggacaagggccuguacaccugcagagugagaagcggccccagcuucaagagcgugaacaccagcgugcacaucuacgacaaggccuucaucaccgugaagcacagaaagcagcaggugcuggagaccguggccggcaagagaagcuacagacugagcaugaaggugaaggccuuccccagccccgaggugguguggcugaaggacggccugcccgccaccgagaagagcgccagauaccugaccagaggcuacagccugaucaucaaggacgugaccgaggaggacgccggcaacuacaccauccugcugagcaucaagcagagcaacguguucaagaaccugaccgccacccugaucgugaacgugaagccccagaucuacgagaaggccgugagcagcuuccccgaccccgcccuguacccccugggcagcagacagauccugaccugcaccgccuacggcaucccccagcccaccaucaagugguucuggcaccccugcaaccacaaccacagcgaggccagaugcgacuucugcagcaacaacgaggagagcuucauccuggacgccgacagcaacaugggcaacagaaucgagagcaucacccagagaauggccaucaucgagggcaagaacaagauggccagcacccuggugguggccgacagcagaaucagcggcaucuacaucugcaucgccagcaacaaggugggcaccgugggcagaaacaucagcuucuacaucaccgacgugcccaacggcuuccacgugaaccuggagaagaugcccaccgagggcgaggaccugaagcugagcugcaccgugaacaaguuccuguacagagacgugaccuggauccugcugagaaccgugaacaacagaaccaugcacuacagcaucagcaagcagaagauggccaucaccaaggagcacagcaucacccugaaccugaccaucaugaacgugagccugcaggacagcggcaccuacgccugcagagccagaaacguguacaccggcgaggagauccugcagaagaaggagaucaccaucagagaccaggaggcccccuaccugcugagaaaccugagcgaccacaccguggccaucagcagcagcaccacccuggacugccacgccaacggcgugcccgagccccagaucaccugguucaagaacaaccacaagauccagcaggagcccggcaucauccugggccccggcagcagcacccuguucaucgagagagugaccgaggaggacgagggcguguaccacugcaaggccaccaaccagaagggcagcguggagagcagcgccuaccugaccgugcagggcaccagcgacaagagcaaccuggagcugaucacccugaccugcaccugcguggccgccacccuguucuggcugcugcugacccuguucaucagaaagaugaagagaagcagcagcgagaucaagaccgacuaccugagcaucaucauggaccccgacgaggugccccuggacgagcagugcgagagacugcccuacgacgccagcaagugggaguucgccagagagagacugaagcugggcaagagccugggcagaggcgccuucggcaagguggugcaggccagcgccuucggcaucaagaagagccccaccugcagaaccguggccgugaagaugcugaaggagggcgccaccgccagcgaguacaaggcccugaugaccgagcugaagauccugacccacaucggccaccaccugaacguggugaaccugcugggcgccugcaccaagcagggcggcccccugauggugaucguggaguacugcaaguacggcaaccugagcaacuaccugaagagcaagagagaccuguucuuccugaacaaggacgccgcccugcacauggagcccaagaaggagaagauggagcccggccuggagcagggcaagaagcccagacuggacagcgugaccagcagcgagagcuucgccagcagcggcuuccaggaggacaagagccugagcgacguggaggaggaggaggacagcgacggcuucuacaaggagcccaucaccauggaggaccugaucagcuacagcuuccagguggccagaggcauggaguuccugagcagcagaaagugcauccacagagaccuggccgccagaaacauccugcugagcgagaacaacguggugaagaucugcgacuucggccuggccagagacaucuacaagaaccccgacuacgugagaaagggcgacaccagacugccccugaaguggauggcccccgagagcaucuucgacaagaucuacagcaccaagagcgacguguggagcuacggcgugcugcugugggagaucuucagccugggcggcagccccuaccccggcgugcagauggacgaggacuucugcagcagacugagagagggcaugagaaugagagcccccgaguacagcacccccgagaucuaccagaucaugcuggacugcuggcacagagaccccaaggagagacccagauucgccgagcugguggagaagcugggcgaccugcugcaggccaacgugcagcaggacggcaaggacuacauccccaucaacgccauccugaccggcaacagcggcuucaccuacagcacccccgccuucagcgaggacuucuucaaggagagcaucagcgcccccaaguucaacagcggcagcagcgacgacgugagauacgugaacgccuucaaguucaugagccuggagagaaucaagaccuucgaggagcugcugcccaacgccaccagcauguucgacgacuaccagggcgacagcagcacccugcuggccagccccaugcugaagagauucaccuggaccgacagcaagcccaaggccagccugaagaucgaccugagagugaccagcaagagcaaggagagcggccugagcgacgugagcagacccagcuucugccacagcagcugcggccacgugagcgagggcaagagaagauucaccuacgaccacgccgagcuggagagaaagaucgccugcugcagccccccccccgacuacaacagcguggugcuguacagcaccccccccaucuga

SEQ ID NO: 7495 - RNA, 4017 nt, Artificial Sequence
  derived and/or modified sequence opt5 from sFLT-1__Homo_sapiens__AGC09589
auggugagcuacugggacaccggcguccugcucugcgcccugcuuuccugucugcuccugaccgggucuagcuccggaucuaaacuuaaggaucccgagcugagccucaagggcacgcagcacaucaugcaagcugggcagacccugcaucugcagugcagaggagaagccgcgcacaaauggucccucccugagaugguuucuaaggaaagcgagcggcuguccauuacaaaaagcgcuuguggccgcaacgggaagcaguucugcucuacccuuacacugaauaccgcccaagccaaccauacaggauuuuauuccuguaaguaccucgcugugccgaccagcaaaaagaaagaaacggagucugccaucuauauuuucaucuccgacaccggcagacccuuuguggagauguacagcgaaauuccugagaucauccacaugacagaaggccgggagcuggucauucccugccgcgugaccucuccuaauaucacaguuacccuuaagaaauucccccuggauacgcucauuccugacgggaagagaaucauuugggauucccggaagggauuuaucauuagcaacgcuacauauaaagagaucggccugcugaccugugaagccacagugaaugggcaucucuacaagaccaacuaucugacccaccgccagacaaauacgaucauugacguccagaucuccaccccgagacccgugaaacuucugcggggacacacacucguucugaacugcaccgcgacaaccccucuuaauacgcgcgugcagaugacauggucuuaccccgaugagaagaacaaaagagccagcguccggcgcagaauugaccaauccaauagccaugcuaacaucuucuacucugugcugaccauugauaagaugcagaauaaagacaagggccucuauaccugucgggugcgcuccgggccuagcuuuaagucugucaacacaagcguucacaucuacgauaaagccuucaucaccgugaagcauagaaaacaacaggugcuggaaacagucgcuggaaagcgguccuauagacugucuaugaaagugaaggccuuucccagcccggagguuguguggcucaaggacggccugccugcgacggaaaaauccgcccgcuaccuuacccggggcuauagccugauuaucaaggaugucacagaggaggacgcugggaauuacaccauucuccugucuaucaaacaauccaacguguucaagaaccuuacagccacccugauuguuaaugugaaaccccagaucuaugaaaaggcugucagcucuuuuccugaccccgcccucuacccccugggauccagacagauccugacgugcaccgccuacggcauuccucaaccgacaaucaagugguucuggcaccccuguaaccacaaucauagcgaggcucgcugcgauuuuugcuccaacaaugaagagucuuucauucucgacgcggauagcaacauggggaaucggaucgaauccauuacccagagaauggccaucauugagggcaaaaacaagauggcuucuacacugguggucgccgacagccgcaucuccggaaucuauauuuguaucgccagcaauaaaguggggaccguuggacggaacauuucuuucuacaucacggaugugccuaauggcuuucacgucaaccuugagaagaugcccacagaaggcgaggaccugaaacucuccugcaccgugaauaaguuccuguauagagauguuacauggauucugcuucgcaccgugaacaaucggaccaugcauuacagcaucucuaagcagaaaauggcuaucacaaaggaacacuccauuacgcucaaccugaccaucaugaacgucagccugcaggacucugggacauaugccuguagagcgcgcaauguguacaccggagaggaaauucuccagaaaaaggagaucacaauucgggaucaggaggcuccuuaucugcuuagaaaccugagcgaccauaccguggccaucuccagcucuacgacacucgauugccacgccaauggcguucccgaaccgcagaucaccugguuuaaaaacaaucacaagauucagcaagagccugggaucauucugggacccggcuccagcacccuguucaucgaacgggucacagaggaggacgaagggguguaccauuguaaagcuaccaaccagaagggcuccguggagucuagcgccuaccuuacaguccagggaacguccgacaagucuaaucucgaacugauuacccugacaugcaccuguguggcugccacacucuuuuggcugcuucugacccucuucauccgcaaaaugaagagaagcuccucugagaucaaaacggauuaucugagcauuaucauggacccugaugaaguuccccuggacgagcagugcgagcggcuuccuuacgaugcguccaagugggaauuugccagagagcgccucaaacugggcaagagccuggggcggggagcuuucggcaaggugguccaagccucugcuuuugggauuaaaaagucccccaccuguagaacaguggccguuaaaaugcucaaggaaggagcgaccgccagcgaguauaaagcucugaugacagaacuuaagauccugacccacauuggccaucaccucaacguggucaaucugcugggggccugcacaaagcagggcggaccgcuuauggugaucguugaguacuguaaauauggcaaccucucuaauuaccugaaguccaaacgcgaccuguucuuucucaacaaggaugcugcccugcacauggagccuaaaaaggaaaagauggagcccgggcuugaacagggcaaaaagcccagacuggacagcgugaccucuuccgagagcuucgccuccagcggauuucaggaagauaaaucucucagcgacgucgaggaggaagaggauuccgacggguucuauaaggaaccuauuacgauggaggaucugaucucuuacagcuuccaaguggcucggggaauggaguuucuguccucucgcaaaugcauccauagagaccuugcggcccggaauauucugcucagcgaaaacaauguggucaagaucugcgacuucggccuggcucgcgauauuuacaaaaacccggacuauguuagaaagggggauacacggcucccccugaaguggauggccccugaguccaucuuugacaaaauuuacucuaccaagagcgaugugugguccuauggcgugcuucugugggaaaucuucagccucggaggcucucccuacccugggguccagauggacgaggauuuuuguucccgccugagagaaggaaugcggaugcgcgcccccgaguauagcaccccugagaucuaccagauuaugcuggacugcuggcacagagaucccaaagaacggccgagauucgcugagcuuguggaaaagcugggcgaccuccugcaagccaacguucagcaggaugggaaagacuauaucccuauuaaugcgauccucacaggaaacucuggcuuuaccuacuccacgcccgcuuucagcgaggacuuuuucaaggaauccauuucugccccuaaguuuaauagcggguccagcgaugacgugcgcuacgucaacgccuucaaauuuaugucucuggagcggaucaagacauucgaggaacuucugcccaaugcuaccuccauguucgaugacuaucagggcgauagcucuacacuccuggccagcccgaugcugaaaagauuuaccuggacagacuccaagccuaaagcgucucuuaagaucgaucugcgcgugaccagcaaguccaaagagucuggacucagcgacguuucccggcccagcuucugucauucuuccugcggccacgugagcgaagggaagagacgcuuuacguacgaucaugcugagcuggaacggaaaauugccuguugcuccccuccucccgacuauaacucugucgugcucuacagcacacccccgaucuga

SEQ ID NO: 7496 - RNA, 4017 nt, Artificial Sequence
  derived and/or modified sequence opt6 from sFLT-1__Homo_sapiens__AGC09589
augguuaguuauugggacacaggcguacuucugugugcuuuacuaucauguuuauuacuaacaggaucaucaagcggcucuaagcuaaaagauccagaacuaagucugaagggaacucagcacauaaugcaagcgggucaaacucuccaccuccagugccguggagaagcugcacauaaauggaguuugccagaaauggucucaaaagaaucagaacgacuuagcauaacaaaauccgcaugugguagaaaugguaaacaauuuugcucaacacucacacuuaauacagcacaagcaaaccacacuggauucuauagcugcaaauaucuugcuguaccaacuucaaaaaaaaaagaaacagaaucagccauauauaucuucauaucagacacaggaaggcccuuuguugaaauguacucugaaauaccagaaauaauacauaugacagaaggucgggaacuugucaucccaugcagagucaccuccccaaauaucacaguuacacugaaaaaauuuccacuagauacgcuuauaccagauggaaaacguaucaucugggauucaagaaaagguuucaucauaucaaaugccacuuacaaagaaauaggcuuacucaccugugaagcaaccguaaauggacacuuauacaaaacuaacuacuuaacacaucgacagacaaauacgauaauagauguacaaauaucaacuccaagaccaguaaaauuauuaagaggacauacgcuaguacuaaauuguacugcaaccaccccccucaauacaagaguucagaugacuuggucauacccagacgaaaaaaacaagagagcuaguguacgcagaagaauugaccaaagcaacucucacgcaaacaucuucuacucuguacuaacuaucgauaaaaugcaaaauaaagacaaaggauuauacacauguaggguccggucaggaccaucauucaaaaguguaaauacaucaguacacauuuaugauaaagcauucauaaccgugaaacaucgaaagcaacaaguauuagagacgguagccggaaaacguagcuaucgucuaagcaugaaaguaaaagcauuccccagcccagaagucguauggcuaaaagauggauuacccgcuaccgaaaaauccgcucgcuaucuaacgagagguuauaguuuaauaauaaaagacguaacagaggaagaugcagguaauuauacaauccuccuuucaauaaaacagucaaauguguucaagaaucuaacagcaacccucauuguaaacguuaaaccucaaauauacgagaaagccguauccucauuuccugauccagccuuauauccacuaggaucucgucaaauacugaccuguacggcauauggaauaccacaaccgacaauaaaaugguucuggcacccauguaaucacaaccauuccgaagcacguugugauuuuuguaguaacaaugaagaaucguuuaucuuagaugcagacaguaauauggguaacagaaucgaaucaaucacacaaagaauggcuaucauugaaggaaaaaacaaaauggccucaacauuaguuguggccgacucacguauauccgguaucuacauuugcauagcgaguaauaaagucggaacugucggccguaauauaaguuuuuauauaacagaugugccaaauggauuucacguuaauuuagaaaaaaugccuacagaaggcgaagaucucaaacuaucuuguacaguaaacaaauuucuauacagggauguaacauggauacuacuacgaacagugaacaaucgaaccaugcauuacagcauaucaaaacaaaaaauggccauaacaaaagaacauaguauaacauuaaaucuuacaaucaugaacgucucgcuacaagauagcgggaccuaugcauguagagcacguaacguguacacaggcgaagaaauacuacaaaaaaaagaaauaacgauccgugaucaagaggccccauaccuacuccgaaacuuaucagaucacaccgucgcaauuucaucauccacuacauuagauugccaugcaaacggcguaccagaaccacaaaucacaugguuuaaaaauaaucacaaaauacaacaagaaccaggaauaauacuaggucccggcucaaguacuuuauuuauugaacgaguaacagaagaggaugaaggaguguaccacugcaaagcuacaaaucaaaaaggguccguugaaaguucggcauaucucacuguacaaggaacuagcgauaaaucuaacuuagaauuaauaaccuuaaccuguaccugcguagcugccacucuauuuugguuacucuugacccuauucauaagaaaaaugaaaagaucaaguuccgaaauaaaaacugauuaccuaaguauaauuauggaccccgaugaaguaccacuagaugaacagugcgaacgacucccuuacgacgcaucaaaaugggaauuugcaagagaaagauuaaaacucggaaaaucuuuaggacguggagccuuuggaaaggucguacaagcgagugcuuucggaauaaaaaagaguccaaccugccguacaguagcaguaaagaugcuuaaagaaggagcaacagcaagcgaauauaaggcucuuaugacagaauuaaaaauacucacccauaucggacaccacuuaaacguaguaaaccuauugggugcgugcacaaaacaagggggcccacuaaugguaauagucgaauacuguaaauaugguaauuuaagcaacuacuuaaaaucaaagagagacuuauucuuuuuaaauaaagacgcagcccuucauauggagccaaaaaaagaaaaaauggagccuggauuggaacaagggaaaaaaccucgucuagacaguguuaccaguucggaaucauucgcaaguagcggauuccaagaagacaaaucauugagcgauguugaagaagaagaagacucggacggauuuuauaaggagccaauuacaauggaagaccuaaucucauacucauuucaagucgcaagagguauggaauucuuaucaucucgcaaaugcauccacagagaccuugcugcuagaaauauuuuacuaagcgaaaauaaugucgucaaaaucugcgacuucgguuuagcuagagacauuuauaaaaaucccgacuacguacgcaaaggagauacaagauuaccccugaaauggauggcaccugaaucuauauucgauaagauauacuccacaaaaucagauguauggucuuaugguguauuacugugggaaauauucagucucggggguagcccguacccaggcguacaaauggacgaagauuucugcucucgccuacgugaaggcaugagaaugcgcgcucccgaauauaguaccccugaaauauaccaaauaauguuagauuguuggcaucgagaccccaaagaaagacccagguuugcagaauuaguagaaaaacuaggagaccuacuacaagccaaugugcaacaagacggaaaagauuauauacccaucaaugcuauauuaacuggaaauucuggauucacuuacuccaccccagccuucucagaagauuucuucaaagaauccaucucugcaccaaaauucaacucaggaucaagcgaugacguccgauacguaaaugcguuuaaauuuaugagcuuagagcguauaaaaacauuugaagaauuacuacccaaugccacaagcauguuugacgacuaccagggugacucaaguacccuuuuagccucaccaaugcucaaaagauuuacauggacugacucaaaaccuaaagcaucacucaaaauugaucucagaguuacaagcaaaagcaaagaaagcggauugucggacguaucgcgcccuucuuuuugucauucgaguugcggucacguaucagaagguaaaagacgauucacguaugaucacgcugaauuagaaaggaaaauagcauguugcaguccaccgccugacuacaauaguguaguacuauacucaacaccuccuauuuaa

SEQ ID NO: 7497 - protein, 1338 aa, Artificial Sequence; identical to SEQ ID NO: 7489
  sFLT-1__Homo_sapiens__P17948

SEQ ID NO: 7498 - RNA, 4017 nt, Artificial Sequence
  sFLT-1__Homo_sapiens__ABY87530
auggucagcuacugggacaccgggguccugcugugcgcgcugcucagcugucugcuucucacaggaucuaguucagguucaaaauuaaaagauccugaacugaguuuaaaaggcacccagcacaucaugcaagcaggccagacacugcaucuccaaugcaggggggaagcagcccauaaauggucuuugccugaaauggugaguaaggaaagcgaaaggcugagcauaacuaaaucugccuguggaagaaauggcaaacaauucugcaguacuuuaaccuugaacacagcucaagcaaaccacacuggcuucuacagcugcaaauaucuagcuguaccuacuucaaagaagaaggaaacagaaucugcaaucuauauauuuauuagugauacagguagaccuuucguagagauguacagugaaauccccgaaauuauacacaugacugaaggaagggagcucgucauucccugccggguuacgucaccuaacaucacuguuacuuuaaaaaaguuuccacuugacacuuugaucccugauggaaaacgcauaaucugggacaguagaaagggcuucaucauaucaaaugcaacguacaaagaaauagggcuucugaccugugaagcaacagucaaugggcauuuguauaagacaaacuaucucacacaucgacaaaccaauacaaucauagauguccaaauaagcacaccacgcccagucaaauuacuuagaggccauacucuuguccucaauuguacugcuaccacucccuugaacacgagaguucaaaugaccuggaguuacccugaugaaaaaaauaagagagcuuccguaaggcgacgaauugaccaaagcaauucccaugccaacauauucuacaguguucuuacuauugacaaaaugcagaacaaagacaaaggacuuuauacuugucguguaaggaguggaccaucauucaaaucuguuaacaccucagugcauauauaugauaaagcauucaucacugugaaacaucgaaaacagcaggugcuugaaaccguagcuggcaagcggucuuaccggcucucuaugaaagugaaggcauuucccucgccggaaguuguaugguuaaaagauggguuaccugcgacugagaaaucugcucgcuauuugacucguggcuacucguuaauuaucaaggacguaacugaagaggaugcagggaauuauacaaucuugcugagcauaaaacagucaaauguguuuaaaaaccucacugccacucuaauugucaaugugaaaccccagauuuacgaaaaggccgugucaucguuuccagacccggcucucuacccacugggcagcagacaaauccugacuuguaccgcauaugguaucccucaaccuacaaucaagugguucuggcaccccuguaaccauaaucauuccgaagcaaggugugacuuuuguuccaauaaugaagaguccuuuauccuggaugcugacagcaacaugggaaacagaauugagagcaucacucagcgcauggcaauaauagaaggaaagaauaagauggcuagcaccuugguuguggcugacucuagaauuucuggaaucuacauuugcauagcuuccaauaaaguugggacugugggaagaaacauaagcuuuuauaucacagaugugccaaauggguuucauguuaacuuggaaaaaaugccgacggaaggagaggaccugaaacugucuugcacaguuaacaaguucuuauacagagacguuacuuggauuuuacugcggacaguuaauaacagaacaaugcacuacaguauuagcaagcaaaaaauggccaucacuaaggagcacuccaucacucuuaaucuuaccaucaugaauguuucccugcaagauucaggcaccuaugccugcagagccaggaauguauacacaggggaagaaauccuccagaagaaagaaauuacaaucagagaucaggaagcaccauaccuccugcgaaaccucagugaucacacaguggccaucagcaguuccaccacuuuagacugucaugcuaaugguguccccgagccucagaucacuugguuuaaaaacaaccacaaaauacaacaagagccuggaauuauuuuaggaccaggaagcagcacgcuguuuauugaaagagucacagaagaggaugaaggugucuaucacugcaaagccaccaaccagaagggcucuguggaaaguucagcauaccucacuguucaaggaaccucggacaagucuaaucuggagcugaucacucuaacaugcaccuguguggcugcgacucucuucuggcuccuauuaacccucuuuauccgaaaaaugaaaaggucuucuucugaaauaaagacugacuaccuaucaauuauaauggacccagaugaaguuccuuuggaugagcagugugagcggcucccuuaugaugccagcaagugggaguuugcccgggagagacuuaaacugggcaaaucacuuggaagaggggcuuuuggaaaagugguucaagcaucagcauuuggcauuaagaaaucaccuacgugccggacuguggcugugaaaaugcugaaagagggggccacggccagcgaguacaaagcucugaugacugagcuaaaaaucuugacccacauuggccaccaucugaacgugguuaaccugcugggagccugcaccaagcaaggagggccucugauggugauuguugaauacugcaaauauggaaaucucuccaacuaccucaagagcaaacgugacuuauuuuuucucaacaaggaugcagcacuacacauggagccuaagaaagaaaaaauggagccaggccuggaacaaggcaagaaaccaagacuagauagcgucaccagcagcgaaagcuuugcgagcuccggcuuucaggaagauaaaagucugagugauguugaggaagaggaggauucugacgguuucuacaaggagcccaucacuauggaagaucugauuucuuacaguuuucaaguggccagaggcauggaguuccugucuuccagaaagugcauucaucgggaccuggcagcgagaaacauucuuuuaucugagaacaacguggugaagauuugugauuuuggccuugcccgggauauuuauaagaaccccgauuaugugagaaaaggagauacucgacuuccucugaaauggauggcuccugaaucuaucuuugacaaaaucuacagcaccaagagcgacguguggucuuacggaguauugcugugggaaaucuucuccuuaggugggucuccauacccaggaguacaaauggaugaggacuuuugcagucgccugagggaaggcaugaggaugagagcuccugaguacucuacuccugaaaucuaucagaucaugcuggacugcuggcacagagacccaaaagaaaggccaagauuugcagaacuuguggaaaaacuaggugauuugcuucaagcaaauguacaacaggaugguaaagacuacaucccaaucaaugccauacugacaggaaauaguggguuuacauacucaacuccugccuucucugaggacuucuucaaggaaaguauuucagcuccgaaguuuaauucaggaagcucugaugaugucagauauguaaaugcuuucaaguucaugagccuggaaagaaucaaaaccuuugaagaacuuuuaccgaaugccaccuccauguuugaugacuaccagggcgacagcagcacucuguuggccucucccaugcugaagcgcuucaccuggacugacagcaaacccaaggccucgcucaagauugacuugagaguaaccaguaaaaguaaggagucggggcugucugaugucagcaggcccaguuucugccauuccagcugugggcacgucagcgaaggcaagcgcagguucaccuacgaccacgcugagcuggaaaggaaaaucgcgugcugcuccccgcccccagacuacaacucggugguccuguacuccaccccacccaucuag

SEQ ID NO: 7499 - RNA, 4017 nt, Artificial Sequence; identical to SEQ ID NO: 7491
  derived and/or modified sequence opt1 from sFLT-1__Homo_sapiens__ABY87530

SEQ ID NO: 7500 - RNA, 4017 nt, Artificial Sequence; identical to SEQ ID NO: 7492
  derived and/or modified sequence opt2 from sFLT-1__Homo_sapiens__ABY87530

SEQ ID NO: 7501 - RNA, 4017 nt, Artificial Sequence; identical to SEQ ID NO: 7493
  derived and/or modified sequence opt3 from sFLT-1__Homo_sapiens__ABY87530

SEQ ID NO: 7502 - RNA, 4017 nt, Artificial Sequence; identical to SEQ ID NO: 7494
  derived and/or modified sequence opt4 from sFLT-1__Homo_sapiens__ABY87530

SEQ ID NO: 7503 - RNA, 4017 nt, Artificial Sequence; identical to SEQ ID NO: 7495
  derived and/or modified sequence opt5 from sFLT-1__Homo_sapiens__ABY87530

SEQ ID NO: 7504 - RNA, 4017 nt, Artificial Sequence
  derived and/or modified sequence opt6 from sFLT-1__Homo_sapiens__ABY87530
augguuagcuacugggauacuggagugcuauuaugugcacuauuaaguugcuuauuacuuaccgguucaaguucuggaaguaaacuuaaggacccagaauuaagucuuaaaggcacucaacauaucaugcaagcuggacaaacacuucaucuccaaugccgaggagaagcagcacauaaauggucucuaccagaaaugguuaguaaagaauccgaacgacuuucuauuacaaaauccgcaugcggccgaaacgggaaacaauuuuguuccacacuaacacuaaauacagcucaggcgaaccauacuggcuuuuacagcugcaaauaucuugccgugccaacgaguaaaaagaaagaaacugaaucagcaauuuacaucuucauuucggacacagguagaccauucguagaaauguauagugaaauaccagaaaucauccauaugacugaaggcagagaacuuguuauaccaugcagaguuacuagcccuaacauaacagucacacuuaagaaauucccacuagacacacucauuccugacggaaaacggauaauuugggauagucguaaaggauucauaauauccaacgcaacuuauaaggaaauaggauuacuaacuugcgaagccaccguaaauggucauuuauauaaaaccaauuacuuaacccaccgucaaacaaacacaauuauagauguucaaauaaguacaccgagaccagucaaacugcuccgaggacacacacuaguucuaaacuguaccgcaaccaccccucuaaacaccagagugcaaaugacauggucauauccugacgaaaaaaacaaacgcgccucaguacgacgcagaauugaccaaaguaauucccaugccaacaucuuuuauucaguguugacaaucgauaagaugcaaaacaaagauaaaggacuuuacacauguagaguacgcucaggucccaguuuuaaaucaguaaauacaaguguccauauauacgauaaagccuuuauaacaguaaaacauagaaaacaacaaguuuuagaaacaguagcuggaaaacgauccuauaggcuaucaaugaaaguuaaagcuuuuccuucaccugaaguuguuugguuaaaggacggacucccugccacagaaaaaagcgcaagauacuuaacucgaggauacucauuaauaauuaaagauguaacugaagaagacgcuggaaauuacacaauacuauuauccauuaaacagucaaacguauuuaagaaucuuaccgcaacacuuauuguaaaugucaaaccccaaauauaugaaaaagcaguguccucauucccagacccagcacucuacccauuaggaucccgacaaauacuuacuuguacugcauaugguaucccucaaccuacuauaaaaugguuuuggcauccauguaaucauaaccauucagaagccagaugcgauuuuuguaguaauaacgaagaaaguuuuauauuagaugcagauucaaacaugggaaacaggauugaaucaauaacucagcgaauggcuauaauagaaggcaaaaauaaaauggcaucaaccuugguaguugcagacucacgaauaaguggcauuuacaucugcaucgcaucaaauaaagucggcacugucggaagaaauauaucauucuacaucacagacguacccaauggauuccacguuaacuuggaaaaaaugccaacagaaggagaagacuuaaaauuaucuuguacaguuaauaaauuccuauacagagauguuaccuggauccuucuaagaacaguuaauaaucgaacaaugcauuacuccauaucgaagcaaaaaauggcaaucacaaaagaacauuccauaacauuaaaucuuacaaucaugaaugucagccuacaagacagcggaaccuaugcaugccgcgcacgcaacguauauacuggugaagaaauuuuacaaaagaaagagauaacuauacgagaccaagaagcaccauaccuuuuaagaaaucuuucagaucacacgguugcuaucucaucaaguaccacucuagauugucaugcaaacggcguaccagaaccccaaauaacuugguucaaaaacaaccacaaaauccaacaggaaccaggaauuauauuaggucccggauccuccacucucuuuauugaaagaguuacugaagaggaugaagguguuuaucacuguaaagcuacaaaucaaaaaggaagcguagaaagcagugcuuaucuuaccguucaaggaacaucagacaaaaguaaucuggaacuaauuacucuaacaugcacuuguguagcagcuacccuuuucuggcuucucuugacacuauuuauccguaaaaugaaacgcucaagcucugagaucaaaacagacuaccuuucuauaauaauggauccagacgaaguuccauuagaugaacaaugugaacgacuuccguaugaugcaaguaaaugggaauucgccagagaacgucuaaaauuaggaaaaucuuuaggacguggagccuuuggcaaaguuguucaagcuucagccuuuggaauaaagaaaagcccaacauguagaacuguagcagucaaaaugcuaaaagaaggugcuacagcaucugaauacaaagcguuaaugacagaauugaaaauccuaacacacauuggccaccaucuaaacgucgucaauuuguuaggagcuugcacuaaacaaggaggaccauuaaugguaauaguagaauauugcaaauacggcaaucuaagcaauuaccucaaaucuaaaagagaccuauuuuuucuaaauaaagaugcugcacuucacauggaaccuaaaaaggaaaaaauggagccaggcuuagaacaaggaaaaaaaccacgacuggacagcgucacaucaucagaauccuucgcauccucaggauuucaagaagauaaaucuuugucagauguugaagaagaagaagacucagauggauuuuauaaagaaccaauuacgauggaagacuuaauaucguauucuuuucagguagcucgcggcauggaauuccuaaguucaaggaaauguauacauagagaccuagcugccagaaacauccuccucagugaaaauaacguuguaaaaauaugugacuuugguuuagcuagagauauauauaaaaaucccgauuacguacgaaaaggcgacacgcgacucccacucaaauggauggccccugaaaguaucuucgauaaaauauacucaaccaagucugacguaugguccuauggagucuuacucugggaaauuuucucacuuggagggucccccuacccagguguucaaauggacgaagauuuuuguaguagacuaagagagggaaugaggaugcgcgcacccgaauacagcacccccgaaauauaucaaauaaugcuugacuguuggcauagagaccccaaagaaagaccacgcuucgcagaauuaguagaaaaacuaggagaccuuuuacaggcgaacguacagcaagauggcaaagacuauaucccaauaaaugcaauacuaacaggaaauagcggguucaccuacuccacacccgcuuuuagugaagauuuuuucaaagagucgauuagcgcaccgaaauuuaacucaggaagcagcgaugauguucgauauguaaaugcauucaaauucaugaguuuagaacgcauaaaaacuuuugaagaauuacuacccaacgcaaccucaauguuugacgauuaucaaggagauucaagcacacuacuagcaaguccgauguuaaaaagauucaccuggaccgacucaaaaccgaaagccagucuaaaaauagaucuuagagugaccagcaaaucaaaagaauccgggcuaucugacguuuccagaccuucauuuugucauucauccuguggacacguauccgaaggaaaacgacgcuuuaccuacgaucaugcagaacuggaaagaaagauagcuuguuguucaccuccaccagauuauaauucaguaguucuauauaguacacccccaauuuaa

SEQ ID NO: 7505 - protein, 367 aa, Artificial Sequence
  sTie2__Homo_sapiens__B5A953
MDSLASLVLCGVSLLLSGTVEGAMDLILINSLPLVSDAETSLTCIASGWRPHEPITIGRDFEALMNQHQDPLEVTQDVTREWAKKVVWKREKASKINGAYFCEGRVRGEAIRIRTMKMRQQASFLPATLTMTVDKGDNVNISFKKVLIKEEDAVIYKNGSFIHSVPRHEVPDILEVHLPHAQPQDAGVYSARYIGGNLFTSAFTRLIVRRCEAQKWGPECNHLCTACMNNGVCHEDTGECICPPGFMGRTCEKACELHTFGRTCKERCSGQEGCKSYVFCLPDPYGCSCATGWKGLQCNEACHPGFYGPDCKLRCSCNNGEMCDRFQGCLCSPGWQGLQCEREGKARHTEDDPKDSGFARSYRSKQW

SEQ ID NO: 7506 - RNA, 1104 nt, Artificial Sequence
  sTie2__Homo_sapiens__ACF47627
auggacucuuuagccagcuuaguucucuguggagucagcuugcuccuuucuggaacuguggaaggugccauggacuugaucuugaucaauucccuaccucuuguaucugaugcugaaacaucucucaccugcauugccucuggguggcgcccccaugagcccaucaccauaggaagggacuuugaagccuuaaugaaccagcaccaggauccgcuggaaguuacucaagaugugaccagagaaugggcuaaaaaaguuguuuggaagagagaaaaggcuaguaagaucaauggugcuuauuucugugaagggcgaguucgaggagaggcaaucaggauacgaaccaugaagaugcgucaacaagcuuccuuccuaccagcuacuuuaacuaugacuguggacaagggagauaacgugaacauaucuuucaaaaagguauugauuaaagaagaagaugcagugauuuacaaaaaugguuccuucauccauucagugccccggcaugaaguaccugauauucuagaaguacaccugccucaugcucagccccaggaugcuggaguguacucggccagguauauaggaggaaaccucuucaccucggccuucaccaggcugauaguccggagaugugaagcccagaaguggggaccugaaugcaaccaucucuguacugcuuguaugaacaauggugucugccaugaagauacuggagaaugcauuugcccuccuggguuuaugggaaggacgugugagaaggcuugugaacugcacacguuuggcagaacuuguaaagaaaggugcaguggacaagagggaugcaagucuuauguguucugucucccugaccccuauggguguuccugugccacaggcuggaagggucugcagugcaaugaagcaugccacccugguuuuuacgggccagauuguaagcuuaggugcagcugcaacaauggggagaugugugaucgcuuccaaggaugucucugcucuccaggauggcaggggcuccagugugagagagaagguaaagcaaggcauacagaggaugaccccaaagauaguggauuugccagaucauauagaaguaaacagugguaa

SEQ ID NO: 7507 - RNA, 1104 nt, Artificial Sequence
  derived and/or modified sequence opt1 from sTie2__Homo_sapiens__ACF47627
auggacagccuggccucccucgugcugugcggcgucagccugcuccuguccgggaccguggagggcgccauggaccugauccucaucaacagccugccccugguguccgacgcggagaccagccucacgugcaucgccuccggguggcgcccgcacgagcccaucaccaucggccgggacuucgaggcccugaugaaccagcaccaggacccccuggaggucacccaggacgugacccgcgagugggccaagaagguggucuggaagcgggagaaggccagcaagaucaacggggcguacuucugcgagggccgcgugcggggcgaggccauccgcauccggacgaugaagaugcgccagcaggccuccuuccuccccgccacccugaccaugaccguggacaagggggacaacgucaacaucagcuucaagaaggugcugaucaaggaggaggacgcggugaucuacaagaacggcuccuucauccacagcgucccgcggcacgaggugcccgacauccucgaggugcaccucccccacgcccagccccaggacgccggggucuacuccgcccgcuacaucggcgggaaccuguucacgagcgccuucacccggcugaucgugcgccggugcgaggcgcagaaguggggcccggagugcaaccaccugugcaccgccugcaugaacaacggcgugugccacgaggacaccggggagugcaucugcccgcccggcuucauggggcgcacgugcgagaaggccugcgagcugcacaccuucggccggaccugcaaggagcgcugcuccggccaggaggggugcaagagcuacgucuucugccuccccgaccccuacggcugcuccugcgccaccggguggaagggccugcagugcaacgaggccugccaccccggguucuacggccccgacugcaagcugcggugcagcugcaacaacggcgagaugugcgaccgcuuccaggggugccucugcucccccggcuggcaggggcugcagugcgagcgggagggcaaggcgcgccacacggaggacgacccgaaggacagcggguucgcccggagcuaccgcuccaagcagugguga

SEQ ID NO: 7508 - RNA, 1104 nt, Artificial Sequence
  derived and/or modified sequence opt2 from sTie2__Homo_sapiens__ACF47627
auggacucccucgccucccucguccucugcggcgucucccuccuccucuccggcaccgucgagggcgccauggaccucauccucaucaacucccucccccucgucuccgacgccgagaccucccucaccugcaucgccuccggcuggcgcccccacgagcccaucaccaucggccgcgacuucgaggcccucaugaaccagcaccaggacccccucgaggucacccaggacgucacccgcgagugggccaagaaggucgucuggaagcgcgagaaggccuccaagaucaacggcgccuacuucugcgagggccgcguccgcggcgaggccauccgcauccgcaccaugaagaugcgccagcaggccuccuuccuccccgccacccucaccaugaccgucgacaagggcgacaacgucaacaucuccuucaagaagguccucaucaaggaggaggacgccgucaucuacaagaacggcuccuucauccacuccgucccccgccacgagguccccgacauccucgagguccaccucccccacgcccagccccaggacgccggcgucuacuccgcccgcuacaucggcggcaaccucuucaccuccgccuucacccgccucaucguccgccgcugcgaggcccagaaguggggccccgagugcaaccaccucugcaccgccugcaugaacaacggcgucugccacgaggacaccggcgagugcaucugcccccccggcuucaugggccgcaccugcgagaaggccugcgagcuccacaccuucggccgcaccugcaaggagcgcugcuccggccaggagggcugcaaguccuacgucuucugccuccccgaccccuacggcugcuccugcgccaccggcuggaagggccuccagugcaacgaggccugccaccccggcuucuacggccccgacugcaagcuccgcugcuccugcaacaacggcgagaugugcgaccgcuuccagggcugccucugcucccccggcuggcagggccuccagugcgagcgcgagggcaaggcccgccacaccgaggacgaccccaaggacuccggcuucgcccgcuccuaccgcuccaagcagugguga

SEQ ID NO: 7509 - RNA, 1104 nt, Artificial Sequence
  derived and/or modified sequence opt3 from sTie2__Homo_sapiens__ACF47627
auggacagccuggccucccucguucuuugcggcgucucucuguuguuaucagggaccguugagggagcuauggaucugauccuaauuaacagucucccccuggugagcgacgcagaaacaucccuuacuuguauagccucugguuggagaccucacgagccaaucacgauuggcagggauuucgaagcgcugaugaaucagcaucaagacccguuggagguaacccaggaugugacacgggaaugggcuaagaaagucguguggaagcgcgagaaagccucgaagaucaacggggcauacuuuugcgagggacgaguucguggcgaagccauuagaaucaggacuaugaaaaugcggcagcaggcuucauuccuccccgcaacccugacaaugaccguggacaagggugauaaugucaacaucagcuuuaagaaagugcugauaaaggaggaagacgccguaauuuauaaaaaugggaguuucauccacuccguuccucgccaugaggugccagauauucucgagguccacuuaccccaugcucaaccucaggacgccggaguguacucugcgagauauaucggcggcaaccuguuuacuagcgcauucacaaggcuuauagugcggcgcugugaagcccagaagugggggccagagugcaaucacuuguguaccgcuugcaugaacaauggagucugucacgaagauacgggugagugcauuugucccccuggcuuuauggggcgaacuugcgaaaaagccugugagcugcauaccuucggaagaacaugcaaggagaggugcuccggccaggaagguuguaagucauacguguuuugccuaccagacccguauggguguaguugcgcaacuggauggaaaggccuccaauguaacgaggcuugccaccccggcuucuacgggccugauuguaagcugcggugcagcuguaauaacggagaaaugugcgaccguuuucaggguugucuuugcucuccaggcuggcaggggcugcagugcgagcgcgaaggaaaagccagacauaccgaggacgaucccaaggacuccggcuucgcgaggucauaucggagcaaacaaugguga

SEQ ID NO: 7510 - RNA, 1104 nt, Artificial Sequence
  derived and/or modified sequence opt4 from sTie2__Homo_sapiens__ACF47627
auggacagccuggccagccuggugcugugcggcgugagccugcugcugagcggcaccguggagggcgccauggaccugauccugaucaacagccugccccuggugagcgacgccgagaccagccugaccugcaucgccagcggcuggagaccccacgagcccaucaccaucggcagagacuucgaggcccugaugaaccagcaccaggacccccuggaggugacccaggacgugaccagagagugggccaagaaggugguguggaagagagagaaggccagcaagaucaacggcgccuacuucugcgagggcagagugagaggcgaggccaucagaaucagaaccaugaagaugagacagcaggccagcuuccugcccgccacccugaccaugaccguggacaagggcgacaacgugaacaucagcuucaagaaggugcugaucaaggaggaggacgccgugaucuacaagaacggcagcuucauccacagcgugcccagacacgaggugcccgacauccuggaggugcaccugccccacgcccagccccaggacgccggcguguacagcgccagauacaucggcggcaaccuguucaccagcgccuucaccagacugaucgugagaagaugcgaggcccagaaguggggccccgagugcaaccaccugugcaccgccugcaugaacaacggcgugugccacgaggacaccggcgagugcaucugcccccccggcuucaugggcagaaccugcgagaaggccugcgagcugcacaccuucggcagaaccugcaaggagagaugcagcggccaggagggcugcaagagcuacguguucugccugcccgaccccuacggcugcagcugcgccaccggcuggaagggccugcagugcaacgaggccugccaccccggcuucuacggccccgacugcaagcugagaugcagcugcaacaacggcgagaugugcgacagauuccagggcugccugugcagccccggcuggcagggccugcagugcgagagagagggcaaggccagacacaccgaggacgaccccaaggacagcggcuucgccagaagcuacagaagcaagcagugguga

SEQ ID NO: 7511 - RNA, 1104 nt, Artificial Sequence
  derived and/or modified sequence opt5 from sTie2__Homo_sapiens__ACF47627
auggacagccuggccucccucgugcugugcggcgucucucuucugcucagcgggaccguugagggagcuauggaucugauccuuauuaacucccugccccucgugucugacgccgaaacaagccugacguguaucgcguccggcuggagaccucacgagccgauuaccaucgggcgggauuucgaagcucugaugaaucagcaucaagacccccucgaggugacacaggaugucacccgcgaaugggccaagaaagugguuuggaagagagagaaagccucuaagauuaacggagcuuacuuuugcgagggccgggugcgcggggaagccaucagaauccggacaaugaaaaugcgccagcaggcuagcuuccugccugccacccuuacaaugaccgucgacaagggagauaaugugaacauuuccuuuaagaaaguucugaucaaggaggaagacgcggugauuuauaaaaauggcagcuucauccacucuguccccagacaugaggugccugauauucucgaggugcaucugccccacgcccaaccucaggacgcuggcgucuacuccgcccgguauaucgggggaaaccuuuuuacgagcgcuuucacccgccugauuguuagacggugugaagcccagaaguggggcccggagugcaaucaccucuguacagcgugcaugaacaauggggugugucacgaagauaccggagagugcaucugucccccuggcuuuauggggcgcacaugcgaaaaagccugugagcugcauaccuucggaagaacgugcaaggagcggugcucuggccaggaaggcuguaaguccuacguguuuugccugcccgacccuuauggguguagcugcgcuacaggauggaaaggccuccaauguaacgaggccugccaccccggguucuacggaccggauuguaagcugcgcugcucuuguaauaacggcgaaaugugcgacagauuucaggggugucuuugcuccccuggauggcagggccugcagugcgagcgggaaggcaaagcuagacauaccgaggacgaucccaaggacagcggguucgcccgcuccuaucggucuaaacaaugguga

SEQ ID NO: 7512 - RNA, 1104 nt, Artificial Sequence
  derived and/or modified sequence opt6 from sTie2__Homo_sapiens__ACF47627
auggauagcuuagcaucauuaguauuauguggaguaaguuuacuauuaucaggaacaguggaaggagcaauggaucuaauauuaauaaauagucuaccacuuguuucagacgcagaaacaucauuaacauguauagccagcggauggcgaccacaugaaccaauaacaauaggaagagauuuugaagcacuaaugaaucaacaucaagauccauuagaaguaacacaagauguaacaagagaaugggcaaaaaaagucguuuggaaaagagaaaaagcaucaaaaauuaacggagcauauuuuugugaaggaagaguaagaggugaagcaauaagaauaagaacuaugaaaaugagacaacaagcaucauucuugccagcaacacuaacaaugaccguagauaaaggagauaauguaaauauaaguuucaaaaaaguacuuauuaaagaagaagacgcaguaauauauaaaaacggaucauuuauacauagcguaccaagacacgaaguaccagauauauuagaaguacacuuaccacaugcacaaccacaagaugcuggaguauacagugcuagauauauaggaggaaauuuauucacaagugcauuuacaagauuaauuguaagaagaugugaagcgcaaaaaugggguccagaaugcaaccacuuauguacagcaugcaugaauaauggaguaugucacgaagacacaggcgaaugcauauguccaccaggauuuaugggaagaacaugugaaaaagcaugugaauuacacacauuuggaagaacauguaaagaaagaugcaguggacaagaaggauguaaaaguuauguauucuguuuaccagacccauauggaugcucaugcgcaacgggauggaaaggacuacaauguaaugaagcaugucauccaggguuuuauggaccagauuguaaauuaagauguaguugcaauaauggagaaaugugugauagauuucagggcuguuuguguaguccaggauggcaaggauuacaaugugaaagagaaggaaaagcuagacauacagaagacgauccaaaagauucaggauuugcaagaaguuauagaagcaagcaaugguaa

SEQ ID NO: 7513 - protein, 207 aa, Artificial Sequence
  TIMP-1__Homo_sapiens__P01033
MAPFEPLASGILLLLWLIAPSRACTCVPPHPQTAFCNSDLVIRAKFVGTPEVNQTTLYQRYEIKMTKMYKGFQALGDAADIRFVYTPAMESVCGYFHRSHNRSEEFLIAGKLQDGLLHITTCSFVAPWNSLSLAQRRGFTKTYTVGCEECTVFPCLSIPCKLQSGTHCLWTDQLLQGSEKGFQSRHLACLPREPGLCTWQSLRSQIA

SEQ ID NO: 7514 - RNA, 624 nt, Artificial Sequence
  TIMP-1__Homo_sapiens__AAA52436
auggcccccuuugagccccuggcuucuggcauccuguuguugcuguggcugauagcccccagcagggccugcaccugugucccaccccacccacagacggccuucugcaauuccgaccucgucaucagggccaaguucguggggacaccagaagucaaccagaccaccuuauaccagcguuaugagaucaagaugaccaagauguauaaaggguuccaagccuuaggggaugccgcugacauccgguucgucuacacccccgccauggagagugucugcggauacuuccacaggucccacaaccgcagcgaggaguuucucauugcuggaaaacugcaggauggacucuugcacaucacuaccugcaguuucguggcucccuggaacagccugagcuuagcucagcgccggggcuucaccaagaccuacacuguuggcugugaggaaugcacaguguuucccuguuuauccauccccugcaaacugcagaguggcacucauugcuuguggacggaccagcuccuccaaggcucugaaaagggcuuccagucccgucaccuugccugccugccucgggagccagggcugugcaccuggcagucccugcggucccagauagccuga

SEQ ID NO: 7515 - RNA, 624 nt, Artificial Sequence
  derived and/or modified sequence opt1 from TIMP-1__Homo_sapiens__AAA52436
auggcccccuucgagccgcuggccagcggcauccuccugcugcucuggcugaucgcgcccucccgcgccugcacgugcgugccgccccacccccagaccgccuucugcaacagcgaccuggucauccgggccaaguucguggggacccccgaggugaaccagaccacccucuaccagcgcuacgagaucaagaugaccaagauguacaagggcuuccaggcccugggggacgcggccgacauccgguucgucuacacgcccgccauggaguccgugugcggcuacuuccaccgcagccacaaccgguccgaggaguuccugaucgccgggaagcuccaggacggccugcugcacaucacgaccugcagcuucguggcgcccuggaacucccucagccuggcccagcgccggggcuucaccaagaccuacaccgucgggugcgaggagugcaccguguucccgugccuguccauccccugcaagcuccagagcggcacccacugccuguggacggaccagcugcuccagggguccgagaagggcuuccagagccgccaccuggccugccugccccgggagcccgggcucugcaccuggcagucccugcgcagccagaucgccuga

SEQ ID NO: 7516 - RNA, 624 nt, Artificial Sequence
  derived and/or modified sequence opt2 from TIMP-1__Homo_sapiens__AAA52436
auggcccccuucgagccccucgccuccggcauccuccuccuccucuggcucaucgcccccucccgcgccugcaccugcguccccccccacccccagaccgccuucugcaacuccgaccucgucauccgcgccaaguucgucggcacccccgaggucaaccagaccacccucuaccagcgcuacgagaucaagaugaccaagauguacaagggcuuccaggcccucggcgacgccgccgacauccgcuucgucuacacccccgccauggaguccgucugcggcuacuuccaccgcucccacaaccgcuccgaggaguuccucaucgccggcaagcuccaggacggccuccuccacaucaccaccugcuccuucgucgcccccuggaacucccucucccucgcccagcgccgcggcuucaccaagaccuacaccgucggcugcgaggagugcaccgucuuccccugccucuccauccccugcaagcuccaguccggcacccacugccucuggaccgaccagcuccuccagggcuccgagaagggcuuccagucccgccaccucgccugccucccccgcgagcccggccucugcaccuggcagucccuccgcucccagaucgccuga

SEQ ID NO: 7517 - RNA, 624 nt, Artificial Sequence
  derived and/or modified sequence opt3 from TIMP-1__Homo_sapiens__AAA52436
auggcccccuucgagccucuggcuagcggcauccuccuucuguugugguuaauugcaccauccagagccugcaccugugugccgccccacccucagacagcguuuugcaauucugaccuggucauaagggcuaaguucguugggacuccagaagugaaucaaacgacccuauaccagcgguaugagaucaaaaugacaaagauguacaaaggauuucaggcccucggugaugcagccgacauucgcuucguauauacucccgcuauggaaucaguguguggcuacuuucaucgaagucacaaccguagcgaggaguuccugaucgcagggaaacuucaggauggacuguugcauauuaccacaugcuccuuugucgccccuuggaacucucucucgcuggcucaaagaaggggcuucaccaagacuuauacaguggguugugaagagugcaccguuuuuccaugucugucaauccccugcaagcuccagagcgggacgcacuguuuauggacugaccagcugcuucagggaagugaaaagggcuuccaaucccggcauuuggccugccugccucgcgagccaggccuauguaccuggcagucucucagaagccagauagcguga

SEQ ID NO: 7518 - RNA, 624 nt, Artificial Sequence
  derived and/or modified sequence opt4 from TIMP-1__Homo_sapiens__AAA52436
auggcccccuucgagccccuggccagcggcauccugcugcugcuguggcugaucgcccccagcagagccugcaccugcgugcccccccacccccagaccgccuucugcaacagcgaccuggugaucagagccaaguucgugggcacccccgaggugaaccagaccacccuguaccagagauacgagaucaagaugaccaagauguacaagggcuuccaggcccugggcgacgccgccgacaucagauucguguacacccccgccauggagagcgugugcggcuacuuccacagaagccacaacagaagcgaggaguuccugaucgccggcaagcugcaggacggccugcugcacaucaccaccugcagcuucguggcccccuggaacagccugagccuggcccagagaagaggcuucaccaagaccuacaccgugggcugcgaggagugcaccguguuccccugccugagcauccccugcaagcugcagagcggcacccacugccuguggaccgaccagcugcugcagggcagcgagaagggcuuccagagcagacaccuggccugccugcccagagagcccggccugugcaccuggcagagccugagaagccagaucgccuga

SEQ ID NO: 7519 - RNA, 624 nt, Artificial Sequence
  derived and/or modified sequence opt5 from TIMP-1__Homo_sapiens__AAA52436
auggcccccuucgagccucuggcuagcggcauccuccugcuucuguggcucauugccccguccagagcgugcaccugugugcccccucacccccagacagcuuuuugcaauucugaccuggucauccgggccaaguucguugggacgccugaagugaaucaaaccacacuuuaccagcgcuaugagauuaaaaugaccaagauguacaaaggauuucaggcccugggcgaugcugccgacaucagauucguguauacacccgcuauggaaagcgucuguggguacuuucaucggucccacaaccgcucugaggaguuccucauugccggaaagcugcaggauggccugcuccauaucaccacaugcagcuuuguggcgccuuggaacucccugucucuugcccaaagacggggguucaccaaaacguauaccguuggaugugaagagugcacaguguuuccgugucugagcauccccugcaagcuccaguccggcacccacugucuguggacagaccagcuucugcagggcagcgaaaagggguuccaaucucgccaucucgcuugccugccuagagagcccggacuguguaccuggcagucccuccggagccagauugccuga

SEQ ID NO: 7520 - RNA, 624 nt, Artificial Sequence
  derived and/or modified sequence opt6 from TIMP-1__Homo_sapiens__AAA52436
auggcaccauucgaacccuuagcaucaggaauacuacuacuacuauggcuaauagcaccaucaagagcaugcacaugcguaccaccacacccacaaaccgcauucugcaacucagaccuaguaauaagagcaaaauucguaggaacaccagaaguaaaucaaaccacauuauaccaaagauacgaaauaaaaaugacaaaaauguacaaaggauuccaagcacuaggagacgcagccgacauaagauuuguauacacaccagcaauggaaucaguauguggauacuuccaccgaucacacaaccgauccgaagaauuuuuaauagcaggaaaauuacaagacggacuauuacacauaacaacaugcucauucguagcaccuuggaacucacuuucacuagcacaaagaagaggauucacaaaaacauacacagucggaugcgaagaauguacaguauucccaugccuauccauaccaugcaaacuacaaucaggaacacacugccuauggacagaccaacuauuacaaggaucagaaaaaggauuccaaucaagacaccuagcaugccuacccagagaaccaggauuaugcacauggcaaucacuaagaucccaaauagccuaa

SEQ ID NO: 7521 - protein, 220 aa, Artificial Sequence
  TIMP-2__Homo_sapiens__P16035
MGAAARTLRLALGLLLLATLLRPADACSCSPVHPQQAFCNADVVIRAKAVSEKEVDSGNDIYGNPIKRIQYEIKQIKMFKGPEKDIEFIYTAPSSAVCGVSLDVGGKKEYLIAGKAEGDGKMHITLCDFIVPWDTLSTTQKKSLNHRYQMGCECKITRCPMIPCYISSPDECLWMDWVTEKNINGHQAKFFACIKRSDGSCAWYRGAAPPKQEFLDIEDP

SEQ ID NO: 7522 - RNA, 663 nt, Artificial Sequence
  TIMP-2__Homo_sapiens__AAA59581
augggcgccgcggcccgcacccugcggcuggcgcucggccuccugcugcuggcgacgcugcuucgcccggccgacgccugcagcugcuccccggugcacccgcaacaggcguuuugcaaugcagauguagugaucagggccaaagcggucagugagaaggaaguggacucuggaaacgacauuuauggcaacccuaucaagaggauccaguaugagaucaagcagauaaagauguucaaagggccugagaaggauauagaguuuaucuacacggcccccuccucggcaguguguggggucucgcuggacguuggaggaaagaaggaauaucucauugcaggaaaggccgagggggacggcaagaugcacaucacccucugugacuucaucgugcccugggacacccugagcaccacccagaagaagagccugaaccacagguaccagaugggcugcgagugcaagaucacgcgcugccccaugaucccgugcuacaucuccuccccggacgagugccucuggauggacugggucacagagaagaacaucaacgggcaccaggccaaguucuucgccugcaucaagagaagugacggcuccugugcgugguaccgcggcgcggcgccccccaagcaggaguuucucgacaucgaggacccauaa

SEQ ID NO: 7523 - RNA, 663 nt, Artificial Sequence
  derived and/or modified sequence opt1 from TIMP-2__Homo_sapiens__AAA59581
augggcgccgccgcgcgcacccugcggcucgcccuggggcugcuccugcuggccacccuccugcgccccgccgacgccugcagcugcucccccgugcacccccagcaggcguucugcaacgccgacgucgugauccgggccaaggccgugagcgagaaggaggucgacuccggcaacgacaucuacgggaaccccaucaagcgcauccaguacgagaucaagcagaucaagauguucaagggccccgagaaggacaucgaguucaucuacacggcgccgagcuccgccgugugcggggugagccuggacgucggcggcaagaaggaguaccucaucgccgggaaggccgagggcgacgggaagaugcacaucacccugugcgacuucaucgugcccugggacacccuguccaccacgcagaagaagucccucaaccaccgguaccagaugggcugcgagugcaagaucacccgcugccccaugauccccugcuacaucagcagcccggacgagugccuguggauggacugggugaccgagaagaacaucaacgggcaccaggccaaguucuucgcgugcaucaagcgguccgacggcagcugcgccugguaccgcggcgccgccccgcccaagcaggaguuccuggacaucgaggaccccuga

SEQ ID NO: 7524 - RNA, 663 nt, Artificial Sequence
  derived and/or modified sequence opt2 from TIMP-2__Homo_sapiens__AAA59581
augggcgccgccgcccgcacccuccgccucgcccucggccuccuccuccucgccacccuccuccgccccgccgacgccugcuccugcucccccguccacccccagcaggccuucugcaacgccgacgucgucauccgcgccaaggccgucuccgagaaggaggucgacuccggcaacgacaucuacggcaaccccaucaagcgcauccaguacgagaucaagcagaucaagauguucaagggccccgagaaggacaucgaguucaucuacaccgcccccuccuccgccgucugcggcgucucccucgacgucggcggcaagaaggaguaccucaucgccggcaaggccgagggcgacggcaagaugcacaucacccucugcgacuucaucguccccugggacacccucuccaccacccagaagaagucccucaaccaccgcuaccagaugggcugcgagugcaagaucacccgcugccccaugauccccugcuacaucuccucccccgacgagugccucuggauggacugggucaccgagaagaacaucaacggccaccaggccaaguucuucgccugcaucaagcgcuccgacggcuccugcgccugguaccgcggcgccgccccccccaagcaggaguuccucgacaucgaggaccccuga

SEQ ID NO: 7525 - RNA, 663 nt, Artificial Sequence
  derived and/or modified sequence opt3 from TIMP-2__Homo_sapiens__AAA59581
augggcgccgcugcaagaacccugaggcucgcccuugggcuguuguuacuggcgacacuacuccggcccgcugacgccugcagcuguuccccugugcacccacagcaagcauucugcaacgccgaugucguuauccgcgcuaaggcagugucugagaaagaaguagacucaggaaaugauauuuacgguaacccgauaaagcgaauccaguaugagauuaaacagaucaagauguuuaaaggccccgaaaaggacauugaguucaucuacacugccccuaguagcgcuguguguggggucucccuggaugugggaggcaagaaagaauaucuuauagccgguaaggcggagggggacggaaaaaugcauaucacgcugugcgauuuuauuguuccaugggacaccuugucuacaacucagaagaaaucgcucaaucaccguuaccaaaugggcugugagugcaagaucaccagaugucccaugauuccuugcuauaucucaagcccagaugaaugucuguggauggacugggugacagagaagaacauaaauggccaucaggcaaaauucuuugccugcauuaagaggagugauggguccugugcuugguaccggggagccgcacccccuaaacaggaguuccuggacaucgaagauccauga

SEQ ID NO: 7526 - RNA, 663 nt, Artificial Sequence
  derived and/or modified sequence opt4 from TIMP-2__Homo_sapiens__AAA59581
augggcgccgccgccagaacccugagacuggcccugggccugcugcugcuggccacccugcugagacccgccgacgccugcagcugcagccccgugcacccccagcaggccuucugcaacgccgacguggugaucagagccaaggccgugagcgagaaggagguggacagcggcaacgacaucuacggcaaccccaucaagagaauccaguacgagaucaagcagaucaagauguucaagggccccgagaaggacaucgaguucaucuacaccgcccccagcagcgccgugugcggcgugagccuggacgugggcggcaagaaggaguaccugaucgccggcaaggccgagggcgacggcaagaugcacaucacccugugcgacuucaucgugcccugggacacccugagcaccacccagaagaagagccugaaccacagauaccagaugggcugcgagugcaagaucaccagaugccccaugauccccugcuacaucagcagccccgacgagugccuguggauggacugggugaccgagaagaacaucaacggccaccaggccaaguucuucgccugcaucaagagaagcgacggcagcugcgccugguacagaggcgccgccccccccaagcaggaguuccuggacaucgaggaccccuga

SEQ ID NO: 7527 - RNA, 663 nt, Artificial Sequence
  derived and/or modified sequence opt5 from TIMP-2__Homo_sapiens__AAA59581
augggcgccgcugccagaacccugcggcucgcgcuggggcuucugcuccuggcuacacuucugcgccccgccgacgccugcagcuguuccccugugcacccgcagcaggcuuucugcaacgccgaugucguuaucagagcuaaggccgugucugagaaagaaguggacagcggaaaugauauuuacggcaaccccaucaagcggauucaauaugagaucaaacagauuaagauguuuaaagggccugaaaaggacaucgaguucaucuacacggcgcccuccucugccgucuguggagugagccucgauguuggcgggaagaaagaauaucugauugcuggaaaggccgagggcgacggcaaaaugcauaucacccugugcgauuuuauugugccuugggacacacucuccaccacacagaagaaaucucugaaucaccgcuaccaaauggggugugagugcaagaucaccagaugucccaugauuccuugcuauaucagcuccccggaugaaugucuuuggauggacugggucacagagaagaacauuaauggacaucaggcuaaauucuuugccugcaucaagcggagcgauggcucuugugcgugguaccgcggggccgcucccccuaaacaggaguuccuggacaucgaagaucccuga

SEQ ID NO: 7528 - RNA, 663 nt, Artificial Sequence
  derived and/or modified sequence opt6 from TIMP-2__Homo_sapiens__AAA59581
augggagcagcagcaagaacauuaagauuagcacuaggacuacuacuauuagcaacacuacuaagaccagcagacgcaugcagcugcucaccaguacacccacaacaagcauucugcaacgcagacguaguaauaagagcaaaagcaguaucagaaaaagaagucgacucaggaaacgacauauauggaaacccaauaaaaagaauacaauacgaaauaaaacaaauaaaaauguucaaaggaccagaaaaagacauagaauucauauauacagcaccaucaucagcaguaugcggaguaucacuagacguaggaggaaaaaaagaauacuuaauagcaggaaaagcagaaggagacggaaaaaugcacauaacacuaugcgacuucauaguaccaugggacacacuaucaacaacccaaaaaaaaagcuuaaaccacagauaccaaaugggaugcgaaugcaaaauaacaagaugcccaaugauaccaugcuacauaucaaguccagaugaaugcuuauggauggacuggguaacagaaaaaaacaucaacggacaccaagcaaaauucuucgcaugcauaaaaagaucagacggaaguugcgcaugguauagaggagcagcaccaccaaaacaagaauuccuagacauagaagauccauaa

SEQ ID NO: 7529 - protein, 211 aa, Artificial Sequence
  TIMP-3__Homo_sapiens__P35625
MTPWLGLIVLLGSWSLGDWGAEACTCSPSHPQDAFCNSDIVIRAKVVGKKLVKEGPFGTLVYTIKQMKMYRGFTKMPHVQYIHTEASESLCGLKLEVNKYQYLLTGRVYDGKMYTGLCNFVERWDQLTLSQRKGLNYRYHLGCNCKIKSCYYLPCFVTSKNECLWTDMLSNFGYPGYQSKHYACIRQKGGYCSWYRGWAPPDKSIINATDP

SEQ ID NO: 7530 - RNA, 636 nt, Artificial Sequence
  TIMP-3__Homo_sapiens__AAA17672
augaccccuuggcucgggcucaucgugcuccugggcagcuggagccugggggacuggggcgccgaggcgugcacaugcucgcccagccacccccaggacgccuucugcaacuccgacaucgugauccgggccaaggugguggggaagaagcugguaaaggaggggcccuucggcacgcuggucuacaccaucaagcagaugaagauguaccgaggcuucaccaagaugccccaugugcaguacauccauacggaagcuuccgagagucucuguggccuuaagcuggaggucaacaaguaccaguaccugcugacaggucgcgucuaugauggcaagauguacacggggcugugcaacuucguggagaggugggaccagcucacccucucccagcgcaaggggcugaacuaucgguaucaccuggguuguaacugcaagaucaaguccugcuacuaccugccuugcuuugugacuuccaagaacgagugucucuggaccgacaugcucuccaauuucgguuacccuggcuaccaguccaaacacuacgccugcauccggcagaagggcggcuacugcagcugguaccgaggaugggcccccccggauaaaagcaucaucaaugccacagaccccuga

SEQ ID NO: 7531 - RNA, 636 nt, Artificial Sequence
  derived and/or modified sequence opt1 from TIMP-3__Homo_sapiens__AAA17672
augacccccuggcugggccucaucgugcugcuggggagcuggucccucggcgacuggggcgccgaggccugcacgugcagcccgucccacccccaggacgcguucugcaacagcgacaucgucauccgcgccaaggugguggggaagaagcuggucaaggaggggcccuucggcacccugguguacaccaucaagcagaugaagauguaccggggcuucaccaagaugccccacgugcaguacauccacaccgaggccuccgagagccucugcgggcugaagcuggaggucaacaaguaccaguaccuccugacgggccgcguguacgacgggaagauguacaccggccugugcaacuucguggagcggugggaccagcucacccugucccagcgcaaggggcugaacuaccgguaccaccucggcugcaacugcaagaucaagagcugcuacuaccugccgugcuucgucaccuccaagaacgagugccuguggacggacaugcucagcaacuucggcuaccccggguaccaguccaagcacuacgccugcauccgccagaagggcggguacugcagcugguaccggggcugggccccgcccgacaaguccaucaucaacgcgaccgaccccuga

SEQ ID NO: 7532 - RNA, 636 nt, Artificial Sequence
  derived and/or modified sequence opt2 from TIMP-3__Homo_sapiens__AAA17672
augacccccuggcucggccucaucguccuccucggcuccuggucccucggcgacuggggcgccgaggccugcaccugcucccccucccacccccaggacgccuucugcaacuccgacaucgucauccgcgccaaggucgucggcaagaagcucgucaaggagggccccuucggcacccucgucuacaccaucaagcagaugaagauguaccgcggcuucaccaagaugccccacguccaguacauccacaccgaggccuccgagucccucugcggccucaagcucgaggucaacaaguaccaguaccuccucaccggccgcgucuacgacggcaagauguacaccggccucugcaacuucgucgagcgcugggaccagcucacccucucccagcgcaagggccucaacuaccgcuaccaccucggcugcaacugcaagaucaaguccugcuacuaccuccccugcuucgucaccuccaagaacgagugccucuggaccgacaugcucuccaacuucggcuaccccggcuaccaguccaagcacuacgccugcauccgccagaagggcggcuacugcuccugguaccgcggcugggccccccccgacaaguccaucaucaacgccaccgaccccuga

SEQ ID NO: 7533 - RNA, 636 nt, Artificial Sequence
  derived and/or modified sequence opt3 from TIMP-3__Homo_sapiens__AAA17672
augacccccuggcugggccucaucgugcuucuggggagcugguccuugggagacuggggugccgaggcuugcacauguucuccuucacacccacaggaugcauucugcaacagugacauugucauaagagccaagguugugggcaaaaaguuaguaaaagaagggccguuuggaacucugguguacacgaucaagcaaaugaaaauguauaggggcuucaccaagaugccccauguccaguacauucacacagaggcgagcgaaucccuauguggucucaagcuggaggugaauaaauaucaguaccuucugacugggcggguuuaugauggaaagauguacaccggcuugugcaacuuuguggaacgcugggaccagcucacacugucucaacgaaaaggccugaauuaucguuaccaucucggguguaacugcaagaucaaaucguguuacuauuuaccuugcuucgucaccucaaagaaugagugucuguggacugauaugcuuagcaacuuuggauacccagguuaucagaguaagcacuacgcuugcauuagacagaaaggcggguauuguuccugguacaggggaugggcacccccugacaagucuaucauaaaugccacagauccauga

SEQ ID NO: 7534 - RNA, 636 nt, Artificial Sequence
  derived and/or modified sequence opt4 from TIMP-3__Homo_sapiens__AAA17672
augacccccuggcugggccugaucgugcugcugggcagcuggagccugggcgacuggggcgccgaggccugcaccugcagccccagccacccccaggacgccuucugcaacagcgacaucgugaucagagccaagguggugggcaagaagcuggugaaggagggccccuucggcacccugguguacaccaucaagcagaugaagauguacagaggcuucaccaagaugccccacgugcaguacauccacaccgaggccagcgagagccugugcggccugaagcuggaggugaacaaguaccaguaccugcugaccggcagaguguacgacggcaagauguacaccggccugugcaacuucguggagagaugggaccagcugacccugagccagagaaagggccugaacuacagauaccaccugggcugcaacugcaagaucaagagcugcuacuaccugcccugcuucgugaccagcaagaacgagugccuguggaccgacaugcugagcaacuucggcuaccccggcuaccagagcaagcacuacgccugcaucagacagaagggcggcuacugcagcugguacagaggcugggccccccccgacaagagcaucaucaacgccaccgaccccuga

SEQ ID NO: 7535 - RNA, 636 nt, Artificial Sequence
  derived and/or modified sequence opt5 from TIMP-3__Homo_sapiens__AAA17672
augacccccuggcugggccucaucgugcugcuugggagcuggucccugggagacuggggcgccgaggcuugcacauguucuccuagccacccgcaggaugccuucugcaacuccgacauugucaucagagcgaagguuguggggaaaaagcucgugaaagaaggacccuuuggcacgcuggucuacaccauuaagcaaaugaaaauguaucggggguucacaaagaugccucaugugcaguacauccacaccgaggcuucugaaagccuuuguggacugaagcucgagguuaauaaauaucaguaccugcugacaggccgcguguaugauggcaagauguacaccgggcucugcaacuuugucgaaagaugggaccagcugacacuuucccaacggaaaggacugaauuaucgcuaccaucucggcuguaacugcaagauuaaaucuuguuacuaucugcccugcuucgugaccagcaagaaugagugucuuuggacggauaugcuguccaacuuuggguacccuggauaucagagcaagcacuacgccugcaucagacagaaaggcggguauuguucuugguaccggggaugggcucccccugacaaguccaucauuaaugccaccgauccguga

SEQ ID NO: 7536 - RNA, 636 nt, Artificial Sequence
  derived and/or modified sequence opt6 from TIMP-3__Homo_sapiens__AAA17672
augacaccauggcuaggacuaauaguacuacuaggaucauggucacuaggagacuggggagcagaagcaugcacaugcucaccaucacacccacaagacgcauucugcaacucagacauaguaauaagagcaaaaguaguaggaaaaaaauuaguaaaagaaggacccuucggaacacuaguauacacaauaaaacaaaugaaaauguacagaggauucacaaaaaugccacacguacaauacauacacacagaagcaucagaaucacuaugcggacuaaaacuagaaguaaacaaauaucaauaucuauuaacaggaagaguauacgacggaaaaauguauacaggacuaugcaacuucguagaaagaugggaccaacuaacacuaucacaaagaaaaggacuaaacuacagauaccaccuaggaugcaauugcaaaauaaaaucaugcuacuacuuaccaugcuucguaacaucaaaaaacgaaugccuauggacagacaugcuaucaaauuucggauacccagguuaccaaagcaaacacuacgcaugcauaagacaaaaaggaggauacugcucaugguacagaggaugggcaccaccagacaaaucaauaauaaacgcaacagaccccuaa

SEQ ID NO: 7537 - protein, 1170 aa, Artificial Sequence
  TSP-1__Homo_sapiens__P07996
MGLAWGLGVLFLMHVCGTNRIPESGGDNSVFDIFELTGAARKGSGRRLVKGPDPSSPAFRIEDANLIPPVPDDKFQDLVDAVRAEKGFLLLASLRQMKKTRGTLLALERKDHSGQVFSVVSNGKAGTLDLSLTVQGKQHVVSVEEALLATGQWKSITLFVQEDRAQLYIDCEKMENAELDVPIQSVFTRDLASIARLRIAKGGVNDNFQGVLQNVRFVFGTTPEDILRNKGCSSSTSVLLTLDNNVVNGSSPAIRTNYIGHKTKDLQAICGISCDELSSMVLELRGLRTIVTTLQDSIRKVTEENKELANELRRPPLCYHNGVQYRNNEEWTVDSCTECHCQNSVTICKKVSCPIMPCSNATVPDGECCPRCWPSDSADDGWSPWSEWTSCSTSCGNGIQQRGRSCDSLNNRCEGSSVQTRTCHIQECDKRFKQDGGWSHWSPWSSCSVTCGDGVITRIRLCNSPSPQMNGKPCEGEARETKACKKDACPINGGWGPWSPWDICSVTCGGGVQKRSRLCNNPTPQFGGKDCVGDVTENQICNKQDCPIDGCLSNPCFAGVKCTSYPDGSWKCGACPPGYSGNGIQCTDVDECKEVPDACFNHNGEHRCENTDPGYNCLPCPPRFTGSQPFGQGVEHATANKQVCKPRNPCTDGTHDCNKNAKCNYLGHYSDPMYRCECKPGYAGNGIICGEDTDLDGWPNENLVCVANATYHCKKDNCPNLPNSGQEDYDKDGIGDACDDDDDNDKIPDDRDNCPFHYNPAQYDYDRDDVGDRCDNCPYNHNPDQADTDNNGEGDACAADIDGDGILNERDNCQYVYNVDQRDTDMDGVGDQCDNCPLEHNPDQLDSDSDRIGDTCDNNQDIDEDGHQNNLDNCPYVPNANQADHDKDGKGDACDHDDDNDGIPDDKDNCRLVPNPDQKDSDGDGRGDACKDDFDHDSVPDIDDICPENVDISETDFRRFQMIPLDPKGTSQNDPNWVVRHQGKELVQTVNCDPGLAVGYDEFNAVDFSGTFFINTERDDDYAGFVFGYQSSSRFYVVMWKQVTQSYWDTNPTRAQGYSGLSVKVVNSTTGPGEHLRNALWHTGNTPGQVRTLWHDPRHIGWKDFTAYRWRLSHRPKTGFIRVVMYEGKKIMADSGPIYDKTYAGGRLGLFVFSQEMVFFSDLKYECRDP

SEQ ID NO: 7538 - RNA, 3513 nt, Artificial Sequence
  TSP-1__Homo_sapiens__AAI36470
auggggcuggccuggggacuaggcguccuguuccugaugcauguguguggcaccaaccgcauuccagagucuggcggagacaacagcguguuugacaucuuugaacucaccggggccgcccgcaaggggucugggcgccgacuggugaagggccccgacccuuccagcccagcuuuccgcaucgaggaugccaaccugauccccccugugccugaugacaaguuccaagaccugguggaugcugugcgggcagaaaaggguuuccuccuucuggcaucccugaggcagaugaagaagacccggggcacgcugcuggcccuggagcggaaagaccacucuggccaggucuucagcgugguguccaauggcaaggcgggcacccuggaccucagccugaccguccaaggaaagcagcacguggugucuguggaagaagcucuccuggcaaccggccaguggaagagcaucacccuguuugugcaggaagacagggcccagcuguacaucgacugugaaaagauggagaaugcugaguuggacguccccauccaaagcgucuucaccagagaccuggccagcaucgccagacuccgcaucgcaaaggggggcgucaaugacaauuuccagggggugcugcagaaugugagguuugucuuuggaaccacaccagaagacauccucaggaacaaaggcugcuccagcucuaccaguguccuccucacccuugacaacaacguggugaaugguuccagcccugccauccgcacuaacuacauuggccacaagacaaaggacuugcaagccaucugcggcaucuccugugaugagcuguccagcaugguccuggaacucaggggccugcgcaccauugugaccacgcugcaggacagcauccgcaaagugacugaagagaacaaagaguuggccaaugagcugaggcggccuccccuaugcuaucacaacggaguucaguacagaaauaacgaggaauggacuguugauagcugcacugagugucacugucagaacucaguuaccaucugcaaaaagguguccugccccaucaugcccugcuccaaugccacaguuccugauggagaaugcuguccucgcuguuggcccagcgacucugcggacgauggcuggucuccaugguccgaguggaccuccuguucuacgagcuguggcaauggaauucagcagcgcggccgcuccugcgauagccucaacaaccgaugugagggcuccucgguccagacacggaccugccacauucaggagugugacaagagauuuaaacaggaugguggcuggagccacugguccccguggucaucuuguucugugacauguggugauggugugaucacaaggauccggcucugcaacucucccagcccccagaugaacgggaaacccugugaaggcgaagcgcgggagaccaaagccugcaagaaagacgccugccccaucaauggaggcugggguccuuggucaccaugggacaucuguucugucaccuguggaggagggguacagaaacguagucgucucugcaacaaccccacaccccaguuuggaggcaaggacugcguuggugauguaacagaaaaccagaucugcaacaagcaggacuguccaauugauggaugccuguccaaucccugcuuugccggcgugaaguguacuagcuacccugauggcagcuggaaauguggugcuugucccccugguuacaguggaaauggcauccagugcacagauguugaugagugcaaagaagugccugaugccugcuucaaccacaauggagagcaccggugugagaacacggaccccggcuacaacugccugcccugccccccacgcuucaccggcucacagcccuucggccagggugucgaacaugccacggccaacaaacaggugugcaagccccguaaccccugcacggaugggacccacgacugcaacaagaacgccaagugcaacuaccugggccacuauagcgaccccauguaccgcugcgagugcaagccuggcuacgcuggcaauggcaucaucugcggggaggacacagaccuggauggcuggcccaaugagaaccuggugugcguggccaaugcgacuuaccacugcaaaaaggauaauugccccaaccuucccaacucagggcaggaagacuaugacaaggauggaauuggugaugccugugaugaugacgaugacaaugauaaaauuccagaugacagggacaacuguccauuccauuacaacccagcucaguaugacuaugacagagaugaugugggagaccgcugugacaacugucccuacaaccacaacccagaucaggcagacacagacaacaauggggaaggagacgccugugcugcagacauugauggagacgguauccucaaugaacgggacaacugccaguacgucuacaauguggaccagagagacacugauauggaugggguuggagaucagugugacaauugccccuuggaacacaauccggaucagcuggacucugacucagaccgcauuggagauaccugugacaacaaucaggauauugaugaagauggccaccagaacaaucuggacaacugucccuaugugcccaaugccaaccaggcugaccaugacaaagauggcaagggagaugccugugaccacgaugaugacaacgauggcauuccugaugacaaggacaacugcagacucgugcccaaucccgaccagaaggacucugacggcgauggucgaggugaugccugcaaagaugauuuugaccaugacagugugccagacaucgaugacaucuguccugagaauguugacaucagugagaccgauuuccgccgauuccagaugauuccucuggaccccaaagggacaucccaaaaugacccuaacuggguuguacgccaucaggguaaagaacucguccagacugucaacugugauccuggacucgcuguagguuaugaugaguuuaaugcuguggacuucaguggcaccuucuucaucaacaccgaaagggacgaugacuaugcuggauuugucuuuggcuaccaguccagcagccgcuuuuauguugugauguggaagcaagucacccaguccuacugggacaccaaccccacgagggcucagggauacucgggccuuucugugaaaguuguaaacuccaccacagggccuggcgagcaccugcggaacgcccuguggcacacaggaaacaccccuggccaggugcgcacccuguggcaugacccucgucacauaggcuggaaagauuucaccgccuacagauggcgucucagccacaggccaaagacggguuucauuagaguggugauguaugaagggaagaaaaucauggcugacucaggacccaucuaugauaaaaccuaugcuggugguagacuaggguuguuugucuucucucaagaaaugguguucuucucugaccugaaauacgaauguagagaucccuaa

SEQ ID NO: 7539 - RNA, 3513 nt, Artificial Sequence
  derived and/or modified sequence opt1 from TSP-1__Homo_sapiens__AAI36470
augggccuggccugggggcucggcgugcuguuccugaugcacgucugcgggaccaaccgcauccccgagagcggcggggacaacuccguguucgacaucuucgagcucaccggcgccgcgcggaagggcagcgggcgccggcuggugaagggcccggaccccuccagccccgccuuccgcaucgaggacgccaaccugaucccgcccguccccgacgacaaguuccaggaccucguggacgccgugcgggccgagaagggguuccugcugcucgcgucccugcgccagaugaagaagacgcggggcacccugcucgcccuggagcgcaaggaccacagcgggcaggucuucuccguggugagcaacggcaaggccggcacccuggaccucucccugaccguccaggggaagcagcacguggugagcgucgaggaggcccugcucgcgacgggccaguggaaguccaucacccuguucgugcaggaggaccgggcccagcuguacaucgacugcgagaagauggagaacgccgagcucgacgugcccauccagagcgucuucacccgcgaccuggccuccaucgcccggcugcgcaucgcgaagggcggggugaacgacaacuuccagggcgugcuccagaacguccgguucguguucgggaccacgcccgaggacauccugcgcaacaagggcugcagcuccagcaccuccgugcugcucacccuggacaacaacgucgugaacgggagcuccccggccauccggaccaacuacaucggccacaagacgaaggaccugcaggccaucugcgggaucagcugcgacgagcucagcuccauggugcuggagcugcgcggccuccggaccaucgucaccacccugcaggacagcauccgcaaggugacggaggagaacaaggagcuggccaacgagcuccggcgcccgccccugugcuaccacaacggcguccaguaccggaacaacgaggaguggaccguggacuccugcaccgagugccacugccagaacagcgugaccaucugcaagaaggucuccugccccaucaugcccugcagcaacgccacggugcccgacggggagugcugcccccgcugcuggcccuccgacagcgcggacgacggcugguccccguggagcgaguggaccuccugcagcaccuccugcgggaacggcauccagcagcgcgggcggagcugcgacucccugaacaaccgcugcgagggcagcuccgugcagacccggacgugccacauccaggagugcgacaagcgcuucaagcaggacggcggguggagccacuggucccccuggagcagcugcuccgugaccugcggcgacggggugaucacccggauccgccucugcaacagccccagcccccagaugaacggcaagccgugcgagggggaggcccgggagaccaaggccugcaagaaggacgccugccccaucaacggcggcugggggcccuggucccccugggacaucugcuccgugacgugcggcgggggcguccagaagcgcagccggcugugcaacaacccgacgccccaguucggcgggaaggacugcgugggcgacgugaccgagaaccagaucugcaacaagcaggacugccccaucgacgggugccuguccaaccccugcuucgccggcgucaagugcaccagcuacccggacggguccuggaagugcggcgcgugcccgcccggcuacagcgggaacggcauccagugcaccgacguggacgagugcaaggaggugcccgacgccugcuucaaccacaacggggagcaccgcugcgagaacaccgaccccggcuacaacugccuccccugcccgccccgguucaccgggucccagcccuucggccagggcgucgagcacgccaccgccaacaagcaggucugcaagccccgcaaccccugcacggacgggacccacgacugcaacaagaacgccaagugcaacuaccugggccacuacagcgacccgauguaccggugcgagugcaagcccggguacgcgggcaacgggaucaucugcggcgaggacaccgaccuggacggcuggcccaacgagaaccucgugugcgucgccaacgccaccuaccacugcaagaaggacaacugccccaaccugccgaacuccgggcaggaggacuacgacaaggacggcaucggggacgccugcgacgacgacgacgacaacgacaagauccccgacgaccgcgacaacugccccuuccacuacaaccccgcgcaguacgacuacgaccgggacgacgugggcgaccgcugcgacaacugcccguacaaccacaaccccgaccaggccgacaccgacaacaacggggagggcgacgccugcgccgccgacaucgacggcgacgggauccugaacgagcgggacaacugccaguacguguacaacgucgaccagcgcgacacggacauggacggcgugggggaccagugcgacaacugcccccucgagcacaaccccgaccagcuggacagcgacuccgaccggaucggcgacacgugcgacaacaaccaggacaucgacgaggacggccaccagaacaaccuggacaacugcccguacgugcccaacgcgaaccaggccgaccacgacaaggacgggaagggcgacgccugcgaccacgacgacgacaacgacgggauccccgacgacaaggacaacugccgccugguccccaacccggaccagaaggacagcgacggcgacgggcgcggcgacgccugcaaggacgacuucgaccacgacuccgugcccgacaucgacgacaucugccccgagaacguggacaucagcgagaccgacuuccggcgcuuccagaugaucccgcucgaccccaagggcaccagccagaacgaccccaacugggucgugcggcaccaggggaaggagcuggugcagaccgucaacugcgaccccggccuggccgugggguacgacgaguucaacgcgguggacuucuccggcaccuucuucaucaacaccgagcgcgacgacgacuacgccggguucgucuucggcuaccagagcuccagccgguucuacguggugauguggaagcaggucacccaguccuacugggacacgaacccgacccgcgcccagggcuacagcgggcucuccgugaagguggucaacagcaccaccggccccggggagcaccuccggaacgcccuguggcacacgggcaacacccccggccaggugcgcacccuguggcacgacccccggcacaucggguggaaggacuucaccgccuaccgcuggcggcugucccaccgcccgaagacgggcuucauccggguggucauguacgaggggaagaagaucauggcggacagcggccccaucuacgacaagaccuacgccgggggccgccugggccucuucguguucucccaggagaugguguucuucagcgaccugaaguacgagugccgggaccccuga

SEQ ID NO: 7540 - RNA, 3513 nt, Artificial Sequence
  derived and/or modified sequence opt2 from TSP-1__Homo_sapiens__AAI36470
augggccucgccuggggccucggcguccucuuccucaugcacgucugcggcaccaaccgcauccccgaguccggcggcgacaacuccgucuucgacaucuucgagcucaccggcgccgcccgcaagggcuccggccgccgccucgucaagggccccgaccccuccucccccgccuuccgcaucgaggacgccaaccucaucccccccguccccgacgacaaguuccaggaccucgucgacgccguccgcgccgagaagggcuuccuccuccucgccucccuccgccagaugaagaagacccgcggcacccuccucgcccucgagcgcaaggaccacuccggccaggucuucuccgucgucuccaacggcaaggccggcacccucgaccucucccucaccguccagggcaagcagcacgucgucuccgucgaggaggcccuccucgccaccggccaguggaaguccaucacccucuucguccaggaggaccgcgcccagcucuacaucgacugcgagaagauggagaacgccgagcucgacguccccauccaguccgucuucacccgcgaccucgccuccaucgcccgccuccgcaucgccaagggcggcgucaacgacaacuuccagggcguccuccagaacguccgcuucgucuucggcaccacccccgaggacauccuccgcaacaagggcugcuccuccuccaccuccguccuccucacccucgacaacaacgucgucaacggcuccucccccgccauccgcaccaacuacaucggccacaagaccaaggaccuccaggccaucugcggcaucuccugcgacgagcucuccuccaugguccucgagcuccgcggccuccgcaccaucgucaccacccuccaggacuccauccgcaaggucaccgaggagaacaaggagcucgccaacgagcuccgccgccccccccucugcuaccacaacggcguccaguaccgcaacaacgaggaguggaccgucgacuccugcaccgagugccacugccagaacuccgucaccaucugcaagaaggucuccugccccaucaugcccugcuccaacgccaccguccccgacggcgagugcugcccccgcugcuggcccuccgacuccgccgacgacggcuggucccccugguccgaguggaccuccugcuccaccuccugcggcaacggcauccagcagcgcggccgcuccugcgacucccucaacaaccgcugcgagggcuccuccguccagacccgcaccugccacauccaggagugcgacaagcgcuucaagcaggacggcggcuggucccacuggucccccugguccuccugcuccgucaccugcggcgacggcgucaucacccgcauccgccucugcaacucccccuccccccagaugaacggcaagcccugcgagggcgaggcccgcgagaccaaggccugcaagaaggacgccugccccaucaacggcggcuggggccccuggucccccugggacaucugcuccgucaccugcggcggcggcguccagaagcgcucccgccucugcaacaaccccaccccccaguucggcggcaaggacugcgucggcgacgucaccgagaaccagaucugcaacaagcaggacugccccaucgacggcugccucuccaaccccugcuucgccggcgucaagugcaccuccuaccccgacggcuccuggaagugcggcgccugcccccccggcuacuccggcaacggcauccagugcaccgacgucgacgagugcaaggagguccccgacgccugcuucaaccacaacggcgagcaccgcugcgagaacaccgaccccggcuacaacugccuccccugccccccccgcuucaccggcucccagcccuucggccagggcgucgagcacgccaccgccaacaagcaggucugcaagccccgcaaccccugcaccgacggcacccacgacugcaacaagaacgccaagugcaacuaccucggccacuacuccgaccccauguaccgcugcgagugcaagcccggcuacgccggcaacggcaucaucugcggcgaggacaccgaccucgacggcuggcccaacgagaaccucgucugcgucgccaacgccaccuaccacugcaagaaggacaacugccccaaccuccccaacuccggccaggaggacuacgacaaggacggcaucggcgacgccugcgacgacgacgacgacaacgacaagauccccgacgaccgcgacaacugccccuuccacuacaaccccgcccaguacgacuacgaccgcgacgacgucggcgaccgcugcgacaacugccccuacaaccacaaccccgaccaggccgacaccgacaacaacggcgagggcgacgccugcgccgccgacaucgacggcgacggcauccucaacgagcgcgacaacugccaguacgucuacaacgucgaccagcgcgacaccgacauggacggcgucggcgaccagugcgacaacugcccccucgagcacaaccccgaccagcucgacuccgacuccgaccgcaucggcgacaccugcgacaacaaccaggacaucgacgaggacggccaccagaacaaccucgacaacugccccuacguccccaacgccaaccaggccgaccacgacaaggacggcaagggcgacgccugcgaccacgacgacgacaacgacggcauccccgacgacaaggacaacugccgccucguccccaaccccgaccagaaggacuccgacggcgacggccgcggcgacgccugcaaggacgacuucgaccacgacuccguccccgacaucgacgacaucugccccgagaacgucgacaucuccgagaccgacuuccgccgcuuccagaugaucccccucgaccccaagggcaccucccagaacgaccccaacugggucguccgccaccagggcaaggagcucguccagaccgucaacugcgaccccggccucgccgucggcuacgacgaguucaacgccgucgacuucuccggcaccuucuucaucaacaccgagcgcgacgacgacuacgccggcuucgucuucggcuaccaguccuccucccgcuucuacgucgucauguggaagcaggucacccaguccuacugggacaccaaccccacccgcgcccagggcuacuccggccucuccgucaaggucgucaacuccaccaccggccccggcgagcaccuccgcaacgcccucuggcacaccggcaacacccccggccagguccgcacccucuggcacgacccccgccacaucggcuggaaggacuucaccgccuaccgcuggcgccucucccaccgccccaagaccggcuucauccgcgucgucauguacgagggcaagaagaucauggccgacuccggccccaucuacgacaagaccuacgccggcggccgccucggccucuucgucuucucccaggagauggucuucuucuccgaccucaaguacgagugccgcgaccccuga

SEQ ID NO: 7541 - RNA, 3513 nt, Artificial Sequence
  derived and/or modified sequence opt3 from TSP-1__Homo_sapiens__AAI36470
augggccuggccugggggcucggagugcuuuuccugaugcacgucugcgguaccaacagaauccccgagagcggcggggacaauuccguuuuugauauuuucgaauugacaggagcugcaaggaagggcucuggucggcgcuuagugaaagggccugacccaucaaguccggccuuucgaauagaggaugcgaaccugauucccccuguaccagacgauaaguuccaggaccuaguggaugcuguccgugccgaaaaaggauuucuccugcuugcaagccugagacaaaugaagaaaacuaggggcacguugcucgcccuggagcggaaggaccauuccggccagguguucucuguugugucgaaugggaaggcuggaacccuggaucucucauuaacaguccaggguaaacagcacgugguaagcguugaagaggcacugcuugccacuggccaauggaagaguaucaccuuguuugugcaggaggaccgcgcucagcuguacaucgauugugaaaagauggagaacgccgaacuagacguccccauucaguccguguucacaagagaucucgcgucuaucgcaaggcugcggauagccaaagggggagugaaugacaacuuucaaggcguccuucagaauguucgcuucguguuugguaccacuccugaggacauccugcgaaacaaagggugcagcuccucaacaaguguauugcucacccuggauaauaacguggucaauggaagcucuccagcuauuagaacgaacuauaucggccauaagacuaaggacuuacaggccauuuguggcaucuccugcgaugagcugucaagcauggugcucgaacuuagggggcugcggaccauaguuacaacuuugcaggacaguauucguaaagugaccgaggaaaauaaggagcuagcaaacgaacugcgcagacccccucucuguuaccacaauggaguccaauauaggaacaacgaggaguggacaguggauucuugcaccgaaugucauugccaaaauuccguaacgaucuguaaaaagguuagcugcccaauuaugccguguucgaacgcuacugugcccgacggugagugcugcccucgguguuggccaucugauuccgccgacgauggcuggucacccuggagugaauggacaagcugcuccaccucuugugggaauggaauccagcagcgaggccgcagcugcgacucacugaacaauagaugugaggguaguuccguccagacuaggacaugccacauccaggaaugugauaaacgguucaagcaggacgggggcuggagccacuggucuccuuggucaaguugcagcgugaccuguggagacggcgucauuacgcgcauaagacuuugcaacuccccaucuccccaaaugaaugggaaaccgugugagggagaggcgagggaaaccaaggccugcaagaaagaugcaugcccuaucaacgguggcugggggcccuggucgccaugggacauuuguagcgugacaugcggaggcgguguucagaagcguucccggcuguguaauaacccuacuccccaguuugggggcaaagauugcgugggagacguaaccgagaaucagaucuguaacaagcaagauugcccaauagacggcuguuugucaaaucccugcuucgcuggggucaaauguacaaguuacccugauggaucuuggaagugcggugccuguccaccgggcuauagcgggaacgggauucagugcacugacguggaugaaugcaaggagguucccgacgcuuguuucaaucauaacggcgaacaccgaugcgagaacaccgauccugguuacaauugucucccaugucccccuagauuuacagggucccagccauucggccagggaguggagcaugccaccgcaaacaaacaagucugcaagcccaggaauccgugcacugacggcacgcacgauuguaacaaaaaugccaagugcaacuaucuggggcacuacucagacccuauguaccgcugugaaugcaaaccaggauaugcuggcaaugguaucaucuguggggaggacacagauuuagacggauggcccaacgaaaaucuggugugcguagcgaacgcaaccuaccauugcaagaaggauaauuguccuaaccuacccaauagcggccaggaggacuaugauaaagacgguauuggcgaugccugcgacgaugacgaugacaacgauaagaucccagacgaccgggauaauuguccuuuucacuacaaccccgcucaguaugacuacgauagagacgaugugggggacaggugcgauaacuguccauauaaucauaacccggaccaggccgauacugacaauaacggagagggcgaugcaugcgccgcugacauugacggggauggaauacucaaugaacgcgacaacugucaauacguuuacaaugucgaucagcgagacaccgauauggacggcgugggugaucagugcgacaacuguccucuggagcacaaucccgaucaacuugacucugauuccgaccggaucggggauacaugcgacaacaaucaggacauugaugaagacggacaucagaacaauuuggauaacuguccauaugugcccaaugccaaccaggcagaccacgauaaagacggcaagggugaugcgugcgaccacgaugacgauaacgacggcaucccugaugacaaagacaauugccgucuggucccaaaccccgaucaaaaggacagugauggggacggaagaggcgaugcuuguaaggacgauuucgaccaugauagcguuccugacaucgaugacauuugcccggagaauguggacauaucugaaaccgauuuuaggcgcuuccagaugaucccacucgaccccaaagggacuucccagaacgauccuaauugggugguacggcaccagggaaaggagcugguccaaacagugaacugugacccaggccuugccguugguuacgaugaguuuaaugcaguggacuucucagggacguuuuucauuaacaccgaaagagaugacgauuaugccggauuugucuucggcuaccagaguagcucgagguuuuaugugguuauguggaaacaggugacucaguccuacugggacacaaaucccacccgagcucaagguuauucuggccugagcguaaaggucgugaacucaacaacugggccuggagagcauuugcgcaaugcccucuggcacaccggcaacacgccgggacaggugcggacccuguggcacgaucccagacauaucggauggaaagacuucacagcauacagguggcguuuaagucaccgcccaaagacuggcuucauucgggucguuauguacgaagguaaaaagaucauggcugauuccgggccuauauaugacaagaccuacgccggaggcagacugggccuauuuguguucucucaggagaugguauuuuucagcgaccucaaauaugaaugcagggaucccuga

SEQ ID NO: 7542 - RNA, 3513 nt, Artificial Sequence
  derived and/or modified sequence opt4 from TSP-1__Homo_sapiens__AAI36470
augggccuggccuggggccugggcgugcuguuccugaugcacgugugcggcaccaacagaauccccgagagcggcggcgacaacagcguguucgacaucuucgagcugaccggcgccgccagaaagggcagcggcagaagacuggugaagggccccgaccccagcagccccgccuucagaaucgaggacgccaaccugaucccccccgugcccgacgacaaguuccaggaccugguggacgccgugagagccgagaagggcuuccugcugcuggccagccugagacagaugaagaagaccagaggcacccugcuggcccuggagagaaaggaccacagcggccagguguucagcguggugagcaacggcaaggccggcacccuggaccugagccugaccgugcagggcaagcagcacguggugagcguggaggaggcccugcuggccaccggccaguggaagagcaucacccuguucgugcaggaggacagagcccagcuguacaucgacugcgagaagauggagaacgccgagcuggacgugcccauccagagcguguucaccagagaccuggccagcaucgccagacugagaaucgccaagggcggcgugaacgacaacuuccagggcgugcugcagaacgugagauucguguucggcaccacccccgaggacauccugagaaacaagggcugcagcagcagcaccagcgugcugcugacccuggacaacaacguggugaacggcagcagccccgccaucagaaccaacuacaucggccacaagaccaaggaccugcaggccaucugcggcaucagcugcgacgagcugagcagcauggugcuggagcugagaggccugagaaccaucgugaccacccugcaggacagcaucagaaaggugaccgaggagaacaaggagcuggccaacgagcugagaagacccccccugugcuaccacaacggcgugcaguacagaaacaacgaggaguggaccguggacagcugcaccgagugccacugccagaacagcgugaccaucugcaagaaggugagcugccccaucaugcccugcagcaacgccaccgugcccgacggcgagugcugccccagaugcuggcccagcgacagcgccgacgacggcuggagccccuggagcgaguggaccagcugcagcaccagcugcggcaacggcauccagcagagaggcagaagcugcgacagccugaacaacagaugcgagggcagcagcgugcagaccagaaccugccacauccaggagugcgacaagagauucaagcaggacggcggcuggagccacuggagccccuggagcagcugcagcgugaccugcggcgacggcgugaucaccagaaucagacugugcaacagccccagcccccagaugaacggcaagcccugcgagggcgaggccagagagaccaaggccugcaagaaggacgccugccccaucaacggcggcuggggccccuggagccccugggacaucugcagcgugaccugcggcggcggcgugcagaagagaagcagacugugcaacaaccccaccccccaguucggcggcaaggacugcgugggcgacgugaccgagaaccagaucugcaacaagcaggacugccccaucgacggcugccugagcaaccccugcuucgccggcgugaagugcaccagcuaccccgacggcagcuggaagugcggcgccugcccccccggcuacagcggcaacggcauccagugcaccgacguggacgagugcaaggaggugcccgacgccugcuucaaccacaacggcgagcacagaugcgagaacaccgaccccggcuacaacugccugcccugcccccccagauucaccggcagccagcccuucggccagggcguggagcacgccaccgccaacaagcaggugugcaagcccagaaaccccugcaccgacggcacccacgacugcaacaagaacgccaagugcaacuaccugggccacuacagcgaccccauguacagaugcgagugcaagcccggcuacgccggcaacggcaucaucugcggcgaggacaccgaccuggacggcuggcccaacgagaaccuggugugcguggccaacgccaccuaccacugcaagaaggacaacugccccaaccugcccaacagcggccaggaggacuacgacaaggacggcaucggcgacgccugcgacgacgacgacgacaacgacaagauccccgacgacagagacaacugccccuuccacuacaaccccgcccaguacgacuacgacagagacgacgugggcgacagaugcgacaacugccccuacaaccacaaccccgaccaggccgacaccgacaacaacggcgagggcgacgccugcgccgccgacaucgacggcgacggcauccugaacgagagagacaacugccaguacguguacaacguggaccagagagacaccgacauggacggcgugggcgaccagugcgacaacugcccccuggagcacaaccccgaccagcuggacagcgacagcgacagaaucggcgacaccugcgacaacaaccaggacaucgacgaggacggccaccagaacaaccuggacaacugccccuacgugcccaacgccaaccaggccgaccacgacaaggacggcaagggcgacgccugcgaccacgacgacgacaacgacggcauccccgacgacaaggacaacugcagacuggugcccaaccccgaccagaaggacagcgacggcgacggcagaggcgacgccugcaaggacgacuucgaccacgacagcgugcccgacaucgacgacaucugccccgagaacguggacaucagcgagaccgacuucagaagauuccagaugaucccccuggaccccaagggcaccagccagaacgaccccaacuggguggugagacaccagggcaaggagcuggugcagaccgugaacugcgaccccggccuggccgugggcuacgacgaguucaacgccguggacuucagcggcaccuucuucaucaacaccgagagagacgacgacuacgccggcuucguguucggcuaccagagcagcagcagauucuacguggugauguggaagcaggugacccagagcuacugggacaccaaccccaccagagcccagggcuacagcggccugagcgugaagguggugaacagcaccaccggccccggcgagcaccugagaaacgcccuguggcacaccggcaacacccccggccaggugagaacccuguggcacgaccccagacacaucggcuggaaggacuucaccgccuacagauggagacugagccacagacccaagaccggcuucaucagaguggugauguacgagggcaagaagaucauggccgacagcggccccaucuacgacaagaccuacgccggcggcagacugggccuguucguguucagccaggagaugguguucuucagcgaccugaaguacgagugcagagaccccuga

SEQ ID NO: 7543 - RNA, 3513 nt, Artificial Sequence
  derived and/or modified sequence opt5 from TSP-1__Homo_sapiens__AAI36470
augggccuggccugggggcucggagugcuguuccuuaugcacgucugcggcaccaacagaauccccgagagcgggggagacaauuccguuuuugauauuuucgaacugacaggcgcugcccggaaggggucuggacgcagacucgugaaaggcccugacccgagcucccccgcguuucggaucgaggaugcuaaccugauuccucccgugccugacgauaaguuccaggaccuugucgaugccgugcgcgccgaaaaaggcuuucugcuccuggcuucucugagacaaaugaagaaaacgcgggggacccuccuggcccuugagcgcaaggaccauagcggacagguuuucuccguggucucuaauggcaaggcugggacacuggaucucagccugaccgugcagggaaaacagcacguuguguccgucgaagaggcccuucuggcgacaggccaauggaaaagcaucacccucuuugugcaggaggacagagcccagcuguacauugauugugaaaagauggagaacgcugaacuggacgugcccauccagucugucuucacacgggaucucgccuccaucgcucgccugagaauugccaaagggggaguuaaugacaacuuucaaggcgugcuucagaaugugcgguucgucuuuggcaccacgccugaggacauccugcgcaacaaggggugcuccucuuccaccagcgugcuccugacacuugauaauaacguugugaauggaucuuccccggcgauuagaaccaacuauaucggccauaagacaaaggaccugcaggccauuugugggaucagcugcgaugagcucuccucuaugguccuggaacugcggggacuccgcaccauugugacgacacugcaggacagcaucagaaaaguuaccgaggaaaauaaggagcuugcuaacgaacugcggagacccccucucuguuaccacaauggcgugcaauaucgcaacaacgaggaguggacagucgauuccugcaccgaaugucauugccagaauagcgugaccaucuguaaaaaggucucuugccccauuaugccuuguuccaacgccacagugcccgacggggagugcugcccgcgguguuggccuagcgauucugcugacgauggauggagccccugguccgaauggacgucuugcagcaccuccuguggcaauggcauccagcaaagagggcgcagcugcgacucucugaacaaucggugugagggauccagcguucagacaagaaccugccacauucaggaaugugauaaacgcuucaagcaggacggcggguggucucacugguccccuuggagcuccugcucugugacauguggagacggcgucaucacccggauuagacuuugcaacagccccagcccccaaaugaaugggaaaccuugugagggcgaggcccgcgaaacgaaggccugcaagaaagaugcuugcccgaucaacggaggcugggggcccuggucuccuugggacaucuguagcgugacaugcggaggcgggguucagaagcgguccagacuguguaauaaccccaccccucaguuuggaggcaaagauugcgugggggacgucaccgagaaucagauuuguaacaagcaagauugccccaucgacggcugucucagcaauccgugcuucgcgggagugaaauguacaucuuacccugauggcuccuggaagugcggggccugucccccuggauauagcggcaacgggauucagugcaccgacguggaugaaugcaaggagguucccgacgcuuguuucaaucauaacggagaacaccgcugcgagaacacagauccuggcuacaauugucugcccugcccgccucgguuuacggggucucagcccuucggccagggagucgagcaugccaccgccaacaaacaaguguguaagcccagaaauccuugcacagacggcacccacgauuguaacaaaaaugcuaagugcaacuaucuggggcacuacuccgacccgauguaccggugugaaugcaaacccggauaugccggcaaugggaucauuuguggagaggacacagaucucgacggcuggccuaacgaaaaucuggugugcgucgcgaacgcuaccuaccauugcaagaaggauaauugucccaaccuuccuaauagcgggcaggaggacuaugauaaagacggcaucggagaugccugcgacgaugacgaugacaacgauaagauccccgacgaccgcgauaauuguccuuuucacuacaaccccgcccaguaugacuacgauagagacgaugugggcgaccggugcgauaacuguccguauaaucauaacccugaccaggcugauacggacaauaacggggagggagaugccugcgcugccgacauugacggcgaugggauccugaaugaaagagacaacugucaauacguuuacaauguggaucagcgcgacaccgauauggacggagucggcgaucagugcgacaacuguccccucgagcacaauccugaucaacuggacucugauagcgaccggauuggcgauacaugcgacaacaaucaggacaucgaugaagacgggcaucagaacaaucuggauaacugucccuaugugccgaaugcgaaccaggccgaccacgauaaagacggaaagggcgaugcuugcgaccacgaugacgauaacgacgggauuccugaugacaaagacaauugcagacuuguucccaacccugaucaaaaggacuccgauggagacggccgcggggaugccuguaaggacgauuucgaccaugauagcgugcccgacaucgaugacauuugccccgagaaugucgacaucucugaaaccgauuuuagacgguuccagaugaucccucucgacccgaaaggaacaucccagaacgaucccaauugggugguucgccaccagggcaaggagcuggugcaaaccgucaacugugacccuggccuggcugugggguacgaugaguuuaaugccguggacuucagcggaacguuuuucauuaacacagaaagagaugacgauuaugcgggcuuugucuucggguaccaguccucuagccgguuuuauguugugauguggaaacaggugacccaguccuacugggacacaaaucccacccgcgcccaaggauauucuggccucagcgucaaggugguuaacuccaccacagggccuggagagcaucugagaaaugcucuuuggcacacgggcaacacccccggccaggugcggacacuguggcacgauccucgccauaucggguggaaagacuucaccgccuacagauggcggcucucucaccgcccgaagacaggauucauuagagucgugauguacgaaggcaaaaagaucauggcugauagcgggcccauuuaugacaagaccuacgccggaggccggcuggggcuguuuguuuucucccaggagaugguguuuuucagcgaccuuaaauaugaaugcagagauccuuga

SEQ ID NO: 7544 - RNA, 3513 nt, Artificial Sequence
  derived and/or modified sequence opt6 from TSP-1__Homo_sapiens__AAI36470
auggguuuagcuuggggucuagguguauuauuuuugaugcauguauguggaacaaauagaauaccagaaucgggaggagauaauucaguauucgacauauuugaauuaacaggagcagcaagaaaaggcagcggaagaagacuuguuaagggaccugacccaaguagucccgcauuucguauagaggaugcuaaucuaauuccaccaguaccagaugauaaauuucaagauuuagucgaugcaguuagagcugaaaaagguuucuuauuauuagcaagcuuaagacaaaugaagaaaacaagagguacauuacuggcauuggaaaggaaagaccacagcgggcaaguauucucaguaguaucuaauggaaaggccggaacuuuagauuuaaguuugacaguccaaggaaagcaacacguaguaucgguugaagaggcccuauuagcuacaggacaguggaaaucgaucacauuauuuguacaagaagaucgagcacaauuauauauagauugugaaaaaauggaaaacgcagaauuggacgucccaauucaaucuguauuuacacgagauuuggcauccaucgcaagacuacgaauagcuaagggaggaguuaacgauaacuuccaagguguacuacaaaauguuagauuuguauucgggacaacaccagaagacauuuuaaggaauaaagguugcucaaguaguacuaguguauuauuaacguuggauaacaacguaguaaacgggaguucacccgcuauucgaacuaauuauaucggacacaaaaccaaagacuuacaagcaauuugugguauaucaugcgaugaauugagcucgaugguauuggaacucagagguuuacgaacaaucguuacaacacuucaagauagcauaagaaaaguaacagaagaaaacaaagaacuagcaaaugaacuccgacgaccaccguuaugcuaccauaacggcguacaauauagaaacaacgaagaauggacuguugauucauguacggaaugucacugucaaaauucuguaacaauauguaagaaaguaucguguccaauuaugccauguucuaaugcuacaguucccgacggagaauguugcccccgauguuggccaagugauucagcagaugauggcuggucgccauggagcgaauggacaagcugcucaacaucuugugguaaugguauacaacaacguggaagaucaugugauucuuuaaauaaucguugcgaaggaaguucugugcaaacucguacaugucauauccaagaaugugauaaacgcuucaaacaagacggaggauggucucacuggaguccauggagcucaugcagcguaacauguggagacggcguaauuaccagaauuaggcuauguaauaguccaagcccgcaaaugaaugggaaacccugugaaggagaagcaagagaaacaaaagcuuguaaaaaagaugccuguccaauaaaugggggauggggaccguggucaccaugggacauaugcucggucacaugcggcggagggguccaaaaaaggucuaggcuaugcaacaauccaacaccacaauuuggaggaaaagauugugucggagauguaaccgaaaaucaaauauguaacaagcaagauuguccaauagauggauguuuaucaaauccaugcuuugcaggaguaaagugcacuucauauccagacggaaguuggaaauguggagcuugcccuccaggauauucaggaaacgguauucaaugcacagauguagacgaauguaaagaaguaccugacgcauguuucaaucacaauggagaacacagaugcgagaauaccgauccuggguauaacugucuaccauguccaccaagauucacuggaagucagccuuuuggacaaggaguagaacaugcgacagcaaacaaacagguauguaaaccuagaaacccgugcacggacggaacacaugauugcaauaaaaacgcgaaauguaauuacuuaggucauuauucugauccuauguacagaugugaaugcaaaccuggauaugcaggaaacgguauaauauguggcgaagacacagauuuagaugguuggccaaacgaaaacuugguauguguggcaaaugcgacauaucauuguaaaaaagauaacugcccaaaucuaccuaauagcggucaagaagacuaugacaaagaugguauaggagacgccugugaugacgacgacgauaaugauaaaauaccugacgaucgggauaacuguccauuccacuacaaucccgcucaauaugauuaugacagggaugacguaggggaucgaugugauaacuguccauacaaccauaacccagaucaagcagauacugauaacaacggugaaggugaugcaugugcagcagauauagauggagacgguauauuaaacgagcgagacaauugucaguacguuuauaacguugaccaaagagauacagacauggaugguguaggagaucaaugugauaacuguccccuagaacacaauccagaccaacuugacagugauagugaccggauuggcgacacaugugauaacaaccaagauauagaugaagauggacaucaaaauaaccuagauaauuguccguacguaccaaaugcaaaucaagcagaucaugauaaagaugguaaaggagacgcuugugaccaugaugaugauaacgauggcauuccugaugauaaagacaauugcagacuaguaccaaaucccgaucaaaaagauagcgauggagacgggagaggugaugcuugcaaagaugauuuugaccaugacucaguuccagauauagaugauauuuguccagaaaauguugacauaucugaaacagauuuucgaagauuccaaaugauaccgcuagacccaaaaggaacuucacaaaaugauccaaauuggguaguaagacaucaaggaaaagagcuaguacaaacaguaaauugcgauccagggcuagcuguaggguaugacgaauuuaaugcaguagauuucucaggaaccuuuuuuaucaauacugaaagagaugacgauuaugcuggauuuguauuuggcuaucagucaagcagcagauuuuacguaguaauguggaaacaaguuacucaaagcuauugggauacaaauccaacaagagcacaaggauacucaggacuuagcguaaaaguuguaaacucaacaacagguccaggagaacaccucagaaaugcacuuuggcauacagguaauacaccgggucaagugagaacacuuuggcacgauccuagacauauaggauggaaagauuucacagcauaccgauggcgauuaucacacagaccaaagacaggauuuauaagaguaguaauguaugagggaaagaaaauaauggcagauuccggaccaauauaugauaagaccuaugccggaggaagauuaggauuauuuguauucagccaagaaaugguauucuucagcgacuugaaauaugaauguagagauccauaa

SEQ ID NO: 7545 - protein, 1172 aa, Artificial Sequence
  TSP-2__Homo_sapiens__P35442
MVWRLVLLALWVWPSTQAGHQDKDTTFDLFSISNINRKTIGAKQFRGPDPGVPAYRFVRFDYIPPVNADDLSKITKIMRQKEGFFLTAQLKQDGKSRGTLLALEGPGLSQRQFEIVSNGPADTLDLTYWIDGTRHVVSLEDVGLADSQWKNVTVQVAGETYSLHVGCDLIDSFALDEPFYEHLQAEKSRMYVAKGSARESHFRGLLQNVHLVFENSVEDILSKKGCQQGQGAEINAISENTETLRLGPHVTTEYVGPSSERRPEVCERSCEELGNMVQELSGLHVLVNQLSENLKRVSNDNQFLWELIGGPPKTRNMSACWQDGRFFAENETWVVDSCTTCTCKKFKTICHQITCPPATCASPSFVEGECCPSCLHSVDGEEGWSPWAEWTQCSVTCGSGTQQRGRSCDVTSNTCLGPSIQTRACSLSKCDTRIRQDGGWSHWSPWSSCSVTCGVGNITRIRLCNSPVPQMGGKNCKGSGRETKACQGAPCPIDGRWSPWSPWSACTVTCAGGIRERTRVCNSPEPQYGGKACVGDVQERQMCNKRSCPVDGCLSNPCFPGAQCSSFPDGSWSCGSCPVGFLGNGTHCEDLDECALVPDICFSTSKVPRCVNTQPGFHCLPCPPRYRGNQPVGVGLEAAKTEKQVCEPENPCKDKTHNCHKHAECIYLGHFSDPMYKCECQTGYAGDGLICGEDSDLDGWPNLNLVCATNATYHCIKDNCPHLPNSGQEDFDKDGIGDACDDDDDNDGVTDEKDNCQLLFNPRQADYDKDEVGDRCDNCPYVHNPAQIDTDNNGEGDACSVDIDGDDVFNERDNCPYVYNTDQRDTDGDGVGDHCDNCPLVHNPDQTDVDNDLVGDQCDNNEDIDDDGHQNNQDNCPYISNANQADHDRDGQGDACDPDDDNDGVPDDRDNCRLVFNPDQEDLDGDGRGDICKDDFDNDNIPDIDDVCPENNAISETDFRNFQMVPLDPKGTTQIDPNWVIRHQGKELVQTANSDPGIAVGFDEFGSVDFSGTFYVNTDRDDDYAGFVFGYQSSSRFYVVMWKQVTQTYWEDQPTRAYGYSGVSLKVVNSTTGTGEHLRNALWHTGNTPGQVRTLWHDPRNIGWKDYTAYRWHLTHRPKTGYIRVLVHEGKQVMADSGPIYDQTYAGGRLGLFVFSQEMVYFSDLKYECRDI

SEQ ID NO: 7546 - RNA, 3519 nt, Artificial Sequence
  TSP-2__Homo_sapiens__BAF85118
auggucuggaggcugguccugcuggcucuguggguguggcccagcacgcaagcuggucaccaggacaaagacacgaccuucgaccuuuucaguaucagcaacaucaaccgcaagaccauuggcgccaagcaguuccgcgggcccgaccccggcgugccggcuuaccgcuucgugcgcuuugacuacaucccaccggugaacgcagaugaccucagcaagaucaccaagaucaugcggcagaaggagggcuucuuccucacggcccagcucaagcaggacggcaaguccaggggcacgcuguuggcucuggagggccccggucucucccagaggcaguucgagaucgucuccaauggccccgcggacacgcuggaucucaccuacuggauugacggcacccggcauguggucucccuggaggacgucggccuggcugacucgcaguggaagaacgucaccgugcagguggcuggcgagaccuacagcuugcacgugggcugcgaccucauagacagcuucgcucuggacgagcccuucuacgagcaccugcaggcggaaaagagccggauguacguggccaaaggcucugccagagagagucacuucagggguuugcuucagaacguccaccuaguguuugaaaacucuguggaagauauucuaagcaagaaggguugccagcaaggccagggagcugagaucaacgccaucagugagaacacagagacgcugcgccuggguccgcaugucaccaccgaguacgugggccccagcucggagaggaggcccgaggugugcgaacgcucgugcgaggagcugggaaacaugguccaggagcucucggggcuccacguccucgugaaccagcucagcgagaaccucaagagagugucgaaugauaaccaguuucucugggagcucauugguggcccuccuaagacaaggaacaugucagcuugcuggcaggauggccgguucuuugcggaaaaugaaacgugggugguggacagcugcaccacguguaccugcaagaaauuuaaaaccauuugccaccaaaucaccugcccgccugcaaccugcgccaguccauccuuuguggaaggcgaaugcugcccuuccugccuccacucgguggacggugaggagggcuggucuccgugggcagaguggacccagugcuccgugacguguggcucugggacccagcagagaggccgguccugugacgucaccagcaacaccugcuuggggcccuccauccagacacgggcuugcagucugagcaagugugacacccgcauccggcaggacggcggcuggagccacuggucaccuuggucuucaugcucugugaccuguggaguuggcaauaucacacgcauccgucucugcaacuccccagugccccagauggggggcaagaauugcaaagggaguggccgggagaccaaagccugccagggcgccccaugcccaaucgauggccgcuggagccccugguccccguggucggccugcacugucaccugugccggugggauccgggagcgcacccgggucugcaacagcccugagccucaguacggagggaaggccugcgugggggaugugcaggagcgucagaugugcaacaagaggagcugccccguggauggcuguuuauccaaccccugcuucccgggagcccagugcagcagcuuccccgauggguccuggucaugcggcuccugcccugugggcuucuugggcaauggcacccacugugaggaccuggacgagugugcccugguccccgacaucugcuucuccaccagcaaggugccucgcugugucaacacucagccuggcuuccacugccugcccugcccgccccgauacagagggaaccagcccgucggggucggccuggaagcagccaagacggaaaagcaagugugugagcccgaaaacccaugcaaggacaagacacacaacugccacaagcacgcggagugcaucuaccugggccacuucagcgaccccauguacaagugcgagugccagacaggcuacgcgggcgacgggcucaucugcggggaggacucggaccuggacggcuggcccaaccucaaucuggucugcgccaccaacgccaccuaccacugcaucaaggauaacugcccccaucugccaaauucugggcaggaagacuuugacaaggacgggauuggcgaugccugugaugaugacgaugacaaugacggugugaccgaugagaaggacaacugccagcuccucuucaauccccgccaggcugacuaugacaaggaugagguuggggaccgcugugacaacugcccuuacgugcacaacccugcccagaucgacacagacaacaauggagagggugacgccugcuccguggacauugauggggacgaugucuucaaugaacgagacaauugucccuacgucuacaacacugaccagagggacacggauggugacggugugggggaucacugugacaacugcccccuggugcacaacccugaccagaccgacguggacaaugaccuuguuggggaccagugugacaacaacgaggacauagaugacgacggccaccagaacaaccaggacaacugccccuacaucuccaacgccaaccaggcugaccaugacagagacggccagggcgacgccugugacccugaugaugacaacgauggcguccccgaugacagggacaacugccggcuuguguucaacccagaccaggaggacuuggacggugauggacggggugauauuuguaaagaugauuuugacaaugacaacaucccagauauugaugauguguguccugaaaacaaugccaucagugagacagacuucaggaacuuccagaugguccccuuggaucccaaagggaccacccaaauugaucccaacugggucauucgccaucaaggcaaggagcugguucagacagccaacucggaccccggcaucgcuguagguuuugacgaguuugggucuguggacuucaguggcacauucuacguaaacacugaccgggacgacgacuaugccggcuucgucuuugguuaccagucaagcagccgcuucuauguggugauguggaagcaggugacgcagaccuacugggaggaccagcccacgcgggccuauggcuacuccggcgugucccucaagguggugaacuccaccacggggacgggcgagcaccugaggaacgcgcuguggcacacggggaacacgccggggcaggugcgaaccuuauggcacgaccccaggaacauuggcuggaaggacuacacggccuauagguggcaccugacucacaggcccaagacuggcuacaucagagucuuagugcaugaaggaaaacaggucauggcagacucaggaccuaucuaugaccaaaccuacgcuggcgggcggcugggucuauuugucuucucucaagaaauggucuauuucucagaccucaaguacgaaugcagagauauuuaa

SEQ ID NO: 7547 - RNA, 3519 nt, Artificial Sequence
  derived and/or modified sequence opt1 from TSP-2__Homo_sapiens__BAF85118
augguguggcgccugguccuccuggcccuguggguguggcccagcacccaggccggccaccaggacaaggacaccacguucgaccucuucuccaucagcaacaucaaccggaagaccaucggggcgaagcaguuccgcggcccggaccccggggugcccgccuaccgguucguccgcuucgacuacaucccgcccgugaacgccgacgaccuguccaagaucaccaagaucaugcggcagaaggagggcuucuuccugaccgcccagcucaagcaggacggcaagagccgcgggacgcugcuggcccucgagggccccgggcugucccagcggcaguucgagaucgugagcaacggccccgcggacacccuggaccucaccuacuggaucgacgggacccgccacgucgugucccuggaggacgugggccuggccgacagccaguggaagaacgucacgguccagguggccggggagaccuacucccuccacgugggcugcgaccugaucgacagcuucgcccuggacgagcccuucuacgagcaccuccaggcggagaagucccggauguacguggccaagggcagcgcccgcgagucccacuuccgggggcugcugcagaacgugcaccucgucuucgagaacagcguggaggacauccuguccaagaagggcugccagcaggggcagggcgccgagaucaacgccaucagcgagaacaccgagacccugcgccucggcccgcacgugacgaccgaguacgucgggcccuccagcgagcggcgccccgaggugugcgagcgguccugcgaggagcugggcaacauggugcaggagcugagcgggcuccacguccuggugaaccagcugagcgagaaccucaagcgcguguccaacgacaaccaguuccugugggagcugaucggcgggcccccgaagacccggaacaugagcgcgugcuggcaggacggccgcuucuucgccgagaacgagaccugggucguggacuccugcacgaccugcacgugcaagaaguucaagaccaucugccaccagaucacgugcccgcccgcgaccugcgccagccccuccuucgucgagggcgagugcugccccagcugccuccacuccguggacggggaggagggcuggagccccugggccgaguggacccagugcuccgugaccugcgggagcggcacccagcagcgggggcgcuccugcgacgucaccagcaacacgugccugggccccuccauccagacccgggcgugcagccuguccaagugcgacacccgcauccgccaggacggcggguggagccacuggucccccuggagcuccugcagcgugaccugcggcguggggaacaucacccggauccgccucugcaacagcccggucccccagaugggcgggaagaacugcaagggcuccggccgggagaccaaggccugccagggggcccccugccccaucgacggccgcuggagcccguggucccccuggagcgccugcacggugaccugcgccgggggcauccgggagcgcacccgggugugcaacucccccgagccccaguacggcgggaaggcgugcgucggcgacgugcaggagcgccagaugugcaacaagcggagcugcccgguggacgggugccuguccaaccccugcuuccccggcgcccagugcagcuccuucccggacgggagcugguccugcggcagcugccccgucggcuuccuggggaacggcacccacugcgaggaccucgacgagugcgcccuggugcccgacaucugcuucuccacgagcaaggugccccgcugcgucaacacccagccgggguuccacugccugcccugcccgccccgguaccgcggcaaccagcccgugggggugggccucgaggccgccaagaccgagaagcaggucugcgagcccgagaaccccugcaaggacaagacccacaacugccacaagcacgcggagugcaucuaccugggccacuucuccgaccccauguacaagugcgagugccagaccggguacgccggcgacgggcugaucugcggcgaggacagcgaccucgacggguggccgaaccugaaccuggugugcgccacgaacgccaccuaccacugcaucaaggacaacugcccccaccuccccaacuccggccaggaggacuucgacaaggacggcaucggggacgcgugcgacgacgacgacgacaacgacggcgugaccgacgagaaggacaacugccagcugcuguucaacccccggcaggccgacuacgacaaggacgaggucggggaccgcugcgacaacugcccguacgugcacaaccccgcccagaucgacaccgacaacaacggcgagggggacgccugcagcguggacaucgacggcgacgacgucuucaacgagcgggacaacugccccuacguguacaacacggaccagcgcgacaccgacggcgacggggugggcgaccacugcgacaacugcccccugguccacaacccggaccagaccgacguggacaacgaccucgugggggaccagugcgacaacaacgaggacaucgacgacgacggccaccagaacaaccaggacaacugccccuacaucagcaacgccaaccaggcggaccacgaccgggacggccagggggacgccugcgaccccgacgacgacaacgacggcguccccgacgaccgcgacaacugccggcugguguucaacccggaccaggaggaccuggacggggacggccgcggggacaucugcaaggacgacuucgacaacgacaacauccccgacaucgacgacgugugccccgagaacaacgccaucuccgagaccgacuuccgcaacuuccagauggucccgcucgaccccaagggcacgacccagaucgaccccaacugggugauccggcaccagggcaaggagcuggugcagaccgccaacagcgaccccgggaucgccgucggcuucgacgaguucggguccguggacuucagcggcaccuucuacgugaacacggaccgcgacgacgacuacgcgggguucgucuucggcuaccaguccagcucccgguucuacguggugauguggaagcaggucacccagaccuacugggaggaccagccgacccgcgccuacggcuacagcggggugucccugaagguggucaacagcacgaccggcaccggggagcaccuccggaacgcccuguggcacaccggcaacacgcccggccaggugcgcacccuguggcacgacccccggaacaucggguggaaggacuacaccgccuaccgcuggcaccucacccaccggcccaagacgggcuacauccgcgugcugguccacgaggggaagcaggucauggccgacuccggcccgaucuacgaccagaccuacgccgggggccggcugggccucuucguguucagccaggagaugguguacuucuccgaccugaaguacgagugccgcgacaucuga

SEQ ID NO: 7548 - RNA, 3519 nt, Artificial Sequence
  derived and/or modified sequence opt2 from TSP-2__Homo_sapiens__BAF85118
auggucuggcgccucguccuccucgcccucugggucuggcccuccacccaggccggccaccaggacaaggacaccaccuucgaccucuucuccaucuccaacaucaaccgcaagaccaucggcgccaagcaguuccgcggccccgaccccggcguccccgccuaccgcuucguccgcuucgacuacaucccccccgucaacgccgacgaccucuccaagaucaccaagaucaugcgccagaaggagggcuucuuccucaccgcccagcucaagcaggacggcaagucccgcggcacccuccucgcccucgagggccccggccucucccagcgccaguucgagaucgucuccaacggccccgccgacacccucgaccucaccuacuggaucgacggcacccgccacgucgucucccucgaggacgucggccucgccgacucccaguggaagaacgucaccguccaggucgccggcgagaccuacucccuccacgucggcugcgaccucaucgacuccuucgcccucgacgagcccuucuacgagcaccuccaggccgagaagucccgcauguacgucgccaagggcuccgcccgcgagucccacuuccgcggccuccuccagaacguccaccucgucuucgagaacuccgucgaggacauccucuccaagaagggcugccagcagggccagggcgccgagaucaacgccaucuccgagaacaccgagacccuccgccucggcccccacgucaccaccgaguacgucggccccuccuccgagcgccgccccgaggucugcgagcgcuccugcgaggagcucggcaacaugguccaggagcucuccggccuccacguccucgucaaccagcucuccgagaaccucaagcgcgucuccaacgacaaccaguuccucugggagcucaucggcggcccccccaagacccgcaacauguccgccugcuggcaggacggccgcuucuucgccgagaacgagaccugggucgucgacuccugcaccaccugcaccugcaagaaguucaagaccaucugccaccagaucaccugcccccccgccaccugcgccucccccuccuucgucgagggcgagugcugccccuccugccuccacuccgucgacggcgaggagggcuggucccccugggccgaguggacccagugcuccgucaccugcggcuccggcacccagcagcgcggccgcuccugcgacgucaccuccaacaccugccucggccccuccauccagacccgcgccugcucccucuccaagugcgacacccgcauccgccaggacggcggcuggucccacuggucccccugguccuccugcuccgucaccugcggcgucggcaacaucacccgcauccgccucugcaacucccccgucccccagaugggcggcaagaacugcaagggcuccggccgcgagaccaaggccugccagggcgcccccugccccaucgacggccgcuggucccccuggucccccugguccgccugcaccgucaccugcgccggcggcauccgcgagcgcacccgcgucugcaacucccccgagccccaguacggcggcaaggccugcgucggcgacguccaggagcgccagaugugcaacaagcgcuccugccccgucgacggcugccucuccaaccccugcuuccccggcgcccagugcuccuccuuccccgacggcuccugguccugcggcuccugccccgucggcuuccucggcaacggcacccacugcgaggaccucgacgagugcgcccucguccccgacaucugcuucuccaccuccaaggucccccgcugcgucaacacccagcccggcuuccacugccuccccugccccccccgcuaccgcggcaaccagcccgucggcgucggccucgaggccgccaagaccgagaagcaggucugcgagcccgagaaccccugcaaggacaagacccacaacugccacaagcacgccgagugcaucuaccucggccacuucuccgaccccauguacaagugcgagugccagaccggcuacgccggcgacggccucaucugcggcgaggacuccgaccucgacggcuggcccaaccucaaccucgucugcgccaccaacgccaccuaccacugcaucaaggacaacugcccccaccuccccaacuccggccaggaggacuucgacaaggacggcaucggcgacgccugcgacgacgacgacgacaacgacggcgucaccgacgagaaggacaacugccagcuccucuucaacccccgccaggccgacuacgacaaggacgaggucggcgaccgcugcgacaacugccccuacguccacaaccccgcccagaucgacaccgacaacaacggcgagggcgacgccugcuccgucgacaucgacggcgacgacgucuucaacgagcgcgacaacugccccuacgucuacaacaccgaccagcgcgacaccgacggcgacggcgucggcgaccacugcgacaacugcccccucguccacaaccccgaccagaccgacgucgacaacgaccucgucggcgaccagugcgacaacaacgaggacaucgacgacgacggccaccagaacaaccaggacaacugccccuacaucuccaacgccaaccaggccgaccacgaccgcgacggccagggcgacgccugcgaccccgacgacgacaacgacggcguccccgacgaccgcgacaacugccgccucgucuucaaccccgaccaggaggaccucgacggcgacggccgcggcgacaucugcaaggacgacuucgacaacgacaacauccccgacaucgacgacgucugccccgagaacaacgccaucuccgagaccgacuuccgcaacuuccagauggucccccucgaccccaagggcaccacccagaucgaccccaacugggucauccgccaccagggcaaggagcucguccagaccgccaacuccgaccccggcaucgccgucggcuucgacgaguucggcuccgucgacuucuccggcaccuucuacgucaacaccgaccgcgacgacgacuacgccggcuucgucuucggcuaccaguccuccucccgcuucuacgucgucauguggaagcaggucacccagaccuacugggaggaccagcccacccgcgccuacggcuacuccggcgucucccucaaggucgucaacuccaccaccggcaccggcgagcaccuccgcaacgcccucuggcacaccggcaacacccccggccagguccgcacccucuggcacgacccccgcaacaucggcuggaaggacuacaccgccuaccgcuggcaccucacccaccgccccaagaccggcuacauccgcguccucguccacgagggcaagcaggucauggccgacuccggccccaucuacgaccagaccuacgccggcggccgccucggccucuucgucuucucccaggagauggucuacuucuccgaccucaaguacgagugccgcgacaucuga

SEQ ID NO: 7549 - RNA, 3519 nt, Artificial Sequence
  derived and/or modified sequence opt3 from TSP-2__Homo_sapiens__BAF85118
augguguggagacugguccuccuugcccuguggguuuggcccagcacccaggcuggccaccaagacaaggauacaacuuucgacuuguuuuccaucucuaacauuaauaggaaaacgauaggggcaaagcaguuccggggaccugauccaggugugccggccuaccgcuuuguacgauucgacuauaucccaccugugaacgcggaugacuuaucaaaaauuaccaagaucaugcgucagaaagagggcuuuuuccugacagcucagcuaaagcaagaugggaagaguagaggaacucuccuggcccuugaaggcccaggucugagccagaggcaguuugagauugucuccaaugggcccgcagacaccuuggaucucacauacuggaucgacggaacccggcaugugguuucucuggaagaugugggccuggccgacucgcaguggaaaaacgucacugugcaaguagcuggcgagacauauucacuccacguugggugcgauuuaauagacagcuucgcacuggacgaaccuuuuuacgagcaucuucaggccgagaagagucgcauguauguggcuaaaggauccgccagagaaucucacuucagggguuugcugcagaauguccaucuaguguuugagaacagcguggaagauauccucuccaagaaaggcugucagcaagggcagggagcggagauuaaugcaaucucagagaacaccgaaacgcugcggcuuggcccacacgucacuaccgaguacguuggucccaguagcgaacgccgaccugaggugugcgaaagaucuugugaggagcuggggaauaugguacaggaauuguccggacuccacgugcuggucaaccaauuaucagagaaucugaagagggugagcaacgacaaucaguuccucugggaacuuauuggcggcccaccgaagacacggaacaugagugccugcuggcaggaugggcgcuuuuucgcugagaaugaaacuuggguuguggacucuuguaccacaugcaccuguaaaaaguucaaaacgaucugccaucagauaacuugucccccugccacaugcgcaucccccagcuuugucgagggagaguguugccccucgugccugcacucuguggauggugaagagggcugguccccuugggcugaauggacccaauguucaguaacuugcgggaguggaacacagcagcguggcagaagcugugacguuaccuccaacacgugcuuggguccaucuauucagaccagggccuguagccuaucaaagugcgauacacggauccgacaagacgggggcuggagucauuggucccccuggagcucuuguucagugacuugcggagucggcaacauuacccgcaucagacuguguaauaguccggugccucagaugggagggaaaaacugcaaggguagcggcagggagacaaaagcgugucagggggcccccugcccaaucgauggacggugguccccuuggucucccuggucggcaugcacugucaccugugcuggcgguauucgcgaaagaacaagggugugcaauagcccagagccccaguaugggggcaaggccuguguuggagacgugcaagagcgucagaugugcaacaagcgguccuguccuguagauggcugccucucaaauccauguuucccgggggcucagugcaguucuuuucccgacggaagcugguccugugguucaugcccugucggcuuccuggggaacggaacccacugugaagaccuugaugagugcgcccuggugccagacauaugcuuuagcacuucuaaaguuccccgaugugugaauacgcagccuggcuuccacugcuugccaugucccccgagauacagggguaaccaaccugucggggugggccucgaagcagccaagacagagaaacagguaugcgagccagaaaaucccuguaaggauaaaacccauaacugccacaagcaugcugaguguaucuaccugggacacuuuuccgacccuauguauaagugcgaaugucagacuggcuacgcgggggauggauuaauuugcggcgaggacagugaucuggacgguuggcccaaucuaaaccucgugugugcaaccaaugccacauaucauugcaucaaagauaacugcccacaucugccuaauagcgggcaagaagacuucgauaaggacggaauaggcgaugcuugugacgacgaugacgauaacgacgguguuaccgaugagaaagacaacugccagcuuuuguuuaauccccgccaggccgauuacgacaaggaugaggucggcgaccggugugauaacugcccauaugugcacaauccggcacagauugacacugauaacaauggggaaggagacgccuguucuguggacaucgauggcgacgaugucuucaacgagagagacaauugcccuuacguuuauaacacagaucaaagggacacggauggggacggagugggcgaucacugugacaauugcccccuggugcacaacccagaucagaccgacguagacaaugaucucgucggugaccagugugauaacaaugaagacaucgaugacgaugggcaucagaacaaucaagacaacugccccuacauuuccaacgcuaaucaggccgaucacgaccgcgauggacagggcgacgcaugugauccugacgacgauaacgacggugugccagaugaccgagauaauugccggcugguuuuuaaccccgaccaggaggaucuugacggcgaugggcguggagacaucugcaaagaugacuucgauaaugacaacauuccugacauagaugacguguguccggaaaauaacgcgaucucagagacugauuuuagaaauuuccaaauggucccacuggaccccaagggcacaacccagauugauccuaacugggugaucaggcaccaggggaaggaguugguucaaacagcuaauagugacccaggaaucgccgugggcuucgaugaauuugguagcguagacuucucggggacuuuuuacgucaacaccgaucgcgacgaugacuaugcaggauucguguuuggcuaccaguccucuagccgguucuauguggucauguggaaacagguuacgcagaccuacugggaggaccaacccacaagagccuaugguuacucaggcgugagucucaagguagugaacuccacuaccgggacaggagaacaucugaggaaugcuuuauggcacacuggcaauaccccugggcagguccgaacgcuguggcaugauccgcgcaacauuggauggaaagacuauacagccuaccgguggcaccuaacccauagacccaagacuggcuacauaagggugcucguucacgaggguaaacaggugauggcagauucugggccaaucuaugaccagacauacgcuggaggccgucugggccuuuuugucuucagccaagaaaugguguauuuuuccgauuugaaguacgagugccgcgacauuuga

SEQ ID NO: 7550 - RNA, 3519 nt, Artificial Sequence
  derived and/or modified sequence opt4 from TSP-2__Homo_sapiens__BAF85118
augguguggagacuggugcugcuggcccuguggguguggcccagcacccaggccggccaccaggacaaggacaccaccuucgaccuguucagcaucagcaacaucaacagaaagaccaucggcgccaagcaguucagaggccccgaccccggcgugcccgccuacagauucgugagauucgacuacaucccccccgugaacgccgacgaccugagcaagaucaccaagaucaugagacagaaggagggcuucuuccugaccgcccagcugaagcaggacggcaagagcagaggcacccugcuggcccuggagggccccggccugagccagagacaguucgagaucgugagcaacggccccgccgacacccuggaccugaccuacuggaucgacggcaccagacacguggugagccuggaggacgugggccuggccgacagccaguggaagaacgugaccgugcagguggccggcgagaccuacagccugcacgugggcugcgaccugaucgacagcuucgcccuggacgagcccuucuacgagcaccugcaggccgagaagagcagaauguacguggccaagggcagcgccagagagagccacuucagaggccugcugcagaacgugcaccugguguucgagaacagcguggaggacauccugagcaagaagggcugccagcagggccagggcgccgagaucaacgccaucagcgagaacaccgagacccugagacugggcccccacgugaccaccgaguacgugggccccagcagcgagagaagacccgaggugugcgagagaagcugcgaggagcugggcaacauggugcaggagcugagcggccugcacgugcuggugaaccagcugagcgagaaccugaagagagugagcaacgacaaccaguuccugugggagcugaucggcggcccccccaagaccagaaacaugagcgccugcuggcaggacggcagauucuucgccgagaacgagaccugggugguggacagcugcaccaccugcaccugcaagaaguucaagaccaucugccaccagaucaccugcccccccgccaccugcgccagccccagcuucguggagggcgagugcugccccagcugccugcacagcguggacggcgaggagggcuggagccccugggccgaguggacccagugcagcgugaccugcggcagcggcacccagcagagaggcagaagcugcgacgugaccagcaacaccugccugggccccagcauccagaccagagccugcagccugagcaagugcgacaccagaaucagacaggacggcggcuggagccacuggagccccuggagcagcugcagcgugaccugcggcgugggcaacaucaccagaaucagacugugcaacagccccgugccccagaugggcggcaagaacugcaagggcagcggcagagagaccaaggccugccagggcgcccccugccccaucgacggcagauggagccccuggagccccuggagcgccugcaccgugaccugcgccggcggcaucagagagagaaccagagugugcaacagccccgagccccaguacggcggcaaggccugcgugggcgacgugcaggagagacagaugugcaacaagagaagcugccccguggacggcugccugagcaaccccugcuuccccggcgcccagugcagcagcuuccccgacggcagcuggagcugcggcagcugccccgugggcuuccugggcaacggcacccacugcgaggaccuggacgagugcgcccuggugcccgacaucugcuucagcaccagcaaggugcccagaugcgugaacacccagcccggcuuccacugccugcccugcccccccagauacagaggcaaccagcccgugggcgugggccuggaggccgccaagaccgagaagcaggugugcgagcccgagaaccccugcaaggacaagacccacaacugccacaagcacgccgagugcaucuaccugggccacuucagcgaccccauguacaagugcgagugccagaccggcuacgccggcgacggccugaucugcggcgaggacagcgaccuggacggcuggcccaaccugaaccuggugugcgccaccaacgccaccuaccacugcaucaaggacaacugcccccaccugcccaacagcggccaggaggacuucgacaaggacggcaucggcgacgccugcgacgacgacgacgacaacgacggcgugaccgacgagaaggacaacugccagcugcuguucaaccccagacaggccgacuacgacaaggacgaggugggcgacagaugcgacaacugccccuacgugcacaaccccgcccagaucgacaccgacaacaacggcgagggcgacgccugcagcguggacaucgacggcgacgacguguucaacgagagagacaacugccccuacguguacaacaccgaccagagagacaccgacggcgacggcgugggcgaccacugcgacaacugcccccuggugcacaaccccgaccagaccgacguggacaacgaccuggugggcgaccagugcgacaacaacgaggacaucgacgacgacggccaccagaacaaccaggacaacugccccuacaucagcaacgccaaccaggccgaccacgacagagacggccagggcgacgccugcgaccccgacgacgacaacgacggcgugcccgacgacagagacaacugcagacugguguucaaccccgaccaggaggaccuggacggcgacggcagaggcgacaucugcaaggacgacuucgacaacgacaacauccccgacaucgacgacgugugccccgagaacaacgccaucagcgagaccgacuucagaaacuuccagauggugccccuggaccccaagggcaccacccagaucgaccccaacugggugaucagacaccagggcaaggagcuggugcagaccgccaacagcgaccccggcaucgccgugggcuucgacgaguucggcagcguggacuucagcggcaccuucuacgugaacaccgacagagacgacgacuacgccggcuucguguucggcuaccagagcagcagcagauucuacguggugauguggaagcaggugacccagaccuacugggaggaccagcccaccagagccuacggcuacagcggcgugagccugaagguggugaacagcaccaccggcaccggcgagcaccugagaaacgcccuguggcacaccggcaacacccccggccaggugagaacccuguggcacgaccccagaaacaucggcuggaaggacuacaccgccuacagauggcaccugacccacagacccaagaccggcuacaucagagugcuggugcacgagggcaagcaggugauggccgacagcggccccaucuacgaccagaccuacgccggcggcagacugggccuguucguguucagccaggagaugguguacuucagcgaccugaaguacgagugcagagacaucuga

SEQ ID NO: 7551 - RNA, 3519 nt, Artificial Sequence
  derived and/or modified sequence opt5 from TSP-2__Homo_sapiens__BAF85118
augguguggagacugguccuccuggcccuuuggguuuggcccagcacccaggcuggccaccaagacaaggauacaacguucgaccuguuuuccaucucuaacauuaaucggaaaaccaucggggccaagcaguuccgcggaccugauccgggcgugcccgcguacagauuugugcgguucgacuauauuccucccgucaacgcugaugaccucagcaaaaucacaaagauuaugcgccagaaagagggguuuuuccugaccgcccagcuuaagcaagauggaaaguccagaggcacacugcucgcccuggaagggccuggacugucucagcggcaguuugagaucgugagcaauggccccgcugacacccucgaucugacauacuggaucgacggcacccgccauguugugucccuugaagaugucgggcuggccgacucucaguggaaaaacgugacgguucaaguggcuggagagaccuauagccuccacgucggcugcgaucugauugacuccuucgcccuugacgaaccuuuuuacgagcaucugcaggcggagaagucuagaauguauguggccaaagggucugcucgggaaucccacuuccgcggacuccugcagaaugugcaucuggucuuugagaacagcguugaagauauccucucuaagaaaggcugucagcaagggcagggagccgagauuaaugcuaucuccgagaacacagaaacccugagacuuggcccgcacgugacaaccgaguacgugggccccagcucugaacggcgcccugaggucugcgaaagauccugugaggagcuggggaauauggugcaggaacucagcggacugcacguucuugugaaccaacuguccgagaaucucaagcgggucucuaacgacaaucaguuccugugggaacugauuggcgggcccccuaagacgcgcaacaugagcgccugcuggcaggauggaagauuuuucgcggagaaugaaacaugggugguugacuccuguaccacaugcaccuguaaaaaguucaaaaccaucugccaucagauuacaugucccccggccacgugcgcuagcccuucuuuuguggagggcgaguguugccccuccugccuccacagcgucgauggggaagagggauggucuccuugggccgaauggacccaauguagcgugacaugcggcuccggcacccagcagcgggggagaucuugugacgucacaagcaauaccugccugggacccuccauccagacgcgcgcuuguagccuuucuaagugcgauacacggaucagacaagacggcggguggucccauuggagccccuggucuuccuguagcgugaccugcggaguuggcaacauuacccgcauccggcuguguaacuccccugugccgcagaugggcgggaaaaacugcaagggaucuggcagagagacaaaagccugucagggggcccccugcccuauugauggacgcuggagccccugguccccuuggucugcuugcaccgucacaugugcgggcgggauccgggaaagaacgcgcgugugcaauagccccgagccgcaguauggaggcaaggccuguguuggggacgugcaagagcggcagaugugcaacaagagauccuguccugucgauggcugccucagcaaucccuguuucccuggagcucagugcagcuccuuucccgacggcagcuggucuuguggguccugcccugugggauuccugggcaacgggacccacugugaagaccuugaugagugcgcccuggugcccgacauuugcuuuagcacaucuaaaguuccgcgcugugucaauacccagccuggauuccacugccuccccugucccccucgguacagaggcaaccaaccggugggggugggccuggaagccgcuaagacagagaaacaggucugcgagcccgaaaauccuuguaaggauaaaacccauaacugccacaagcaugccgaguguaucuaccugggacacuuuagcgaccccauguauaagugcgaaugucagacgggcuacgcgggggauggacucaucugcggcgaggacuccgaucuggacggguggccuaaucuuaaccuggugugugcuaccaaugccacauaucauugcauuaaagauaacugcccccaccucccuaauagcggacaagaagacuucgauaaggacggcaucggggaugccugugacgacgaugacgauaacgacggcguuaccgaugagaaagacaacugccagcugcuguuuaauccccggcaggcugauuacgacaaggaugaggugggagaccgcugugauaacugcccguauguccacaauccugcccagauugacacagauaacaauggcgaaggggacgcuuguucuguggacaucgauggagacgauguuuucaacgagagagacaauugccccuacguguauaacaccgaucaacgggacacggauggcgacggggucggagaucauugugacaauugcccucuugugcacaaccccgaucagacagacguugacaaugaucucgugggcgaccagugugauaacaaugaagacauugaugacgauggccaucagaacaaucaagacaacugcccguacaucuccaacgccaaucaggcggaucacgacagagaugggcagggagacgccugugauccugacgacgauaacgacggcguccccgaugaccgcgauaauugccggcugguguuuaacccugaccaggaggaucuggacggggauggaagaggcgacaucugcaaagaugacuucgauaaugacaacauucccgacaucgaugacgugugucccgaaaauaacgcuauuagcgagaccgauuuucgcaauuuccaaauggucccucucgacccgaaggggacaacccagaucgaucccaacuggguuauuagacaccagggaaaggagcuggugcaaaccgccaauuccgacccuggcaucgcugugggcuucgaugaauuugggucugucgacuucagcggaacauuuuacgugaacacggaucgggacgaugacuaugccggcuucguuuuuggguaccaguccucuagccgcuucuauguggucauguggaaacaggugacccagacauacugggaggaccaacccaccagagcguauggauacuccggcguuucucuuaagguggucaauagcacaaccgggacgggagaacaucugcggaacgcccucuggcacacaggcaauaccccuggccaggugcgcacccuguggcaugaucccagaaacauuggguggaaagacuauacagcuuaccgguggcaccugacccaucgcccuaagacaggauacaucagaguucuugugcacgagggcaaacaggucauggccgauuccgggccgaucuaugaccagacguacgcuggaggccggcucgggcuguuuguguucagccaagaaaugguguauuuuucugaucugaaguacgagugccgcgacauuuga

SEQ ID NO: 7552 - RNA, 3519 nt, Artificial Sequence
  derived and/or modified sequence opt6 from TSP-2__Homo_sapiens__BAF85118
augguuuggagauuaguguuacuagcacuauggguauggccaaguacccaagcagggcaucaagauaaagauacuacauuugaucuauuuaguauuucuaacauaaauagaaaaacaauaggugcaaaacaauucagggguccugauccuggaguuccagccuaucguuuuguaagauuugauuauauaccaccuguaaacgccgaugacuuaucaaaaauaacaaaaauaaugagacaaaaagaaggcuuuuuucuaacugcacaacuuaaacaagauggaaaauccagagguacacuauuagcauuagaagggcccggauuaucacaaagacaauucgaaauuguaaguaaugggccugccgauacacuagauuugacguacuggauagauggaacaagacacguugugagcuuagaagaugucggauuagcagauucacaauggaaaaauguaacaguacagguugcaggugaaacauauuccuugcauguaggaugcgauuuaauagauucguuugccuuagaugaaccauucuacgaacaccuacaagcugaaaaaucacggauguauguagcaaaaggaagugcaagagagucacauuucagaggacuguuacaaaacguucacuuagucuuugagaauucagucgaggacauauuaucaaagaaagguugucaacaaggucaaggugcagaaauuaaugcuauaagugagaauacagaaacucuaagauuagguccgcauguaacaacggaauaugucgguccgagcagcgaaaggagaccagaaguuugugaaagaucaugcgaagaauugggaaauaugguccaagaauuaucaggauuacauguacugguaaaucagcuuucagaaaauuuaaaacgaguaucaaaugacaaucaauuuuuaugggaauuaauaggggguccaccuaaaacuagaaauaugucagcaugcuggcaagauggaagauucuucgcugaaaaugaaacauggguuguagauaguugcacaacaugcacaugcaaaaaauuuaaaacaaucugucaccaaauuacgugcccaccagcaacaugcgcaucaccaucauuuguagaaggagaaugcugucccuccugcuuacauucaguugauggugaagaaggauggaguccaugggcagaguggacacaauguaguguaacaugugguucgggaacgcaacaaagaggacgcucaugugauguaacaaguaacacuugucuugguccuucaauacaaacaagagcuugcucauuaucaaaaugugauacuaggaucagacaagacggaggauggucacacuggaguccaugguccuccuguuccgugacaugcggcgucggaaauauaacaagaauucgacuaugcaauuccccgguaccacaaaugggagguaaaaauuguaaagguaguggaagagagacaaaagcuugucaaggggcacccuguccaauagauggaagguggaguccaugguccccuuggucggcauguacuguaacaugugcggguggaauucgggaaagaacaagaguguguaacagcccugaaccacaguacggaggaaaggcauguguaggagacguacaggaacgucaaauguguaauaaaagaucaugucccgucgauggaugucuaucuaauccuuguuuuccaggcgcacaauguucuuccuuuccugauggaucauggucaugugguaguugcccagucggguuuuuagggaaugguacacauugugaagaccuagacgaaugcgcguuaguuccagauauauguuucaguaccucaaaagugccaagaugugugaauacacaaccuggauuucauugcuuaccauguccaccuagauauagaggcaaccaaccgguaggcguugguuuagaagccgcaaaaacugaaaaacagguuugugaaccugaaaauccuugcaaagacaaaacacauaauugccacaaacaugcagaguguauauaucugggucauuuuucagauccaauguauaagugugaaugccaaacaggguacgcaggagauggacuaauauguggugaggauucagaucuagauggcuggccuaaccuuaaucuaguaugugcaacaaaugcaacauaccauuguauaaaagacaauugcccucaucuuccaaacaguggccaagaagauuucgauaaagauggcauuggagaugcaugugacgaugaugacgacaaugauggugucacagacgaaaaagauaauugccaauuacuuuuuaaccccagacaagcagauuacgauaaagacgaaguaggagauagaugugauaauuguccauauguacauaauccggcacaaauagauacagacaacaacggagaaggugaugcauguuccguugauauagauggcgaugauguauucaacgaaagagauaacuguccuuauguuuacaacacggaucaacgagauacagauggcgacggaguaggagaucacugcgauaacuguccuuuaguacauaauccugaucaaacugauguagauaacgacuuaguaggagaucagugcgacaacaaugaagacauagaugaugauggccaucaaaauaaccaggauaauuguccauauaucucaaacgcaaaccaagcagaucacgauagagauggucagggggaugcaugcgacccagacgaugacaacgacggaguaccggaugaccgugauaauugucgucuuguauuuaauccagaucaagaagaucuagacggggacggaagaggagauauaugcaaagacgauuucgacaacgauaauauaccagauauugacgacguuuguccugaaaauaaugccauuagugaaacggacuuucguaacuuucaaaugguuccguuagauccaaaaggaacuacucaaauagauccaaacuggguaaucagacaucaaggaaaagaauuaguacaaacagccaauucagaccccggaauugcaguaggguuugaugaauucggaucaguagacuuuucaggaacauucuauguaaauaccgaucgugaugacgacuaugcaggauucguauuuggauaucaaaguucgaguagauuuuacguaguuauguggaaacaagucacccagacuuacugggaagaccaaccuacucgagcuuauggauauucuggggucaguuuaaagguaguuaauuccacuacuggaacgggugaacauuuaagaaaugcuuuauggcauacagggaacaccccaggacaggucagaacuuuauggcaugaucccaggaauauaggauggaaagacuauacagccuauagauggcaucuaacgcaucggccaaaaacuggauacauaagaguacuaguucacgaagguaagcaaguaauggcagacagcggaccuauauaugaccaaacuuacgcaggaggaagauuagguuuauucguuuucucccaggaaaugguauacuuuucggaucuaaaauaugaaugccgcgacaucuaa

SEQ ID NO: 7553 - protein, 1670 aa, Artificial Sequence
  Tumstatin__Homo_sapiens__Q01955
MSARTAPRPQVLLLPLLLVLLAAAPAASKGCVCKDKGQCFCDGAKGEKGEKGFPGPPGSPGQKGFTGPEGLPGPQGPKGFPGLPGLTGSKGVRGISGLPGFSGSPGLPGTPGNTGPYGLVGVPGCSGSKGEQGFPGLPGTLGYPGIPGAAGLKGQKGAPAKEEDIELDAKGDPGLPGAPGPQGLPGPPGFPGPVGPPGPPGFFGFPGAMGPRGPKGHMGERVIGHKGERGVKGLTGPPGPPGTVIVTLTGPDNRTDLKGEKGDKGAMGEPGPPGPSGLPGESYGSEKGAPGDPGLQGKPGKDGVPGFPGSEGVKGNRGFPGLMGEDGIKGQKGDIGPPGFRGPTEYYDTYQEKGDEGTPGPPGPRGARGPQGPSGPPGVPGSPGSSRPGLRGAPGWPGLKGSKGERGRPGKDAMGTPGSPGCAGSPGLPGSPGPPGPPGDIVFRKGPPGDHGLPGYLGSPGIPGVDGPKGEPGLLCTQCPYIPGPPGLPGLPGLHGVKGIPGRQGAAGLKGSPGSPGNTGLPGFPGFPGAQGDPGLKGEKGETLQPEGQVGVPGDPGLRGQPGRKGLDGIPGTPGVKGLPGPKGELALSGEKGDQGPPGDPGSPGSPGPAGPAGPPGYGPQGEPGLQGTQGVPGAPGPPGEAGPRGELSVSTPVPGPPGPPGPPGHPGPQGPPGIPGSLGKCGDPGLPGPDGEPGIPGIGFPGPPGPKGDQGFPGTKGSLGCPGKMGEPGLPGKPGLPGAKGEPAVAMPGGPGTPGFPGERGNSGEHGEIGLPGLPGLPGTPGNEGLDGPRGDPGQPGPPGEQGPPGRCIEGPRGAQGLPGLNGLKGQQGRRGKTGPKGDPGIPGLDRSGFPGETGSPGIPGHQGEMGPLGQRGYPGNPGILGPPGEDGVIGMMGFPGAIGPPGPPGNPGTPGQRGSPGIPGVKGQRGTPGAKGEQGDKGNPGPSEISHVIGDKGEPGLKGFAGNPGEKGNRGVPGMPGLKGLKGLPGPAGPPGPRGDLGSTGNPGEPGLRGIPGSMGNMGMPGSKGKRGTLGFPGRAGRPGLPGIHGLQGDKGEPGYSEGTRPGPPGPTGDPGLPGDMGKKGEMGQPGPPGHLGPAGPEGAPGSPGSPGLPGKPGPHGDLGFKGIKGLLGPPGIRGPPGLPGFPGSPGPMGIRGDQGRDGIPGPAGEKGETGLLRAPPGPRGNPGAQGAKGDRGAPGFPGLPGRKGAMGDAGPRGPTGIEGFPGPPGLPGAIIPGQTGNRGPPGSRGSPGAPGPPGPPGSHVIGIKGDKGSMGHPGPKGPPGTAGDMGPPGRLGAPGTPGLPGPRGDPGFQGFPGVKGEKGNPGFLGSIGPPGPIGPKGPPGVRGDPGTLKIISLPGSPGPPGTPGEPGMQGEPGPPGPPGNLGPCGPRGKPGKDGKPGTPGPAGEKGNKGSKGEPGPAGSDGLPGLKGKRGDSGSPATWTTRGFVFTRHSQTTAIPSCPEGTVPLYSGFSFLFVQGNQRAHGQDLGTLGSCLQRFTTMPFLFCNVNDVCNFASRNDYSYWLSTPALMPMNMAPITGRALEPYISRCTVCEGPAIAIAVHSQTTDIPPCPHGWISLWKGFSFIMFTSAGSEGTGQALASPGSCLEEFRASPFLECHGRGTCNYYSNSYSFWLASLNPERMFRKPIPSTVKAGELEKIISRCQVCMKKRH

SEQ ID NO: 7554 - RNA, 5013 nt, Artificial Sequence
  Tumstatin__Homo_sapiens__CCDS42829.1
augagcgcccggaccgcccccaggccgcaggugcuccugcugccgcuccugcuggugcuccuggcggcggcgcccgcagccagcaaggguugugucuguaaagacaaaggccagugcuucugugacggggccaaaggggagaagggggagaagggcuuuccuggaccccccgguucuccuggccagaaaggauucacagguccugaaggcuugccuggaccgcagggacccaagggcuuuccaggacuuccaggacucacggguuccaaagguguaaggggaauaaguggauugccaggauuuucugguucuccuggacuuccaggcaccccaggcaauaccgggccuuacggacuugucgguguaccaggaugcagugguucuaagggugagcagggguuuccaggacucccagggacacugggcuacccagggaucccgggugcugcugguuugaaaggacaaaagggugcuccugcuaaagaagaagauauagaacuugaugcaaaaggcgaccccggguugccaggggcuccaggaccccaggguuugccaggcccuccagguuuuccugggccuguuggcccaccugguccuccgggauucuuuggcuuuccaggagccaugggaccuagaggaccuaagggucacaugggugaaagagugauaggacauaaaggagagcggggugugaaaggguuaacaggacccccgggaccaccaggaacaguuauugugacccuaacuggcccagauaacagaacggaccucaagggggaaaagggagacaagggagcaaugggcgagccuggaccuccuggacccucaggacugccuggagaaucauauggaucugaaaagggugcuccuggagacccuggccugcagggaaaacccggaaaagaugguguuccuggcuucccuggaagugagggagucaagggcaacagggguuucccuggguuaaugggugaagauggcauuaagggacagaaaggggacauuggcccuccaggauuucgugguccaacagaauauuaugacacauaccaggaaaagggagaugaaggcacuccaggcccaccagggcccagaggagcucguggcccacaaggucccagugguccccccggaguuccuggaaguccuggaucaucaaggccuggccucagaggagccccuggauggccaggccugaaaggaaguaaaggggaacgaggccgcccaggaaaggaugccauggggacuccuggguccccagguugugcugguucaccaggucuuccaggaucaccgggaccuccaggaccgccaggugacaucguuuuucgcaaggguccaccuggagaucacggacugccaggcuaucuagggucuccaggaaucccaggaguugaugggcccaaaggagaaccaggccuccuguguacacagugcccuuauaucccagggccucccggucucccaggauugccaggguuacaugguguaaaaggaaucccaggaagacaaggcgcagcuggcuugaaaggaagcccaggguccccaggaaauacaggucuuccaggauuuccagguuucccaggugcccagggugacccaggacuuaaaggagaaaaaggugaaacacuucagccugaggggcaagugggugucccaggugacccggggcucagaggccaaccugggagaaagggcuuggauggaauuccuggaacuccgggagugaaaggauuaccaggaccuaaaggcgaacuggcucugaguggugagaaaggggaccaagguccuccaggggauccuggcuccccuggguccccaggaccugcaggaccagcuggaccaccuggcuacggaccccaaggagaaccuggucuccagggcacgcaaggaguuccuggagcccccggaccacccggagaagccggcccuaggggagagcucaguguuucaacaccaguuccaggcccaccaggaccuccagggcccccuggccauccuggcccccaagguccaccugguaucccuggaucccuggggaaauguggagauccuggucuuccagggccugauggugaaccaggaauuccaggaauuggauuuccugggccuccuggaccuaagggagaccaagguuuuccagguacaaaaggaucacuggguuguccuggaaaaaugggagagccuggguuaccuggaaagccaggccucccaggagccaagggagaaccagcaguagccaugccuggaggaccaggaacaccagguuuuccaggagaaagaggcaauucuggggaacauggagaaauuggacucccuggacuuccaggucucccuggaacuccaggaaaugaagggcuugauggaccacgaggagauccagggcagccuggaccaccuggagaacaaggacccccaggaaggugcauagagggucccaggggagcccaaggacuuccaggcuuaaauggauugaaagggcaacaaggcagaagagguaaaacggggccaaagggagacccaggaauuccaggcuuggauagaucaggauuuccuggagaaacuggaucaccaggaauuccaggucaucaaggugaaaugggaccacugggucaaagaggauauccaggaaauccgggaauuuuagggccaccaggugaagauggagugauugggaugaugggcuuuccuggagccauuggcccuccagggcccccugggaacccaggcacaccagggcagagggggagcccuggaauuccaggaguaaagggccagagaggaaccccaggagccaagggggaacaaggagauaaaggaaaucccgggccuucagagauaucccacguaauaggggacaaaggagaaccaggucucaaaggauucgcaggaaauccaggugagaaaggaaacagaggcguuccagggaugccagguuuaaagggccucaaaggacuacccggaccagcaggaccaccaggccccagaggagauuugggcagcacugggaauccuggagaaccaggacugcgugguauaccaggaagcauggggaacaugggcaugccagguucuaaaggaaaaaggggaacuuugggauucccaggucgagcaggaagaccaggccucccagguauucauggucuccagggagauaagggagagccagguuauucagaagguacaaggccaggaccaccgggaccaacgggggauccaggacugccgggugauaugggaaagaaaggagaaauggggcaaccuggcccaccuggacauuuggggccugcuggaccugagggagccccuggaaguccuggaaguccuggccucccaggaaagccagguccucauggugauuuggguuuuaaaggaaucaaaggccuccugggcccuccaggaaucagaggcccuccaggucuuccaggauuuccaggaucuccuggaccaauggguauaagaggugaccaaggacgugauggaauuccugguccagccggagaaaagggagaaacggguuuauugagggccccuccaggcccaagagggaacccuggugcucaaggagccaaaggagacaggggagccccagguuuuccuggccucccgggcagaaaaggggccaugggagaugcuggaccucgaggacccacaggcauagaaggauucccagggccaccaggucugcccggugcaauuaucccuggccagacaggaaaucgugguccaccaggcucaagaggaagcccaggugcgccuggucccccuggaccuccagggagucauguaauaggcauaaaaggagacaaagggucuaugggccacccuggcccaaaagguccaccuggaacugcaggagacaugggaccaccaggucgucugggagcaccagguacuccaggucuuccaggacccagaggugauccuggauuccagggguuuccaggcgugaaaggagaaaaggguaauccuggauuucuaggauccauuggaccuccaggaccaauugggccaaaaggaccaccugguguacguggagacccuggcacacuuaagauuaucucccuuccaggaagcccagggccaccuggcacaccuggagaaccagggaugcagggagaaccugggccaccagggccaccuggaaaccuaggacccugugggccaagagguaagccaggcaaggauggaaaaccaggaacuccuggaccagcuggagaaaaaggcaacaaagguucuaaaggagagccaggaccagcuggaucagauggauugccagguuugaaaggaaaacguggagacaguggaucaccugcaaccuggacaacgagaggcuuugucuucacccgacacagucaaaccacagcaauuccuucauguccagaggggacagugccacucuacaguggguuuucuuuucuuuuuguacaaggaaaucaacgagcccacggacaagaccuuggaacucuuggcagcugccugcagcgauuuaccacaaugccauucuuauucugcaaugucaaugauguauguaauuuugcaucucgaaaugauuauucauacuggcugucaacaccagcucugaugccaaugaacauggcucccauuacuggcagagcccuugagccuuauauaagcagaugcacuguuugugaagguccugcgaucgccauagccguucacagccaaaccacugacauuccuccauguccucacggcuggauuucucucuggaaaggauuuucauucaucauguucacaagugcagguucugagggcaccgggcaagcacuggccuccccuggcuccugccuggaagaauuccgagccagcccauuucuagaaugucauggaagaggaacgugcaacuacuauucaaauuccuacaguuucuggcuggcuucauuaaacccagaaagaauguucagaaagccuauuccaucaacugugaaagcuggggaauuagaaaaaauaauaagucgcugucaggugugcaugaagaaaagacacuga

SEQ ID NO: 7555 - RNA, 5013 nt, Artificial Sequence
  derived and/or modified sequence opt1 from Tumstatin__Homo_sapiens__CCDS42829.1
augagcgcccgcaccgccccccggccgcaggugcugcuccugccccugcuccugguccugcucgcggccgcccccgccgccuccaagggcugcgugugcaaggacaaggggcagugcuucugcgacggcgcgaagggggagaagggcgagaagggguuccccggcccgcccggcagccccgggcagaagggcuucaccgggcccgagggccugccggggccccagggccccaagggcuuccccgggcugccgggccucacgggguccaagggcgugcgcggcaucagcgggcugcccggcuucuccgggagccccggccugcccgggaccccgggcaacaccggccccuacgggcucgucggcgugcccgggugcuccggcagcaagggggagcagggcuuccccggccugccggggacccugggcuaccccgggauccccggcgccgccgggcucaagggccagaagggcgcccccgcgaaggaggaggacaucgagcuggacgccaagggggacccgggccugcccggggcccccggcccccagggccucccggggccccccggcuucccggggcccgugggcccccccgggccgcccggcuucuucggcuuccccggggccaugggcccccgggggccgaagggccacaugggggagcgcgucaucggccacaagggcgagcggggggugaagggccugacggggccccccggccccccggggaccgugaucgucacccugaccggccccgacaaccgcacggaccucaagggcgagaagggggacaagggcgccaugggggagcccggccccccggggcccuccggccugcccggcgagagcuacggguccgagaagggcgcgcccggggacccgggccugcagggcaagcccgggaaggacggcgugcccggguuccccggcagcgagggggugaagggcaaccggggcuucccggggcucaugggcgaggacgggaucaagggccagaagggggacaucggcccccccggcuuccgcgggccgaccgaguacuacgacaccuaccaggagaagggcgacgaggggacccccggcccccccgggccgcggggcgcccgcggcccccaggggcccuccggccccccggggguccccggcagccccggcuccagccggcccgggcugcgcggcgccccgggguggcccggccugaagggguccaagggcgagcggggccgccccgggaaggacgccaugggcacgcccgggagcccgggcugcgccgggucccccggccuccccggcagccccgggccgcccggcccccccggggacaucguguuccggaagggcccgcccggggaccacggccugcccggcuaccuggggagccccggcaucccggggguggacggccccaagggggagcccggccuccugugcacccagugcccguacauccccggcccccccgggcugccgggccuccccgggcugcacggcgucaagggcauccccgggcgccagggcgcggccgggcugaagggcucccccgggagcccgggcaacaccggccuccccggguuccccggcuuccccggggcccagggcgacccggggcugaagggcgagaagggcgagacccugcagcccgaggggcaggugggcgugcccggggaccccggccuccgggggcagccgggccgcaagggccuggacgggauccccggcacgcccggggucaagggccugcccgggccgaagggcgagcucgcccuguccggcgagaagggggaccagggcccccccggggaccccggcagcccgggcucccccgggcccgccggccccgcggggccgcccggcuacgggccccagggcgagccgggccugcaggggacccagggcgugcccggggcccccggccccccgggggaggccggcccccggggcgagcucagcguguccacccccguccccgggccgcccggcccccccgggccgcccggccaccccgggccccagggcccgcccggcauccccgggagccugggcaagugcggggaccccggccugccgggccccgacggggagcccggcauccccgggaucggcuucccggggccccccggcccgaagggcgaccagggguuccccggcaccaaggggucccucggcugccccgggaagaugggcgagcccggccugccggggaagcccggccugcccggggccaagggcgagcccgccguggcgaugccggggggccccggcacgcccggguuccccggcgagcgcgggaacagcggcgagcacggggagaucggccugccgggccuccccgggcugcccggcacccccgggaacgagggccuggacggcccgcggggggaccccggccagcccgggcccccgggcgagcaggggccccccggccgcugcaucgagggcccccgcggggcccagggccucccggggcugaacggccugaaggggcagcagggccggcgcggcaagaccgggcccaagggcgaccccgggauccccggccucgaccgguccggguucccgggcgagaccggcagccccgggauccccggccaccagggggagaugggcccgcugggccagcgcggguaccccggcaaccccgggauccugggccccccgggggaggacggcgugaucggcaugaugggguuccccggcgccaucgggccccccggcccgcccgggaaccccggcacgcccggccagcggggguccccgggcauccccggggucaagggccagcgcgggacccccggcgccaagggcgagcagggggacaagggcaaccccgggccgagcgagaucucccacgugaucggcgacaagggggagcccggccucaagggcuucgcggggaaccccggcgagaaggggaaccggggcguccccggcaugccggggcugaagggccugaaggggcuccccggccccgccgggcccccgggcccccgcggcgaccuggggagcaccggcaaccccggggagcccggccugcgggggaucccgggcuccaugggcaacauggggaugcccggcagcaaggggaagcgcggcacccucggguuccccggccgggccggccgcccggggcugcccggcauccacgggcugcagggcgacaagggcgagcccggguacuccgagggcacgcggcccgggccgcccggccccaccggggaccccggccucccgggcgacauggggaagaagggcgagauggggcagcccggcccccccgggcaccugggcccggccggccccgagggggcccccggcagccccgggagcccgggccugcccgggaagcccggcccccacggcgaccucggguucaagggcaucaaggggcugcugggcccgcccgggauccgcggcccccccggccucccgggguuccccggcucccccgggcccaugggcauccggggcgaccaggggcgcgacggcaucccggggcccgcgggcgagaagggggagaccggccugcugcgggcccccccgggcccccgcgggaaccccggcgcccagggggccaagggcgaccggggggcccccggcuucccgggccuccccgggcgcaagggcgcgaugggggacgccggcccccgcgggcccaccggcaucgagggcuucccggggccccccggccugcccggggccaucaucccgggccagacggggaaccggggcccccccggcagccgcgggucccccggcgccccggggccccccggccccccgggcagccacgugaucgggaucaagggcgacaagggguccaugggccaccccgggcccaagggccccccgggcaccgccggggacaugggcccccccgggcggcugggcgcgccggggacccccggccuccccggcccccgcggggacccgggcuuccagggguuccccggcgugaagggggagaagggcaaccccggcuuccuggggagcaucggccccccggggcccaucggccccaagggccccccggggguccggggcgaccccgggacccugaagaucaucucccuccccggcagccccgggccgcccggcacgcccggcgagcccgggaugcagggcgagccggggccccccggccccccggggaaccugggccccugcggcccccgcgggaagcccggcaaggacgggaagccgggcacccccgggcccgccggcgagaagggcaacaagggguccaagggcgagccggggcccgccggcagcgacgggcugcccggccucaagggcaagcggggggacuccggcagccccgccaccuggaccacccgcggguucguguucacgcggcacucccagaccaccgcgaucccgagcugccccgagggcaccgugccccuguacuccggcuucagcuuccuguucguccaggggaaccagcgcgcccacggccaggaccucgggacgcugggcuccugccugcagcgguucaccaccaugcccuuccucuucugcaacgugaacgacgugugcaacuucgccagccgcaacgacuacagcuacuggcuguccaccccggcccugaugcccaugaacauggcccccaucacggggcgggcgcucgagcccuacaucagccgcugcaccgucugcgagggcccggccaucgccaucgccgugcacucccagaccaccgacaucccccccugcccccacggcuggaucagccuguggaagggguucuccuucaucauguucacgagcgccggcuccgaggggaccggccaggcgcuggccagcccgggguccugccucgaggaguuccgggccagccccuuccuggagugccacggccgcggcaccugcaacuacuacuccaacagcuacuccuucuggcuggccagccucaaccccgagcggauguuccgcaagcccaucccguccaccgugaaggccggggagcuggagaagaucaucagccggugccaggucugcaugaagaagcgccacuga

SEQ ID NO: 7556 - RNA, 5013 nt, Artificial Sequence
  derived and/or modified sequence opt2 from Tumstatin__Homo_sapiens__CCDS42829.1
auguccgcccgcaccgccccccgcccccagguccuccuccucccccuccuccucguccuccucgccgccgcccccgccgccuccaagggcugcgucugcaaggacaagggccagugcuucugcgacggcgccaagggcgagaagggcgagaagggcuuccccggcccccccggcucccccggccagaagggcuucaccggccccgagggccuccccggcccccagggccccaagggcuuccccggccuccccggccucaccggcuccaagggcguccgcggcaucuccggccuccccggcuucuccggcucccccggccuccccggcacccccggcaacaccggccccuacggccucgucggcguccccggcugcuccggcuccaagggcgagcagggcuuccccggccuccccggcacccucggcuaccccggcauccccggcgccgccggccucaagggccagaagggcgcccccgccaaggaggaggacaucgagcucgacgccaagggcgaccccggccuccccggcgcccccggcccccagggccuccccggcccccccggcuuccccggccccgucggcccccccggcccccccggcuucuucggcuuccccggcgccaugggcccccgcggccccaagggccacaugggcgagcgcgucaucggccacaagggcgagcgcggcgucaagggccucaccggcccccccggcccccccggcaccgucaucgucacccucaccggccccgacaaccgcaccgaccucaagggcgagaagggcgacaagggcgccaugggcgagcccggcccccccggccccuccggccuccccggcgaguccuacggcuccgagaagggcgcccccggcgaccccggccuccagggcaagcccggcaaggacggcguccccggcuuccccggcuccgagggcgucaagggcaaccgcggcuuccccggccucaugggcgaggacggcaucaagggccagaagggcgacaucggcccccccggcuuccgcggccccaccgaguacuacgacaccuaccaggagaagggcgacgagggcacccccggcccccccggcccccgcggcgcccgcggcccccagggccccuccggcccccccggcguccccggcucccccggcuccucccgccccggccuccgcggcgcccccggcuggcccggccucaagggcuccaagggcgagcgcggccgccccggcaaggacgccaugggcacccccggcucccccggcugcgccggcucccccggccuccccggcucccccggcccccccggcccccccggcgacaucgucuuccgcaagggcccccccggcgaccacggccuccccggcuaccucggcucccccggcauccccggcgucgacggccccaagggcgagcccggccuccucugcacccagugccccuacauccccggcccccccggccuccccggccuccccggccuccacggcgucaagggcauccccggccgccagggcgccgccggccucaagggcucccccggcucccccggcaacaccggccuccccggcuuccccggcuuccccggcgcccagggcgaccccggccucaagggcgagaagggcgagacccuccagcccgagggccaggucggcguccccggcgaccccggccuccgcggccagcccggccgcaagggccucgacggcauccccggcacccccggcgucaagggccuccccggccccaagggcgagcucgcccucuccggcgagaagggcgaccagggcccccccggcgaccccggcucccccggcucccccggccccgccggccccgccggcccccccggcuacggcccccagggcgagcccggccuccagggcacccagggcguccccggcgcccccggcccccccggcgaggccggcccccgcggcgagcucuccgucuccacccccguccccggcccccccggcccccccggcccccccggccaccccggcccccagggcccccccggcauccccggcucccucggcaagugcggcgaccccggccuccccggccccgacggcgagcccggcauccccggcaucggcuuccccggcccccccggccccaagggcgaccagggcuuccccggcaccaagggcucccucggcugccccggcaagaugggcgagcccggccuccccggcaagcccggccuccccggcgccaagggcgagcccgccgucgccaugcccggcggccccggcacccccggcuuccccggcgagcgcggcaacuccggcgagcacggcgagaucggccuccccggccuccccggccuccccggcacccccggcaacgagggccucgacggcccccgcggcgaccccggccagcccggcccccccggcgagcagggcccccccggccgcugcaucgagggcccccgcggcgcccagggccuccccggccucaacggccucaagggccagcagggccgccgcggcaagaccggccccaagggcgaccccggcauccccggccucgaccgcuccggcuuccccggcgagaccggcucccccggcauccccggccaccagggcgagaugggcccccucggccagcgcggcuaccccggcaaccccggcauccucggcccccccggcgaggacggcgucaucggcaugaugggcuuccccggcgccaucggcccccccggcccccccggcaaccccggcacccccggccagcgcggcucccccggcauccccggcgucaagggccagcgcggcacccccggcgccaagggcgagcagggcgacaagggcaaccccggccccuccgagaucucccacgucaucggcgacaagggcgagcccggccucaagggcuucgccggcaaccccggcgagaagggcaaccgcggcguccccggcaugcccggccucaagggccucaagggccuccccggccccgccggcccccccggcccccgcggcgaccucggcuccaccggcaaccccggcgagcccggccuccgcggcauccccggcuccaugggcaacaugggcaugcccggcuccaagggcaagcgcggcacccucggcuuccccggccgcgccggccgccccggccuccccggcauccacggccuccagggcgacaagggcgagcccggcuacuccgagggcacccgccccggcccccccggccccaccggcgaccccggccuccccggcgacaugggcaagaagggcgagaugggccagcccggcccccccggccaccucggccccgccggccccgagggcgcccccggcucccccggcucccccggccuccccggcaagcccggcccccacggcgaccucggcuucaagggcaucaagggccuccucggcccccccggcauccgcggcccccccggccuccccggcuuccccggcucccccggccccaugggcauccgcggcgaccagggccgcgacggcauccccggccccgccggcgagaagggcgagaccggccuccuccgcgccccccccggcccccgcggcaaccccggcgcccagggcgccaagggcgaccgcggcgcccccggcuuccccggccuccccggccgcaagggcgccaugggcgacgccggcccccgcggccccaccggcaucgagggcuuccccggcccccccggccuccccggcgccaucauccccggccagaccggcaaccgcggcccccccggcucccgcggcucccccggcgcccccggcccccccggcccccccggcucccacgucaucggcaucaagggcgacaagggcuccaugggccaccccggccccaagggcccccccggcaccgccggcgacaugggcccccccggccgccucggcgcccccggcacccccggccuccccggcccccgcggcgaccccggcuuccagggcuuccccggcgucaagggcgagaagggcaaccccggcuuccucggcuccaucggcccccccggccccaucggccccaagggcccccccggcguccgcggcgaccccggcacccucaagaucaucucccuccccggcucccccggcccccccggcacccccggcgagcccggcaugcagggcgagcccggcccccccggcccccccggcaaccucggccccugcggcccccgcggcaagcccggcaaggacggcaagcccggcacccccggccccgccggcgagaagggcaacaagggcuccaagggcgagcccggccccgccggcuccgacggccuccccggccucaagggcaagcgcggcgacuccggcucccccgccaccuggaccacccgcggcuucgucuucacccgccacucccagaccaccgccauccccuccugccccgagggcaccgucccccucuacuccggcuucuccuuccucuucguccagggcaaccagcgcgcccacggccaggaccucggcacccucggcuccugccuccagcgcuucaccaccaugcccuuccucuucugcaacgucaacgacgucugcaacuucgccucccgcaacgacuacuccuacuggcucuccacccccgcccucaugcccaugaacauggcccccaucaccggccgcgcccucgagcccuacaucucccgcugcaccgucugcgagggccccgccaucgccaucgccguccacucccagaccaccgacaucccccccugcccccacggcuggaucucccucuggaagggcuucuccuucaucauguucaccuccgccggcuccgagggcaccggccaggcccucgccucccccggcuccugccucgaggaguuccgcgccucccccuuccucgagugccacggccgcggcaccugcaacuacuacuccaacuccuacuccuucuggcucgccucccucaaccccgagcgcauguuccgcaagcccauccccuccaccgucaaggccggcgagcucgagaagaucaucucccgcugccaggucugcaugaagaagcgccacuga

SEQ ID NO: 7557 - RNA, 5013 nt, Artificial Sequence
  derived and/or modified sequence opt3 from Tumstatin__Homo_sapiens__CCDS42829.1
augagcgccagaaccgcucccaggccucaggugcugcuccuuccacuguuguuaguccugcuagcagccgcgccggcugccuccaagggcugcguuuguaaagacaaggggcaaugcuucugugauggagcaaaaggugagaagggcgaaaaaggguuucccggaccuccaggcucucccggucagaagggguucacaggaccugagggccucccaggcccccaggggccuaagggauuuccaggucugccgggccuuacugggucaaaaggagugcggggcaucaguggucugcccggguucagcggauccccuggcuugccaggcacgcccgggaacaccggaccuuacggucucguaggcgugccagggugcucuggaucgaagggcgaacaggguuuucccgggcugccgggcacacugggauauccuggcauucccggggccgcuggacucaaaggucaaaagggcgcaccagccaaagaggaagacauagaguuagaugcuaagggggacccuggacugcccggcgccccagguccccaggggcuuccuggcccaccgggauuccccggcccugucgggccacccggaccuccagguuucuucggcuuucccggggcgaugggaccgcgcggcccuaagggucacaugggggagcgagugaucggccauaaaggagaacguggcguuaagggguugacuggaccacccggcccucccgguaccgugauugucacacugaccgggccagauaauagaacugaccuaaaaggagagaagggcgauaaaggugcaaugggcgaaccugggcccccaggaccgucaggccucccuggggagagcuacggaagugagaagggcgcccccggugacccagggcugcagggaaaacccggcaaggauggugugccuggcuucccaggguccgaaggaguaaagggcaacaggggguuucccggacuuaugggcgaggacgguaucaaagggcagaagggagauauuggcccuccggguuuccggggcccaacagaauauuacgacaccuaucaagagaaaggggaugaaggaacgcccggcccuccagggccccgcggagcuagaggcccucaggguccgucugggcccccaggaguuccuggcagccccggcuccucaaggccagggcugcggggagccccugguuggcccggcuugaaggggaguaaaggagagcgcggccgaccagguaaggacgcaauggggacuccgggaagcccuggcugugcuggcucucccgggcucccaggaucccccgguccuccaggcccucccggggacaucguguuuagaaagggaccgccaggcgaucacggucugcccggguacuuaggaucaccuggcauacccggcgucgacgggccaaaaggagagccuggucugcucugcacccagugucccuauaucccaggcccuccggggcuucccggacugccaggcuugcauggugugaaggggauuccuggaaggcagggcgccgcgggccuaaaagggagccccggaaguccagguaauacaggccugccuggguuccccggauucccgggcgcccaaggugauccagggcucaagggagaaaaaggcgagacucugcagccugaaggccagguggggguccccggagacccaggucuucggggccaacccgggcguaagggacuggauggcaucccugguaccccggggguuaagggcuugcccggaccaaaaggcgagcucgcacugucuggggaaaagggagaccaggguccucccggcgauccuggguccccaggaagccccggcccugcugguccagccgggcccccgggcuacggaccucagggcgagccaggguuacagggaacacaaggugugcccggcgcuccugggccacccggagaggccggcccgcgcggugaacugucgguaucuaccccugugcccgggccaccuggacccccaggacccccuggccacccagggccgcagggacccccuggcauuccagguucccuagggaaaugcggagaccccggccucccugguccagauggcgagcccgggaucccuggaauaggcuuuccggggccacccggaccuaagggcgaccaggguuuccccgggacgaaaggaucacugggcuguccagguaagaugggcgaaccugggcuucccggaaagccaggcuugccgggggcaaaaggagagccugccgucgcuaugcccggcgguccagggacucccggauuuccuggcgaaagaggcaacaguggggagcauggagagauuggucugccaggccuccccgggcugccuggaacaccgggcaaugaaggucuugaugggccaaggggagaccccggccagccuggcccacccggggagcaaggaccucccggucggugcaucgaaggcccacgaggggcgcagggacugccgggcuugaacggucucaaggggcagcagggacgcagaggcaaaaccggcccuaagggggaccccggcauuccaggucuggauaggagcggcuucccuggggagacuggaucccccggcaucccaggucaccaaggggagaugggaccuuuaggccagcggggcuaccccgggaauccgggaauccuggguccaccuggcgaagacggggugauuggaaugaugggcuuucccggugcaauagggccacccggaccuccgggcaacccaggcacacccgggcagcgcggaucuccugguauccccggcguuaaagggcagagaggaaccccaggcgccaagggugagcaaggggauaaaggaaauccuggccccagcgaaauuucacacgugaucggcgacaagggggagccaggacuaaaggguuucgcuggcaacccuggggaaaaaggaaauaggggcgucccggguaugcccgggcucaagggccugaaaggacuuccaggcccugccgggcccccaggaccucguggugauuugggcaguacggggaaccccggagagccgggccugcgggguauaccaggguccaugggcaauaugggaaugccuggcagcaaggggaaacgaggaacccucgguuuucccggcagagcagggaggccaggacugcccggcauucaugguuuacagggcgacaagggggagccuggauauucugaaggcacacgccccgggccaccuggaccgacuggcgaucccggucugccaggggacaugggaaagaaaggcgagaugggucagccugggcccccaggccaccuuggaccugccggccccgaaggggcuccgggaucaccuggcaguccagguuugcccgggaagccuggaccacauggcgaucucgguuucaaaggcaucaaggggcugcuaggacccccuggcauccgggggccacccggacugccgggcuuuccugguagccccgggccaaugggaauuagaggcgaccaaggcagggaugggauccccggaccugccggugagaaaggcgaaaccgggcuccugcgcgcaccacccggaccucgaggcaacccaggugcgcagggggcuaagggagaccggggcgccccgggcuuccccgggcuuccuggacguaagggugcaaugggcgaugccgggccaagaggacccacaggcauugaggguuuuccugggccacccggauugccgggcgcuauaaucccuggccagacugggaauaggggaccacccgguucccgcggcucuccuggggcccccggaccaccgggcccucccgguucgcacgugauugggaucaaaggagacaagggcagcaugggccacccagggcccaaaggaccuccagguaccgcaggcgacauggggcccccuggacggcugggcgcuccagguacaccgggguuacccggaccuagaggcgauccaggcuuccagggguuucccggaguaaagggugagaaaggcaacccuggguuccucggauccaucggcccacccgguccuauugggccgaagggacccccaggcguuaggggcgacccugggacccugaagauaaucucacuucccggaaguccagguccucccggcacuccaggggaaccgggaaugcaaggcgagccuggucccccagggcccccuggcaaccugggaccauguggcccccgagggaaaccuggaaaggaugguaaaccgggcacgcccgggccagccggagaaaagggcaauaaagguucuaagggggagccuggccccgcgggaagcgacggcuugccagggcucaaaggaaagcgcggugauuccggcagcccugccacauggaccacucggggguucguguuuaccagacauucacagacaaccgcuauucccucuugcccagaaggaacugucccgcuguacuccggcuucaguuuucuauucgugcaggguaaccagagggcacacggccaagaccuggggacacucggaagcugccugcagcguuuuacgaccaugccuuucuuguuuuguaaugucaacgaugugugcaauuucgccucucgcaacgacuauuccuacuggcuuucaacucccgcucugaugccaaugaauauggccccuaucacaggccgggcauuagagcccuauauuaguagauguaccguuugcgaggggccagcgaucgccauagcugugcauagccagacaacugauaucccucccuguccgcacggauggauuucgcucuggaagggcuuuuccuucaucauguuuaccucugccgguagcgaagggacgggacaggcacuggcuucaccaggcaguugccuugaggaauuuagggccucccccuuucuggagugucauggucgagggaccugcaacuacuauucuaauagcuacuccuucuggcuagcaucacucaacccugagcggauguuccgcaaaccaauucccagcacaguaaaggccggcgaacuggagaaaaucauaaguagaugucaagucugcaugaagaaaaggcacuga

SEQ ID NO: 7558 - RNA, 5013 nt, Artificial Sequence
  derived and/or modified sequence opt4 from Tumstatin__Homo_sapiens__CCDS42829.1
augagcgccagaaccgcccccagaccccaggugcugcugcugccccugcugcuggugcugcuggccgccgcccccgccgccagcaagggcugcgugugcaaggacaagggccagugcuucugcgacggcgccaagggcgagaagggcgagaagggcuuccccggcccccccggcagccccggccagaagggcuucaccggccccgagggccugcccggcccccagggccccaagggcuuccccggccugcccggccugaccggcagcaagggcgugagaggcaucagcggccugcccggcuucagcggcagccccggccugcccggcacccccggcaacaccggccccuacggccuggugggcgugcccggcugcagcggcagcaagggcgagcagggcuuccccggccugcccggcacccugggcuaccccggcauccccggcgccgccggccugaagggccagaagggcgcccccgccaaggaggaggacaucgagcuggacgccaagggcgaccccggccugcccggcgcccccggcccccagggccugcccggcccccccggcuuccccggccccgugggcccccccggcccccccggcuucuucggcuuccccggcgccaugggccccagaggccccaagggccacaugggcgagagagugaucggccacaagggcgagagaggcgugaagggccugaccggcccccccggcccccccggcaccgugaucgugacccugaccggccccgacaacagaaccgaccugaagggcgagaagggcgacaagggcgccaugggcgagcccggcccccccggccccagcggccugcccggcgagagcuacggcagcgagaagggcgcccccggcgaccccggccugcagggcaagcccggcaaggacggcgugcccggcuuccccggcagcgagggcgugaagggcaacagaggcuuccccggccugaugggcgaggacggcaucaagggccagaagggcgacaucggcccccccggcuucagaggccccaccgaguacuacgacaccuaccaggagaagggcgacgagggcacccccggcccccccggccccagaggcgccagaggcccccagggccccagcggcccccccggcgugcccggcagccccggcagcagcagacccggccugagaggcgcccccggcuggcccggccugaagggcagcaagggcgagagaggcagacccggcaaggacgccaugggcacccccggcagccccggcugcgccggcagccccggccugcccggcagccccggcccccccggcccccccggcgacaucguguucagaaagggcccccccggcgaccacggccugcccggcuaccugggcagccccggcauccccggcguggacggccccaagggcgagcccggccugcugugcacccagugccccuacauccccggcccccccggccugcccggccugcccggccugcacggcgugaagggcauccccggcagacagggcgccgccggccugaagggcagccccggcagccccggcaacaccggccugcccggcuuccccggcuuccccggcgcccagggcgaccccggccugaagggcgagaagggcgagacccugcagcccgagggccaggugggcgugcccggcgaccccggccugagaggccagcccggcagaaagggccuggacggcauccccggcacccccggcgugaagggccugcccggccccaagggcgagcuggcccugagcggcgagaagggcgaccagggcccccccggcgaccccggcagccccggcagccccggccccgccggccccgccggcccccccggcuacggcccccagggcgagcccggccugcagggcacccagggcgugcccggcgcccccggcccccccggcgaggccggccccagaggcgagcugagcgugagcacccccgugcccggcccccccggcccccccggcccccccggccaccccggcccccagggcccccccggcauccccggcagccugggcaagugcggcgaccccggccugcccggccccgacggcgagcccggcauccccggcaucggcuuccccggcccccccggccccaagggcgaccagggcuuccccggcaccaagggcagccugggcugccccggcaagaugggcgagcccggccugcccggcaagcccggccugcccggcgccaagggcgagcccgccguggccaugcccggcggccccggcacccccggcuuccccggcgagagaggcaacagcggcgagcacggcgagaucggccugcccggccugcccggccugcccggcacccccggcaacgagggccuggacggccccagaggcgaccccggccagcccggcccccccggcgagcagggcccccccggcagaugcaucgagggccccagaggcgcccagggccugcccggccugaacggccugaagggccagcagggcagaagaggcaagaccggccccaagggcgaccccggcauccccggccuggacagaagcggcuuccccggcgagaccggcagccccggcauccccggccaccagggcgagaugggcccccugggccagagaggcuaccccggcaaccccggcauccugggcccccccggcgaggacggcgugaucggcaugaugggcuuccccggcgccaucggcccccccggcccccccggcaaccccggcacccccggccagagaggcagccccggcauccccggcgugaagggccagagaggcacccccggcgccaagggcgagcagggcgacaagggcaaccccggccccagcgagaucagccacgugaucggcgacaagggcgagcccggccugaagggcuucgccggcaaccccggcgagaagggcaacagaggcgugcccggcaugcccggccugaagggccugaagggccugcccggccccgccggcccccccggccccagaggcgaccugggcagcaccggcaaccccggcgagcccggccugagaggcauccccggcagcaugggcaacaugggcaugcccggcagcaagggcaagagaggcacccugggcuuccccggcagagccggcagacccggccugcccggcauccacggccugcagggcgacaagggcgagcccggcuacagcgagggcaccagacccggcccccccggccccaccggcgaccccggccugcccggcgacaugggcaagaagggcgagaugggccagcccggcccccccggccaccugggccccgccggccccgagggcgcccccggcagccccggcagccccggccugcccggcaagcccggcccccacggcgaccugggcuucaagggcaucaagggccugcugggcccccccggcaucagaggcccccccggccugcccggcuuccccggcagccccggccccaugggcaucagaggcgaccagggcagagacggcauccccggccccgccggcgagaagggcgagaccggccugcugagagccccccccggccccagaggcaaccccggcgcccagggcgccaagggcgacagaggcgcccccggcuuccccggccugcccggcagaaagggcgccaugggcgacgccggccccagaggccccaccggcaucgagggcuuccccggcccccccggccugcccggcgccaucauccccggccagaccggcaacagaggcccccccggcagcagaggcagccccggcgcccccggcccccccggcccccccggcagccacgugaucggcaucaagggcgacaagggcagcaugggccaccccggccccaagggcccccccggcaccgccggcgacaugggcccccccggcagacugggcgcccccggcacccccggccugcccggccccagaggcgaccccggcuuccagggcuuccccggcgugaagggcgagaagggcaaccccggcuuccugggcagcaucggcccccccggccccaucggccccaagggcccccccggcgugagaggcgaccccggcacccugaagaucaucagccugcccggcagccccggcccccccggcacccccggcgagcccggcaugcagggcgagcccggcccccccggcccccccggcaaccugggccccugcggccccagaggcaagcccggcaaggacggcaagcccggcacccccggccccgccggcgagaagggcaacaagggcagcaagggcgagcccggccccgccggcagcgacggccugcccggccugaagggcaagagaggcgacagcggcagccccgccaccuggaccaccagaggcuucguguucaccagacacagccagaccaccgccauccccagcugccccgagggcaccgugccccuguacagcggcuucagcuuccuguucgugcagggcaaccagagagcccacggccaggaccugggcacccugggcagcugccugcagagauucaccaccaugcccuuccuguucugcaacgugaacgacgugugcaacuucgccagcagaaacgacuacagcuacuggcugagcacccccgcccugaugcccaugaacauggcccccaucaccggcagagcccuggagcccuacaucagcagaugcaccgugugcgagggccccgccaucgccaucgccgugcacagccagaccaccgacaucccccccugcccccacggcuggaucagccuguggaagggcuucagcuucaucauguucaccagcgccggcagcgagggcaccggccaggcccuggccagccccggcagcugccuggaggaguucagagccagccccuuccuggagugccacggcagaggcaccugcaacuacuacagcaacagcuacagcuucuggcuggccagccugaaccccgagagaauguucagaaagcccauccccagcaccgugaaggccggcgagcuggagaagaucaucagcagaugccaggugugcaugaagaagagacacuga

SEQ ID NO: 7559 - RNA, 5013 nt, Artificial Sequence
  derived and/or modified sequence opt5 from Tumstatin__Homo_sapiens__CCDS42829.1
augagcgccagaaccgcuccccggccucaggugcugcuccugccgcuucugcucguccugcuugccgcggcucccgccgccuccaagggcugcguuuguaaagacaaggggcaaugcuucugugauggagcuaaaggcgagaagggggaaaaaggauuuccuggacccccugggucucccggacagaagggcuucacaggcccugaggggcugccgggaccccagggcccuaagggguuucccggacucccuggccugacggggagcaaaggagugcgcggcaucuccggccugcccggguucucuggaagcccgggccucccugggacccccggaaacacaggcccuuacgggcuggugggaguccccggcugcuccggcucuaagggggaacagggauuucccggccuuccugggacccugggauauccgggcauucccggggccgcuggccucaaaggacaaaagggcgccccugcgaaagaggaagacaucgagcuggaugccaagggggaccccggacuuccuggcgcucccgggccgcagggacugccugggcccccuggcuuccccggcccugugggacccccgggcccucccggguuuuucggauuucccggcgccauggggccuagaggaccgaagggccacaugggggagcggguuauuggccauaaaggagaacgcggcgugaaggggcucacaggacccccugggcccccuggcaccgucaucgugacacugaccggacccgauaauagaacggaccugaaaggcgagaagggggauaaaggcgcuaugggagaaccugggcccccgggcccuagcggacuccccggcgaguccuacgggagcgagaagggagccccuggcgaccccggccugcaggggaaaccgggaaaggauggcguuccuggguuccccggaucugaaggcgugaaggggaaccggggauuuccuggccuuaugggcgaggacgggauuaaaggacagaagggcgauaucgggccgcccggauuccgcggcccuaccgaauauuacgacacauaucaagagaaaggggaugaaggaaccccggggcccccuggccccagaggcgcgcggggaccucagggccccuccgggccuccgggaguccccggcagcccugggucuucccgccccggacugagaggcgccccuggcuggcccgggcucaagggaagcaaaggcgagcgggggcgcccgggaaaggacgcuaugggcacaccugggucucccggaugugccggcucccccggccugccugggagccccggaccuccggggcccccuggcgacaucguguuuagaaagggacccccuggcgaucacgggcuucccggauaccugggcuccccgggcauuccugggguggacggacccaaaggcgagccugggcuccugugcacccagugucccuauaucccuggacccccgggccugccugggcuccccggacugcauggcgucaagggcauucccgggcggcagggagcugccggccuuaaagggucuccuggaagcccgggcaauacggggcugcccggcuucccuggauuccccggcgcccaaggggauccuggacucaagggcgaaaaaggggagacacugcagcccgaaggacagguuggcgugccuggggacccgggccuucgcggacaacccggcagaaaggggcuggauggaaucccuggcacccccggggugaagggacucccuggccccaaaggggagcuggcucuguccggcgaaaagggagaccagggcccgccuggggaucccggaagccccggcucuccugggcccgcgggaccugccggcccgcccggcuacgggccucagggagagcccggccuccaggggacacaaggagucccuggcgcucccgggccgccuggagaggccggcccccggggcgaacuguccgugagcaccccuguucccgggccucccggaccgccuggcccucccgggcaccccggaccgcaggggcccccuggcauucccggaucucuuggcaaaugcggcgacccugggcugcccggaccugauggcgagcccgggaucccgggaauuggcuuuccugggcccccuggacccaagggcgaccagggcuucccggggaccaaaggaagccucggcuguccugggaagaugggagaacccggccugcccgggaagccuggacugcccggcgccaaaggcgagccugcuguggccaugcccgggggacccggcacaccuggguuucccggagaaagaggcaacuccggggagcauggagagaucggccuuccuggccuccccgggcugccuggaacgccgggcaaugaagggcuggauggaccccgcggcgacccugggcagcccggaccucccggcgagcaaggcccgccugggcggugcaucgaaggacccagaggcgcgcaggggcuccccggacugaacggccuuaaggggcagcagggccgccggggaaaaaccggcccuaagggggaccccggcauuccuggccuggauagaucuggguucccgggagagacaggcagccccgggaucccuggccaccaaggagagaugggcccccucgggcagcgcggauacccuggcaaucccgggauucugggaccgccuggcgaagacggggucaucggcaugaugggauuucccggcgcuauugggccucccggaccgccuggcaaccccgggacccccggacagcggggcuccccugggauccccggcgugaaaggacagagaggcacaccuggggccaagggagagcaaggcgauaaagggaauccgggacccagcgaaaucucucacguuauuggcgacaagggcgagccugggcugaagggauucgccggcaaccccggggaaaaaggaaaucgcggcgugccugggaugcccggacuuaagggccucaaaggccugccugggccggcuggacccccuggccccagaggggaucugggauccaccggcaacccuggggagcccggacuccggggcaucccgggcagcauggggaauaugggaaugccuggcucuaaggggaaacgcggaacgcugggcuuucccgggcgggccggaagacccggccuuccuggcauucaugggcugcagggagacaagggcgagcccggguauuccgaaggaacacggccuggcccgcccgggccuaccggagaucccggccucccuggcgacauggggaagaaaggagagaugggccagcccgggccgccuggacaccugggccccgcugggccugaaggagcccccggcagcccuggcucccccgggcugccgggaaagcccggcccucauggggaucuuggauucaaaggcaucaaggggcuccugggacccccuggcauucgcggcccgcccgggcugccuggauuucccggcucuccugggcccaugggaaucagaggcgaccaagggcgggauggcaucccuggacccgcgggcgagaaaggggaaaccggacuccugagagccccgccuggcccccgcgggaacccuggagcucagggcgccaagggggaccggggcgcucccggauucccgggccuuccugggagaaagggagccaugggcgaugcggggccccgcggacccacaggcauugagggguuuccuggacccccuggccugccgggcgccaucauucccgggcagaccggaaauagaggcccucccgggagccggggauccccuggcgcucccgggccgccuggacccccuggcucucacgucaucggcauuaaaggggacaagggaagcaugggccaccccgggccuaaaggacccccgggcacagccggcgacauggggcccccuggacgccucggcgcucccgggacgccuggacugcccggcccuagaggggauccgggauuccagggcuuucccggcgugaagggggagaaaggaaacccuggcuuccugggguccaucggacccccuggccccauugggccgaagggaccucccggcguccggggcgacccugggacccuuaagaucaucagccuccccggaucuccgggcccucccgggacacccggagaaccuggcaugcaaggggagcccggaccuccggggcccccuggcaaccugggccccuguggaccucgcggcaaacccgggaaggauggaaaaccuggcaccccggggcccgccggagaaaagggcaauaaaggcuccaagggggagccuggacccgccggcagcgacgggcugccuggacucaaaggcaagagaggggauucuggaucccccgcuacauggaccacgcggggcuucguguuuacccgccauagccagacaaccgcgauuccgucuugccccgaaggcacaguuccucuguacagcggguucuccuuucuuuucgugcagggaaaccagagagcccacggccaagaccuggggacccucggaagcugccugcagcgguuuacgacaaugcccuuccuguuuuguaaugucaacgaugugugcaauuucgcuucucgcaacgacuauuccuacuggcuuagcaccccugcccugaugcccaugaauauggccccuaucacaggcagagcucucgagccguauauuucccgguguaccguuugcgaggggcccgccaucgcgauugcugugcauucucagaccacagauaucccucccuguccucacggauggaucagccuguggaagggcuuuuccuucauuauguuuacgucugccggcagcgaagggaccggacaggcccucgcuucccccggcucuugccuggaggaguucagagccagcccguuucuugaaugucaugggcgcggaacaugcaacuacuauuccaauagcuacucuuucuggcuggcgucccucaacccugagcggauguucagaaaacccaucccuagcaccgucaaggcuggcgaacuggagaaaauuaucucucgcugucaagugugcaugaagaaacggcacuga

SEQ ID NO: 7560 - RNA, 5013 nt, Artificial Sequence
  derived and/or modified sequence opt6 from Tumstatin__Homo_sapiens__CCDS42829.1
augagugcucggacggcgccaagaccucagguguuguuguugccuuuacuuuuggucuuauuggcagccgcaccggcagcgucuaaaggcuguguuuguaaagauaaggggcagugcuucugcgauggagcuaaaggugagaaaggagaaaaaggauuuccaggacccccaggaucaccagggcaaaaagguuucacgggcccugaaggauuaccugggccacaagguccgaaaggauucccgggauuaccuggacuaacugguucgaaaggugucagaggaauaucaggacuuccaggauuuucagguucacccggacuuccaggaacaccuggcaacacaggaccauauggauuagucggcguaccuggguguaguggaucuaaaggagagcaaggauuuccgggcuugccaggaacuuuaggcuauccaggcauaccuggagcagcuggacugaaaggacaaaaaggugcuccagcaaaagaagaagauauagaacuagaugccaaaggagacccaggguuaccgggagcacccggaccacagggacuaccugggccgccaggauucccaggaccaguagguccaccugguccaccgggauuuuuuggguuuccaggcgcaauggguccucgagggcccaaaggacacaugggcgaaagagugauaggucacaaaggggagagaggcguuaaggguuuaacaggcccaccagguccaccagguacgguaauuguaacacuaaccggacccgauaauaggacagauuugaaaggagaaaaaggagacaaaggcgcaaugggagaaccaggaccaccaggaccaaguggccuaccuggagaaaguuauggaagcgaaaagggagcaccaggagauccaggacuacaaggaaaaccagggaaagauggagucccaggauucccaggguccgaaggaguaaaggggaauaggggauuuccaggacugaugggagaagacggaaucaaaggucaaaaaggugauauaggacccccgggauucagaggacccacagaguauuacgauacauaucaggaaaaaggcgacgaaggaacucccgguccacccggaccaagaggagcgagggguccacaaggaccaucuggaccaccaggaguuccagguucgccaggaaguucucgaccaggacuaagaggagcuccuggguggccaggguugaaaggauccaagggugagagagggagaccaggcaaggacgcgauggguacaccaggaucgccggggugcgcaggaucaccggguuugccaggauccccaggcccaccgggaccacccggagauauaguauucaggaaaggcccaccgggggaucauggauuaccaggauauuuggggaguccugguauccccggaguugacgggcccaaaggggaaccaggacuuuuguguacacaauguccauauauuccgggucccccgggacuucccggacuuccaggacuacauggcgugaaagggauaccagggcgacaaggugcagccggccuaaaaggaucaccgggauccccaggaaauacuggucucccagguuucccaggauuuccuggagcgcagggagaccccggauuaaaaggcgaaaaaggagaaacucuacagccugaaggacaaguaggaguuccuggagacccuggucuuagaggacaaccaggaaggaaaggacucgacgguauacccgggaccccgggaguuaaaggacuaccuggucccaaaggugagcuugcacuuucuggagaaaagggcgaucagggaccgccaggagaucccgggaguccagggucaccaggaccagcugguccagcaggaccgccuggauacgguccacaaggagagccugggcuacaaggaacacaaggggugccaggugcaccaggaccuccuggggaagcaggaccgagaggagaauuaagcgugucuacuccagugccaggaccuccaggaccaccggggccaccuggucaucccgguccucaaggacccccaggaaucccggguucauuaggaaaauguggugacccaggauuaccuggaccagauggagaaccgggaauuccaggaauaggauuuccaggcccuccaggaccuaaaggagaccaagguuuuccaggaaccaaagguaguuuagguugcccaggaaaaaugggcgaaccaggucuaccggguaaaccaggacuaccuggcgcgaagggugaaccagcuguagccaugccggguggacccggaacaccugguuuuccgggcgaacguggaaacucgggagagcacggagagauuggucucccaggauuaccaggacuaccaggcacaccagguaacgaaggacuggaugguccacgcggugacccaggacaaccugggccaccaggggaacaaggaccaccuggaagguguauagagggucccagaggcgcucaaggacuaccuggauuaaaugguuuaaagggucagcaaggcagaagagguaaaacagggccaaagggcgacccagguauacccggauuggacagaucugguuuuccuggagaaacagguucuccggguauuccgggccaccaaggugaaaugggcccguuaggacagagggguuacccugguaaccccgggauccuagguccgccuggagaggaugguguaauagggaugaugggauuuccuggagcuauaggaccacccggaccaccaggaaauccuggcacaccuggacagcgcgggucaccaggaauaccuggcguaaaaggccaaagaggaaccccaggggcaaaaggagaacaaggagacaaaggcaauccgggaccgucggaaauaucucauguaaucggagacaaaggugaacccgggcuuaaagguuuugccggcaauccgggagaaaaaggaaauagaggugucccaggcaugccagguuuaaaagguuugaaaggauuacccggaccagccgggccgccugguccgagaggagacuuagggucuacggggaacccaggagaaccaggccuuagaggaauaccagguuccaugggaaauauggggaugccuggaaguaaaggaaaaagagguacguuaggguuucccggaagggcuggacgaccgggauuacccgggauacauggucuucagggagauaagggagaaccaggauacucagaagguacuagaccuggaccaccaggucccacgggagacccgggucuacccggcgauaugggaaaaaaaggagaaaugggccaaccugguccgccuggucaucugggcccagcaggaccagagggugcaccaggaagcccagguucaccaggccuaccgggaaaaccuggaccacauggugauuuaggauuuaaaggaauaaaaggauuacuaggaccaccuggcauacgugguccaccaggauugcccggcuuuccaggaucuccagguccaauggggauuagaggagaucaagguagagacggaauaccggggccagcgggugaaaaaggagaaacagguuuauuacgagcuccgccaggaccgcgggggaacccgggggcacaaggagcaaaaggagauagaggugcaccgggauuuccaggacugccaggucguaaaggagcgaugggggaugccggacccagaggcccuacggggauagaaggcuuccccgguccuccgggucuucccggugcaauaauaccaggacaaacaggaaaccguggacccccagggaguagagguucuccuggagcaccaggaccuccgggaccaccaggaagucauguuaucggcauaaagggcgacaaaggcaguaugggacauccaggaccuaaaggaccuccagguacagccggagauauggguccaccagggaggcuaggugccccgggaacuccgggacuuccaggacccagaggagauccaggauuucagggcuucccuggaguuaaaggagaaaaaggcaauccuggauucuuagggucuauaggaccaccagggccaauagggccgaaaggaccaccaggagugagaggagacccuggaacccuuaaaauaauaaguuuacccggauccccugguccacccgggacuccaggagaaccagguaugcaaggagaaccgggaccaccaggcccgccaggcaaucuagguccuuguggacccagggggaaaccugggaaggauggaaagccaggaaccccaggaccggccggggagaaagguaauaaagguaguaaaggggagcccggaccagcagggagcgacggauuaccaggccuaaaggguaaaagaggggacucagguucaccggcuacuuggacgaccagaggcuuuguguucacuagacacucacagacuacagcuauucccucuuguccagaggguacagucccacuauauagugguuuuucauuccuuuuuguacaaggaaaucaaagggcacaugggcaggaucuuggaacgcuagggucgugucugcaaagauucacuaccaugcccuuucuauuuuguaacgucaaugauguauguaauuuugcgucaagaaaugauuauagcuacugguugucaaccccugcauugaugccgaugaacauggcgcccaucacagguagagcacuagaaccguacauaucuagauguacuguaugugaaggaccugcaaucgcaauugcagugcauucacaaacaacugauauuccuccaugcccucacggguggauuucguuguggaaaggauucucauucauaauguuuacaucugcgggaucagaaggaacaggucaagcacuugccucuccgggaaguuguuuggaggaauuucgcgcaucgccuuuucuagaaugucaugguagaggaacuuguaacuauuauagcaauagcuacagcuuuuggcuagcuucauugaauccggaaaggauguuuagaaaaccaauuccuucaacuguuaaagcaggugaauuggagaaaauaauuucaagaugccaaguguguaugaaaaagcgccacuaa

SEQ ID NO: 7561 - protein, 457 aa, Artificial Sequence
  Vasostatin__Homo_sapiens__P10645
MRSAAVLALLLCAGQVTALPVNSPMNKGDTEVMKCIVEVISDTLSKPSPMPVSQECFETLRGDERILSILRHQNLLKELQDLALQGAKERAHQQKKHSGFEDELSEVLENQSSQAELKEAVEEPSSKDVMEKREDSKEAEKSGEATDGARPQALPEPMQESKAEGNNQAPGEEEEEEEEATNTHPPASLPSQKYPGPQAEGDSEGLSQGLVDREKGLSAEPGWQAKREEEEEEEEEAEAGEEAVPEEEGPTVVLNPHPSLGYKEIRKGESRSEALAVDGAGKPGAEEAQDPEGKGEQEHSQQKEEEEEMAVVPQGLFRGGKSGELEQEEERLSKEWEDSKRWSKMDQLAKELTAEKRLEGQEEEEDNRDSSMKLSFRARAYGFRGPGPQLRRGWRPSSREDSLEAGLPLQVRGYPEEKKEEEGSANRRPEDQELESLSAIEAELEKVAHQLQALRRG

SEQ ID NO: 7562 - RNA, 1374 nt, Artificial Sequence
  Vasostatin__Homo_sapiens__AAH01059
augcgcuccgccgcuguccuggcucuucugcucugcgccgggcaagucacugcgcucccugugaacagcccuaugaauaaaggggauaccgaggugaugaaaugcaucguugaggucaucuccgacacacuuuccaagcccagccccaugccugucagccaggaauguuuugagacacuccgaggagaugaacggauccuuuccauucugagacaucagaauuuacugaaggagcuccaagaccucgcucuccaaggcgccaaggagagggcacaucagcagaagaaacacagcgguuuugaagaugaacucucagagguucuugagaaccagagcagccaggccgagcugaaagaggcgguggaagagccaucauccaaggauguuauggagaaaagagaggauuccaaggaggcagagaaaaguggugaagccacagacggagccaggccccaggcccucccggagcccaugcaggaguccaaggcugaggggaacaaucaggccccuggggaggaagaggaggaggaggaggaggccaccaacacccacccuccagccagccuccccagccagaaauacccaggcccacaggccgagggggacagugagggccucucucagggucugguggacagagagaagggccugagugcagagccaggguggcaggcaaagagagaagaggaggaggaggaggaggaggaggcugaggcuggagaggaggcuguccccgaggaagaaggccccacuguagugcugaacccccacccgagccuuggcuacaaggagauccggaaaggcgagagucggucggaggcucuggcuguggauggagcugggaagccuggggcugaggaggcucaggaccccgaagggaagggagaacaggagcacucccagcagaaagaggaggaggaggagauggcaguggucccgcaaggccucuuccggggugggaagagcggagagcuggagcaggaggaggagcggcucuccaaggagugggaggacuccaaacgcuggagcaagauggaccagcuggccaaggagcugacggcugagaagcggcuggaggggcaggaggaggaggaggacaaccgggacaguuccaugaagcucuccuuccgggcccgggccuacggcuucaggggcccugggccgcagcugcgacgaggcuggaggccauccucccgggaggacagccuugaggcgggccugccccuccagguccgaggcuaccccgaggagaagaaagaggaggagggcagcgcaaaccgcagaccagaggaccaggagcuggagagccugucggccauugaggcagagcuggagaaaguggcccaccagcugcaggcacuacggcggggcuga

SEQ ID NO: 7563 - RNA, 1374 nt, Artificial Sequence
  derived and/or modified sequence opt1 from Vasostatin__Homo_sapiens__AAH01059
augcgcagcgccgccgugcuggcgcuccugcugugcgccggccaggucaccgcccuccccgugaacuccccgaugaacaagggggacaccgaggugaugaagugcaucgucgaggugaucagcgacacgcuguccaagcccagccccaugcccgugucccaggagugcuucgagacccugcggggcgacgagcgcauccucagcauccugcggcaccagaaccugcucaaggagcugcaggaccuggcccuccagggggccaaggagcgcgcgcaccagcagaagaagcacuccggcuucgaggacgagcugagcgagguccuggagaaccaguccagccaggccgagcucaaggaggccguggaggagccguccagcaaggacgugauggagaagcgggaggacuccaaggaggccgagaaguccggggaggcgaccgacggcgcccgcccccaggcccugcccgagcccaugcaggagagcaaggccgagggcaacaaccaggccccgggggaggaggaggaggaggaggaggaggcgaccaacacgcacccgcccgccagccugcccucccagaaguaccccggcccccaggccgagggggacagcgagggccucucccaggggcuggucgaccgggagaagggccugagcgccgagcccggcuggcaggccaagcgcgaggaggaggaggaggaggaggaggaggcggaggccggggaggaggccgugcccgaggaggagggcccgaccgugguccucaacccccaccccagccugggguacaaggagauccggaagggcgagucccgcagcgaggcccuggccguggacggcgcggggaagcccggcgccgaggaggcccaggacccggaggggaagggcgagcaggagcacucccagcagaaggaggaggaggaggagauggccguggucccccaggggcuguuccggggcggcaagagcggggagcuggagcaggaggaggagcgccuguccaaggagugggaggacagcaagcggugguccaagauggaccagcucgccaaggagcugaccgcggagaagcgccuggagggccaggaggaggaggaggacaaccgggacagcuccaugaagcucagcuuccgcgcccgggccuacggguuccgcggccccgggccccagcugcggcgcggcuggcggccguccagccgcgaggacucccuggaggccggccucccccuccaggugcgcggguaccccgaggagaagaaggaggaggagggcagcgcgaaccggcgccccgaggaccaggagcuggagucccucagcgccaucgaggccgagcuggagaagguggcccaccagcugcaggcccuccggcgcggguga

SEQ ID NO: 7564 - RNA, 1374 nt, Artificial Sequence
  derived and/or modified sequence opt2 from Vasostatin__Homo_sapiens__AAH01059
augcgcuccgccgccguccucgcccuccuccucugcgccggccaggucaccgcccuccccgucaacucccccaugaacaagggcgacaccgaggucaugaagugcaucgucgaggucaucuccgacacccucuccaagcccucccccaugcccgucucccaggagugcuucgagacccuccgcggcgacgagcgcauccucuccauccuccgccaccagaaccuccucaaggagcuccaggaccucgcccuccagggcgccaaggagcgcgcccaccagcagaagaagcacuccggcuucgaggacgagcucuccgagguccucgagaaccaguccucccaggccgagcucaaggaggccgucgaggagcccuccuccaaggacgucauggagaagcgcgaggacuccaaggaggccgagaaguccggcgaggccaccgacggcgcccgcccccaggcccuccccgagcccaugcaggaguccaaggccgagggcaacaaccaggcccccggcgaggaggaggaggaggaggaggaggccaccaacacccacccccccgccucccuccccucccagaaguaccccggcccccaggccgagggcgacuccgagggccucucccagggccucgucgaccgcgagaagggccucuccgccgagcccggcuggcaggccaagcgcgaggaggaggaggaggaggaggaggaggccgaggccggcgaggaggccguccccgaggaggagggccccaccgucguccucaacccccaccccucccucggcuacaaggagauccgcaagggcgagucccgcuccgaggcccucgccgucgacggcgccggcaagcccggcgccgaggaggcccaggaccccgagggcaagggcgagcaggagcacucccagcagaaggaggaggaggaggagauggccgucgucccccagggccucuuccgcggcggcaaguccggcgagcucgagcaggaggaggagcgccucuccaaggagugggaggacuccaagcgcugguccaagauggaccagcucgccaaggagcucaccgccgagaagcgccucgagggccaggaggaggaggaggacaaccgcgacuccuccaugaagcucuccuuccgcgcccgcgccuacggcuuccgcggccccggcccccagcuccgccgcggcuggcgccccuccucccgcgaggacucccucgaggccggccucccccuccagguccgcggcuaccccgaggagaagaaggaggaggagggcuccgccaaccgccgccccgaggaccaggagcucgagucccucuccgccaucgaggccgagcucgagaaggucgcccaccagcuccaggcccuccgccgcggcuga

SEQ ID NO: 7565 - RNA, 1374 nt, Artificial Sequence
  derived and/or modified sequence opt3 from Vasostatin__Homo_sapiens__AAH01059
augagaagcgccgcugugcuggcacuccuucugugcgccggccaggucaccgcguugcccguuaacuccccuaugaauaagggggacacagaggugaugaaauguaucguagaagugauuucugauacuuuaucaaagccaaguccgaugcccgucagccaagagugcuucgaaacgcugaggggagacgagcggauacuauccauccuccgccaccagaaccugcuuaaagaacugcaggauuuggcucuccagggugccaaggagcgagcacaucaacagaaaaagcacucuggcuuugaggacgaacugucggaggugcuggaaaaucagucaagccaggccgagcucaaggaggcuguugaggagccuaguuccaaagaugugauggaaaagcgugaggacucuaaagaagcagaaaagagcggggaggccaccgauggagcuagaccacaagccuuacccgaaccuaugcaggaguccaaagcggaaggcaacaaucaggcaccaggugaggaagaggaggaagaggaagaggccacaaacacucaucccccugcuucacugccaagucagaaguacccggggccccaagccgaaggagacagcgagggccuuucucagggcuuggucgauagggagaaggggcuguccgcagaaccuggauggcaggcuaaacgggaggaagaggaggaagaggaagaggaagccgaggcgggugaggaagccgugccagaggaagagggccccaccguaguucuaaauccucacccaucacucggguauaaggaaauucgcaaaggagagagcagaagugaggcacuggcuguggacggcgccgguaagcccggggcugaagaggcccaagauccggaaggaaaaggcgagcaggaacauucucagcagaaggaggaggaagaggaaauggcagucgugccucaaggccuuuucaggggagggaaauccggugagcuggagcaggaagaggaacgguugagcaaggagugggaagacucgaagcgcuggucuaaaauggaucagcucgccaaggagcugacagcugagaaacgauuagaaggccaggaggaagaggaagacaacagagacuccucaaugaagcugaguuuuagggcgcgggcauacggguuccguggacccggcccacaacuccgcagagguuggaggccuagcucccgggaggauucucuugaggccgggcugccccuacaggugcgaggcuauccagaagagaaaaaggaagaggaaggaagcgcuaaucgcagacccgaggaccaggaguuggaaucacugagugccaucgaggcagaacucgagaaggucgcccaccagcugcaagcucuuaggcggggcuga

SEQ ID NO: 7566 - RNA, 1374 nt, Artificial Sequence
  derived and/or modified sequence opt4 from Vasostatin__Homo_sapiens__AAH01059
augagaagcgccgccgugcuggcccugcugcugugcgccggccaggugaccgcccugcccgugaacagccccaugaacaagggcgacaccgaggugaugaagugcaucguggaggugaucagcgacacccugagcaagcccagccccaugcccgugagccaggagugcuucgagacccugagaggcgacgagagaauccugagcauccugagacaccagaaccugcugaaggagcugcaggaccuggcccugcagggcgccaaggagagagcccaccagcagaagaagcacagcggcuucgaggacgagcugagcgaggugcuggagaaccagagcagccaggccgagcugaaggaggccguggaggagcccagcagcaaggacgugauggagaagagagaggacagcaaggaggccgagaagagcggcgaggccaccgacggcgccagaccccaggcccugcccgagcccaugcaggagagcaaggccgagggcaacaaccaggcccccggcgaggaggaggaggaggaggaggaggccaccaacacccacccccccgccagccugcccagccagaaguaccccggcccccaggccgagggcgacagcgagggccugagccagggccugguggacagagagaagggccugagcgccgagcccggcuggcaggccaagagagaggaggaggaggaggaggaggaggaggccgaggccggcgaggaggccgugcccgaggaggagggccccaccguggugcugaacccccaccccagccugggcuacaaggagaucagaaagggcgagagcagaagcgaggcccuggccguggacggcgccggcaagcccggcgccgaggaggcccaggaccccgagggcaagggcgagcaggagcacagccagcagaaggaggaggaggaggagauggccguggugccccagggccuguucagaggcggcaagagcggcgagcuggagcaggaggaggagagacugagcaaggagugggaggacagcaagagauggagcaagauggaccagcuggccaaggagcugaccgccgagaagagacuggagggccaggaggaggaggaggacaacagagacagcagcaugaagcugagcuucagagccagagccuacggcuucagaggccccggcccccagcugagaagaggcuggagacccagcagcagagaggacagccuggaggccggccugccccugcaggugagaggcuaccccgaggagaagaaggaggaggagggcagcgccaacagaagacccgaggaccaggagcuggagagccugagcgccaucgaggccgagcuggagaagguggcccaccagcugcaggcccugagaagaggcuga

SEQ ID NO: 7567 - RNA, 1374 nt, Artificial Sequence
  derived and/or modified sequence opt5 from Vasostatin__Homo_sapiens__AAH01059
augagaagcgccgcugugcuggcccuccugcuuugcgcgggccaggucaccgcucugcccguuaacuccccuaugaauaagggggacacagaggugaugaaauguaucguggaagucauuucugauacgcucagcaagccgucccccaugccugugucucaagagugcuucgaaacccugcggggagacgagcgcauccuuagcauucugagacaccagaaccuccugaaagaacugcaggaucucgcccugcagggcgccaaggagcgggcucaucaacagaaaaagcacuccggguuugaggacgaacuuucugagguucuggaaaaucagagcucccaggccgagcucaaggaggcuguggaggagcccagcucuaaagaugucauggaaaagcgcgaggacuccaaagaagccgaaaagagcggagaggcgacagauggcgccagaccucaagcucugcccgaaccuaugcaggagucuaaagccgaagggaacaaucaggcuccgggagaggaagaggaggaagaggaagaggccaccaacacacaucccccugcgucccuucccagccagaaguacccuggcccccaagccgaaggcgacucugaggggcugucccagggacucguggaucgggagaagggccugagcgcugaaccgggguggcaggccaaacgcgaggaagaggaggaagaggaagaggaagcugaggccggagaggaagccguuccugaggaagagggccccaccgugguccugaauccucaccccucccucggguauaaggaaaucagaaaaggagagucucggagcgaggcucuggcgguggacggcgccggcaagcccggggcugaagaggcccaagauccugaaggaaaaggcgagcaggaacauucccagcagaaggaggaggaagaggaaauggccguggucccgcaagggcuuuuccgcggaggcaaaagcggggagcuggagcaggaagaggaaagacucucuaaggagugggaagacuccaagcgguggagcaaaauggaucagcuggcuaaggagcuuacagccgagaaacgccuggaaggacaggaggaagaggaagacaacagagacucuagcaugaagcucuccuuucgggcgcgcgcuuacggcuucagaggccccgggccucaacugcggagaggauggcgccccucuagccgggaggauucccuggaggccggccucccucugcagguuagaggguaucccgaagagaaaaaggaagaggaaggaagcgccaaucgccggccggaggaccaggagcuugaaucucuguccgcuauugaggccgaacucgagaagguggcucaccagcugcaagcccuuagacgcggcuga

SEQ ID NO: 7568 - RNA, 1374 nt, Artificial Sequence
  derived and/or modified sequence opt6 from Vasostatin__Homo_sapiens__AAH01059
augagaucagcagcaguauuagcauuauuauuaugugcaggacagguaacggcacugccagugaauuccccaaugaauaaaggagauacagaaguaaugaaauguauaguagaaguaauaagcgauacauuaagcaaacccaguccaaugccaguaucacaagaauguuuugaaacauuaagaggugaugaaagaauauuaaguauacuuagacaucaaaaucuauuaaaagaauuacaagauuuagcacuacagggagcaaaagaaagagcacaucaacaaaagaaacacagugguuucgaagaugaauuaucagaaguguuagaaaaucaaaguucacaagcagaacuaaaagaggcaguggaagaaccaaguagcaaagauguaauggaaaagagggaagauaguaaagaggcggaaaaaaguggagaagcgacggauggagcucgaccacaagcauuaccagaaccuaugcaggaaaguaaagcggaaggaaacaaucaagcaccaggagaggaagaagaagaagaagaagaagcuacaaauacacauccuccagcgagccuaccgagucaaaaauauccuggaccacaggcagaaggagauucagaaggauuaagucaaggacuuguagauagagaaaaaggacuaagugcugaacccgguuggcaagcaaaaagggaagaagaagaagaagaagaagaagaagcagaagcaggagaagaagcaguaccggaagaagaaggaccaacggucgugcuaaauccacauccaaguuuaggauacaaagaaauaagaaaaggagaaagcagaagugaggcauuagcuguagauggugcaggaaaaccgggagcugaagaagcucaagacccagaaggaaaaggagaacaagaacauagccaacaaaaggaagaagaagaagaaauggcuguaguaccacaaggacuauucagaggaggaaaaagcggagaauuagagcaagaagaagaaagauuaaguaaagaaugggaagauaguaaaagauggaguaaaauggaucaauuagcaaaagaacucacggcagaaaaaagacuagaaggacaagaagaagaagaagacaacagagauaguucaaugaaacuaaguuuuagagcaagagcguacggauuuaggggaccagggccacaacuaaggaggggauggagaccaucaaguagagaagauaguuuagaagcaggauuaccuuuacaaguaagaggauauccagaagaaaaaaaagaagaagaaggaagcgcgaacaggagaccagaagaucaagaauuggagagccuaagugcaauagaagcagaguuagaaaagguagcacaucaauugcaagcauuacgaagaggauga

SEQ ID NO: 7569 - protein, 212 aa, Artificial Sequence [sequence omitted]

SEQ ID NO: 7570 - RNA, 639 nt, Artificial Sequence
  calreticulin__Homo_sapiens__BAG58223
augcugcuauccgucuacuucaaggagcaguuucuggacggagacggguggacuucccgcuggaucgaauccaaacacaagucagauuuuggcaaauucguucucaguuccggcaaguucuacggugacgaggagaaagauaaagguuugcagacaagccaggaugcacgcuuuuaugcucugucggccaguuucgagccuuucagcaacaaaggccagacgcugguggugcaguucacggugaaacaugagcagaacaucgacugugggggcggcuaugugaagcuguuuccuaauaguuuggaccagacagacaugcacggagacucagaauacaacaucauguuuggucccgacaucuguggcccuggcaccaagaagguucaugucaucuucaacuacaagggcaagaacgugcugaucaacaaggacauccguugcaaggaugaugaguuuacacaccuguacacacugauugugcggccagacaacaccuaugaggugaagauugacaacagccagguggaguccggcuccuuggaagacgauugggacuuccugccacccaagaagauaaaggauccugaugcuucaaaaccggaagacugggaugagcgggccaagaucgaugaucccuga

SEQ ID NO: 7571 - RNA, 639 nt, Artificial Sequence
  derived and/or modified sequence opt1 from calreticulin__Homo_sapiens__BAG58223
augcugcucagcguguacuucaaggagcaguuccuggacggcgacggguggaccucccgcuggaucgagagcaagcacaaguccgacuucggcaaguucguccugagcuccgggaaguucuacggcgacgaggagaaggacaaggggcuccagaccagccaggacgcccgguucuacgcccuguccgcgagcuucgagcccuucuccaacaagggccagacgcugguggugcaguucaccgucaagcacgagcagaacaucgacugcggcgggggcuacgugaagcuguucccgaacagccucgaccagaccgacaugcacggggacuccgaguacaacaucauguucggccccgacaucugcgggcccggcaccaagaaggugcacgucaucuucaacuacaagggcaagaacgugcugaucaacaaggacauccgcugcaaggacgacgaguucacgcaccucuacacccugaucgugcggcccgacaacaccuacgaggucaagaucgacaacagccagguggaguccgggagccuggaggacgacugggacuuccucccgcccaagaagaucaaggaccccgacgccuccaagcccgaggacugggacgagcgcgccaagaucgacgacccguga

SEQ ID NO: 7572 - RNA, 639 nt, Artificial Sequence
  derived and/or modified sequence opt2 from calreticulin__Homo_sapiens__BAG58223
augcuccucuccgucuacuucaaggagcaguuccucgacggcgacggcuggaccucccgcuggaucgaguccaagcacaaguccgacuucggcaaguucguccucuccuccggcaaguucuacggcgacgaggagaaggacaagggccuccagaccucccaggacgcccgcuucuacgcccucuccgccuccuucgagcccuucuccaacaagggccagacccucgucguccaguucaccgucaagcacgagcagaacaucgacugcggcggcggcuacgucaagcucuuccccaacucccucgaccagaccgacaugcacggcgacuccgaguacaacaucauguucggccccgacaucugcggccccggcaccaagaagguccacgucaucuucaacuacaagggcaagaacguccucaucaacaaggacauccgcugcaaggacgacgaguucacccaccucuacacccucaucguccgccccgacaacaccuacgaggucaagaucgacaacucccaggucgaguccggcucccucgaggacgacugggacuuccucccccccaagaagaucaaggaccccgacgccuccaagcccgaggacugggacgagcgcgccaagaucgacgaccccuga

SEQ ID NO: 7573 - RNA, 639 nt, Artificial Sequence
  derived and/or modified sequence opt3 from calreticulin__Homo_sapiens__BAG58223
augcugcucagcguguacuucaaggagcaguuucuugacggcgauggguggaccuccagauggaucgaaucuaaacacaagucagacuucggaaaauuuguccugaguagcgguaaguucuauggcgaugaggaaaaagacaagggguugcaaacaucccaggaugccagguuuuacgcuuuaucugcaucguucgagcccuuuucaaacaagggacagacucugguugugcaguucacgguaaaacaugaacaaaauauugacugcggcgguggguaugugaagcuauuuccuaacagccucgaucagaccgacaugcacggagauagugaguacaauauaauguucggcccagacaucuguggcccggggacuaaaaagguccaugugauuuuuaacuauaaaggaaagaauguucugaucaacaaggauauucggugcaaagacgaugaguucacacaccuuuacacccugaucgugcgccccgacaauacauaugaagucaagauagacaacucccagguggagucugguagcuuggaagaugacugggauuuucucccucccaaaaagaucaaagacccagaugccuccaagccugaggacugggaugagcgagcgaaaauugacgauccauga

SEQ ID NO: 7574 - RNA, 639 nt, Artificial Sequence
  derived and/or modified sequence opt4 from calreticulin__Homo_sapiens__BAG58223
augcugcugagcguguacuucaaggagcaguuccuggacggcgacggcuggaccagcagauggaucgagagcaagcacaagagcgacuucggcaaguucgugcugagcagcggcaaguucuacggcgacgaggagaaggacaagggccugcagaccagccaggacgccagauucuacgcccugagcgccagcuucgagcccuucagcaacaagggccagacccugguggugcaguucaccgugaagcacgagcagaacaucgacugcggcggcggcuacgugaagcuguuccccaacagccuggaccagaccgacaugcacggcgacagcgaguacaacaucauguucggccccgacaucugcggccccggcaccaagaaggugcacgugaucuucaacuacaagggcaagaacgugcugaucaacaaggacaucagaugcaaggacgacgaguucacccaccuguacacccugaucgugagacccgacaacaccuacgaggugaagaucgacaacagccagguggagagcggcagccuggaggacgacugggacuuccugccccccaagaagaucaaggaccccgacgccagcaagcccgaggacugggacgagagagccaagaucgacgaccccuga

SEQ ID NO: 7575 - RNA, 639 nt, Artificial Sequence
  derived and/or modified sequence opt5 from calreticulin__Homo_sapiens__BAG58223
augcugcucagcguguacuucaaggagcaguuucuggacggcgauggguggaccuccagauggaucgaaucuaaacacaagagcgacuucggaaaauuuguccuuuccucuggcaaguucuauggggaugaggaaaaagacaagggacugcaaacaagccaggaugcccgguuuuacgcucucuccgccucuuucgagcccuuuagcaacaagggccagacgcugguugugcaguucaccgugaaacaugaacaaaauauugacugcgggggaggcuaugucaaacuuuuuccuaacucccuggaucagacagacaugcacggcgauagcgaguacaauaucauguucgggccggacauuuguggacccggcaccaagaaggugcauguuaucuuuaacuauaaagggaagaaugugcucauuaacaaggauauccgcugcaaagacgaugaguucacacaccuguacacccugaucgucagaccugacaauacauaugaagugaagauugacaacucucagguugaguccggaagccucgaagaugacugggauuuucugcccccuaaaaagaucaaagaccccgaugcgucuaagccugaggacugggaugagcgggcuaaaauugacgauccguga

SEQ ID NO: 7576 - RNA, 639 nt, Artificial Sequence
  derived and/or modified sequence opt6 from calreticulin__Homo_sapiens__BAG58223
augcuacuaagcguauacuucaaagaacaauuccuagacggagacggauggacaucaagauggaucgaaucaaaacacaaaucagacuucggaaaauucguacuaucaucaggaaaauuuuacggagacgaagaaaaagacaaaggacuccaaacaucacaagacgcaagauucuacgcacuaucagcaucauucgaaccauucucaaacaaaggacaaacacuagucguacaauucacaguaaaacacgaacaaaacauagacugcggaggaggauacguaaaacuauucccaaacucacuagaccaaacagauaugcacggagacagcgaauacaacauaauguucggaccagacauaugcggaccaggaacaaaaaaaguacacguaauauucaacuacaaaggaaaaaacguacuaauaaacaaagacauaagaugcaaagacgacgaauucacacaccuauacacacuaauaguaagaccagauaacacauacgaagucaaaauagacaacucacaaguagaaucaggauccuuagaagacgacugggacuuccuaccaccaaaaaaaauaaaagacccagacgcaucaaaaccagaagacugggacgaaagagcaaaaauagacgacccauaa

SEQ ID NO: 7577 - protein, 296 aa, Artificial Sequence
  calreticulin__Homo_sapiens__B4E2Y9
MHGDSEYNIMFGPDICGPGTKKVHVIFNYKGKNVLINKDIRCKDDEFTHLYTLIVRPDNTYEVKIDNSQVESGSLEDDWDFLPPKKIKDPDASKPEDWDERAKIDDPTDSKPEDWDKPEHIPDPDAKKPEDWDEEMDGEWEPPVIQNPEYKGEWKPRQIDNPDYKGTWIHPEIDNPEYSPDPSIYAYDNFGVLGLDLWQVKSGTIFDNFLITNDEAYAEEFGNETWGVTKAAEKQMKDKQDEEQRLKEEEEDKKRKEEEEAEDKEDDEDKDEDEEDEEDKEEDEEEDVPGQAKDEL

SEQ ID NO: 7578 - RNA, 891 nt, Artificial Sequence
  calreticulin__Homo_sapiens__BAG65301
augcacggagacucagaauacaacaucauguuuggucccgacaucuguggcccuggcaccaagaagguucaugucaucuucaacuacaagggcaagaacgugcugaucaacaaggacauccguugcaaggaugaugaguuuacacaccuguacacacugauugugcggccagacaacaccuaugaggugaagauugacaacagccagguggaguccggcuccuuggaagacgauugggacuuccugccacccaagaagauaaaggauccugaugcuucaaaaccggaagacugggaugagcgggccaagaucgaugaucccacagacuccaagccugaggacugggacaagcccgagcauaucccugacccugaugcuaagaagcccgaggacugggaugaagagauggacggagagugggaacccccagugauucagaacccugaguacaagggugaguggaagccccggcagaucgacaacccagauuacaagggcacuuggauccacccagaaauugacaaccccgaguauucucccgaucccaguaucuaugccuaugauaacuuuggcgugcugggccuggaccucuggcaggucaagucuggcaccaucuuugacaacuuccucaucaccaacgaugaggcauacgcugaggaguuuggcaacgagacguggggcguaacaaaggcagcagagaaacaaaugaaggacaaacaggacgaggagcagaggcuuaaggaggaggaagaagacaagaaacgcaaagaggaggaggaggcagaggacaaggaggaugaugaggacaaagaugaggaugaggaggaugaggaggacaaggaggaagaugaggaggaagauguccccggccaggccaaggacgagcuguag

SEQ ID NO: 7579 - RNA, 891 nt, Artificial Sequence
  derived and/or modified sequence opt1 from calreticulin__Homo_sapiens__BAG65301
augcacggcgacagcgaguacaacaucauguucgggcccgacaucugcggcccggggaccaagaaggugcacgucaucuucaacuacaagggcaagaacgugcugaucaacaaggacauccgcugcaaggacgacgaguucacccaccucuacacgcugaucgugcggcccgacaacaccuacgaggucaagaucgacaacucccagguggagagcgggucccuggaggacgacugggacuuccucccgcccaagaagaucaaggaccccgacgccagcaagcccgaggacugggacgagcgcgccaagaucgacgaccccaccgacuccaagcccgaggacugggacaagccggagcacauccccgaccccgacgcgaagaagcccgaggacugggacgaggagauggacggcgagugggagccgcccgugauccagaaccccgaguacaagggcgaguggaagccccggcagaucgacaacccggacuacaaggggaccuggauccaccccgagaucgacaaccccgaguacagccccgacccguccaucuacgccuacgacaacuucggcguccuggggcuggaccucuggcaggucaagagcggcacgaucuucgacaacuuccugaucaccaacgacgaggccuacgccgaggaguucgggaacgagaccuggggcgugaccaaggccgcggagaagcagaugaaggacaagcaggacgaggagcagcgccugaaggaggaggaggaggacaagaagcggaaggaggaggaggaggccgaggacaaggaggacgacgaggacaaggacgaggacgaggaggacgaggaggacaaggaggaggacgaggaggaggacgugcccggccaggccaaggacgagcucuga

SEQ ID NO: 7580 - RNA, 891 nt, Artificial Sequence
  derived and/or modified sequence opt2 from calreticulin__Homo_sapiens__BAG65301
augcacggcgacuccgaguacaacaucauguucggccccgacaucugcggccccggcaccaagaagguccacgucaucuucaacuacaagggcaagaacguccucaucaacaaggacauccgcugcaaggacgacgaguucacccaccucuacacccucaucguccgccccgacaacaccuacgaggucaagaucgacaacucccaggucgaguccggcucccucgaggacgacugggacuuccucccccccaagaagaucaaggaccccgacgccuccaagcccgaggacugggacgagcgcgccaagaucgacgaccccaccgacuccaagcccgaggacugggacaagcccgagcacauccccgaccccgacgccaagaagcccgaggacugggacgaggagauggacggcgagugggagccccccgucauccagaaccccgaguacaagggcgaguggaagccccgccagaucgacaaccccgacuacaagggcaccuggauccaccccgagaucgacaaccccgaguacucccccgaccccuccaucuacgccuacgacaacuucggcguccucggccucgaccucuggcaggucaaguccggcaccaucuucgacaacuuccucaucaccaacgacgaggccuacgccgaggaguucggcaacgagaccuggggcgucaccaaggccgccgagaagcagaugaaggacaagcaggacgaggagcagcgccucaaggaggaggaggaggacaagaagcgcaaggaggaggaggaggccgaggacaaggaggacgacgaggacaaggacgaggacgaggaggacgaggaggacaaggaggaggacgaggaggaggacguccccggccaggccaaggacgagcucuga

SEQ ID NO: 7581 - RNA, 891 nt, Artificial Sequence
  derived and/or modified sequence opt3 from calreticulin__Homo_sapiens__BAG65301
augcacggcgacagcgaguacaacaucauguucgggcccgauauuugcggaccugguaccaagaaagugcaugucauauuuaauuauaagggcaaaaacguucugaucaauaaggacauuagauguaaagaugacgaauuuacacaccucuacacucuuaucgugaggccagauaacacguaugagguaaagauugacaauucccagguggaaucugggucacuggaggaugacugggauuucuugccgcccaagaaaaucaaggacccugaugccaguaaaccagaagacugggaugagcgggcuaagauagacgaccccaccgauagcaaaccugaggacugggauaagccagaacauauccccgacccugaugcaaagaaaccagaggacugggaugaagagauggacggagagugggaaccgcccgucauucaaaacccugaguacaagggcgaauggaaaccacgccagaucgauaaucccgacuauaaggguacauggauucacccugagaucgauaacccagaauacucccccgacccgucuauauaugccuacgacaauuucgggguguuaggacuggaucuauggcagguuaaaucgggcacuauuuuugacaacuuccucaucaccaaugaugaggcguacgcugaggaauuuggcaacgagacauggggagugaccaaggccgcagaaaaacagaugaaggacaagcaagaugaggaacagcgacugaaagaggaggaagaggacaagaaacguaaggaagaggaagaggccgaggauaaagaagacgaugaggacaaggaugaagacgaggaggaugaagaggacaaggaagaggacgaagaggaggaugucccugggcaggcuaaagacgaacuuuga

SEQ ID NO: 7582 - RNA, 891 nt, Artificial Sequence
  derived and/or modified sequence opt4 from calreticulin__Homo_sapiens__BAG65301
augcacggcgacagcgaguacaacaucauguucggccccgacaucugcggccccggcaccaagaaggugcacgugaucuucaacuacaagggcaagaacgugcugaucaacaaggacaucagaugcaaggacgacgaguucacccaccuguacacccugaucgugagacccgacaacaccuacgaggugaagaucgacaacagccagguggagagcggcagccuggaggacgacugggacuuccugccccccaagaagaucaaggaccccgacgccagcaagcccgaggacugggacgagagagccaagaucgacgaccccaccgacagcaagcccgaggacugggacaagcccgagcacauccccgaccccgacgccaagaagcccgaggacugggacgaggagauggacggcgagugggagccccccgugauccagaaccccgaguacaagggcgaguggaagcccagacagaucgacaaccccgacuacaagggcaccuggauccaccccgagaucgacaaccccgaguacagccccgaccccagcaucuacgccuacgacaacuucggcgugcugggccuggaccuguggcaggugaagagcggcaccaucuucgacaacuuccugaucaccaacgacgaggccuacgccgaggaguucggcaacgagaccuggggcgugaccaaggccgccgagaagcagaugaaggacaagcaggacgaggagcagagacugaaggaggaggaggaggacaagaagagaaaggaggaggaggaggccgaggacaaggaggacgacgaggacaaggacgaggacgaggaggacgaggaggacaaggaggaggacgaggaggaggacgugcccggccaggccaaggacgagcuguga

SEQ ID NO: 7583 - RNA, 891 nt, Artificial Sequence
  derived and/or modified sequence opt5 from calreticulin__Homo_sapiens__BAG65301
augcacggcgacagcgaguacaacaucauguucgggcccgauauuugcggaccuggcaccaagaaagugcaugucaucuuuaauuauaaggggaaaaacguucugauuaauaaggacaucagauguaaagaugacgaguucacacaccucuacacgcugauugugcggccggauaacaccuaugaagugaagaucgacaauucccaggucgaaucuggaagccuugaggaugacugggauuuucugcccccuaagaaaaucaaggaccccgaugccuccaaaccugaagacugggaugagcgcgcuaagauugacgaccccacagauucuaaaccugaggacugggauaagccggaacauauccccgacccugaugccaagaaacccgaggacugggaugaagagauggacggcgagugggaaccucccgugauucaaaacccggaguacaagggggaauggaaaccuagacagaucgauaaucccgacuauaagggaaccuggauucacccugagaucgauaaccccgaauacagccccgacccuuccauuuaugcguacgacaauuucggcguucucggccuggaucuuuggcaagugaaaucugggacaaucuuugacaacuuccugaucaccaaugaugaggcuuacgccgaggaauuuggaaacgagacauggggcgucaccaaggccgcugaaaaacagaugaaggacaagcaggaugaggaacagcggcucaaagaggaggaagaggacaagaaacgcaaggaagaggaagaggccgaggauaaagaagacgaugaggacaaggaugaagacgaggaggaugaagaggacaaggaagaggacgaagaggaggaugugccggggcaggcuaaagacgaacuguga

SEQ ID NO: 7584 - RNA, 891 nt, Artificial Sequence
  derived and/or modified sequence opt6 from calreticulin__Homo_sapiens__BAG65301
augcacggagauagcgaauacaauauaauguucgggccagacauaugcggaccaggaacaaaaaaaguacacguaauauucaacuacaaaggaaaaaacguacuaauaaacaaagacauaagauguaaagacgacgaauuuacacaccuauacacacuaauaguaagaccagacaacacauaugaaguaaaaauagacaacagucaaguagaaucaggaagccuagaagacgacugggacuucuuaccaccgaaaaaaauaaaagacccagacgcaagcaaaccagaagacugggacgaaagagcgaaaauagacgauccaacagacucaaaaccagaagacugggacaaaccagaacacauaccagacccagacgcaaaaaaaccagaagacugggacgaagaaauggauggagaaugggaacccccaguaauccaaaacccagaauacaaaggagaauggaaaccaagacaaauagacaacccagacuacaaagggacauggauacacccagaaauagacaauccagaauauagcccagacccaaguauauacgcauacgacaacuucggaguauuaggauuagaucuauggcaagugaaaaguggaacaauauuugacaacuucuuaauaacaaaugaugaagcauacgcagaagaauucggaaacgaaacauggggaguaacaaaagcagcagaaaaacaaaugaaagacaaacaagacgaagaacaaagauuaaaagaagaagaagaagauaaaaaaagaaaagaagaagaagaagcagaagacaaagaagacgacgaagacaaagacgaagacgaagaagacgaagaagacaaagaagaagacgaagaagaagacguaccaggacaagcaaaagacgaauuauaa

SEQ ID NO: 7585 - protein, 417 aa, Artificial Sequence
  calreticulin__Homo_sapiens__P27797
MLLSVPLLLGLLGLAVAEPAVYFKEQFLDGDGWTSRWIESKHKSDFGKFVLSSGKFYGDEEKDKGLQTSQDARFYALSASFEPFSNKGQTLVVQFTVKHEQNIDCGGGYVKLFPNSLDQTDMHGDSEYNIMFGPDICGPGTKKVHVIFNYKGKNVLINKDIRCKDDEFTHLYTLIVRPDNTYEVKIDNSQVESGSLEDDWDFLPPKKIKDPDASKPEDWDERAKIDDPTDSKPEDWDKPEHIPDPDAKKPEDWDEEMDGEWEPPVIQNPEYKGEWKPRQIDNPDYKGTWIHPEIDNPEYSPDPSIYAYDNFGVLGLDLWQVKSGTIFDNFLITNDEAYAEEFGNETWGVTKAAEKQMKDKQDEEQRLKEEEEDKKRKEEEEAEDKEDDEDKDEDEEDEEDKEEDEEEDVPGQAKDEL

SEQ ID NO: 7586 - RNA, 1254 nt, Artificial Sequence
  calreticulin__Homo_sapiens__AAA36582
augcugcuauccgugccgcugcugcucggccuccucggccuggccgucgccgagcccgccgucuacuucaaggagcaguuucuggacggagacggguggacuucccgcuggaucgaauccaaacacaagucagauuuuggcaaauucguucucaguuccggcaaguucuacggugacgaggagaaagauaaagguuugcagacaagccaggaugcacgcuuuuaugcucugucggccaguuucgagccuuucagcaacaaaggccagacgcugguggugcaguucacggugaaacaugagcagaacaucgacugugggggcggcuaugugaagcuguuuccuaauaguuuggaccagacagacaugcacggagacucagaauacaacaucauguuuggucccgacaucuguggcccuggcaccaagaagguucaugucaucuucaacuacaagggcaagaacgugcugaucaacaaggacauccguugcaaggaugaugaguuuacacaccuguacacacugauugugcggccagacaacaccuaugaggugaagauugacaacagccagguggaguccggcuccuuggaagacgauugggacuuccugccacccaagaagauaaaggauccugaugcuucaaaaccggaagacugggaugagcgggccaagaucgaugaucccacagacuccaagccugaggacugggacaagcccgagcauaucccugacccugaugcuaagaagcccgaggacugggaugaagagauggacggagagugggaacccccagugauucagaacccugaguacaagggugaguggaagccccggcagaucgacaacccagauuacaagggcacuuggauccacccagaaauugacaaccccgaguauucucccgaucccaguaucuaugccuaugauaacuuuggcgugcugggccuggaccucuggcaggucaagucuggcaccaucuuugacaacuuccucaucaccaacgaugaggcauacgcugaggaguuuggcaacgagacguggggcguaacaaaggcagcagagaaacaaaugaaggacaaacaggacgaggagcagaggcuuaaggaggaggaagaagacaagaaacgcaaagaggaggaggaggcagaggacaaggaggaugaugaggacaaagaugaggaugaggaggaugaggaggacaaggaggaagaugaggaggaagauguccccggccaggccaaggacgagcuguag

SEQ ID NO: 7587 - RNA, 1254 nt, Artificial Sequence
  derived and/or modified sequence opt1 from calreticulin__Homo_sapiens__AAA36582
augcugcucagcgugccccugcugcucggccugcuggggcucgccgucgccgagccggcgguguacuucaaggagcaguuccuggacggcgacggguggaccucccgcuggaucgagagcaagcacaaguccgacuucggcaaguucgugcugagcuccgggaaguucuacggcgacgaggagaaggacaagggccuccagaccagccaggacgcccgguucuacgcccuguccgccagcuucgagcccuucuccaacaaggggcagacgcuggucgugcaguucaccgugaagcacgagcagaacaucgacugcggcgggggcuacgucaagcuguuccccaacagccucgaccagaccgacaugcacggggacuccgaguacaacaucauguucggccccgacaucugcggcccggggaccaagaaggugcacgugaucuucaacuacaagggcaagaacguccugaucaacaaggacauccgcugcaaggacgacgaguucacgcaccucuacacccugaucgugcggcccgacaacaccuacgaggugaagaucgacaacagccaggucgaguccgggagccuggaggacgacugggacuuccucccgcccaagaagaucaaggaccccgacgccuccaagcccgaggacugggacgagcgcgcgaagaucgacgaccccaccgacagcaagcccgaggacugggacaagccggagcacauccccgaccccgacgccaagaagcccgaggacugggacgaggagauggacggcgagugggagccgcccgugauccagaaccccgaguacaagggcgaguggaagccccggcagaucgacaacccggacuacaaggggacguggauccaccccgagaucgacaaccccgaguacucccccgacccgagcaucuacgccuacgacaacuucggcgugcuggggcuggaccucuggcaggucaaguccggcaccaucuucgacaacuuccugaucaccaacgacgaggccuacgcggaggaguucgggaacgagaccuggggcgugacgaaggccgccgagaagcagaugaaggacaagcaggacgaggagcagcgccugaaggaggaggaggaggacaagaagcggaaggaggaggaggaggccgaggacaaggaggacgacgaggacaaggacgaggacgaggaggacgaggaggacaaggaggaggacgaggaggaggacgugcccggccaggccaaggacgagcucuga

SEQ ID NO: 7588 - RNA, 1254 nt, Artificial Sequence
  derived and/or modified sequence opt2 from calreticulin__Homo_sapiens__AAA36582
augcuccucuccgucccccuccuccucggccuccucggccucgccgucgccgagcccgccgucuacuucaaggagcaguuccucgacggcgacggcuggaccucccgcuggaucgaguccaagcacaaguccgacuucggcaaguucguccucuccuccggcaaguucuacggcgacgaggagaaggacaagggccuccagaccucccaggacgcccgcuucuacgcccucuccgccuccuucgagcccuucuccaacaagggccagacccucgucguccaguucaccgucaagcacgagcagaacaucgacugcggcggcggcuacgucaagcucuuccccaacucccucgaccagaccgacaugcacggcgacuccgaguacaacaucauguucggccccgacaucugcggccccggcaccaagaagguccacgucaucuucaacuacaagggcaagaacguccucaucaacaaggacauccgcugcaaggacgacgaguucacccaccucuacacccucaucguccgccccgacaacaccuacgaggucaagaucgacaacucccaggucgaguccggcucccucgaggacgacugggacuuccucccccccaagaagaucaaggaccccgacgccuccaagcccgaggacugggacgagcgcgccaagaucgacgaccccaccgacuccaagcccgaggacugggacaagcccgagcacauccccgaccccgacgccaagaagcccgaggacugggacgaggagauggacggcgagugggagccccccgucauccagaaccccgaguacaagggcgaguggaagccccgccagaucgacaaccccgacuacaagggcaccuggauccaccccgagaucgacaaccccgaguacucccccgaccccuccaucuacgccuacgacaacuucggcguccucggccucgaccucuggcaggucaaguccggcaccaucuucgacaacuuccucaucaccaacgacgaggccuacgccgaggaguucggcaacgagaccuggggcgucaccaaggccgccgagaagcagaugaaggacaagcaggacgaggagcagcgccucaaggaggaggaggaggacaagaagcgcaaggaggaggaggaggccgaggacaaggaggacgacgaggacaaggacgaggacgaggaggacgaggaggacaaggaggaggacgaggaggaggacguccccggccaggccaaggacgagcucuga

SEQ ID NO: 7589 - RNA, 1254 nt, Artificial Sequence
  derived and/or modified sequence opt3 from calreticulin__Homo_sapiens__AAA36582
augcugcucagcgugccccuucuguugggcuuacuggggcuagccgucgcugagccugcaguuuacuucaaggaacaguuucucgacggagaugguuggaccuccagauggaucgagucuaaacacaagucagacuucggcaaauuugugcugaguagcgggaaguucuauggagaugaagagaaagacaagggccuucaaacaucccaggaugccagguuuuacgcgcugucugcuucguucgaaccauuuucaaacaagggucagacuuugguagugcaguucacggucaaacaugagcaaaauauugacugcgggggaggcuaugugaagcucuuuccgaacagccuggaucagaccgacaugcacggcgauagugaguacaauauaauguucgggcccgacaucuguggaccugguacuaaaaagguucaugugauuuuuaacuauaaaggcaagaauguccugaucaacaaggauauucggugcaaagacgaugaguucacacaccucuacaccuuaaucgugcgcccagacaauacauaugaaguaaagauagacaacucccagguugaaucugggagccuggaggaugacugggauuuucuucccccuaaaaagaucaaagacccagaugccuccaagcccgaggacugggaugaacgagcaaaaauugacgauccuaccgacucaaagccagaggauugggacaagccggaacauauccccgacccugaugccaaaaagccagaggacugggaugaagagauggacggagagugggaacccccugugauucagaauccagaguacaaaggcgaauggaagccccgucaaaucgauaacccggacuacaaagguacuuggauacacccugagauugauaaucccgaauauaguccagacccuagcaucuacgcuuaugauaacuucggggucuugggacuggaccuauggcaagugaagucuggcacaauuuucgauaauuuucucaucaccaacgacgaggcauacgccgaggaguucggcaaugaaacguggggagugacuaaggcugccgaaaaacagaugaaggauaaacaggacgaggaacagagacugaaggaggaggaagaggacaaaaagaggaaggaagaggaggaagcggaggauaaagaagacgaugaggacaaggaugaagacgaggaggaugaagaggacaaagaagaggaugaagaggaggacguccccgggcaggcaaaggaugaacuuuga

SEQ ID NO: 7590 - RNA, 1254 nt, Artificial Sequence
  derived and/or modified sequence opt4 from calreticulin__Homo_sapiens__AAA36582
augcugcugagcgugccccugcugcugggccugcugggccuggccguggccgagcccgccguguacuucaaggagcaguuccuggacggcgacggcuggaccagcagauggaucgagagcaagcacaagagcgacuucggcaaguucgugcugagcagcggcaaguucuacggcgacgaggagaaggacaagggccugcagaccagccaggacgccagauucuacgcccugagcgccagcuucgagcccuucagcaacaagggccagacccugguggugcaguucaccgugaagcacgagcagaacaucgacugcggcggcggcuacgugaagcuguuccccaacagccuggaccagaccgacaugcacggcgacagcgaguacaacaucauguucggccccgacaucugcggccccggcaccaagaaggugcacgugaucuucaacuacaagggcaagaacgugcugaucaacaaggacaucagaugcaaggacgacgaguucacccaccuguacacccugaucgugagacccgacaacaccuacgaggugaagaucgacaacagccagguggagagcggcagccuggaggacgacugggacuuccugccccccaagaagaucaaggaccccgacgccagcaagcccgaggacugggacgagagagccaagaucgacgaccccaccgacagcaagcccgaggacugggacaagcccgagcacauccccgaccccgacgccaagaagcccgaggacugggacgaggagauggacggcgagugggagccccccgugauccagaaccccgaguacaagggcgaguggaagcccagacagaucgacaaccccgacuacaagggcaccuggauccaccccgagaucgacaaccccgaguacagccccgaccccagcaucuacgccuacgacaacuucggcgugcugggccuggaccuguggcaggugaagagcggcaccaucuucgacaacuuccugaucaccaacgacgaggccuacgccgaggaguucggcaacgagaccuggggcgugaccaaggccgccgagaagcagaugaaggacaagcaggacgaggagcagagacugaaggaggaggaggaggacaagaagagaaaggaggaggaggaggccgaggacaaggaggacgacgaggacaaggacgaggacgaggaggacgaggaggacaaggaggaggacgaggaggaggacgugcccggccaggccaaggacgagcuguga

SEQ ID NO: 7591 - RNA, 1254 nt, Artificial Sequence
  derived and/or modified sequence opt5 from calreticulin__Homo_sapiens__AAA36582
augcugcucagcgugccccugcuucugggccuccuggggcuugccgucgcugagccugccguuuacuucaaggaacaguuucuggacggagauggcuggaccuccagauggaucgagucuaaacacaagagcgacuucgggaaauuugugcucuccucuggaaaguucuauggcgaugaagagaaagacaaggggcugcaaacaagccaggaugcgcgguuuuacgcucuguccgccucuuucgaaccguuuagcaacaagggacagacgcucgugguccaguucaccgugaaacaugagcaaaauauugacugcggcggcggguauguuaagcuguuucccaacucccuugaucagacagacaugcacggagauagcgaguacaauaucauguucggcccugacauuugugggcccggaaccaaaaaggugcaugucaucuuuaacuauaaaggcaagaaugugcugauuaacaaggauauccgcugcaaagacgaugaguucacacaccucuacacccugaucguuagaccugacaauacauaugaagugaagauugacaacucucaggucgaauccgggagccuugaggaugacugggauuuucugcccccuaaaaagaucaaagacccggaugccucuaagcccgaggacugggaugaacgggcuaaaauugacgauccuaccgacuccaagcccgaggauugggacaagccugaacauauccccgacccggaugccaaaaagccugaggacugggaugaagagauggacggagagugggaacccccugugauucagaaucccgaguacaaaggcgaauggaagccccgccaaaucgauaacccugacuacaaaggcacguggauucacccggagaucgauaaucccgaauauagcccugaccccucuaucuacgcuuaugauaacuucggggugcucggacuggaccuguggcaggucaaguccggcaccauuuucgauaauuuucucaucacaaacgacgaggccuacgcggaggaguucgggaaugaaaccuggggaguuacaaaggccgcugaaaaacagaugaaggauaaacaggacgaggaacaaagacugaaggaggaggaagaggacaaaaagcggaaggaagaggaggaagccgaggauaaagaagacgaugaggacaaggaugaagacgaggaggaugaagaggacaaagaagaggaugaagaggaggacgugccuggccaggcuaaggaugaacuuuga

SEQ ID NO: 7592 - RNA, 1254 nt, Artificial Sequence
  derived and/or modified sequence opt6 from calreticulin__Homo_sapiens__AAA36582
augcuauuaucaguaccacuucuauuaggauuauuaggauuagcgguagcagaaccagcaguauacuuuaaagaacaauuccuagauggagacggauggacaagcagauggauagaaagcaaacauaaaagcgauuucggaaaauuuguauuaaguucagguaaauucuauggagacgaagaaaaagauaaaggguuacaaacaucacaagaugcaagauucuaugccuuaucagcaucuuuugaaccauucaguaauaaaggacaaacauuaguaguacaauuuacaguaaaacaugaacaaaauauagauugugguggagguuauguaaaacuauuuccaaauucacuagaccaaacagacaugcacggagacagcgaauacaauauaauguucggaccagauauauguggaccaggaacaaaaaaaguacauguaauauucaauuauaaaggaaaaaauguacuaauaaacaaagacauaagauguaaagaugacgaauucacacaccuguacacgcuaauaguaagaccagacaacacauacgaaguaaaaauagauaacucacaaguugaaaguggaucacuagaagacgauugggacuuuuuaccaccaaaaaaaauaaaagacccugacgcaaguaaacccgaagacugggacgaacgagcaaaaauagacgauccaacagacucaaaaccggaagauugggauaaaccagaacacauaccagauccagaugcaaaaaagccagaagacugggacgaagaaauggacggagaaugggaaccaccaguaauacagaacccagaauauaaaggagaauggaaaccaagacaaauagauaaccccgacuacaaaggaacauggauacauccagaaauagauaacccagaauauaguccagauccaaguauauacgcauacgacaacuuuggagucuuaggacuagaucuauggcaaguaaaaaguggaacaauauuugacaauuucuuaauaacaaacgaugaagcguacgcagaagaauucggaaacgaaacauggggaguaacuaaagcagcugaaaaacaaaugaaagauaaacaagaugaagaacaaagguugaaagaagaagaagaggauaaaaaaagaaaagaagaagaggaagcagaagauaaagaagaugacgaagacaaagacgaagaugaagaagaugaagaagacaaagaagaagacgaagaagaagacguaccaggacaagcaaaagaugaauuauaa

SEQ ID NO: 7593 - protein, 384 aa, Artificial Sequence
  calreticulin__Homo_sapiens__Q96L12
MARALVQLWAICMLRVALATVYFQEEFLDGEHWRNRWLQSTNDSRFGHFRLSSGKFYGHKEKDKGLQTTQNGRFYAISARFKPFSNKGKTLVIQYTVKHEQKMDCGGGYIKVFPADIDQKNLNGKSQYYIMFGPDICGFDIKKVHVILHFKNKYHENKKLIRCKVDGFTHLYTLILRPDLSYDVKIDGQSIESGSIEYDWNLTSLKKETSPAESKDWEQTKDNKAQDWEKHFLDASTSKQSDWNGDLDGDWPAPMLQKPPYQDGLKPEGIHKDVWLHRKMKNTDYLTQYDLSEFENIGAIGLELWQVRSGTIFDNFLITDDEEYADNFGKATWGETKGPEREMDAIQAKEEMKKAREEEEEELLSGKINRHEHYFNQFHRRNEL

SEQ ID NO: 7594 - RNA, 1155 nt, Artificial Sequence
  calreticulin__Homo_sapiens__BAB71655
auggcccgggcuuugguccagcucugggccauaugcaugcugcgaguggcgcuggcuaccgucuauuuccaagaggaauuucuagacggagagcauuggagaaaccgaugguugcaguccaccaaugacucccgauuugggcauuuuagacuuucgucgggcaaguuuuauggucauaaagagaaagauaaaggucugcaaaccacucagaauggccgauucuaugccaucucugcacgcuucaaaccguucagcaauaaagggaaaacucugguuauucaguacacaguaaaacaugagcagaagauggacuguggagggggcuacauuaaggucuuuccugcagacauugaccagaagaaccugaauggaaaaucgcaauacuauauuauguuuggacccgauauuuguggauuugauaucaagaaaguucauguuauuuuacauuucaagaauaaguaucacgaaaacaagaaacugaucagguguaagguugauggcuucacacaccuguacacucuaauuuuaagaccagaucuuucuuaugaugugaaaauugauggucagucaauugaauccggcagcauagaguacgacuggaacuuaacaucacucaagaaggaaacguccccggcagaaucgaaggauugggaacagacuaaagacaacaaagcccaggacugggagaagcauuuucuggacgccagcaccagcaagcagagcgacuggaacggugaccuggauggggacuggccagcgccgaugcuccagaagcccccguaccaggauggccugaaaccagaagguauucauaaagacgucuggcuccaccguaagaugaagaauaccgacuauuugacgcaguaugaccucucagaauuugagaacauuggugccauuggccuggagcuuuggcaggugagaucuggaaccauuuuugauaacuuucugaucacagaugaugaagaguaugcagauaauuuuggcaaggccaccuggggcgaaaccaaggguccagaaagggagauggaugccauacaggccaaggaggaaaugaagaaggcccgcgaggaagaggaggaagagcugcugucgggaaaaauuaacaggcacgaacauuacuucaaucaauuucacagaaggaaugaacuuuag

SEQ ID NO: 7595 - RNA, 1155 nt, Artificial Sequence
  derived and/or modified sequence opt1 from calreticulin__Homo_sapiens__BAB71655
auggcccgcgcccuggugcagcucugggcgaucugcaugcugcggguggcccuggccaccguguacuuccaggaggaguuccucgacggcgagcacuggcgcaaccgguggcugcagagcaccaacgacucccgcuucgggcacuuccggcugagcuccggcaaguucuacgggcacaaggagaaggacaagggccuccagacgacccagaacgggcgcuucuacgccaucagcgcccgguucaagcccuucuccaacaagggcaagacccuggugauccaguacaccgucaagcacgagcagaagauggacugcggcgggggcuacaucaagguguucccggcggacaucgaccagaagaaccugaacggcaagagccaguacuacaucauguucgggcccgacaucugcggguucgacaucaagaaggugcacgucauccuccacuucaagaacaaguaccacgagaacaagaagcugauccgcugcaagguggacggcuucacgcaccuguacacccucauccugcggcccgaccuguccuacgacgugaagaucgacggccagagcaucgaguccgggagcaucgaguacgacuggaaccucaccucccugaagaaggagaccagccccgccgaguccaaggacugggagcagacgaaggacaacaaggcccaggacugggagaagcacuuccuggacgccagcaccuccaagcagagcgacuggaacggcgaccucgacggggacuggccggcgcccaugcugcagaagccgcccuaccaggacggccugaagcccgagggcauccacaaggacgucuggcuccaccgcaagaugaagaacaccgacuaccugacccaguacgaccuguccgaguucgagaacaucggggccaucggccucgagcuguggcagguccggagcgggacgaucuucgacaacuuccugaucaccgacgacgaggaguacgccgacaacuucggcaaggccaccuggggcgagaccaaggggcccgagcgcgagauggacgccauccaggcgaaggaggagaugaagaaggcccgggaggaggaggaggaggagcuccuguccggcaagaucaaccgccacgagcacuacuucaaccaguuccaccggcgcaacgagcuguga

SEQ ID NO: 7596 - RNA, 1155 nt, Artificial Sequence
  derived and/or modified sequence opt2 from calreticulin__Homo_sapiens__BAB71655
auggcccgcgcccucguccagcucugggccaucugcaugcuccgcgucgcccucgccaccgucuacuuccaggaggaguuccucgacggcgagcacuggcgcaaccgcuggcuccaguccaccaacgacucccgcuucggccacuuccgccucuccuccggcaaguucuacggccacaaggagaaggacaagggccuccagaccacccagaacggccgcuucuacgccaucuccgcccgcuucaagcccuucuccaacaagggcaagacccucgucauccaguacaccgucaagcacgagcagaagauggacugcggcggcggcuacaucaaggucuuccccgccgacaucgaccagaagaaccucaacggcaagucccaguacuacaucauguucggccccgacaucugcggcuucgacaucaagaagguccacgucauccuccacuucaagaacaaguaccacgagaacaagaagcucauccgcugcaaggucgacggcuucacccaccucuacacccucauccuccgccccgaccucuccuacgacgucaagaucgacggccaguccaucgaguccggcuccaucgaguacgacuggaaccucaccucccucaagaaggagaccucccccgccgaguccaaggacugggagcagaccaaggacaacaaggcccaggacugggagaagcacuuccucgacgccuccaccuccaagcaguccgacuggaacggcgaccucgacggcgacuggcccgcccccaugcuccagaagccccccuaccaggacggccucaagcccgagggcauccacaaggacgucuggcuccaccgcaagaugaagaacaccgacuaccucacccaguacgaccucuccgaguucgagaacaucggcgccaucggccucgagcucuggcagguccgcuccggcaccaucuucgacaacuuccucaucaccgacgacgaggaguacgccgacaacuucggcaaggccaccuggggcgagaccaagggccccgagcgcgagauggacgccauccaggccaaggaggagaugaagaaggcccgcgaggaggaggaggaggagcuccucuccggcaagaucaaccgccacgagcacuacuucaaccaguuccaccgccgcaacgagcucuga

SEQ ID NO: 7597 - RNA, 1155 nt, Artificial Sequence
  derived and/or modified sequence opt3 from calreticulin__Homo_sapiens__BAB71655
auggccagagcucuggugcagcucugggcaaucugcaugcuuagggucgcccuggcgaccguuuacuuccaagaggaauuuuuggacggcgagcacuggcggaaccgcugguuacagagcacaaaugauucccgauucgggcauuuucgucugucuucaggaaaguucuauggucacaaagaaaaggacaaaggccuacagacuacgcagaacgggagauuuuacgcuauuagugccagguucaagcccuuuagcaauaaaggaaagacccucgugauacaauauacaguaaagcaugagcagaaaauggauuguggcgguggguacaucaagguguucccugcagacauugaucagaaaaaccugaauggaaagucccaguauuacaucauguuuggcccagacauuugcggcuucgauaucaaaaagguccacgugauacuucauuuuaagaacaaauaucacgaaaauaagaaacugauccgguguaagguugacggguucacucacuuguacacccucauucugcgcccggaucugucuuacgacgugaaaaucgauggacaaucgauugagucagguagcaucgaguaugacuggaaccucacaaguuuaaagaaagaaaccucccccgccgagucuaaggauugggaacagacuaaggacaauaaagcucaggacugggagaagcauuuucuggaugcaagcacauccaaacagucagacuggaacggcgaucuugacggggauuggccugccccaauguugcaaaagcccccuuaccaggacggacugaaaccagagggcauacacaaggaugucuggcuacauagaaagaugaaaaauaccgacuaucucacgcaguacgaucugagugaauuugagaacauuggugcuaucgggcuugaacuguggcaagugaggagcggaacuauuuucgacaauuucuugaucaccgaugacgaggaauaugccgacaacuucggcaaggcgacauggggcgagacuaaagggcccgagcgggaaauggaugcaauccaggccaaggaggaaaugaaaaaggcucgcgaggaagaggaggaggaacuccugucuggaaagauuaaucgacacgaacacuacuuuaaccaguuccauagaaggaacgaguuauga

SEQ ID NO: 7598 - RNA, 1155 nt, Artificial Sequence
  derived and/or modified sequence opt4 from calreticulin__Homo_sapiens__BAB71655
auggccagagcccuggugcagcugugggccaucugcaugcugagaguggcccuggccaccguguacuuccaggaggaguuccuggacggcgagcacuggagaaacagauggcugcagagcaccaacgacagcagauucggccacuucagacugagcagcggcaaguucuacggccacaaggagaaggacaagggccugcagaccacccagaacggcagauucuacgccaucagcgccagauucaagcccuucagcaacaagggcaagacccuggugauccaguacaccgugaagcacgagcagaagauggacugcggcggcggcuacaucaagguguuccccgccgacaucgaccagaagaaccugaacggcaagagccaguacuacaucauguucggccccgacaucugcggcuucgacaucaagaaggugcacgugauccugcacuucaagaacaaguaccacgagaacaagaagcugaucagaugcaagguggacggcuucacccaccuguacacccugauccugagacccgaccugagcuacgacgugaagaucgacggccagagcaucgagagcggcagcaucgaguacgacuggaaccugaccagccugaagaaggagaccagccccgccgagagcaaggacugggagcagaccaaggacaacaaggcccaggacugggagaagcacuuccuggacgccagcaccagcaagcagagcgacuggaacggcgaccuggacggcgacuggcccgcccccaugcugcagaagccccccuaccaggacggccugaagcccgagggcauccacaaggacguguggcugcacagaaagaugaagaacaccgacuaccugacccaguacgaccugagcgaguucgagaacaucggcgccaucggccuggagcuguggcaggugagaagcggcaccaucuucgacaacuuccugaucaccgacgacgaggaguacgccgacaacuucggcaaggccaccuggggcgagaccaagggccccgagagagagauggacgccauccaggccaaggaggagaugaagaaggccagagaggaggaggaggaggagcugcugagcggcaagaucaacagacacgagcacuacuucaaccaguuccacagaagaaacgagcuguga

SEQ ID NO: 7599 - RNA, 1155 nt, Artificial Sequence
  derived and/or modified sequence opt5 from calreticulin__Homo_sapiens__BAB71655
auggccagagcucuggugcagcucugggccaucugcaugcugcgggucgcgcuugcuaccguuuacuuccaagaggaauuucuggacggcgagcacuggcgcaacagauggcuccagagcacaaaugauucccgguucgggcauuuucgccugucuagcggaaaguucuauggccacaaagaaaaggacaaagggcuucagacgacccagaacggaagauuuuacgccauuuccgcccgguucaagcccuuuucuaauaaaggcaagacacuggugauccaauauaccgugaagcaugagcagaaaauggauugugggggaggcuacauuaaggucuucccugcugacaucgaucagaaaaaccucaauggcaagagccaguauuacauuauguuugggccggacaucugcggauucgauaucaaaaaggugcacguuauucugcauuuuaagaacaaauaucacgaaaauaagaaacugauccgcuguaagguggacggcuucacacaccucuacacccugauucuuagacccgaucuguccuacgacgucaaaaucgaugggcaaucuauugagagcggauccaucgaguaugacuggaaccucacaagccugaagaaagaaaccucuccugccgaguccaaggauugggaacagacgaaggacaauaaagcucaggacugggagaagcauuuucuugaugccagcaccucuaaacaguccgacuggaacggcgaucuggacggggauuggcccgcgccuaugcuccaaaagcccccuuaccaggacggacugaaaccggagggcauucacaaggauguguggcugcaucggaagaugaaaaauacagacuaucucacccaguacgaucugagcgaguucgagaacaucggcgccaucgggcuugaacuguggcaaguucgcucuggaacaauuuucgacaauuuucucaucaccgaugacgaggaauaugcugacaacuucggcaaggccacguggggagagacaaaagggcccgagagagaaauggaugcuauucaggccaaggaggaaaugaaaaaggcgcgggaggaagaggaggaagaacugcuuuccggcaagaucaaucgccacgaacacuacuuuaaccaguuccauagacggaacgagcuguga

SEQ ID NO: 7600 - RNA, 1155 nt, Artificial Sequence
  derived and/or modified sequence opt6 from calreticulin__Homo_sapiens__BAB71655
auggccagagcacuaguccaauuaugggcaauaugcauguuacgaguugcacuagcuacaguauacuuucaagaagaauuccuagacggagaacacuggcgaaacagauggcuacaaucaacaaaugauucaagauucggacacuucagacuaaguagcggaaaauucuauggacacaaagaaaaagacaaaggccuacaaacaacacaaaauggaagauuuuaugcaauaucagcaagauucaaaccauucucaaauaaaggaaaaacacuaguaauacaauacacaguaaaacaugaacagaaaauggacugcggaggaggauacaucaaggucuucccagcagacauagaccaaaaaaacuuaaacggcaaaucacaauacuacauaauguuuggaccagacaucuguggauucgacauaaaaaaaguacauguaauacuacacuucaaaaauaaauaccacgaaaauaaaaaacuaauaagaugcaaaguagacggauuuacacacuuauacacacuaauauuacgaccagaccuaucauacgacguaaaaaucgacggacaaucaauagaaucaggaucaauagaauacgacuggaaccuaacaucauuaaaaaaagaaacaucaccagcagaaucaaaagacugggaacaaacaaaagacaacaaagcacaagacugggaaaaacacuuccuagacgcaagcacaagcaaacaaucagacuggaacggagaucuagacggagacuggccagcaccaauguuacaaaaaccaccuuaucaagacggacuaaaaccagaaggaauacauaaagacguaugguuacacaggaaaaugaaaaauacagacuaccuaacacaauacgacuuaucagaauucgaaaacauaggagcaauaggacuagaacuauggcaaguaagaaguggaacaauauucgacaauuuccuaauaacagacgacgaagaauacgcagacaauuucgguaaagcaacauggggcgaaacaaaaggaccagaaagagaaauggacgcaauacaagcaaaagaagaaaugaaaaaagcaagagaagaagaagaagaagaacuacuuaguggcaaaauaaacagacacgaacacuacuucaaccaauuucacagaagaaaugaauuauaa

SEQ ID NO: 7601 - protein, 999 aa, Artificial Sequence
  GRP170_(ORP150)__Homo_sapiens__Q9Y4L1
MADKVRRQRPRRRVCWALVAVLLADLLALSDTLAVMSVDLGSESMKVAIVKPGVPMEIVLNKESRRKTPVIVTLKENERFFGDSAASMAIKNPKATLRYFQHLLGKQADNPHVALYQARFPEHELTFDPQRQTVHFQISSQLQFSPEEVLGMVLNYSRSLAEDFAEQPIKDAVITVPVFFNQAERRAVLQAARMAGLKVLQLINDNTATALSYGVFRRKDINTTAQNIMFYDMGSGSTVCTIVTYQMVKTKEAGMQPQLQIRGVGFDRTLGGLEMELRLRERLAGLFNEQRKGQRAKDVRENPRAMAKLLREANRLKTVLSANADHMAQIEGLMDDVDFKAKVTRVEFEELCADLFERVPGPVQQALQSAEMSLDEIEQVILVGGATRVPRVQEVLLKAVGKEELGKNINADEAAAMGAVYQAAALSKAFKVKPFVVRDAVVYPILVEFTREVEEEPGIHSLKHNKRVLFSRMGPYPQRKVITFNRYSHDFNFHINYGDLGFLGPEDLRVFGSQNLTTVKLKGVGDSFKKYPDYESKGIKAHFNLDESGVLSLDRVESVFETLVEDSAEEESTLTKLGNTISSLFGGGTTPDAKENGTDTVQEEEESPAEGSKDEPGEQVELKEEAEAPVEDGSQPPPPEPKGDATPEGEKATEKENGDKSEAQKPSEKAEAGPEGVAPAPEGEKKQKPARKRRMVEEIGVELVVLDLPDLPEDKLAQSVQKLQDLTLRDLEKQEREKAANSLEAFIFETQDKLYQPEYQEVSTEEQREEISGKLSAASTWLEDEGVGATTVMLKEKLAELRKLCQGLFFRVEERKKWPERLSALDNLLNHSSMFLKGARLIPEMDQIFTEVEMTTLEKVINETWAWKNATLAEQAKLPATEKPVLLSKDIEAKMMALDREVQYLLNKAKFTKPRPRPKDKNGTRAEPPLNASASDQGEKVIPPAGQTEDAEPISEPEKVETGSEPGDTEPLELGGPGAEPEQKEQSTGQKRPLKNDEL

SEQ ID NO: 7602 - RNA, 3000 nt, Artificial Sequence
  GRP170_(ORP150)__Homo_sapiens__AAC50947
auggcagacaaaguuaggaggcagaggccgaggaggcgagucuguugggccuugguggcugugcucuuggcagaccuguuggcacugagugauacacuggcagugaugucuguggaccugggcagugaguccaugaagguggccauugucaaaccuggagugcccauggaaauugucuugaauaaggaaucucggaggaaaacaccggugaucgugacccugaaagaaaaugaaagauucuuuggagacagugcagcaagcauggcgauuaagaauccaaaggcuacgcuacguuacuuccagcaccuccuggggaagcaggcagauaacccccauguagcucuuuaccaggcccgcuucccggagcacgagcugacuuucgacccacagaggcagacugugcacuuucagaucagcucgcagcugcaguucucaccugaggaaguguugggcaugguucucaauuauucucguucucuagcugaagauuuugcagagcagcccaucaaggaugcagugaucaccgugccagucuucuucaaccaggccgagcgccgagcugugcugcaggcugcucguauggcuggccucaaagugcugcagcucaucaaugacaacaccgccacugcccucagcuauggugucuuccgccggaaagauauuaacaccacugcccagaauaucauguucuaugacaugggcucaggcagcaccguaugcaccauugugaccuaccagauggugaagacuaaggaagcugggaugcagccacagcugcagauccggggaguaggauuugaccguacccuggggggccuggagauggagcuccggcuucgagaacgccuggcugggcuuuucaaugagcagcgcaagggucagagagcaaaggaugugcgggagaacccgcgugccauggccaagcugcugcgugaggcuaaucggcucaaaaccguccucagugccaacgcugaccacauggcacagauugaaggccugauggaugauguggacuucaaggcaaaagugacucguguggaauuugaggaguugugugcagacuuguuugagcgggugccugggccuguacagcaggcccuccagagugccgaaaugagucuggaugagauugagcaggugauccugguggguggggccacucggguccccagaguucaggaggugcugcugaaggccgugggcaaggaggagcuggggaagaacaucaaugcagaugaagcagccgccaugggggcaguguaccaggcagcugcgcucagcaaagccuuuaaagugaagccauuugucguccgagaugcaguggucuaccccauccugguggaguucacgagggagguggaggaggagccugggauucacagccugaagcacaauaaacggguacucuucucucggauggggcccuacccucaacgcaaagucaucaccuuuaaccgcuacagccaugauuucaacuuccacaucaacuacggcgaccugggcuuccuggggccugaagaucuucggguauuuggcucccagaaucugaccacagugaagcuaaaaggggugggugacagcuucaagaaguauccugacuacgaguccaagggcaucaaggcucacuucaaccuggaugagaguggcgugcucagucuagacaggguggagucuguauuugagacacugguagaggacagcgcagaagaggaaucuacucucaccaaacuuggcaacaccauuuccagccuguuuggaggcgguaccacaccagaugccaaggagaaugguacugauacuguccaggaggaagaggagagcccugcagaggggagcaaggacgagccuggggagcagguggagcucaaggaggaagcugaggccccaguggaggauggcucucagcccccacccccugaaccuaagggagaugcaaccccugagggagaaaaggccacagaaaaagaaaauggggacaagucugaggcccagaaaccaagugagaaggcagaggcagggccugagggcgucgcuccagccccagagggagagaagaagcagaagcccgccaggaagcggcgaaugguagaggagaucgggguggagcugguuguucuggaccugccugacuugccagaggauaagcuggcucagucggugcagaaacuucaggacuugacacuccgagaccuggagaagcaggaacgggaaaaagcugccaacagcuuggaagcguucauauuugagacccaggacaagcuguaccagcccgaguaccaggaaguguccacagaggagcagcgugaggagaucucugggaagcucagcgccgcauccaccuggcuggaggaugaggguguuggagccaccacagugauguugaaggagaagcuggcugagcugaggaagcugugccaagggcuguuuuuucggguagaggagcgcaagaaguggcccgaacggcugucugcccucgauaaucuccucaaccauuccagcauguuccucaagggggcccggcucaucccagagauggaccagaucuucacugagguggagaugacaacguuagagaaagucaucaaugagaccugggccuggaagaaugcaacucuggccgagcaggcuaagcugcccgccacagagaagccuguguugcucucaaaagacauugaagcuaagaugauggcccuggaccgagaggugcaguaucugcucaauaaggccaaguuuaccaagccccggccccggccuaaggacaagaaugggacccgggcagagccaccccucaaugccagugccagugaccagggggagaaggucaucccuccagcaggccagacugaagaugcagagcccauuucagaaccugagaaaguagagacuggauccgagccaggagacacugagccuuuggaguuaggagguccuggagcagaaccugaacagaaagaacaaucgacaggacagaagcggccuuugaagaacgacgaacuauaa

SEQ ID NO: 7603 - RNA, 3000 nt, Artificial Sequence
  derived and/or modified sequence opt1 from GRP170_(ORP150)__Homo_sapiens__AAC50947
auggccgacaaggugcgccggcagcgcccccggcgccgggucugcugggcccugguggcggugcuccuggccgaccugcucgcccugagcgacacccuggccgucauguccguggaccucggcagcgaguccaugaagguggccaucgucaagccgggggugcccauggagaucgugcugaacaaggagagccgccggaagacccccgucaucgugacgcugaaggagaacgagcgcuucuucggcgacuccgcggccagcauggccaucaagaaccccaaggccacccuccgguacuuccagcaccuccuggggaagcaggcggacaacccgcacguggcccuguaccaggcccgcuuccccgagcacgagcugaccuucgacccccagcggcagaccguccacuuccagaucuccagccagcugcaguucucccccgaggaggugcucggcauggugcugaacuacagccgcucccuggccgaggacuucgccgagcagccgaucaaggacgcggucaucacggugcccguguucuucaaccaggccgagcggcgcgccguccuccaggccgcccggauggcggggcugaaggugcugcagcucaucaacgacaacaccgccaccgcccugagcuacggcguguuccgccggaaggacaucaacaccacggcccagaacaucauguucuacgacaugggcuccgggagcaccgucugcaccaucgugaccuaccagauggugaagacgaaggaggccggcaugcagccccagcugcagauccgcggggucggcuucgaccggacccucgggggccuggagauggagcugcgccuccgggagcgccuggcgggccuguucaacgagcagcgcaaggggcagcgggccaaggacgugcgcgagaacccccgggccauggccaagcuccugcgcgaggccaaccggcugaagaccguccucuccgcgaacgccgaccacauggcccagaucgagggccugauggacgacguggacuucaaggccaaggugacccgcgucgaguucgaggagcugugcgcggaccucuucgagcgggugccggggcccgugcagcaggcccugcagagcgccgagaugucccuggacgagaucgagcaggucauccucgugggcggcgccacgcgcgugccccggguccaggaggugcugcugaaggccguggggaaggaggagcucggcaagaacaucaacgcggacgaggccgccgccaugggggccgucuaccaggcggccgcccugagcaaggccuucaaggugaagcccuucgugguccgcgacgccgugguguacccgauccuggucgaguucacccgggagguggaggaggagcccggcauccacucccucaagcacaacaagcgcgugcuguucagccggauggggcccuacccccagcgcaaggucaucaccuucaaccgguacagccacgacuucaacuuccacaucaacuacggcgaccugggcuuccucgggccggaggaccugcgcguguucggcucccagaaccugaccacggugaagcugaagggggucggcgacagcuucaagaaguaccccgacuacgaguccaaggggaucaaggcgcacuucaaccucgacgagagcggcgugcugucccuggaccggguggagagcgucuucgagacccucguggaggacuccgccgaggaggagagcacccugaccaagcugggcaacacgaucuccagccucuucgggggcgggaccacccccgacgccaaggagaacggcaccgacacggugcaggaggaggaggagucccccgccgaggggagcaaggacgagccgggcgagcaggucgagcugaaggaggaggcggaggcccccguggaggacggcucccagccgccgccgcccgagcccaagggggacgccacccccgagggcgagaaggccaccgagaaggagaacggggacaagagcgaggcccagaagcccuccgagaaggcggaggccggccccgagggcguggcccccgcccccgagggggagaagaagcagaagcccgcccgcaagcggcgcauggucgaggagaucggcguggagcuggugguccucgaccugcccgaccugcccgaggacaagcucgcgcagagcgugcagaagcugcaggaccugacccuccgcgaccuggagaagcaggagcgggagaaggccgccaacucccuggaggccuucaucuucgagacgcaggacaagcucuaccagccggaguaccaggaggugagcaccgaggagcagcgcgaggagaucuccgggaagcugagcgccgcgagcaccuggcuggaggacgagggcgucggggccaccacggugaugcucaaggagaagcuggccgagcugcggaagcucugccagggccuguucuuccgcguggaggagcggaagaaguggcccgagcgccuguccgcccucgacaaccugcugaaccacagcuccauguuccucaagggcgcgcggcugauccccgagauggaccagaucuucaccgaggucgagaugaccacccuggagaaggugaucaacgagaccugggccuggaagaacgccacgcucgccgagcaggccaagcugcccgcgaccgagaagccggugcugcucagcaaggacaucgaggccaagaugauggcccuggaccgcgagguccaguaccugcucaacaaggccaaguucaccaagccccggccccgccccaaggacaagaacgggacccgggccgagccgccccugaacgcguccgccagcgaccagggcgagaaggugaucccgcccgccgggcagacggaggacgccgagcccaucuccgagcccgagaagguggagaccggcagcgagcccggggacaccgagccccuggagcucggcggcccgggggccgagcccgagcagaaggagcaguccaccggccagaagcgcccccugaagaacgacgagcuguga

SEQ ID NO: 7604 - RNA, 3000 nt, Artificial Sequence
  derived and/or modified sequence opt2 from GRP170_(ORP150)__Homo_sapiens__AAC50947
auggccgacaagguccgccgccagcgcccccgccgccgcgucugcugggcccucgucgccguccuccucgccgaccuccucgcccucuccgacacccucgccgucauguccgucgaccucggcuccgaguccaugaaggucgccaucgucaagcccggcguccccauggagaucguccucaacaaggagucccgccgcaagacccccgucaucgucacccucaaggagaacgagcgcuucuucggcgacuccgccgccuccauggccaucaagaaccccaaggccacccuccgcuacuuccagcaccuccucggcaagcaggccgacaacccccacgucgcccucuaccaggcccgcuuccccgagcacgagcucaccuucgacccccagcgccagaccguccacuuccagaucuccucccagcuccaguucucccccgaggagguccucggcaugguccucaacuacucccgcucccucgccgaggacuucgccgagcagcccaucaaggacgccgucaucaccguccccgucuucuucaaccaggccgagcgccgcgccguccuccaggccgcccgcauggccggccucaagguccuccagcucaucaacgacaacaccgccaccgcccucuccuacggcgucuuccgccgcaaggacaucaacaccaccgcccagaacaucauguucuacgacaugggcuccggcuccaccgucugcaccaucgucaccuaccagauggucaagaccaaggaggccggcaugcagccccagcuccagauccgcggcgucggcuucgaccgcacccucggcggccucgagauggagcuccgccuccgcgagcgccucgccggccucuucaacgagcagcgcaagggccagcgcgccaaggacguccgcgagaacccccgcgccauggccaagcuccuccgcgaggccaaccgccucaagaccguccucuccgccaacgccgaccacauggcccagaucgagggccucauggacgacgucgacuucaaggccaaggucacccgcgucgaguucgaggagcucugcgccgaccucuucgagcgcguccccggccccguccagcaggcccuccaguccgccgagaugucccucgacgagaucgagcaggucauccucgucggcggcgccacccgcgucccccgcguccaggagguccuccucaaggccgucggcaaggaggagcucggcaagaacaucaacgccgacgaggccgccgccaugggcgccgucuaccaggccgccgcccucuccaaggccuucaaggucaagcccuucgucguccgcgacgccgucgucuaccccauccucgucgaguucacccgcgaggucgaggaggagcccggcauccacucccucaagcacaacaagcgcguccucuucucccgcaugggccccuacccccagcgcaaggucaucaccuucaaccgcuacucccacgacuucaacuuccacaucaacuacggcgaccucggcuuccucggccccgaggaccuccgcgucuucggcucccagaaccucaccaccgucaagcucaagggcgucggcgacuccuucaagaaguaccccgacuacgaguccaagggcaucaaggcccacuucaaccucgacgaguccggcguccucucccucgaccgcgucgaguccgucuucgagacccucgucgaggacuccgccgaggaggaguccacccucaccaagcucggcaacaccaucuccucccucuucggcggcggcaccacccccgacgccaaggagaacggcaccgacaccguccaggaggaggaggagucccccgccgagggcuccaaggacgagcccggcgagcaggucgagcucaaggaggaggccgaggcccccgucgaggacggcucccagccccccccccccgagcccaagggcgacgccacccccgagggcgagaaggccaccgagaaggagaacggcgacaaguccgaggcccagaagcccuccgagaaggccgaggccggccccgagggcgucgcccccgcccccgagggcgagaagaagcagaagcccgcccgcaagcgccgcauggucgaggagaucggcgucgagcucgucguccucgaccuccccgaccuccccgaggacaagcucgcccaguccguccagaagcuccaggaccucacccuccgcgaccucgagaagcaggagcgcgagaaggccgccaacucccucgaggccuucaucuucgagacccaggacaagcucuaccagcccgaguaccaggaggucuccaccgaggagcagcgcgaggagaucuccggcaagcucuccgccgccuccaccuggcucgaggacgagggcgucggcgccaccaccgucaugcucaaggagaagcucgccgagcuccgcaagcucugccagggccucuucuuccgcgucgaggagcgcaagaaguggcccgagcgccucuccgcccucgacaaccuccucaaccacuccuccauguuccucaagggcgcccgccucauccccgagauggaccagaucuucaccgaggucgagaugaccacccucgagaaggucaucaacgagaccugggccuggaagaacgccacccucgccgagcaggccaagcuccccgccaccgagaagcccguccuccucuccaaggacaucgaggccaagaugauggcccucgaccgcgagguccaguaccuccucaacaaggccaaguucaccaagccccgcccccgccccaaggacaagaacggcacccgcgccgagcccccccucaacgccuccgccuccgaccagggcgagaaggucaucccccccgccggccagaccgaggacgccgagcccaucuccgagcccgagaaggucgagaccggcuccgagcccggcgacaccgagccccucgagcucggcggccccggcgccgagcccgagcagaaggagcaguccaccggccagaagcgcccccucaagaacgacgagcucuga

SEQ ID NO: 7605 - RNA, 3000 nt, Artificial Sequence
  derived and/or modified sequence opt3 from GRP170_(ORP150)__Homo_sapiens__AAC50947
auggccgacaaggugagaaggcagcggccccgccgacgugucugcugggcucugguugcagugcuccuugccgaucuguuggcguuaagcgacacccuggcuguaauguccguggaucuaggcucugagucaaugaaagucgccaucgugaagccugggguuccaauggaaauugugcucaacaaagagaguagaaggaagacaccggucauagugacucugaaagaaaaugagcgguucuuuggagacagcgcagccuccauggcuaucaagaaccccaaggcaacgcuucgcuacuuccaacaccuguuggguaaacaggccgauaauccucauguagcucucuaucaggccagauuuccagaacacgagcugaccuucgacccccagaggcaaacaguucauuuucagauuucuucgcagcugcaguucucaccugaggaagugcucggcauggucuuaaacuacagccggagucuggcggaggauuuugcagaacaaccaaucaaggacgccgugauuacugugcccgucuucuuuaaucaggcugagcgccgagccguucuucaggcagcuagaauggccggguugaaagugcugcagcuaaucaacgauaauaccgcgacagcccucuccuauggaguauucaggcggaaggacauaaacaccacugcacaaaauaucauguuuuacgauaugggcucugguagcacaguguguaccauugucacguaucagauggugaaaacuaaggaggcugggaugcagccucaacugcagauccguggaguuggcuucgaccgcacccuuggcgggcuggaaauggaguugagacucagggaacggcuggccggauuauuuaacgagcagcgaaagggucagcgcgcuaaagaugugagagaaaauccaagggccauggcaaagcugcuccgggaggccaaccgccuuaaaacaguccuguccgcuaaugcggaccacauggcacaaauugagggcuugauggacgauguggacuucaaggccaaaguaacuagaguugaguucgaggaacuaugcgcugaucuguuugagagggugccggggcccguccagcaggcccuccagucagcagaaaugagucuggacgagaucgagcaagugauacuugucggaggcgccacccgugugccucggguucaggaagugcuguugaaggcuguagguaaagaggaacucgggaagaacauuaaugccgaugaggcagcggcuaugggagccgucuaccaggcagccgcucugagcaaggccuucaaagugaagccauuuguugugcgagacgcagucguguaucccaucuuaguagaguucacaagagagguggaggaagaaccuggcauucauucucugaaacacaacaagaggguucuauuuucccgcaugggcccauacccccagcggaaagucaucaccuucaacagauacucacacgauuuuaauuuccauaucaacuauggggaccucggauuucuggguccggaagaucuuaggguguucggcagccaaaauuugacgacugugaagcugaagggggucggagacaguuuuaaaaaguacccugauuaugagucuaaaggcauuaaggcucacuucaaccucgacgaguccgguguucugagccuugaccgcguggaaucgguguuugagacacugguagaagauucugccgaggaagaguccaccuugacuaaacucgggaauacaauaucaagucuguucggcggaggcaccacgcccgacgcgaaggagaacgggaccgauacaguccaggaagaggaagagagcccagccgaaggauccaaggacgagccuggugaacagguggaauuaaaagaggaagcugaggcacccguugaagauggcucucagccacccccuccagagccgaagggggacgccacucccgagggagaaaaagcuaccgagaaggaaaauggcgauaaaagcgaggcccaaaagccuucagagaaggcagaagcggguccagaggggguggcccccgcuccugaaggcgagaaaaagcagaaaccagcccgaaagcggcguauggucgaagagaucggaguggagcugguugugcuagaccuccccgaucugccggaagacaaacuugcacagaguguacaaaaguugcaggaucugacacucagagaccuggagaaacaggaaagggagaaggcugccaacuccuuagaagcauucauuuuugagacucaggauaagcuguaccaaccugaguaucaggaagucagcaccgaggaacagcgcgaggaaaucucuggcaaacuuucagccgcuaguacaugguuggaggacgagggggugggagcgaccacugugaugcucaaggaaaaacuggccgagcuacggaagcugugucagggucucuucuuuagagucgaagagaggaaaaaguggccagagcgacugagcgcacuugacaauuugcugaaccauuccucuauguucuuaaagggcgcucgccucauacccgaaauggaucaaauuuuuacggagguugaaaugacaacccuggagaaagugaucaaugaaacuugggccuggaagaacgccacccuugcugagcaggcaaaacugccugccacagagaagcccguauugcucucgaaagacaucgaagcgaagaugauggcucuggaucgggaggugcaguaccuacugaauaaggccaaauucaccaagccaagaccuaggcccaaagacaagaacgggacucgugcagaaccaccgcucaaugccagcgcuuccgaucagggagagaaagucauuccucccgcaggccaaacagaagacgccgagccaaucucagagcccgaaaagguggagacggguagugaaccuggggauaccgagccacuggaacuuggcggacccggcgcggagccugagcagaaggaacagucuacugggcaaaaacgcccguugaagaacgacgagcuguga

SEQ ID NO: 7606 - RNA, 3000 nt, Artificial Sequence
  derived and/or modified sequence opt4 from GRP170_(ORP150)__Homo_sapiens__AAC50947
auggccgacaaggugagaagacagagacccagaagaagagugugcugggcccugguggccgugcugcuggccgaccugcuggcccugagcgacacccuggccgugaugagcguggaccugggcagcgagagcaugaagguggccaucgugaagcccggcgugcccauggagaucgugcugaacaaggagagcagaagaaagacccccgugaucgugacccugaaggagaacgagagauucuucggcgacagcgccgccagcauggccaucaagaaccccaaggccacccugagauacuuccagcaccugcugggcaagcaggccgacaacccccacguggcccuguaccaggccagauuccccgagcacgagcugaccuucgacccccagagacagaccgugcacuuccagaucagcagccagcugcaguucagccccgaggaggugcugggcauggugcugaacuacagcagaagccuggccgaggacuucgccgagcagcccaucaaggacgccgugaucaccgugcccguguucuucaaccaggccgagagaagagccgugcugcaggccgccagaauggccggccugaaggugcugcagcugaucaacgacaacaccgccaccgcccugagcuacggcguguucagaagaaaggacaucaacaccaccgcccagaacaucauguucuacgacaugggcagcggcagcaccgugugcaccaucgugaccuaccagauggugaagaccaaggaggccggcaugcagccccagcugcagaucagaggcgugggcuucgacagaacccugggcggccuggagauggagcugagacugagagagagacuggccggccuguucaacgagcagagaaagggccagagagccaaggacgugagagagaaccccagagccauggccaagcugcugagagaggccaacagacugaagaccgugcugagcgccaacgccgaccacauggcccagaucgagggccugauggacgacguggacuucaaggccaaggugaccagaguggaguucgaggagcugugcgccgaccuguucgagagagugcccggccccgugcagcaggcccugcagagcgccgagaugagccuggacgagaucgagcaggugauccuggugggcggcgccaccagagugcccagagugcaggaggugcugcugaaggccgugggcaaggaggagcugggcaagaacaucaacgccgacgaggccgccgccaugggcgccguguaccaggccgccgcccugagcaaggccuucaaggugaagcccuucguggugagagacgccgugguguaccccauccugguggaguucaccagagagguggaggaggagcccggcauccacagccugaagcacaacaagagagugcuguucagcagaaugggccccuacccccagagaaaggugaucaccuucaacagauacagccacgacuucaacuuccacaucaacuacggcgaccugggcuuccugggccccgaggaccugagaguguucggcagccagaaccugaccaccgugaagcugaagggcgugggcgacagcuucaagaaguaccccgacuacgagagcaagggcaucaaggcccacuucaaccuggacgagagcggcgugcugagccuggacagaguggagagcguguucgagacccugguggaggacagcgccgaggaggagagcacccugaccaagcugggcaacaccaucagcagccuguucggcggcggcaccacccccgacgccaaggagaacggcaccgacaccgugcaggaggaggaggagagccccgccgagggcagcaaggacgagcccggcgagcagguggagcugaaggaggaggccgaggcccccguggaggacggcagccagccccccccccccgagcccaagggcgacgccacccccgagggcgagaaggccaccgagaaggagaacggcgacaagagcgaggcccagaagcccagcgagaaggccgaggccggccccgagggcguggcccccgcccccgagggcgagaagaagcagaagcccgccagaaagagaagaaugguggaggagaucggcguggagcugguggugcuggaccugcccgaccugcccgaggacaagcuggcccagagcgugcagaagcugcaggaccugacccugagagaccuggagaagcaggagagagagaaggccgccaacagccuggaggccuucaucuucgagacccaggacaagcuguaccagcccgaguaccaggaggugagcaccgaggagcagagagaggagaucagcggcaagcugagcgccgccagcaccuggcuggaggacgagggcgugggcgccaccaccgugaugcugaaggagaagcuggccgagcugagaaagcugugccagggccuguucuucagaguggaggagagaaagaaguggcccgagagacugagcgcccuggacaaccugcugaaccacagcagcauguuccugaagggcgccagacugauccccgagauggaccagaucuucaccgagguggagaugaccacccuggagaaggugaucaacgagaccugggccuggaagaacgccacccuggccgagcaggccaagcugcccgccaccgagaagcccgugcugcugagcaaggacaucgaggccaagaugauggcccuggacagagaggugcaguaccugcugaacaaggccaaguucaccaagcccagacccagacccaaggacaagaacggcaccagagccgagcccccccugaacgccagcgccagcgaccagggcgagaaggugaucccccccgccggccagaccgaggacgccgagcccaucagcgagcccgagaagguggagaccggcagcgagcccggcgacaccgagccccuggagcugggcggccccggcgccgagcccgagcagaaggagcagagcaccggccagaagagaccccugaagaacgacgagcuguga

SEQ ID NO: 7607 - RNA, 3000 nt, Artificial Sequence
  derived and/or modified sequence opt5 from GRP170_(ORP150)__Homo_sapiens__AAC50947
auggccgacaaggugagacggcagcgccccagacggcgcgucugcugggcucugguugccgugcuccuggcggaucuucuggcucucagcgacacccuggccgugauguccgucgaucuuggcucugagagcaugaaaguggccaucguuaagccuggggugccgauggaaaucguccugaacaaagaguccagacggaagacacccgugaucguuacgcucaaagaaaaugagcgcuucuuuggagacucugcugccagcauggcuauuaagaacccuaaggccacccugagauacuuccaacaucugcucggcaaacaggcggauaauccccacguggcccuguaucaggcucgguuuccugaacacgagcuuacauucgacccccagcgccaaaccguccauuuucagaucuccucucagcugcaguucagcccugaggaagugcucgggauggugcugaacuacuccagaagccuugccgaggauuuugcugaacaaccgauuaaggacgccgucaucacaguucccguguucuuuaaucaggcggagcggcgcgccgugcugcaggcugccagaauggcuggacucaaaguccugcagcugaucaacgauaauaccgccacagcccucucuuauggcguguuccggcgcaaggacauuaacaccacggcucaaaauaucauguuuuacgauaugggguccggaagcaccguuuguacaauugugaccuaucagauggucaaaacaaaggaggcgggcaugcagccucaacugcagaucagaggcgugggguucgaccggacccuuggaggccuggaaauggagcucagacugcgcgaacggcuugccgggcuguuuaacgagcagagaaagggacagcgcgcuaaagauguucgggaaaaucccagagccauggccaagcuccugcgcgaggcuaaccggcugaaaacggugcucucugccaaugcggaccacauggcucaaauugagggccugauggacgaugucgacuucaaggccaaagugacaagagucgaguucgaggaacuuugcgccgaucuguuugagcgcgugccugggcccguucagcaggcucuccaguccgccgaaaugagccuggacgagaucgagcaagugauucuugucggaggcgcuacccgggugccgagaguucaggaagugcugcucaaggccgucggcaaagaggaacuggggaagaacaucaaugcggaugaggccgcugccaugggagcuguguaccaggccgcggcccugucuaaggcuuucaaagugaagccuuuuguuguccgcgacgccgugguguaucccauccucgucgaguucacacgggagguggaggaagaaccuggcauucauucccugaaacacaacaagagaguucuuuuuagccggauggggcccuacccccagcgcaaagugaucaccuucaacagauacucccacgauuuuaauuuccauauuaacuauggagaccugggcuuucucgggccugaagaucugcgggucuucggaucucaaaaucugaccacagugaagcucaagggcguuggcgacagcuuuaaaaaguacccggauuaugaguccaaagggaucaaggcucacuucaaccucgacgagagcggagugcugucucuggacagagucgaauccguguuugagacgcucguugaagauagcgccgaggaagagucuacccugacaaaacuuggcaauaccauuagcucccuguucgggggaggcacaacccccgacgccaaggagaacgggacggauacagugcaggaagaggaagagucuccugcugaaggcagcaaggacgagcccggagagcaggucgaacucaaagaggaagcggaggccccuguggaagauggcucccagcccccgccucccgagccuaagggggacgcuacccccgagggagaaaaagccaccgagaaggaaaauggcgauaaaagcgaggcccaaaagccuucugagaaggcugaagccgggcccgagggaguggcgccggcuccugaaggcgagaaaaagcagaaacccgcccgcaagcggagaauggucgaagagaucgggguugagcugguggugcuggaccuucccgaucucccugaagacaaacuggcccaguccguccaaaagcugcaggaucucacacugcgcgaccuugagaaacaggaaagagagaaggcugccaacagccuggaagcguucaucuuugagacccaggauaagcucuaccaaccggaguaucaggaagugucuacagaggaacagcgggaggaaauuuccggcaaacugagcgcugccuccacguggcuggaggacgagggaguuggcgccaccacagugaugcuuaaggaaaaacucgcugagcugcgcaagcugugucaggggcuuuucuuuagagucgaagaacggaaaaaguggcccgagcgccugucugcccuugacaaucugcucaaccauagcuccauguuccugaagggagcuagacugaucccugaaauggaucaaauuuuuaccgagguggaaaugacaacccuugagaaaguuaucaaugaaacgugggccuggaagaacgcgacccucgccgagcaggcuaaacugcccgccacagagaagccugugcugcucucuaaagacauugaagcuaagaugauggcccuggaucgggagguccaguaccuucugaauaaggccaaauucaccaagccccgcccuagacccaaagacaagaacggcacacgggcugaaccgccucucaaugcgagcgccuccgaucagggggagaaagugauucccccugcuggacaaaccgaagacgccgagcccaucagcgagccggaaaagguugagacgggcucugaaccuggggauacagagccccuggaacugggcggaccuggcgccgagcccgagcagaaggaacaguccaccgggcaaaaacgcccccuuaagaacgacgagcuguga

SEQ ID NO: 7608 - RNA, 3000 nt, Artificial Sequence
  derived and/or modified sequence opt6 from GRP170_(ORP150)__Homo_sapiens__AAC50947
auggcagacaaaguaagacgacaaagaccuaggagaagaguuuguugggcauuaguugcaguacuauuagcagaucuauuagcucuaucugauacuuuagcuguuaugagugucgaucuuggaagugagucaaugaaaguagcaauaguaaaaccagguguaccaauggagauaguucuaaauaaagaaaguagaagaaaaacgccaguaaucgucacucuaaaagaaaacgaaagauuuuucggugacucggcagcaagcauggcaauuaaaaauccuaaagcaaccuuaagauacuuccaacaucuucuuggaaaacaggcagauaacccacauguggcacuauaucaggcaagauuccccgaacaugaauuaacauucgauccacaacgacagacgguacacuuucaaauuucaucacaauuacaauuuucacccgaagaaguacuuggaaugguacuaaacuauagcagaucauuggcugaggauuuugcugaacaaccaauaaaagaugcaguaauaacagugcccguauucuuuaaccaagcagaaagaagggcaguacuacaagcugcaagaauggccggauuaaagguacuucaacuaauaaaugauaauacugcaacagcauugucauacggugucuuccgaagaaaagauauaaacacaacagcccaaaauauaauguuuuaugauauggguucaggguccaccguaugcacuauuguuacauaccagaugguaaaaacaaaagaagcagguaugcaaccacaguugcagauacgaggaguaggauuugaccguacacuagguggauuggaaauggaacugaggcuacgagaaagauuggcggguuuauuuaaugaacaacgcaaaggucaacgggcuaaagacguaagagaaaaucccagggcuauggccaagcuauuaagagaagcaaauagacuaaaaacuguucugucagcaaacgcagaccauauggcacaaauagaaggucuaauggaugacgucgacuuuaaagcgaaagugacccggguugaauucgaagaacucugugccgauuuauuugaacgagucccuggaccaguucaacaagcacuacaaagugcagaaaugucacuagacgaaaucgagcaaguaauucuagugggaggagcaacacgagucccaagaguccaagaaguccuacuuaaagccguaggaaaagaagaacucggaaaaaauauaaaugcagacgaagcugcggcgaugggagcuguauaucaagcagcagcacuuagcaaagcguucaagguuaaacccuucguagugagagacgcaguuguauaccccauauuaguagaauucacacgggaagucgaggaagaaccuggaauacauucuuuaaaacauaauaaaaggguacuauuuaguagaaugggaccauacccacaaagaaaaguuauaacuuuuaaucgauacagucaugacuuuaauuuccauauaaauuacggggaucuaggcuuccuaggaccagaagaccugcgaguauucgggagccaaaacuuaaccacagucaaacuaaaaggagucggagauagcuucaaaaaauaucccgacuacgaaaguaaaggaauaaaagcccacuuuaauuuagaugaaucaggaguucuaaguuuagaucgugucgaaagugucuuugaaacacuuguagaagacagcgcagaggaggaaaguacgcuuaccaaacuagggaauacaauaucaagucuauuuggaggggggacaacaccagaugcaaaagaaaaugguacugacaccgugcaagaagaagaagaaucgccagccgaaggaucgaaagacgaaccaggggaacaagucgaauuaaaagaagaagcagaagcaccaguugaagaugguagccaaccgccucccccggaaccuaaaggugacgcaacaccugaaggagaaaaagcaacagaaaaagagaauggugauaaaucagaagcacaaaaaccuagugaaaaagcagaagcgggucccgaaggaguagcaccagcaccagaaggugaaaaaaaacaaaagccagcacgaaaaagaagaaugguagaagaaauaggagucgaacuugucguucuagacuuaccggauuuaccagaagauaagcuagcacaaaguguacaaaaauugcaagacuuaacucuuagggaccuagaaaaacaggagcgcgaaaaagcugcaaauaguuuagaagcauuuaucuuugaaacgcaagacaaacuguaccaaccagaauaucaggaaguaaguacugaagaacaaagagaagaaauuaguggaaaacugucagcagcuucaacuugguuagaagaugaaggaguuggagcuacaaccgucaugcuuaaagaaaaacuagcugaacuaagaaaauuaugucaaggcuuauucuuuaggguagaagaaagaaaaaaauggccugaacgcuuauccgcauuagauaauuugcuaaaucacucgaguauguuuuugaaaggugcucgauuaauccccgaaauggaccaaauauucacugaaguagaaaugaccacauuagagaaaguaauuaaugaaacaugggcauggaaaaacgcaaccuuagccgaacaagcuaaacuaccagccacggagaaaccgguucuauuauccaaagacauagaagcgaagaugauggcccucgauagagaaguacaguauuuauugaacaaagcaaaauuuacaaaaccaagacccaggcccaaagauaaaaacgguacaagagcagaaccaccgcuaaacgcaucagcaucagaccaaggagagaaaguaauacccccagccggacaaacagaagacgcagaaccaauaagugaaccagaaaaaguugagaccggaucagaaccuggagacacagaaccauuagaacuaggaggccccggcgcagaaccugaacaaaaagaacaaaguacaggacaaaaaaggccgcuaaagaacgacgaguuauaa

SEQ ID NO: 7609 - protein, 654 aa, Artificial Sequence
  GRP78_(BiP)__Homo_sapiens__P11021
MKLSLVAAMLLLLSAARAEEEDKKEDVGTVVGIDLGTTYSCVGVFKNGRVEIIANDQGNRITPSYVAFTPEGERLIGDAAKNQLTSNPENTVFDAKRLIGRTWNDPSVQQDIKFLPFKVVEKKTKPYIQVDIGGGQTKTFAPEEISAMVLTKMKETAEAYLGKKVTHAVVTVPAYFNDAQRQATKDAGTIAGLNVMRIINEPTAAAIAYGLDKREGEKNILVFDLGGGTFDVSLLTIDNGVFEVVATNGDTHLGGEDFDQRVMEHFIKLYKKKTGKDVRKDNRAVQKLRREVEKAKRALSSQHQARIEIESFYEGEDFSETLTRAKFEELNMDLFRSTMKPVQKVLEDSDLKKSDIDEIVLVGGSTRIPKIQQLVKEFFNGKEPSRGINPDEAVAYGAAVQAGVLSGDQDTGDLVLLDVCPLTLGIETVGGVMTKLIPRNTVVPTKKSQIFSTASDNQPTVTIKVYEGERPLTKDNHLLGTFDLTGIPPAPRGVPQIEVTFEIDVNGILRVTAEDKGTGNKNKITITNDQNRLTPEEIERMVNDAEKFAEEDKKLKERIDTRNELESYAYSLKNQIGDKEKLGGKLSSEDKETMEKAVEEKIEWLESHQDADIEDFKAKKKELEEIVQPIISKLYGSAGPPPTGEEDTAEKDEL

SEQ ID NO: 7610 - RNA, 1965 nt, Artificial Sequence
  GRP78_(BiP)__Homo_sapiens__AAF42836
augaagcucucccugguggccgcgaugcugcugcugcucagcgcggcgcgggccgaggaggaggacaagaaggaggacgugggcacgguggucggcaucgaccuggggaccaccuacuccugcgucggcguguucaagaacggccgcguggagaucaucgccaacgaucagggcaaccgcaucacgccguccuaugucgccuucacuccugaaggggaacgucugauuggcgaugccgccaagaaccagcucaccuccaaccccgagaacacggucuuugacgccaagcggcucaucggccgcacguggaaugacccgucugugcagcaggacaucaaguucuugccguucaaggugguugaaaagaaaacuaaaccauacauucaaguugauauuggaggugggcaaacaaagacauuugcuccugaagaaauuucugccaugguucucacuaaaaugaaagaaaccgcugaggcuuauuugggaaagaagguuacccaugcaguuguuacuguaccagccuauuuuaaugaugcccaacgccaagcaaccaaagacgcuggaacuauugcuggccuaaauguuaugaggaucaucaacgagccuacggcagcugcuauugcuuauggccuggauaagagggagggggagaagaacauccugguguuugaccuggguggcggaaccuucgaugugucucuucucaccauugacaauggugucuucgaaguuguggccacuaauggagauacucaucuggguggagaagacuuugaccagcgugucauggaacacuucaucaaacuguacaaaaagaagacgggcaaagaugucaggaaagacaauagagcugugcagaaacuccggcgcgagguagaaaaggccaaacgggcccugucuucucagcaucaagcaagaauugaaauugaguccuucuaugaaggagaagacuuuucugagacccugacucgggccaaauuugaagagcucaacauggaucuguuccggucuacuaugaagcccguccagaaaguguuggaagauucugauuugaagaagucugauauugaugaaauuguucuuguugguggcucgacucgaauuccaaagauucagcaacugguuaaagaguucuucaauggcaaggaaccaucccguggcauaaacccagaugaagcuguagcguauggugcugcuguccaggcuggugugcucucuggugaucaagauacaggugaccugguacugcuugauguauguccccuuacacuugguauugaaacugugggaggugucaugaccaaacugauuccaaggaacacaguggugccuaccaagaagucucagaucuuuucuacagcuucugauaaucaaccaacuguuacaaucaaggucuaugaaggugaaagaccccugacaaaagacaaucaucuucuggguacauuugaucugacuggaauuccuccugcuccucguggggucccacagauugaagucaccuuugagauagaugugaaugguauucuucgagugacagcugaagacaaggguacagggaacaaaaauaagaucacaaucaccaaugaccagaaucgccugacaccugaagaaaucgaaaggaugguuaaugaugcugagaaguuugcugaggaagacaaaaagcucaaggagcgcauugauacuagaaaugaguuggaaagcuaugccuauucucuaaagaaucagauuggagauaaagaaaagcugggagguaaacuuuccucugaagauaaggagaccauggaaaaagcuguagaagaaaagauugaauggcuggaaagccaccaagaugcugacauugaagacuucaaagcuaagaagaaggaacuggaagaaauuguucaaccaauuaucagcaaacucuauggaagugcaggcccucccccaacuggugaagaggauacagcagaaaaagaugaguuguag

SEQ ID NO: 7611 - RNA, 1965 nt, Artificial Sequence
  derived and/or modified sequence opt1 from GRP78_(BiP)__Homo_sapiens__AAF42836
augaagcugagccucguggccgccaugcugcugcuccuguccgcggcccgcgccgaggaggaggacaagaaggaggacgucggcaccgugguggggaucgaccugggcaccacguacagcugcgucgggguguucaagaacggccggguggagaucaucgccaacgaccaggggaaccgcaucacccccuccuacgucgccuucaccccggagggcgagcggcucaucggcgacgcggccaagaaccagcugaccagcaaccccgagaacacgguguucgacgccaagcgccugaucgggcggaccuggaacgaccccuccgugcagcaggacaucaaguuccuccccuucaaggucguggagaagaagaccaagccguacauccagguggacaucggcgggggccagaccaagacguucgcccccgaggagaucagcgcgaugguccugaccaagaugaaggagaccgccgaggccuaccuggggaagaaggugacccacgccguggucacggugcccgccuacuucaacgacgcgcagcgccaggccaccaaggacgccggcaccaucgccggccucaacgugaugcggaucaucaacgagcccaccgccgcggccaucgccuacgggcuggacaagcgcgagggcgagaagaacauccuggucuucgaccucgggggcggcacguucgacgugucccugcugaccaucgacaacgggguguucgaggucguggccaccaacggcgacacccaccucgggggcgaggacuucgaccagcgggugauggagcacuucaucaagcuguacaagaagaagacggggaaggacguccgcaaggacaaccgggccgugcagaagcugcgccgggaggucgagaaggcgaagcgcgcccucagcucccagcaccaggcccggaucgagaucgagagcuucuacgagggcgaggacuucuccgagacccugacccgcgccaaguucgaggagcugaacauggaccucuuccggagcaccaugaagccggugcagaaggugcuggaggacuccgaccugaagaaguccgacaucgacgagaucguccucgugggcgggagcacgcgcauccccaagauccagcagcuggugaaggaguucuucaacggcaaggagcccagccgggggaucaaccccgacgaggccgucgcguacggcgccgccgugcaggccggggugcuguccggcgaccaggacaccggcgaccucguccugcuggacgugugcccgcucacccuggggaucgagaccgugggcggggucaugacgaagcugaucccccgcaacaccguggugcccaccaagaagucccagaucuucagcaccgcgagcgacaaccagcccacggucaccaucaagguguacgagggcgagcggccgcucaccaaggacaaccaccuccuggggaccuucgaccugacgggcaucccgcccgcgccccgcggcgugccccagaucgaggucaccuucgagaucgacgugaacgggauccugcgcgugaccgccgaggacaagggcaccgggaacaagaacaagaucaccaucacgaacgaccagaaccggcugacccccgaggagaucgagcgcauggucaacgacgccgagaaguucgccgaggaggacaagaagcucaaggagcggaucgacacccgcaacgagcuggagagcuacgccuacucccugaagaaccagaucggcgacaaggagaagcucggcgggaagcugagcuccgaggacaaggagaccauggagaaggccguggaggagaagaucgaguggcuggagagccaccaggacgccgacaucgaggacuucaaggccaagaagaaggagcucgaggagaucgugcagcccaucaucuccaagcuguacggcagcgccgggcccccgcccacgggcgaggaggacaccgcggagaaggacgagcuguga

SEQ ID NO: 7612 - RNA, 1965 nt, Artificial Sequence
  derived and/or modified sequence opt2 from GRP78_(BiP)__Homo_sapiens__AAF42836
augaagcucucccucgucgccgccaugcuccuccuccucuccgccgcccgcgccgaggaggaggacaagaaggaggacgucggcaccgucgucggcaucgaccucggcaccaccuacuccugcgucggcgucuucaagaacggccgcgucgagaucaucgccaacgaccagggcaaccgcaucacccccuccuacgucgccuucacccccgagggcgagcgccucaucggcgacgccgccaagaaccagcucaccuccaaccccgagaacaccgucuucgacgccaagcgccucaucggccgcaccuggaacgaccccuccguccagcaggacaucaaguuccuccccuucaaggucgucgagaagaagaccaagcccuacauccaggucgacaucggcggcggccagaccaagaccuucgcccccgaggagaucuccgccaugguccucaccaagaugaaggagaccgccgaggccuaccucggcaagaaggucacccacgccgucgucaccguccccgccuacuucaacgacgcccagcgccaggccaccaaggacgccggcaccaucgccggccucaacgucaugcgcaucaucaacgagcccaccgccgccgccaucgccuacggccucgacaagcgcgagggcgagaagaacauccucgucuucgaccucggcggcggcaccuucgacgucucccuccucaccaucgacaacggcgucuucgaggucgucgccaccaacggcgacacccaccucggcggcgaggacuucgaccagcgcgucauggagcacuucaucaagcucuacaagaagaagaccggcaaggacguccgcaaggacaaccgcgccguccagaagcuccgccgcgaggucgagaaggccaagcgcgcccucuccucccagcaccaggcccgcaucgagaucgaguccuucuacgagggcgaggacuucuccgagacccucacccgcgccaaguucgaggagcucaacauggaccucuuccgcuccaccaugaagcccguccagaagguccucgaggacuccgaccucaagaaguccgacaucgacgagaucguccucgucggcggcuccacccgcauccccaagauccagcagcucgucaaggaguucuucaacggcaaggagcccucccgcggcaucaaccccgacgaggccgucgccuacggcgccgccguccaggccggcguccucuccggcgaccaggacaccggcgaccucguccuccucgacgucugcccccucacccucggcaucgagaccgucggcggcgucaugaccaagcucaucccccgcaacaccgucguccccaccaagaagucccagaucuucuccaccgccuccgacaaccagcccaccgucaccaucaaggucuacgagggcgagcgcccccucaccaaggacaaccaccuccucggcaccuucgaccucaccggcaucccccccgccccccgcggcgucccccagaucgaggucaccuucgagaucgacgucaacggcauccuccgcgucaccgccgaggacaagggcaccggcaacaagaacaagaucaccaucaccaacgaccagaaccgccucacccccgaggagaucgagcgcauggucaacgacgccgagaaguucgccgaggaggacaagaagcucaaggagcgcaucgacacccgcaacgagcucgaguccuacgccuacucccucaagaaccagaucggcgacaaggagaagcucggcggcaagcucuccuccgaggacaaggagaccauggagaaggccgucgaggagaagaucgaguggcucgagucccaccaggacgccgacaucgaggacuucaaggccaagaagaaggagcucgaggagaucguccagcccaucaucuccaagcucuacggcuccgccggccccccccccaccggcgaggaggacaccgccgagaaggacgagcucuga

SEQ ID NO: 7613 - RNA, 1965 nt, Artificial Sequence
  derived and/or modified sequence opt3 from GRP78_(BiP)__Homo_sapiens__AAF42836
augaagcugagccucguggccgcuaugcuucuguuguuauccgcagccagagcggaggaagaggacaaaaaggaagaugucggcaccguuguggggaucgaccugggaacaacuuacucuugcguagguguguucaaaaacggcagggucgagauuauagcuaaugaucaggggaaccggaucacgcccucauauguggccuuuaccccugaaggagagcgccuaauuggcgacgcagccaagaaucaacucacaaguaacccagagaauacuguuuucgaugcuaaacgacugaucggucguaccuggaacgacccgagcgugcagcaggauauuaaguuucuucccuucaaggucguggaaaagaagacaaaaccuuacauccagguagacauagggggaggccaaaccaagacuuuugcaccagaggaaaucuccgccaugguucugacaaaaaugaaggagaccgcugaggccuauuugggcaagaaagugacgcacgcggucgugacugugcccgcauacuucaaugaugcccagagacaggcuaccaaggacgccgggacaauugcaggacucaacgucaugaggaucauuaaugaaccuacugcugccgcgaucgccuauggucuggauaaacgggagggcgaaaagaacauacugguuuuugaccucgggggaggcaccuucgaugugucuuuacugacaauugacaaugguguauuugagguggucgcaaccaacggggacacgcaucuuggaggcgaagauuucgaccagcgcgugauggagcacuuuaucaaauuguacaagaaaaagacuggcaaggauguuagaaaagacaauagggcugugcaaaagcugcggcgcgaggucgaaaaagccaagcgagcucuaucgucacagcaucaggccagaauugagaucgaaucuuucuaugagggggaagauuuuagugagacacucaccagggcaaaauucgaggaacugaacauggaccuuuuccgguccacuaugaagccagugcagaagguacuggaggauucugacuugaaaaagagcgauaucgacgaaauuguucucgugggagguuccacacguauacccaaaauccaacagcuggucaaggaguuuuucaauggcaaagaaccuucacgcgggauuaacccagaugaggccguggcuuacggagcggcaguccaggccggcguguuaaguggugaccaagacaccggggaucugguucuccuugacguguguccgcugacguugggcaucgagaccguaggaggcgucaugacaaagcuaauacccagaaacacugugguuccuaccaagaaaagccagauuuuuagcacagcuuccgauaaucagccaacugugaccaucaaggucuacgaaggggagaggccccugacaaaagacaaccaccuccugggaaccuucgaucuuacugguaucccuccagcaccccggggcgugccgcagauugaaguaacguuugagaucgacgugaaugggauucugcgaguuacagccgaggauaagggaaccggcaacaaaaauaagauaacuaucaccaacgaccaaaaucgcuugacaccugaagagauugaaagaauggucaacgaugccgagaaguucgcugaagaggacaaaaagcucaaagagaggaucgauacccggaaugaacuggagucauaugccuacagcuuaaagaaccagaucggugacaaagaaaagcuagggggcaaacugaguucugaggauaaggaaacuauggagaaggcaguggaggagaaaauugaauggcucgaaucccaucaggacgcggacauagaggauuuuaaggcuaaaaagaaagaacuggaggagaucgugcagcccauuaucagcaaacuuuauggaucggccggcccaccucccacaggggaagaggacacggcagaaaaggaugaguuguga

SEQ ID NO: 7614 - RNA, 1965 nt, Artificial Sequence
  derived and/or modified sequence opt4 from GRP78_(BiP)__Homo_sapiens__AAF42836
augaagcugagccugguggccgccaugcugcugcugcugagcgccgccagagccgaggaggaggacaagaaggaggacgugggcaccguggugggcaucgaccugggcaccaccuacagcugcgugggcguguucaagaacggcagaguggagaucaucgccaacgaccagggcaacagaaucacccccagcuacguggccuucacccccgagggcgagagacugaucggcgacgccgccaagaaccagcugaccagcaaccccgagaacaccguguucgacgccaagagacugaucggcagaaccuggaacgaccccagcgugcagcaggacaucaaguuccugcccuucaaggugguggagaagaagaccaagcccuacauccagguggacaucggcggcggccagaccaagaccuucgcccccgaggagaucagcgccauggugcugaccaagaugaaggagaccgccgaggccuaccugggcaagaaggugacccacgccguggugaccgugcccgccuacuucaacgacgcccagagacaggccaccaaggacgccggcaccaucgccggccugaacgugaugagaaucaucaacgagcccaccgccgccgccaucgccuacggccuggacaagagagagggcgagaagaacauccugguguucgaccugggcggcggcaccuucgacgugagccugcugaccaucgacaacggcguguucgaggugguggccaccaacggcgacacccaccugggcggcgaggacuucgaccagagagugauggagcacuucaucaagcuguacaagaagaagaccggcaaggacgugagaaaggacaacagagccgugcagaagcugagaagagagguggagaaggccaagagagcccugagcagccagcaccaggccagaaucgagaucgagagcuucuacgagggcgaggacuucagcgagacccugaccagagccaaguucgaggagcugaacauggaccuguucagaagcaccaugaagcccgugcagaaggugcuggaggacagcgaccugaagaagagcgacaucgacgagaucgugcuggugggcggcagcaccagaauccccaagauccagcagcuggugaaggaguucuucaacggcaaggagcccagcagaggcaucaaccccgacgaggccguggccuacggcgccgccgugcaggccggcgugcugagcggcgaccaggacaccggcgaccuggugcugcuggacgugugcccccugacccugggcaucgagaccgugggcggcgugaugaccaagcugauccccagaaacaccguggugcccaccaagaagagccagaucuucagcaccgccagcgacaaccagcccaccgugaccaucaagguguacgagggcgagagaccccugaccaaggacaaccaccugcugggcaccuucgaccugaccggcaucccccccgcccccagaggcgugccccagaucgaggugaccuucgagaucgacgugaacggcauccugagagugaccgccgaggacaagggcaccggcaacaagaacaagaucaccaucaccaacgaccagaacagacugacccccgaggagaucgagagaauggugaacgacgccgagaaguucgccgaggaggacaagaagcugaaggagagaaucgacaccagaaacgagcuggagagcuacgccuacagccugaagaaccagaucggcgacaaggagaagcugggcggcaagcugagcagcgaggacaaggagaccauggagaaggccguggaggagaagaucgaguggcuggagagccaccaggacgccgacaucgaggacuucaaggccaagaagaaggagcuggaggagaucgugcagcccaucaucagcaagcuguacggcagcgccggccccccccccaccggcgaggaggacaccgccgagaaggacgagcuguga

SEQ ID NO: 7615 - RNA, 1965 nt, Artificial Sequence
  derived and/or modified sequence opt5 from GRP78_(BiP)__Homo_sapiens__AAF42836
augaagcugagccucguggccgcuaugcugcuucugcucuccgccgcgagagcugaggaagaggacaaaaaggaagaugucggcaccguuguggggaucgaccugggaacaacguacucuugcgugggcgucuucaaaaacgggcggguggagauuaucgccaaugaucagggaaaccgcauuacccccagcuauguugccuuuacaccugaaggcgagagacuuaucggggacgcugccaagaaucaacugaccuccaacccggagaauacaguguucgaugcuaaacggcucauuggacgcaccuggaacgaccccucuguccagcaggauaucaaguuucugccuuucaaggugguugaaaagaagacaaaacccuacauccagguggacauuggcggcgggcaaaccaagacguuugccccugaggaaaucagcgcgaugguccugaccaaaaugaaggagacagccgaggcuuaucucggaaagaaagugacccacgccguggucacaguucccgcuuacuucaaugaugcccagagacaggcgaccaaggacgccggcacgauugcugggcugaacgugaugcggaucauuaaugaaccuacagccgcugccaucgccuauggacuugauaaacgcgagggcgaaaagaacauucugguguuugaccucgggggaggcaccuucgaugucucccugcuuacaaucgacaauggcguguuugagguuguggcuaccaacggggacacccaucugggaggcgaagauuucgaccagagagucauggagcacuuuaucaaacucuacaagaaaaagacagggaaggaugugcggaaagacaaucgcgcgguucaaaagcugagacgggagguggaaaaagccaagcgcgcucugucuagccagcaucaggccagaauugagaucgaauccuucuaugagggagaagauuuuagcgagacgcucacccgggccaaauucgaggaacugaacauggaccuuuuccgcucuacaaugaagccgguccagaaggugcuggaggauuccgaccucaaaaagagcgauauugacgaaaucguccuggugggcgggucuacccggauucccaaaauccaacagcuuguuaaggaguuuuucaauggaaaagaaccuuccagaggcaucaaccccgaugaggcuguggccuacggcgcggcuguccaggccggggugcugagcggagaccaagacacaggcgaucucguucugcuggacguguguccucucacccuggggauugagacggucggaggcgugaugacaaaacuuauccccagaaacaccgugguuccgaccaagaaaucucagaucuuuuccacagccagcgauaaucagccuaccgucacaauuaagguguacgaaggggagcgcccccugacgaaagacaaccaccuccugggcaccuucgaucuuacaggcauuccucccgcuccccggggagugccucagaucgaagucaccuuugagaucgacgugaaugggauucugagaguuacagccgaggauaagggaaccggcaacaaaaauaagaucacgauuaccaacgaccaaaaucgccucacaccggaagagaucgaacggauggugaacgaugcugagaaguucgccgaagaggacaaaaagcugaaagagagaauugauacccgcaaugaacuggaguccuaugcguacucucucaagaaccagaucggggacaaagaaaagcugggaggcaaacuuagcuccgaggauaaggaaacaauggagaaggccgucgaggagaaaauugaauggcuggaaagccaucaggacgcugacaucgaggauuuuaaggccaaaaagaaagaacucgaggagaucgugcagcccauuaucucuaagcuguauggguccgcuggcccucccccuaccggagaagaggacacggccgaaaaggaugagcuguga

SEQ ID NO: 7616 - RNA, 1965 nt, Artificial Sequence
  derived and/or modified sequence opt6 from GRP78_(BiP)__Homo_sapiens__AAF42836
augaaacuaucauuaguagccgcaaugcuuuuacuucuaagcgcagcccgugccgaagaagaagauaaaaaagaagauguaggaacaguagucggaauagauuuaggaacaacauauagcuguguaggggucuuuaaaaacggaagaguagaaauuaucgcaaaugaccaaggaaauagaauaacaccuucauauguugcauuuacaccagaaggagaacgauuaauuggagacgcugcuaaaaaucaacuaacuucuaauccagaaaacacaguguucgacgcaaaaagauuaauaggaaggacauggaaugauccaaguguacaacaagacauaaaauuccuaccauucaaagucguagagaaaaaaacaaaaccauacauacaaguagauauaggagggggacaaacaaaaacauucgcccccgaagagauaucagcaaugguauuaaccaaaaugaaagaaacagcggaagcauauuuaggcaaaaaaguaacacaugcaguaguaaccguacccgcauacuuuaaugacgcccaaagacaagcaacaaaagacgcaggaacaauagcaggacugaauguaaugcguauaauaaaugaacccacagccgcagcaauagcauacggauuagauaaaagagaaggagaaaaaaauauucucguguucgaucugggagguggcacauuugacguaagucuauuaacaauagauaacggaguuuucgaaguaguagcaacuaacggcgacacccauuuaggaggagaagauuuugaccaacgaguaauggaacacuucauaaaauuauauaaaaaaaaaaccggaaaagacgucagaaaagacaacagagcuguacaaaaacuacgaagagaaguagaaaaagcuaaaagagcccugucaagucaacaccaagcaagaauagaaauagaauccuucuaugaaggagaagacuucagcgaaacacuaaccagagcaaaauucgaagaacuaaauauggaccucuuuagaagcacaaugaaaccaguacaaaaaguauuagaagauucggacuuaaaaaaaucagauauagaugaaauaguacuaguuggagggucaacaagaauaccaaagauacaacaacuuguaaaagaguucuuuaacggaaaagaaccaagcaggggaauaaauccagacgaagcaguagcuuauggagcagcaguacaagcaggaguauuaaguggagaucaagauacaggagaucuaguacuauuagacguaugcccauuaacucucggaauagaaacuguaggaggcguaaugacaaaauuaaucccaagaaacaccguagucccaacaaaaaaaucacaaauauuuucaacagcaagugacaaccaaccaacaguuacaauaaagguuuacgaaggagaaagaccauuaacaaaagauaaucaccuauuaggaacauuugacuuaacaggaauaccaccugcacccagaggagucccacaaaucgaaguaacauuugaaauagauguaaacggaauauuaagggucacagcugaagauaaaggcacagguaacaaaaacaaaauaacaauaacuaaugaccaaaauagauuaacaccagaagaaauagaaaggaugguaaacgaugcagaaaaauucgcagaagaagacaaaaaauuaaaagagagaaucgauacuagaaacgaacuugaaucuuacgcuuacagccuaaaaaaucaaauaggagacaaagaaaaacuuggcggaaaacuaucuagcgaagacaaagaaacuauggaaaaagcgguagaggaaaaaauagaaugguuggaaucucaucaagacgcagacauagaagacuucaaagcaaaaaaaaaagaacucgaagagauaguacaaccaauaaucaguaaacuauauggaagcgcaggaccaccuccaacgggagaagaagacaccgcagaaaaagacgaacuauaa

SEQ ID NO: 7617 - protein, 803 aa, Artificial Sequence
  GRP94_(gp96)__Homo_sapiens__P14625
MRALWVLGLCCVLLTFGSVRADDEVDVDGTVEEDLGKSREGSRTDDEVVQREEEAIQLDGLNASQIRELREKSEKFAFQAEVNRMMKLIINSLYKNKEIFLRELISNASDALDKIRLISLTDENALSGNEELTVKIKCDKEKNLLHVTDTGVGMTREELVKNLGTIAKSGTSEFLNKMTEAQEDGQSTSELIGQFGVGFYSAFLVADKVIVTSKHNNDTQHIWESDSNEFSVIADPRGNTLGRGTTITLVLKEEASDYLELDTIKNLVKKYSQFINFPIYVWSSKTETVEEPMEEEEAAKEEKEESDDEAAVEEEEEEKKPKTKKVEKTVWDWELMNDIKPIWQRPSKEVEEDEYKAFYKSFSKESDDPMAYIHFTAEGEVTFKSILFVPTSAPRGLFDEYGSKKSDYIKLYVRRVFITDDFHDMMPKYLNFVKGVVDSDDLPLNVSRETLQQHKLLKVIRKKLVRKTLDMIKKIADDKYNDTFWKEFGTNIKLGVIEDHSNRTRLAKLLRFQSSHHPTDITSLDQYVERMKEKQDKIYFMAGSSRKEAESSPFVERLLKKGYEVIYLTEPVDEYCIQALPEFDGKRFQNVAKEGVKFDESEKTKESREAVEKEFEPLLNWMKDKALKDKIEKAVVSQRLTESPCALVASQYGWSGNMERIMKAQAYQTGKDISTNYYASQKKTFEINPRHPLIRDMLRRIKEDEDDKTVLDLAVVLFETATLRSGYLLPDTKAYGDRIERMLRLSLNIDPDAKVEEEPEEEPEETAEDTTEDTEQDEDEEMDVGTDEEEETAKESTAEKDEL

SEQ ID NO: 7618 - RNA, 2412 nt, Artificial Sequence
  GRP94_(gp96)__Homo_sapiens__AAH66656
augagggcccugugggugcugggccucugcugcguccugcugaccuucgggucggucagagcugacgaugaaguugauguggaugguacaguagaagaggaucuggguaaaaguagagaaggaucaaggacggaugaugaaguaguacagagagaggaagaagcuauucaguuggauggauuaaaugcaucacaaauaagagaacuuagagagaagucggaaaaguuugccuuccaagccgaaguuaacagaaugaugaaacuuaucaucaauucauuguauaaaaauaaagagauuuuccugagagaacugauuucaaaugcuucugaugcuuuagauaagauaaggcuaauaucacugacugaugaaaaugcucuuucuggaaaugaggaacuaacagucaaaauuaagugugauaaggagaagaaccugcugcaugucacagacaccgguguaggaaugaccagagaagaguugguuaaaaaccuugguaccauagccaaaucugggacaagcgaguuuuuaaacaaaaugacugaagcacaggaagauggccagucaacuucugaauugauuggccaguuuggugucgguuucuauuccgccuuccuuguagcagauaagguuauugucacuucaaaacacaacaacgauacccagcacaucugggagucugacuccaaugaauuuucuguaauugcugacccaagaggaaacacucuaggacggggaacgacaauuacccuugucuuaaaagaagaagcaucugauuaccuugaauuggauacaauuaaaaaucucgucaaaaaauauucacaguucauaaacuuuccuauuuauguauggagcagcaagacugaaacuguugaggagcccauggaggaagaagaagcagccaaagaagagaaagaagaaucugaugaugaagcugcaguagaggaagaagaagaagaaaagaaaccaaagacuaaaaaaguugaaaaaacugucugggacugggaacuuaugaaugauaucaaaccaauauggcagagaccaucaaaagaaguagaagaagaugaauacaaagcuuucuacaaaucauuuucaaaggaaagugaugaccccauggcuuauauucacuuuacugcugaaggggaaguuaccuucaaaucaauuuuauuuguacccacaucugcuccacguggucuguuugacgaauauggaucuaaaaagagcgauuacauuaagcucuaugugcgccguguauucaucacagacgacuuccaugauaugaugccuaaauaccucaauuuugucaagggugugguggacucagaugaucuccccuugaauguuucccgcgagacucuucagcaacauaaacugcuuaaggugauuaggaagaagcuuguucguaaaacgcuggacaugaucaagaagauugcugaugauaaauacaaugauacuuuuuggaaagaauuugguaccaacaucaagcuuggugugauugaagaccacucgaaucgaacacgucuugcuaaacuucuuagguuccagucuucucaucauccaacugacauuacuagccuagaccaguauguggaaagaaugaaggaaaaacaagacaaaaucuacuucauggcuggguccagcagaaaagaggcugaaucuucuccauuuguugagcgacuucugaaaaagggcuaugaaguuauuuaccucacagaaccuguggaugaauacuguauucaggcccuucccgaauuugaugggaagagguuccagaauguugccaaggaaggagugaaguucgaugaaagugagaaaacuaaggagagucgugaagcaguugagaaagaauuugagccucugcugaauuggaugaaagauaaagcccuuaaggacaagauugaaaaggcuguggugucucagcgccugacagaaucuccgugugcuuugguggccagccaguacggauggucuggcaacauggagagaaucaugaaagcacaagcguaccaaacgggcaaggacaucucuacaaauuacuaugcgagucagaagaaaacauuugaaauuaaucccagacacccgcugaucagagacaugcuucgacgaauuaaggaagaugaagaugauaaaacaguuuuggaucuugcugugguuuuguuugaaacagcaacgcuucggucaggguaucuuuuaccagacacuaaagcauauggagauagaauagaaagaaugcuucgccucaguuugaacauugacccugaugcaaagguggaagaagagccugaagaagaaccugaagagacagcagaagacacaacagaagacacagagcaagacgaagaugaagaaauggaugugggaacagaugaagaagaagaaacagcaaaggaaucuacagcugaaaaagaugaauuguaa

SEQ ID NO: 7619 - RNA, 2412 nt, Artificial Sequence
  derived and/or modified sequence opt1 from GRP94_(gp96)__Homo_sapiens__AAH66656
augcgcgcccugugggugcucggccugugcugcguccugcucaccuucgggagcgugcgggccgacgacgagguggacgucgacggcaccguggaggaggaccuggggaagucccgcgagggcagccggacggacgacgaggugguccagcgcgaggaggaggcgauccagcuggacgggcucaacgccucccagauccgggagcugcgcgagaaguccgagaaguucgccuuccaggccgaggugaaccggaugaugaagcugaucaucaacagccucuacaagaacaaggagaucuuccugcgcgagcugaucagcaacgccuccgacgcgcucgacaagauccggcugaucagccugaccgacgagaacgcccucuccggcaacgaggagcugaccgugaagaucaagugcgacaaggagaagaaccugcuccacgucaccgacacgggcguggggaugacccgcgaggagcuggugaagaaccugggcaccaucgccaagagcgggaccuccgaguuccucaacaagaugacggaggcccaggaggacggccagagcaccuccgagcugaucgggcaguucggcgucggcuucuacagcgcguuccugguggccgacaaggugaucgucaccuccaagcacaacaacgacacccagcacaucugggagagcgacuccaacgaguucagcgugaucgccgacccccgggggaacacgcucggccgcgggaccaccaucacccuggugcugaaggaggaggccuccgacuaccucgagcuggacacgaucaagaaccuggucaagaaguacagccaguucaucaacuucccgaucuacguguggagcuccaagaccgagaccguggaggagcccauggaggaggaggaggccgcgaaggaggagaaggaggagagcgacgacgaggccgccgucgaggaggaggaggaggagaagaagcccaagaccaagaagguggagaagacggugugggacugggagcucaugaacgacaucaagcccaucuggcagcggccguccaaggaggucgaggaggacgaguacaaggccuucuacaagagcuucuccaaggagagcgacgaccccauggccuacauccacuucaccgcggagggcgaggugaccuucaaguccauccuguucguccccaccagcgcgccccgcggccuguucgacgaguacggguccaagaaguccgacuacaucaagcucuacgugcggcgcguguucaucacggacgacuuccacgacaugaugccgaaguaccugaacuucgucaagggcgugguggacagcgacgaccugccccucaacgucagccgggagacccugcagcagcacaagcugcucaaggugauccgcaagaagcuggugcggaagacccuggacaugaucaagaagaucgccgacgacaaguacaacgacaccuucuggaaggaguucgggacgaacaucaagcucggcgucaucgaggaccacuccaaccgcacccggcuggccaagcugcuccgcuuccagagcucccaccaccccaccgacaucaccagccuggaccaguacguggagcgcaugaaggagaagcaggacaagaucuacuucauggccggguccagccggaaggaggccgaguccagccccuucguggagcgccugcucaagaagggcuacgaggucaucuaccugacggagccgguggacgaguacugcauccaggcccugcccgaguucgacggcaagcgguuccagaacguggccaaggagggggucaaguucgacgagagcgagaagaccaaggagucccgcgaggccguggagaaggaguucgagccccugcucaacuggaugaaggacaaggcccugaaggacaagaucgagaaggcgguggucagccagcggcugaccgagucccccugcgcccucguggccagccaguacggcugguccgggaacauggagcgcaucaugaaggcccaggcguaccagaccggcaaggacaucagcacgaacuacuacgccucccagaagaagaccuucgagaucaacccgcggcacccccugauccgcgacaugcugcggcgcaucaaggaggacgaggacgacaagaccgugcucgaccuggccgucgugcuguucgagaccgccacccuccggagcggguaccugcugcccgacacgaaggccuacggcgaccgcaucgagcggaugcuccgccugucccugaacaucgaccccgacgcgaagguggaggaggagccggaggaggagcccgaggagaccgccgaggacaccaccgaggacacggagcaggacgaggacgaggagauggacgucggcaccgacgaggaggaggagaccgccaaggagagcaccgccgagaaggacgagcucuga

SEQ ID NO: 7620 - RNA, 2412 nt, Artificial Sequence
  derived and/or modified sequence opt2 from GRP94_(gp96)__Homo_sapiens__AAH66656
augcgcgcccucuggguccucggccucugcugcguccuccucaccuucggcuccguccgcgccgacgacgaggucgacgucgacggcaccgucgaggaggaccucggcaagucccgcgagggcucccgcaccgacgacgaggucguccagcgcgaggaggaggccauccagcucgacggccucaacgccucccagauccgcgagcuccgcgagaaguccgagaaguucgccuuccaggccgaggucaaccgcaugaugaagcucaucaucaacucccucuacaagaacaaggagaucuuccuccgcgagcucaucuccaacgccuccgacgcccucgacaagauccgccucaucucccucaccgacgagaacgcccucuccggcaacgaggagcucaccgucaagaucaagugcgacaaggagaagaaccuccuccacgucaccgacaccggcgucggcaugacccgcgaggagcucgucaagaaccucggcaccaucgccaaguccggcaccuccgaguuccucaacaagaugaccgaggcccaggaggacggccaguccaccuccgagcucaucggccaguucggcgucggcuucuacuccgccuuccucgucgccgacaaggucaucgucaccuccaagcacaacaacgacacccagcacaucugggaguccgacuccaacgaguucuccgucaucgccgacccccgcggcaacacccucggccgcggcaccaccaucacccucguccucaaggaggaggccuccgacuaccucgagcucgacaccaucaagaaccucgucaagaaguacucccaguucaucaacuuccccaucuacgucugguccuccaagaccgagaccgucgaggagcccauggaggaggaggaggccgccaaggaggagaaggaggaguccgacgacgaggccgccgucgaggaggaggaggaggagaagaagcccaagaccaagaaggucgagaagaccgucugggacugggagcucaugaacgacaucaagcccaucuggcagcgccccuccaaggaggucgaggaggacgaguacaaggccuucuacaaguccuucuccaaggaguccgacgaccccauggccuacauccacuucaccgccgagggcgaggucaccuucaaguccauccucuucguccccaccuccgccccccgcggccucuucgacgaguacggcuccaagaaguccgacuacaucaagcucuacguccgccgcgucuucaucaccgacgacuuccacgacaugaugcccaaguaccucaacuucgucaagggcgucgucgacuccgacgaccucccccucaacgucucccgcgagacccuccagcagcacaagcuccucaaggucauccgcaagaagcucguccgcaagacccucgacaugaucaagaagaucgccgacgacaaguacaacgacaccuucuggaaggaguucggcaccaacaucaagcucggcgucaucgaggaccacuccaaccgcacccgccucgccaagcuccuccgcuuccaguccucccaccaccccaccgacaucaccucccucgaccaguacgucgagcgcaugaaggagaagcaggacaagaucuacuucauggccggcuccucccgcaaggaggccgaguccucccccuucgucgagcgccuccucaagaagggcuacgaggucaucuaccucaccgagcccgucgacgaguacugcauccaggcccuccccgaguucgacggcaagcgcuuccagaacgucgccaaggagggcgucaaguucgacgaguccgagaagaccaaggagucccgcgaggccgucgagaaggaguucgagccccuccucaacuggaugaaggacaaggcccucaaggacaagaucgagaaggccgucgucucccagcgccucaccgagucccccugcgcccucgucgccucccaguacggcugguccggcaacauggagcgcaucaugaaggcccaggccuaccagaccggcaaggacaucuccaccaacuacuacgccucccagaagaagaccuucgagaucaacccccgccacccccucauccgcgacaugcuccgccgcaucaaggaggacgaggacgacaagaccguccucgaccucgccgucguccucuucgagaccgccacccuccgcuccggcuaccuccuccccgacaccaaggccuacggcgaccgcaucgagcgcaugcuccgccucucccucaacaucgaccccgacgccaaggucgaggaggagcccgaggaggagcccgaggagaccgccgaggacaccaccgaggacaccgagcaggacgaggacgaggagauggacgucggcaccgacgaggaggaggagaccgccaaggaguccaccgccgagaaggacgagcucuga

SEQ ID NO: 7621 - RNA, 2412 nt, Artificial Sequence
  derived and/or modified sequence opt3 from GRP94_(gp96)__Homo_sapiens__AAH66656
augagagcccugugggugcucggccuuugcuguguccuguugaccuucgggagcguuagggcugacgaugagguggacguagauggaacaguggaagaggacuuagguaagucccgggaaggcucucgcacugaugacgaggucgugcagcgagaagaggaggcaauccaacuggaugggcuaaacgccucacagauucgugaacucagagagaaaagugaaaaguuugcguuccaggcugagguuaauaggaugaugaaacugauaaucaacagccuuuacaagaauaaagagauuuuucugcgggaauugaucuccaacgccucugacgcacucgauaagauucgccugaucucgcugacggacgagaaugcccucucaggaaacgaagaguuaaccgugaagauaaaaugcgauaaggagaaaaaucugcuucacgucacagacacuggcguggguaugaccagagaggaguugguaaagaaccuggggacaaucgcuaaaagcggaaccagugaguuccuaaauaagaugacugaagcacaggaagauggccaauccacaucugagcucauuggccaguuugggguuggauucuauagcgccuuucugguggcugacaaggucaucgugaccuccaaacauaacaaugacacgcagcacauuugggaaucagauaguaacgaguucagcgugaucgccgaccccagggguaauacucuuggccgggggaccacaauaacucuggucuugaaggaggaagcgucugauuaccucgagcuggacaccauuaaaaacuuaguuaagaaauauucccaguuuaucaauuucccuauuuacguguggucaagcaagacagaaaccguagaggaaccaauggaggaggaagaggcagccaaagaagagaaggaggaaagugaugacgaggcugccguggaagaggaagaggaggaaaagaaaccgaagacgaaaaaggucgagaaaacugugugggauugggaacugaugaacgacaucaagcccaucuggcaacgcccuucuaaggagguugaagaggaugaguauaaagcauuuuacaaguccuucagcaaagaaucggacgauccaauggcuuauauucauuuuacagccgagggagaagugaccuucaagucuauacucuucguccccacuuccgcgccucgaggccuuuuugacgaguacgguaguaaaaagucagacuacaucaagcuguaugugagaaggguauucauuacagaugacuuucacgauaugaugccaaaauacuugaacuucguuaaggggguggucgacagcgaugaccuaccccugaaugugucccgggaaacccuccagcagcauaaacugcuuaaggucauccguaaaaagcuggugcgcaagacguuggauaugauuaaaaagauagccgacgauaaauauaacgacaccuuuuggaaggaguucggaacaaauaucaaacucggcguuaucgaggaucacucuaacagaacuaggcuggcaaaguuacugcgguuucagagcucacaccauccuaccgacauuacaagucuagaucaauacguggaacgaaugaaagagaagcaggacaagaucuauuucauggcuggcuccagccgcaaagaagccgagucuucaccauuuguagagagacuccugaagaaaggguacgaagucauuuaucuuacugagccgguggacgaauacuguauacaggcuuugcccgaguucgauggaaagagguuucaaaauguugccaaagaaggugugaaguucgacgagagugagaagaccaaagaaagccgggaggcagucgaaaaggaguuugaaccucugcucaacuggaugaaagauaaggcccugaaagacaagaucgagaaggcugugguaucccagcgccuuacagagucuccaugcgcgcugguggcaucgcaguacggcuggagcgggaauauggaaagaauuaugaaagcccaggcuuaucaaaccggaaaggauaucuccacuaacuacuaugccucacagaaaaagacguucgagaucaaucccaggcacccuuugauucgugacaugcuccggcgaauaaaagaagaugaggacgauaagacaguucuggacuuagcagucgugcuguucgaaaccgccacucuaagaaguggcuaccuccugccagauaccaaggcuuauggugacaggaucgagcgcaugcuucgguugucucugaacauugaucccgacgccaaaguggaggaagaaccggaagaggagccugaagagacagcagaagacaccacugaggauacagaacaggacgaggaugaggaaauggacgucgggacggaugaggaagaggaaaccgcgaaggagagcacugcugagaaagacgaacucuga

SEQ ID NO: 7622 - RNA, 2412 nt, Artificial Sequence
  derived and/or modified sequence opt4 from GRP94_(gp96)__Homo_sapiens__AAH66656
augagagcccugugggugcugggccugugcugcgugcugcugaccuucggcagcgugagagccgacgacgagguggacguggacggcaccguggaggaggaccugggcaagagcagagagggcagcagaaccgacgacgagguggugcagagagaggaggaggccauccagcuggacggccugaacgccagccagaucagagagcugagagagaagagcgagaaguucgccuuccaggccgaggugaacagaaugaugaagcugaucaucaacagccuguacaagaacaaggagaucuuccugagagagcugaucagcaacgccagcgacgcccuggacaagaucagacugaucagccugaccgacgagaacgcccugagcggcaacgaggagcugaccgugaagaucaagugcgacaaggagaagaaccugcugcacgugaccgacaccggcgugggcaugaccagagaggagcuggugaagaaccugggcaccaucgccaagagcggcaccagcgaguuccugaacaagaugaccgaggcccaggaggacggccagagcaccagcgagcugaucggccaguucggcgugggcuucuacagcgccuuccugguggccgacaaggugaucgugaccagcaagcacaacaacgacacccagcacaucugggagagcgacagcaacgaguucagcgugaucgccgaccccagaggcaacacccugggcagaggcaccaccaucacccuggugcugaaggaggaggccagcgacuaccuggagcuggacaccaucaagaaccuggugaagaaguacagccaguucaucaacuuccccaucuacguguggagcagcaagaccgagaccguggaggagcccauggaggaggaggaggccgccaaggaggagaaggaggagagcgacgacgaggccgccguggaggaggaggaggaggagaagaagcccaagaccaagaagguggagaagaccgugugggacugggagcugaugaacgacaucaagcccaucuggcagagacccagcaaggagguggaggaggacgaguacaaggccuucuacaagagcuucagcaaggagagcgacgaccccauggccuacauccacuucaccgccgagggcgaggugaccuucaagagcauccuguucgugcccaccagcgcccccagaggccuguucgacgaguacggcagcaagaagagcgacuacaucaagcuguacgugagaagaguguucaucaccgacgacuuccacgacaugaugcccaaguaccugaacuucgugaagggcgugguggacagcgacgaccugccccugaacgugagcagagagacccugcagcagcacaagcugcugaaggugaucagaaagaagcuggugagaaagacccuggacaugaucaagaagaucgccgacgacaaguacaacgacaccuucuggaaggaguucggcaccaacaucaagcugggcgugaucgaggaccacagcaacagaaccagacuggccaagcugcugagauuccagagcagccaccaccccaccgacaucaccagccuggaccaguacguggagagaaugaaggagaagcaggacaagaucuacuucauggccggcagcagcagaaaggaggccgagagcagccccuucguggagagacugcugaagaagggcuacgaggugaucuaccugaccgagcccguggacgaguacugcauccaggcccugcccgaguucgacggcaagagauuccagaacguggccaaggagggcgugaaguucgacgagagcgagaagaccaaggagagcagagaggccguggagaaggaguucgagccccugcugaacuggaugaaggacaaggcccugaaggacaagaucgagaaggccguggugagccagagacugaccgagagccccugcgcccugguggccagccaguacggcuggagcggcaacauggagagaaucaugaaggcccaggccuaccagaccggcaaggacaucagcaccaacuacuacgccagccagaagaagaccuucgagaucaaccccagacacccccugaucagagacaugcugagaagaaucaaggaggacgaggacgacaagaccgugcuggaccuggccguggugcuguucgagaccgccacccugagaagcggcuaccugcugcccgacaccaaggccuacggcgacagaaucgagagaaugcugagacugagccugaacaucgaccccgacgccaagguggaggaggagcccgaggaggagcccgaggagaccgccgaggacaccaccgaggacaccgagcaggacgaggacgaggagauggacgugggcaccgacgaggaggaggagaccgccaaggagagcaccgccgagaaggacgagcuguga

SEQ ID NO: 7623 - RNA, 2412 nt, Artificial Sequence
  derived and/or modified sequence opt5 from GRP94_(gp96)__Homo_sapiens__AAH66656
augagagcccugugggugcucggccugugcuguguccuucugaccuucgggagcguucgggcugacgaugagguggacguggauggaacagucgaagaggaccucggcaagucccgcgaagggucuagaacggaugacgaggugguucagcgggaagaggaggccauccaacuggauggacuuaacgcgagccagauucgcgaacugagagagaaauccgaaaaguuugcuuuccaggccgaggugaaucggaugaugaaacucaucauuaacucucuguacaagaauaaagagaucuuucugcgcgaacucauuagcaacgccuccgacgcucuggauaagaucagacuuaucucucugaccgacgagaaugcccucagcggcaacgaagaacugacagucaagauuaaaugcgauaaggagaaaaaucuucugcacgugaccgacacagggguuggaaugacccgggaggagcucgugaagaaccugggcacaaucgcuaaauccggcaccagcgaguuccugaauaagaugacggaggcccaggaagaugggcaaucuaccuccgagcucauuggacaguuuggcgucggguucuauagcgcguuucugguggccgacaaggugaucgucacaucuaaacauaacaaugacacccagcacauuugggaauccgauagcaacgaguucucuguuaucgcugacccccgcggaaauacacuuggcagagggaccacgauuacacuggugcucaaggaggaagccuccgauuaccuggagcuugacaccaucaaaaaccuggugaagaaauauagccaguuuaucaauuucccuauuuacgucugguccucuaagacagaaaccguggaggaaccgauggaggaggaagaggcugccaaagaagagaaggaggaaagcgaugacgaggcggccguugaagaggaagaggaggaaaagaaacccaagaccaaaaagguggagaaaacagucugggauugggaacucaugaacgacaucaagccuauuuggcaacggcccuccaaggagguggaagaggaugaguauaaagccuuuuacaagagcuucucuaaagaauccgacgauccuauggcuuauauccauuuuacggcugagggagaaguuaccuucaagagcauucuguucgugcccacaucugccccucgcggccuguuugacgaguacggcagcaaaaaguccgacuacaucaagcucuaugucagacggguguucaucaccgaugacuuucacgauaugaugccgaaauaccugaacuucgucaagggggugguugacucugaugaccuuccccugaaugugagccgcgaaacacuccagcagcauaaacugcuuaaggucauucggaaaaagcuggugagaaagacccucgauaugaucaaaaagauugccgacgauaaauauaacgacacguuuuggaaggaguucggaacaaauaucaaacugggcguuauugaggaucacuccaacagaacccgccuggcuaagcuccugcgguuucagagcucucaccauccuaccgacaucacaucccuugaucaauacguggaaagaaugaaagagaagcaggacaagaucuauuucauggcggggagcucucgcaaagaagccgaguccagccccuuugucgagcggcugcucaagaaaggauacgaagugauuuaucugaccgagccuguggacgaauacuguauccaggcucugcccgaguucgauggcaagagauuucaaaauguugccaaagaaggggucaaguucgacgaguccgagaagacaaaagaaucucgcgaggccguggaaaaggaguuugaaccgcuucucaacuggaugaaagauaaggcucugaaagacaagauugagaaggccguggucagccagcggcugacggaguccccuugcgcgcucguggcuucucaguacggauggagcggcaauauggaaagaaucaugaaagcccaggccuaucaaaccggcaaggauauuuccacaaacuacuaugcuagccagaaaaagaccuucgagaucaauccccgccacccucugauucgggacaugcuuagacgcaucaaagaagaugaggacgauaagacaguucuggaccucgccgugguccuguucgaaaccgcuacgcugcggucuggguaccuucuccccgauaccaaggccuauggagacagaaucgagcggaugcugcgccugucccucaacauugaucccgacgcgaaaguggaggaagaaccugaagaggagccggaagagacagccgaagacaccacagaggauaccgaacaggacgaggaugaggaaauggacguuggcacggaugaggaagaggaaacagcuaaggagagcaccgccgagaaagacgaacuguga

SEQ ID NO: 7624 - RNA, 2412 nt, Artificial Sequence
  derived and/or modified sequence opt6 from GRP94_(gp96)__Homo_sapiens__AAH66656
augagagcgcucuggguacuaggauuauguugcguacuauuaacguuugggucuguaagagcagacgaugagguagauguagacggaacuguugaagaagauuuaggaaaaagccgagaaggaucaagaacagaugacgaagucguacaaagagaagaagaagcaauacaacuugauggacuaaacgcaagucaaauaagagaauuaagagaaaaaucagaaaaauuugcguuucaagcagaaguaaacagaaugaugaaacuaauaaucaacagucuauauaaaaacaaagaaauuuucuuaagagaacucauaagcaaugcuagugaugcacuagauaaaauacgauuaauaucauuaacagaugaaaaugcacuaagcggaaaugaggaauuaacaguaaaaauaaaaugcgauaaagaaaaaaaccuguuacaugucacagauacaggcguugguaugacuagagaagaacuaguuaaaaaucuugguacuauagcaaaaaguggaacaucagaauuccuaaauaaaaugacagaagcacaagaagauggacaaaguacgucagaacuaauaggacaauuuggagugggauuuuauuccgcauuccuaguagcggacaaagugauagugacuagcaaacacaacaaugacacacaacauauaugggaaucagauaguaaugaguucagugucaucgcugauccaagaggaaacacacuagguagaggaacaacuauaacacugguccuaaaagaagaagccagcgauuaucuagaauuagacacuauaaaaaaucuaguuaaaaaauacagccaauucauaaacuucccaauauacguaugguccaguaaaaccgaaacaguugaagaaccuauggaagaagaagaagccgcgaaagaggaaaaagaagaaucagaugacgaagcagcaguagaagaagaagaagaagagaaaaaaccaaaaacuaagaaaguagaaaaaacgguaugggauugggaacucaugaaugacauaaaaccaauauggcaaagaccaucuaaagaaguugaagaagaugaauacaaggcauuuuauaaaucauuuagcaaagaaagcgaugauccaauggcauauauacacuuuacagcagaaggagaaguaacuuucaaaucaauauuauucguaccgacaagugcuccaagaggauuauucgacgaauauggaucaaaaaaaagugacuauauuaaacuauacguaaggagaguauucauaaccgaugauuuucacgauaugaugccuaaauaccucaacuucguaaaaggaguuguggacucggacgacuuaccacuaaacguuagccgagaaacacuccaacaacacaaguuguuaaagguaauacgcaaaaaacuuguaagaaaaacacuagauaugauaaaaaagaucgcagaugacaaauacaacgauacauucuggaaagaauucgguacaaauauuaaacucggagugauugaagaucacaguaauagaacgagauuagcaaaacuacuuagauuccagucaagucaucacccaacagacaucacgucacuagaccaauaugucgaaagaaugaaagaaaaacaagauaagauauauuuuauggcaggaucaucaagaaaagaagcagaaaguagcccuuuuguagaaagauuauugaaaaaaggauacgaaguaauauauuuaaccgaaccuguugacgaauauuguauucaagcacuccccgaauuugacggaaaaagauuccaaaaugucgccaaagaaggaguuaaauucgaugaaucagaaaaaacaaaagagucaagagaagcaguagaaaaagaauucgaaccacuacuaaacuggaugaaagacaaagcauuaaaagauaaaauagaaaaagcaguaguaagccaaagauuaacggaaucgccaugcgcacuaguagcaucacaauacggauggaguggcaauauggaacgaauaaugaaagcacaggccuaccaaacagggaaagacauaagcacaaauuauuacgcaagucaaaaaaaaacauucgaaaucaauccuaggcacccauuaauucgagacaugcuaagaaggauaaaagaagaugaagacgauaaaacgguacuagaucuagcaguaguucuuuucgaaacagcaacccuacgaucagguuauuuacuccccgauacgaaagcuuacggcgacagaaucgaaagaaugcuaagacuaagucucaauaucgacccagaugcaaaaguugaagaagaacccgaagaagaaccugaagaaacagcagaagauacaacagaagacacagaacaagaugaagaugaagagauggauguaggaacagacgaagaagaggaaacugcaaaagaaucaacagcagaaaaagacgaacuauaa

SEQ ID NO: 7625 - protein, 646 aa, Artificial Sequence
  HSC70__Homo_sapiens__P11142
MSKGPAVGIDLGTTYSCVGVFQHGKVEIIANDQGNRTTPSYVAFTDTERLIGDAAKNQVAMNPTNTVFDAKRLIGRRFDDAVVQSDMKHWPFMVVNDAGRPKVQVEYKGETKSFYPEEVSSMVLTKMKEIAEAYLGKTVTNAVVTVPAYFNDSQRQATKDAGTIAGLNVLRIINEPTAAAIAYGLDKKVGAERNVLIFDLGGGTFDVSILTIEDGIFEVKSTAGDTHLGGEDFDNRMVNHFIAEFKRKHKKDISENKRAVRRLRTACERAKRTLSSSTQASIEIDSLYEGIDFYTSITRARFEELNADLFRGTLDPVEKALRDAKLDKSQIHDIVLVGGSTRIPKIQKLLQDFFNGKELNKSINPDEAVAYGAAVQAAILSGDKSENVQDLLLLDVTPLSLGIETAGGVMTVLIKRNTTIPTKQTQTFTTYSDNQPGVLIQVYEGERAMTKDNNLLGKFELTGIPPAPRGVPQIEVTFDIDANGILNVSAVDKSTGKENKITITNDKGRLSKEDIERMVQEAEKYKAEDEKQRDKVSSKNSLESYAFNMKATVEDEKLQGKINDEDKQKILDKCNEIINWLDKNQTAEKEEFEHQQKELEKVCNPIITKLYQSAGGMPGGMPGGFPGGGAPPSGGASSGPTIEEVD

SEQ ID NO: 7626 - RNA, 1941 nt, Artificial Sequence
  HSC70__Homo_sapiens__AAH16179
auguccaagggaccugcaguugguauugaucuuggcaccaccuacucuuguguggguguuuuccagcacggaaaagucgagauaauugccaaugaucagggaaaccgaaccacuccaagcuaugucgccuuuacggacacugaacgguugaucggugaugccgcaaagaaucaaguugcaaugaaccccaccaacacaguuuuugaugccaaacgucugauuggacgcagauuugaugaugcuguuguccagucugauaugaaacauuggcccuuuaugguggugaaugaugcuggcaggcccaagguccaaguagaauacaagggagagaccaaaagcuucuauccagaggaggugucuucuaugguucugacaaagaugaaggaaauugcagaagccuaccuugggaagacuguuaccaaugcuguggucacagugccagcuuacuuuaaugacucucagcgucaggcuaccaaagaugcuggaacuauugcuggucucaauguacuuagaauuauuaaugagccaacugcugcugcuauugcuuacggcuuagacaaaaagguuggagcagaaagaaacgugcucaucuuugaccugggagguggcacuuuugaugugucaauccucacuauugaggauggaaucuuugaggucaagucuacagcuggagacacccacuuggguggagaagauuuugacaaccgaauggucaaccauuuuauugcugaguuuaagcgcaagcauaagaaggacaucagugagaacaagagagcuguaagacgccuccguacugcuugugaacgugcuaagcguacccucucuuccagcacccaggccaguauugagaucgauucucucuaugaaggaaucgacuucuauaccuccauuacccgugcccgauuugaagaacugaaugcugaccuguuccguggcacccuggacccaguagagaaagcccuucgagaugccaaacuagacaagucacagauucaugauauuguccugguuggugguucuacucguauccccaagauucagaagcuucuccaagacuucuucaauggaaaagaacugaauaagagcaucaacccugaugaagcuguugcuuauggugcagcuguccaggcagccaucuugucuggagacaagucugagaauguucaagauuugcugcucuuggaugucacuccucuuucccuugguauugaaacugcugguggagucaugacuguccucaucaagcguaauaccaccauuccuaccaagcagacacagaccuucacuaccuauucugacaaccagccuggugugcuuauucagguuuaugaaggcgagcgugccaugacaaaggauaacaaccugcuuggcaaguuugaacucacaggcauaccuccugcaccccgagguguuccucagauugaagucacuuuugacauugaugccaaugguauacucaaugucucugcuguggacaagaguacgggaaaagagaacaagauuacuaucacuaaugacaagggccguuugagcaaggaagacauugaacguaugguccaggaagcugagaaguacaaagcugaagaugagaagcagagggacaaggugucauccaagaauucacuugaguccuaugccuucaacaugaaagcaacuguugaagaugagaaacuucaaggcaagauuaacgaugaggacaaacagaagauucuggacaaguguaaugaaauuaucaacuggcuugauaagaaucagacugccgagaaggaagaauuugaacaucaacagaaagagcuggagaaaguuugcaaccccaucaucaccaagcuguaccagagugcaggaggcaugccaggaggaaugccugggggauuuccuggugguggagcuccucccucugguggugcuuccucagggcccaccauugaagagguugauuaa

SEQ ID NO: 7627 - RNA, 1941 nt, Artificial Sequence
  derived and/or modified sequence opt1 from HSC70__Homo_sapiens__AAH16179
augagcaagggccccgccguggggaucgaccugggcaccaccuacuccugcgucgggguguuccagcacggcaagguggagaucaucgccaacgaccaggggaaccgcacgacccccagcuacgucgcguucaccgacaccgagcggcucaucggcgacgccgccaagaaccagguggccaugaaccccacgaacaccguguucgacgccaagcgccugaucggccggcgcuucgacgacgcggucgugcaguccgacaugaagcacuggcccuucaugguggucaacgacgccgggcggcccaagguccagguggaguacaagggcgagaccaagagcuucuacccggaggagguguccagcauggugcugaccaagaugaaggagaucgccgaggccuaccucgggaagacggugaccaacgcggucgugaccgugcccgccuacuucaacgacucccagcgccaggccaccaaggacgccggcacgaucgccgggcugaacguccugcggaucaucaacgagcccaccgcggccgccaucgccuacggccucgacaagaaggugggcgccgagcgcaacgugcugaucuucgaccucgggggcgggaccuucgacgucagcauccugaccaucgaggacggcaucuucgaggugaaguccacggcgggcgacacccaccucgggggcgaggacuucgacaaccggauggugaaccacuucaucgccgaguucaagcgcaagcacaagaaggacaucagcgagaacaagcgggccguccgccggcugcgcaccgccugcgagcgggccaagcgcacccuguccagcuccacgcaggcgagcaucgagaucgacucccuguacgaggggaucgacuucuacaccagcaucacccgggcccgcuucgaggagcugaacgccgaccucuuccggggcacccuggaccccguggagaaggcccugcgcgacgccaagcucgacaagucccagauccacgacaucguccuggucgggggcagcacgcggaucccgaagauccagaagcugcuccaggacuucuucaacggcaaggagcugaacaaguccaucaaccccgacgaggcgguggccuacggggccgccgugcaggcggccauccugagcggcgacaagagcgagaacgugcaggaccuccugcugcucgacgugacgccccugucccuggggaucgagaccgccggcggggucaugaccgugcucaucaagcgcaacaccaccauccccaccaagcagacccagacguucaccaccuacagcgacaaccagccgggcgugcugauccaggucuacgagggcgagcgcgccaugaccaaggacaacaaccugcucgggaaguucgagcugacgggcaucccgcccgcgccccgcggggugccccagaucgaggugaccuucgacaucgacgccaacggcauccugaacgucuccgccguggacaagagcaccgggaaggagaacaagaucaccaucaccaacgacaagggccggcucuccaaggaggacaucgagcggauggugcaggaggccgagaaguacaaggccgaggacgagaagcagcgcgacaaggucagcuccaagaacagccuggaguccuacgccuucaacaugaaggcgacgguggaggacgagaagcugcagggcaagaucaacgacgaggacaagcagaagauccucgacaagugcaacgagaucaucaacuggcuggacaagaaccagaccgccgagaaggaggaguucgagcaccagcagaaggagcuggagaaggugugcaaccccaucaucaccaagcucuaccagagcgccgggggcaugcccgggggcaugcccggcggguucccgggcgggggcgccccgcccuccgggggcgccagcuccggccccaccaucgaggaggucgacuga

SEQ ID NO: 7628 - RNA, 1941 nt, Artificial Sequence
  derived and/or modified sequence opt2 from HSC70__Homo_sapiens__AAH16179
auguccaagggccccgccgucggcaucgaccucggcaccaccuacuccugcgucggcgucuuccagcacggcaaggucgagaucaucgccaacgaccagggcaaccgcaccacccccuccuacgucgccuucaccgacaccgagcgccucaucggcgacgccgccaagaaccaggucgccaugaaccccaccaacaccgucuucgacgccaagcgccucaucggccgccgcuucgacgacgccgucguccaguccgacaugaagcacuggcccuucauggucgucaacgacgccggccgccccaagguccaggucgaguacaagggcgagaccaaguccuucuaccccgaggaggucuccuccaugguccucaccaagaugaaggagaucgccgaggccuaccucggcaagaccgucaccaacgccgucgucaccguccccgccuacuucaacgacucccagcgccaggccaccaaggacgccggcaccaucgccggccucaacguccuccgcaucaucaacgagcccaccgccgccgccaucgccuacggccucgacaagaaggucggcgccgagcgcaacguccucaucuucgaccucggcggcggcaccuucgacgucuccauccucaccaucgaggacggcaucuucgaggucaaguccaccgccggcgacacccaccucggcggcgaggacuucgacaaccgcauggucaaccacuucaucgccgaguucaagcgcaagcacaagaaggacaucuccgagaacaagcgcgccguccgccgccuccgcaccgccugcgagcgcgccaagcgcacccucuccuccuccacccaggccuccaucgagaucgacucccucuacgagggcaucgacuucuacaccuccaucacccgcgcccgcuucgaggagcucaacgccgaccucuuccgcggcacccucgaccccgucgagaaggcccuccgcgacgccaagcucgacaagucccagauccacgacaucguccucgucggcggcuccacccgcauccccaagauccagaagcuccuccaggacuucuucaacggcaaggagcucaacaaguccaucaaccccgacgaggccgucgccuacggcgccgccguccaggccgccauccucuccggcgacaaguccgagaacguccaggaccuccuccuccucgacgucaccccccucucccucggcaucgagaccgccggcggcgucaugaccguccucaucaagcgcaacaccaccauccccaccaagcagacccagaccuucaccaccuacuccgacaaccagcccggcguccucauccaggucuacgagggcgagcgcgccaugaccaaggacaacaaccuccucggcaaguucgagcucaccggcaucccccccgccccccgcggcgucccccagaucgaggucaccuucgacaucgacgccaacggcauccucaacgucuccgccgucgacaaguccaccggcaaggagaacaagaucaccaucaccaacgacaagggccgccucuccaaggaggacaucgagcgcaugguccaggaggccgagaaguacaaggccgaggacgagaagcagcgcgacaaggucuccuccaagaacucccucgaguccuacgccuucaacaugaaggccaccgucgaggacgagaagcuccagggcaagaucaacgacgaggacaagcagaagauccucgacaagugcaacgagaucaucaacuggcucgacaagaaccagaccgccgagaaggaggaguucgagcaccagcagaaggagcucgagaaggucugcaaccccaucaucaccaagcucuaccaguccgccggcggcaugcccggcggcaugcccggcggcuuccccggcggcggcgccccccccuccggcggcgccuccuccggccccaccaucgaggaggucgacuga

SEQ ID NO: 7629 - RNA, 1941 nt, Artificial Sequence
  derived and/or modified sequence opt3 from HSC70__Homo_sapiens__AAH16179
augagcaagggccccgccguggggaucgaccugggaaccacauacuccugcgucgguguuuuccagcacggcaaaguggagauuauagcuaacgaucaagggaauagaacuacgccuucuuauguagcauuuaccgacacagaaaggcucaucggagaugccgcgaagaaccagguggcuaugaauccaacuaacaccgucuucgacgccaaacggcuuauuggccgccgauuugaugacgcagugguucagucagauaugaagcauuggccguucaugguggucaaugacgccggucgucccaaagugcagguagaguacaagggggaaacaaagaguuuuuauccugaggaaguuagcuccauggugcugaccaaaaugaaggagaucgcugaggcauacuugggaaaaacugucacaaacgccguggugaccgucccagcuuauuucaaugauucucaaagacaggccacgaaggacgcgggcacuauugcaggcuuaaacguucugaggaucauaaaugaacccaccgccgcugccaucgcauacgggcuagauaaaaaggugggagcugagcggaacguacucauuuuugaccuggguggcgggacauucgaugugucgauccuuacuauugaagacggaaucuuugaggucaagucaaccgccggcgacacacaccuggguggggaggauuucgacaaucgcauggugaaccauuuuauagcggaauuuaaaagaaagcacaaaaaggauauuagcgagaauaaaagggccguucggcgcuugcgaaccgcaugugaaagagcuaagaggacgcucaguuccucuacucaggccagcaucgagauugacucccuguaugaaggaaucgauuuuuacacaucaaucacccgggcucguuucgaggagcugaacgccgaccucuuccgcggcacuuuagauccuguggaaaaagcacugagagacgccaaacuugauaagagucagauucaugacauagucuuggugggcgggagcacaaggaucccaaagauucaaaagcugcuacaggauuucuucaauggaaaagagcucaacaagucuaucaaccccgacgaagcuguagcguacggugcagccguucaggcugccauacuguccggcgacaaaucagagaaugugcaggaucuucuguugcucgacgucaccccucugagcuuagggauugaaacggcaggaggcgugaugaccguccugaucaagcggaacacaacuaucccaaccaagcaaacacagacuuuuaccacauauagugauaaucagccgggugugcucauucaaguuuacgagggggagcgagccaugaccaaagacaacaaucuucugggcaaguucgaauugacuggaaucccucccgcuccacgcggcgugccccagauugagguaacguuugauauagacgccaacgggauccuaaaugucucugcaguggauaaauccacaggaaaggaaaacaaaauuaccaucacuaaugacaaggguagacugagcaaggaggauaucgaaaggaugguucaggaggcggagaaauauaaggcugaagacgagaaacagcgggauaaggugucgucuaaaaacucccucgaaucauacgccuucaauaugaaggcaaccgucgaggacgagaagcugcaaggcaaaauuaacgaugaagacaagcagaaaauacuugacaagugcaaugagaucauuaacuggcuggauaaaaaucagacagccgaaaaggaggaauuugagcaccagcaaaaagaguuggaaaagguguguaacccuaucauuaccaagcucuaucagagugcugggggaaugccaggcgguaugcccgggggcuucccgggaggcggggccccucccagcggaggugcauccucuggcccaacuaucgaggaaguagacuga

SEQ ID NO: 7630 - RNA, 1941 nt, Artificial Sequence
  derived and/or modified sequence opt4 from HSC70__Homo_sapiens__AAH16179
augagcaagggccccgccgugggcaucgaccugggcaccaccuacagcugcgugggcguguuccagcacggcaagguggagaucaucgccaacgaccagggcaacagaaccacccccagcuacguggccuucaccgacaccgagagacugaucggcgacgccgccaagaaccagguggccaugaaccccaccaacaccguguucgacgccaagagacugaucggcagaagauucgacgacgccguggugcagagcgacaugaagcacuggcccuucaugguggugaacgacgccggcagacccaaggugcagguggaguacaagggcgagaccaagagcuucuaccccgaggaggugagcagcauggugcugaccaagaugaaggagaucgccgaggccuaccugggcaagaccgugaccaacgccguggugaccgugcccgccuacuucaacgacagccagagacaggccaccaaggacgccggcaccaucgccggccugaacgugcugagaaucaucaacgagcccaccgccgccgccaucgccuacggccuggacaagaaggugggcgccgagagaaacgugcugaucuucgaccugggcggcggcaccuucgacgugagcauccugaccaucgaggacggcaucuucgaggugaagagcaccgccggcgacacccaccugggcggcgaggacuucgacaacagaauggugaaccacuucaucgccgaguucaagagaaagcacaagaaggacaucagcgagaacaagagagccgugagaagacugagaaccgccugcgagagagccaagagaacccugagcagcagcacccaggccagcaucgagaucgacagccuguacgagggcaucgacuucuacaccagcaucaccagagccagauucgaggagcugaacgccgaccuguucagaggcacccuggaccccguggagaaggcccugagagacgccaagcuggacaagagccagauccacgacaucgugcuggugggcggcagcaccagaauccccaagauccagaagcugcugcaggacuucuucaacggcaaggagcugaacaagagcaucaaccccgacgaggccguggccuacggcgccgccgugcaggccgccauccugagcggcgacaagagcgagaacgugcaggaccugcugcugcuggacgugaccccccugagccugggcaucgagaccgccggcggcgugaugaccgugcugaucaagagaaacaccaccauccccaccaagcagacccagaccuucaccaccuacagcgacaaccagcccggcgugcugauccagguguacgagggcgagagagccaugaccaaggacaacaaccugcugggcaaguucgagcugaccggcaucccccccgcccccagaggcgugccccagaucgaggugaccuucgacaucgacgccaacggcauccugaacgugagcgccguggacaagagcaccggcaaggagaacaagaucaccaucaccaacgacaagggcagacugagcaaggaggacaucgagagaauggugcaggaggccgagaaguacaaggccgaggacgagaagcagagagacaaggugagcagcaagaacagccuggagagcuacgccuucaacaugaaggccaccguggaggacgagaagcugcagggcaagaucaacgacgaggacaagcagaagauccuggacaagugcaacgagaucaucaacuggcuggacaagaaccagaccgccgagaaggaggaguucgagcaccagcagaaggagcuggagaaggugugcaaccccaucaucaccaagcuguaccagagcgccggcggcaugcccggcggcaugcccggcggcuuccccggcggcggcgccccccccagcggcggcgccagcagcggccccaccaucgaggagguggacuga

SEQ ID NO: 7631 - RNA, 1941 nt, Artificial Sequence
  derived and/or modified sequence opt5 from HSC70__Homo_sapiens__AAH16179
augagcaagggccccgccguggggaucgaccugggaaccacauacuccugcgucggcguuuuccagcacgggaaaguggagauuaucgcuaacgaucaaggaaauagaacgaccccuucuuauguggccuuuacagacaccgaacggcucauuggcgaugcggcuaagaaccaggucgccaugaauccgacaaacaccguguucgacgccaaacgccugaucgggagacgguuugaugacgcuguugugcagagcgauaugaagcauuggcccuucauggucgugaaugacgccggacgcccuaaaguucagguggaguacaagggcgaaacaaaguccuuuuaucccgaggaagucucuagcauggugcuuaccaaaaugaaggagauugcugaggccuaccugggcaaaacggugaccaacgcggucguuacagugccugccuauuucaaugauucccaaagacaggcuaccaaggacgccgggacaaucgcuggacucaacgugcugcggaucauuaaugaacccaccgccgcggccaucgcuuacggccuugauaaaaaggucggggccgagcgcaacgugcugauuuuugaccucggaggcgggacguucgauguuucuauccugacaauugaagacggaaucuuugaggugaagucuaccgcuggcgacacacaccugggcggggaggauuucgacaauagaauggucaaccauuuuauugccgaauuuaaacggaagcacaaaaaggauaucuccgagaauaaacgcgccgugagacggcuccgcaccgcuugugaaagagcgaagcggacccugagcagcuccacacaggccagcaucgagauugacucucuuuaugaaggaaucgauuuuuacacguccauuacccgcgcuagauucgaggagcugaacgccgaccucuuccggggcacacuggauccuguugaaaaagcccuuagagacgcuaagcuggauaagagccagauccaugacauugugcucgucgggggaucuacccgcaucccgaaaauccaaaagcugcugcaggauuucuucaauggcaaagagcucaacaaguccauuaaccccgacgaagccguggcguacggggcugccguccaggccgcuauccugagcggagacaaauccgagaaugugcaggaucuucugcuccuggacguuacaccucuuucucugggcauugaaaccgccggcggggugaugacgguccucaucaagcggaacacaaccauucccaccaagcaaacacagaccuuuacaacguauagcgauaaucagccuggagugcugauccaaguuuacgagggcgagagagcuaugaccaaagacaacaaucugcucgggaaguucgaacugacaggaaucccgcccgccccucgcggcgugccccagauugaggucaccuuugauaucgacgcgaacgggauucuuaauguguccgccguggauaaaagcacaggcaaggaaaacaaaaucaccauuacgaaugacaagggacggcugucuaaggaggauaucgaaagaaugguucaggaggcugagaaauauaaggccgaagacgagaaacagcgcgauaaggucuccagcaaaaacucucucgaaagcuacgcuuucaauaugaaggccaccguggaggacgagaagcugcaaggcaaaauuaacgaugaagacaagcagaaaauccuugacaagugcaaugagaucauuaacuggcuggauaaaaaucagacagcggaaaaggaggaauuugagcaccagcaaaaagagcucgaaaagguguguaacccuaucauuaccaagcuguaucaguccgccgggggaaugcccggcgggaugcccggaggcuucccugggggcggagcuccgcccucuggcggggccagcuccggaccuacaaucgaggaagucgacuga

SEQ ID NO: 7632 - RNA, 1941 nt, Artificial Sequence
  derived and/or modified sequence opt6 from HSC70__Homo_sapiens__AAH16179
augucuaagggucccgcaguugggauugauuuaggaacuacuuauucaugcguaggaguauuccaacacggaaaaguagaaauuauagcaaacgaccaaggaaaucgaacaacaccaaguuaugucgccuuuacugauacugaaagacucauaggagacgcugcaaaaaaccaaguugcaaugaacccaacuaauacaguauucgaugcaaaaagacuaauagguagaagauucgacgacgcuguaguacaaagugauaugaaacacuggccauuuaugguagugaaugacgccgguagaccaaaaguacaaguagaauauaaaggugaaaccaaaaguuuuuacccagaagaaguaagcucaaugguauuaaccaaaaugaaagagauagcagaagcguauuuaggaaaaacaguaacuaacgcaguagucaccguaccagcauacuuuaaugauucucaaagacaagcaacaaaagaugcaggaacaaucgccggauuaaauguacuaagaaucauaaaugaaccuacagcagcagcaauagcauacggauuagauaaaaaaguaggcgcagaaagaaauguacuaauauuugaccucggaggaggaacauuugacguuucaauuuuaaccauagaagacggaauuuucgaaguaaaaucaacagcaggagacacucaucuagguggcgaagauuuugacaaucgaaugguaaaccauuucauugcagaauuuaaaagaaaacauaaaaaggauauaucagaaaacaaaagagcagucagaagguuaagaacagcaugugaaagagcaaaaagaacauuaucuucaaguacgcaagcaaguauagaaaucgacaguuuauaugaaggaauugauuuuuacacaucaaucacacgagcuagguuugaagaacuaaaugcagaccucuucagaggaacauuggauccaguagagaaagcucuacgagaugcuaaacuagacaaaucacaaauacaugacauagugcugguaggcggaucaacaagaaucccgaaaauacaaaaauuacuacaagauuucuuuaauggaaaagaacuuaacaaaucaauaaauccagacgaagcuguagcauacggugcagcagugcaagcagcaauuuuauccggagacaaaucagaaaacgugcaagauuuauuacuacuagacguuacaccacuaagucuagguauagaaacagcgggaggaguaaugacaguauuaauaaaacgaaauaccacaauacccacuaaacaaacgcaaacauuuacaacauauucagacaaucaaccuggcgugcugauccaaguauacgaaggagaaagagcaaugacaaaagauaacaaccuuuuaggcaaauuugaacuaacagguauaccaccugcaccaaggggaguaccacaaaucgaaguuacauucgacauagacgcaaacggaauauuaaauguaagugcaguagacaaaucaacagguaaagaaaacaagauaacuauaacaaacgauaaaggaagacuaucuaaagaagacauagaacgaaugguacaagaagcagaaaaauacaaagccgaggacgaaaaacaaagagauaaaguaaguagcaaaaauaguuuagaaucauacgcauucaauaugaaagcaacuguggaggacgaaaaauugcaaggaaaaauaaaugaugaagacaaacaaaagauauuagauaaauguaaugaaauaauaaacuggcuagauaaaaaucaaacagcagaaaaagaagaauuugaacaucaacaaaaagaauuggaaaaaguaugcaauccaauaauaacaaaacuauaucaaagcgcagggggcaugcccggcggaaugcccggaggcuuuccaggaggaggagcuccaccaucagguggcgcuucaaguggucccacaauagaagaaguagauuaa

SEQ ID NO: 7633 - protein, 858 aa, Artificial Sequence
  HSP110__Homo_sapiens__Q92598
MSVVGLDVGSQSCYIAVARAGGIETIANEFSDRCTPSVISFGSKNRTIGVAAKNQQITHANNTVSNFKRFHGRAFNDPFIQKEKENLSYDLVPLKNGGVGIKVMYMGEEHLFSVEQITAMLLTKLKETAENSLKKPVTDCVISVPSFFTDAERRSVLDAAQIVGLNCLRLMNDMTAVALNYGIYKQDLPSLDEKPRIVVFVDMGHSAFQVSACAFNKGKLKVLGTAFDPFLGGKNFDEKLVEHFCAEFKTKYKLDAKSKIRALLRLYQECEKLKKLMSSNSTDLPLNIECFMNDKDVSGKMNRSQFEELCAELLQKIEVPLYSLLEQTHLKVEDVSAVEIVGGATRIPAVKERIAKFFGKDISTTLNADEAVARGCALQCAILSPAFKVREFSVTDAVPFPISLIWNHDSEDTEGVHEVFSRNHAAPFSKVLTFLRRGPFELEAFYSDPQGVPYPEAKIGRFVVQNVSAQKDGEKSRVKVKVRVNTHGIFTISTASMVEKVPTEENEMSSEADMECLNQRPPENPDTDKNVQQDNSEAGTQPQVQTDAQQTSQSPPSPELTSEENKIPDADKANEKKVDQPPEAKKPKIKVVNVELPIEANLVWQLGKDLLNMYIETEGKMIMQDKLEKERNDAKNAVEEYVYEFRDKLCGPYEKFICEQDHQNFLRLLTETEDWLYEEGEDQAKQAYVDKLEELMKIGTPVKVRFQEAEERPKMFEELGQRLQHYAKIAADFRNKDEKYNHIDESEMKKVEKSVNEVMEWMNNVMNAQAKKSLDQDPVVRAQEIKTKIKELNNTCEPVVTQPKPKIESPKLERTPNGPNIDKKEEDLEDKNNFGAEPPHQNGECYPNEKNSVNMDLD

SEQ ID NO: 7634 - RNA, 2577 nt, Artificial Sequence
  HSP110__Homo_sapiens__AAH37553
augucgguggugggguuggacgugggcucgcagagcugcuacaucgcgguagcccgggccgggggcaucgagaccaucgccaaugaguucagcgaccggugcaccccgucagucauaucauuuggaucaaaaaauagaacaaucggaguugcagccaaaaaucagcaaaucacucaugcaaacaauacggugucuaacuucaaaagauuucauggccgagcauucaaugaccccuucauucaaaaggagaaggaaaacuugaguuacgauuugguuccauugaaaaaugguggaguuggaauaaagguaauguacaugggugaagaacaucuauuuaguguggagcagauaacagccauguuguugacuaagcugaaggaaacugcugaaaacagccucaagaaaccaguaacagauuguguuauuucaguccccuccuucuuuacagaugcugagaggcgaucuguguuagaugcugcacagauuguuggccuaaacuguuuaagacuuaugaaugacaugacagcuguugcuuugaauuacggaauuuauaagcaggaucucccaagccuggaugagaaaccucggauagugguuuuuguugauaugggacauucagcuuuucaagugucugcuugugcuuuuaacaagggaaaauugaagguacugggaacagcuuuugauccuuucuuaggaggaaaaaacuucgaugaaaaguuaguggaacauuuuugugcagaauuuaaaacuaaguacaaguuggaugcaaaauccaaaauacgagcacuccuacgucuguaucaggaaugugaaaaacugaaaaagcuaaugagcucuaacagcacagaccuuccacugaauaucgaaugcuuuaugaaugauaaagauguuuccggaaagaugaacaggucacaauuugaagaacucugugcugaacuucugcaaaagauagaaguaccccuuuauucacuguuggaacaaacucaucucaaaguagaagaugugagugcaguugagauuguuggaggcgcuacacgaauuccagcugugaaggaaagaauugccaaauucuuuggaaaagauauuagcacaacacucaaugcagaugaagcaguagccagaggaugugcauuacagugugcaauacuuuccccggcauuuaaaguuagagaauuuuccgucacagaugcaguuccuuuuccaauaucucugaucuggaaccaugauucagaagauacugaagguguucaugaagucuuuagucgaaaccaugcugcuccuuucuccaaaguucucaccuuucugagaagggggccuuuugagcuagaagcuuucuauucugauccccaaggaguuccauauccagaagcaaaaauaggccgcuuuguaguucagaauguuucugcacagaaagauggagaaaaaucuagaguaaaagucaaagugcgagucaacacccauggcauuuucaccaucucuacggcaucuaugguggagaaagucccaacugaggagaaugaaaugucuucugaagcugacauggagugucugaaucagagaccaccagaaaacccagacacugauaaaaauguccagcaagacaacagugaagcuggaacacagccccagguacaaacugaugcucaacaaaccucacagucucccccuucaccugaacuuaccucagaagaaaacaaaaucccagaugcugacaaagcaaaugaaaaaaaaguugaccagccuccagaagcuaaaaagcccaaaauaaagguggugaauguugagcugccuauugaagccaacuuggucuggcaguuagggaaagaccuucuuaacauguauauugagacagaggguaagaugauaaugcaagauaaauuggaaaaagaaaggaaugaugcuaaaaaugcaguugaggaauauguguaugaguucagagacaagcuguguggaccauaugaaaaauuuauaugugagcaggaucaucaaaauuuuuugagacuccucacagaaacugaagacuggcuguaugaagaaggagaggaccaagcuaaacaagcauauguugacaaguuggaagaauuaaugaaaauuggcacuccaguuaaaguucgguuucaggaagcugaagaacggccaaaaauguuugaagaacuaggacagaggcugcagcauuaugccaagauagcagcugacuucagaaauaaggaugagaaauacaaccauauugaugagucugaaaugaaaaaaguggagaagucuguuaaugaagugauggaauggaugaauaaugucaugaaugcucaggcuaaaaagagucuugaucaggauccaguuguacgugcucaggaaauuaaaacaaaaaucaaggaauugaacaacacaugugaacccguuguaacacaaccgaaaccaaaaauugaaucacccaaacuggaaagaacuccaaauggcccaaauauugauaaaaaggaagaagauuuagaagacaaaaacaauuuuggugcugaaccuccacaucagaauggugaauguuacccuaaugagaaaaauucuguuaauauggacuuggacuag

SEQ ID NO: 7635 - RNA, 2577 nt, Artificial Sequence
  derived and/or modified sequence opt1 from HSP110__Homo_sapiens__AAH37553
augagcguggucggccuggacguggggucccagagcugcuacaucgccguggcccgcgcgggcgggaucgagaccaucgccaacgaguucuccgaccggugcacccccagcgucaucuccuucggcagcaagaaccgcaccaucgggguggccgccaagaaccagcagaucacccacgccaacaacaccguguccaacuucaagcgguuccacggccgcgcguucaacgacccguucauccagaaggagaaggagaaccucagcuacgaccuggucccccugaagaacggcggggugggcaucaaggugauguacaugggggaggagcaccucuucuccgucgagcagaucaccgccaugcugcugacgaagcucaaggagaccgccgagaacagccugaagaagcccgugaccgacugcgugaucuccguccccagcuucuucaccgacgccgagcggcgcuccgugcuggacgcggcccagaucgugggccucaacugccugcggcugaugaacgacaugacggccgucgcccucaacuacgggaucuacaagcaggaccugccgagccuggacgagaagccccgcaucgugguguucgucgacaugggccacuccgccuuccaggugagcgcgugcgccuucaacaagggcaagcucaaggugcuggggaccgccuucgaccccuuccugggcgggaagaacuucgacgagaagcucgucgagcacuucugcgccgaguucaagaccaaguacaagcuggacgccaaguccaagauccgggcgcugcuccgccuguaccaggagugcgagaagcugaagaagcucaugagcuccaacagcaccgaccugccccugaacaucgagugcuucaugaacgacaaggacgugagcggcaagaugaaccggucccaguucgaggagcucugcgccgagcugcugcagaagaucgaggugccgcucuacagccugcuggagcagacgcaccucaaggucgaggacguguccgccgucgagaucgugggcggggccacccgcauccccgccgugaaggagcggaucgcgaaguucuucggcaaggacaucagcaccacccugaacgccgacgaggccgucgcccgcgggugcgcccugcagugcgcgauccucucccccgccuucaaggugcgggaguucagcgugacggacgccguccccuucccgaucucccugaucuggaaccacgacagcgaggacaccgagggcgugcacgagguguucucccgcaaccacgccgcgcccuucagcaagguccugaccuuccuccggcgcgggcccuucgagcuggaggccuucuacuccgacccccagggcgugccguaccccgaggccaagaucggccgguucgugguccagaacgugagcgcccagaaggacggggagaagucccgcgugaaggucaaggugcgggugaacacccacggcaucuucacgaucagcaccgccuccauggucgagaaggugcccaccgaggagaacgagaugagcuccgaggcggacauggagugccugaaccagcggcccccggagaaccccgacaccgacaagaacgugcagcaggacaacagcgaggccgggacgcagccccagguccagaccgacgcccagcagaccucccagagcccgcccagccccgagcucaccuccgaggagaacaagauccccgacgccgacaaggccaacgagaagaagguggaccagcccccggaggcgaagaagcccaagaucaagguggucaacguggagcugcccaucgaggccaaccugguguggcagcucggcaaggaccugcugaacauguacaucgagacggaggggaagaugaucaugcaggacaagcucgagaaggagcgcaacgacgccaagaacgccgucgaggaguacguguacgaguuccgcgacaagcugugcggcccguacgagaaguucaucugcgagcaggaccaccagaacuuccugcgccugcucaccgagaccgaggacuggcuguacgaggagggcgaggaccaggccaagcaggcguacguggacaagcuggaggagcucaugaagaucgggacccccgucaaggugcgguuccaggaggccgaggagcgccccaagauguucgaggagcugggccagcggcugcagcacuacgccaagaucgccgcggacuuccgcaacaaggacgagaaguacaaccacaucgacgagagcgagaugaagaagguggagaaguccgucaacgaggugauggaguggaugaacaacgugaugaacgcccaggccaagaagucccucgaccaggaccccgucgugcgggcccaggagaucaagacgaagaucaaggagcugaacaacacgugcgagccgguggucacccagcccaagcccaagaucgagagccccaagcuggagcgcaccccgaacgggcccaacaucgacaagaaggaggaggaccucgaggacaagaacaacuucggcgccgagccgccccaccagaacggggagugcuaccccaacgagaagaacagcgugaacauggaccuggacuga

SEQ ID NO: 7636 - RNA, 2577 nt, Artificial Sequence
  derived and/or modified sequence opt2 from HSP110__Homo_sapiens__AAH37553
auguccgucgucggccucgacgucggcucccaguccugcuacaucgccgucgcccgcgccggcggcaucgagaccaucgccaacgaguucuccgaccgcugcacccccuccgucaucuccuucggcuccaagaaccgcaccaucggcgucgccgccaagaaccagcagaucacccacgccaacaacaccgucuccaacuucaagcgcuuccacggccgcgccuucaacgaccccuucauccagaaggagaaggagaaccucuccuacgaccucgucccccucaagaacggcggcgucggcaucaaggucauguacaugggcgaggagcaccucuucuccgucgagcagaucaccgccaugcuccucaccaagcucaaggagaccgccgagaacucccucaagaagcccgucaccgacugcgucaucuccguccccuccuucuucaccgacgccgagcgccgcuccguccucgacgccgcccagaucgucggccucaacugccuccgccucaugaacgacaugaccgccgucgcccucaacuacggcaucuacaagcaggaccuccccucccucgacgagaagccccgcaucgucgucuucgucgacaugggccacuccgccuuccaggucuccgccugcgccuucaacaagggcaagcucaagguccucggcaccgccuucgaccccuuccucggcggcaagaacuucgacgagaagcucgucgagcacuucugcgccgaguucaagaccaaguacaagcucgacgccaaguccaagauccgcgcccuccuccgccucuaccaggagugcgagaagcucaagaagcucauguccuccaacuccaccgaccucccccucaacaucgagugcuucaugaacgacaaggacgucuccggcaagaugaaccgcucccaguucgaggagcucugcgccgagcuccuccagaagaucgaggucccccucuacucccuccucgagcagacccaccucaaggucgaggacgucuccgccgucgagaucgucggcggcgccacccgcauccccgccgucaaggagcgcaucgccaaguucuucggcaaggacaucuccaccacccucaacgccgacgaggccgucgcccgcggcugcgcccuccagugcgccauccucucccccgccuucaagguccgcgaguucuccgucaccgacgccguccccuuccccaucucccucaucuggaaccacgacuccgaggacaccgagggcguccacgaggucuucucccgcaaccacgccgcccccuucuccaagguccucaccuuccuccgccgcggccccuucgagcucgaggccuucuacuccgacccccagggcguccccuaccccgaggccaagaucggccgcuucgucguccagaacgucuccgcccagaaggacggcgagaagucccgcgucaaggucaagguccgcgucaacacccacggcaucuucaccaucuccaccgccuccauggucgagaagguccccaccgaggagaacgagauguccuccgaggccgacauggagugccucaaccagcgcccccccgagaaccccgacaccgacaagaacguccagcaggacaacuccgaggccggcacccagccccagguccagaccgacgcccagcagaccucccaguccccccccucccccgagcucaccuccgaggagaacaagauccccgacgccgacaaggccaacgagaagaaggucgaccagccccccgaggccaagaagcccaagaucaaggucgucaacgucgagcuccccaucgaggccaaccucgucuggcagcucggcaaggaccuccucaacauguacaucgagaccgagggcaagaugaucaugcaggacaagcucgagaaggagcgcaacgacgccaagaacgccgucgaggaguacgucuacgaguuccgcgacaagcucugcggccccuacgagaaguucaucugcgagcaggaccaccagaacuuccuccgccuccucaccgagaccgaggacuggcucuacgaggagggcgaggaccaggccaagcaggccuacgucgacaagcucgaggagcucaugaagaucggcacccccgucaagguccgcuuccaggaggccgaggagcgccccaagauguucgaggagcucggccagcgccuccagcacuacgccaagaucgccgccgacuuccgcaacaaggacgagaaguacaaccacaucgacgaguccgagaugaagaaggucgagaaguccgucaacgaggucauggaguggaugaacaacgucaugaacgcccaggccaagaagucccucgaccaggaccccgucguccgcgcccaggagaucaagaccaagaucaaggagcucaacaacaccugcgagcccgucgucacccagcccaagcccaagaucgagucccccaagcucgagcgcacccccaacggccccaacaucgacaagaaggaggaggaccucgaggacaagaacaacuucggcgccgagcccccccaccagaacggcgagugcuaccccaacgagaagaacuccgucaacauggaccucgacuga

SEQ ID NO: 7637 - RNA, 2577 nt, Artificial Sequence
  derived and/or modified sequence opt3 from HSP110__Homo_sapiens__AAH37553
augagcguggucggccuggacguugggucccagucuugcuacaucgccguggcuagagcaggagguauugagaccauagccaacgaguucucagauagguguacacccaguguaaucagcuuuggcuccaagaaucggacuauugggguggcggcuaaaaaccaacagaucacgcacgccaauaacaccgucucuaauuucaagcgcuuucauggacgagcauucaacgacccuuuuauucagaaagagaaggaaaaucucucguaugaucuugugccacugaaaaacggcgguguugggaucaaggugauguacaugggagaggaacacuuguucucagucgagcagauaacagccauguuacugacuaagcuaaaagagaccgcugaaaauagccucaagaaaccggugacagacugcguaaucaguguucccuccuuuuucaccgaugcagagcguagaucugugcuggacgccgcucaaauugucggccuuaacugucugagguugaugaaugauaugacugccguggcgcucaacuauggcaucuacaagcaggaccugccuagccuggaugaaaaaccacggauuguggucuuuguugacauggggcauuccgcauuccaggugucagccugcgcuuuuaauaagggaaagcucaaaguauuagguacagccuucgaucccuuucugggcgggaagaacuucgacgagaaacuuguggagcacuucugugcagaauuuaagaccaaauauaaguuggaugcuaaaaguaagauccgcgcccugcuaagacucuaccaggagugcgaaaagcugaaaaagcugaugagcucuaauuccacggaccuuccuuugaacauagaguguuucaugaacgacaaagaugucucaggaaagaugaauaggagccaauuugaagaacucugcgcggagcuguuacagaaaauugaagugccacuguauagucuccuugagcagacucaucugaagguugaagacgugucugccgucgagaucgugggcggugcaacccggauucccgcuguaaaggaacgcaucgccaaauucuuugggaaggauaucuccacaacuuugaacgcugacgaggccguugcacgaggaugugcccuacagugcgcuauucugagcccugcguucaaagugagagaguuuucggucaccgaugcagugccauucccgauaucucucaucuggaaucacgacuccgaagauacagagggcguccacgaaguguuuucaaggaaccaugccgcucccuucaguaagguucugaccuuucuucggcguggcccuuucgagcuggaagccuuuuacagcgacccacaaggggugcccuacccugaggcaaaaauuggacgcuucguaguccagaauguguccgcccagaaggauggugagaagucuagaguuaaagugaaggucagggugaacacgcacggcaucuucacuauaagcacagcuucaaugguagaaaaagugccaaccgaggaaaaugagaugaguuccgaggccgacauggaauguuugaaccaacggcccccggagaauccugauacugacaagaacguucagcaggacaauagcgaagcagggacacagccccaaguccagaccgaugcgcagcagacgucucaaucaccaccuagucccgagcucaccagcgaagagaacaaaauuccagacgcugauaaggccaaugagaagaaaguggaccagcccccugaagcaaagaaaccaaagaucaaaguggucaacguugagcugccgaucgaagccaauuuaguguggcagcugggaaaggaucuacucaacauguauauugagacagaaggcaaaaugaucaugcaggacaagcuggagaaggagcgaaacgaugcuaaaaaugccguggaagaguacguauaugaauuucgcgacaaacuuugcggucccuacgagaaauucauuugcgaacaagaucaucagaacuuuuugagacugcucacugagaccgaggacuggcuguaugaagagggggaagaucaggcaaagcaggcuuacgucgacaaacuugaggagcugaugaagauaggcacaccugugaagguuagguuccaagaagccgaggaacggccaaaaauguuugaggaauugggacagcgccuccagcacuaugcgaagaucgccgcugauuucagaaauaaagacgagaaguacaaccacauugacgaguccgaaaugaaaaagguggagaagucugucaaugaagugauggaguggaugaacaauguuaugaacgcacaagccaaaaagucgcuggaucaggaccccgugguaagggcucaggaaaucaaaacuaagaucaaagaguuaaauaacaccugugagccugucgugacacagccaaagcccaagauugaaagcccgaaacuggagcguaccccuaauggcccaaacauagauaagaaagaagaggaccuagaagauaagaauaacuuuggggccgagcccccucaucaaaauggagagugcuaccccaacgaaaagaacuccgugaauauggaccucgauuga

SEQ ID NO: 7638 - RNA, 2577 nt, Artificial Sequence
  derived and/or modified sequence opt4 from HSP110__Homo_sapiens__AAH37553
augagcguggugggccuggacgugggcagccagagcugcuacaucgccguggccagagccggcggcaucgagaccaucgccaacgaguucagcgacagaugcacccccagcgugaucagcuucggcagcaagaacagaaccaucggcguggccgccaagaaccagcagaucacccacgccaacaacaccgugagcaacuucaagagauuccacggcagagccuucaacgaccccuucauccagaaggagaaggagaaccugagcuacgaccuggugccccugaagaacggcggcgugggcaucaaggugauguacaugggcgaggagcaccuguucagcguggagcagaucaccgccaugcugcugaccaagcugaaggagaccgccgagaacagccugaagaagcccgugaccgacugcgugaucagcgugcccagcuucuucaccgacgccgagagaagaagcgugcuggacgccgcccagaucgugggccugaacugccugagacugaugaacgacaugaccgccguggcccugaacuacggcaucuacaagcaggaccugcccagccuggacgagaagcccagaaucgugguguucguggacaugggccacagcgccuuccaggugagcgccugcgccuucaacaagggcaagcugaaggugcugggcaccgccuucgaccccuuccugggcggcaagaacuucgacgagaagcugguggagcacuucugcgccgaguucaagaccaaguacaagcuggacgccaagagcaagaucagagcccugcugagacuguaccaggagugcgagaagcugaagaagcugaugagcagcaacagcaccgaccugccccugaacaucgagugcuucaugaacgacaaggacgugagcggcaagaugaacagaagccaguucgaggagcugugcgccgagcugcugcagaagaucgaggugccccuguacagccugcuggagcagacccaccugaagguggaggacgugagcgccguggagaucgugggcggcgccaccagaauccccgccgugaaggagagaaucgccaaguucuucggcaaggacaucagcaccacccugaacgccgacgaggccguggccagaggcugcgcccugcagugcgccauccugagccccgccuucaaggugagagaguucagcgugaccgacgccgugcccuuccccaucagccugaucuggaaccacgacagcgaggacaccgagggcgugcacgagguguucagcagaaaccacgccgcccccuucagcaaggugcugaccuuccugagaagaggccccuucgagcuggaggccuucuacagcgacccccagggcgugcccuaccccgaggccaagaucggcagauucguggugcagaacgugagcgcccagaaggacggcgagaagagcagagugaaggugaaggugagagugaacacccacggcaucuucaccaucagcaccgccagcaugguggagaaggugcccaccgaggagaacgagaugagcagcgaggccgacauggagugccugaaccagagaccccccgagaaccccgacaccgacaagaacgugcagcaggacaacagcgaggccggcacccagccccaggugcagaccgacgcccagcagaccagccagagcccccccagccccgagcugaccagcgaggagaacaagauccccgacgccgacaaggccaacgagaagaagguggaccagccccccgaggccaagaagcccaagaucaagguggugaacguggagcugcccaucgaggccaaccugguguggcagcugggcaaggaccugcugaacauguacaucgagaccgagggcaagaugaucaugcaggacaagcuggagaaggagagaaacgacgccaagaacgccguggaggaguacguguacgaguucagagacaagcugugcggccccuacgagaaguucaucugcgagcaggaccaccagaacuuccugagacugcugaccgagaccgaggacuggcuguacgaggagggcgaggaccaggccaagcaggccuacguggacaagcuggaggagcugaugaagaucggcacccccgugaaggugagauuccaggaggccgaggagagacccaagauguucgaggagcugggccagagacugcagcacuacgccaagaucgccgccgacuucagaaacaaggacgagaaguacaaccacaucgacgagagcgagaugaagaagguggagaagagcgugaacgaggugauggaguggaugaacaacgugaugaacgcccaggccaagaagagccuggaccaggaccccguggugagagcccaggagaucaagaccaagaucaaggagcugaacaacaccugcgagcccguggugacccagcccaagcccaagaucgagagccccaagcuggagagaacccccaacggccccaacaucgacaagaaggaggaggaccuggaggacaagaacaacuucggcgccgagcccccccaccagaacggcgagugcuaccccaacgagaagaacagcgugaacauggaccuggacuga

SEQ ID NO: 7639 - RNA, 2577 nt, Artificial Sequence
  derived and/or modified sequence opt5 from HSP110__Homo_sapiens__AAH37553
augagcguggucggccuggacguugggucccagucuugcuacaucgccguggcuagagccggaggcauugagaccaucgcgaacgaauuuagcgaucgguguacacccuccgugauuucuuuugggagcaagaaucgcacgaucggagucgcugccaaaaaccaacagauuacccacgccaauaacacaguguccaauuucaagagauuucauggccgggcuuucaacgacccuuuuauccagaaagagaaggaaaaucucucuuaugaucugguuccgcuuaaaaacgggggagugggcaucaaggucauguacaugggcgaggaacaccuguucagcguggagcagauuaccgccaugcuccugacaaaacuuaaagagaccgcugaaaauucccugaagaaacccguuacagacugcgugaucagcgucccuucuuucuucaccgaugccgagcgcagauccgugcucgacgcggcccaaauuguggggcugaacugucugcggcucaugaaugauaugacggcugucgcccugaacuauggaaucuacaagcaggaccuucccagccuggaugaaaaaccucgcauuguuguguuuguggacaugggccauucugcuuuccaggucuccgccugcgcguuuaauaaggggaagcucaaagugcugggaaccgccuucgaucccuuucuuggcgggaagaacuucgacgagaaacugguugagcacuucugugcugaauuuaagacaaaauauaagcucgaugccaaaagcaagaucagagcucugcugcggcucuaccaggagugcgaaaagcugaaaaagcugaugucuuccaauagcaccgaccuuccucucaacauugaguguuucaugaacgacaaagauguguccggaaagaugaaucgcucucaauuugaggaacugugcgccgagcuucugcagaaaaucgaagucccgcucuauagccugcuggagcagacacaucucaagguggaagacguuuccgccguggagaucgucggcggcgcuacccggauucccgcggugaaggaaagaaucgccaaauucuuugggaaggauauuagcacgacacugaacgcugacgaggccgucgcccgcggaugugcccuucagugcgcuauccugucuccugcguucaaagugagagaguuuuccguuaccgaugcugugcccuucccuauuagccucaucuggaaucacgacucugaagauacagagggcguccacgaaguguuuagccggaaccaugccgcccccuucuccaagguucugaccuuucuucgcagagggccguucgagcuggaggcuuuuuacucugacccucaaggagugcccuacccugaagccaaaaucggccgguucgucgugcagaaugugagcgcucagaaggauggggagaaguccagaguuaaagucaaggugcgcgugaacacccacggaauuuucacaaucagcacggccucuauggucgaaaaagugcccaccgaggaaaaugagauguccagcgaggcggacauggaaugucucaaccaacggcccccugagaauccggauacagacaagaacguucagcaggacaauucugaagccggcacccagccccaagugcagacagaugcucagcagaccucccaaagcccucccuccccugagcugacgucugaagagaacaaaauucccgacgccgauaaggcuaaugagaagaaagucgaccagccgccugaagccaagaaacccaagaucaaagugguuaacguggagcugccuauugaagcgaaucucgucuggcagcugggcaaggaucuucugaacauguauaucgagacagaagggaaaaugaucaugcaggacaagcucgagaaggagagaaacgaugccaaaaaugcuguggaagaguacguuuaugaauuucgcgacaagcugugcggacccuacgagaaauucauuugcgaacaagaucaucagaacuuucugcggcuucucaccgagaccgaggacuggcuguaugaagagggcgaagaucaggccaagcaggcuuacguggacaaacuggaggagcucaugaagaucgggacaccugucaaggugagauuccaagaagccgaggaacgccccaaaauguuugaggaacugggacagcggcuucagcacuaugccaagauugcugcggauuucagaaauaaagacgagaaguacaaccacaucgacgagagcgaaaugaaaaagguggagaaguccgucaaugaaguuauggaguggaugaacaaugugaugaacgcccaagcuaaaaagucucuggaucaggacccggugguccgcgcccaggaaauuaaaaccaagaucaaagagcucaauaacacaugugagccugugguuacgcagcccaagcccaagauugaaagcccuaaacuggagcggaccccgaauggccccaacaucgauaagaaagaagaggaccuggaagauaagaauaacuuuggggccgagccuccccaucaaaauggcgagugcuacccuaacgaaaagaacuccgugaauauggaccuugauuga

SEQ ID NO: 7640 - RNA, 2577 nt, Artificial Sequence
  derived and/or modified sequence opt6 from HSP110__Homo_sapiens__AAH37553
augucaguugucggauuagauguaggaucucaaucauguuacauugcggucgccagagcuggcggaauagaaacaauagcgaacgaauucucagacagauguacaccaucaguuauaaguuuugguagcaaaaacagaacaauaggaguggcggcaaaaaaccaacaaauaacucaugcuaacaacacgguaucaaauuucaaaagauuucauggccgugcauucaaugacccguuuauacaaaaagaaaaagaaaauuuaaguuacgaucuaguaccauuaaaaaacggaggagucgggauaaaaguaauguauaugggggaagaacacuuauucuccguagagcaaauaacagcaauguuacuaacgaaauuaaaagaaacagcagaaaauucccuaaaaaaacccguuacagauuguguuauuuccgugccaagcuucuuuacagacgcagaacgacggaguguccuugacgcagcccaaauagucggacuaaauugccucagauuaaugaacgauaugacagcaguagcacuaaauuauggaauauauaaacaagaucuacccagccuagaugaaaagccucgaauaguaguauuuguagauaugggucauuccgcauuccaaguaucagcuugugcuuuuaacaaaggcaaacuuaaaguacuaggcacagcauucgacccuuuccugggaggcaaaaacuuugacgaaaaauuagucgaacauuucugcgcagaauucaaaacaaaauauaaauuagaugccaaaaguaaaauacgagcacucuuacgacuauaucaagaaugugaaaaauuaaaaaaacuaaugagcucuaacucuacugaccuaccacuaaauaucgaaugcuucaugaacgauaaagacguaucagguaaaaugaauagaucacaauucgaagaacuaugugcagaauuacuacaaaaaauagaaguaccacuuuacucacuauuagaacaaacucacuuaaaaguagaagaugucagcgcaguagaaaucguagguggcgccacuagaauaccagcagugaaagaaagaauagcaaaauuuuuuggaaaagauauaucaaccacacuaaacgccgaugaagcuguagcacguggcugcgccuuacaaugcgcaauucuaagccccgcauucaaagucagagaauuuuccguaacagaugcagugccauucccaauaagucuaauauggaaucacgauuccgaagacacugaaggaguccacgaaguauuuagcagaaaucacgcagcaccauucucaaaaguacuaacauuccuaaggagaggaccuuuugagcuagaagcauucuacucagacccucaaggaguaccuuacccagaagcaaagauaggaagauucguggugcaaaauguuagcgcacaaaaagauggagaaaaaagcagagucaaagucaaaguaagagucaacacacauggaauauuuacaaucucaacagcauccauggucgaaaaggucccaacagaagaaaacgaaaugaguagcgaagcagacauggaaugucuaaaucaaagaccgccagaaaauccggauacugauaaaaacgugcaacaggauaacagcgaagcaggaacccaaccacaaguucaaacagaugcacaacagacaucacaguccccuccaucacccgaacucaccucggaagaaaacaaaauaccagacgcugacaaagcaaacgaaaaaaaaguagaucaaccaccagaagcuaaaaaaccuaaaauaaaaguaguaaacgucgaacuacccauagaggcaaaccucguauggcaauuaggaaaagaucuccucaauauguauauugaaaccgaagggaagaugauuaugcaagauaaacuagagaaagaaagaaacgaugcuaaaaaugcaguugaggaauacguauacgaauuuagagacaaauuauguggaccauacgaaaaauucauaugcgaacaagaccaccaaaauuuccuaagauuacuuacagaaacagaagauuggcucuaugaagaaggcgaggaucaagccaaacaagcauacguagacaaacuagaagaauuaaugaagaucggcacaccagucaaaguaagauuucaggaagcugaagaaagaccaaaaauguucgaagaacucgggcaacgauuacaacacuacgcaaaaauagcagcagacuucagaaacaaggaugaaaaauacaaucacauagacgaaucagaaaugaaaaaaguagaaaaguccguaaaugaaguaauggaauggaugaauaacgugaugaacgcacaggcaaaaaaaagucucgaccaagacccaguaguucgugcacaagaaauaaaaacaaaaauaaaagaauugaacaacacaugugaaccaguaguaacacaaccuaaaccaaaaaucgaaucacccaaacuagaacgaacaccaaacggcccaaacauagauaaaaaagaggaagacuuagaagacaaaaauaauuuuggagcagaaccaccacaucagaacggagaaugcuauccaaaugaaaaaaauucaguaaauauggauuuagacuaa

SEQ ID NO: 7641 - protein, 205 aa, Artificial Sequence
  HSP27__Homo_sapiens__P04792
MTERRVPFSLLRGPSWDPFRDWYPHSRLFDQAFGLPRLPEEWSQWLGGSSWPGYVRPLPPAAIESPAVAAPAYSRALSRQLSSGVSEIRHTADRWRVSLDVNHFAPDELTVKTKDGVVEITGKHEERQDEHGYISRCFTRKYTLPPGVDPTQVSSSLSPEGTLTVEAPMPKLATQSNEITIPVTFESRAQLGGPEAAKSDETAAK

SEQ ID NO: 7642 - RNA, 618 nt, Artificial Sequence
  HSP27__Homo_sapiens__AAB51056
augaccgagcgccgcguccccuucucgcuccugcggggccccagcugggaccccuuccgcgacugguacccgcauagccgccucuucgaccaggccuucgggcugccccggcugccggaggaguggucgcagugguuaggcggcagcagcuggccaggcuacgugcgcccccugccccccgccgccaucgagagccccgcaguggccgcgcccgccuacagccgcgcgcucagccggcaacucagcagcggggucucggagauccggcacacugcggaccgcuggcgcgugucccuggaugucaaccacuucgccccggacgagcugacggucaagaccaaggauggcgugguggagaucaccggcaagcacgaggagcggcaggacgagcauggcuacaucucccggugcuucacgcggaaauacacgcugccccccgguguggaccccacccaaguuuccuccucccuguccccugagggcacacugaccguggaggcccccaugcccaagcuagccacgcaguccaacgagaucaccaucccagucaccuucgagucgcgggcccagcuugggggcccagaagcugcaaaauccgaugagacugccgccaaguaa

SEQ ID NO: 7643 - RNA, 618 nt, Artificial Sequence
  derived and/or modified sequence opt1 from HSP27__Homo_sapiens__AAB51056
augaccgagcgccgggugcccuucagccugcuccgcggcccguccugggaccccuuccgggacugguacccccacagccgccuguucgaccaggccuucgggcugccccggcucccggaggaguggucccaguggcugggcgggagcuccuggcccggcuacguccgcccccugcccccggccgcgaucgagagccccgccguggccgcccccgccuacucccgggcgcucagccgccagcuguccagcgggguguccgagauccggcacaccgccgaccgcuggcgggucagccuggacgugaaccacuucgcccccgacgagcucacggugaagaccaaggacggcgucguggagaucaccggcaagcacgaggagcgccaggacgagcacggguacaucucccggugcuucacccgcaaguacacgcugccgcccggcguggaccccacccaggucagcuccagccugucccccgaggggacccucaccguggaggccccgaugcccaagcuggcgacgcagagcaacgagaucaccauccccgugaccuucgagucccgggcccagcugggcgggcccgaggccgccaagagcgacgagaccgccgcgaaguga

SEQ ID NO: 7644 - RNA, 618 nt, Artificial Sequence
  derived and/or modified sequence opt2 from HSP27__Homo_sapiens__AAB51056
augaccgagcgccgcguccccuucucccuccuccgcggccccuccugggaccccuuccgcgacugguacccccacucccgccucuucgaccaggccuucggccucccccgccuccccgaggaguggucccaguggcucggcggcuccuccuggcccggcuacguccgcccccucccccccgccgccaucgagucccccgccgucgccgcccccgccuacucccgcgcccucucccgccagcucuccuccggcgucuccgagauccgccacaccgccgaccgcuggcgcgucucccucgacgucaaccacuucgcccccgacgagcucaccgucaagaccaaggacggcgucgucgagaucaccggcaagcacgaggagcgccaggacgagcacggcuacaucucccgcugcuucacccgcaaguacacccucccccccggcgucgaccccacccaggucuccuccucccucucccccgagggcacccucaccgucgaggcccccaugcccaagcucgccacccaguccaacgagaucaccauccccgucaccuucgagucccgcgcccagcucggcggccccgaggccgccaaguccgacgagaccgccgccaaguga

SEQ ID NO: 7645 - RNA, 618 nt, Artificial Sequence
  derived and/or modified sequence opt3 from HSP27__Homo_sapiens__AAB51056
augaccgagagaagggugcccuucagccugcuccggggcccuuccugggacccauuucgcgauugguacccgcacucucgacuuuucgaccaggccuuugggcugccccguuugccugaagaguggucacaaugguuaggagguaguagcuggccaggcuaugucagaccccugccuccagcugcaaucgaaucccccgccguugcggcuccugccuacucuagggcacuaucgcggcagcucucaagcggggugagugagauucgccauacagccgauagauggaggguaucccuggacgugaaccacuucgcuccagaugaacuuacugucaagacgaaagacggagugguugagauaaccggcaagcaugaggaacggcaggaugagcacgguuauaucucucgcugcuuuacacgaaaauacacucugccgcccgggguggacccuacccaggucagcuccucauugaguccagaaggaacacucaccguggaggcacccaugccuaagcuggccacucaaagcaaugagauuacaaucccaguaaccuucgaaucuagagcucagcugggcggccccgaggccgcgaaauccgaugaaacggcagccaaguga

SEQ ID NO: 7646 - RNA, 618 nt, Artificial Sequence
  derived and/or modified sequence opt4 from HSP27__Homo_sapiens__AAB51056
augaccgagagaagagugcccuucagccugcugagaggccccagcugggaccccuucagagacugguacccccacagcagacuguucgaccaggccuucggccugcccagacugcccgaggaguggagccaguggcugggcggcagcagcuggcccggcuacgugagaccccugccccccgccgccaucgagagccccgccguggccgcccccgccuacagcagagcccugagcagacagcugagcagcggcgugagcgagaucagacacaccgccgacagauggagagugagccuggacgugaaccacuucgcccccgacgagcugaccgugaagaccaaggacggcgugguggagaucaccggcaagcacgaggagagacaggacgagcacggcuacaucagcagaugcuucaccagaaaguacacccugccccccggcguggaccccacccaggugagcagcagccugagccccgagggcacccugaccguggaggcccccaugcccaagcuggccacccagagcaacgagaucaccauccccgugaccuucgagagcagagcccagcugggcggccccgaggccgccaagagcgacgagaccgccgccaaguga

SEQ ID NO: 7647 - RNA, 618 nt, Artificial Sequence
  derived and/or modified sequence opt5 from HSP27__Homo_sapiens__AAB51056
augaccgagagacgggugcccuucagccugcuccgcggcccuuccugggacccguuuagagauugguacccccacucucggcuguucgaccaggccuuugggcuuccucgccugcccgaagaguggagccaauggcucggaggcuccucuuggccuggguaugucagaccccugccuccggcugccaucgaaagccccgcgguugcugccccugccuacucccgggcucuuucucgccagcugagcuccggagugagcgagauuagacauacagccgaucgguggcgcgugucucucgacgucaaccacuucgcucccgaugaacugacggugaagaccaaagacggcguuguggagaucacagggaagcaugaggaaagacaggaugagcacggauauauuucccggugcuuuacccgcaaauacacacugccucccggcgucgacccgacccaggugucuagcucccucagcccugaaggcacacugaccguugaggcccccaugccuaagcuggcgacgcaaucuaaugagaucaccauucccgugacauucgaauccagagcccagcuugggggacccgaggcugccaaaagcgaugaaaccgcugccaaguga

SEQ ID NO: 7648 - RNA, 618 nt, Artificial Sequence
  derived and/or modified sequence opt6 from HSP27__Homo_sapiens__AAB51056
augacagaaagaagaguaccuuucucauuauuaagaggaccaucaugggauccauuucgagauugguauccacauagcagacucuuugaucaagcauuuggauuaccuagacuaccugaagaauggucacaauggcuaggaggaucaucauggccaggauacguaagaccauuaccaccagcagcaauagaaucaccagcaguagcagcaccagcauauucacgagcauuaaguagacaauuaagcucaggcguuucagaaauaagacacacagcugacagauggagaguaagcuuagacguaaaccauuucgcaccagaugaauuaacaguaaaaacaaaagacggaguaguagaaauaacaggaaaacacgaagaaagacaagaugaacauggauauauaucaagauguuucacaagaaaauacacacuaccaccaggaguagauccaacucaaguaagcucaagcuuaucaccagaaggaaccuuaacaguagaagcaccaaugccaaaacuagcaacccaaucaaaugaaauaacaauacccguaacauuugaaaguagagcacaauuaggaggaccagaagcagcaaaaucagacgaaacagcagcaaaauaa

SEQ ID NO: 7649 - protein, 418 aa, Artificial Sequence
  HSP47_(serpin_H1)__Homo_sapiens__P50454
MRSLLLLSAFCLLEAALAAEVKKPAAAAAPGTAEKLSPKAATLAERSAGLAFSLYQAMAKDQAVENILVSPVVVASSLGLVSLGGKATTASQAKAVLSAEQLRDEEVHAGLGELLRSLSNSTARNVTWKLGSRLYGPSSVSFADDFVRSSKQHYNCEHSKINFRDKRSALQSINEWAAQTTDGKLPEVTKDVERTDGALLVNAMFFKPHWDEKFHHKMVDNRGFMVTRSYTVGVMMMHRTGLYNYYDDEKEKLQIVEMPLAHKLSSLIILMPHHVEPLERLEKLLTKEQLKIWMGKMQKKAVAISLPKGVVEVTHDLQKHLAGLGLTEAIDKNKADLSRMSGKKDLYLASVFHATAFELDTDGNPFDQDIYGREELRSPKLFYADHPFIFLVRDTQSGSLLFIGRLVRPKGDKMRDEL

SEQ ID NO: 7650 - RNA, 1257 nt, Artificial Sequence
  HSP47_(serpin_H1)__Homo_sapiens__AAH14623
augcgcucccuccugcuucucagcgccuucugccuccuggaggcggcccuggccgccgaggugaagaaaccugcagccgcagcagcuccuggcacugcggagaaguugagccccaaggcggccacgcuugccgagcgcagcgccggccuggccuucagcuuguaccaggccauggccaaggaccaggcaguggagaacauccuggugucacccguggugguggccucgucgcuggggcucgugucgcugggcggcaaggcgaccacggcgucgcaggccaaggcagugcugagcgccgagcagcugcgcgacgaggaggugcacgccggccugggcgagcugcugcgcucacucagcaacuccacggcgcgcaacgugaccuggaagcugggcagccgacuguacggacccagcucagugagcuucgcugaugacuucgugcgcagcagcaagcagcacuacaacugcgagcacuccaagaucaacuuccgcgacaagcgcagcgcgcugcaguccaucaacgagugggccgcgcagaccaccgacggcaagcugcccgaggucaccaaggacguggagcgcacggacggcgcccuguuagucaacgccauguucuucaagccacacugggaugagaaauuccaccacaagaugguggacaaccguggcuucauggugacucgguccuauaccgugggugucaugaugaugcaccggacaggccucuacaacuacuacgacgacgagaaggaaaagcugcaaaucguggagaugccccuggcccacaagcucuccagccucaucauccucaugccccaucacguggagccucucgagcgccuugaaaagcugcuaaccaaagagcagcugaagaucuggauggggaagaugcagaagaaggcuguugccaucuccuugcccaagggugugguggaggugacccaugaccugcagaaacaccuggcugggcugggccugacugaggccauugacaagaacaaggccgacuugucacgcaugucaggcaagaaggaccuguaccuggccagcguguuccacgccaccgccuuugaguuggacacagauggcaaccccuuugaccaggacaucuacgggcgcgaggagcugcgcagccccaagcuguucuacgccgaccaccccuucaucuuccuagugcgggacacccaaagcggcucccugcuauucauugggcgccugguccggccuaagggugacaagaugcgagacgaguuauag

SEQ ID NO: 7651 - RNA, 1257 nt, Artificial Sequence
  derived and/or modified sequence opt1 from HSP47_(serpin_H1)__Homo_sapiens__AAH14623
augcgcagccugcuccugcuguccgccuucugccuccuggaggccgcgcuggccgccgaggugaagaagcccgccgccgcggccgccccgggcaccgccgagaagcucagccccaaggcggccacccuggccgagcgguccgccgggcuggccuucagccucuaccaggcgauggccaaggaccaggccgucgagaacauccuggugucccccguggucguggccagcucccugggccucgugagccucgggggcaaggccacgaccgcgucccaggccaaggccguccugagcgccgagcagcugcgcgacgaggaggugcacgccgggcugggcgagcugcuccggucccugagcaacuccaccgcgcgcaacgugaccuggaagcugggcagccggcucuacgggcccuccagcgucuccuucgccgacgacuucgugcgcagcuccaagcagcacuacaacugcgagcacagcaagaucaacuuccgggacaagcgcagcgcccugcaguccaucaacgagugggccgcccagacgaccgacggcaagcugccggaggugaccaaggacgucgagcggaccgacggggcgcuccuggugaacgccauguucuucaagccccacugggacgagaaguuccaccacaagaugguggacaaccgcggcuucauggucacgcggagcuacaccgugggggugaugaugaugcaccgcaccggccuguacaacuacuacgacgacgagaaggagaagcuccagaucgucgagaugccccuggcccacaagcuguccagccucaucauccugaugccccaccacguggagccgcuggagcggcucgagaagcugcugaccaaggagcagcucaagaucuggaugggcaagaugcagaagaaggccguggcgaucucccugcccaagggggucguggaggugacgcacgaccugcagaagcaccucgccggccuggggcugaccgaggccaucgacaagaacaaggccgaccucagccgcauguccggcaagaaggaccuguaccuggccagcgucuuccacgcgaccgccuucgagcucgacaccgacggcaaccccuucgaccaggacaucuacgggcgggaggagcugcgcucccccaagcuguucuacgccgaccacccguucaucuuccucgugcgggacacgcagagcggcucccugcuguucaucgggcgccugguccggcccaagggcgacaagaugcgcgacgagcucuga

SEQ ID NO: 7652 - RNA, 1257 nt, Artificial Sequence
  derived and/or modified sequence opt2 from HSP47_(serpin_H1)__Homo_sapiens__AAH14623
augcgcucccuccuccuccucuccgccuucugccuccucgaggccgcccucgccgccgaggucaagaagcccgccgccgccgccgcccccggcaccgccgagaagcucucccccaaggccgccacccucgccgagcgcuccgccggccucgccuucucccucuaccaggccauggccaaggaccaggccgucgagaacauccucgucucccccgucgucgucgccuccucccucggccucgucucccucggcggcaaggccaccaccgccucccaggccaaggccguccucuccgccgagcagcuccgcgacgaggagguccacgccggccucggcgagcuccuccgcucccucuccaacuccaccgcccgcaacgucaccuggaagcucggcucccgccucuacggccccuccuccgucuccuucgccgacgacuucguccgcuccuccaagcagcacuacaacugcgagcacuccaagaucaacuuccgcgacaagcgcuccgcccuccaguccaucaacgagugggccgcccagaccaccgacggcaagcuccccgaggucaccaaggacgucgagcgcaccgacggcgcccuccucgucaacgccauguucuucaagccccacugggacgagaaguuccaccacaagauggucgacaaccgcggcuucauggucacccgcuccuacaccgucggcgucaugaugaugcaccgcaccggccucuacaacuacuacgacgacgagaaggagaagcuccagaucgucgagaugccccucgcccacaagcucuccucccucaucauccucaugccccaccacgucgagccccucgagcgccucgagaagcuccucaccaaggagcagcucaagaucuggaugggcaagaugcagaagaaggccgucgccaucucccuccccaagggcgucgucgaggucacccacgaccuccagaagcaccucgccggccucggccucaccgaggccaucgacaagaacaaggccgaccucucccgcauguccggcaagaaggaccucuaccucgccuccgucuuccacgccaccgccuucgagcucgacaccgacggcaaccccuucgaccaggacaucuacggccgcgaggagcuccgcucccccaagcucuucuacgccgaccaccccuucaucuuccucguccgcgacacccaguccggcucccuccucuucaucggccgccucguccgccccaagggcgacaagaugcgcgacgagcucuga

SEQ ID NO: 7653 - RNA, 1257 nt, Artificial Sequence
  derived and/or modified sequence opt3 from HSP47_(serpin_H1)__Homo_sapiens__AAH14623
augagaagccugcuccuucuguccgccuucugcuuguuagaggcugcacuggccgcggaagugaagaaacccgcugccgcagccgcuccuggcaccgcagagaagcuaucuccaaaagccgcuacacucgccgaaaggucagcggggcuggcauuuagucuuuaccaggccauggcuaaggaccaagccgucgagaacauccugguuagcccggugguaguggcauccucuuugggacucgucucgcuggguggcaaagcuacuacggccucacaggcgaaggccgugcugagcgcagaacagcuccgggaugaggagguucacgcuggguuaggagaacugcuucgcaguuuguccaauucuaccgcccgaaacgugacauggaagcugggcagccgucuauauggucccuccucagucaguuucgcugacgauuuugugagaagcucuaaacagcauuacaauugugagcacuccaagauuaacuucagggacaaacggucagcccuccaaagcauaaaugaaugggcagcccagacuaccgaugggaagcugccugagguaacaaaagacguugagcgcaccgauggagcgcuucuggugaacgcuauguuuuucaagccacauugggacgaaaaguuucaccauaaaauggucgauaauagaggcuucauggugacuaggaguuauacagugggcgucaugaugaugcaccggaccggguuguacaacuauuacgacgaugagaaggaaaaacuccagaucguugagaugccccuggcacacaaguuaucuucccugauuauccucaugccucaucacguggaaccacuugagcgccuggagaaauugcuaacgaaggaacagcugaaaauuuggaugggaaagaugcaaaagaaagccguagcuaucagccuccccaaggguguggucgaggugacucaugaccugcagaaacaccuugccggccugggguugaccgaagcaauagauaagaauaaagccgaccucucgcgaaugucuggaaagaaggaccuguauuuagcuuccguuuuucacgccacagcauucgagcuggauacugacggcaacccuuuugaucaggacaucuacgguagagaggaacuaaggucaccaaaacucuucuacgcggaucauccguuuauuuuccuggugcgggacacccagagugggagccuuuuguucaucggacgucugguccgccccaagggcgauaaaaugagagacgagcucuga

SEQ ID NO: 7654 - RNA, 1257 nt, Artificial Sequence
  derived and/or modified sequence opt4 from HSP47_(serpin_H1)__Homo_sapiens__AAH14623
augagaagccugcugcugcugagcgccuucugccugcuggaggccgcccuggccgccgaggugaagaagcccgccgccgccgccgcccccggcaccgccgagaagcugagccccaaggccgccacccuggccgagagaagcgccggccuggccuucagccuguaccaggccauggccaaggaccaggccguggagaacauccuggugagccccguggugguggccagcagccugggccuggugagccugggcggcaaggccaccaccgccagccaggccaaggccgugcugagcgccgagcagcugagagacgaggaggugcacgccggccugggcgagcugcugagaagccugagcaacagcaccgccagaaacgugaccuggaagcugggcagcagacuguacggccccagcagcgugagcuucgccgacgacuucgugagaagcagcaagcagcacuacaacugcgagcacagcaagaucaacuucagagacaagagaagcgcccugcagagcaucaacgagugggccgcccagaccaccgacggcaagcugcccgaggugaccaaggacguggagagaaccgacggcgcccugcuggugaacgccauguucuucaagccccacugggacgagaaguuccaccacaagaugguggacaacagaggcuucauggugaccagaagcuacaccgugggcgugaugaugaugcacagaaccggccuguacaacuacuacgacgacgagaaggagaagcugcagaucguggagaugccccuggcccacaagcugagcagccugaucauccugaugccccaccacguggagccccuggagagacuggagaagcugcugaccaaggagcagcugaagaucuggaugggcaagaugcagaagaaggccguggccaucagccugcccaagggcgugguggaggugacccacgaccugcagaagcaccuggccggccugggccugaccgaggccaucgacaagaacaaggccgaccugagcagaaugagcggcaagaaggaccuguaccuggccagcguguuccacgccaccgccuucgagcuggacaccgacggcaaccccuucgaccaggacaucuacggcagagaggagcugagaagccccaagcuguucuacgccgaccaccccuucaucuuccuggugagagacacccagagcggcagccugcuguucaucggcagacuggugagacccaagggcgacaagaugagagacgagcuguga

SEQ ID NO: 7655 - RNA, 1257 nt, Artificial Sequence
  derived and/or modified sequence opt5 from HSP47_(serpin_H1)__Homo_sapiens__AAH14623
augagaagccugcuccugcuuuccgccuucugccugcucgaggcugcccuggcggcugaagugaagaaacccgccgccgcugccgcuccuggcaccgccgagaaacuuucuccgaaggcggccacacuggcugaacggagcgccgggcucgcuuuuucccuguaccaggccauggcgaaggaccaagccgucgagaacauccugguuucucccgugguggucgcuagcucccucggacuggugucucuuggcgggaaagccacgaccgcuagccaggccaaggccguucuguccgcugaacagcuccgcgaugaggaggugcacgcgggacugggcgaacuucugagaagccucucuaauuccacagcccggaacgucaccuggaagcuggggagccgccuguauggaccuucuuccgugagcuucgcugacgauuuuguuagaucuuccaaacagcauuacaauugugagcacagcaagauuaacuuccgggacaaacgcuccgcccuccaaucuaucaaugaaugggccgcucagacaaccgauggcaagcugcccgaggugacaaaagacgucgagagaaccgauggcgcccuucuggugaacgcgauguuuuucaagccucauugggacgaaaaguuucaccauaaaaugguggauaaucggggguucauggucacgcgcagcuauaccguuggagugaugaugaugcacagaacaggccucuacaacuauuacgacgaugagaaggaaaaacugcagauuguggagaugccccuugcucacaagcuguccagccucaucauucugaugccucaucacgucgaaccgcuggagcggcucgagaaacugcuuaccaaggaacagcugaaaaucuggauggggaagaugcaaaagaaagccguggccaucucucuccccaagggaguuguggaggucacacaugaccugcagaaacaccuugcuggccuggggcucaccgaagccauugauaagaauaaagcugaccugucccgcaugagcggaaagaaggaccuguaucucgccucuguguuucacgcgacggccuucgagcuggauacagacggcaacccuuuugaucaggacaucuacggcagagaggaacuucggagccccaaacuguucuacgcugaucauccuuuuauuuuccucguucgcgacacccaguccgggucucugcuguucaucggaagacuugugcggcccaagggcgauaaaaugagagacgagcucuga

SEQ ID NO: 7656 - RNA, 1257 nt, Artificial Sequence
  derived and/or modified sequence opt6 from HSP47_(serpin_H1)__Homo_sapiens__AAH14623
augcgaagccuacuauuauuaagcgccuucugucuacuagaagcagcauuagccgcagaaguaaaaaaaccagcagcagcagccgcaccaggaaccgcggaaaaacuaucaccaaaagcagcaacacuagcagaacgcucagcuggacuagcauucucauuauaucaagcaauggcaaaagaucaagcaguagaaaacauucuaguaucaccaguuguaguagcuucaucccuaggacuaguaagccuaggcggaaaagcaacuacagcaucacaagcaaaagcaguccuaagcgcagaacaacuaagagacgaagaaguacacgcaggcuuaggagaauuauugcgaucauuaucgaacucaacagcaagaaauguaacauggaaauugggaagucggcuauauggaccaaguucaguaucauucgcagacgauuucguaagaucauccaaacaacauuacaauugcgaacacucuaaaauaaacuuuagagauaaaagaagugcacuacaauccauaaaugaaugggcagcacaaaccacagauggaaaacuaccagagguaacaaaagauguagaaagaacagacggagccuuauuagugaaugcaauguuuuucaaaccccauugggaugaaaaauuucaccauaaaaugguggauaauagaggauucaugguaaccagaucauacacgguaggaguaaugaugaugcauagaacaggacuauauaacuauuaugaugacgaaaaagaaaaauuacaaauaguagaaaugccacuagcccauaaacuuucaagucuaauaauacuuaugccacaucauguugaaccacuagaaagacuagaaaaacuccugacaaaagaacaauuaaaaauauggaugggaaaaaugcaaaaaaaagcuguugcaauaucacuaccaaaaggaguuguagaaguaacccaugacuuacaaaaacacuuagcaggacuaggacuaacggaagcaauagauaaaaauaaagcggacuuauccagaaugucagguaaaaaagaucuauaucuugcgaguguauuccacgcaacagcauucgaacuagauacugacggaaauccauuugaucaagauaucuauggaagagaagaacucaggaguccaaaacuauucuaugccgaucacccauuuauauucuuagucagagauacgcaaucggguucauuauuauuuauaggaagacuaguaagaccaaaaggagauaaaaugagagacgaacuauag

SEQ ID NO: 7657 - protein, 573 aa, Artificial Sequence
  HSP60__Homo_sapiens__A0A024R3X4
MLRLPTVFRQMRPVSRVLAPHLTRAYAKDVKFGADARALMLQGVDLLADAVAVTMGPKGRTVIIEQSWGSPKVTKDGVTVAKSIDLKDKYKNIGAKLVQDVANNTNEEAGDGTTTATVLARSIAKEGFEKISKGANPVEIRRGVMLAVDAVIAELKKQSKPVTTPEEIAQVATISANGDKEIGNIISDAMKKVGRKGVITVKDGKTLNDELEIIEGMKFDRGYISPYFINTSKGQKCEFQDAYVLLSEKKISSIQSIVPALEIANAHRKPLVIIAEDVDGEALSTLVLNRLKVGLQVVAVKAPGFGDNRKNQLKDMAIATGGAVFGEEGLTLNLEDVQPHDLGKVGEVIVTKDDAMLLKGKGDKAQIEKRIQEIIEQLDVTTSEYEKEKLNERLAKLSDGVAVLKVGGTSDVEVNEKKDRVTDALNATRAAVEEGIVLGGGCALLRCIPALDSLTPANEDQKIGIEIIKRTLKIPAMTIAKNAGVEGSLIVEKIMQSSSEVGYDAMAGDFVNMVEKGIIDPTKVVRTALLDAAGVASLLTTAEVVVTEIPKEEKDPGMGAMGGMGGGMGGGMF

SEQ ID NO: 7658 - RNA, 1722 nt, Artificial Sequence
  HSP60__Homo_sapiens__EAW70148
augcuucgguuacccacagucuuucgccagaugagaccgguguccaggguacuggcuccucaucucacucgggcuuaugccaaagauguaaaauuuggugcagaugcccgagccuuaaugcuucaagguguagaccuuuuagccgaugcuguggccguuacaauggggccaaagggaagaacagugauuauugagcagaguuggggaagucccaaaguaacaaaagauggugugacuguugcaaagucaauugacuuaaaagauaaauacaaaaacauuggagcuaaacuuguucaagauguugccaauaacacaaaugaagaagcuggggauggcacuaccacugcuacuguacuggcacgcucuauagccaaggaaggcuucgagaagauuagcaaaggugcuaauccaguggaaaucaggagaggugugauguuagcuguugaugcuguaauugcugaacuuaaaaagcagucuaaaccugugaccaccccugaagaaauugcacagguugcuacgauuucugcaaacggagacaaagaaauuggcaauaucaucucugaugcaaugaaaaaaguuggaagaaagggugucaucacaguaaaggauggaaaaacacugaaugaugaauuagaaauuauugaaggcaugaaguuugaucgaggcuauauuucuccauacuuuauuaauacaucaaaaggucagaaaugugaauuccaggaugccuauguucuguugagugaaaagaaaauuucuaguauccaguccauuguaccugcucuugaaauugccaaugcucaccguaagccuuuggucauaaucgcugaagauguugauggagaagcucuaaguacacucgucuugaauaggcuaaagguuggucuucagguuguggcagucaaggcuccaggguuuggugacaauagaaagaaccagcuuaaagauauggcuauugcuacugguggugcaguguuuggagaagagggauugacccugaaucuugaagacguucagccucaugacuuaggaaaaguuggagaggucauugugaccaaagacgaugccaugcucuuaaaaggaaaaggugacaaggcucaaauugaaaaacguauucaagaaaucauugagcaguuagaugucacaacuagugaauaugaaaaggaaaaacugaaugaacggcuugcaaaacuuucagauggaguggcugugcugaagguuggugggacaagugauguugaagugaaugaaaagaaagacagaguuacagaugcccuuaaugcuacaagagcugcuguugaagaaggcauuguuuugggaggggguugugcccuccuucgaugcauuccagccuuggacucauugacuccagcuaaugaagaucaaaaaauugguauagaaauuauuaaaagaacacucaaaauuccagcaaugaccauugcuaagaaugcagguguugaaggaucuuugauaguugagaaaauuaugcaaaguuccucagaaguugguuaugaugcuauggcuggagauuuugugaauaugguggaaaaaggaaucauugacccaacaaagguugugagaacugcuuuauuggaugcugcugguguggccucucuguuaacuacagcagaaguuguagucacagaaauuccuaaagaagagaaggacccuggaaugggugcaauggguggaaugggaggugguaugggagguggcauguucuaa

SEQ ID NO: 7659 - RNA, 1722 nt, Artificial Sequence
  derived and/or modified sequence opt1 from HSP60__Homo_sapiens__EAW70148
augcugcgccuccccaccguguuccggcagaugcgcccggucagccgggugcuggcgccccaccugacccgcgccuacgccaaggacgugaaguucggggccgacgcccgggcccucaugcugcagggggucgaccugcucgccgacgcgguggccgugacgaugggccccaaggggcgcaccgucaucaucgagcaguccuggggcagccccaaggugaccaaggacggggugaccgucgccaaguccaucgaccugaaggacaaguacaagaacaucggcgccaagcuggugcaggacguggcgaacaacacgaacgaggaggccggcgacgggaccaccaccgccacgguccucgcccggagcaucgccaaggagggcuucgagaagaucuccaagggggcgaacccgguggagauccgccggggcgugaugcuggccgucgacgccgugaucgccgagcugaagaagcagagcaagcccgugaccacccccgaggagaucgcccaggucgcgaccaucuccgccaacggggacaaggagaucggcaacaucaucagcgacgccaugaagaaggugggccgcaagggggugaucacggucaaggacggcaagacccucaacgacgagcuggagaucaucgaggggaugaaguucgaccggggcuacaucucccccuacuucaucaacaccagcaagggccagaagugcgaguuccaggacgccuacgugcugcucuccgagaagaagaucagcuccauccagagcaucgugccggcccuggagaucgcgaacgcccaccgcaagccccuggucaucaucgccgaggacguggacggggaggcccucuccacccugguccugaaccggcucaaggugggccuccagguggucgccgugaaggcgcccggguucggcgacaaccgcaagaaccagcugaaggacauggccaucgccaccgggggcgccguguucggcgaggaggggcugacgcugaaccuggaggacguccagccccacgaccucggcaaggugggggaggugaucgucaccaaggacgacgcgaugcugcugaagggcaagggggacaaggcccagaucgagaagcggauccaggagaucaucgagcagcucgacgugaccacgagcgaguacgagaaggagaagcugaacgagcgccuggccaagcucuccgacggcguggccguccugaaggugggcgggaccagcgacguggaggucaacgagaagaaggaccgggugaccgacgcccugaacgcgacccgcgccgccguggaggagggcaucguccucgggggcgggugcgcccugcugcggugcaucccggcccucgacucccugacgcccgcgaacgaggaccagaagaucggcaucgagaucaucaagcgcacccugaagauccccgccaugaccaucgccaagaacgccggcguggaggggagccucaucguggagaagaucaugcagagcuccagcgaggucggcuacgacgccauggcgggggacuucgugaacaugguggagaagggcaucaucgaccccaccaaggucgugcggacggcccugcuggacgccgccggcguggcgucccuccugaccaccgccgaggucguggugaccgagaucccgaaggaggagaaggaccccgggaugggcgccaugggcgggaugggcgggggcaugggcggcgggauguucuga

SEQ ID NO: 7660 - RNA, 1722 nt, Artificial Sequence
  derived and/or modified sequence opt2 from HSP60__Homo_sapiens__EAW70148
augcuccgccuccccaccgucuuccgccagaugcgccccgucucccgcguccucgccccccaccucacccgcgccuacgccaaggacgucaaguucggcgccgacgcccgcgcccucaugcuccagggcgucgaccuccucgccgacgccgucgccgucaccaugggccccaagggccgcaccgucaucaucgagcaguccuggggcucccccaaggucaccaaggacggcgucaccgucgccaaguccaucgaccucaaggacaaguacaagaacaucggcgccaagcucguccaggacgucgccaacaacaccaacgaggaggccggcgacggcaccaccaccgccaccguccucgcccgcuccaucgccaaggagggcuucgagaagaucuccaagggcgccaaccccgucgagauccgccgcggcgucaugcucgccgucgacgccgucaucgccgagcucaagaagcaguccaagcccgucaccacccccgaggagaucgcccaggucgccaccaucuccgccaacggcgacaaggagaucggcaacaucaucuccgacgccaugaagaaggucggccgcaagggcgucaucaccgucaaggacggcaagacccucaacgacgagcucgagaucaucgagggcaugaaguucgaccgcggcuacaucucccccuacuucaucaacaccuccaagggccagaagugcgaguuccaggacgccuacguccuccucuccgagaagaagaucuccuccauccaguccaucguccccgcccucgagaucgccaacgcccaccgcaagccccucgucaucaucgccgaggacgucgacggcgaggcccucuccacccucguccucaaccgccucaaggucggccuccaggucgucgccgucaaggcccccggcuucggcgacaaccgcaagaaccagcucaaggacauggccaucgccaccggcggcgccgucuucggcgaggagggccucacccucaaccucgaggacguccagccccacgaccucggcaaggucggcgaggucaucgucaccaaggacgacgccaugcuccucaagggcaagggcgacaaggcccagaucgagaagcgcauccaggagaucaucgagcagcucgacgucaccaccuccgaguacgagaaggagaagcucaacgagcgccucgccaagcucuccgacggcgucgccguccucaaggucggcggcaccuccgacgucgaggucaacgagaagaaggaccgcgucaccgacgcccucaacgccacccgcgccgccgucgaggagggcaucguccucggcggcggcugcgcccuccuccgcugcauccccgcccucgacucccucacccccgccaacgaggaccagaagaucggcaucgagaucaucaagcgcacccucaagauccccgccaugaccaucgccaagaacgccggcgucgagggcucccucaucgucgagaagaucaugcaguccuccuccgaggucggcuacgacgccauggccggcgacuucgucaacauggucgagaagggcaucaucgaccccaccaaggucguccgcaccgcccuccucgacgccgccggcgucgccucccuccucaccaccgccgaggucgucgucaccgagauccccaaggaggagaaggaccccggcaugggcgccaugggcggcaugggcggcggcaugggcggcggcauguucuga

SEQ ID NO: 7661 - RNA, 1722 nt, Artificial Sequence
  derived and/or modified sequence opt3 from HSP60__Homo_sapiens__EAW70148
augcugagacuccccaccguguucaggcagaugcggccugucagccgcguucuugccccacaccugacacgagcuuacgcaaaggacgugaaauuuggcgccgaugcgcgugcuuugauguuacaagggguagaccugcuagccgaugcaguggccgucacuaugggaccgaaggguagaacggugaucauugagcaguccuggggcucucccaaaguuaccaaggacggggugacagucgcuaaaucaauagaucucaaggacaaguauaaaaacaucggagcaaagcuggugcaggauguagccaauaacacuaaugaagaggcuggcgacgguaccacaaccgccacuguucuugcgaggaguauugcaaaagaaggguucgagaagaucagcaaaggagccaacccuguggaaauucggcgcggcgucaugcuggcuguggaugccgugaucgcagaguugaagaagcaguccaaaccagucacaacccccgaggaaauagcucaaguugccacgaucucugcgaauggcgacaaggagauugggaacaucauuucggaugccaugaaaaaggugggaagaaaagguguaaucacugugaaggacggcaaaacccucaaugaugaacuggagauaauugaggggaugaaguuugacaggggauacaucucaccuuauuucauuaacacaagcaagggccagaaaugcgaauuucaggacgcauacguccugcucagugagaagaaaaucuccucuauccagagcauugugccagcuuuagaaauagccaaugcucaucggaagccccugguuaucauugccgaggauguggacggugaagcacuuuccacuuugguccugaaccgccuaaaaguggggcuccaaguaguugccgugaaggcuccuggauucggcgauaaucgaaagaaccagcugaaagacauggcgaucgcaaccggcggggccgucuuuggagaggagggucuuacacugaauuuggaagaugugcagccacacgaccucggcaaggucggggaggugauaguuaccaaagaugacgcuaugcuguuaaagggaaaaggcgauaaggcccagauugaaaagagaauccaagagaucauugaacagcuggacgugacgacuucagaguaugagaaagaaaagcucaacgagaggcuugcaaaacugagugaugguguagccgucuugaagguugggggcacaagcgacguggaagugaaugagaaaaaggaccgggucaccgaugcucuaaacgccacucgugcagcgguggaagagggaaucguacugggcgggggaugugcucuccugcgcugcauuccggcccuugacucucugacacccgcaaacgaggaucagaagauagguaucgaaauuaucaaaagaaccuugaagaucccugccaugacgauugcuaaaaaugccggcguggaggggucccucauaguugaaaagaucaugcaaucaagcagugaggucggauacgacgcaauggcuggcgauuucgugaacaugguggagaaagguauuaucgacccaaccaaggucguuaggacagcccuguuagaugcggccgggguggcuucucugcuaacuaccgcagaagugguagucacagagauucccaaagaagagaaggacccuggcaugggagccaugggcgggaugggagguggcaugggagggggcauguuuuga

SEQ ID NO: 7662 - RNA, 1722 nt, Artificial Sequence
  derived and/or modified sequence opt4 from HSP60__Homo_sapiens__EAW70148
augcugagacugcccaccguguucagacagaugagacccgugagcagagugcuggccccccaccugaccagagccuacgccaaggacgugaaguucggcgccgacgccagagcccugaugcugcagggcguggaccugcuggccgacgccguggccgugaccaugggccccaagggcagaaccgugaucaucgagcagagcuggggcagccccaaggugaccaaggacggcgugaccguggccaagagcaucgaccugaaggacaaguacaagaacaucggcgccaagcuggugcaggacguggccaacaacaccaacgaggaggccggcgacggcaccaccaccgccaccgugcuggccagaagcaucgccaaggagggcuucgagaagaucagcaagggcgccaaccccguggagaucagaagaggcgugaugcuggccguggacgccgugaucgccgagcugaagaagcagagcaagcccgugaccacccccgaggagaucgcccagguggccaccaucagcgccaacggcgacaaggagaucggcaacaucaucagcgacgccaugaagaaggugggcagaaagggcgugaucaccgugaaggacggcaagacccugaacgacgagcuggagaucaucgagggcaugaaguucgacagaggcuacaucagccccuacuucaucaacaccagcaagggccagaagugcgaguuccaggacgccuacgugcugcugagcgagaagaagaucagcagcauccagagcaucgugcccgcccuggagaucgccaacgcccacagaaagccccuggugaucaucgccgaggacguggacggcgaggcccugagcacccuggugcugaacagacugaaggugggccugcaggugguggccgugaaggcccccggcuucggcgacaacagaaagaaccagcugaaggacauggccaucgccaccggcggcgccguguucggcgaggagggccugacccugaaccuggaggacgugcagccccacgaccugggcaaggugggcgaggugaucgugaccaaggacgacgccaugcugcugaagggcaagggcgacaaggcccagaucgagaagagaauccaggagaucaucgagcagcuggacgugaccaccagcgaguacgagaaggagaagcugaacgagagacuggccaagcugagcgacggcguggccgugcugaaggugggcggcaccagcgacguggaggugaacgagaagaaggacagagugaccgacgcccugaacgccaccagagccgccguggaggagggcaucgugcugggcggcggcugcgcccugcugagaugcauccccgcccuggacagccugacccccgccaacgaggaccagaagaucggcaucgagaucaucaagagaacccugaagauccccgccaugaccaucgccaagaacgccggcguggagggcagccugaucguggagaagaucaugcagagcagcagcgaggugggcuacgacgccauggccggcgacuucgugaacaugguggagaagggcaucaucgaccccaccaagguggugagaaccgcccugcuggacgccgccggcguggccagccugcugaccaccgccgaggugguggugaccgagauccccaaggaggagaaggaccccggcaugggcgccaugggcggcaugggcggcggcaugggcggcggcauguucuga

SEQ ID NO: 7663 - RNA, 1722 nt, Artificial Sequence
  derived and/or modified sequence opt5 from HSP60__Homo_sapiens__EAW70148
augcugagacuccccaccguguuccggcagaugcgcccugucagcagaguucuggccccgcaccuuacacgggcuuacgccaaggacgugaaauuuggcgcggaugcucgcgcccugaugcuccaagggguggaccugcuugccgaugcugucgccgugacgaugggacccaagggcagaaccguuaucauugagcaguccugggggucuccuaaagugacaaaggacggagucaccguggcuaaaagcaucgaucugaaggacaaguauaaaaacauuggcgccaagcucguucaggauguggcgaauaacacaaaugaagaggccggggacggaaccacaaccgcuacgguccuggcccgguccaucgcuaaagaaggcuucgagaagauuucuaaaggcgccaaccccguggaaauccgcagaggggugaugcuggcggucgaugccguuaucgcugagcucaagaagcagagcaaaccugugaccacacccgaggaaauugcccaaguggcuaccaucuccgccaauggagacaaggagauuggcaacaucauuucugaugccaugaaaaaggucgggcggaaaggagugaucacaguuaaggacggcaaaacccugaaugaugaacuugagauuaucgaggggaugaaguuugaccgcggauacaucagcccuuauuucauuaacacguccaagggccagaaaugcgaauuucaggacgcuuacgugcugcucagcgagaagaaaaucucuuccauucagagcaucgucccggcgcuggaaauugccaaugcucauagaaagccccuugugaucaucgccgaggauguugacggcgaagcccugucuacacucgugcugaaccggcugaaagucgggcuccaaguggucgcugugaaggccccuggauucggcgauaaucgcaagaaccagcugaaagacauggcgauugcuaccgggggagccguuuuuggcgaggaggggcuuacacugaaucucgaagaugugcagccccacgaccugggaaaggucggcgaggugaucguuaccaaagaugacgccaugcuucugaagggcaaaggggauaaggcucagauugaaaagagaauccaagagauuaucgaacagcucgacgugaccacauccgaguaugagaaagaaaagcugaacgagcggcuggccaaacucagcgauggagucgcugugcugaaggugggcgggacgucugacguugaagucaaugagaaaaaggaccgcgugaccgaugcccuuaacgcgacaagagccgcuguggaagagggaaucguccugggcgggggcugugcccuccugcggugcauuccugcucuugacucccugacccccgccaacgaggaucagaagaucggaauugaaaucauuaaaagaacacucaagaucccggcgaugaccauugccaaaaaugcuggcguggaggggagccugaucguugaaaagaucaugcaauccucuagcgaggugggauacgacgccauggcuggcgauuucgucaacaugguggagaaagggauuaucgacccuacgaagguugugcgcacagcccugcucgaugccgcuggagucgcgucccugcuuaccaccgccgaagugguugugacagagauucccaaagaagagaaggacccuggcaugggggcuaugggcggaaugggcgggggaaugggcgggggaauguuuuga

SEQ ID NO: 7664 - RNA, 1722 nt, Artificial Sequence
  derived and/or modified sequence opt6 from HSP60__Homo_sapiens__EAW70148
augcuaagacuaccgacgguauuuagacaaaugagaccaguaaguagaguauuggcaccacaccugacaagagcauaugcgaaagauguaaaauuuggagcagaugcaagagcacuaaugcuacaaggcguggauuuacuagccgacgcaguagcaguuacuaugggaccgaaaggacggacaguaauuauagaacaaaguugggguaguccgaaaguaacaaaagauggggucacaguagcaaaaucaauagacuuaaaggacaaauacaaaaauauaggagcaaaacuaguacaagauguggcaaauaacacaaaugaagaagcaggagacggaacaaccacggcaacaguacuagcuagaaguauagcaaaagaaggguuugaaaaaauaagcaaaggagcaaauccuguagaaauaagaaggggaguaaugcuagcgguagacgccguuauagcagaguuaaaaaaacaaaguaaaccaguaacaacaccagaggaaauagcacaaguagcaacaauaagugcaaauggagauaaggaaauuggaaacauuauauccgaugccaugaagaaaguaggaagaaaagggguaauaacaguaaaggauggaaaaacguuaaaugaugaacuagaaauaauagaaggaaugaaauucgaccgaggauauauuaguccauauuuuauaaacacaagcaaaggacaaaaaugugaauuucaagacgcuuauguccuauuaagcgaaaaaaaaauaucaagcauacaaucaauuguaccagcacuugaaauagcaaaugcacacagaaaaccauuaguaauaauugcugaagauguagacggggaagcgcuaagcacauuaguauuaaauagacuaaaaguaggacuccaagugguagcaguaaaagcuccaggauuuggagauaauagaaaaaaucaauuaaaagacauggcaauagcaacagggggagccguauuuggagaggaaggucugacauuaaacuuagaggacguacagccacaugauuugggaaaaguaggagaaguaauaguaacgaaagacgacgcaauguuauugaaaggaaagggagauaaagcgcagauagaaaaaaggauucaagagauaauagagcaauuagauguaacaacaagugaauaugagaaagaaaaacuaaaugaaagauuagcaaaauugagcgacggaguagcaguauuaaaaguaggaggaacaucagacguagaaguaaaugaaaaaaaggacagaguaacagaugcuuugaacgcaacaagagcagccguugaagaaggaauaguauuaggaggaggaugugcuuuacuaagaugcaucccagcacuagauucauuaacgccagcaaaugaagaucaaaaaauaggaauagaaauaauaaaaagaaccuuaaaaauaccagcuaugacaauagcaaaaaacgcaggcguagagggaagccuaauaguagaaaaaauaaugcaaaguucaagugaaguaggguaugacgccauggcuggagauuuuguaaacaugguagaaaaaggaauaauagauccaacaaaaguaguaaggacggcauuguuagaugcagcaggaguugcaagccuuuuaacaaccgcagaaguaguagugacagaaauaccaaaagaagaaaaagauccagguaugggggcaaugggagggaugggaggaggaaugggaggaggaauguucuaa

SEQ ID NO: 7665 - protein, 569 aa, Artificial Sequence [sequence omitted]

SEQ ID NO: 7666 - RNA, 1710 nt, Artificial Sequence
  HSP60__Homo_sapiens__ACE06961
augcuucgguuacccacagucuuucgccagaugagaccgguguccaggguacuggcuccucaucucacucgggcuuaugccaaagauguaaaauuuggugcagaugcccgagccuuaaugcuucaagguguagaccuuuuagccgaugcuguggccguuacaauggggccaaagggaagaacagugauuauugagcagaguuggggaagucccaaaguaacaaaagauggugugacuguugcaaagucaauugacuuaaaagauaaauacaagaacauuggagcuaaacuuguucaagauguugccaauaacacaaaugaagaagcuggggauggcacuaccacugcuacuguacuggcacgcucuauagccaaggaaggcuucgagaagauuagcaaaggugcuaauccaguggaaaucaggagaggugugauguuagcuguugaugcuguaauugcugaacuuaaaaagcagucuaaaccugugaccaccccugaagaaauugcacagguugcuacgauuucugcaaacggagacaaagaaauuggcaauaucaucucugaugcaaugaaaaaaguuggaagaaagggugucaucacaguaaaggauggaaaaacacugaaugaugaauuagaaauuauugaaggcaugaaguuugaucgaggcuauauuucuccauacuuuauuaauacaucaaaaggucagaaaugugaauuccaggaugccuauguucuguugagugaaaagaaaauuucuaguauccaguccauuguaccugcucuugaaauugccaaugcucaccguaagccuuuggucauaaucgcugaagauguugauggagaagcucuaaguacacucgucuugaauaggcuaaagguuggucuucagguuguggcagucaaggcuccaggguuuggugacaauagaaagaaccagcuuaaagauauggcuauugcuacugguggugcaguguuuggagaagagggauugacccugaaucuugaagacguucagccucaugacuuaggaaaaguuggagaggucauugugaccaaagacgaugccaugcucuuaaaaggaaaaggugacaaggcucaaauugaaaaacguauucaagaaaucauugagcaguuagaugucacaacuagugaauaugaaaagggaaaacugaaugaacggcuugcaaaacuuucagauggaguggcugugcugaagguuggugggacaagugauguugaagugaaugaaaagaaagacagaguuacagaugcccuuaaugcuacaagagcugcuguugaagaaggcauuguuuugggaggggguugugcccuccuucgaugcauuccagccuuggacucauugacuccagcuaaugaagaucaaaaaauugguauagaaauuauuaaaagaacacucaaaauuccagcaaugaccauugcuaagaaugcagguguugaaggaucuuugauaguugagaaaauuaugcaaaguuccucagaaguugguuaugaugcuauggcuggagauuuugugaauaugguggaaaaaggaaucauugacccaacaaagguugugagaacugcuuuauuggaugcugcugguguggccucucuguuaacuacagcagaaguuguagucacagaaauuccuaaagaagagaaggacccuggaaugggugcaauggguggaaugggagguggcauguucuaa

SEQ ID NO: 7667 - RNA, 1710 nt, Artificial Sequence
  derived and/or modified sequence opt1 from HSP60__Homo_sapiens__ACE06961
augcugcgccuccccaccguguuccggcagaugcgcccggucagccgggugcuggcgccccaccugacccgcgccuacgccaaggacgugaaguucggcgccgacgcccgggcccucaugcugcagggggucgaccugcucgccgacgcgguggccgugacgaugggccccaaggggcgcaccgucaucaucgagcaguccuggggcagccccaaggugaccaaggacggggugaccgucgccaaguccaucgaccugaaggacaaguacaagaacaucggcgccaagcuggugcaggacguggcgaacaacacgaacgaggaggccggcgacgggaccaccaccgccacgguccucgcccggagcaucgccaaggagggcuucgagaagaucuccaagggggcgaacccgguggagauccgccggggcgugaugcuggccgucgacgccgugaucgccgagcugaagaagcagagcaagcccgugaccacccccgaggagaucgcccaggucgcgaccaucuccgccaacggggacaaggagaucggcaacaucaucagcgacgccaugaagaaggugggccgcaagggggugaucacggucaaggacggcaagacccucaacgacgagcuggagaucaucgaggggaugaaguucgaccggggcuacaucucccccuacuucaucaacaccagcaagggccagaagugcgaguuccaggacgccuacgugcugcucuccgagaagaagaucagcuccauccagagcaucgugccggcccuggagaucgcgaacgcccaccgcaagccccuggucaucaucgccgaggacguggacggggaggcccucuccacccugguccugaaccggcucaaggugggccuccagguggucgccgugaaggcgcccggguucggcgacaaccgcaagaaccagcugaaggacauggccaucgccaccgggggcgccguguucggcgaggaggggcugacgcugaaccuggaggacguccagccccacgaccucggcaaggugggggaggugaucgucaccaaggacgacgcgaugcugcugaagggcaagggggacaaggcccagaucgagaagcggauccaggagaucaucgagcagcucgacgugaccacgagcgaguacgagaagggcaagcugaacgagcgccuggccaagcucuccgacggcguggccguccugaaggucgggggcaccagcgacguggaggugaacgagaagaaggaccgggugaccgacgcccugaacgcgacccgcgccgccguggaggaggggaucguccucggcgggggcugcgcccugcugcggugcaucccggcccucgacucccugacgcccgcgaacgaggaccagaagaucggcaucgagaucaucaagcgcacccugaagauccccgccaugaccaucgccaagaacgccgggguggagggcagccucaucguggagaagaucaugcagagcuccagcgaggucggguacgacgccauggcgggcgacuucgugaacaugguggagaagggcaucaucgaccccaccaaggucgugcggacggcccugcuggacgccgccgggguggcgucccuccugaccaccgccgaggucguggugaccgagaucccgaaggaggagaaggaccccggcaugggggccaugggcgggaugggcggcgggauguucuga

SEQ ID NO: 7668 - RNA, 1710 nt, Artificial Sequence
  derived and/or modified sequence opt2 from HSP60__Homo_sapiens__ACE06961
augcuccgccuccccaccgucuuccgccagaugcgccccgucucccgcguccucgccccccaccucacccgcgccuacgccaaggacgucaaguucggcgccgacgcccgcgcccucaugcuccagggcgucgaccuccucgccgacgccgucgccgucaccaugggccccaagggccgcaccgucaucaucgagcaguccuggggcucccccaaggucaccaaggacggcgucaccgucgccaaguccaucgaccucaaggacaaguacaagaacaucggcgccaagcucguccaggacgucgccaacaacaccaacgaggaggccggcgacggcaccaccaccgccaccguccucgcccgcuccaucgccaaggagggcuucgagaagaucuccaagggcgccaaccccgucgagauccgccgcggcgucaugcucgccgucgacgccgucaucgccgagcucaagaagcaguccaagcccgucaccacccccgaggagaucgcccaggucgccaccaucuccgccaacggcgacaaggagaucggcaacaucaucuccgacgccaugaagaaggucggccgcaagggcgucaucaccgucaaggacggcaagacccucaacgacgagcucgagaucaucgagggcaugaaguucgaccgcggcuacaucucccccuacuucaucaacaccuccaagggccagaagugcgaguuccaggacgccuacguccuccucuccgagaagaagaucuccuccauccaguccaucguccccgcccucgagaucgccaacgcccaccgcaagccccucgucaucaucgccgaggacgucgacggcgaggcccucuccacccucguccucaaccgccucaaggucggccuccaggucgucgccgucaaggcccccggcuucggcgacaaccgcaagaaccagcucaaggacauggccaucgccaccggcggcgccgucuucggcgaggagggccucacccucaaccucgaggacguccagccccacgaccucggcaaggucggcgaggucaucgucaccaaggacgacgccaugcuccucaagggcaagggcgacaaggcccagaucgagaagcgcauccaggagaucaucgagcagcucgacgucaccaccuccgaguacgagaagggcaagcucaacgagcgccucgccaagcucuccgacggcgucgccguccucaaggucggcggcaccuccgacgucgaggucaacgagaagaaggaccgcgucaccgacgcccucaacgccacccgcgccgccgucgaggagggcaucguccucggcggcggcugcgcccuccuccgcugcauccccgcccucgacucccucacccccgccaacgaggaccagaagaucggcaucgagaucaucaagcgcacccucaagauccccgccaugaccaucgccaagaacgccggcgucgagggcucccucaucgucgagaagaucaugcaguccuccuccgaggucggcuacgacgccauggccggcgacuucgucaacauggucgagaagggcaucaucgaccccaccaaggucguccgcaccgcccuccucgacgccgccggcgucgccucccuccucaccaccgccgaggucgucgucaccgagauccccaaggaggagaaggaccccggcaugggcgccaugggcggcaugggcggcggcauguucuga

SEQ ID NO: 7669 - RNA, 1710 nt, Artificial Sequence
  derived and/or modified sequence opt3 from HSP60__Homo_sapiens__ACE06961
augcugagacuccccaccguguucaggcagaugcggccugucagccgcguucuugccccacaccugacacgagcuuacgcaaaggacgugaaauuuggcgccgaugcgcgugcuuugauguuacaagggguagaccugcuagccgaugcaguggccgucacuaugggaccgaaggguagaacggugaucauugagcaguccuggggcucucccaaaguuaccaaggacggggugacagucgcuaaaucaauagaucucaaggacaaguauaaaaacaucggagcaaagcuggugcaggauguagccaauaacacuaaugaagaggcuggcgacgguaccacaaccgccacuguucuugcgaggaguauugcaaaagaaggguucgagaagaucagcaaaggagccaacccuguggaaauucggcgcggcgucaugcuggcuguggaugccgugaucgcagaguugaagaagcaguccaaaccagucacaacccccgaggaaauagcucaaguugccacgaucucugcgaauggcgacaaggagauugggaacaucauuucggaugccaugaaaaaggugggaagaaaagguguaaucacugugaaggacggcaaaacccucaaugaugaacuggagauaauugaggggaugaaguuugacaggggauacaucucaccuuauuucauuaacacaagcaagggccagaaaugcgaauuucaggacgcauacguccugcucagugagaagaaaaucuccucuauccagagcauugugccagcuuuagaaauagccaaugcucaucggaagccccugguuaucauugccgaggauguggacggugaagcacuuuccacuuugguccugaaccgccuaaaaguggggcuccaaguaguugccgugaaggcuccuggauucggcgauaaucgaaagaaccagcugaaagacauggcgaucgcaaccggcggggccgucuuuggagaggagggucuuacacugaauuuggaagaugugcagccacacgaccucggcaaggucggggaggugauaguuaccaaagaugacgcuaugcuguuaaagggaaaaggcgauaaggcccagauugaaaagagaauccaagagaucauugaacagcuggacgugacgacuucagaguaugagaaagguaagcucaacgaaaggcuugcaaaacugagugaugggguagccgucuugaaggugggcggaacaagcgacguugaggugaaugagaaaaaggaccgggucaccgaugcucuaaacgccacucgugcagcgguggaagaaggcaucguacucgggggagguugugcucugcugcgcugcauuccggcccuugacucucugacacccgcaaacgaggaucagaagauaggcaucgagauuaucaaaagaaccuugaagaucccugccaugacgauugcuaaaaaugccgggguggaaggaucccucauaguugagaagaucaugcaaucaagcagugaagucggcuacgacgcaauggcuggugauuucgugaacaugguggagaaagggauuaucgacccaaccaaggucguuaggacagcccuguuagaugcggccggcguggcuucucugcuaacuaccgcagaggugguagucacagaaauucccaaagaggaaaaggacccuggaaugggcgccaugggagggauggguggcgggauguuuuga

SEQ ID NO: 7670 - RNA, 1710 nt, Artificial Sequence
  derived and/or modified sequence opt4 from HSP60__Homo_sapiens__ACE06961
augcugagacugcccaccguguucagacagaugagacccgugagcagagugcuggccccccaccugaccagagccuacgccaaggacgugaaguucggcgccgacgccagagcccugaugcugcagggcguggaccugcuggccgacgccguggccgugaccaugggccccaagggcagaaccgugaucaucgagcagagcuggggcagccccaaggugaccaaggacggcgugaccguggccaagagcaucgaccugaaggacaaguacaagaacaucggcgccaagcuggugcaggacguggccaacaacaccaacgaggaggccggcgacggcaccaccaccgccaccgugcuggccagaagcaucgccaaggagggcuucgagaagaucagcaagggcgccaaccccguggagaucagaagaggcgugaugcuggccguggacgccgugaucgccgagcugaagaagcagagcaagcccgugaccacccccgaggagaucgcccagguggccaccaucagcgccaacggcgacaaggagaucggcaacaucaucagcgacgccaugaagaaggugggcagaaagggcgugaucaccgugaaggacggcaagacccugaacgacgagcuggagaucaucgagggcaugaaguucgacagaggcuacaucagccccuacuucaucaacaccagcaagggccagaagugcgaguuccaggacgccuacgugcugcugagcgagaagaagaucagcagcauccagagcaucgugcccgcccuggagaucgccaacgcccacagaaagccccuggugaucaucgccgaggacguggacggcgaggcccugagcacccuggugcugaacagacugaaggugggccugcaggugguggccgugaaggcccccggcuucggcgacaacagaaagaaccagcugaaggacauggccaucgccaccggcggcgccguguucggcgaggagggccugacccugaaccuggaggacgugcagccccacgaccugggcaaggugggcgaggugaucgugaccaaggacgacgccaugcugcugaagggcaagggcgacaaggcccagaucgagaagagaauccaggagaucaucgagcagcuggacgugaccaccagcgaguacgagaagggcaagcugaacgagagacuggccaagcugagcgacggcguggccgugcugaaggugggcggcaccagcgacguggaggugaacgagaagaaggacagagugaccgacgcccugaacgccaccagagccgccguggaggagggcaucgugcugggcggcggcugcgcccugcugagaugcauccccgcccuggacagccugacccccgccaacgaggaccagaagaucggcaucgagaucaucaagagaacccugaagauccccgccaugaccaucgccaagaacgccggcguggagggcagccugaucguggagaagaucaugcagagcagcagcgaggugggcuacgacgccauggccggcgacuucgugaacaugguggagaagggcaucaucgaccccaccaagguggugagaaccgcccugcuggacgccgccggcguggccagccugcugaccaccgccgaggugguggugaccgagauccccaaggaggagaaggaccccggcaugggcgccaugggcggcaugggcggcggcauguucuga

SEQ ID NO: 7671 - RNA, 1710 nt, Artificial Sequence
  derived and/or modified sequence opt5 from HSP60__Homo_sapiens__ACE06961
augcugagacuccccaccguguuccggcagaugcgcccugucagcagaguucuggccccgcaccuuacacgggcuuacgccaaggacgugaaauuuggcgcggaugcucgcgcccugaugcuccaagggguggaccugcuugccgaugcugucgccgugacgaugggacccaagggcagaaccguuaucauugagcaguccugggggucuccuaaagugacaaaggacggagucaccguggcuaaaagcaucgaucugaaggacaaguauaaaaacauuggcgccaagcucguucaggauguggcgaauaacacaaaugaagaggccggggacggaaccacaaccgcuacgguccuggcccgguccaucgcuaaagaaggcuucgagaagauuucuaaaggcgccaaccccguggaaauccgcagaggggugaugcuggcggucgaugccguuaucgcugagcucaagaagcagagcaaaccugugaccacacccgaggaaauugcccaaguggcuaccaucuccgccaauggagacaaggagauuggcaacaucauuucugaugccaugaaaaaggucgggcggaaaggagugaucacaguuaaggacggcaaaacccugaaugaugaacuugagauuaucgaggggaugaaguuugaccgcggauacaucagcccuuauuucauuaacacguccaagggccagaaaugcgaauuucaggacgcuuacgugcugcucagcgagaagaaaaucucuuccauucagagcaucgucccggcgcuggaaauugccaaugcucauagaaagccccuugugaucaucgccgaggauguugacggcgaagcccugucuacacucgugcugaaccggcugaaagucgggcuccaaguggucgcugugaaggccccuggauucggcgauaaucgcaagaaccagcugaaagacauggcgauugcuaccgggggagccguuuuuggcgaggaggggcuuacacugaaucucgaagaugugcagccccacgaccugggaaaggucggcgaggugaucguuaccaaagaugacgccaugcuucugaagggcaaaggggauaaggcucagauugaaaagagaauccaagagauuaucgaacagcucgacgugaccacauccgaguaugagaaaggaaagcugaacgaacggcuggccaaacucagcgauggcgucgcugugcugaagguugggggaacgucugacguggaggucaaugagaaaaaggaccgcgugaccgaugcccuuaacgcgacaagagccgcuguggaagaaggcaucguccucgggggcggaugugcccugcugcggugcauuccugcucuugacucccugacccccgccaacgaggaucagaagaucggcauugagaucauuaaaagaacacucaagaucccggcgaugaccauugccaaaaaugcugggguggaaggaagccugaucguugagaagaucaugcaauccucuagcgaagugggcuacgacgccauggcuggggauuucgucaacaugguggagaaaggaauuaucgacccuacgaagguugugcgcacagcccugcucgaugccgcuggcgucgcgucccugcuuaccaccgccgaggugguugugacagaaauucccaaagaggaaaaggacccugggaugggcgcuaugggaggcaugggagggggcauguuuuga

SEQ ID NO: 7672 - RNA, 1710 nt, Artificial Sequence
  derived and/or modified sequence opt6 from HSP60__Homo_sapiens__ACE06961
augcuaagguuaccaacaguauucagacaaaugagaccaguaucaagaguccuagcaccacauuuaacacgagcauaugcaaaagauguaaaauucggggcagaugcaagggcauugauguuacaaggagucgauuuacuagcggaugcaguagcgguaacaaugggaccaaaaggaagaacaguaauaauagaacaaaguuggggaucaccuaaaguaacaaaagauggaguaacaguagcaaaaaguauagauuuaaaagacaaauauaaaaacauuggagcaaaacuagugcaagauguagcaaacaauaccaaugaagaagcaggagaugguacaacaacagcaacgguauuggcuagaucaauagcgaaagaaggauuugaaaaaauaucaaaaggcgcaaacccaguagagauaagaaggggaguaaugcuagcaguagaugcgguaauagcagaacuaaaaaaacaaaguaaaccuguaacaaccccugaggaaauagcacaaguugcaacuauaucagcaaacggcgacaaagaaauagggaauauuauaagugaugcaaugaagaaaguaggaagaaaagguguaauaacaguaaaagaugggaaaacacugaaugaugaacuagagauaauagaaggaaugaaauucgauaggggauacauaagcccauacuuuauuaauacaucaaaaggacagaaaugcgaauuucaagacgcauacgucuuacuaagcgaaaaaaaaauaaguagcauacaaucaauuguaccagcacuggagauagcgaacgcacaucgaaaaccauuagugauuauagcugaagauguggauggagaggcacuaaguacauuaguguuaaacagguuaaaaguaggacuucaaguaguagccguaaaagccccaggauucggagauaauagaaaaaaucaauugaaagacauggcaauugcaacaggaggagcaguauuuggcgaagaaggauuaacacuaaaccuagaagauguacagccacacgauuuagggaaaguaggagaaguaauagugacgaaagacgaugcaauguuacuaaaaggaaaaggggauaaagcucaaauagagaaaagaauacaagagauaauugaacaauuagacguaacaacaagcgaauacgaaaaaggaaaauuaaaugaaaggcuagcaaaauuaagcgauggaguggcagugcuaaaaguaggaggaacaagugacgucgaaguaaaugaaaagaaagauagagugacagaugcguuaaacgcaacaagagcagcaguagaggaagggauaguacuagggggcggaugugcccuacuaagaugcauuccggcuuuagacucauuaacaccagcuaaugaagaucaaaaaaucggaauagaaauaauaaaaagaacguuaaaaauaccagcaaugacgauagcaaagaaugcagggguagaaggaucacuaauaguggaaaaaauaaugcaaaguucaagugaaguaggauaugacgcaauggcuggggauuucguaaauaugguagagaaagggauaauagauccaacaaaaguaguucgaaccgcauuauuagaugcagcagggguagcaucacuacuaacaacugcagaaguaguaguaacagaaauaccaaaagaagagaaagaucccggaaugggagcuaugggagggauggguggagggauguucuaa

SEQ ID NO: 7673 - protein, 573 aa, Artificial Sequence; identical to SEQ ID NO: 7657
  HSP60__Homo_sapiens__P10809

SEQ ID NO: 7674 - RNA, 1722 nt, Artificial Sequence
  HSP60__Homo_sapiens__AAA60127
augcuucgguuacccacagucuuucgccagaugagaccgguguccaggguacuggcuccucaucucacucgggcuuaugccaaagauguaaaauuuggugcagaugcccgagccuuaaugcuucaagguguagaccuuuuagccgaugcuguggccguuacaauggggccaaagggaagaacagugauuauugagcagaguuggggaagucccaaaguaacaaaagauggugugacuguugcaaagucaauugacuuaaaagauaaauacaagaacauuggagcuaaacuuguucaagauguugccaauaacacaaaugaagaagcuggggauggcacuaccacugcuacuguacuggcacgcucuauagccaaggaaggcuucgagaagauuagcaaaggugcuaauccaguggaaaucaggagaggugugauguuagcuguugaugcuguaauugcugaacuuaaaaagcagucuaaaccugugaccaccccugaagaaauugcacagguugcuacgauuucugcaaacggagacaaagaaauuggcaauaucaucucugaugcaaugaaaaaaguuggaagaaagggugucaucacaguaaaggauggaaaaacacugaaugaugaauuagaaauuauugaaggcaugaaguuugaucgaggcuauauuucuccauacuuuauuaauacaucaaaaggucagaaaugugaauuccaggaugccuauguucuguugagugaaaagaaaauuucuaguauccaguccauuguaccugcucuugaaauugccaaugcucaccguaagccuuuggucauaaucgcugaagauguugauggagaagcucuaaguacacucgucuugaauaggcuaaagguuggucuucagguuguggcagucaaggcuccaggguuuggugacaauagaaagaaccagcuuaaagauauggcuauugcuacugguggugcaguguuuggagaagagggauugacccugaaucuugaagacguucagccucaugacuuaggaaaaguuggagaggucauugugaccaaagacgaugccaugcucuuaaaaggaaaaggugacaaggcucaaauugaaaaacguauucaagaaaucauugagcaguuagaugucacaacuagugaauaugaaaaggaaaaacugaaugaacggcuugcaaaacuuucagauggaguggcugugcugaagguuggugggacaagugauguugaagugaaugaaaagaaagacagaguuacagaugcccuuaaugcuacaagagcugcuguugaagaaggcauuguuuugggaggggguugugcccuccuucgaugcauuccagccuuggacucauugacuccagcuaaugaagaucaaaaaauugguauagaaauuauuaaaagaacacucaaaauuccagcaaugaccauugcuaagaaugcagguguugaaggaucuuugauaguugagaaaauuaugcaaaguuccucagaaguugguuaugaugcuauggcuggagauuuugugaauaugguggaaaaaggaaucauugacccaacaaagguugugagaacugcuuuauuggaugcugcugguguggccucucuguuaacuacagcagaaguuguagucacagaaauuccuaaagaagagaaggacccuggaaugggugcaauggguggaaugggaggugguaugggagguggcauguucuaa

SEQ ID NO: 7675 - RNA, 1722 nt, Artificial Sequence; identical to SEQ ID NO: 7659
  derived and/or modified sequence opt1 from HSP60__Homo_sapiens__AAA60127

SEQ ID NO: 7676 - RNA, 1722 nt, Artificial Sequence; identical to SEQ ID NO: 7660
  derived and/or modified sequence opt2 from HSP60__Homo_sapiens__AAA60127

SEQ ID NO: 7677 - RNA, 1722 nt, Artificial Sequence; identical to SEQ ID NO: 7661
  derived and/or modified sequence opt3 from HSP60__Homo_sapiens__AAA60127

SEQ ID NO: 7678 - RNA, 1722 nt, Artificial Sequence; identical to SEQ ID NO: 7662
  derived and/or modified sequence opt4 from HSP60__Homo_sapiens__AAA60127

SEQ ID NO: 7679 - RNA, 1722 nt, Artificial Sequence; identical to SEQ ID NO: 7663
  derived and/or modified sequence opt5 from HSP60__Homo_sapiens__AAA60127

SEQ ID NO: 7680 - RNA, 1722 nt, Artificial Sequence
  derived and/or modified sequence opt6 from HSP60__Homo_sapiens__AAA60127
auguuaagauuaccaacgguauucagacaaaugagaccaguaaguagaguacuagcuccacaucuaacaagagccuaugcaaaagacguaaaauuuggagcugaugcaagagcauuaaugcuacaaggaguagaucuacuagcagaugcaguugcaguuacaaugggaccaaaaggaaggacggucauaauagaacaaagcuggggaucgccaaaaguaacgaaagauggaguuacuguagcaaaaagcauagaccuaaaagauaaauauaagaacauaggagcaaaauuaguacaagacgucgcaaauaauacaaacgaagaagcaggagacggaacaacaaccgcaacaguacuugcaaggucaauugcaaaagaaggauuugaaaaaauaucaaaaggagcaaaucccguagaaauaagaagagggguaaugcuagcaguagacgcaguaauagcagaacugaaaaaacaaaguaaaccagugacuacaccagaagaaauagcgcaaguagcuacaauaagcgcuaauggagacaaagaaauaggaaacauaauaagcgaugccaugaaaaagguaggaagaaaaggaguaauaacaguuaaagauggaaaaacacuuaaugaugaacucgaaauaauagaagggaugaaauuugauagaggauauauaagcccauacuuuauaaacacaaguaaaggacaaaaaugcgaauuccaggaugcauacguguuacuaagcgagaaaaaaaucaguagcauucaaucaauuguaccagcauuagagaucgcaaaugcgcauagaaaaccacuaguaauaauagcagaagauguagacggagaagcauuaaguacauuaguuuuaaauagacuaaaaguaggacuacaaguaguagcaguaaaagcaccaggauucggagauaaucgaaaaaaucaacuuaaagauauggcaauagcaacaggaggcgcuguguucggagaagaaggguuaacuuugaaucuagaagauguacaaccacaugaucuaggaaaaguaggagaaguaauaguaacaaaagacgaugcaaugcucuuaaaaggaaaaggagauaaggcgcaaauugaaaaaagaauucaagaaauaauagaacaacuagauguaacaacaagugaauaugagaaagagaaacugaacgaaagacuggcaaaacugagugacggcgucgcaguacuaaaaguagguggcacgucagauguagaaguaaacgaaaaaaaagauagaguaacagacgcguuaaaugcuacuagagcggcaguugaagaagguauagucuuagguggaggaugcgcauuguuaagauguauaccagcauuagauagccuaacacccgcaaaugaagaucaaaagauuggaauagaaauaauaaaaagaacucuaaaaauaccagcaaugaccauagcgaaaaaugcagguguagaaggaagccuaauaguagaaaaaauaaugcaaucaaguucagaaguaggauaugaugcgauggcgggugacuuuguuaauaugguagaaaaagguauuauagacccaacaaaaguaguaagaacagcauuacuggacgcagcaggaguagcaagucuauuaacaacagcagaaguuguaguaacugaaauaccuaaagaggaaaaagauccaggaaugggagcaaugggaggaaugggcgguggaaugggaggaggaauguuuuaa

SEQ ID NO: 7681 - protein, 509 aa, Artificial Sequence
  HSP60__Homo_sapiens__Q0VDF9
MAAIGVHLGCTSACVAVYKDGRAGVVANDAGDRVTPAVVAYSENEEIVGLAAKQSRIRNISNTVMKVKQILGRSSSDPQAQKYIAESKCLVIEKNGKLRYEIDTGEETKFVNPEDVARLIFSKMKETAHSVLGSDANDVVITVPFDFGEKQKNALGEAARAAGFNVLRLIHEPSAALLAYGIGQDSPTGKSNILVFKLGGTSLSLSVMEVNSGIYRVLSTNTDDNIGGAHFTETLAQYLASEFQRSFKHDVRGNARAMMKLTNSAEVAKHSLSTLGSANCFLDSLYEGQDFDCNVSRARFELLCSPLFNKCIEAIRGLLDQNGFTADDINKVVLCGGSSRIPKLQQLIKDLFPAVELLNSIPPDEVIPIGAAIEAGILIGKENLLVEDSLMIECSARDILVKGVDESGASRFTVLFPSGTPLPARRQHTLQAPGSISSVCLELYESDGKNSAKEETKFAQVVLQDLDKKENGLRDILAVLTMKRDGSLHVTCTDQETGKCEAISIEIAS

SEQ ID NO: 7682 - RNA, 1530 nt, Artificial Sequence
  HSP60__Homo_sapiens__AAI19691
auggcggccaucggaguucaccugggcugcaccucagccuguguggccgucuauaaggauggccgggcuggugugguugcaaaugaugccggugaccgaguuacuccagcuguuguugcuuacucagaaaaugaagagauuguuggauuggcagcaaaacaaaguagaauaagaaauauuucaaauacaguaaugaaaguaaagcagauccugggcagaagcuccagugauccacaagcucagaaauacaucgcggaaaguaaauguuuagucauugaaaaaaaugggaaauuacgauaugaaauagauacuggagaagaaacaaaauuuguuaacccagaagauguugccagacugauauuuaguaaaaugaaagaaacggcacauucuguauugggcucagaugcaaaugauguaguuauuacugucccguuugauuuuggagaaaagcaaaaaaaugcucuuggagaagcagcuagagcugcuggauuuaauguuuugcgauuaauucacgaaccgucugcagcucuucuugcuuauggaauuggacaagacuccccuacuggaaaaagcaauauuuugguguuuaagcuuggaggaacauccuuaucucucagcgucauggaaguuaacaguggaauauaucggguucuuucaacaaacacugaugauaacaucgguggugcacauuucacagaaaccuuagcacaguaucuagcuucugaguuccaaagauccuucaaacaugaugugagaggaaaugcgcgagccaugaugaaauuaacgaacagugcugaaguagcgaaacauucuuugucaaccuugggaagugccaacuguuuucuugacucauuauaugaaggucaagauuuugauugcaauguguccagagcaagauuugaacuucuuuguucuccacuuuuuaauaaguguauagaagcaaucagaggacucuuagaucaaaauggauuuacagcagaugauaucaacaagguuguccuuuguggagggucuucucgaaucccaaagcuacagcaacugauuaaagaucuuuucccagcuguugagcuucucaauucuaucccuccugaugaagugaucccuauuggugcagcuauagaagcaggaauucuuauugggaaagaaaaccuguugguggaagacucucuuaugauagaguguucagccagagauauuuuaguuaaggguguggacgaaucaggagccaguagauucacagugcuguuuccaucagggacuccuuugccagcucgaagacaacacacauugcaagccccuggaagcauaucuucagugugccuugaacucuaugagucugaugggaagaacucugccaaagaggaaaccaaguuugcacagguuguacuccaggauuuagauaaaaaagaaaauggauuacgugauauauuagcuguucuuacuaugaaaagggauggaucuuuacaugugacaugcacagaucaagaaacuggaaaaugugaagcaaucucuauugagauagcaucuuag

SEQ ID NO: 7683 - RNA, 1530 nt, Artificial Sequence
  derived and/or modified sequence opt1 from HSP60__Homo_sapiens__AAI19691
auggccgccaucggcgugcaccuggggugcaccagcgcgugcgucgccguguacaaggacggccgcgccgggguggucgccaacgacgccggcgaccgggugacccccgcgguggucgccuacuccgagaacgaggagaucguggggcucgccgccaagcagagccgcauccggaacaucuccaacacggugaugaaggucaagcagauccugggccgcagcuccagcgacccgcaggcgcagaaguacaucgccgaguccaagugccuggugaucgagaagaacggcaagcuccgguacgagaucgacaccggggaggagaccaaguucgugaaccccgaggacgucgcccgccugaucuucagcaagaugaaggagaccgcccacuccgugcugggcagcgacgccaacgacguggucaucacggugcccuucgacuucggggagaagcagaagaacgcgcucggcgaggccgcccgggccgccggguucaacgugcugcgccugauccacgagcccuccgcggcccuccuggccuacggcaucggccaggacagcccgaccgggaaguccaacauccuggucuucaagcucggcgggaccagccugucccugagcgugauggaggugaacuccggcaucuaccggguccucagcaccaacacggacgacaacaucggcggggcccacuucaccgagacccuggcccaguaccuggcguccgaguuccagcgcagcuucaagcacgacgugcggggcaacgcccgcgccaugaugaagcucaccaacagcgccgagguggccaagcacucccugagcacgcugggguccgcgaacugcuuccucgacagccuguacgagggccaggacuucgacugcaacgucucccgggcccgcuucgagcugcucugcagcccccuguucaacaagugcaucgaggccauccgggggcugcucgaccagaacggcuucaccgccgacgacaucaacaaggugguccugugcggcggguccagccgcauccccaagcugcagcagcucaucaaggaccuguuccccgcgguggagcugcucaacuccaucccgcccgacgaggugauccccaucggcgccgccaucgaggccgggauccugaucggcaaggagaaccugcucgucgaggacagccugaugaucgagugcuccgcccgggacauccuggugaaggggguggacgagagcggcgcgucccgcuucaccguccucuuccccagcggcaccccgcugcccgcccggcgccagcacacgcugcaggcccccggguccaucagcuccgugugccucgagcuguacgagagcgacggcaagaacuccgccaaggaggagaccaaguucgcccaggugguccugcaggaccucgacaagaaggagaacgggcugcgggacauccuggcggugcucaccaugaagcgcgacggcagccugcacgugaccugcacggaccaggagaccgggaagugcgaggccaucagcaucgagaucgccuccuga

SEQ ID NO: 7684 - RNA, 1530 nt, Artificial Sequence
  derived and/or modified sequence opt2 from HSP60__Homo_sapiens__AAI19691
auggccgccaucggcguccaccucggcugcaccuccgccugcgucgccgucuacaaggacggccgcgccggcgucgucgccaacgacgccggcgaccgcgucacccccgccgucgucgccuacuccgagaacgaggagaucgucggccucgccgccaagcagucccgcauccgcaacaucuccaacaccgucaugaaggucaagcagauccucggccgcuccuccuccgacccccaggcccagaaguacaucgccgaguccaagugccucgucaucgagaagaacggcaagcuccgcuacgagaucgacaccggcgaggagaccaaguucgucaaccccgaggacgucgcccgccucaucuucuccaagaugaaggagaccgcccacuccguccucggcuccgacgccaacgacgucgucaucaccguccccuucgacuucggcgagaagcagaagaacgcccucggcgaggccgcccgcgccgccggcuucaacguccuccgccucauccacgagcccuccgccgcccuccucgccuacggcaucggccaggacucccccaccggcaaguccaacauccucgucuucaagcucggcggcaccucccucucccucuccgucauggaggucaacuccggcaucuaccgcguccucuccaccaacaccgacgacaacaucggcggcgcccacuucaccgagacccucgcccaguaccucgccuccgaguuccagcgcuccuucaagcacgacguccgcggcaacgcccgcgccaugaugaagcucaccaacuccgccgaggucgccaagcacucccucuccacccucggcuccgccaacugcuuccucgacucccucuacgagggccaggacuucgacugcaacgucucccgcgcccgcuucgagcuccucugcuccccccucuucaacaagugcaucgaggccauccgcggccuccucgaccagaacggcuucaccgccgacgacaucaacaaggucguccucugcggcggcuccucccgcauccccaagcuccagcagcucaucaaggaccucuuccccgccgucgagcuccucaacuccaucccccccgacgaggucauccccaucggcgccgccaucgaggccggcauccucaucggcaaggagaaccuccucgucgaggacucccucaugaucgagugcuccgcccgcgacauccucgucaagggcgucgacgaguccggcgccucccgcuucaccguccucuuccccuccggcaccccccuccccgcccgccgccagcacacccuccaggcccccggcuccaucuccuccgucugccucgagcucuacgaguccgacggcaagaacuccgccaaggaggagaccaaguucgcccaggucguccuccaggaccucgacaagaaggagaacggccuccgcgacauccucgccguccucaccaugaagcgcgacggcucccuccacgucaccugcaccgaccaggagaccggcaagugcgaggccaucuccaucgagaucgccuccuga

SEQ ID NO: 7685 - RNA, 1530 nt, Artificial Sequence
  derived and/or modified sequence opt3 from HSP60__Homo_sapiens__AAI19691
auggccgcuaucggcgugcaccuggggugcaccagcgcaugugucgccguuuacaaggacgguagagcgggagugguagcuaacgaugccggcgacagggugacacccgcagucguggccuauuccgagaaugaagagauuguugggcucgcugcaaaacagucucggauacgcaacaucucaaauacugugaugaaggucaaacaaauucuuggacgaaguagcuccgauccucaggcccagaaguacaucgcugaaucuaaaugccuggugauugagaagaacggcaaguugcguuaugaaaucgacacgggugaggagaccaaauucguaaauccagaagauguugccagauuaauauuuucgaagaugaaagagacagcgcauucagugcuggggagcgacgcaaacgaugucgugaucacugugccguucgacuuuggagaaaagcagaaaaaugcccuaggcgaggcugccagggcagcuggcuucaacguccuccggcugauucacgagcccagugccgcgcuucuggccuacgggaucggacaagauuccccuaccgguaagucuaauauuuugguuuuuaagcucggcgggacaagccugucccugucagugauggaaguaaacaguggaaucuaucgcgugcucagcaccaauacugacgauaacauaggcggugcacauuucacagagaccuuagcucaguaccuggccucugaauuucagagauccuucaaacacgacgucagggggaaugcucgggccaugaugaagcugacgaacucagcagagguggccaaacauagcuugaguacucugggaucugcuaauuguuuucuagauucccucuaugaaggccaggacuucgacugcaacguuagccgcgcgcgauuugagcugcuuuguucgccacuguucaacaagugcauugaggcaaucagaggcuugcucgaucaaaauggguuuaccgccgacgauauuaacaaagugguccuguguggagguucuuccaggauccccaaguuacagcagcugaucaaagaccucuucccugcuguggaacuucuuaauucaauuccacccgaugagguaauaccuaucggcgccgcaauugaagccgggaucuugauaggaaaggagaaccuacugguugaagacagucucaugauugagugcagcgcucgggauauccuggugaagggcgucgacgaguccggugccucucguuucacagugcuuuuuccaagcgggacuccgcugcccgcacgcagacagcacaccuugcaagcgccuggcucaaucaguuccgucugucucgaacuguacgagagcgauggcaaaaauucugcuaaggaagagacaaaauucgcccaggugguuuuacaggaccuggauaagaaagaaaacggacuaagggacauucucgcagugcugaccaugaagcgggacgggucacuucacguaacgugcacugaucaagagacaggaaagugugaggccaucaguauugaaauagcuagcuga

SEQ ID NO: 7686 - RNA, 1530 nt, Artificial Sequence
  derived and/or modified sequence opt4 from HSP60__Homo_sapiens__AAI19691
auggccgccaucggcgugcaccugggcugcaccagcgccugcguggccguguacaaggacggcagagccggcgugguggccaacgacgccggcgacagagugacccccgccgugguggccuacagcgagaacgaggagaucgugggccuggccgccaagcagagcagaaucagaaacaucagcaacaccgugaugaaggugaagcagauccugggcagaagcagcagcgacccccaggcccagaaguacaucgccgagagcaagugccuggugaucgagaagaacggcaagcugagauacgagaucgacaccggcgaggagaccaaguucgugaaccccgaggacguggccagacugaucuucagcaagaugaaggagaccgcccacagcgugcugggcagcgacgccaacgacguggugaucaccgugcccuucgacuucggcgagaagcagaagaacgcccugggcgaggccgccagagccgccggcuucaacgugcugagacugauccacgagcccagcgccgcccugcuggccuacggcaucggccaggacagccccaccggcaagagcaacauccugguguucaagcugggcggcaccagccugagccugagcgugauggaggugaacagcggcaucuacagagugcugagcaccaacaccgacgacaacaucggcggcgcccacuucaccgagacccuggcccaguaccuggccagcgaguuccagagaagcuucaagcacgacgugagaggcaacgccagagccaugaugaagcugaccaacagcgccgagguggccaagcacagccugagcacccugggcagcgccaacugcuuccuggacagccuguacgagggccaggacuucgacugcaacgugagcagagccagauucgagcugcugugcagcccccuguucaacaagugcaucgaggccaucagaggccugcuggaccagaacggcuucaccgccgacgacaucaacaagguggugcugugcggcggcagcagcagaauccccaagcugcagcagcugaucaaggaccuguuccccgccguggagcugcugaacagcaucccccccgacgaggugauccccaucggcgccgccaucgaggccggcauccugaucggcaaggagaaccugcugguggaggacagccugaugaucgagugcagcgccagagacauccuggugaagggcguggacgagagcggcgccagcagauucaccgugcuguuccccagcggcaccccccugcccgccagaagacagcacacccugcaggcccccggcagcaucagcagcgugugccuggagcuguacgagagcgacggcaagaacagcgccaaggaggagaccaaguucgcccagguggugcugcaggaccuggacaagaaggagaacggccugagagacauccuggccgugcugaccaugaagagagacggcagccugcacgugaccugcaccgaccaggagaccggcaagugcgaggccaucagcaucgagaucgccagcuga

SEQ ID NO: 7687 - RNA, 1530 nt, Artificial Sequence
  derived and/or modified sequence opt5 from HSP60__Homo_sapiens__AAI19691
auggccgcuaucggcguccaccuggggugcaccagcgccugugucgcgguuuacaaggacggcagagcuggagugguggccaacgaugccggggaccgggucacacccgcugugguugccuauuccgagaaugaagagauugugggacucgcugccaaacagucucgcaucagaaacauuagcaauacggucaugaaggugaaacaaauccugggccgguccucuagcgauccucaggcgcagaaguacauugccgaauccaaaugccuuguuaucgagaagaacgggaagcugcgcuaugaaaucgacaccggagaggagacaaaauucgugaauccggaagaugucgcuagacucaucuuuucuaagaugaaagagaccgcccauagcgugcugggcuccgacgcuaacgauguggucauuacaguucccuucgacuuuggcgaaaagcagaaaaaugcccuuggggaggcggcccgggcugccggauucaacgugcugcgccucauucacgagccuagcgcugcccugcuggccuacggcaucgggcaagauucucccaccggaaaguccaauauucucguguuuaagcugggcgggacaagccuuucucuguccgucauggaagugaacagcggaaucuauagaguucucucuaccaauacggacgauaacauuggcggcgcucauuucaccgagacacuggcgcaguaccuugccuccgaauuucagcggagcuucaaacacgacgugcgcgggaaugcuagagccaugaugaagcugaccaacuccgccgaggucgcuaaacauucucucagcacacugggauccgccaauuguuuucuggauagccucuaugaaggccaggacuucgacugcaacgugucucgggcgcgcuuugagcugcuuuguuccccucuguucaacaagugcaucgaggcuaucagagggcuccuggaucaaaauggauuuaccgccgacgauauuaacaaaguugugcuuuguggcgggagcucucggauccccaagcugcagcagcucauuaaagaccuguucccugccgucgaacugcucaauagcaucccgcccgaugaggugauuccuaucggagcugccaucgaagcuggcauucugaucggcaaggagaaccuucuggucgaagacucccucaugauugagugcucugcccgcgauauccuggugaaggggguugacgagagcggagcguccagauucacggugcuuuuucccagcggcacaccucugcccgcccggagacagcacacccuccaagcuccggggucuauuuccagcgucugucuggaacuguacgagucugauggcaaaaauuccgccaaggaagagacaaaauucgcucaggugguucuccaggaccuggauaagaaagaaaacggacuucgcgacauccuggccgugcucaccaugaagcgggacgggagccugcacgugaccugcacagaucaagagacgggcaagugugaggcgaucuccauugaaaucgccucuuga

SEQ ID NO: 7688 - RNA, 1530 nt, Artificial Sequence
  derived and/or modified sequence opt6 from HSP60__Homo_sapiens__AAI19691
auggcagcaauaggaguacaucuagguuguacaucagcaugcguagcaguuuacaaagauggaagagcaggaguaguagcaaacgacgcaggugauagaguaacaccagcgguuguagccuauucagaaaaugaagaaauaguaggauuagcugcaaaacaaucaagaauaagaaauauaaguaacacaguaaugaaaguaaaacaaauacuaggaagaaguaguagcgacccacaagcacaaaaauauauagcagaaaguaaauguuuagucauagaaaaaaauggaaaacucagauacgaaauagauacaggagaagaaacaaaauuuguaaaucccgaagacguugcaagacuaauauucagcaaaaugaaagaaacugcucauucaguacuaggaucagaugcaaaugauguaguaauaacaguaccauuugauuuuggagaaaaacaaaaaaaugcauuaggagaagcagcaagagcagccggauuuaauguauuaagauuaauacacgaaccaucugcagcauuacuagcauaugggauuggacaagauucaccaacuggaaagagcaacauacuaguauucaaacuuggugggacuagucuaucguuaaguguaauggaagucaacagcggaauuuacagaguacuaucaacaaauacggacgacaacauagguggagcacacuuuacagaaacacuagcacaguacuuagcauccgaauuucaaagguccuucaaacaugacguaaggggaaaugcaagagccaugaugaaauuaacaaauagcgcagaaguagcaaaacauucauuaucaacauuaggaucugccaauugcuuucuggauaguuuauacgaaggacaagacuucgacugcaauguuaguagagcuagauuugaauuauuauguagcccauuauucaauaaauguauagaagcaauacgaggacuacuagaccaaaauggauucacagcagaugacauaaacaagguuguauuauguggaggaaguucacgaauaccaaaauuacaacaacuaauuaaagaccuauucccagcaguagagcuauugaauagcauaccacccgacgaaguaauaccaauuggagcagcuauagaagcaggaauauuaauaggaaaagaaaacuuauuaguagaagacagccuaaugauagaaugcagcgcuagagacauauuaguuaaaggcguugaugaaagcggagcaucuagauuuacaguacucuucccaagcggaacaccccuaccagcaagaagacaacacacauuacaagccccaggaucaauaucaaguguaugccuugaacuuuacgaaucagauggaaaaaacagugcaaaggaagagacaaaauuugcacaaguaguacuacaagaucuagacaaaaaagaaaauggccuaagagauauauuagcaguacuaacaaugaagagagacggaagccuacauguaaccugcaccgaucaagaaacaggaaaaugcgaagcaauaucaauagaaauagcaucauaa

SEQ ID NO: 7689 - protein, 679 aa, Artificial Sequence
  HSP70__Homo_sapiens__P38646
MISASRAAAARLVGAAASRGPTAARHQDSWNGLSHEAFRLVSRRDYASEAIKGAVVGIDLGTTNSCVAVMEGKQAKVLENAEGARTTPSVVAFTADGERLVGMPAKRQAVTNPNNTFYATKRLIGRRYDDPEVQKDIKNVPFKIVRASNGDAWVEAHGKLYSPSQIGAFVLMKMKETAENYLGHTAKNAVITVPAYFNDSQRQATKDAGQISGLNVLRVINEPTAAALAYGLDKSEDKVIAVYDLGGGTFDISILEIQKGVFEVKSTNGDTFLGGEDFDQALLRHIVKEFKRETGVDLTKDNMALQRVREAAEKAKCELSSSVQTDINLPYLTMDSSGPKHLNMKLTRAQFEGIVTDLIRRTIAPCQKAMQDAEVSKSDIGEVILVGGMTRMPKVQQTVQDLFGRAPSKAVNPDEAVAIGAAIQGGVLAGDVTDVLLLDVTPLSLGIETLGGVFTKLINRNTTIPTKKSQVFSTAADGQTQVEIKVCQGEREMAGDNKLLGQFTLIGIPPAPRGVPQIEVTFDIDANGIVHVSAKDKGTGREQQIVIQSSGGLSKDDIENMVKNAEKYAEEDRRKKERVEAVNMAEGIIHDTETKMEEFKDQLPADECNKLKEEISKMRELLARKDSETGENIRQAASSLQQASLKLFEMAYKKMASEREGSGSSGTGEQKEDQKEEKQ

SEQ ID NO: 7690 - RNA, 2040 nt, Artificial Sequence
  HSP70__Homo_sapiens__ABF50973
augauaagugccagccgagcugcagcagcccgucucgugggcgccgcagccucccggggcccuacggccgcccgccaccaggauagcuggaauggccuuagucaugaggcuuuuagacuuguuucaaggcgggauuaugcaucagaagcaaucaagggagcaguuguugguauugauuuggguacuaccaacuccugcguggcaguuauggaagguaaacaagcaaaggugcuggagaaugccgaaggugccagaaccaccccuucaguuguggccuuuacagcagauggugagcgacuuguuggaaugccggccaagcgacaggcugucaccaacccaaacaauacauuuuaugcuaccaagcgucucauuggccggcgauaugaugauccugaaguacagaaagacauuaaaaauguucccuuuaaaauuguccgugccuccaauggugaugccuggguugaggcucaugggaaauuguauucuccgagucagauuggagcauuuguguugaugaagaugaaagagacugcagaaaauuacuuggggcacacagcaaaaaaugcugugaucacagucccagcuuauuucaaugacucgcagagacaggccacuaaagaugcuggccagauaucuggacugaaugugcuucgggugauuaaugagcccacagcugcugcucuugccuauggucuagacaaaucagaagacaaagucauugcuguauaugauuuaggugguggaacuuuugauauuucuauccuggaaauucagaaaggaguauuugaggugaaauccacaaauggggauaccuucuuagguggggaagacuuugaccaggccuugcuacggcacauugugaaggaguucaagagagagacagggguugauuugacuaaagacaacauggcacuucagaggguacgggaagcugcugaaaaggcuaaaugugaacucuccucaucugugcagacugacaucaauuugcccuaucuuacaauggauucuucuggacccaagcauuugaauaugaaguugacccgugcucaauuugaagggauugucacugaucuaaucagaaggacuaucgcuccaugccaaaaagcuaugcaagaugcagaagucagcaagagugacauaggagaagugauucuuguggguggcaugacuaggaugcccaagguucagcagacuguacaggaucuuuuuggcagagccccaaguaaagcugucaauccugaugaggcuguggccauuggagcugccauucagggagguguguuggccggcgaugucacggaugugcugcuccuugaugucacuccccugucucuggguauugaaacucuaggaggugucuuuaccaaacuuauuaauaggaauaccacuauuccaaccaagaagagccagguauucucuacugccgcugauggucaaacgcaaguggaaauuaaagugugucagggugaaagagagauggcuggagacaacaaacuccuuggacaguuuacuuugauuggaauuccaccagccccucguggaguuccucagauugaaguuacauuugacauugaugccaaugggauaguacauguuucugcuaaagauaaaggcacaggacgugagcagcagauuguaauccagucuucugguggauuaagcaaagaugauauugaaaauaugguuaaaaaugcagagaaauaugcugaagaagaccggcgaaagaaggaacgaguugaagcaguuaauauggcugaaggaaucauucacgacacagaaaccaagauggaagaauucaaggaccaauuaccugcugaugagugcaacaagcugaaagaagagauuuccaaaaugagggagcuccuggcuagaaaagacagcgaaacaggagaaaauauuagacaggcagcauccucucuucagcaggcaucauugaagcuguucgaaauggcauacaaaaagauggcaucugagcgagaaggcucuggaaguucuggcacuggggaacaaaaggaagaucaaaaggaggaaaaacaguaa

SEQ ID NO: 7691 - RNA, 2040 nt, Artificial Sequence
  derived and/or modified sequence opt1 from HSP70__Homo_sapiens__ABF50973
augaucagcgccucccgcgccgcggccgcccggcuggugggcgccgccgcgagccgcgggcccaccgccgcccggcaccaggacuccuggaacggccucagccacgaggccuuccgccuggucucccggcgcgacuacgcgagcgaggccaucaagggggccguggugggcaucgaccuggggaccacgaacuccugcgucgccgugauggagggcaagcaggccaaggugcucgagaacgcggagggcgcccggaccaccccgagcgucguggccuucaccgccgacggggagcgccuggugggcaugcccgccaagcggcaggcggucacgaaccccaacaacaccuucuacgccaccaagcgccugaucgggcggcgcuacgacgaccccgaggugcagaaggacaucaagaacgugccguucaagaucguccgggccuccaacggcgacgccuggguggaggcccacgggaagcucuacagccccucccagaucggcgcguucgugcugaugaagaugaaggagaccgccgagaacuaccugggccacacggccaagaacgccgucaucaccgugcccgccuacuucaacgacagccagcgccaggcgaccaaggacgccgggcagaucuccggccucaacgugcugcgggucaucaacgagcccaccgccgccgcgcuggccuacgggcucgacaagagcgaggacaaggugaucgccguguacgaccugggcggcgggacguucgacaucuccauccuggagauccagaagggcgucuucgaggucaagagcaccaacggggacaccuuccucggcggggaggacuucgaccaggcccugcugcgccacaucgugaaggaguucaagcgggagaccggcguggaccucacgaaggacaacauggcccugcagcgcgugcgggaggcggccgagaaggccaagugcgagcuguccagcuccguccagaccgacaucaaccucccguaccugaccauggacagcagcggccccaagcaccugaacaugaagcucacccgcgcccaguucgaggggaucgugacggaccugauccggcgcaccaucgcccccugccagaaggcgaugcaggacgccgagguguccaagagcgacaucggcgaggucauccuggucgggggcaugacccgcaugcccaaggugcagcagaccgugcaggaccucuucgggcgggccccguccaaggccgugaaccccgacgaggccguggcgaucggcgccgccauccagggcgggguccuggccggcgacgugacggacgugcugcuccuggacgucacgccccugagccucgggaucgagacccugggcgggguguucaccaagcugaucaaccgcaacaccaccauccccaccaagaagucccagguguucagcaccgcggccgacggccagacgcaggucgagaucaaggugugccagggcgagcgggagauggccggggacaacaagcuccugggccaguucacccugaucgggaucccgcccgcgccccgcggcgugccccagaucgaggucaccuucgacaucgacgccaacggcaucgugcacguguccgccaaggacaaggggaccggccgggagcagcagaucgucauccagagcuccgggggccucagcaaggacgacaucgagaacauggugaagaacgccgagaaguacgccgaggaggaccgccggaagaaggagcgcguggaggccgucaacauggccgaggggaucauccacgacacggagaccaagauggaggaguucaaggaccagcugccggcggacgagugcaacaagcugaaggaggagaucuccaagaugcgggagcuccuggcccgcaaggacagcgagaccggcgagaacauccggcaggccgccuccagccugcagcaggccucccucaagcuguucgagauggcguacaagaagauggccagcgagcgcgagggcuccgggagcuccggcaccggggagcagaaggaggaccagaaggaggagaagcaguga

SEQ ID NO: 7692 - RNA, 2040 nt, Artificial Sequence
  derived and/or modified sequence opt2 from HSP70__Homo_sapiens__ABF50973
augaucuccgccucccgcgccgccgccgcccgccucgucggcgccgccgccucccgcggccccaccgccgcccgccaccaggacuccuggaacggccucucccacgaggccuuccgccucgucucccgccgcgacuacgccuccgaggccaucaagggcgccgucgucggcaucgaccucggcaccaccaacuccugcgucgccgucauggagggcaagcaggccaagguccucgagaacgccgagggcgcccgcaccacccccuccgucgucgccuucaccgccgacggcgagcgccucgucggcaugcccgccaagcgccaggccgucaccaaccccaacaacaccuucuacgccaccaagcgccucaucggccgccgcuacgacgaccccgagguccagaaggacaucaagaacguccccuucaagaucguccgcgccuccaacggcgacgccugggucgaggcccacggcaagcucuacucccccucccagaucggcgccuucguccucaugaagaugaaggagaccgccgagaacuaccucggccacaccgccaagaacgccgucaucaccguccccgccuacuucaacgacucccagcgccaggccaccaaggacgccggccagaucuccggccucaacguccuccgcgucaucaacgagcccaccgccgccgcccucgccuacggccucgacaaguccgaggacaaggucaucgccgucuacgaccucggcggcggcaccuucgacaucuccauccucgagauccagaagggcgucuucgaggucaaguccaccaacggcgacaccuuccucggcggcgaggacuucgaccaggcccuccuccgccacaucgucaaggaguucaagcgcgagaccggcgucgaccucaccaaggacaacauggcccuccagcgcguccgcgaggccgccgagaaggccaagugcgagcucuccuccuccguccagaccgacaucaaccuccccuaccucaccauggacuccuccggccccaagcaccucaacaugaagcucacccgcgcccaguucgagggcaucgucaccgaccucauccgccgcaccaucgcccccugccagaaggccaugcaggacgccgaggucuccaaguccgacaucggcgaggucauccucgucggcggcaugacccgcaugcccaagguccagcagaccguccaggaccucuucggccgcgcccccuccaaggccgucaaccccgacgaggccgucgccaucggcgccgccauccagggcggcguccucgccggcgacgucaccgacguccuccuccucgacgucaccccccucucccucggcaucgagacccucggcggcgucuucaccaagcucaucaaccgcaacaccaccauccccaccaagaagucccaggucuucuccaccgccgccgacggccagacccaggucgagaucaaggucugccagggcgagcgcgagauggccggcgacaacaagcuccucggccaguucacccucaucggcaucccccccgccccccgcggcgucccccagaucgaggucaccuucgacaucgacgccaacggcaucguccacgucuccgccaaggacaagggcaccggccgcgagcagcagaucgucauccaguccuccggcggccucuccaaggacgacaucgagaacauggucaagaacgccgagaaguacgccgaggaggaccgccgcaagaaggagcgcgucgaggccgucaacauggccgagggcaucauccacgacaccgagaccaagauggaggaguucaaggaccagcuccccgccgacgagugcaacaagcucaaggaggagaucuccaagaugcgcgagcuccucgcccgcaaggacuccgagaccggcgagaacauccgccaggccgccuccucccuccagcaggccucccucaagcucuucgagauggccuacaagaagauggccuccgagcgcgagggcuccggcuccuccggcaccggcgagcagaaggaggaccagaaggaggagaagcaguga

SEQ ID NO: 7693 - RNA, 2040 nt, Artificial Sequence
  derived and/or modified sequence opt3 from HSP70__Homo_sapiens__ABF50973
augaucagcgccuccagagcugcagccgcgaggcuggugggcgcugccgcaucucgggggcccaccgccgcucgccaccaggacucauggaacggacucagucaugaggcauuccgacuugucagccguagagauuacgccuccgaagcuauuaagggugccguugugggcauagaccuggggacaacuaauucuugcguagcggugauggagggaaaacaagcaaaggucuuggaaaacgccgagggcgcuaggacgaccccuucggugguugccuuuacagcagauggugaacgguuaguggggaugccagcuaaacgccaggccgucacuaauccgaacaauaccuucuaugcgacaaagagacugaucggaaggcgguacgacgaucccgaggugcagaaagacauuaagaacguaccuuuuaagaucguucgcgccucaaauggcgaugcauggguggaggcucacggcaaacuauauagcccaagucagauuggggccuucguccucaugaagaugaaagaaaccgcugagaacuaccugggacauacugccaagaaugcagugaucacagugcccgccuauuuuaacgacucccaacgacaggcuaccaaagaugcgggucagauaucuggccuuaauguccugagaguuaucaacgaaccuacggcagccgcuuuggccuacgggcucgacaagagcgaggauaaggugauugcaguauaugaccugggaggcgguacuuucgauaucuccauucuggagauccagaaagggguguuugaagucaagucaaccaauggagacacauuccucggcggcgaggacuuugaucaagccuuacugaggcacauagugaaagaguucaagcgggaaacugggguugaccuuaccaaagauaacauggcuuugcagcgugugcgcgaagccgcagagaaggcgaaaugugagcugaguagcucuguccagacagacauuaaucuaccauaccucaccauggauuccucaggacccaagcaucugaacaugaaguugacgagagcucaguuugaagguaucgugacugaccugauuaggcggacaaucgccccuugccaaaaagcaaugcaggaugccgagguaagcaagagugacaucggcgaaguuauuuuggucgggggaaugacccgaaugccaaaagugcagcaaacugugcaggaucucuucggccgcgcuccgucuaaggccgucaaccccgacgaggcaguggcuauaggugccgcgauccaagggggcguucuggccggagaugugacagacguauuacugcucgacgucaccccucuuucccugggcauugaaacgcuugggggaguguuuaccaaacuaaucaauagaaacacaacuauaccaaccaaaaagagccagguuuucucgacagcugcagauggucagacucagguggagauuaaggucugucagggcgagagggaaauggccggggacaauaagcugcucggacaguucacccugaucggcauucccccugcuccacggggugugccccaaaucgagguaacauuugauaucgacgccaacgggauugugcacguuucugcaaaagauaagggcaccggacgcgaacagcagauagucauccaguccucaggcgggcuuaguaaagacgauauugagaauauggugaagaacgcggaaaaguacgccgaggaggacagaaggaaaaaggaacguguggaggcugucaauauggccgaaggaaucauccacgauacugagacgaaaauggaggaguucaaggaccaacugccggcagaugaaugcaacaaauugaaggaagagauuagcaagaugcgggaacuccuggcucgaaaagacuccgagacaggugagaauauaagacaggccgcaucuagcuuacagcaggccucacugaagcuauuugaaauggcuuauaaaaagauggcgagugagagggaaggcuccgggagcucuggaaccggcgagcaaaaagaagaucagaaggaggagaaacaguga

SEQ ID NO: 7694 - RNA, 2040 nt, Artificial Sequence
  derived and/or modified sequence opt4 from HSP70__Homo_sapiens__ABF50973
augaucagcgccagcagagccgccgccgccagacuggugggcgccgccgccagcagaggccccaccgccgccagacaccaggacagcuggaacggccugagccacgaggccuucagacuggugagcagaagagacuacgccagcgaggccaucaagggcgccguggugggcaucgaccugggcaccaccaacagcugcguggccgugauggagggcaagcaggccaaggugcuggagaacgccgagggcgccagaaccacccccagcgugguggccuucaccgccgacggcgagagacuggugggcaugcccgccaagagacaggccgugaccaaccccaacaacaccuucuacgccaccaagagacugaucggcagaagauacgacgaccccgaggugcagaaggacaucaagaacgugcccuucaagaucgugagagccagcaacggcgacgccuggguggaggcccacggcaagcuguacagccccagccagaucggcgccuucgugcugaugaagaugaaggagaccgccgagaacuaccugggccacaccgccaagaacgccgugaucaccgugcccgccuacuucaacgacagccagagacaggccaccaaggacgccggccagaucagcggccugaacgugcugagagugaucaacgagcccaccgccgccgcccuggccuacggccuggacaagagcgaggacaaggugaucgccguguacgaccugggcggcggcaccuucgacaucagcauccuggagauccagaagggcguguucgaggugaagagcaccaacggcgacaccuuccugggcggcgaggacuucgaccaggcccugcugagacacaucgugaaggaguucaagagagagaccggcguggaccugaccaaggacaacauggcccugcagagagugagagaggccgccgagaaggccaagugcgagcugagcagcagcgugcagaccgacaucaaccugcccuaccugaccauggacagcagcggccccaagcaccugaacaugaagcugaccagagcccaguucgagggcaucgugaccgaccugaucagaagaaccaucgcccccugccagaaggccaugcaggacgccgaggugagcaagagcgacaucggcgaggugauccuggugggcggcaugaccagaaugcccaaggugcagcagaccgugcaggaccuguucggcagagcccccagcaaggccgugaaccccgacgaggccguggccaucggcgccgccauccagggcggcgugcuggccggcgacgugaccgacgugcugcugcuggacgugaccccccugagccugggcaucgagacccugggcggcguguucaccaagcugaucaacagaaacaccaccauccccaccaagaagagccagguguucagcaccgccgccgacggccagacccagguggagaucaaggugugccagggcgagagagagauggccggcgacaacaagcugcugggccaguucacccugaucggcaucccccccgcccccagaggcgugccccagaucgaggugaccuucgacaucgacgccaacggcaucgugcacgugagcgccaaggacaagggcaccggcagagagcagcagaucgugauccagagcagcggcggccugagcaaggacgacaucgagaacauggugaagaacgccgagaaguacgccgaggaggacagaagaaagaaggagagaguggaggccgugaacauggccgagggcaucauccacgacaccgagaccaagauggaggaguucaaggaccagcugcccgccgacgagugcaacaagcugaaggaggagaucagcaagaugagagagcugcuggccagaaaggacagcgagaccggcgagaacaucagacaggccgccagcagccugcagcaggccagccugaagcuguucgagauggccuacaagaagauggccagcgagagagagggcagcggcagcagcggcaccggcgagcagaaggaggaccagaaggaggagaagcaguga

SEQ ID NO: 7695 - RNA, 2040 nt, Artificial Sequence
  derived and/or modified sequence opt5 from HSP70__Homo_sapiens__ABF50973
augaucagcgccuccagagcugccgcggcucggcuggugggcgccgccgcuucucgcgggcccaccgccgcuagacaccaggacagcuggaacggacucucccaugaggccuuccggcuggucucucgcagagauuacgcgagcgaagccauuaagggcgcuguuguggggaucgaccuuggaacaacgaauagcugcguggccgucauggagggcaaacaagcuaaggugcuggaaaacgccgagggggcgcggaccacaccuucuguuguggccuuuaccgcugauggagaacgccucgucggcaugccggccaaaagacaggcugugacaaaucccaacaauaccuucuaugccacaaagcggcugauuggccgcagauacgacgauccugagguucagaaagacaucaagaacgugcccuuuaagauuguccgggccagcaauggggaugcuuggguggaggcgcacggaaaacuuuauuccccuagccagaucggcgccuucgugcugaugaagaugaaagaaaccgcugagaacuaccucgggcauacggccaagaaugccgucaucaccguucccgcuuauuuuaacgacucucaacgccaggccacaaaagaugcgggacagauuuccggccugaaugugcugagagugaucaacgaaccuaccgcugccgcccucgcuuacgggcuggacaagagcgaggauaaggucauugccguguaugaccuuggaggcggcacauucgauaucucuauucuggagauccagaaagggguuuuugaagugaaguccaccaauggagacacguuccucggcggggaggacuuugaucaagcucugcuucggcacauugucaaagaguucaagcgcgaaacaggaguggaccugaccaaagauaacauggcccuccagagaguucgggaagcggccgagaaggcuaaaugugagcuguccucuuccgugcagacagacaucaaucugccguaccucaccauggauagcuccggccccaagcaucugaacaugaaacuuaccagagcccaguuugaagggaucgucacagaccugauucgccggacgaucgcuccuugccaaaaggccaugcaggaugcggaggugucuaagagcgacauuggagaagucauccucgugggcggcaugaccagaaugcccaaaguucagcaaacagugcaggaucuguucgggcgcgccccuuccaaggcugucaaccccgacgaggccguggcuauuggagccgccauccagggcgggguucuugcuggagaugugaccgacguccugcuccuggacgugacaccgcugagccucggcaucgaaacccugggcggcguguuuacgaaacuuauuaaucggaacacaaccaucccuaccaagaagucucagguuuucuccacagcggccgauggacaaacccaggucgagauuaaagugugucagggcgagagagaaauggcuggggacaauaagcugcucggacaguucacacugaucggcauucccccugcuccccgcggggugccccaaaucgaggucacguuugauaucgacgccaacggaauugugcacguuagcgccaaagauaagggcaccgggcgggaacagcagaucgugauucagucuagcggcggacuuuccaaagacgauaucgagaauauggucaagaacgccgaaaaguacgcggaggaggacagacgcaaaaaggaacggguggaggcuguuaauauggccgaaggcauuauccacgauacagagaccaaaauggaggaguucaaggaccaacugccugccgaugaaugcaacaaacucaaggaagagauuucuaagaugagagaacugcuggcucgcaaagacagcgagacaggggagaauauccggcaggccgcguccagccuccagcaggcuucucugaaacuuuuugaaauggccuauaagaagauggccuccgagagagaaggaagcgggucuuccgggaccggagagcaaaaagaagaucagaaggaggagaaacaguga

SEQ ID NO: 7696 - RNA, 2040 nt, Artificial Sequence
  derived and/or modified sequence opt6 from HSP70__Homo_sapiens__ABF50973
augauauccgcaagcagagcagcagcagcaagauuaguaggugcugcagcaucaagaggaccaacagcggcaaggcaucaagacaguuggaacggauuaucacaugaggcauucagauuaguaagcagaagagauuaugcaagcgaagcuauaaaaggagcaguaguagggauagaucuaggaacaacaaauagcuguguagcggugauggaaggaaaacaagcaaaaguauuagaaaacgcugaaggagcaagaacaacuccaaguguaguagcauucacagcagauggcgaaagauuaguaggaaugccggcaaaaagacaagcagugacaaauccaaauaacacauuuuaugcaacaaaaagacuaauugggaggagguaugaugauccagaaguacaaaaagauauaaaaaaugugccguuuaaaauaguaagagccaguaacggagacgcuuggguugaagcucacggaaaauuauauucuccaucacaaauaggggcauuuguacucaugaaaaugaaagaaacugcggaaaacuaucugggccauacggcaaaaaaugcaguuauaacaguaccagcuuacuucaaugauagccaaagacaagcaacaaaagaugcaggucaaauaagugguuuaaauguacuucguguaauaaaugaacccacagcggcagcacuagcauacggauuagauaaaucagaagacaaaguaauagccguuuacgaucugggagggggaacauuugauauaagcauccuagaaauucaaaaagggguauucgaaguaaaaaguacaaauggagacacguuccucggaggugaagauuucgaucaagcacuucuaaggcauauaguaaaagaauuuaaaagagaaaccgguguugaccuaacaaaagacaauauggcguugcaaagaguaagagaggcugcagaaaaagcaaaaugcgaacuaucaagcaguguacaaacagauauaaaucugccguauuuaacaauggauucaucaggaccgaaacauuuaaauaugaaacuuacaagagcccaauuugaaggaauagucacggacuuaauaagaaggacgauagcaccaugucaaaaagcaaugcaagaugcagaaguaaguaaaagcgacauaggagaagucauuuugguaggggguaugacuagaaugccaaaaguccaacaaacaguccaagauuuauucggaagagcgccaagcaaagcuguaaauccagaugaagcaguagcgauaggagcagcaauacaaggaggaguauuggcuggagauguuacugacguauuauuauuggacgugacaccauuaaguuuaggaauagaaacauuaggagggguauuuacaaaauuaauaaauagaaauacaaccauucccacaaaaaaaucacaaguauucaguacagcagcugauggucaaacacaaguugaaauaaaaguaugucaaggcgaaagagaaauggcaggugauaauaaauuauuaggacaauucacacuaauagguauaccaccugcuccuagaggaguuccucaaauugaaguuacuuuugacauagacgcaaacggaauaguacauguaagugcaaaagacaaaggaacaggaagagaacaacagauaguaauacaaaguagcggaggauuaucaaaagacgauauagaaaauauggucaaaaaugcugaaaaauaugcagaggaagaucgacggaaaaaagaaaggguagaagcggugaauauggcugaaggaauaauacaugauacggagacaaaaauggaggaauuuaaagaucaauuaccggcugacgaaugcaauaaauuaaaagaagaaauaagcaaaaugcgagaauugcuggcacgaaaagauagcgaaacaggcgaaaauauuagacaagcagcaaguagcuuacaacaagcaucuuuaaaacuauuugaaauggcguauaaaaagauggcaagugaaagagaaggaaguggaagcucaggaacgggagaacaaaaagaagaucaaaaagaagaaaaacaauaa

SEQ ID NO: 7697 - protein, 732 aa, Artificial Sequence
  HSP90__Homo_sapiens__P07900
MPEETQTQDQPMEEEEVETFAFQAEIAQLMSLIINTFYSNKEIFLRELISNSSDALDKIRYESLTDPSKLDSGKELHINLIPNKQDRTLTIVDTGIGMTKADLINNLGTIAKSGTKAFMEALQAGADISMIGQFGVGFYSAYLVAEKVTVITKHNDDEQYAWESSAGGSFTVRTDTGEPMGRGTKVILHLKEDQTEYLEERRIKEIVKKHSQFIGYPITLFVEKERDKEVSDDEAEEKEDKEEEKEKEEKESEDKPEIEDVGSDEEEEKKDGDKKKKKKIKEKYIDQEELNKTKPIWTRNPDDITNEEYGEFYKSLTNDWEDHLAVKHFSVEGQLEFRALLFVPRRAPFDLFENRKKKNNIKLYVRRVFIMDNCEELIPEYLNFIRGVVDSEDLPLNISREMLQQSKILKVIRKNLVKKCLELFTELAEDKENYKKFYEQFSKNIKLGIHEDSQNRKKLSELLRYYTSASGDEMVSLKDYCTRMKENQKHIYYITGETKDQVANSAFVERLRKHGLEVIYMIEPIDEYCVQQLKEFEGKTLVSVTKEGLELPEDEEEKKKQEEKKTKFENLCKIMKDILEKKVEKVVVSNRLVTSPCCIVTSTYGWTANMERIMKAQALRDNSTMGYMAAKKHLEINPDHSIIETLRQKAEADKNDKSVKDLVILLYETALLSSGFSLEDPQTHANRIYRMIKLGLGIDEDDPTADDTSAAVTEEMPPLEGDDDTSRMEEVD

SEQ ID NO: 7698 - RNA, 2199 nt, Artificial Sequence
  HSP90__Homo_sapiens__AAA63194
augccugaggaaacccagacccaagaccaaccgauggaggaggaggagguugagacguucgccuuucaggcagaaauugcccaguugaugucauugaucaucaauacuuucuacucgaacaaagagaucuuucugagagagcucauuucaaauucaucagaugcauuggacaaaauccgguaugaaagcuugacagaucccaguaaauuagacucugggaaagagcugcauauuaaccuuauaccgaacaaacaagaucgaacucucacuauuguggauacuggaauuggaaugaccaaggcugacuugaucaauaaccuugguacuaucgccaagucugggaccaaagcguucauggaagcuuugcaggcuggugcagauaucucuaugauuggccaguucgguguugguuuuuauucugcuuauuugguugcugagaaaguaacugugaucaccaaacauaacgaugaugagcaguacgcuugggaguccucagcagggggaucauucacagugaggacagacacaggugaaccuaugggucguggaacaaaaguuauccuacaccugaaagaagaccaaacugaguacuuggaggaacgaagaauaaaggagauugugaagaaacauucucaguuuauuggauaucccauuacucuuuuuguggagaaggaacgugauaaagaaguaagcgaugaugaggcugaagaaaaggaagacaaagaagaagaaaaagaaaaagaagagaaagagucggaagacaaaccugaaauugaagauguugguucugaugaggaagaagaaaagaaggauggugacaagaagaagaagaagaagauuaaggaaaaguacaucgaucaagaagagcucaacaaaacaaagcccaucuggaccagaaaucccgacgauauuacuaaugaggaguacggagaauucuauaagagcuugaccaaugacugggaagaucacuuggcagugaagcauuuuucaguugaaggacaguuggaauucagagcccuucuauuugucccacgacgugcuccuuuugaucuguuugaaaacagaaagaaaaagaacaacaucaaauuguauguacgcagaguuuucaucauggauaacugugaggagcuaaucccugaauaucugaacuucauuagaggggugguagacucggaggaucucccucuaaacauaucccgugagauguugcaacaaagcaaaauuuugaaaguuaucaggaagaauuuggucaaaaaaugcuuagaacucuuuacugaacuggcggaagauaaagagaacuacaagaaauucuaugagcaguucucuaaaaacauaaagcuuggaauacacgaagacucucaaaaucggaagaagcuuucagagcuguuaagguacuacacaucugccucuggugaugagaugguuucucucaaggacuacugcaccagaaugaaggagaaccagaaacauaucuauuauaucacaggugagaccaaggaccagguagcuaacucagccuuuguggaacgucuucggaaacauggcuuagaagugaucuauaugauugagcccauugaugaguacuguguccaacagcugaaggaauuugaggggaagacuuuagugucagucaccaaagaaggccuggaacuuccagaggaugaagaagagaaaaagaagcaggaagagaaaaaaacaaaguuugagaaccucugcaaaaucaugaaagacauauuggagaaaaaaguugaaaaggugguugugucaaaccgauuggugacaucuccaugcuguauugucacaagcacauauggcuggacagcaaacauggagagaaucaugaaagcucaagcccuaagagacaacucaacaauggguuacauggcagcaaagaaacaccuggagauaaacccugaccauuccauuauugagaccuuaaggcaaaaggcagaggcugauaagaacgacaagucugugaaggaucuggucaucuugcuuuaugaaacugcgcuccugucuucuggcuucagucuggaagauccccagacacaugcuaacaggaucuacaggaugaucaaacuuggucuggguauugaugaagaugacccuacugcugaugauaccagugcugcuguaacugaagaaaugccaccccuugaaggagaugacgacacaucacgcauggaagaaguagacuaa

SEQ ID NO: 7699 - RNA, 2199 nt, Artificial Sequence
  derived and/or modified sequence opt1 from HSP90__Homo_sapiens__AAA63194
augcccgaggagacccagacccaggaccagcccauggaggaggaggagguggagacguucgccuuccaggccgagaucgcgcagcugaugagccucaucaucaacaccuucuacuccaacaaggagaucuuccugcgcgagcugaucagcaacuccagcgacgcccucgacaagauccgguacgagucccugaccgaccccagcaagcuggacuccggcaaggagcuccacaucaaccugauccccaacaagcaggaccgcacccugacgaucgucgacaccgggaucggcaugaccaaggccgaccucaucaacaaccuggggaccaucgccaagagcggcacgaaggccuucauggaggcgcugcaggccggggccgacaucuccaugaucggccaguucggcgugggguucuacagcgccuaccucguggcggagaaggucaccgugaucaccaagcacaacgacgacgagcaguacgccugggaguccagcgccggcggguccuucaccgugcggacggacaccggcgagcccauggggcgcggcaccaaggucauccugcaccugaaggaggaccagaccgaguaccucgaggagcggcgcaucaaggagaucgugaagaagcacagccaguucaucggcuacccgaucacgcuguucguggagaaggagcgggacaaggaggucuccgacgacgaggccgaggagaaggaggacaaggaggaggagaaggagaaggaggagaaggagagcgaggacaagcccgagaucgaggacgugggguccgacgaggaggaggagaagaaggacggcgacaagaagaagaagaagaagaucaaggagaaguacaucgaccaggaggagcugaacaagaccaagcccaucuggacccgcaaccccgacgacaucaccaacgaggaguacggggaguucuacaagagccucacgaacgacugggaggaccaccuggccgugaagcacuucuccgucgagggccagcuggaguuccgggcgcuccuguucgugccgcgccgggcccccuucgaccuguucgagaaccgcaagaagaagaacaacaucaagcucuacgugcggcgcgucuucaucauggacaacugcgaggagcugauccccgaguaccugaacuucauccggggcgugguggacagcgaggaccucccccugaacaucagccgcgagaugcugcagcaguccaagauccucaaggucauccggaagaaccuggugaagaagugccuggagcuguucaccgagcucgccgaggacaaggagaacuacaagaaguucuacgagcaguucagcaagaacaucaagcuggggauccacgaggacucccagaaccgcaagaagcucagcgagcugcugcgguacuacaccuccgccagcggcgacgagauggugucccucaaggacuacugcacccgcaugaaggagaaccagaagcacaucuacuacaucacgggggagaccaaggaccaggucgccaacagcgcguucguggagcggcugcgcaagcacggccuggaggugaucuacaugaucgagccgaucgacgaguacugcguccagcagcucaaggaguucgaggggaagacccugguguccgucaccaaggagggccuggagcuccccgaggacgaggaggagaagaagaagcaggaggagaagaagacgaaguucgagaaccugugcaagaucaugaaggacauccuggagaagaagguggagaagguggucgugagcaaccgccucgugaccucccccugcugcaucgucaccagcaccuacggcuggacggccaacauggagcggaucaugaaggcccaggcccugcgcgacaacuccaccaugggguacauggccgcgaagaagcaccuggagaucaaccccgaccacagcaucaucgagacccugcggcagaaggccgaggccgacaagaacgacaaguccgugaaggaccucgugauccugcuguacgagaccgcccuccugagcuccggcuucagccuggaggacccgcagacgcacgccaaccgcaucuaccggaugaucaagcucgggcugggcaucgacgaggacgaccccaccgcggacgacaccuccgccgccgucaccgaggagaugccgccccuggagggggacgacgacaccagccgcauggaggagguggacuga

SEQ ID NO: 7700 - RNA, 2199 nt, Artificial Sequence
  derived and/or modified sequence opt2 from HSP90__Homo_sapiens__AAA63194
augcccgaggagacccagacccaggaccagcccauggaggaggaggaggucgagaccuucgccuuccaggccgagaucgcccagcucaugucccucaucaucaacaccuucuacuccaacaaggagaucuuccuccgcgagcucaucuccaacuccuccgacgcccucgacaagauccgcuacgagucccucaccgaccccuccaagcucgacuccggcaaggagcuccacaucaaccucauccccaacaagcaggaccgcacccucaccaucgucgacaccggcaucggcaugaccaaggccgaccucaucaacaaccucggcaccaucgccaaguccggcaccaaggccuucauggaggcccuccaggccggcgccgacaucuccaugaucggccaguucggcgucggcuucuacuccgccuaccucgucgccgagaaggucaccgucaucaccaagcacaacgacgacgagcaguacgccugggaguccuccgccggcggcuccuucaccguccgcaccgacaccggcgagcccaugggccgcggcaccaaggucauccuccaccucaaggaggaccagaccgaguaccucgaggagcgccgcaucaaggagaucgucaagaagcacucccaguucaucggcuaccccaucacccucuucgucgagaaggagcgcgacaaggaggucuccgacgacgaggccgaggagaaggaggacaaggaggaggagaaggagaaggaggagaaggaguccgaggacaagcccgagaucgaggacgucggcuccgacgaggaggaggagaagaaggacggcgacaagaagaagaagaagaagaucaaggagaaguacaucgaccaggaggagcucaacaagaccaagcccaucuggacccgcaaccccgacgacaucaccaacgaggaguacggcgaguucuacaagucccucaccaacgacugggaggaccaccucgccgucaagcacuucuccgucgagggccagcucgaguuccgcgcccuccucuucgucccccgccgcgcccccuucgaccucuucgagaaccgcaagaagaagaacaacaucaagcucuacguccgccgcgucuucaucauggacaacugcgaggagcucauccccgaguaccucaacuucauccgcggcgucgucgacuccgaggaccucccccucaacaucucccgcgagaugcuccagcaguccaagauccucaaggucauccgcaagaaccucgucaagaagugccucgagcucuucaccgagcucgccgaggacaaggagaacuacaagaaguucuacgagcaguucuccaagaacaucaagcucggcauccacgaggacucccagaaccgcaagaagcucuccgagcuccuccgcuacuacaccuccgccuccggcgacgagauggucucccucaaggacuacugcacccgcaugaaggagaaccagaagcacaucuacuacaucaccggcgagaccaaggaccaggucgccaacuccgccuucgucgagcgccuccgcaagcacggccucgaggucaucuacaugaucgagcccaucgacgaguacugcguccagcagcucaaggaguucgagggcaagacccucgucuccgucaccaaggagggccucgagcuccccgaggacgaggaggagaagaagaagcaggaggagaagaagaccaaguucgagaaccucugcaagaucaugaaggacauccucgagaagaaggucgagaaggucgucgucuccaaccgccucgucaccucccccugcugcaucgucaccuccaccuacggcuggaccgccaacauggagcgcaucaugaaggcccaggcccuccgcgacaacuccaccaugggcuacauggccgccaagaagcaccucgagaucaaccccgaccacuccaucaucgagacccuccgccagaaggccgaggccgacaagaacgacaaguccgucaaggaccucgucauccuccucuacgagaccgcccuccucuccuccggcuucucccucgaggacccccagacccacgccaaccgcaucuaccgcaugaucaagcucggccucggcaucgacgaggacgaccccaccgccgacgacaccuccgccgccgucaccgaggagaugcccccccucgagggcgacgacgacaccucccgcauggaggaggucgacuga

SEQ ID NO: 7701 - RNA, 2199 nt, Artificial Sequence
  derived and/or modified sequence opt3 from HSP90__Homo_sapiens__AAA63194
augcccgaggaaacccagacacaagaccagccuauggaggaagaggaaguggagacuuucgccuuucaggcugagaucgcacagcugaugagccucauuauaaacacguucuacuccaauaaggaaaucuuucuuagagagcugauuucuaacucaagugaugccuuggacaaaaucagguaugagagcuuaaccgauccauccaagcuggacucuggcaaagagcuacacauuaaucucaucccgaacaagcaagaucggacacugacuauagucgacaccgggaucggaaugacaaaagcggaucuuauuaauaaccuggguaccaucgcuaagucgggcacuaaggccuucauggaggcauugcaggccggggcugacauuucaaugaucggacaguuuggcguugguuucuacagcgcauaucucguggccgaaaaaguaacagugauaaccaagcauaaugaugacgagcaguacgcuugggaaaguuccgccgggggaucuuuuacgguccgcacugauaccggcgagcccaugggccgagggacaaaagugauucugcaccugaaggaagaccaaacugaguaucucgaggaacguagaaucaaagagauuguuaagaagcauagccaguucaucggauacccuaucaccuuauuuguggaaaaagagagggauaaggaagucuccgacgacgaggcggaggaaaaagaggauaaggaagaggaaaaagagaaggaggaaaaagagucagaagacaagccagagauugaggauguggguagugacgaagaggaagagaagaaagauggcgacaagaaaaagaaaaagaagauaaaagaaaaguauaucgaucaggaggagcugaacaaaacaaagcccauuuggacccggaauccugacgauaucacgaacgaagaguacggggaguucuacaaaagccuuacuaaugacugggaagaucacuuggcaguaaagcauuuuucuguugaaggacagcuggaguuccgcgcccuacucuuugugccaagaagggcucccuucgaccuguucgagaaccggaagaaaaagaauaacauaaaacuuuauguccgccgaguguuuauuauggacaauugcgaagaacugaucccugaauacuugaacuucaucagaggcguggucgauuccgaggaccucccacugaacauuucaagggaaauguuacaacagagcaagauccugaaaguuauucggaagaaucucgugaagaaaugucuugagcuguuuacagaguuggccgaagauaaggagaacuauaaaaaguucuacgaacaguuuaguaaaaauauaaagcuagguauccacgaggacucucaaaaccguaaaaagcuguccgagcuccugcgcuauuacaccagcgcaucgggggaugaaaugguaucucuuaaggacuauugcacuagaaugaaagagaaucagaagcacauuuacuacaucacaggagaaaccaaagaucagguggcuaacuccgccuucgucgagaggcugcggaagcauggcuuggaagugaucuauaugauugagccgauagacgaguacuguguucagcaacucaaagaauuugagggcaagacgcuggugucagucaccaaggaaggguuagagcugcccgaagaugaggaggagaaaaagaaacaggaagaaaagaaaacaaaguucgagaaucuaugcaagaucaugaaagacauucucgaaaagaaaguggagaagguaguugugaguaaccgacuggucacuagcccuuguugcaucgugaccuccacauauggauggacugcgaauauggagcgcauuaugaaagcccaggcacuuagagauaacucuaccauggguuacauggcugccaagaagcacuuggaaaucaauccagaccauagcauaaucgagacacugaggcagaaagcugaagccgauaagaacgacaaaucagucaaggaccucgugauucugcuuuaugagaccgcacuguugaguuccggcuuuagccucgaggauccccaaacucacgccaaucggaucuaccgcaugauuaaacugggguuaggaaucgacgaagaugacccuacggcugaugacacaucugcggcaguuaccgaggaaaugccaccccuggagggcgaugacgauacuucaagaauggaagagguggacuga

SEQ ID NO: 7702 - RNA, 2199 nt, Artificial Sequence
  derived and/or modified sequence opt4 from HSP90__Homo_sapiens__AAA63194
augcccgaggagacccagacccaggaccagcccauggaggaggaggagguggagaccuucgccuuccaggccgagaucgcccagcugaugagccugaucaucaacaccuucuacagcaacaaggagaucuuccugagagagcugaucagcaacagcagcgacgcccuggacaagaucagauacgagagccugaccgaccccagcaagcuggacagcggcaaggagcugcacaucaaccugauccccaacaagcaggacagaacccugaccaucguggacaccggcaucggcaugaccaaggccgaccugaucaacaaccugggcaccaucgccaagagcggcaccaaggccuucauggaggcccugcaggccggcgccgacaucagcaugaucggccaguucggcgugggcuucuacagcgccuaccugguggccgagaaggugaccgugaucaccaagcacaacgacgacgagcaguacgccugggagagcagcgccggcggcagcuucaccgugagaaccgacaccggcgagcccaugggcagaggcaccaaggugauccugcaccugaaggaggaccagaccgaguaccuggaggagagaagaaucaaggagaucgugaagaagcacagccaguucaucggcuaccccaucacccuguucguggagaaggagagagacaaggaggugagcgacgacgaggccgaggagaaggaggacaaggaggaggagaaggagaaggaggagaaggagagcgaggacaagcccgagaucgaggacgugggcagcgacgaggaggaggagaagaaggacggcgacaagaagaagaagaagaagaucaaggagaaguacaucgaccaggaggagcugaacaagaccaagcccaucuggaccagaaaccccgacgacaucaccaacgaggaguacggcgaguucuacaagagccugaccaacgacugggaggaccaccuggccgugaagcacuucagcguggagggccagcuggaguucagagcccugcuguucgugcccagaagagcccccuucgaccuguucgagaacagaaagaagaagaacaacaucaagcuguacgugagaagaguguucaucauggacaacugcgaggagcugauccccgaguaccugaacuucaucagaggcgugguggacagcgaggaccugccccugaacaucagcagagagaugcugcagcagagcaagauccugaaggugaucagaaagaaccuggugaagaagugccuggagcuguucaccgagcuggccgaggacaaggagaacuacaagaaguucuacgagcaguucagcaagaacaucaagcugggcauccacgaggacagccagaacagaaagaagcugagcgagcugcugagauacuacaccagcgccagcggcgacgagauggugagccugaaggacuacugcaccagaaugaaggagaaccagaagcacaucuacuacaucaccggcgagaccaaggaccagguggccaacagcgccuucguggagagacugagaaagcacggccuggaggugaucuacaugaucgagcccaucgacgaguacugcgugcagcagcugaaggaguucgagggcaagacccuggugagcgugaccaaggagggccuggagcugcccgaggacgaggaggagaagaagaagcaggaggagaagaagaccaaguucgagaaccugugcaagaucaugaaggacauccuggagaagaagguggagaaggugguggugagcaacagacuggugaccagccccugcugcaucgugaccagcaccuacggcuggaccgccaacauggagagaaucaugaaggcccaggcccugagagacaacagcaccaugggcuacauggccgccaagaagcaccuggagaucaaccccgaccacagcaucaucgagacccugagacagaaggccgaggccgacaagaacgacaagagcgugaaggaccuggugauccugcuguacgagaccgcccugcugagcagcggcuucagccuggaggacccccagacccacgccaacagaaucuacagaaugaucaagcugggccugggcaucgacgaggacgaccccaccgccgacgacaccagcgccgccgugaccgaggagaugcccccccuggagggcgacgacgacaccagcagaauggaggagguggacuga

SEQ ID NO: 7703 - RNA, 2199 nt, Artificial Sequence
  derived and/or modified sequence opt5 from HSP90__Homo_sapiens__AAA63194
augcccgaggaaacccagacacaagaccagcccauggaggaagaggaaguggagacguucgccuuucaggcugagaucgcccagcugaugagccucauuaucaacaccuucuacuccaauaaggaaauuuuucugagagagcuuaucucuaacagcuccgaugcgcuggacaaaauucgguaugaaucucucacagauccgagcaagcuggacuccggcaaagagcuucacaucaaucugauccccaacaagcaagaucgcacccucacaauugucgacaccgggaucggaaugacaaaagcugaucugauuaauaaccugggcaccaucgccaagucugggacgaaggccuucauggaggcucuccaggccggagcugacauuagcaugaucggccaguuugggguuggauucuacuccgccuaucugguggcggaaaaagugaccgucauuacaaagcauaaugaugacgagcaguacgccugggaaagcucugcuggcggcuccuuuaccgugagaacagauaccggggagccuaugggacggggcacgaaaguuauccuucaccugaaggaagaccaaacagaguaucucgaggaacgcagaaucaaagagauugugaagaagcauagccaguucaucggguaccccauuacccuguuugucgaaaaagagcgggauaaggaagugucugacgacgaggccgaggaaaaagaggauaaggaagaggaaaaagagaaggaggaaaaagaguccgaagacaagccugagaucgaggauguuggaagcgacgaagaggaagagaagaaagauggcgacaagaaaaagaaaaagaagauuaaagaaaaguauaucgaucaggaggagcuuaacaaaacaaagcccaucuggacccgcaauccugacgauauuaccaacgaagaguacggggaguucuacaaaucucugacaaaugacugggaggaucaccucgcugugaagcauuuuuccgucgaaggacagcuggaguucagagcccugcucuuugugccgcggcgcgcgcccuucgaccuguucgagaacagaaagaaaaagaauaacaucaaacuuuaugugcggcgcgucuuuauuauggacaauugcgaagaacugaucccugaauaccucaacuucauuagaggcguuguggauagcgaggaccugccccuuaacaucucccgggaaaugcugcaacagucuaagauccucaaagugauucgcaagaaucuggucaagaaaugucuggagcucuuuacggagcuggccgaagauaaggagaacuauaaaaaguucuacgaacaguuuagcaaaaauaucaaacuuggcauucacgaggacucccaaaacagaaagaagcugagcgagcuccugcgguauuacaccucugcuuccggggaugaaauggugagccuuaaggacuauugcacaagaaugaaagagaaucagaagcacaucuacuacauuaccggagaaacaaaagaucagguugccaacucugcuuucguggagcgccugcggaagcauggccucgaagucaucuauaugauugagccuaucgacgaguacugugugcagcaacugaaagaauuugaggggaagacccugguuagcgugacgaaggaaggacucgagcugcccgaagaugaggaggagaaaaagaaacaggaagaaaagaaaacaaaguucgagaaucuuugcaagaucaugaaagacauucuggaaaagaaagucgagaagguggucguguccaacagacucguuaccucuccguguugcaucgugaccagcacauauggcuggaccgccaauauggagcgcauuaugaaagcccaggcucugcgggauaacuccacaaugggguacauggcggccaagaagcaccuggaaaucaauccugaccauagcauuaucgagacgcuuagacagaaagcugaagccgauaagaacgacaaaucugucaaggaccucgugauccugcuguaugagaccgcccuccuguccagcggauuuucucuugaggauccccaaacacacgcuaaucgcauuuaccggaugaucaaacugggccucggcauugacgaagaugacccuaccgccgaugacacauccgcggcuguuaccgaggaaaugccuccccuggagggggaugacgauacgagcagaauggaagagguggacuga

SEQ ID NO: 7704 - RNA, 2199 nt, Artificial Sequence
  derived and/or modified sequence opt6 from HSP90__Homo_sapiens__AAA63194
augccagaagaaacacaaacacaagaucaaccaauggaagaagaggaaguggaaacauuugcauuccaagcagaaaucgcacaacucaugucauuaauaauaaauaccuucuacaguaacaaagaaauuuucuuacgagaauuaauaagcaauaguagcgacgcacuagacaaaauuagauacgaaaguuuaacagacccuagcaaacuagacucaggaaaagaauuacacauaaaucucauaccuaauaaacaagacagaacacuaacgauaguagacaccggaauaggaaugacaaaagcagaucuaauaaauaacuuaggaacaaucgcaaaaucaggcacaaaagcauucauggaagcauuacaagcgggagcagauauaucaaugaucggacaauucggugucggauuuuacuccgcauaucuagucgcagaaaaaguaacgguaauaacaaagcacaaugaugaugaacaauaugcaugggaaaguucagccggaggaagcuucacgguaagaacagauacaggcgaaccaaugggaagaggaacaaaaguaauacuacaccuaaaagaagaccaaacggaauauuuagaagaaagaagaaucaaagaaauaguaaaaaaacacucacaauuuauaggauacccaauuacacuauucguagaaaaagaaagagacaaagaagucucugacgaugaagcggaagagaaagaagacaaagaagaagaaaaagaaaaggaagaaaaagaaagugaagacaaaccagagauagaagacguaggaagugacgaagaagaagaaaaaaaagacggugacaaaaagaaaaaaaaaaagauaaaagaaaaauauauagaucaagaagaacuaaacaaaacaaaaccaauauggacacgaaacccagaugauauaacuaaugaagaauacggagaauucuacaaaagcuuaacaaaugacugggaagaucacuuagcaguuaaacauuuuucaguagaaggacaauuagaauucagagcacuacuauucguaccuagacgugcgccauucgaucucuucgaaaaucguaaaaaaaaaaauaacauaaaacuauacguaagaaggguauucaucauggacaauugcgaagaauuaaucccagaauaccuaaacuuuauaagaggaguaguagauucggaagauuuaccauuaaauauaagcagagaaaugcuacaacagaguaaaauacugaaagugauacgaaaaaaccugguaaaaaaaugccucgaauuauucacagaauuagcagaagacaaagaaaacuauaaaaaauuuuaugaacaauucaguaaaaacauaaaauuagguauacacgaagauagucaaaacagaaaaaaacuaagcgaacuacuaagguacuacacauccgcauccggggaugaaaugguaagcuugaaagauuacuguacaagaaugaaagaaaaccaaaaacacauauacuacauaacaggggaaacaaaagaucaagucgcgaauucagcguuuguagaaagacuaagaaaacauggacuagaaguaauauauaugauagaaccaauagaugaauacugcguacaacaauuaaaagaauuugaaggaaaaacacuaguaaguguaaccaaagaaggcuuagaauugcccgaagacgaagaagaaaaaaagaaacaggaagaaaaaaaaacaaaauuugaaaaucuaugcaagauaaugaaagauauauuggaaaaaaaaguagaaaaaguagugguaagcaauagauuaguaacaucaccaugcugcauaguaacgagcacauacggauggacggcaaauauggaaagaauuaugaaagcacaagccuuaagggauaacucaacaaugggauacauggcagcaaaaaaacaccuagaaauaaauccagaccauagcauaauagaaacauuaagacaaaaagccgaagcagauaaaaaugauaagagcguaaaagaucuaguaauauuacuauacgaaacagcacuauugucaagcggcuuuaguuuagaagauccacagacccaugcaaaucgaaucuaccgcaugauuaaauuaggauuaggaaucgacgaagacgauccuacagcugacgacacaucugcagccguuacagaagaaaugccaccacuagaaggagaugacgacaccaguagaauggaggaaguagacuaa

SEQ ID NO: 7705 - protein, 724 aa, Artificial Sequence
  HSP90__Homo_sapiens__P08238
MPEEVHHGEEEVETFAFQAEIAQLMSLIINTFYSNKEIFLRELISNASDALDKIRYESLTDPSKLDSGKELKIDIIPNPQERTLTLVDTGIGMTKADLINNLGTIAKSGTKAFMEALQAGADISMIGQFGVGFYSAYLVAEKVVVITKHNDDEQYAWESSAGGSFTVRADHGEPIGRGTKVILHLKEDQTEYLEERRVKEVVKKHSQFIGYPITLYLEKEREKEISDDEAEEEKGEKEEEDKDDEEKPKIEDVGSDEEDDSGKDKKKKTKKIKEKYIDQEELNKTKPIWTRNPDDITQEEYGEFYKSLTNDWEDHLAVKHFSVEGQLEFRALLFIPRRAPFDLFENKKKKNNIKLYVRRVFIMDSCDELIPEYLNFIRGVVDSEDLPLNISREMLQQSKILKVIRKNIVKKCLELFSELAEDKENYKKFYEAFSKNLKLGIHEDSTNRRRLSELLRYHTSQSGDEMTSLSEYVSRMKETQKSIYYITGESKEQVANSAFVERVRKRGFEVVYMTEPIDEYCVQQLKEFDGKSLVSVTKEGLELPEDEEEKKKMEESKAKFENLCKLMKEILDKKVEKVTISNRLVSSPCCIVTSTYGWTANMERIMKAQALRDNSTMGYMMAKKHLEINPDHPIVETLRQKAEADKNDKAVKDLVVLLFETALLSSGFSLEDPQTHSNRIYRMIKLGLGIDEDEVAAEEPNAAVPDEIPPLEGDEDASRMEEVD

SEQ ID NO: 7706 - RNA, 2175 nt, Artificial Sequence
  HSP90__Homo_sapiens__AAA36026
augccugaggaagugcaccauggagaggaggagguggagacuuuugccuuucaggcagaaauugcccaacucaugucccucaucaucaauaccuucuauuccaacaaggagauuuuccuucgggaguugaucucuaaugcuucugaugccuuggacaagauucgcuaugagagccugacagacccuucgaaguuggacagugguaaagagcugaaaauugacaucauccccaacccucaggaacguacccugacuuugguagacacaggcauuggcaugaccaaagcugaucucauaaauaauuugggaaccauugccaagucugguacuaaagcauucauggaggcucuucaggcuggugcagacaucuccaugauugggcaguuugguguuggcuuuuauucugccuacuugguggcagagaaagugguugugaucacaaagcacaacgaugaugaacaguaugcuugggagucuucugcuggagguuccuucacugugcgugcugaccauggugagcccauuggcagggguaccaaagugauccuccaucuuaaagaagaucagacagaguaccuagaagagaggcgggucaaagaaguagugaagaagcauucucaguucauaggcuaucccaucacccuuuauuuggagaaggaacgagagaaggaaauuagugaugaugaggcagaggaagagaaaggugagaaagaagaggaagauaaagaugaugaagaaaaacccaagaucgaagauguggguucagaugaggaggaugacagcgguaaggauaagaagaagaaaacuaagaagaucaaagagaaauacauugaucaggaagaacuaaacaagaccaagccuauuuggaccagaaacccugaugacaucacccaagaggaguauggagaauucuacaagagccucacuaaugacugggaagaccacuuggcagucaagcacuuuucuguagaaggucaguuggaauucagggcauugcuauuuauuccucgucgggcucccuuugaccuuuuugagaacaagaagaaaaagaacaacaucaaacucuauguccgccguguguucaucauggacagcugugaugaguugauaccagaguaucucaauuuuauccguggugugguugacucugaggaucugccccugaacaucucccgagaaaugcuccagcagagcaaaaucuugaaagucauucgcaaaaacauuguuaagaagugccuugagcucuucucugagcuggcagaagacaaggagaauuacaagaaauucuaugaggcauucucuaaaaaucucaagcuuggaauccacgaagacuccacuaaccgccgccgccugucugagcugcugcgcuaucauaccucccagucuggagaugagaugacaucucugucagaguauguuucucgcaugaaggagacacagaaguccaucuauuacaucacuggugagagcaaagagcagguggccaacucagcuuuuguggagcgagugcggaaacggggcuucgaggugguauauaugaccgagcccauugacgaguacugugugcagcagcucaaggaauuugaugggaagagccuggucucaguuaccaaggagggucuggagcugccugaggaugaggaggagaagaagaagauggaagagagcaaggcaaaguuugagaaccucugcaagcucaugaaagaaaucuuagauaagaagguugagaaggugacaaucuccaauagacuugugucuucaccuugcugcauugugaccagcaccuacggcuggacagccaauauggagcggaucaugaaagcccaggcacuucgggacaacuccaccaugggcuauaugauggccaaaaagcaccuggagaucaacccugaccaccccauuguggagacgcugcggcagaaggcugaggccgacaagaaugauaaggcaguuaaggaccugguggugcugcuguuugaaaccgcccugcuaucuucuggcuuuucccuugaggauccccagacccacuccaaccgcaucuaucgcaugaucaagcuaggucuagguauugaugaagaugaaguggcagcagaggaacccaaugcugcaguuccugaugagauccccccucucgagggcgaugaggaugcgucucgcauggaagaagucgauuag

SEQ ID NO: 7707 - RNA, 2175 nt, Artificial Sequence
  derived and/or modified sequence opt1 from HSP90__Homo_sapiens__AAA36026
augcccgaggaggugcaccacggcgaggaggaggucgagaccuucgccuuccaggccgagaucgcgcagcugaugagccucaucaucaacaccuucuacuccaacaaggagaucuuccugcgcgagcugaucagcaacgccuccgacgcccucgacaagauccgguacgagagccugacggacccguccaagcuggacagcgggaaggagcucaagaucgacaucauccccaacccccaggagcgcacccugacccugguggacaccggcaucgggaugacgaaggccgaccucaucaacaaccugggcaccaucgccaaguccgggaccaaggcguucauggaggcccugcaggccggcgccgacaucagcaugaucggccaguucggggugggcuucuacuccgcguaccucgucgccgagaaggugguggucaucaccaagcacaacgacgacgagcaguacgccugggagagcuccgccgggggcagcuucacggugcgggccgaccacggggagcccaucggccgcggcaccaaggugauccugcaccugaaggaggaccagaccgaguaccucgaggagcggcgcgucaaggagguggugaagaagcacucccaguucaucggguacccgaucacccuguaccuggagaaggagcgggagaaggagaucagcgacgacgaggcggaggaggagaagggcgagaaggaggaggaggacaaggacgacgaggagaagcccaagaucgaggacgucggguccgacgaggaggacgacagcggcaaggacaagaagaagaagacgaagaagaucaaggagaaguacaucgaccaggaggagcucaacaagaccaagcccaucuggacccgcaaccccgacgacaucacccaggaggaguacggcgaguucuacaagucccugacgaacgacugggaggaccaccuggccgugaagcacuucagcguggaggggcagcucgaguuccgggcccugcuguucaucccgcgccgggcccccuucgaccucuucgagaacaagaagaagaagaacaacaucaagcuguacguccgccggguguucaucauggacuccugcgacgagcugauccccgaguaccucaacuucauccgcggcguggucgacagcgaggaccugccccugaacaucagccgggagaugcuccagcaguccaagauccugaaggugauccgcaagaacaucgugaagaagugccuggagcuguucagcgagcucgccgaggacaaggagaacuacaagaaguucuacgaggcguucuccaagaaccugaagcucgggauccacgaggacagcaccaaccggcgccggcuguccgagcugcuccgcuaccacaccagccaguccggcgacgagaugaccagccuguccgaguacgucagccggaugaaggagacgcagaaguccaucuacuacaucaccggggagagcaaggagcaggucgccaacuccgccuucguggagcgcgugcgcaagcggggcuucgagguggucuacaugaccgagccgaucgacgaguacugcgugcagcagcugaaggaguucgacggcaagagccucguguccgucaccaaggaggggcuggagcugcccgaggacgaggaggagaagaagaagauggaggagagcaaggccaaguucgagaaccucugcaagcugaugaaggagauccuggacaagaagguggagaaggugacgaucuccaaccgccucgucagcucccccugcugcaucgugaccagcaccuacggcuggaccgccaacauggagcggaucaugaaggcgcaggcccugcgcgacaacagcacgaugggguacaugauggccaagaagcaccuggagaucaaccccgaccacccgaucguggagacccugcggcagaaggccgaggccgacaagaacgacaaggcggucaaggaccucguggugcugcuguucgagaccgcccuccuguccagcggcuucucccuggaggacccccagacccacagcaaccgcaucuaccggaugaucaagcucgggcugggcaucgacgaggacgaggucgccgccgaggagcccaacgcggccgugcccgacgagaucccgccccuggagggcgacgaggacgccucccgcauggaggagguggacuga

SEQ ID NO: 7708 - RNA, 2175 nt, Artificial Sequence
  derived and/or modified sequence opt2 from HSP90__Homo_sapiens__AAA36026
augcccgaggagguccaccacggcgaggaggaggucgagaccuucgccuuccaggccgagaucgcccagcucaugucccucaucaucaacaccuucuacuccaacaaggagaucuuccuccgcgagcucaucuccaacgccuccgacgcccucgacaagauccgcuacgagucccucaccgaccccuccaagcucgacuccggcaaggagcucaagaucgacaucauccccaacccccaggagcgcacccucacccucgucgacaccggcaucggcaugaccaaggccgaccucaucaacaaccucggcaccaucgccaaguccggcaccaaggccuucauggaggcccuccaggccggcgccgacaucuccaugaucggccaguucggcgucggcuucuacuccgccuaccucgucgccgagaaggucgucgucaucaccaagcacaacgacgacgagcaguacgccugggaguccuccgccggcggcuccuucaccguccgcgccgaccacggcgagcccaucggccgcggcaccaaggucauccuccaccucaaggaggaccagaccgaguaccucgaggagcgccgcgucaaggaggucgucaagaagcacucccaguucaucggcuaccccaucacccucuaccucgagaaggagcgcgagaaggagaucuccgacgacgaggccgaggaggagaagggcgagaaggaggaggaggacaaggacgacgaggagaagcccaagaucgaggacgucggcuccgacgaggaggacgacuccggcaaggacaagaagaagaagaccaagaagaucaaggagaaguacaucgaccaggaggagcucaacaagaccaagcccaucuggacccgcaaccccgacgacaucacccaggaggaguacggcgaguucuacaagucccucaccaacgacugggaggaccaccucgccgucaagcacuucuccgucgagggccagcucgaguuccgcgcccuccucuucaucccccgccgcgcccccuucgaccucuucgagaacaagaagaagaagaacaacaucaagcucuacguccgccgcgucuucaucauggacuccugcgacgagcucauccccgaguaccucaacuucauccgcggcgucgucgacuccgaggaccucccccucaacaucucccgcgagaugcuccagcaguccaagauccucaaggucauccgcaagaacaucgucaagaagugccucgagcucuucuccgagcucgccgaggacaaggagaacuacaagaaguucuacgaggccuucuccaagaaccucaagcucggcauccacgaggacuccaccaaccgccgccgccucuccgagcuccuccgcuaccacaccucccaguccggcgacgagaugaccucccucuccgaguacgucucccgcaugaaggagacccagaaguccaucuacuacaucaccggcgaguccaaggagcaggucgccaacuccgccuucgucgagcgcguccgcaagcgcggcuucgaggucgucuacaugaccgagcccaucgacgaguacugcguccagcagcucaaggaguucgacggcaagucccucgucuccgucaccaaggagggccucgagcuccccgaggacgaggaggagaagaagaagauggaggaguccaaggccaaguucgagaaccucugcaagcucaugaaggagauccucgacaagaaggucgagaaggucaccaucuccaaccgccucgucuccucccccugcugcaucgucaccuccaccuacggcuggaccgccaacauggagcgcaucaugaaggcccaggcccuccgcgacaacuccaccaugggcuacaugauggccaagaagcaccucgagaucaaccccgaccaccccaucgucgagacccuccgccagaaggccgaggccgacaagaacgacaaggccgucaaggaccucgucguccuccucuucgagaccgcccuccucuccuccggcuucucccucgaggacccccagacccacuccaaccgcaucuaccgcaugaucaagcucggccucggcaucgacgaggacgaggucgccgccgaggagcccaacgccgccguccccgacgagauccccccccucgagggcgacgaggacgccucccgcauggaggaggucgacuga

SEQ ID NO: 7709 - RNA, 2175 nt, Artificial Sequence
  derived and/or modified sequence opt3 from HSP90__Homo_sapiens__AAA36026
augcccgaggaagugcaccauggcgaggaagaggucgaaaccuucgccuuucaggcugagaucgcacaacugaugagccucauuauaaacacauucuacuccaauaaggagaucuuucuuagagaacugauuucuaacgccucagacgcguuggauaaaaucagguaugagaguuuaacugacccuagcaagcuggauuccgggaaagaacuaaagauugacaucauaccaaauccgcaggagcggacgcucacccugguugauacaggaaucgguaugacuaaagcugaccuuauuaacaaucugggcaccaucgccaagucugggacaaaggcauucauggaggccuugcaggcuggagcagauauuucgaugaucggccaguuuggugugggguucuacucagccuaucucguagcugaaaaaguggucgugauaaccaagcacaacgacgaugagcaauacgccugggaaagcagugcgggaggcuccuuuacuguucgcgcagaccauggcgagcccauugggcgaggaacaaaagugauccugcaccugaaggaagaucagaccgaguaucucgaggaacguagagucaaagaggugguaaagaagcauucucaguucauugguuacccuaucacguuauaucuggaaaaagagagggaaaaggagaucagcgacgaugaggccgaagaggaaaaaggcgagaaggaagaggaggacaaagacgaugaagagaagccaaaaauugaagacguuggguccgaugaggaggacgauucaggaaaggacaagaaaaagaaaacuaagaaaauaaaggaaaaguacaucgaucaggaggaacuuaauaaaaccaagcccauuuggacacggaacccugacgauaucacucaagaggaauacggcgaguuuuauaaaaguuugaccaaugacugggaggaucaccuggcugugaagcacuucagcgucgaaggucagcuagaguuucgcgcccuccuguucauaccaagaagggcacccuuugaccuuuucgaaaacaaaaagaagaaaaauaacauuaagcuguacgugcggcgcguguucaucauggacucuugcgaugaguugaucccugaauaucucaauuuuauucgaggggucguugacuccgaggaucugccauuaaacaucucaagagagaugcugcagcagagcaaaauucucaaggugauaaggaaaaauaucguaaagaagugucuugaacuguucagugaguuggcugaagacaaagagaacuacaagaaauuuuaugaagccuucucuaagaaccuaaaacugggcauucaugaggauuccacaaaucggcgucgccucagcgagcugcuuagauaccacaccucgcaaucuggagacgaaaugacgucccugucagaguaugugaguaggaugaaggaaacucagaaaagcaucuacuacaucacaggcgaguccaaggagcaggucgcgaacucugccuuuguggaacggguucgaaagcgcggguucgagguggucuauaugaccgaaccgauugaugaguacugcgugcaacaguugaaagaauuugacggaaagagccucguaucaguuacuaaagagggucuggaguuacccgaagaugaggaagagaagaaaaagauggaagagaguaaggcaaaauucgagaaucuguguaagcuaaugaaagaaauacucgacaagaaaguggagaaggucacaaucuccaacagacuggugagcucuccuugcuguauugucaccucaacguauggcuggaccgcuaauauggaaaggaucaugaaggcccaggcccuucgggauaacaguacaaugggguacaugauggcuaaaaagcauuuggagauuaauccagaccaccccaucguggaaacucugcgccagaaagcagaggccgauaagaacgacaaagcuguuaaggaccucgugguacugcuuuuugagaccgcgcuguugagcuccggauucucucucgaagauccucaaacacacucgaauagaauauauaggaugaucaagcugggcuuagguauugacgaggaugaagucgcagccgaggagccaaacgcugccgugcccgacgaaaucccgccucuggagggggaugaagacgcaagccguauggaggaaguugauuga

SEQ ID NO: 7710 - RNA, 2175 nt, Artificial Sequence
  derived and/or modified sequence opt4 from HSP90__Homo_sapiens__AAA36026
augcccgaggaggugcaccacggcgaggaggagguggagaccuucgccuuccaggccgagaucgcccagcugaugagccugaucaucaacaccuucuacagcaacaaggagaucuuccugagagagcugaucagcaacgccagcgacgcccuggacaagaucagauacgagagccugaccgaccccagcaagcuggacagcggcaaggagcugaagaucgacaucauccccaacccccaggagagaacccugacccugguggacaccggcaucggcaugaccaaggccgaccugaucaacaaccugggcaccaucgccaagagcggcaccaaggccuucauggaggcccugcaggccggcgccgacaucagcaugaucggccaguucggcgugggcuucuacagcgccuaccugguggccgagaaggugguggugaucaccaagcacaacgacgacgagcaguacgccugggagagcagcgccggcggcagcuucaccgugagagccgaccacggcgagcccaucggcagaggcaccaaggugauccugcaccugaaggaggaccagaccgaguaccuggaggagagaagagugaaggagguggugaagaagcacagccaguucaucggcuaccccaucacccuguaccuggagaaggagagagagaaggagaucagcgacgacgaggccgaggaggagaagggcgagaaggaggaggaggacaaggacgacgaggagaagcccaagaucgaggacgugggcagcgacgaggaggacgacagcggcaaggacaagaagaagaagaccaagaagaucaaggagaaguacaucgaccaggaggagcugaacaagaccaagcccaucuggaccagaaaccccgacgacaucacccaggaggaguacggcgaguucuacaagagccugaccaacgacugggaggaccaccuggccgugaagcacuucagcguggagggccagcuggaguucagagcccugcuguucauccccagaagagcccccuucgaccuguucgagaacaagaagaagaagaacaacaucaagcuguacgugagaagaguguucaucauggacagcugcgacgagcugauccccgaguaccugaacuucaucagaggcgugguggacagcgaggaccugccccugaacaucagcagagagaugcugcagcagagcaagauccugaaggugaucagaaagaacaucgugaagaagugccuggagcuguucagcgagcuggccgaggacaaggagaacuacaagaaguucuacgaggccuucagcaagaaccugaagcugggcauccacgaggacagcaccaacagaagaagacugagcgagcugcugagauaccacaccagccagagcggcgacgagaugaccagccugagcgaguacgugagcagaaugaaggagacccagaagagcaucuacuacaucaccggcgagagcaaggagcagguggccaacagcgccuucguggagagagugagaaagagaggcuucgaggugguguacaugaccgagcccaucgacgaguacugcgugcagcagcugaaggaguucgacggcaagagccuggugagcgugaccaaggagggccuggagcugcccgaggacgaggaggagaagaagaagauggaggagagcaaggccaaguucgagaaccugugcaagcugaugaaggagauccuggacaagaagguggagaaggugaccaucagcaacagacuggugagcagccccugcugcaucgugaccagcaccuacggcuggaccgccaacauggagagaaucaugaaggcccaggcccugagagacaacagcaccaugggcuacaugauggccaagaagcaccuggagaucaaccccgaccaccccaucguggagacccugagacagaaggccgaggccgacaagaacgacaaggccgugaaggaccugguggugcugcuguucgagaccgcccugcugagcagcggcuucagccuggaggacccccagacccacagcaacagaaucuacagaaugaucaagcugggccugggcaucgacgaggacgagguggccgccgaggagcccaacgccgccgugcccgacgagauccccccccuggagggcgacgaggacgccagcagaauggaggagguggacuga

SEQ ID NO: 7711 - RNA, 2175 nt, Artificial Sequence
  derived and/or modified sequence opt5 from HSP90__Homo_sapiens__AAA36026
augcccgaggaagugcaccauggcgaggaagaggucgaaaccuucgccuuucaggcugagaucgcccaacugaugagccucauuaucaacacauucuacuccaauaaggagauuuuucugagagaacuuaucucuaacgcgagcgacgcucuggauaaaauucgguaugagucccucacggacccuucuaagcuggauagcgggaaagaacuuaagaucgacaucauuccgaauccccaggagcgcacccugacacucguugauaccggaaucggcaugacaaaagccgaccugauuaacaaucuggggaccaucgccaaguccggaacaaaggcuuucauggaggcccuccaggcuggcgccgauauuucuaugaucgggcaguuuggagugggcuucuacagcgcguaucugguggccgaaaaagucgugguuauuaccaagcacaacgacgaugagcaauacgcuugggaauccagcgccggcgggucuuuuacggugagagcugaccauggagagccuaucggccgggggaccaaagucauccuucaccugaaggaagaucagacagaguaucucgaggaacgcagagugaaagagguugugaagaagcauucccaguucauuggauaccccaucacccuguaucuugaaaaagagcgggaaaaggagauuagcgacgaugaggccgaagaggaaaaaggcgagaaggaagaggaggacaaagacgaugaagagaagccuaaaaucgaagacgucgggucugaugaggaggacgauuccggaaaggacaagaaaaagaaaacaaagaaaauuaaggaaaaguacaucgaucaggaggaacugaauaaaaccaagcccaucuggacgcgcaacccugacgauauuacacaagaggaauacggcgaguuuuauaaaagccucaccaaugacugggaggaucaccuggcggugaagcacuucucuguggaaggccagcuggaguuuagagcccuccuguucaucccgcggcgcgcucccuuugaccuuuucgaaaacaaaaagaagaaaaauaacauuaagcuguacgucagacggguuuucaucauggacuccugcgaugagcucauuccugaauaucugaauuuuauccgcggggugguggacagcgaggaucuuccccugaacaucuccagagagaugcuccagcagucuaaaauucugaaggucauccggaaaaauauugugaagaagugucuggaacucuucagcgagcuggccgaagacaaagagaacuacaagaaauuuuaugaggcuuucuccaagaaccuuaaacugggaauccaugaggauagcacaaaucgcagacggcucucugagcugcuuagauaccacaccucccaaagcggcgacgaaaugaccucucugagcgaguauguuucccgcaugaaggaaacacagaaaucuauuuacuacaucacgggggagagcaaggaacagguggccaacuccgccuuugucgaacgggugagaaagcgcggauucgagguuguguauaugaccgaaccuauugaugaguacugcguccaacagcucaaagaauuugacggcaagagccuggugucugucacaaaagaggggcuggagcuccccgaagaugaggaagagaagaaaaagauggaagaguccaaggcuaaauucgagaaucuguguaaacuuaugaaggaaauccuggacaagaaaguggagaagguuaccaucagcaaccggcucgugucuuccccgugcuguauugucacaagcaccuauggauggacggcgaauauggaaagaaucaugaaggcccaggcucugcgcgauaacuccacaaugggcuacaugauggccaaaaagcaucuggagauuaauccugaccaccccaucguggaaacccuucggcagaaagccgaggcugauaagaacgacaaagccguuaaggaccucgugguccugcuguuugagaccgcgcuccugucuagcggcuucucccuugaagauccucaaacacacucuaauagaauuuaucgcaugaucaagcuggggcucggaaucgacgaggaugaaguggcugccgaggagcccaacgccgcugugcccgacgaaauuccuccgcuggagggcgaugaagacgccagccggauggaggaaguugauuga

SEQ ID NO: 7712 - RNA, 2175 nt, Artificial Sequence
  derived and/or modified sequence opt6 from HSP90__Homo_sapiens__AAA36026
augccugaagaaguacaccauggagaagaagaaguagaaacuuuugcauuccaagcagaaaucgcucaacuaaugagcuuaauaauaaauacguuuuauaguaauaaagaaauauuccuaagagaauuaauaucaaaugcaagugaugcauuagacaaaauaagauacgagaguuugaccgacccaucaaaauuagacaguggaaaagaacuaaaaaucgacauaauaccaaauccacaagaaagaacacuaacacuaguagacacaggaauaggcaugacaaaagcugauuuaaucaacaauuuaggaacaauagccaaaucagggacuaaagccuucauggaggcacuacaagcaggugcagauauaucaaugauaggacaauuuggagugggauuuuacucagcauacuuaguagccgaaaaaguaguaguaauuacaaaacauaaugacgacgagcaauaugcaugggaguccagcgcaggaggaaguuucacaguaagagcggaccauggagagccaauagggagagguacaaaaguaauauugcacuuaaaagaagaccaaacagaauacuuagaagaaagaagaguaaaagaaguagugaaaaaacacagccaauucaucggauacccuauaaccuuauaccuagaaaaagagagagaaaaagaaauuagugaugacgaagcugaagaagaaaaaggggaaaaagaagaagaagacaaagacgaugaagaaaaaccuaaaauagaggauguagggagcgacgaagaagacgacagcggaaaggacaaaaaaaaaaaaacaaaaaaaauaaaagaaaaauauauagaccaagaagaacuaaacaaaacaaaaccaauauggacuagaaacccagacgauauaacccaggaagaauauggagaauucuacaaaucguuaacaaaugacugggaagaucaucuugcgguaaaacacuucaguguagaaggacaguuagaauuccgagcacuacuguucauuccaagaagagcacccuuugaccuauuugaaaauaaaaagaaaaaaaacaacauaaaauuauacguaagacgaguuuucauaauggauucaugugacgaauuaauaccagaauaccuaaacuuuauacgaggagugguugacucagaagauuuaccacuaaacaucucaagagagaugcuacaacaaaguaaaauacugaaaguaauaagaaaaaacauugugaaaaaauguuuagaauuauucagcgaauuagcugaagauaaagaaaauuauaagaaauuuuacgaagcauucagcaaaaaucugaaacuaggaauacacgaagauucaaccaauagaagacgacugagcgaacuacuucgguaccauacaagccagaguggagaugaaaugacgucauuaucagaauaugucucaagaaugaaagaaacgcaaaaaucuauauacuacauaacuggagaaagcaaagaacaagucgcaaacucagcauucguugaaagaguacguaagagaggauucgagguuguauacaugacugagccaauagaugaauacugcguacaacaauuaaaggaauucgauggaaaaucauuaguuagcguaacgaaagaaggacuagaauugccagaagacgaagaagaaaaaaaaaaaauggaagaaagcaaagccaaauuugaaaauuuaugcaaauugaugaaagaaauacuagauaaaaaaguggaaaaagugacaauaucaaauagacuuguaagcucgccgugcuguauuguaacauccacauacggguggacggcaaacauggagagaauaaugaaagcccaagcacugcgagacaacucaaccaugggauacaugauggccaaaaagcacuuggaaauaaaccccgaucauccaauaguagaaacauuaagacaaaaagcagaagcagacaaaaacgauaaagcugucaaagaucuuguaguacuacuguuugaaacagcacuauuaaguagcggauuuaguuuagaagauccacagacacacagcaacagaaucuacagaaugauuaaauuaggucuaggaauagacgaggaugaaguagcggcagaagaaccaaaugcggcaguaccugacgaaauaccaccacuggagggagaugaagacgcaucaagaauggaagaaguggauuaa

SEQ ID NO: 7713 - protein, 508 aa, Artificial Sequence
  PDI/PDIA__Homo_sapiens__P07237
MLRRALLCLAVAALVRADAPEEEDHVLVLRKSNFAEALAAHKYLLVEFYAPWCGHCKALAPEYAKAAGKLKAEGSEIRLAKVDATEESDLAQQYGVRGYPTIKFFRNGDTASPKEYTAGREADDIVNWLKKRTGPAATTLPDGAAAESLVESSEVAVIGFFKDVESDSAKQFLQAAEAIDDIPFGITSNSDVFSKYQLDKDGVVLFKKFDEGRNNFEGEVTKENLLDFIKHNQLPLVIEFTEQTAPKIFGGEIKTHILLFLPKSVSDYDGKLSNFKTAAESFKGKILFIFIDSDHTDNQRILEFFGLKKEECPAVRLITLEEEMTKYKPESEELTAERITEFCHRFLEGKIKPHLMSQELPEDWDKQPVKVLVGKNFEDVAFDEKKNVFVEFYAPWCGHCKQLAPIWDKLGETYKDHENIVIAKMDSTANEVEAVKVHSFPTLKFFPASADRTVIDYNGERTLDGFKKFLESGGQDGAGDDDDLEDLEEAEEPDMEEDDDQKAVKDEL

SEQ ID NO: 7714 - RNA, 1527 nt, Artificial Sequence
  PDI/PDIA__Homo_sapiens__AAC13652
augcugcgccgcgcucugcugugccuggccguggccgcccuggugcgcgccgacgcccccgaggaggaggaccacguccuggugcugcggaaaagcaacuucgcggaggcgcuggcggcccacaaguaccugcugguggaguucuaugccccuugguguggccacugcaaggcucuggccccugaguaugccaaagccgcugggaagcugaaggcagaagguuccgagaucagguuggccaagguggacgccacggaggagucugaccuggcccagcaguacggcgugcgcggcuaucccaccaucaaguucuucaggaauggagacacggcuucccccaaggaauauacagcuggcagagaggcugaugacaucgugaacuggcugaagaagcgcacgggcccggcugccaccacccugccugacggcgcagcugcagaguccuugguggaguccagcgagguggcugucaucggcuucuucaaggacguggagucggacucugccaagcaguuuuugcaggcagcagaggccaucgaugacauaccauuugggaucacuuccaacagugacguguucuccaaauaccagcucgacaaagaugggguuguccucuuuaagaaguuugaugaaggccggaacaacuuugaaggggaggucaccaaggagaaccugcuggacuuuaucaaacacaaccagcugccccuugucaucgaguucaccgagcagacagccccgaagauuuuuggaggugaaaucaagacucacauccugcuguucuugcccaagagugugucugacuaugacggcaaacugagcaacuucaaaacagcagccgagagcuucaagggcaagauccuguucaucuucaucgacagcgaccacaccgacaaccagcgcauccucgaguucuuuggccugaagaaggaagagugcccggccgugcgccucaucacccuggaggaggagaugaccaaguacaagcccgaaucggaggagcugacggcagagaggaucacagaguucugccaccgcuuccuggagggcaaaaucaagccccaccugaugagccaggagcugccggaggacugggacaagcagccugucaaggugcuuguugggaagaacuuugaagacguggcuuuugaugagaaaaaaaacgucuuuguggaguucuaugccccaugguguggucacugcaaacaguuggcucccauuugggauaaacugggagagacguacaaggaccaugagaacaucgucaucgccaagauggacucgacugccaacgagguggaggccgucaaagugcacagcuuccccacacucaaguucuuuccugccagugccgacaggacggucauugauuacaacggggaacgcacgcuggaugguuuuaagaaauuccuggagagcgguggccaggauggggcaggggaugaugacgaucucgaggaccuggaagaagcagaggagccagacauggaggaagacgaugaucagaaagcugugaaagaugaacuguaa

SEQ ID NO: 7715 - RNA, 1527 nt, Artificial Sequence
  derived and/or modified sequence opt1 from PDI/PDIA__Homo_sapiens__AAC13652
augcugcgccgggcccuccugugccuggccguggcggcccucguccgcgccgacgcccccgaggaggaggaccacgugcuggugcugcgcaagagcaacuucgccgaggcgcucgccgcccacaaguaccugcuggucgaguucuacgccccguggugcggccacugcaaggcgcucgcccccgaguacgccaaggccgccgggaagcugaaggcggagggcuccgagauccggcuggccaagguggacgccaccgaggagagcgaccucgcccagcaguacggggugcggggcuaccccaccaucaaguucuuccgcaacggggacacggccucccccaaggaguacaccgcgggccgggaggccgacgacaucgucaacuggcugaagaagcgcaccggcccggccgccaccacgcugcccgacggggccgcggccgagagccucguggaguccagcgagguggccgucaucggcuucuucaaggacguggaguccgacagcgccaagcaguuccugcaggccgcggaggccaucgacgacauccccuucgggaucaccuccaacagcgacguguucuccaaguaccagcuggacaaggacggcgucgugcuguucaagaaguucgacgaggggcggaacaacuucgagggcgaggugaccaaggagaaccugcuggacuucaucaagcacaaccagcucccccuggucaucgaguucaccgagcagacggccccgaagaucuucggcggggagaucaagacccacauccuccucuuccugcccaagagcguguccgacuacgacggcaagcugagcaacuucaagaccgccgcggaguccuucaaggggaagauccucuucaucuucaucgacagcgaccacaccgacaaccagcgcauccuggaguucuucggccugaagaaggaggagugccccgccgugcggcucaucacgcuggaggaggagaugaccaaguacaagcccgaguccgaggagcugaccgccgagcgcaucaccgaguucugccaccgguuccucgagggcaagaucaagccgcaccugaugagccaggagcugcccgaggacugggacaagcagcccgucaaggugcucguggggaagaacuucgaggacgucgccuucgacgagaagaagaacguguucguggaguucuacgcccccuggugcggccacugcaagcagcuggcgccgaucugggacaagcugggggagacguacaaggaccacgagaacaucgucaucgccaagauggacuccaccgccaacgagguggaggccgucaaggugcacagcuuccccacccucaaguucuuccccgccagcgcggaccgcaccgugaucgacuacaacggcgagcggacgcuggacggguucaagaaguuccuggaguccggcggccaggacggggccggcgacgacgacgaccucgaggaccuggaggaggccgaggagcccgacauggaggaggacgacgaccagaaggccgucaaggacgagcuguga

SEQ ID NO: 7716 - RNA, 1527 nt, Artificial Sequence
  derived and/or modified sequence opt2 from PDI/PDIA__Homo_sapiens__AAC13652
augcuccgccgcgcccuccucugccucgccgucgccgcccucguccgcgccgacgcccccgaggaggaggaccacguccucguccuccgcaaguccaacuucgccgaggcccucgccgcccacaaguaccuccucgucgaguucuacgcccccuggugcggccacugcaaggcccucgcccccgaguacgccaaggccgccggcaagcucaaggccgagggcuccgagauccgccucgccaaggucgacgccaccgaggaguccgaccucgcccagcaguacggcguccgcggcuaccccaccaucaaguucuuccgcaacggcgacaccgccucccccaaggaguacaccgccggccgcgaggccgacgacaucgucaacuggcucaagaagcgcaccggccccgccgccaccacccuccccgacggcgccgccgccgagucccucgucgaguccuccgaggucgccgucaucggcuucuucaaggacgucgaguccgacuccgccaagcaguuccuccaggccgccgaggccaucgacgacauccccuucggcaucaccuccaacuccgacgucuucuccaaguaccagcucgacaaggacggcgucguccucuucaagaaguucgacgagggccgcaacaacuucgagggcgaggucaccaaggagaaccuccucgacuucaucaagcacaaccagcucccccucgucaucgaguucaccgagcagaccgcccccaagaucuucggcggcgagaucaagacccacauccuccucuuccuccccaaguccgucuccgacuacgacggcaagcucuccaacuucaagaccgccgccgaguccuucaagggcaagauccucuucaucuucaucgacuccgaccacaccgacaaccagcgcauccucgaguucuucggccucaagaaggaggagugccccgccguccgccucaucacccucgaggaggagaugaccaaguacaagcccgaguccgaggagcucaccgccgagcgcaucaccgaguucugccaccgcuuccucgagggcaagaucaagccccaccucaugucccaggagcuccccgaggacugggacaagcagcccgucaagguccucgucggcaagaacuucgaggacgucgccuucgacgagaagaagaacgucuucgucgaguucuacgcccccuggugcggccacugcaagcagcucgcccccaucugggacaagcucggcgagaccuacaaggaccacgagaacaucgucaucgccaagauggacuccaccgccaacgaggucgaggccgucaagguccacuccuuccccacccucaaguucuuccccgccuccgccgaccgcaccgucaucgacuacaacggcgagcgcacccucgacggcuucaagaaguuccucgaguccggcggccaggacggcgccggcgacgacgacgaccucgaggaccucgaggaggccgaggagcccgacauggaggaggacgacgaccagaaggccgucaaggacgagcucuga

SEQ ID NO: 7717 - RNA, 1527 nt, Artificial Sequence
  derived and/or modified sequence opt3 from PDI/PDIA__Homo_sapiens__AAC13652
augcugagaagggcccuccuuugccuggcuguggcagccuugguccgggcggacgcucccgaggaagaggaucacguuuuagugcugcgcaagagcaacuucgccgaagcacuagccgcucauaaauaccuccugguagaguuuuaugcaccuugguguggccacugcaaggcccuugcuccagaauacgccaaagcggcagggaagcugaaagccgagggauccgagauccgauuggcuaagguggacgccaccgaagagucugaucucgcacagcaauaugguguccguggcuacccgacaauuaaguucuuuagaaauggggacacugcuucacccaaagaauauacggccggaagggaggcggaugacauagugaacuggcugaagaaacggaccggcccugccgcaacaacucugccagauggugcugccgcugagagucucguugaaagcuccgagguggccgucaucggguucuuuaaggacguggaaucugauucggcaaaacaguucuuacaggccgcugaggcgauugacgauauccccuuuggaauuaccucaaauagcgacguauucaguaaguaccagcuggauaaggacggcguugugcuuuuuaaaaaguucgacgaaggccgcaacaauuuugagggggaggucacaaaagaaaacuugcuggauuucaucaagcauaaucaacuaccucucgugauagaguuuaccgaacagacugcaccaaaaaucuucggaggugagauuaagacacacauccugcuuuuccugcccaaauccgugucugacuaugauggcaaguugagcaacuuuaagaccgccgcugaauccuucaaagggaagauucucuuuaucuucauagacucagaucauacggacaaucagagaauuuuagaguuuuucggacugaaaaaggaggaauguccugccgucaggcugaucacucucgaggaagagaugaccaaauacaagccagaaagugaggagcuuacagcagaacggauuacugaguuuugccaccgcuuccuggaaggcaagaucaaaccgcacuugaugagccaggagcuacccgaggauugggacaagcaaccuguuaaagugcugguagguaagaacuuugaagauguggccuucgacgagaaaaagaaugucuuuguggaguucuacgcuccauggugugggcauugcaagcagcucgcccccaucugggauaaacugggagaaaccuauaaggaccacgaaaacauuguuauagcaaaaauggacucuacagcgaaugagguggaggcugucaaggugcauuccuuuccuacccuuaaauucuucccagccucagcagaucgaacgguaaucgacuacaacggcgaaagaacucuggauggcuuuaagaaguucuuggagagcgggggacaggacggugccggcgaugacgaugaccucgaagaucuggaggaagcugaggagcccgacauggaagaggaugacgaucagaaagccguuaaggacgaauuauga

SEQ ID NO: 7718 - RNA, 1527 nt, Artificial Sequence
  derived and/or modified sequence opt4 from PDI/PDIA__Homo_sapiens__AAC13652
augcugagaagagcccugcugugccuggccguggccgcccuggugagagccgacgcccccgaggaggaggaccacgugcuggugcugagaaagagcaacuucgccgaggcccuggccgcccacaaguaccugcugguggaguucuacgcccccuggugcggccacugcaaggcccuggcccccgaguacgccaaggccgccggcaagcugaaggccgagggcagcgagaucagacuggccaagguggacgccaccgaggagagcgaccuggcccagcaguacggcgugagaggcuaccccaccaucaaguucuucagaaacggcgacaccgccagccccaaggaguacaccgccggcagagaggccgacgacaucgugaacuggcugaagaagagaaccggccccgccgccaccacccugcccgacggcgccgccgccgagagccugguggagagcagcgagguggccgugaucggcuucuucaaggacguggagagcgacagcgccaagcaguuccugcaggccgccgaggccaucgacgacauccccuucggcaucaccagcaacagcgacguguucagcaaguaccagcuggacaaggacggcguggugcuguucaagaaguucgacgagggcagaaacaacuucgagggcgaggugaccaaggagaaccugcuggacuucaucaagcacaaccagcugccccuggugaucgaguucaccgagcagaccgcccccaagaucuucggcggcgagaucaagacccacauccugcuguuccugcccaagagcgugagcgacuacgacggcaagcugagcaacuucaagaccgccgccgagagcuucaagggcaagauccuguucaucuucaucgacagcgaccacaccgacaaccagagaauccuggaguucuucggccugaagaaggaggagugccccgccgugagacugaucacccuggaggaggagaugaccaaguacaagcccgagagcgaggagcugaccgccgagagaaucaccgaguucugccacagauuccuggagggcaagaucaagccccaccugaugagccaggagcugcccgaggacugggacaagcagcccgugaaggugcuggugggcaagaacuucgaggacguggccuucgacgagaagaagaacguguucguggaguucuacgcccccuggugcggccacugcaagcagcuggcccccaucugggacaagcugggcgagaccuacaaggaccacgagaacaucgugaucgccaagauggacagcaccgccaacgagguggaggccgugaaggugcacagcuuccccacccugaaguucuuccccgccagcgccgacagaaccgugaucgacuacaacggcgagagaacccuggacggcuucaagaaguuccuggagagcggcggccaggacggcgccggcgacgacgacgaccuggaggaccuggaggaggccgaggagcccgacauggaggaggacgacgaccagaaggccgugaaggacgagcuguga

SEQ ID NO: 7719 - RNA, 1527 nt, Artificial Sequence
  derived and/or modified sequence opt5 from PDI/PDIA__Homo_sapiens__AAC13652
augcugagacgggcccuccugugccuugcuguggccgcgcugguccgcgcugacgcccccgaggaagaggaucacguucucgugcugagaaagagcaacuucgccgaagcucuugccgcucauaaauaccugcucguggaguuuuaugccccuugguguggccacugcaaggcgcuggccccggaauacgcuaaagccgcugggaagcugaaagccgagggauccgagauccggcucgcgaaggucgacgccaccgaagagucugaucuggcucagcaauauggcgugcgcggguaccccacaauuaaguucuuuagaaauggagacacggccagcccuaaagaauauaccgcuggccgggaggccgaugacaucguuaacuggcuuaagaaacgcacagggcccgccgcuaccacacugccugauggagcggccgcugagucccucguggaaucuagcgaggucgccgugauuggcuucuuuaaggacguugaauccgauucugccaaacaguuccugcaggcugccgaggcgaucgacgauauucccuuuggcaucaccagcaauuccgacguguucagcaaguaccagcuugauaaggacggggucgugcuguuuaaaaaguucgacgaaggaagaaacaauuuugagggcgaggugacaaaagaaaaccuccuggauuucaucaagcauaaucaacugccucucgucauugaguuuaccgaacagacggcuccgaaaaucuucgggggagagauuaagacccacauccugcuuuuccugcccaaaucuguuuccgacuaugauggcaagcucagcaacuuuaagacagccgccgaaucuuucaaagggaagauucuguuuaucuucauugacuccgaucauaccgacaaucagcggauccuugaguuuuucggacugaaaaaggaggaauguccugcugugcgccucaucacacuggaggaagagaugaccaaauacaagcccgaaagcgaggagcugacggccgaaagaauuacagaguuuugccaccgguuccucgaaggcaagaucaaaccucaccugaugucucaggagcuucccgaggauugggacaagcaaccggugaaaguccuggugggcaagaacuuugaagauguugcuuucgacgagaaaaagaauguguuugucgaguucuacgccccuuggugugggcauugcaagcagcucgcgcccauuugggauaaacugggagaaaccuauaaggaccacgaaaacaucgugauugccaaaauggacuccacagcuaaugagguugaggccgugaagguccauagcuuuccuacccuuaaauucuuccccgcuuccgccgaucgcaccgugaucgacuacaacggcgaaagaacacuggauggguuuaagaaguuccucgagucuggaggccaggacggggcgggagaugacgaugaccuggaagaucuggaggaagccgaggagcccgacauggaagaggaugacgaucagaaagcugucaaggacgaacucuga

SEQ ID NO: 7720 - RNA, 1527 nt, Artificial Sequence
  derived and/or modified sequence opt6 from PDI/PDIA__Homo_sapiens__AAC13652
augcuaagaagagcucuauuaugucuagcaguugcggcacuagucagggcugacgcaccagaagaagaagaucauguacuaguauuacgaaaaagcaauuucgcagaagcucuagcagcacacaaauaccucuuaguagaauucuacgcaccaugguguggacauugcaaagcauuagcacccgaauaugccaaagcagcaggaaaacuaaaggcagaaggaagcgaaauaagauuagccaaaguagaugcaacagaagaaagcgacuuagcacaacaauauggaguccgaggauauccaacaauaaaauuuuuuagaaauggagauaccgcaucaccaaaagaauauacagcagguagagaagcagaugacauugucaauuggcuaaaaaaaagaacaggcccagcugccacaacacuaccggacggagcagcggcagaauccuuaguagaaucaucagaaguagcaguaaucggauucuucaaagauguugaaagcgauucagcaaaacaauuuuuacaagccgcagaagcaauugaugauauaccauuuggaauaacuucaaacagugacgucuucaguaaauaucaauuagauaaagaugguguuguacuauucaaaaaauucgacgaaggaagaaauaacuucgaaggagaagugacaaaagaaaaucuucuagacuucauaaagcauaaccaacuaccauuaguaauugaauuuacagaacaaacagcuccaaaaauauuuggaggagaaauaaaaacacauauacuauuauucuuaccaaaaaguguaucagacuaugacgguaaacuaaguaacuuuaaaacugcagcagaaaguuuuaaaggaaaaauauuauuuauauuuauugauagugaccauacugauaaccaacgaauacuagaauucuuuggauuaaaaaaagaagaauguccggcagucagacucauaacauuagaagaagaaaugacaaaauacaaaccagaaagugaggaauugacagcagaaagaauaacagaauucugucacagauuccuagaaggaaaaauaaaaccacauuuaaugucacaagaacuaccagaggauugggacaaacaacccguaaaaguauuaguaggaaaaaacuuugaagauguagcauucgacgaaaaaaaaaacguguuuguagaauuuuaugcaccaugguguggacauuguaaacaacuagccccuauaugggauaaacuaggagaaacauacaaagaccaugaaaacauaguaauagcaaaaauggacucaacagcuaaugaagucgaagcaguaaaaguacacucguuuccaacguuaaaauuuuuuccagcaucagcagaucguacaguaauagacuacaauggagaaagaacauuagacggauuuaaaaaauucuuagaaagcggaggacaggacggugcaggcgaugaugaugaccuugaagauuuagaagaagcugaagaaccagauauggaagaagacgaugaccaaaaagcaguaaaagacgaacuuuaa

SEQ ID NO: 7721 - protein, 332 aa, Artificial Sequence [sequence omitted]

SEQ ID NO: 7722 - RNA, 999 nt, Artificial Sequence
  PDI/PDIA__Homo_sapiens__AAG32626
augggagucugguuaaauaaagaugacuauaucagagacuugaaaaggaucauucucuguuuucugauaguguauauggccauuuuagugggcacagaucaggauuuuuacaguuuacuuggaguguccaaaacugcaagcaguagagaaauaagacaagcuuucaagaaauuggcauugaaguuacauccugauaaaaacccgaauaacccaaaugcacauggcaauuuuuuaaaaauaaauagagcauaugaaguacucaaagaugaagaucuacggaaaaaguaugacaaauauggagaaaagggacuugaggauaaucaagguggccaguaugaaagcuggaacuauuaucguuaugauuuugguauuuaugaugaugauccugaaaucauaacauuggaaagaagagaauuugaugcugcuguuaauucuggagaacugugguuuguaaauuuuuacuccccaggcuguucacacugccaugauuuagcucccacauggagagacuuugcuaaagaaguggauggguuacuucgaauuggagcuguuaacuguggugaugauagaaugcuuugccgaaugaaaggagucaacagcuaucccagucucuucauuuuucggucuggaauggccccagugaaauaucauggagacagaucaaaggagaguuuagugaguuuugcaaugcagcauguuagaaguacagugacagaacuuuggacaggaaauuuugucaacuccauacaaacugcuuuugcugcugguauuggcuggcugaucacuuuuuguucaaaaggaggagauuguuugacuucacagacacgacucaggcuuaguggcauguuggauggucuuguuaauguaggauggauggacugugccacccaggauaaccuuuguaaaagcuuagauauuacaacaaguacuacugcuuauuuuccuccuggagccacuuuaaauaacaaagagaaaaacaguauuuugcugcuucauuga

SEQ ID NO: 7723 - RNA, 999 nt, Artificial Sequence
  derived and/or modified sequence opt1 from PDI/PDIA__Homo_sapiens__AAG32626
augggcguguggcugaacaaggacgacuacauccgcgaccucaagcggaucauccugugcuuccugaucgucuacauggccauccucguggggaccgaccaggacuucuacagccugcugggcguguccaagaccgccagcucccgcgagauccggcaggcguucaagaagcucgcccugaagcugcaccccgacaagaacccgaacaaccccaacgcccacgggaacuuccucaagaucaaccgcgccuacgagguccugaaggacgaggaccugcggaagaaguacgacaaguacggcgagaaggggcucgaggacaaccagggcggccaguacgagagcuggaacuacuaccgcuacgacuucgggaucuacgacgacgaccccgagaucaucacgcuggagcggcgcgaguucgacgccgcggugaacuccggcgagcugugguucgugaacuucuacagccccgggugcucccacugccacgaccucgccccgaccuggcgggacuucgccaaggaggucgacggccugcugcgcaucggggccgugaacugcggcgacgaccggaugcucugccgcaugaagggcgugaacagcuaccccucccuguucaucuuccggagcgggauggcgcccgucaaguaccacggcgaccgcuccaaggagagccugguguccuucgccaugcagcacgugcggagcaccgucaccgagcucuggacggggaacuucgugaacuccauccagaccgccuucgccgccggcaucggcuggcugaucaccuucugcagcaagggcggggacugccugaccucccagacgcgccuccggcugagcgggaugcuggacggccucgugaacgucggguggauggacugcgcgacccaggacaaccugugcaagucccuggacaucaccaccagcacgaccgccuacuucccgcccggcgccacccucaacaacaaggagaagaacagcauccugcugcuccacuga

SEQ ID NO: 7724 - RNA, 999 nt, Artificial Sequence
  derived and/or modified sequence opt2 from PDI/PDIA__Homo_sapiens__AAG32626
augggcgucuggcucaacaaggacgacuacauccgcgaccucaagcgcaucauccucugcuuccucaucgucuacauggccauccucgucggcaccgaccaggacuucuacucccuccucggcgucuccaagaccgccuccucccgcgagauccgccaggccuucaagaagcucgcccucaagcuccaccccgacaagaaccccaacaaccccaacgcccacggcaacuuccucaagaucaaccgcgccuacgagguccucaaggacgaggaccuccgcaagaaguacgacaaguacggcgagaagggccucgaggacaaccagggcggccaguacgaguccuggaacuacuaccgcuacgacuucggcaucuacgacgacgaccccgagaucaucacccucgagcgccgcgaguucgacgccgccgucaacuccggcgagcucugguucgucaacuucuacucccccggcugcucccacugccacgaccucgcccccaccuggcgcgacuucgccaaggaggucgacggccuccuccgcaucggcgccgucaacugcggcgacgaccgcaugcucugccgcaugaagggcgucaacuccuaccccucccucuucaucuuccgcuccggcauggcccccgucaaguaccacggcgaccgcuccaaggagucccucgucuccuucgccaugcagcacguccgcuccaccgucaccgagcucuggaccggcaacuucgucaacuccauccagaccgccuucgccgccggcaucggcuggcucaucaccuucugcuccaagggcggcgacugccucaccucccagacccgccuccgccucuccggcaugcucgacggccucgucaacgucggcuggauggacugcgccacccaggacaaccucugcaagucccucgacaucaccaccuccaccaccgccuacuucccccccggcgccacccucaacaacaaggagaagaacuccauccuccuccuccacuga

SEQ ID NO: 7725 - RNA, 999 nt, Artificial Sequence
  derived and/or modified sequence opt3 from PDI/PDIA__Homo_sapiens__AAG32626
augggcguguggcugaacaaggacgauuacaucagagaccucaaaaggauuauacuuugcuuccugaucgucuauauggccauuuugguugggaccgaucaggacuuuuacagcuuacugggaguguccaagacagcuucuucacgggagauccgccaagcauucaaaaagcuagcccucaaacugcaccccgauaagaauccuaacaauccaaacgcgcaugguaauuuucuuaagauuaaccgagcuuaugaaguacugaaagacgaggauuugcguaagaaauacgacaaguauggcgaaaaagggcucgaggauaaucagggaggccaguacgaaaguuggaacuauuacagauacgacuucgguaucuaugaugacgauccggagauaaucacucuggagaggcgggaauuugacgccgcagugaauagcggggagcugugguucgucaacuuuuacucccccggauguucucacugccaugaccucgccccuacguggcgcgauuucgcuaaggaaguggacggcuuacugagaauuggcgcaguuaauuguggggaugacaggaugcuuugccggaugaagggagugaacucguauccaucauuguuuaucuuccgcagcgguauggcccccgucaaauaccacggcgaucgaaguaaggagucccuggugucuuuugcuaugcagcauguaagaagcaccguuacagagcuauggacugggaauuucgugaacuccauucaaaccgccuuugcggcaggaaucggcuggcucauaacauucuguucaaaagguggggacugccugaccagucagacuaggcuucggcugagcggaauguuggauggccucgucaaugugggcuggauggacugugccacacaggauaaccugugcaagucuuuagacauuaccacguccacuaccgcuuauuucccuccaggggccacacugaacaauaaagaaaagaacucaauccuccuucugcacuga

SEQ ID NO: 7726 - RNA, 999 nt, Artificial Sequence
  derived and/or modified sequence opt4 from PDI/PDIA__Homo_sapiens__AAG32626
augggcguguggcugaacaaggacgacuacaucagagaccugaagagaaucauccugugcuuccugaucguguacauggccauccuggugggcaccgaccaggacuucuacagccugcugggcgugagcaagaccgccagcagcagagagaucagacaggccuucaagaagcuggcccugaagcugcaccccgacaagaaccccaacaaccccaacgcccacggcaacuuccugaagaucaacagagccuacgaggugcugaaggacgaggaccugagaaagaaguacgacaaguacggcgagaagggccuggaggacaaccagggcggccaguacgagagcuggaacuacuacagauacgacuucggcaucuacgacgacgaccccgagaucaucacccuggagagaagagaguucgacgccgccgugaacagcggcgagcugugguucgugaacuucuacagccccggcugcagccacugccacgaccuggcccccaccuggagagacuucgccaaggagguggacggccugcugagaaucggcgccgugaacugcggcgacgacagaaugcugugcagaaugaagggcgugaacagcuaccccagccuguucaucuucagaagcggcauggcccccgugaaguaccacggcgacagaagcaaggagagccuggugagcuucgccaugcagcacgugagaagcaccgugaccgagcuguggaccggcaacuucgugaacagcauccagaccgccuucgccgccggcaucggcuggcugaucaccuucugcagcaagggcggcgacugccugaccagccagaccagacugagacugagcggcaugcuggacggccuggugaacgugggcuggauggacugcgccacccaggacaaccugugcaagagccuggacaucaccaccagcaccaccgccuacuucccccccggcgccacccugaacaacaaggagaagaacagcauccugcugcugcacuga

SEQ ID NO: 7727 - RNA, 999 nt, Artificial Sequence
  derived and/or modified sequence opt5 from PDI/PDIA__Homo_sapiens__AAG32626
augggcguguggcugaacaaggacgauuacaucagagaccucaaacggauuauccugugcuuccuuauugucuauauggccauccugguugggaccgaucaggacuuuuacagccuccugggaguguccaagacagcuucuagccgcgagauuagacaagccuucaaaaagcuggcgcuuaaacuccaccccgauaagaauccuaacaauccgaacgcucauggcaauuuucugaagaucaaccgggccuaugaagugcugaaagacgaggaucuccgcaagaaauacgacaaguauggggaaaaaggacuggaggauaaucagggcgggcaguacgaauccuggaacuauuacagauacgacuucggaaucuaugaugacgaucccgagauuaucacgcuugagcggcgcgaauuugacgccgcugucaauucuggcgagcugugguucgugaacuuuuacagcccuggcuguucccacugccaugaccucgcccccaccuggagagauuucgcuaaggaaguugacgggcugcuucggauuggagccgugaauuguggcgaugaccgcaugcugugcagaaugaagggggucaacucuuauccuagccucuuuaucuuccgguccggaauggcgcccgugaaauaccacggcgaucgcagcaaggagucucugguuuccuuugccaugcagcaugugagaagcacagucaccgagcuguggacagggaauuucgugaacucuauucaaaccgcuuuugccgcuggaaucggcuggcucauuacauucuguuccaaaggcggggacugccugaccagccagacgcggcuucgccugucuggaaugcucgauggccuggugaaugucggguggauggacugugccacccaggauaaccuuugcaagucccuggacaucacaaccagcacaaccgcguauuucccuccgggagccacgcucaacaauaaagaaaagaacuccauccugcugcuccacuga

SEQ ID NO: 7728 - RNA, 999 nt, Artificial Sequence
  derived and/or modified sequence opt6 from PDI/PDIA__Homo_sapiens__AAG32626
augggaguauggcuaaacaaagacgauuacauacgagaucuaaaaagaauaauauuaugcuuuuuaauaguauauauggcaauauuaguaggaacagaccaagauuucuauaguuuauuagguguaucaaaaacagcaucgagcagagaaauaagacaagcauuuaaaaaacuagcacuaaaacuacauccagauaaaaauccaaauaauccaaacgcacacggaaacuuucuaaaaauaaauagagcauaugaaguauuaaaagaugaagaucuaagaaaaaaauacgauaaguauggagaaaaaggucuagaagacaaccaaggaggacaauacgaaagcuggaauuacuaccgauacgauuucgguauauaugacgaugacccagaaauaauaacauuagaaagaagagaauucgacgcagcaguaaacucuggagaacuaugguucguuaacuuuuacucucccggauguucacacugucacgauuuagcaccaacauggagagacuuugcaaaagaaguugacggauuauuaagaauaggagcaguaaacugcggagacgauagaaugcuaugucgaaugaaaggaguaaauagcuacccaagucuauuuauauucagaucaggaauggcaccaguaaaauaccacggcgauagaucaaaagaaagcuuaguaucauucgcaaugcaacacguaagaucgacaguaacagaacuauggacaggaaacuuuguaaauagcauacaaacugcauuugcagcuggaauaggauggcuaauaacauuuuguucaaaaggaggagauugcuuaacaucucaaacaagacuaagacuaucaggaauguuagacggacuaguaaacguaggauggauggauugugcuacacaagacaauuuauguaaaaguuuagauauaacaacaucaacaacagcauauuuuccaccaggagcaacucuaaauaacaaagaaaaaaacucgauacuauuauuacacuaa

SEQ ID NO: 7729 - protein, 177 aa, Artificial Sequence [sequence omitted]

SEQ ID NO: 7730 - RNA, 534 nt, Artificial Sequence
  PDI/PDIA__Homo_sapiens__AAQ14565
augggagucugguuaaauaaagaugacuauaucagagacuugaaaaggaucauucucuguuuucugauaguguauauggccauuuuagugggcacagaucaggauuuuuacaguuuacuuggaguguccaaaacugcaagcaguagagaaauaagacaagcuuucaagaaauuggcauugaaguuacauccugauaaaaacccgaauaacccaaaugcacauggcgauuuuuuaaaaauaaauagagcauaugaaguacucaaagaugaagaucuacggaaaaaguaugacaaauauggagaaaagggacuugaggauaaucaagguggccaguaugaaagcuggaacuauuaucguuaugauuuugguauuuaugaugaugauccugaaaucauaacauuggaaagaagagaauuugaugcugcuguuaauucuggagaacugugguuuguaaauuuuuacuccccaggcuguucacacugccaugauuuagcucccacauggagagacuuugccaaagaaucccugagauaa

SEQ ID NO: 7731 - RNA, 534 nt, Artificial Sequence
  derived and/or modified sequence opt1 from PDI/PDIA__Homo_sapiens__AAQ14565
augggcguguggcugaacaaggacgacuacauccgcgaccucaagcggaucauccugugcuuccugaucgucuacauggccauccucguggggaccgaccaggacuucuacagccugcugggcguguccaagaccgccagcucccgcgagauccggcaggcguucaagaagcucgcccugaagcugcaccccgacaagaacccgaacaaccccaacgcccacggggacuuccucaagaucaaccgcgccuacgagguccugaaggacgaggaccugcggaagaaguacgacaaguacggcgagaaggggcucgaggacaaccagggcggccaguacgagagcuggaacuacuaccgcuacgacuucgggaucuacgacgacgaccccgagaucaucacgcuggagcggcgcgaguucgacgccgcggugaacuccggcgagcugugguucgugaacuucuacagccccgggugcucccacugccacgaccucgccccgaccuggcgggacuucgccaaggagagccugcgcuga

SEQ ID NO: 7732 - RNA, 534 nt, Artificial Sequence
  derived and/or modified sequence opt2 from PDI/PDIA__Homo_sapiens__AAQ14565
augggcgucuggcucaacaaggacgacuacauccgcgaccucaagcgcaucauccucugcuuccucaucgucuacauggccauccucgucggcaccgaccaggacuucuacucccuccucggcgucuccaagaccgccuccucccgcgagauccgccaggccuucaagaagcucgcccucaagcuccaccccgacaagaaccccaacaaccccaacgcccacggcgacuuccucaagaucaaccgcgccuacgagguccucaaggacgaggaccuccgcaagaaguacgacaaguacggcgagaagggccucgaggacaaccagggcggccaguacgaguccuggaacuacuaccgcuacgacuucggcaucuacgacgacgaccccgagaucaucacccucgagcgccgcgaguucgacgccgccgucaacuccggcgagcucugguucgucaacuucuacucccccggcugcucccacugccacgaccucgcccccaccuggcgcgacuucgccaaggagucccuccgcuga

SEQ ID NO: 7733 - RNA, 534 nt, Artificial Sequence
  derived and/or modified sequence opt3 from PDI/PDIA__Homo_sapiens__AAQ14565
augggcguguggcugaacaaggacgauuacaucagagaccucaaaaggauuauacuuugcuuccugaucgucuauauggccauuuugguugggaccgaucaggacuuuuacagcuuacugggaguguccaagacagcuucuucacgggagauccgccaagcauucaaaaagcuagcccucaaacugcaccccgauaagaauccuaacaauccaaacgcgcauggugacuuucuuaagauuaaucgagcuuaugaaguacugaaagaugaggacuugcguaagaaauacgauaaguauggcgaaaaagggcucgaggacaaccagggaggccaguacgaaaguuggaauuauuacagauacgauuucgguaucuaugacgaugacccggagauaaucacucuggagaggcgggaauuugacgccgcagugaacagcggggagcugugguucgucaauuuuuacucccccggauguucucacugccaugaucucgccccuacguggcgcgacuucgcuaaggaaucguuaagauga

SEQ ID NO: 7734 - RNA, 534 nt, Artificial Sequence
  derived and/or modified sequence opt4 from PDI/PDIA__Homo_sapiens__AAQ14565
augggcguguggcugaacaaggacgacuacaucagagaccugaagagaaucauccugugcuuccugaucguguacauggccauccuggugggcaccgaccaggacuucuacagccugcugggcgugagcaagaccgccagcagcagagagaucagacaggccuucaagaagcuggcccugaagcugcaccccgacaagaaccccaacaaccccaacgcccacggcgacuuccugaagaucaacagagccuacgaggugcugaaggacgaggaccugagaaagaaguacgacaaguacggcgagaagggccuggaggacaaccagggcggccaguacgagagcuggaacuacuacagauacgacuucggcaucuacgacgacgaccccgagaucaucacccuggagagaagagaguucgacgccgccgugaacagcggcgagcugugguucgugaacuucuacagccccggcugcagccacugccacgaccuggcccccaccuggagagacuucgccaaggagagccugagauga

SEQ ID NO: 7735 - RNA, 534 nt, Artificial Sequence
  derived and/or modified sequence opt5 from PDI/PDIA__Homo_sapiens__AAQ14565
augggcguguggcugaacaaggacgauuacaucagagaccucaaacggauuauccugugcuuccuuauugucuauauggccauccugguugggaccgaucaggacuuuuacagccuccugggaguguccaagacagcuucuagccgcgagauuagacaagccuucaaaaagcuggcgcuuaaacuccaccccgauaagaauccuaacaauccgaacgcucauggcgacuuucugaagaucaaucgggccuaugaagugcugaaagaugaggaccuccgcaagaaauacgauaaguauggggaaaaaggacuggaggacaaccagggcgggcaguacgaauccuggaauuauuacagauacgauuucggaaucuaugacgaugaccccgagauuaucacgcuugagcggcgcgaauuugacgccgcugucaacucuggcgagcugugguucgugaauuuuuacagcccuggcuguucccacugccaugaucucgcccccaccuggagagacuucgcuaaggaaucucugcgguga

SEQ ID NO: 7736 - RNA, 534 nt, Artificial Sequence
  derived and/or modified sequence opt6 from PDI/PDIA__Homo_sapiens__AAQ14565
augggaguauggcuaaacaaagacgacuacauaagagacuuaaaaagaauaauacuaugcuuccuaauaguauacauggcaauacuaguaggaacagaccaagacuucuacagccuacuaggaguaucaaaaacagcaucaucaagagaaauacgacaagcauucaaaaaauuagcacuaaaauuacauccagacaaaaacccaaacaacccaaacgcacacggagacuuccuaaaaauaaacagagcauacgaaguauuaaaagacgaagacuuaagaaaaaaauacgacaaauacggagaaaaaggacuagaagacaaccaaggaggacaauacgaaucauggaacuacuacagauacgacuucggaauauacgacgacgacccagaaauaauaacacuagaaagaagagaauucgacgcagcaguaaacucaggagaacuaugguucguaaacuucuacucaccaggaugcagucacugccacgaccuagcaccaacauggagagacuucgcaaaagaaucacuacgauaa

SEQ ID NO: 7737 - protein, 480 aa, Artificial Sequence [sequence omitted]

SEQ ID NO: 7738 - RNA, 1443 nt, Artificial Sequence
  Akt__Homo_sapiens__ABY87524
augagcgacguggcuauugugaaggaggguuggcugcacaaacgaggggaguacaucaagaccuggcggccacgcuacuuccuccucaagaaugauggcaccuucauuggcuacaaggagcggccgcaggauguggaccaacgugaggcuccccucaacaacuucucuguggcgcagugccagcugaugaagacggagcggccccggcccaacaccuucaucauccgcugccugcaguggaccacugucaucgaacgcaccuuccauguggagacuccugaggagcgggaggaguggacaaccgccauccagacuguggcugacggccucaagaagcaggaggaggaggagauggacuuccggucgggcucacccagugacaacucaggggcugaagagauggaggugucccuggccaagcccaagcaccgcgugaccaugaacgaguuugaguaccugaagcugcugggcaagggcacuuucggcaaggugauccuggugaaggagaaggccacaggccgcuacuacgccaugaagauccucaagaaggaagucaucguggccaaggacgagguggcccacacacucaccgagaaccgcguccugcagaacuccaggcaccccuuccucacagcccugaaguacucuuuccagacccacgaccgccucugcuuugucauggaguacgccaacgggggcgagcuguucuuccaccugucccgggagcguguguucuccgaggaccgggcccgcuucuauggcgcugagauugugucagcccuggacuaccugcacucggagaagaacgugguguaccgggaccucaagcuggagaaccucaugcuggacaaggacgggcacauuaagaucacagacuucgggcugugcaaggaggggaucaaggacggugccaccaugaagaccuuuugcggcacaccugaguaccuggcccccgaggugcuggaggacaaugacuacggccgugcaguggacuggugggggcugggcguggucauguacgagaugaugugcggucgccugcccuucuacaaccaggaccaugagaagcuuuuugagcucauccucauggaggagauccgcuucccgcgcacgcuuggucccgaggccaaguccuugcuuucagggcugcucaagaaggaccccaagcagaggcuuggcgggggcuccgaggacgccaaggagaucaugcagcaucgcuucuuugccgguaucguguggcagcacguguacgagaagaagcucagcccacccuucaagccccaggucacgucggagacugacaccagguauuuugaugaggaguucacggcccagaugaucaccaucacaccaccugaccaagaugacagcauggaguguguggacagcgagcgcaggccccacuucccccaguucuccuacucggccagcggcacggccuga

SEQ ID NO: 7739 - RNA, 1443 nt, Artificial Sequence
  derived and/or modified sequence opt1 from Akt__Homo_sapiens__ABY87524
augagcgacguggccaucgucaaggagggcuggcugcacaagcgcggggaguacaucaagaccuggcggccccgcuacuuccuccugaagaacgacggcaccuucaucggguacaaggagcggccgcaggacguggaccagcgcgaggcgccccugaacaacuucuccguggcccagugccagcucaugaagacggagcggccccgccccaacaccuucaucauccggugccugcaguggaccaccgucaucgagcgcacguuccacguggagaccccggaggagcgggaggaguggaccaccgccauccagacgguggccgacggccugaagaagcaggaggaggaggagauggacuuccgcagcgggucccccagcgacaacuccggcgccgaggagauggaggucagccucgccaagcccaagcaccgggugaccaugaacgaguucgaguaccugaagcugcucggcaaggggaccuucggcaaggugauccuggucaaggagaaggcgaccgggcgcuacuacgccaugaagauccugaagaaggaggugaucguggccaaggacgaggucgcccacacgcucaccgagaaccgggugcugcagaacucccgccaccccuuccugaccgcgcucaaguacagcuuccagacccacgaccggcugugcuucgugauggaguacgccaacggcggggagcuguucuuccaccucucccgcgagcgggucuucagcgaggaccgcgcccgguucuacggcgccgagaucguguccgcccuggacuaccugcacagcgagaagaacguggucuaccgcgaccucaagcuggagaaccugaugcucgacaaggacggccacaucaagaucacggacuucgggcugugcaaggagggcaucaaggacggggcgaccaugaagaccuucugcggcaccccggaguaccuggcccccgaggugcucgaggacaacgacuacggccgggccguggacuggugggggcugggcgucgugauguacgagaugaugugcgggcgccugcccuucuacaaccaggaccacgagaagcuguucgagcucauccugauggaggagauccgcuucccccggacgcucggcccggaggccaagucccugcugagcgggcuccugaagaaggaccccaagcagcgccugggcggcggguccgaggacgccaaggagaucaugcagcaccgguucuucgcgggcaucguguggcagcacgucuacgagaagaagcucagcccgcccuucaagccccaggugaccuccgagaccgacacccgcuacuucgacgaggaguucacggcccagaugaucaccaucaccccgcccgaccaggacgacagcauggagugcgucgacuccgagcggcgcccccacuucccccaguucagcuacagcgccuccgggaccgccuga

SEQ ID NO: 7740 - RNA, 1443 nt, Artificial Sequence
  derived and/or modified sequence opt2 from Akt__Homo_sapiens__ABY87524
auguccgacgucgccaucgucaaggagggcuggcuccacaagcgcggcgaguacaucaagaccuggcgcccccgcuacuuccuccucaagaacgacggcaccuucaucggcuacaaggagcgcccccaggacgucgaccagcgcgaggccccccucaacaacuucuccgucgcccagugccagcucaugaagaccgagcgcccccgccccaacaccuucaucauccgcugccuccaguggaccaccgucaucgagcgcaccuuccacgucgagacccccgaggagcgcgaggaguggaccaccgccauccagaccgucgccgacggccucaagaagcaggaggaggaggagauggacuuccgcuccggcucccccuccgacaacuccggcgccgaggagauggaggucucccucgccaagcccaagcaccgcgucaccaugaacgaguucgaguaccucaagcuccucggcaagggcaccuucggcaaggucauccucgucaaggagaaggccaccggccgcuacuacgccaugaagauccucaagaaggaggucaucgucgccaaggacgaggucgcccacacccucaccgagaaccgcguccuccagaacucccgccaccccuuccucaccgcccucaaguacuccuuccagacccacgaccgccucugcuucgucauggaguacgccaacggcggcgagcucuucuuccaccucucccgcgagcgcgucuucuccgaggaccgcgcccgcuucuacggcgccgagaucgucuccgcccucgacuaccuccacuccgagaagaacgucgucuaccgcgaccucaagcucgagaaccucaugcucgacaaggacggccacaucaagaucaccgacuucggccucugcaaggagggcaucaaggacggcgccaccaugaagaccuucugcggcacccccgaguaccucgcccccgagguccucgaggacaacgacuacggccgcgccgucgacugguggggccucggcgucgucauguacgagaugaugugcggccgccuccccuucuacaaccaggaccacgagaagcucuucgagcucauccucauggaggagauccgcuucccccgcacccucggccccgaggccaagucccuccucuccggccuccucaagaaggaccccaagcagcgccucggcggcggcuccgaggacgccaaggagaucaugcagcaccgcuucuucgccggcaucgucuggcagcacgucuacgagaagaagcucuccccccccuucaagccccaggucaccuccgagaccgacacccgcuacuucgacgaggaguucaccgcccagaugaucaccaucaccccccccgaccaggacgacuccauggagugcgucgacuccgagcgccgcccccacuucccccaguucuccuacuccgccuccggcaccgccuga

SEQ ID NO: 7741 - RNA, 1443 nt, Artificial Sequence
  derived and/or modified sequence opt3 from Akt__Homo_sapiens__ABY87524
augagcgacguggccaucgucaaggagggcuggcugcacaaaagaggggaauacauuaagaccuggaggccccgguauuuccuccuuaaaaacgauggaacauuuauagguuacaaggagcgcccucaggacguugaucaacgagaagcuccacugaauaacuucuccguggcacagugccaguugaugaaaacugagcguccgagacccaauacguuuaucauuagguguuuacaguggaccacaguaaucgaacggacuuuccauguggagaccccugaggaacgcgaggaauggacaaccgccauucaaacugucgcggacggccugaagaagcaggaggaggaagagauggauuuuagaucugggucaccaagugacaacagcggagcugaagagauggaagugucccuagccaaacccaagcacaggguuacaaugaaugaguucgaguaucucaaacugcuuggcaaggguaccuuugggaaagugauccuggucaaggaaaaggcaacgggacgguacuaugccaugaaaauauugaagaaagaggugaucguagcuaaggaugaaguugcacauacucucaccgagaaccgcgugcugcaaaauucucgacacccuuuccugacagcccucaaauacucguuucagacucaugacagauuaugcuucgucauggaauaugcuaacggcggcgagcuguuuuuccaccuuucaagggagcggguguuuagcgaagaucgugcccgcuucuacggggcggagauugugagugcauuggacuaccugcacuccgaaaagaaugucguuuauagagaucuaaaacucgagaaccugaugcuugacaaggauggacauaucaagauuaccgacuucggucuguguaaagaaggcaucaaggacggggccacaaugaaaaccuuuugcggaacgccagaguacuuggcucccgaggugcucgaagauaaugacuauggcagggccguagauugguggggucuggggguggucauguacgagaugauguguggacgguuaccuuucuauaaccaggaccacgaaaagcuguuugagcucauacuuauggaggaaauucgauucccacgcacucugggcccggaggcaaaaucuuugcuaagcggccugcucaagaaggaucccaaacagagacuugggggagguuccgaagacgcuaaggagaucaugcagcauagguuuuucgccggcauuguguggcagcacguuuacgaaaagaaacugucaccuccauuuaaaccccaagugacaagugagaccgauacucgguauuucgacgaggaauuuacagcgcagaugaucaccaucacgccuccagaucaggacgauagcauggagugcgucgacucugaacgcagaccccacuucccgcaauuuuccuacucagccagcgggaccgcauga

SEQ ID NO: 7742 - RNA, 1443 nt, Artificial Sequence
  derived and/or modified sequence opt4 from Akt__Homo_sapiens__ABY87524
augagcgacguggccaucgugaaggagggcuggcugcacaagagaggcgaguacaucaagaccuggagacccagauacuuccugcugaagaacgacggcaccuucaucggcuacaaggagagaccccaggacguggaccagagagaggccccccugaacaacuucagcguggcccagugccagcugaugaagaccgagagacccagacccaacaccuucaucaucagaugccugcaguggaccaccgugaucgagagaaccuuccacguggagacccccgaggagagagaggaguggaccaccgccauccagaccguggccgacggccugaagaagcaggaggaggaggagauggacuucagaagcggcagccccagcgacaacagcggcgccgaggagauggaggugagccuggccaagcccaagcacagagugaccaugaacgaguucgaguaccugaagcugcugggcaagggcaccuucggcaaggugauccuggugaaggagaaggccaccggcagauacuacgccaugaagauccugaagaaggaggugaucguggccaaggacgagguggcccacacccugaccgagaacagagugcugcagaacagcagacaccccuuccugaccgcccugaaguacagcuuccagacccacgacagacugugcuucgugauggaguacgccaacggcggcgagcuguucuuccaccugagcagagagagaguguucagcgaggacagagccagauucuacggcgccgagaucgugagcgcccuggacuaccugcacagcgagaagaacgugguguacagagaccugaagcuggagaaccugaugcuggacaaggacggccacaucaagaucaccgacuucggccugugcaaggagggcaucaaggacggcgccaccaugaagaccuucugcggcacccccgaguaccuggcccccgaggugcuggaggacaacgacuacggcagagccguggacugguggggccugggcguggugauguacgagaugaugugcggcagacugcccuucuacaaccaggaccacgagaagcuguucgagcugauccugauggaggagaucagauuccccagaacccugggccccgaggccaagagccugcugagcggccugcugaagaaggaccccaagcagagacugggcggcggcagcgaggacgccaaggagaucaugcagcacagauucuucgccggcaucguguggcagcacguguacgagaagaagcugagcccccccuucaagccccaggugaccagcgagaccgacaccagauacuucgacgaggaguucaccgcccagaugaucaccaucaccccccccgaccaggacgacagcauggagugcguggacagcgagagaagaccccacuucccccaguucagcuacagcgccagcggcaccgccuga

SEQ ID NO: 7743 - RNA, 1443 nt, Artificial Sequence
  derived and/or modified sequence opt5 from Akt__Homo_sapiens__ABY87524
augagcgacguggccaucgucaaggagggcuggcugcacaaaagaggggaauacauuaagaccuggcggccccgcuauuuccuccugaaaaacgauggaacauuuaucggcuacaaggagagaccucaggacguugaucaacgggaagcuccgcuuaauaacuucuccguggcccagugccagcugaugaaaacggagcgccccagaccuaauaccuuuauuauccggugucuccaguggacaaccgugauugaacgcacauuccaugucgagacccccgaggaaagagaggaauggacaaccgcgauccaaacgguggcugacgggcugaagaagcaggaggaggaagagauggauuuucggucuggaagcccuuccgacaacucuggcgccgaagagauggaaguuagccuugccaaacccaagcaccgcgugaccaugaaugaguucgaguaucugaaacuccuggggaagggaacauuuggcaaagucauccuggugaaggaaaaggcuaccggcagauacuaugccaugaaaauucucaagaaagagguuaucguggcuaaggaugaagucgcccauacacugaccgagaaccgggugcuucaaaauucccgccacccuuuccugacggcgcucaaauacucuuuucagacacaugacagacugugcuucgugauggaauaugccaacgggggagagcuguuuuuccaccuuagccgggagcgcgucuuuuccgaagauagagcucgguucuacggcgccgagauuguuagcgcucucgacuaccugcacucugaaaagaaugugguguauagagaucugaaacucgagaaccugaugcuugacaaggaugggcauaucaagauuaccgacuucggacuguguaaagaaggcaucaaggacggggccacaaugaaaaccuuuugcggaaccccggaguaccucgcgcccgagguccuggaagauaaugacuauggccgcgccguggauugguggggccuugggguugugauguacgagaugauguguggacggcugccuuucuauaaccaggaccacgaaaagcucuuugagcugauucugauggaggaaaucagauucccccgcacacucggcccugaggcuaaaucccugcuuagcgggcugcucaagaaggaucccaaacagcggcugggaggcgggucugaagacgccaaggagaucaugcagcauagauuuuucgcuggaauugucuggcagcacguguacgaaaagaaacuuuccccgccuuuuaaaccccaaguuacgagcgagaccgauacacgcuauuucgacgaggaauuuaccgcccagaugaucacaauuaccccucccgaucaggacgauucuauggagugcguggacuccgaacggagaccccacuucccucaauuuagcuacuccgccucuggcacggcuuga

SEQ ID NO: 7744 - protein, 480 aa, Artificial Sequence [sequence omitted]

SEQ ID NO: 7745 - RNA, 1443 nt, Artificial Sequence; identical to SEQ ID NO: 7738
  Akt__Homo_sapiens__AAH00479

SEQ ID NO: 7746 - RNA, 1443 nt, Artificial Sequence; identical to SEQ ID NO: 7739
  derived and/or modified sequence opt1 from Akt__Homo_sapiens__AAH00479

SEQ ID NO: 7747 - RNA, 1443 nt, Artificial Sequence; identical to SEQ ID NO: 7740
  derived and/or modified sequence opt2 from Akt__Homo_sapiens__AAH00479

SEQ ID NO: 7748 - RNA, 1443 nt, Artificial Sequence; identical to SEQ ID NO: 7741
  derived and/or modified sequence opt3 from Akt__Homo_sapiens__AAH00479

SEQ ID NO: 7749 - RNA, 1443 nt, Artificial Sequence; identical to SEQ ID NO: 7742
  derived and/or modified sequence opt4 from Akt__Homo_sapiens__AAH00479

SEQ ID NO: 7750 - RNA, 1443 nt, Artificial Sequence; identical to SEQ ID NO: 7743
  derived and/or modified sequence opt5 from Akt__Homo_sapiens__AAH00479

SEQ ID NO: 7751 - protein, 481 aa, Artificial Sequence
  Akt__Homo_sapiens__P31751
MNEVSVIKEGWLHKRGEYIKTWRPRYFLLKSDGSFIGYKERPEAPDQTLPPLNNFSVAECQLMKTERPRPNTFVIRCLQWTTVIERTFHVDSPDEREEWMRAIQMVANSLKQRAPGEDPMDYKCGSPSDSSTTEEMEVAVSKARAKVTMNDFDYLKLLGKGTFGKVILVREKATGRYYAMKILRKEVIIAKDEVAHTVTESRVLQNTRHPFLTALKYAFQTHDRLCFVMEYANGGELFFHLSRERVFTEERARFYGAEIVSALEYLHSRDVVYRDIKLENLMLDKDGHIKITDFGLCKEGISDGATMKTFCGTPEYLAPEVLEDNDYGRAVDWWGLGVVMYEMMCGRLPFYNQDHERLFELILMEEIRFPRTLSPEAKSLLAGLLKKDPKQRLGGGPSDAKEVMEHRFFLSINWQDVVQKKLLPPFKPQVTSEVDTRYFDDEFTAQSITITPPDRYDSLGLLELDQRTHFPQFSYSASIRE

SEQ ID NO: 7752 - RNA, 1446 nt, Artificial Sequence
  Akt__Homo_sapiens__AAA58364
augaaugaggugucugucaucaaagaaggcuggcuccacaagcguggugaauacaucaagaccuggaggccacgguacuuccugcugaagagcgacggcuccuucauuggguacaaggagaggcccgaggccccugaucagacucuaccccccuuaaacaacuucuccguagcagaaugccagcugaugaagaccgagaggccgcgacccaacaccuuugucauacgcugccugcaguggaccacagucaucgagaggaccuuccacguggauucuccagacgagagggaggaguggaugcgggccauccagauggucgccaacagccucaagcagcgggccccaggcgaggaccccauggacuacaaguguggcucccccagugacuccuccacgacugaggagauggaaguggcggucagcaaggcacgggcuaaagugaccaugaaugacuucgacuaucucaaacuccuuggcaagggaaccuuuggcaaagucauccuggugcgggagaaggccacuggccgcuacuacgccaugaagauccugcgaaaggaagucaucauugccaaggaugaagucgcucacacagucaccgagagccggguccuccagaacaccaggcacccguuccucacugcgcugaaguaugccuuccagacccacgaccgccugugcuuugugauggaguaugccaacgggggugagcuguucuuccaccugucccgggagcgugucuucacagaggagcgggcccgguuuuauggugcagagauugucucggcucuugaguacuugcacucgcgggacgugguauaccgcgacaucaagcuggaaaaccucaugcuggacaaagauggccacaucaagaucacugacuuuggccucugcaaagagggcaucagugacggggccaccaugaaaaccuucugugggaccccggaguaccuggcgccugaggugcuggaggacaaugacuauggccgggccguggacuggugggggcuggguguggucauguacgagaugaugugcggccgccugcccuucuacaaccaggaccacgagcgccucuucgagcucauccucauggaagagauccgcuucccgcgcacgcucagccccgaggccaagucccugcuugcugggcugcuuaagaaggaccccaagcagaggcuugguggggggcccagcgaugccaaggaggucauggagcacagguucuuccucagcaucaacuggcaggacgugguccagaagaagcuccugccacccuucaaaccucaggucacguccgaggucgacacaagguacuucgaugaugaauuuaccgcccaguccaucacaaucacacccccugaccgcuaugacagccugggcuuacuggagcuggaccagcggacccacuucccccaguucuccuacucggccagcauccgcgaguga

SEQ ID NO: 7753 - RNA, 1446 nt, Artificial Sequence
  derived and/or modified sequence opt1 from Akt__Homo_sapiens__AAA58364
augaacgaggugagcgucaucaaggagggcuggcugcacaagcgcggggaguacaucaagaccuggcggccccgcuacuuccuccugaaguccgacggcagcuucaucggguacaaggagcggcccgaggcccccgaccagacccugccgccccucaacaacuucuccguggccgagugccagcugaugaagacggagcgcccccggcccaacaccuucgugauccgcugccugcaguggaccaccgucaucgagcggacguuccacguggacagccccgacgagcgcgaggaguggaugcgggcgauccagaugguggccaacucccucaagcagcgcgcccccggcgaggacccgauggacuacaagugcgggagccccuccgacagcuccaccaccgaggagauggaggucgccgugagcaaggcccgggcgaaggugaccaugaacgacuucgacuaccugaagcugcucggcaagggcacguucgggaaggucauccuggugcgcgagaaggccaccggccgguacuacgccaugaagauccugcgcaaggaggugaucaucgccaaggacgaggucgcgcacaccgugaccgagucccgggugcuccagaacacgcgccaccccuuccugaccgcccugaaguacgccuuccagacccacgaccggcucugcuucgucauggaguacgccaacgggggcgagcuguucuuccaccugagccgcgagcggguguucaccgaggagcgcgcccgguucuacggggcggagaucguguccgcccucgaguaccugcacagccgcgacgucguguaccgcgacaucaagcuggagaaccucaugcuggacaaggacggccacaucaagaucacggacuucggccugugcaaggaggggaucuccgacggcgccaccaugaagaccuucugcgggacccccgaguaccucgccccggaggugcuggaggacaacgacuacggccgggccgucgacugguggggccuggggguggugauguacgagaugaugugcggccgccuccccuucuacaaccaggaccacgagcggcuguucgagcugauccucauggaggagauccgcuucccccggacgcugagccccgaggcgaagucccugcucgccgggcugcugaagaaggacccgaagcagcgccucggcgggggccccagcgacgccaaggaggucauggagcaccgguucuuccuguccaucaacuggcaggacgugguccagaagaagcugcucccgcccuucaagccccaggugaccagcgagguggacacccgcuacuucgacgacgaguucaccgcccagagcaucacgaucaccccgcccgaccgguacgacucccugggccugcucgagcuggaccagcgcacccacuucccccaguucagcuacuccgccagcauccgggaguga

SEQ ID NO: 7754 - RNA, 1446 nt, Artificial Sequence
  derived and/or modified sequence opt2 from Akt__Homo_sapiens__AAA58364
augaacgaggucuccgucaucaaggagggcuggcuccacaagcgcggcgaguacaucaagaccuggcgcccccgcuacuuccuccucaaguccgacggcuccuucaucggcuacaaggagcgccccgaggcccccgaccagacccuccccccccucaacaacuucuccgucgccgagugccagcucaugaagaccgagcgcccccgccccaacaccuucgucauccgcugccuccaguggaccaccgucaucgagcgcaccuuccacgucgacucccccgacgagcgcgaggaguggaugcgcgccauccagauggucgccaacucccucaagcagcgcgcccccggcgaggaccccauggacuacaagugcggcucccccuccgacuccuccaccaccgaggagauggaggucgccgucuccaaggcccgcgccaaggucaccaugaacgacuucgacuaccucaagcuccucggcaagggcaccuucggcaaggucauccucguccgcgagaaggccaccggccgcuacuacgccaugaagauccuccgcaaggaggucaucaucgccaaggacgaggucgcccacaccgucaccgagucccgcguccuccagaacacccgccaccccuuccucaccgcccucaaguacgccuuccagacccacgaccgccucugcuucgucauggaguacgccaacggcggcgagcucuucuuccaccucucccgcgagcgcgucuucaccgaggagcgcgcccgcuucuacggcgccgagaucgucuccgcccucgaguaccuccacucccgcgacgucgucuaccgcgacaucaagcucgagaaccucaugcucgacaaggacggccacaucaagaucaccgacuucggccucugcaaggagggcaucuccgacggcgccaccaugaagaccuucugcggcacccccgaguaccucgcccccgagguccucgaggacaacgacuacggccgcgccgucgacugguggggccucggcgucgucauguacgagaugaugugcggccgccuccccuucuacaaccaggaccacgagcgccucuucgagcucauccucauggaggagauccgcuucccccgcacccucucccccgaggccaagucccuccucgccggccuccucaagaaggaccccaagcagcgccucggcggcggccccuccgacgccaaggaggucauggagcaccgcuucuuccucuccaucaacuggcaggacgucguccagaagaagcuccucccccccuucaagccccaggucaccuccgaggucgacacccgcuacuucgacgacgaguucaccgcccaguccaucaccaucaccccccccgaccgcuacgacucccucggccuccucgagcucgaccagcgcacccacuucccccaguucuccuacuccgccuccauccgcgaguga

SEQ ID NO: 7755 - RNA, 1446 nt, Artificial Sequence
  derived and/or modified sequence opt3 from Akt__Homo_sapiens__AAA58364
augaacgaggugagcgucaucaaggaaggcuggcugcacaaaagaggggaguacauuaagaccuggaggccccgguauuuccuccuuaaauccgacggaucuuuuauagguuacaaggaacgcccugaggccccagaucagacacugccgcccuugaauaacuucucaguugcugaaugccaauuaaugaaaacugagcgaccucguccaaauacguuugugaucagaugucugcaguggaccacaguaauugagaggacuuuccauguggacagucccgaugaacgggaggaauggaugcgcgcaauccagauggucgccaacagccuaaagcagagagcgccuggcgaggacccaauggauuauaagugcgggucccccucugacucgucaaccacagaggaaauggagguggcuguuagcaaagccagggcaaaggugaccaugaaugauuuugacuaccucaaacugcuuggaaagggcacuuucgguaaagucauucuggugcgggaaaaggccacagggcgcuauuacgcuaugaagaucuugcgaaaagagguaauaaucgcaaaggaugaaguugcccacaccgugacggagaguagaguccuccaaaacacuaggcauccuuuucugaccgcucugaaauaugccuuccagacacacgaccggcucuguuuugugauggaguacgcgaauggaggcgaauuauucuuucaucugucccgugagcgcguguucacugaagagagagcaagguuuuacggcgccgaaauugucucugcucuugaguauuugcacagccgggauguuguguaccgagacaucaagcuggagaaccuaaugcucgauaaagacgggcacauuaagaucaccgacuucggacugugcaaagaagguauauccgauggcgccacaaugaagaccuucugugggacgccagaguaucuugcaccggaaguacuggaggacaaugauuacggacgcgcuguggacugguggggcuugggugucgugauguaugaaaugaugugcgggagacuccccuuuuacaaccaggaucaugagaggcuguucgaguuaauucugauggaagagauccgguuuccucgcacucucucaccagaagccaagagucuucuggcgggauugcugaaaaaggaccccaaacagagacuaggcggcgggccuagcgaugccaaggagguuauggagcacagguucuuucucucuauuaauuggcaagacgugguccagaaaaagcugcuuccacccuucaagccucaggugacauccgaaguagauacccguuauuuugacgaugaguucacugcacagucaaucacaaucaccccgcccgaccgguacgacagccugggauugcucgaacuggaucaacgaacgcauuuuccacaguucaguuacucugcuuccauuagagaguga

SEQ ID NO: 7756 - RNA, 1446 nt, Artificial Sequence
  derived and/or modified sequence opt4 from Akt__Homo_sapiens__AAA58364
augaacgaggugagcgugaucaaggagggcuggcugcacaagagaggcgaguacaucaagaccuggagacccagauacuuccugcugaagagcgacggcagcuucaucggcuacaaggagagacccgaggcccccgaccagacccugcccccccugaacaacuucagcguggccgagugccagcugaugaagaccgagagacccagacccaacaccuucgugaucagaugccugcaguggaccaccgugaucgagagaaccuuccacguggacagccccgacgagagagaggaguggaugagagccauccagaugguggccaacagccugaagcagagagcccccggcgaggaccccauggacuacaagugcggcagccccagcgacagcagcaccaccgaggagauggagguggccgugagcaaggccagagccaaggugaccaugaacgacuucgacuaccugaagcugcugggcaagggcaccuucggcaaggugauccuggugagagagaaggccaccggcagauacuacgccaugaagauccugagaaaggaggugaucaucgccaaggacgagguggcccacaccgugaccgagagcagagugcugcagaacaccagacaccccuuccugaccgcccugaaguacgccuuccagacccacgacagacugugcuucgugauggaguacgccaacggcggcgagcuguucuuccaccugagcagagagagaguguucaccgaggagagagccagauucuacggcgccgagaucgugagcgcccuggaguaccugcacagcagagacgugguguacagagacaucaagcuggagaaccugaugcuggacaaggacggccacaucaagaucaccgacuucggccugugcaaggagggcaucagcgacggcgccaccaugaagaccuucugcggcacccccgaguaccuggcccccgaggugcuggaggacaacgacuacggcagagccguggacugguggggccugggcguggugauguacgagaugaugugcggcagacugcccuucuacaaccaggaccacgagagacuguucgagcugauccugauggaggagaucagauuccccagaacccugagccccgaggccaagagccugcuggccggccugcugaagaaggaccccaagcagagacugggcggcggccccagcgacgccaaggaggugauggagcacagauucuuccugagcaucaacuggcaggacguggugcagaagaagcugcugccccccuucaagccccaggugaccagcgagguggacaccagauacuucgacgacgaguucaccgcccagagcaucaccaucaccccccccgacagauacgacagccugggccugcuggagcuggaccagagaacccacuucccccaguucagcuacagcgccagcaucagagaguga

SEQ ID NO: 7757 - RNA, 1446 nt, Artificial Sequence
  derived and/or modified sequence opt5 from Akt__Homo_sapiens__AAA58364
augaacgaggugagcgucaucaaggaaggcuggcugcacaaaagaggggaguacauuaagaccuggcggccccgcuauuuccuccugaaauccgacggaucuuuuaucggcuacaaggaaagaccugaggccccggaucagacacuucccccucugaauaacuucagcguugcugaaugccaacucaugaaaacggagcggccccgcccuaauaccuuugugauuagaugucugcaguggacaaccgugaucgagcggacauuccaugucgacucccccgaugaacgcgaggaauggaugagagccauucagaugguggcgaacucucuuaagcagcgggcuccuggggaggacccgauggauuauaagugcggaagccccuccgacucuagcaccacagaggaaauggagguugccguguccaaagcccgcgcuaaggucaccaugaaugauuuugacuaccugaaacuccugggcaaggggacguucggaaaagugauccugguuagagaaaaggccaccggccgguauuacgcuaugaagauccuccgcaaagaggugauuaucgccaaggaugaagucgcgcacacagugaccgagagcagagugcugcaaaacacacggcauccuuuucuuaccgcccugaaauaugcuuuccagacgcacgaccgccucuguuuugucauggaguacgccaauggcggggaacuguucuuucaucuuucuagagagcggguuuucacagaagagagagcucgcuuuuacggagccgaaauuguguccgcgcuggaguaucuccacagccgggauguggucuacagagacaucaagcuggagaaccugaugcucgauaaagacggccacauuaagaucaccgacuucgggcugugcaaagaaggaauuucugauggcgccacaaugaagaccuucugugggacccccgaguaucuugcuccugaagugcuggaggacaaugauuacggacgcgccguugacugguggggccucggcguggucauguaugaaaugaugugcgggcggcugcccuuuuacaaccaggaucaugagagacuuuucgagcugauccucauggaagagauccgcuuuccgcggacacuguccccugaagcuaagagccugcucgccggacugcuuaaaaaggaccccaaacagagacugggcgggggaccuucugaugccaaggaggugauggagcaccgcuucuuucucuccauuaauuggcaagacguugugcagaaaaagcugcuuccucccuucaagccccaggucacgagcgaaguggauacccgguauuuugacgaugaguucacagcucaguccaucaccauuacaccgcccgacagauacgacucucugggccuccuggaacuggaucaacgcacccauuuuccucaguucagcuacuccgcgagcauccgggaguga

SEQ ID NO: 7758 - protein, 479 aa, Artificial Sequence
  Akt__Homo_sapiens__Q9Y243
MSDVTIVKEGWVQKRGEYIKNWRPRYFLLKTDGSFIGYKEKPQDVDLPYPLNNFSVAKCQLMKTERPKPNTFIIRCLQWTTVIERTFHVDTPEEREEWTEAIQAVADRLQRQEEERMNCSPTSQIDNIGEEEMDASTTHHKRKTMNDFDYLKLLGKGTFGKVILVREKASGKYYAMKILKKEVIIAKDEVAHTLTESRVLKNTRHPFLTSLKYSFQTKDRLCFVMEYVNGGELFFHLSRERVFSEDRTRFYGAEIVSALDYLHSGKIVYRDLKLENLMLDKDGHIKITDFGLCKEGITDAATMKTFCGTPEYLAPEVLEDNDYGRAVDWWGLGVVMYEMMCGRLPFYNQDHEKLFELILMEDIKFPRTLSSDAKSLLSGLLIKDPNKRLGGGPDDAKEIMRHSFFSGVNWQDVYDKKLVPPFKPQVTSETDTRYFDEEFTAQTITITPPEKYDEDGMDCMDNERRPHFPQFSYSASGRE

SEQ ID NO: 7759 - RNA, 1440 nt, Artificial Sequence
  Akt__Homo_sapiens__AAD24196
augagcgauguuaccauugugaaagaagguuggguucagaagaggggagaauauauaaaaaacuggaggccaagauacuuccuuuugaagacagauggcucauucauaggauauaaagagaaaccucaagauguggauuuaccuuauccccucaacaacuuuucaguggcaaaaugccaguuaaugaaaacagaacgaccaaagccaaacacauuuauaaucagaugucuccaguggacuacuguuauagagagaacauuucauguagauacuccagaggaaagggaagaauggacagaagcuauccaggcuguagcagacagacugcagaggcaagaagaggagagaaugaauuguaguccaacuucacaaauugauaauauaggagaggaagagauggaugccucuacaacccaucauaaaagaaagacaaugaaugauuuugacuauuugaaacuacuagguaaaggcacuuuugggaaaguuauuuugguucgagagaaggcaaguggaaaauacuaugcuaugaagauucugaagaaagaagucauuauugcaaaggaugaaguggcacacacucuaacugaaagcagaguauuaaagaacacuagacaucccuuuuuaacauccuugaaauauuccuuccagacaaaagaccguuuguguuuugugauggaauauguuaaugggggcgagcuguuuuuccauuugucgagagagcggguguucucugaggaccgcacacguuucuauggugcagaaauugucucugccuuggacuaucuacauuccggaaagauuguguaccgugaucucaaguuggagaaucuaaugcuggacaaagauggccacauaaaaauuacagauuuuggacuuugcaaagaagggaucacagaugcagccaccaugaagacauucuguggcacuccagaauaucuggcaccagagguguuagaagauaaugacuauggccgagcaguagacugguggggccuagggguugucauguaugaaaugaugugugggagguuaccuuucuacaaccaggaccaugagaaacuuuuugaauuaauauuaauggaagacauuaaauuuccucgaacacucucuucagaugcaaaaucauugcuuucagggcucuugauaaaggauccaaauaaacgccuugguggaggaccagaugaugcaaaagaaauuaugagacacaguuucuucucuggaguaaacuggcaagauguauaugauaaaaagcuuguaccuccuuuuaaaccucaaguaacaucugagacagauacuagauauuuugaugaagaauuuacagcucagacuauuacaauaacaccaccugaaaaauaugaugaggaugguauggacugcauggacaaugagaggcggccgcauuucccucaauuuuccuacucugcaaguggacgagaauaa

SEQ ID NO: 7760 - RNA, 1440 nt, Artificial Sequence
  derived and/or modified sequence opt1 from Akt__Homo_sapiens__AAD24196
augagcgacgugaccaucgucaaggagggcugggugcagaagcgcggggaguacaucaagaacuggcggccccgcuacuuccugcugaagaccgacggcuccuucaucggguacaaggagaagccgcaggacguggaccugcccuacccccugaacaacuucagcgucgccaagugccagcucaugaagacggagcggcccaagccgaacaccuucaucauccgcugccugcaguggaccaccgugaucgagcggacguuccacguggacacccccgaggagcgcgaggaguggaccgaggccauccaggcggucgccgaccggcugcagcgccaggaggaggagcggaugaacugcucccccaccagccagaucgacaacaucggcgaggaggagauggacgccuccacgacccaccacaagcgcaagaccaugaacgacuucgacuaccucaagcugcuggggaagggcaccuucggcaaggugauccucgugcgggagaaggccagcgggaaguacuacgccaugaagauccugaagaaggaggucaucaucgcgaaggacgagguggcccacacgcugaccgagucccgcgugcucaagaacacccggcaccccuuccugaccagccugaaguacuccuuccagacgaaggaccgccucugcuucgucauggaguacgugaacggcggggagcuguucuuccaccugagccgggagcgcguguucuccgaggaccggacccgcuucuacggcgccgagaucgucagcgcccucgacuaccugcacuccgggaagaucguguaccgggaccugaagcucgagaaccugaugcuggacaaggacggccacaucaagaucaccgacuucggccucugcaaggaggggaucaccgacgcggccacgaugaagaccuucugcggcaccccggaguaccuggcccccgaggugcuggaggacaacgacuacgggcgcgccgucgacugguggggccucggcguggugauguacgagaugaugugcgggcggcugcccuucuacaaccaggaccacgagaagcuguucgagcucauccugauggaggacaucaaguucccccgcacccugagcuccgacgccaagagccuccuguccggccugcucaucaaggacccgaacaagcgccucgggggcgggcccgacgacgcgaaggagaucaugcggcacagcuucuucuccggcgucaacuggcaggacguguacgacaagaagcuggugccgcccuucaagccccaggucacgagcgagaccgacacccgcuacuucgacgaggaguucaccgcccagacgaucaccaucaccccgcccgagaaguacgacgaggacggcauggacugcauggacaacgagcggcgcccccacuucccccaguucagcuacuccgccagcgggcgggaguga

SEQ ID NO: 7761 - RNA, 1440 nt, Artificial Sequence
  derived and/or modified sequence opt2 from Akt__Homo_sapiens__AAD24196
auguccgacgucaccaucgucaaggagggcuggguccagaagcgcggcgaguacaucaagaacuggcgcccccgcuacuuccuccucaagaccgacggcuccuucaucggcuacaaggagaagccccaggacgucgaccuccccuacccccucaacaacuucuccgucgccaagugccagcucaugaagaccgagcgccccaagcccaacaccuucaucauccgcugccuccaguggaccaccgucaucgagcgcaccuuccacgucgacacccccgaggagcgcgaggaguggaccgaggccauccaggccgucgccgaccgccuccagcgccaggaggaggagcgcaugaacugcucccccaccucccagaucgacaacaucggcgaggaggagauggacgccuccaccacccaccacaagcgcaagaccaugaacgacuucgacuaccucaagcuccucggcaagggcaccuucggcaaggucauccucguccgcgagaaggccuccggcaaguacuacgccaugaagauccucaagaaggaggucaucaucgccaaggacgaggucgcccacacccucaccgagucccgcguccucaagaacacccgccaccccuuccucaccucccucaaguacuccuuccagaccaaggaccgccucugcuucgucauggaguacgucaacggcggcgagcucuucuuccaccucucccgcgagcgcgucuucuccgaggaccgcacccgcuucuacggcgccgagaucgucuccgcccucgacuaccuccacuccggcaagaucgucuaccgcgaccucaagcucgagaaccucaugcucgacaaggacggccacaucaagaucaccgacuucggccucugcaaggagggcaucaccgacgccgccaccaugaagaccuucugcggcacccccgaguaccucgcccccgagguccucgaggacaacgacuacggccgcgccgucgacugguggggccucggcgucgucauguacgagaugaugugcggccgccuccccuucuacaaccaggaccacgagaagcucuucgagcucauccucauggaggacaucaaguucccccgcacccucuccuccgacgccaagucccuccucuccggccuccucaucaaggaccccaacaagcgccucggcggcggccccgacgacgccaaggagaucaugcgccacuccuucuucuccggcgucaacuggcaggacgucuacgacaagaagcucgucccccccuucaagccccaggucaccuccgagaccgacacccgcuacuucgacgaggaguucaccgcccagaccaucaccaucaccccccccgagaaguacgacgaggacggcauggacugcauggacaacgagcgccgcccccacuucccccaguucuccuacuccgccuccggccgcgaguga

SEQ ID NO: 7762 - RNA, 1440 nt, Artificial Sequence
  derived and/or modified sequence opt3 from Akt__Homo_sapiens__AAD24196
augagcgacgugaccaucgucaaggagggcuggguucagaaaagaggggaauacauuaagaacuggaggccccgguauuuccugcucaaaacagauggauccuuuauagguuacaaggagaaaccucaagacguggaucuuccauauccgcugaauaacuucucuguagccaagugccaguugaugaagacugaacgccccaaaccuaauacguuuaucauucgauguuuacaguggaccacagugaucgagcguacuuuccacgucgacaccccagaagagagagaggaauggacagaggcuauucaggcaguggccgauaggcugcaacggcaggaagaggagcgcaugaacugcucacccaccagucagaucgacaauauaggcgaagaggaaauggaugcgagcacuacacaucacaagagaaaaaccaugaacgacuuugauuaccuaaagcuccuggggaaaggaacguucggcaagguuauccuugugagggagaaggcuuccgguaaauauuacgccaugaagauucugaaaaaggaagucaucauugcaaaagacgagguggcccauacuuugaccgagucucggguacucaagaauacacgccacccuuuucugacuucgcugaaauauucauuccagaccaaggaucgacucuguuuuguuauggaauacgugaacgggggagaguuauucuuucaucugagcagagaaagggucuucagugaggaccggacacguuuuuacggcgcugaaaucguguccgcacuugauuauuugcacucuggcaagauaguguaccgcgaccugaaacuagagaaucucaugcuggacaaggaugggcacauuaaaaucaccgacuucggacuuugcaaggaggguauuacggaugccgcuacuaugaaaacauucuguggcaccccagaauaucuggcccccgaggucuuggaagacaacgauuacgggagagcgguugacugguggggacucggcgugguaauguaugagaugaugugcgguaggcugccuuuuuacaaucaagaucaugaaaaguuauucgagcugauccucauggaggacaucaaguuuccacggacucuuagcuccgaugcaaaaucacuguugagugggcuacugauuaaggacccgaacaaacgacucggaggcggccccgaugacgccaaggaaauaaugcgccacagcuucuuuucuggggugaauuggcaggacgucuaugauaaaaagcuggugccuccauucaagccccagguuacauccgagaccgacacgagauacuuugaugaagaguucaccgcucagacaaucacuauuaccccuccagagaaauacgacgaagauggaauggacuguauggauaacgagaggcggccccauuuuccgcaauucucauauagcgccaguggucgcgaauga

SEQ ID NO: 7763 - RNA, 1440 nt, Artificial Sequence
  derived and/or modified sequence opt4 from Akt__Homo_sapiens__AAD24196
augagcgacgugaccaucgugaaggagggcugggugcagaagagaggcgaguacaucaagaacuggagacccagauacuuccugcugaagaccgacggcagcuucaucggcuacaaggagaagccccaggacguggaccugcccuacccccugaacaacuucagcguggccaagugccagcugaugaagaccgagagacccaagcccaacaccuucaucaucagaugccugcaguggaccaccgugaucgagagaaccuuccacguggacacccccgaggagagagaggaguggaccgaggccauccaggccguggccgacagacugcagagacaggaggaggagagaaugaacugcagccccaccagccagaucgacaacaucggcgaggaggagauggacgccagcaccacccaccacaagagaaagaccaugaacgacuucgacuaccugaagcugcugggcaagggcaccuucggcaaggugauccuggugagagagaaggccagcggcaaguacuacgccaugaagauccugaagaaggaggugaucaucgccaaggacgagguggcccacacccugaccgagagcagagugcugaagaacaccagacaccccuuccugaccagccugaaguacagcuuccagaccaaggacagacugugcuucgugauggaguacgugaacggcggcgagcuguucuuccaccugagcagagagagaguguucagcgaggacagaaccagauucuacggcgccgagaucgugagcgcccuggacuaccugcacagcggcaagaucguguacagagaccugaagcuggagaaccugaugcuggacaaggacggccacaucaagaucaccgacuucggccugugcaaggagggcaucaccgacgccgccaccaugaagaccuucugcggcacccccgaguaccuggcccccgaggugcuggaggacaacgacuacggcagagccguggacugguggggccugggcguggugauguacgagaugaugugcggcagacugcccuucuacaaccaggaccacgagaagcuguucgagcugauccugauggaggacaucaaguuccccagaacccugagcagcgacgccaagagccugcugagcggccugcugaucaaggaccccaacaagagacugggcggcggccccgacgacgccaaggagaucaugagacacagcuucuucagcggcgugaacuggcaggacguguacgacaagaagcuggugccccccuucaagccccaggugaccagcgagaccgacaccagauacuucgacgaggaguucaccgcccagaccaucaccaucaccccccccgagaaguacgacgaggacggcauggacugcauggacaacgagagaagaccccacuucccccaguucagcuacagcgccagcggcagagaguga

SEQ ID NO: 7764 - RNA, 1440 nt, Artificial Sequence
  derived and/or modified sequence opt5 from Akt__Homo_sapiens__AAD24196
augagcgacgugaccaucgucaaggagggcuggguucagaaaagaggggaauacauuaagaacuggcggccccgcuauuuccugcucaaaacagauggauccuuuaucggcuacaaggagaaaccucaagacguggaucugccguauccccuuaauaacuucucuguggccaagugccagcugaugaagacggaaagaccuaaacccaauaccuuuauuauccggugucuccaguggacaaccgucauugagcgcacauuccacguggacaccccugaagagagagaggaauggacagaggcuauccaggccguugcggaucggcugcaacgccaggaagaggagagaaugaacugcagccccaccucccagaucgacaauauuggggaagaggaaauggaugcuucuacgacccaucacaagcggaaaacaaugaacgacuuugauuaccuuaagcugcucggaaaaggcaccuucgggaaggugauccugguccgcgagaaggccagcggaaaauauuacgccaugaagauucugaaaaaggaagugaucauugcuaaagacgagguugcccauacacucaccgaguccagagugcugaagaauacgcggcacccuuuucuuacaucucugaaauauagcuuccagaccaaggaucgccucuguuuugucauggaauacgugaacggcggcgagcuguucuuucaucuuuccagagaacggguguucagcgaggaccgcacaagauuuuacggggcugaaaucgucucugcccuggauuaucuccacuccggaaagauuguuuaccgggaccugaaacuggagaaucucaugcuggacaaggauggccacaucaaaaucaccgacuucgggcuuugcaaggagggaauuaccgaugcggccacaaugaaaacguucuguggcaccccggaauaucuggcucccgaggugcucgaagacaacgauuacgggagagccguggacugguggggacugggcgucgugauguaugagaugaugugcggccgccuuccuuuuuacaaucaagaucaugaaaagcuguucgagcucauccugauggaggacauuaaguuuccccggacacugagcucugaugcuaaaucccuccugagcgggcuucugaucaaggacccuaacaaaagacucggaggcgggcccgaugacgccaaggaaauuaugcgccacucuuucuuuuccggaguuaauuggcaggacguguaugauaaaaagcuggucccgccuuucaagccccaggugaccagcgagacagacacccgguacuuugaugaagaguucacggcgcagacaaucaccaucaccccucccgagaaauacgacgaagauggcauggacuguauggauaacgagagacgcccccauuuuccucaauucuccuauucugccagcgggcgggaauga

SEQ ID NO: 7765 - protein, 505 aa, Artificial Sequence
  ATF2__Homo_sapiens__P15336
MKFKLHVNSARQYKDLWNMSDDKPFLCTAPGCGQRFTNEDHLAVHKHKHEMTLKFGPARNDSVIVADQTPTPTRFLKNCEEVGLFNELASPFENEFKKASEDDIKKMPLDLSPLATPIIRSKIEEPSVVETTHQDSPLPHPESTTSDEKEVPLAQTAQPTSAIVRPASLQVPNVLLTSSDSSVIIQQAVPSPTSSTVITQAPSSNRPIVPVPGPFPLLLHLPNGQTMPVAIPASITSSNVHVPAAVPLVRPVTMVPSVPGIPGPSSPQPVQSEAKMRLKAALTQQHPPVTNGDTVKGHGSGLVRTQSEESRPQSLQQPATSTTETPASPAHTTPQTQSTSGRRRRAANEDPDEKRRKFLERNRAAASRCRQKRKVWVQSLEKKAEDLSSLNGQLQSEVTLLRNEVAQLKQLLLAHKDCPVTAMQKKSGYHTADKDDSSEDISVPSSPHTEAIQHSSVSTSNGVSSTSKAEAVATSVLTQMADQSTEPALSQIVMAPSSQSQPSGS

SEQ ID NO: 7766 - RNA, 1518 nt, Artificial Sequence
  ATF2__Homo_sapiens__CCDS2262.1
augaaauucaaguuacaugugaauucugccaggcaauacaaggaccuguggaauaugagugaugacaaacccuuucuauguacugcgccuggauguggccagcguuuuaccaacgaggaucauuuggcuguccauaaacauaaacaugagaugacacugaaauuugguccagcacguaaugacagugucauuguggcugaucagaccccaacaccaacaagauucuugaaaaacugugaagaaguggguuuguuuaaugaguuggcgaguccauuugagaaugaauucaagaaagcuucagaagaugacauuaaaaaaaugccucuagauuuauccccucuugcaacaccuaucauaagaagcaaaauugaggagccuucuguuguagaaacaacucaccaggauaguccuuuaccucacccagagucuacuaccagugaugagaaggaaguaccauuggcacaaacugcacagcccacaucagcuauuguucguccagcaucauuacagguucccaaugugcugcuuacaaguucugacucaaguguaauuauucagcaggcaguaccuucaccaaccucaaguacuguaaucacccaggcaccauccucuaacaggccaauugucccuguaccaggcccauuuccucuucuguuacaucuuccuaauggacaaaccaugccuguugcuauuccugcaucaauuacaaguucuaaugugcauguuccagcugcagucccacucguucgaccagucaccauggugccuaguguuccaggaaucccagguccuuccucuccccaaccaguacagucagaagcaaaaaugagauuaaaagcugcuuugacccagcaacauccuccaguuaccaauggugauacugucaaaggucaugguagcggauugguuaggacucagucagaggaaucucgaccgcagucauuacaacagccagccacauccacuacagaaacuccggcuucuccagcucacacaacuccacagacccaaaguacaaguggucgucggagaagagcagcuaacgaagauccugaugaaaaaaggagaaaguuuuuagagcgaaauagagcagcagcuucaagaugccgacaaaaaaggaaagucuggguucagucuuuagagaagaaagcugaagacuugaguucauuaaauggucagcugcagagugaagucacccugcugagaaaugaaguggcacagcugaaacagcuucuucuggcucauaaagauugcccuguaaccgccaugcagaagaaaucuggcuaucauacugcugauaaagaugauaguucagaagacauuucagugccgaguaguccacauacagaagcuauacagcauaguucggucagcacauccaauggagucaguucaaccuccaaggcagaagcuguagccacuucaguccucacccagauggcggaccagaguacagagccugcucuuucacagaucguuauggcuccuuccucccagucacagcccucaggaaguuga

SEQ ID NO: 7767 - RNA, 1518 nt, Artificial Sequence
  derived and/or modified sequence opt1 from ATF2__Homo_sapiens__CCDS2262.1
augaaguucaagcugcacgugaacagcgcccgccaguacaaggaccucuggaacauguccgacgacaagcccuuccugugcaccgccccgggcugcgggcagcgguucaccaacgaggaccaccuggcgguccacaagcacaagcacgagaugacgcucaaguucggccccgcccgcaacgacagcgugaucguggccgaccagacccccacccccacccgguuccugaagaacugcgaggaggucgggcuguucaacgagcucgccuccccguucgagaacgaguucaagaaggccagcgaggacgacaucaagaagaugccccuggaccugagcccccucgcgacgcccaucauccgcagcaagaucgaggagccguccgugguggagaccacccaccaggacagcccccugccccaccccgaguccaccacgagcgacgagaaggaggucccgcuggcccagaccgcccagcccaccuccgccaucgugcggcccgcgagccuccaggugcccaacguccugcugaccuccagcgacuccagcgugaucauccagcaggccgugccgucccccacgagcuccaccgucaucacccaggcccccagcagcaaccgccccaucgugccggugcccggccccuucccccuccugcugcaccucccgaacgggcagaccaugcccgucgccauccccgccuccaucacgagcuccaacgugcacgugcccgcggccgucccgcuggugcggcccgugaccaugguccccagcgugccgggcauccccggccccuccagcccccagccggugcaguccgaggccaagaugcgccugaaggccgcccucacccagcagcacccgcccgucaccaacggggacacggugaagggccacgggagcggccugguccggacccaguccgaggagagccgcccccagucccugcagcagcccgcgaccagcaccacggagacccccgccucccccgcccacaccacgccccagacccagagcaccuccgggcggcgccggcgcgccgccaacgaggacccggacgagaagcggcgcaaguuccucgagcggaaccgcgcggccgccagccggugccgccagaagcggaaggugugggugcagucccuggagaagaaggccgaggaccugagcucccucaacggccagcugcagagcgaggucacccugcuccgcaacgagguggcccagcugaagcagcugcuccuggcgcacaaggacugccccgugaccgccaugcagaagaaguccggcuaccacacggccgacaaggacgacuccagcgaggacaucuccguccccagcagcccccacaccgaggccauccagcacuccuccgugagcaccuccaacggggugagcuccaccagcaaggcggaggccgucgccacguccgugcugacccagauggccgaccagagcaccgagccggcccucucccagaucgugauggcgcccagcucccagagccagcccagcggcuccuga

SEQ ID NO: 7768 - RNA, 1518 nt, Artificial Sequence
  derived and/or modified sequence opt2 from ATF2__Homo_sapiens__CCDS2262.1
augaaguucaagcuccacgucaacuccgcccgccaguacaaggaccucuggaacauguccgacgacaagcccuuccucugcaccgcccccggcugcggccagcgcuucaccaacgaggaccaccucgccguccacaagcacaagcacgagaugacccucaaguucggccccgcccgcaacgacuccgucaucgucgccgaccagacccccacccccacccgcuuccucaagaacugcgaggaggucggccucuucaacgagcucgccucccccuucgagaacgaguucaagaaggccuccgaggacgacaucaagaagaugccccucgaccucuccccccucgccacccccaucauccgcuccaagaucgaggagcccuccgucgucgagaccacccaccaggacuccccccucccccaccccgaguccaccaccuccgacgagaaggaggucccccucgcccagaccgcccagcccaccuccgccaucguccgccccgccucccuccagguccccaacguccuccucaccuccuccgacuccuccgucaucauccagcaggccguccccucccccaccuccuccaccgucaucacccaggcccccuccuccaaccgccccaucguccccguccccggccccuucccccuccuccuccaccuccccaacggccagaccaugcccgucgccauccccgccuccaucaccuccuccaacguccacguccccgccgccgucccccucguccgccccgucaccaugguccccuccguccccggcauccccggccccuccuccccccagcccguccaguccgaggccaagaugcgccucaaggccgcccucacccagcagcacccccccgucaccaacggcgacaccgucaagggccacggcuccggccucguccgcacccaguccgaggagucccgcccccagucccuccagcagcccgccaccuccaccaccgagacccccgccucccccgcccacaccaccccccagacccaguccaccuccggccgccgccgccgcgccgccaacgaggaccccgacgagaagcgccgcaaguuccucgagcgcaaccgcgccgccgccucccgcugccgccagaagcgcaaggucuggguccagucccucgagaagaaggccgaggaccucuccucccucaacggccagcuccaguccgaggucacccuccuccgcaacgaggucgcccagcucaagcagcuccuccucgcccacaaggacugccccgucaccgccaugcagaagaaguccggcuaccacaccgccgacaaggacgacuccuccgaggacaucuccguccccuccuccccccacaccgaggccauccagcacuccuccgucuccaccuccaacggcgucuccuccaccuccaaggccgaggccgucgccaccuccguccucacccagauggccgaccaguccaccgagcccgcccucucccagaucgucauggcccccuccucccagucccagcccuccggcuccuga

SEQ ID NO: 7769 - RNA, 1518 nt, Artificial Sequence
  derived and/or modified sequence opt3 from ATF2__Homo_sapiens__CCDS2262.1
augaaguucaaacugcacgugaacagcgccagacaguacaaggaccucuggaauauguccgaugacaaacccuuucuuugcaccgcuccuggcugugggcaaagguucacaaacgaggaucaucuggcaguccacaagcauaaacacgaaaugacuuugaaguuuggaccagcccggaaugacucuguuaucguggcggaucagacgccgacccccacacgcuucuuaaagaacugcgaggaaguaggucuguuuaaugagcuagcuucaccuuucgaaaacgaguuuaaaaaggccagugaggacgauauuaaaaagaugccacucgaccugagcccccuugcaacuccuauaauccgauccaaaauugaggaaccaucuguggucgaaaccacacaucaggauucgccccugccucacccagagucaaccacuagcgacgagaaggaagugccguuggcccagacagcucaacccaccagugcaaucguucguccugccucccuccaggugccaaauguccugcugacgucuagcgauuccucagugauuauccagcaggcuguacccaguccuacuagcucuaccguuauaacacaagccccauccucaaacagacccaucgugccggucccuggccccuucccacucuuacugcaccuuccuaaugggcagacuaugcccguggcgauuccagcaagcaucaccaguucuaacgugcauguccccgccgcuguuccuuuggugaggccaguaacaauggugccguccguccccggcauuccuggaccaagcucgccccagccugugcagucugaggccaagaugcggcugaaagcagcucuaacccaacagcacccacccguuacgaauggugacacugugaaggggcauggauccggccucguccgcacacagucagaagagaguagaccgcaaagccugcagcagccugccaccuccacuacagaaaccccagcgucucccgcccacacgaccccucagacacaaagcacuucaggcaggcggcgccgagcagcuaacgaggaucccgacgagaaaagaaggaaguuucuugaacggaaucgugccgcugccagucgcuguagacagaaaaggaagguguggguacagucccuggagaaaaaggcagaagacuugagcucucucaacgggcagcugcaaucagagguuaccuuacugcggaaugaaguggcccagcucaagcagcuucuguuggcucacaaagauugcccagucacagcgaugcagaagaaaaguggauaucauacugcagacaaggaugacagcuccgaggauaucucugugccuucgagcccccacaccgaggccauacaacauuccucagucaguacaucuaacggugugagcuccaccucaaaagcugaagccguugcaacuagcgugcuaacgcagauggccgaccagucuacagagccagcucugucccagauuguaauggccccgaguagccaaucucagccuuccggcucauga

SEQ ID NO: 7770 - RNA, 1518 nt, Artificial Sequence
  derived and/or modified sequence opt4 from ATF2__Homo_sapiens__CCDS2262.1
augaaguucaagcugcacgugaacagcgccagacaguacaaggaccuguggaacaugagcgacgacaagcccuuccugugcaccgcccccggcugcggccagagauucaccaacgaggaccaccuggccgugcacaagcacaagcacgagaugacccugaaguucggccccgccagaaacgacagcgugaucguggccgaccagacccccacccccaccagauuccugaagaacugcgaggaggugggccuguucaacgagcuggccagccccuucgagaacgaguucaagaaggccagcgaggacgacaucaagaagaugccccuggaccugagcccccuggccacccccaucaucagaagcaagaucgaggagcccagcgugguggagaccacccaccaggacagcccccugccccaccccgagagcaccaccagcgacgagaaggaggugccccuggcccagaccgcccagcccaccagcgccaucgugagacccgccagccugcaggugcccaacgugcugcugaccagcagcgacagcagcgugaucauccagcaggccgugcccagccccaccagcagcaccgugaucacccaggcccccagcagcaacagacccaucgugcccgugcccggccccuucccccugcugcugcaccugcccaacggccagaccaugcccguggccauccccgccagcaucaccagcagcaacgugcacgugcccgccgccgugccccuggugagacccgugaccauggugcccagcgugcccggcauccccggccccagcagcccccagcccgugcagagcgaggccaagaugagacugaaggccgcccugacccagcagcacccccccgugaccaacggcgacaccgugaagggccacggcagcggccuggugagaacccagagcgaggagagcagaccccagagccugcagcagcccgccaccagcaccaccgagacccccgccagccccgcccacaccaccccccagacccagagcaccagcggcagaagaagaagagccgccaacgaggaccccgacgagaagagaagaaaguuccuggagagaaacagagccgccgccagcagaugcagacagaagagaaaggugugggugcagagccuggagaagaaggccgaggaccugagcagccugaacggccagcugcagagcgaggugacccugcugagaaacgagguggcccagcugaagcagcugcugcuggcccacaaggacugccccgugaccgccaugcagaagaagagcggcuaccacaccgccgacaaggacgacagcagcgaggacaucagcgugcccagcagcccccacaccgaggccauccagcacagcagcgugagcaccagcaacggcgugagcagcaccagcaaggccgaggccguggccaccagcgugcugacccagauggccgaccagagcaccgagcccgcccugagccagaucgugauggcccccagcagccagagccagcccagcggcagcuga

SEQ ID NO: 7771 - RNA, 1518 nt, Artificial Sequence
  derived and/or modified sequence opt5 from ATF2__Homo_sapiens__CCDS2262.1
augaaguucaaacugcacgugaacagcgccagacaguacaaggaccucuggaauauguccgaugacaaacccuuucugugcaccgcuccuggcugugggcaacgguucacaaacgaggaucaucuugccguccacaagcauaaacacgaaaugacgcugaaguuuggaccggcgcgcaaugacucuguuaucguggcugaucagacccccacaccuaccagauuccucaagaacugcgaggaagugggccuguuuaaugagcuugccagccccuucgaaaacgaguuuaaaaaggccuccgaggacgauauuaaaaagaugccucuggaccucucuccccuggcuacaccuaucauucggagcaaaaucgaggaaccguccgucguggaaaccacacaucaggauucuccccugccucaccccgagagcaccacguccgacgagaaggaaguuccucucgcccagaccgcucaacccacaagcgccauugugcgcccggcgucucugcaggucccuaaugugcuucugaccuccagcgauucuuccguuaucauccagcaggccgugcccagcccuacaucuuccaccgucauuacgcaagcucccagcuccaacagacccaucgugccugugccggggcccuucccucuccugcuucaucugcccaauggacagacaaugccugucgccauucccgcuucuaucaccagcuccaacguucacgugccggccgcggugccucucguccggcccgugacaaugguuccuagcgugcccggcauuccugggcccucuuccccgcagccuguccagagcgaggccaagaugcgccugaaagcugcccugacccaacagcacccucccgugaccaauggagacacaguuaagggccauggcucugggcucgugagaacgcagagcgaagagucccggccccaaucucugcagcagccggcuaccagcacaaccgaaacacccgccuccccugcccacaccacgccccagacacaaagcaccucuggacgcagacggcgcgcugcgaacgaggauccugacgagaaaagacggaaguuucuugaacgcaauagagccgcugccucccgguguagacagaaacgcaaggucugggugcagagccuggagaaaaaggccgaagaccucucuucccugaacggccagcuucaaagcgaggucacccugcuccggaaugaaguggcucagcugaagcagcugcuccuggcccacaaagauugccccguuacagcgaugcagaagaaauccggguaucauaccgcugacaaggaugacucuagcgaggauaucuccgugccuucuagcccccacacagaggccauucaacauuccagcgucucuacguccaacggagugagcucuaccuccaaagccgaagcuguugccacaagcgugcuuacccagauggcugaccagucuacagagccggcccugagccagaucgucauggcgccuuccagccaaucucagcccuccggcagcuga

SEQ ID NO: 7772 - protein, 282 aa, Artificial Sequence
  C1QBP__Homo_sapiens__Q07021
MLPLLRCVPRVLGSSVAGLRAAAPASPFRQLLQPAPRLCTRPFGLLSVRAGSERRPGLLRPRGPCACGCGCGSLHTDGDKAFVDFLSDEIKEERKIQKHKTLPKMSGGWELELNGTEAKLVRKVAGEKITVTFNINNSIPPTFDGEEEPSQGQKVEEQEPELTSTPNFVVEVIKNDDGKKALVLDCHYPEDEVGQEDEAESDIFSIREVSFQSTGESEWKDTNYTLNTDSLDWALYDHLMDFLADRGVDNTFADELVELSTALEHQEYITFLEDLKSFVKSQ

SEQ ID NO: 7773 - RNA, 849 nt, Artificial Sequence
  C1QBP__Homo_sapiens__AAA16315
augcugccucugcugcgcugcgugccccgugugcugggcuccuccgucgccggccuccgcgcugccgcgcccgccucgccuuuccggcagcuccugcagccggcaccccggcugugcacccggcccuucgggcugcucagcgugcgcgcagguuccgagcggcggccgggccuccugcggccucgcggacccugcgccuguggcuguggcugcggcucgcugcacaccgacggagacaaagcuuuuguugauuuccugagugaugaaauuaaggaggaaagaaaaauucagaagcauaaaacccucccuaagaugucuggagguugggagcuggaacugaaugggacagaagcgaaauuagugcggaaaguugccggggaaaaaaucacggucacuuucaacauuaacaacagcaucccaccaacauuugauggugaggaggaacccucgcaagggcagaagguugaagaacaggagccugaacugacaucaacucccaauuucgugguugaaguuauaaagaaugaugauggcaagaaggcccuuguguuggacugucauuauccagaggaugagguuggacaagaagacgaggcugagagugacaucuucucuaucagggaaguuagcuuucaguccacuggcgagucugaauggaaggauacuaauuauacacucaacacagauuccuuggacugggccuuauaugaccaccuaauggauuuccuugccgaccgagggguggacaacacuuuugcagaugagcugguggagcucagcacagcccuggagcaccaggaguacauuacuuuucuugaagaccucaagaguuuugucaagagccaguag

SEQ ID NO: 7774 - RNA, 849 nt, Artificial Sequence
  derived and/or modified sequence opt1 from C1QBP__Homo_sapiens__AAA16315
augcugccccugcugcgcugcgugccgcggguccugggcagcuccguggccgggcuccgcgccgcggcccccgccagccccuuccggcagcugcugcagcccgccccgcgccucugcacccggcccuucggccugcuguccgugcgcgccgggagcgagcggcgccccggccuccugcggccccgcgggccgugcgcgugcggcugcggcugcgggucccugcacaccgacggcgacaaggccuucgucgacuuccucagcgacgagaucaaggaggagcggaagauccagaagcacaagacgcugcccaagauguccgggggcugggagcuggagcucaacgggaccgaggccaagcuggugcgcaagguggccggcgagaagaucaccgucaccuucaacaucaacaacagcaucccgcccacguucgacggcgaggaggagcccucccaggggcagaagguggaggagcaggagcccgagcugaccagcacccccaacuucguggucgaggugaucaagaacgacgacggcaagaaggcgcucgugcuggacugccacuaccccgaggacgaggucgggcaggaggacgaggccgaguccgacaucuucagcauccgggagguguccuuccagagcaccggcgaguccgaguggaaggacacgaacuacacccugaacaccgacagccucgacugggcccuguacgaccaccugauggacuuccucgccgaccgcggcguggacaacaccuucgccgacgagcuggucgagcuguccacggcgcucgagcaccaggaguacaucaccuuccuggaggaccucaagagcuucgugaagucccaguga

SEQ ID NO: 7775 - RNA, 849 nt, Artificial Sequence
  derived and/or modified sequence opt2 from C1QBP__Homo_sapiens__AAA16315
augcucccccuccuccgcugcgucccccgcguccucggcuccuccgucgccggccuccgcgccgccgcccccgccucccccuuccgccagcuccuccagcccgccccccgccucugcacccgccccuucggccuccucuccguccgcgccggcuccgagcgccgccccggccuccuccgcccccgcggccccugcgccugcggcugcggcugcggcucccuccacaccgacggcgacaaggccuucgucgacuuccucuccgacgagaucaaggaggagcgcaagauccagaagcacaagacccuccccaagauguccggcggcugggagcucgagcucaacggcaccgaggccaagcucguccgcaaggucgccggcgagaagaucaccgucaccuucaacaucaacaacuccaucccccccaccuucgacggcgaggaggagcccucccagggccagaaggucgaggagcaggagcccgagcucaccuccacccccaacuucgucgucgaggucaucaagaacgacgacggcaagaaggcccucguccucgacugccacuaccccgaggacgaggucggccaggaggacgaggccgaguccgacaucuucuccauccgcgaggucuccuuccaguccaccggcgaguccgaguggaaggacaccaacuacacccucaacaccgacucccucgacugggcccucuacgaccaccucauggacuuccucgccgaccgcggcgucgacaacaccuucgccgacgagcucgucgagcucuccaccgcccucgagcaccaggaguacaucaccuuccucgaggaccucaaguccuucgucaagucccaguga

SEQ ID NO: 7776 - RNA, 849 nt, Artificial Sequence
  derived and/or modified sequence opt3 from C1QBP__Homo_sapiens__AAA16315
augcugccccuccuuagaugcgugccuaggguccugggcagcuccguugccggguugcgggcugcagccccagcgucuccguuccgccaguuacugcaacccgcuccucgacuauguacccguccauuuggacuccugucagugagagccgguagugagaggcggcccggccuucugcgcccuagagggccaugcgcauguggaugcggcugugguagcuugcacacagacggggauaaggccuucguagacuuucucuccgaugaaaucaaagaggaaaggaagauucagaaacauaagacucugcccaaaaugucuggaggcugggagcuggaacucaacggcacggaggcuaaguuagugcggaaggucgcaggggagaaaauaaccgugacauucaauaucaacaauucgauuccuccaacuuuugacggagaagaggaaccgucacagggucagaagguugaggagcaagaacccgagcugaccagcacaccuaacuucguggucgaagugaucaaaaaugaugacggcaagaaagcccuuguauuggauugccacuacccagaggacgaaguugggcaggaggaugaggcugaaagugacaucuuuuccauucgcgaggugucuuuccagagcaccggagaauccgaguggaaggauacuaacuauacacugaauaccgacucacuagauugggcccucuacgaccaucugauggacuuucuugcggaucgaggcgucgacaacacguucgcagaugaacugguggaguugaguacugcccucgagcaccaggaauauauaaccuuucuggaggacuuaaagagcuucgugaaaucucaauga

SEQ ID NO: 7777 - RNA, 849 nt, Artificial Sequence
  derived and/or modified sequence opt4 from C1QBP__Homo_sapiens__AAA16315
augcugccccugcugagaugcgugcccagagugcugggcagcagcguggccggccugagagccgccgcccccgccagccccuucagacagcugcugcagcccgcccccagacugugcaccagacccuucggccugcugagcgugagagccggcagcgagagaagacccggccugcugagacccagaggccccugcgccugcggcugcggcugcggcagccugcacaccgacggcgacaaggccuucguggacuuccugagcgacgagaucaaggaggagagaaagauccagaagcacaagacccugcccaagaugagcggcggcugggagcuggagcugaacggcaccgaggccaagcuggugagaaagguggccggcgagaagaucaccgugaccuucaacaucaacaacagcaucccccccaccuucgacggcgaggaggagcccagccagggccagaagguggaggagcaggagcccgagcugaccagcacccccaacuucgugguggaggugaucaagaacgacgacggcaagaaggcccuggugcuggacugccacuaccccgaggacgaggugggccaggaggacgaggccgagagcgacaucuucagcaucagagaggugagcuuccagagcaccggcgagagcgaguggaaggacaccaacuacacccugaacaccgacagccuggacugggcccuguacgaccaccugauggacuuccuggccgacagaggcguggacaacaccuucgccgacgagcugguggagcugagcaccgcccuggagcaccaggaguacaucaccuuccuggaggaccugaagagcuucgugaagagccaguga

SEQ ID NO: 7778 - RNA, 849 nt, Artificial Sequence
  derived and/or modified sequence opt5 from C1QBP__Homo_sapiens__AAA16315
augcugccccuccugagaugcgugccucggguccuuggcagcuccguugccgggcugcgcgcugccgcgccggcuucucccuucagacagcuccugcaaccugcuccccggcuuuguacccgcccuuuuggacugcucagcgugagagccggcuccgagcggcgccccgggcugcugagaccucggggaccgugcgccuguggcugcggguguggaucucuccacacagacggcgauaaggccuucguggacuuucugagcgaugaaaucaaagaggaacgcaagauucagaaacauaagacgcuucccaaaauguccggcgggugggagcuggaacucaacggaaccgaggcuaagcuggucagaaagguggccggcgagaaaaucacaguuaccuucaauauuaacaauucuaucccucccacauuugacggggaagaggaaccuagccagggacagaagguggaggagcaagaacccgagcuuaccuccacaccgaacuucgucguggaaguuauuaaaaaugaugacggcaagaaagcgcuggugcucgauugccacuacccugaggacgaagucgggcaggaggaugaggccgaaagcgacaucuuuucuauccgggagguguccuuccagagcaccggagaaucugaguggaaggauacgaacuauacccugaauacagacucccuggauugggcucucuacgaccaucugauggacuuucuugccgaucgcggcguggacaacaccuucgcugaugaacuggucgagcucagcacagcccuggagcaccaggaauauauuaccuuucuugaggaccugaagucuuucguuaaaucccaauga

SEQ ID NO: 7779 - protein, 245 aa, Artificial Sequence
  C1QC__Homo_sapiens__P02747
MDVGPSSLPHLGLKLLLLLLLLPLRGQANTGCYGIPGMPGLPGAPGKDGYDGLPGPKGEPGIPAIPGIRGPKGQKGEPGLPGHPGKNGPMGPPGMPGVPGPMGIPGEPGEEGRYKQKFQSVFTVTRQTHQPPAPNSLIRFNAVLTNPQGDYDTSTGKFTCKVPGLYYFVYHASHTANLCVLLYRSGVKVVTFCGHTSKTNQVNSGGVLLRLQVGEEVWLAVNDYYDMVGIQGSDSVFSGFLLFPD

SEQ ID NO: 7780 - RNA, 738 nt, Artificial Sequence
  C1QC__Homo_sapiens__CCDS227.1
auggacguggggcccagcucccugccccaccuugggcugaagcugcugcugcuccugcugcugcugccccucaggggccaagccaacacaggcugcuacgggaucccagggaugcccggccugcccggggcaccagggaaggauggguacgacggacugccggggcccaagggggagccaggaaucccagccauucccgggauccgaggacccaaagggcagaagggagaacccggcuuacccggccauccugggaaaaauggccccaugggacccccugggaugccaggggugcccggccccaugggcaucccuggagagccaggugaggagggcagauacaagcagaaauuccagucaguguucacggucacucggcagacccaccagcccccugcacccaacagccugaucagauucaacgcgguccucaccaacccgcagggagauuaugacacgagcacuggcaaguucaccugcaaaguccccggccucuacuacuuugucuaccacgcgucgcauacagccaaccugugcgugcugcuguaccgcagcggcgucaaaguggucaccuucuguggccacacguccaaaaccaaucaggucaacucgggcggugugcugcugagguugcaggugggcgaggagguguggcuggcugucaaugacuacuacgacauggugggcauccagggcucugacagcgucuucuccggcuuccugcucuuccccgacuag

SEQ ID NO: 7781 - RNA, 738 nt, Artificial Sequence
  derived and/or modified sequence opt1 from C1QC__Homo_sapiens__CCDS227.1
auggacgugggccccagcucccugccgcaccucgggcugaagcugcuccugcugcuccugcugcucccccugcgcggccaggccaacaccgggugcuacggcauccccgggaugcccggccugccgggcgcccccgggaaggacggcuacgacgggcuccccggccccaagggggagccgggcauccccgcgauccccggcauccgggggcccaagggccagaagggggagccgggccugcccggccaccccgggaagaacggccccauggggccgcccggcaugcccgggguccccggcccgaugggcauccccggggagcccggcgaggaggggcgcuacaagcagaaguuccagagcguguucaccgugacgcggcagacccaccagcccccggcccccaacucccugauccgcuucaacgccguccucaccaacccccagggcgacuacgacaccagcacggggaaguucacgugcaaggugcccggccuguacuacuucguguaccacgccucccacaccgccaaccugugcguccuccuguaccggagcggcgugaagguggucaccuucugcgggcacaccuccaagaccaaccaggugaacagcggcggggugcugcuccgccugcaggucggcgaggagguguggcuggcggugaacgacuacuacgacauggucgggauccagggcuccgacagcguguucuccggcuuccuccuguucccggacuga

SEQ ID NO: 7782 - RNA, 738 nt, Artificial Sequence
  derived and/or modified sequence opt2 from C1QC__Homo_sapiens__CCDS227.1
auggacgucggccccuccucccucccccaccucggccucaagcuccuccuccuccuccuccuccucccccuccgcggccaggccaacaccggcugcuacggcauccccggcaugcccggccuccccggcgcccccggcaaggacggcuacgacggccuccccggccccaagggcgagcccggcauccccgccauccccggcauccgcggccccaagggccagaagggcgagcccggccuccccggccaccccggcaagaacggccccaugggcccccccggcaugcccggcguccccggccccaugggcauccccggcgagcccggcgaggagggccgcuacaagcagaaguuccaguccgucuucaccgucacccgccagacccaccagccccccgcccccaacucccucauccgcuucaacgccguccucaccaacccccagggcgacuacgacaccuccaccggcaaguucaccugcaagguccccggccucuacuacuucgucuaccacgccucccacaccgccaaccucugcguccuccucuaccgcuccggcgucaaggucgucaccuucugcggccacaccuccaagaccaaccaggucaacuccggcggcguccuccuccgccuccaggucggcgaggaggucuggcucgccgucaacgacuacuacgacauggucggcauccagggcuccgacuccgucuucuccggcuuccuccucuuccccgacuga

SEQ ID NO: 7783 - RNA, 738 nt, Artificial Sequence
  derived and/or modified sequence opt3 from C1QC__Homo_sapiens__CCDS227.1
auggacgugggccccagcucccugccucaccucgggcuuaagcuguuguuacugcuacuccugcuuccacugagaggacaggccaacaccgguugcuacggcaucccggggaugcccggauugccuggcgcuccagguaaagauggguaugacggacuccccggcccuaagggcgagccagggauucccgcaauaccuggaaucagggguccaaaaggccaaaagggggaaccgggacugcccggccauccugguaaaaaugggccaaugggacccccuggcaugccaggcguccccgggccgauggguauuccuggagagcccggcgaagaggggcgguacaagcagaaguuccagucuguuuuuacagugacucgccagacgcaccaaccuccagcccccaacucacugauccgauucaaugcgguacucaccaacccacagggagauuaugacacaaguacuggcaaauuuaccuguaaggugcccgguuuauacuauuucgucuaccaugcuagccacacagccaaucugugcgugcuuuuguaucguuccgggguuaaaguggucaccuuuuguggccauacuucuaagacaaaccagguaaauucgggaggcgugcugcuaagacuccagguuggggaagagguguggcuggcagucaacgauuacuacgacaugguggguauucaaggaucagauagcguguucaguggcuuucuucuguucccugacuga

SEQ ID NO: 7784 - RNA, 738 nt, Artificial Sequence
  derived and/or modified sequence opt4 from C1QC__Homo_sapiens__CCDS227.1
auggacgugggccccagcagccugccccaccugggccugaagcugcugcugcugcugcugcugcugccccugagaggccaggccaacaccggcugcuacggcauccccggcaugcccggccugcccggcgcccccggcaaggacggcuacgacggccugcccggccccaagggcgagcccggcauccccgccauccccggcaucagaggccccaagggccagaagggcgagcccggccugcccggccaccccggcaagaacggccccaugggcccccccggcaugcccggcgugcccggccccaugggcauccccggcgagcccggcgaggagggcagauacaagcagaaguuccagagcguguucaccgugaccagacagacccaccagccccccgcccccaacagccugaucagauucaacgccgugcugaccaacccccagggcgacuacgacaccagcaccggcaaguucaccugcaaggugcccggccuguacuacuucguguaccacgccagccacaccgccaaccugugcgugcugcuguacagaagcggcgugaagguggugaccuucugcggccacaccagcaagaccaaccaggugaacagcggcggcgugcugcugagacugcaggugggcgaggagguguggcuggccgugaacgacuacuacgacauggugggcauccagggcagcgacagcguguucagcggcuuccugcuguuccccgacuga

SEQ ID NO: 7785 - RNA, 738 nt, Artificial Sequence
  derived and/or modified sequence opt5 from C1QC__Homo_sapiens__CCDS227.1
auggacgugggccccagcucccugccucaccucgggcugaaacuucugcuccugcuucugcuccugccgcugagaggacaggccaacaccggcugcuacgggauccccggaaugccuggccuccccggggcuccuggaaaggauggcuaugacggccugcccgggccuaagggagagccgggcauucccgccaucccugggauucggggacccaaaggccaaaagggggaaccuggacuucccggccauccgggcaaaaaugggccuaugggacccccuggcaugcccgggguccccggaccuaugggcaucccgggggagcccggagaagagggccgcuacaagcagaaguuccagucuguuuuuacagugacgagacagacccaccaaccucccgcgccuaacagccugauucgguucaaugcugugcucacaaacccccagggcgauuaugacaccuccacagggaaauuuaccuguaaggucccgggacuguacuauuucguguaccaugccucucacacagccaaucuuugcguucugcucuaucgcagcggcgugaaagucgugaccuuuugugggcauacguccaagaccaaccagguuaauucuggaggcgugcugcugagacuccaggucggggaagagguguggcuggcugugaacgauuacuacgacauggucggcauccaaggaagcgauuccguuuucagcggcuuucuucuguucccugacuga

SEQ ID NO: 7786 - protein, 540 aa, Artificial Sequence
  Cardif__Homo_sapiens__Q7Z434
MPFAEDKTYKYICRNFSNFCNVDVVEILPYLPCLTARDQDRLRATCTLSGNRDTLWHLFNTLQRRPGWVEYFIAALRGCELVDLADEVASVYQSYQPRTSDRPPDPLEPPSLPAERPGPPTPAAAHSIPYNSCREKEPSYPMPVQETQAPESPGENSEQALQTLSPRAIPRNPDGGPLESSSDLAALSPLTSSGHQEQDTELGSTHTAGATSSLTPSRGPVSPSVSFQPLARSTPRASRLPGPTGSVVSTGTSFSSSSPGLASAGAAEGKQGAESDQAEPIICSSGAEAPANSLPSKVPTTLMPVNTVALKVPANPASVSTVPSKLPTSSKPPGAVPSNALTNPAPSKLPINSTRAGMVPSKVPTSMVLTKVSASTVPTDGSSRNEETPAAPTPAGATGGSSAWLDSSSENRGLGSELSKPGVLASQVDSPFSGCFEDLAISASTSLGMGPCHGPEENEYKSEGTFGIHVAENPSIQLLEGNPGPPADPDGGPRPQADRKFQEREVPCHRPSPGALWLQVAVTGVLVVTLLVVLYRRRLH

SEQ ID NO: 7787 - RNA, 1623 nt, Artificial Sequence
  Cardif__Homo_sapiens__ABA54890
augccguuugcugaagacaagaccuauaaguauaucugccgcaauuucagcaauuuuugcaauguggauguuguagagauucugccuuaccugcccugccucacagcaagagaccaggaucgacugcgggccaccugcacacucucagggaaccgggacacccucuggcaucucuucaauacccuucagcggcggcccggcuggguggaguacuucauugcggcacugaggggcugugagcuaguugaucucgcggacgaaguggccucugucuaccagagcuaccagccucggaccucggaccgucccccagacccacuggagccaccgucacuuccugcugagaggccagggccccccacaccugcugcggcccacagcauccccuacaacagcugcagagagaaggagccaaguuaccccaugccuguccaggagacccaggcgccagaguccccaggagagaauucagagcaagcccugcagacgcucagccccagagccaucccaaggaauccagaugguggcccccuggaguccuccucugaccuggcagcccucagcccucugaccuccagcgggcaucaggagcaggacacagaacugggcaguacccacacagcaggugcgaccuccagccucacaccaucccgugggccugugucuccaucugucuccuuccagccccuggcccguuccacccccagggcaagccgcuugccuggacccacagggucaguuguaucuacuggcaccuccuucuccuccucauccccuggcuuggccucugcaggggcugcagaggguaaacagggugcagagagugaccaggccgagccuaucaucugcuccaguggggcagaggcaccugccaacucucugcccuccaaagugccuaccaccuugaugccugugaacacaguggcccugaaagugccugccaacccagcaucugucagcacagugcccuccaaguugccaacuagcucaaagcccccuggugcagugccuucuaaugcgcucaccaauccagcaccauccaaauugcccaucaacucaacccgugcuggcauggugccauccaaagugccuacuagcauggugcucaccaaggugucugccagcacaguccccacugacgggagcagcagaaaugaggagaccccagcagcuccaacacccgccggcgccacuggaggcagcucagccuggcuagacagcagcucugagaauaggggccuugggucggagcugaguaagccuggcgugcuggcaucccagguagacagcccguucucgggcugcuucgaggaucuugccaucagugccagcaccuccuugggcauggggcccugccauggcccagaggagaaugaguauaaguccgagggcaccuuugggauccacguggcugagaaccccagcauccagcuccuggagggcaacccugggccaccugcggacccggauggcggccccaggccacaagccgaccggaaguuccaggagagggaggugccaugccacaggcccucaccuggggcucuguggcuccagguggcugugacaggggugcugguagucacacuccugguggugcuguaccggcggcgucugcacuag

SEQ ID NO: 7788 - RNA, 1623 nt, Artificial Sequence
  derived and/or modified sequence opt1 from Cardif__Homo_sapiens__ABA54890
augcccuucgccgaggacaagaccuacaaguacaucugccgcaacuucagcaacuucugcaacguggacgucguggagauccugccguaccuccccugccugaccgcccgggaccaggaccgccugcgggcgacgugcacccucuccggcaaccgcgacacccuguggcaccuguucaacacccuccagcggcgccccggguggguggaguacuucaucgccgcccugcggggcugcgagcuggucgaccucgccgacgagguggccagcguguaccaguccuaccagccccgcacgagcgaccggccgcccgacccccuggagcccccgucccugcccgcggagcgccccgggcccccgacccccgccgccgcccacagcauccccuacaacuccugccgggagaaggagcccagcuacccgaugcccguccaggagacccaggcgcccgagucccccggcgagaacagcgagcaggcccuccagacccuguccccgcgcgccaucccccggaaccccgacgggggcccccuggagagcuccagcgaccucgccgcccuguccccgcugacgagcuccggccaccaggagcaggacaccgagcucgggagcacccacaccgcgggcgccacguccagccugacccccagccgcgggcccgugucccccagcguguccuuccagccgcuggcccggagcacgccccgcgccucccggcuccccggcccgaccgggagcgucguguccaccggcaccagcuucuccagcuccagccccggccuggccuccgcgggggccgccgagggcaagcagggggccgagagcgaccaggccgagcccaucaucugcuccagcggcgcggaggcccccgccaacucccugccgagcaaggugcccaccacccucaugcccgucaacacgguggcccugaaggugcccgccaacccggcguccgucagcaccgugcccagcaagcugcccaccuccagcaagcccccgggcgccgugcccuccaacgcccucaccaaccccgcccccagcaagcugccgaucaacuccacgcgcgcggggaugguccccagcaaggugcccaccuccauggugcugaccaaggucagcgccuccaccgugcccacggacggcagcucccggaacgaggagaccccggccgcccccacccccgccggggcgaccggcgggagcuccgccuggcucgacagcuccagcgagaaccgcggccugggcuccgagcugagcaagcccggggugcucgccagccaggucgacuccccguucagcggcugcuucgaggaccuggccaucuccgccagcacgucccuggggaugggccccugccacgggcccgaggagaacgaguacaagagcgagggcaccuucggcauccacguggcggagaacccguccauccagcuccuggaggggaaccccggcccgcccgccgaccccgacgggggcccccggccccaggccgaccgcaaguuccaggagcgcgagguccccugccaccggccgagccccggggcccuguggcuccagguggccgugaccggcguccugguggugacccugcucgucgugcuguaccgccggcgccugcacuga

SEQ ID NO: 7789 - RNA, 1623 nt, Artificial Sequence
  derived and/or modified sequence opt2 from Cardif__Homo_sapiens__ABA54890
augcccuucgccgaggacaagaccuacaaguacaucugccgcaacuucuccaacuucugcaacgucgacgucgucgagauccuccccuaccuccccugccucaccgcccgcgaccaggaccgccuccgcgccaccugcacccucuccggcaaccgcgacacccucuggcaccucuucaacacccuccagcgccgccccggcugggucgaguacuucaucgccgcccuccgcggcugcgagcucgucgaccucgccgacgaggucgccuccgucuaccaguccuaccagccccgcaccuccgaccgcccccccgacccccucgagccccccucccuccccgccgagcgccccggcccccccacccccgccgccgcccacuccauccccuacaacuccugccgcgagaaggagcccuccuaccccaugcccguccaggagacccaggcccccgagucccccggcgagaacuccgagcaggcccuccagacccucuccccccgcgccaucccccgcaaccccgacggcggcccccucgaguccuccuccgaccucgccgcccucuccccccucaccuccuccggccaccaggagcaggacaccgagcucggcuccacccacaccgccggcgccaccuccucccucacccccucccgcggccccgucucccccuccgucuccuuccagccccucgcccgcuccaccccccgcgccucccgccuccccggccccaccggcuccgucgucuccaccggcaccuccuucuccuccuccucccccggccucgccuccgccggcgccgccgagggcaagcagggcgccgaguccgaccaggccgagcccaucaucugcuccuccggcgccgaggcccccgccaacucccuccccuccaagguccccaccacccucaugcccgucaacaccgucgcccucaagguccccgccaaccccgccuccgucuccaccguccccuccaagcuccccaccuccuccaagccccccggcgccguccccuccaacgcccucaccaaccccgcccccuccaagcuccccaucaacuccacccgcgccggcaugguccccuccaagguccccaccuccaugguccucaccaaggucuccgccuccaccguccccaccgacggcuccucccgcaacgaggagacccccgccgcccccacccccgccggcgccaccggcggcuccuccgccuggcucgacuccuccuccgagaaccgcggccucggcuccgagcucuccaagcccggcguccucgccucccaggucgacucccccuucuccggcugcuucgaggaccucgccaucuccgccuccaccucccucggcaugggccccugccacggccccgaggagaacgaguacaaguccgagggcaccuucggcauccacgucgccgagaaccccuccauccagcuccucgagggcaaccccggcccccccgccgaccccgacggcggcccccgcccccaggccgaccgcaaguuccaggagcgcgagguccccugccaccgccccucccccggcgcccucuggcuccaggucgccgucaccggcguccucgucgucacccuccucgucguccucuaccgccgccgccuccacuga

SEQ ID NO: 7790 - RNA, 1623 nt, Artificial Sequence
  derived and/or modified sequence opt3 from Cardif__Homo_sapiens__ABA54890
augcccuucgccgaggacaagaccuacaaauauaucugcagaaacuuuagcaauuucuguaacguggaugucguugaaauucugccuuaccucccaugccuuacagcuagggaccaggaucggcugcgcgcaacuuguacguuguccggcaaucgagacaccuuauggcaccuguuuaacacacuacaacguagaccgggguggguggaguauuucauagccgcgcucaggggaugcgaacugguagaucuugcugacgagguggccucugucuaccagucauaucagccccggacuagcgaucgcccuccagacccccuggaaccuccaaguuugcccgcagagagaccugguccaccgacccccgccgcugcacauuccaucccuuacaauucuuguagggagaaggaaccaucguaucccaugccugugcaggagacacaagccccagaaucacccggcgagaacagcgagcaggcucuccagacccugaguccgcgggccauuccucgcaaucccgaugggggaccacuggaauccucuagcgaccucgcggcauuauccccucugacuucaaguggccaccaggagcaagauacagaacuugguagcacccauacggccggggcuacuucuuccuugacccccucacgaggaccaguuagccccagugugucuuuucagccucuggccagauccacaccaagggcaagccggcuaccgggccccacuggcucggucgugucuaccgggacauccuucucaaguagcuccccuggacucgcuucugccggugcggccgagggcaaacagggggcagaaagcgaccaggcugagccaaucauuugcucaaguggagccgaggcucccgccaacucccugccuagcaagguaccaaccacgcuuaugcccguuaauacuguggcacugaaagucccggccaacccugcuucugugucaacagugccaaguaaguugcccaccagcuccaagccucccggcgcggucccaucuaaugcacucacuaacccugcccccucgaaacugccaaucaauagcacacgugcugguaugguuccguccaaggugccuaccucaaugguauuaacgaaagugagugccucuaccguccccacagaugggagcucccgcaacgaagagacuccagcagcccccaccccugcuggagccacaggcggcucaagcgcauggcuggacucuuccagugaaaauagagggcucggaagcgagcuuucuaagccaggugugcuggcgucccaaguugacucacccuuuaguggcuguuucgaagauuuggcuauaagcgccucgacuucccuagggaugggaccuugccacggcccggaggagaacgaauacaaaucugaggguaccuuugggauccauguggcagaaaacccaagcauucagcugcucgagggcaaucccggaccuccagccgaccccgauggcgggccuaggccgcaggcugaccggaaguuccaagaacgagagguccccugucaccgcccaucaccuggagcccuguggcuucagguggcaguaacagguguucugguggucaccuugcucgugguccuguacagaaggcgguuacacuga

SEQ ID NO: 7791 - RNA, 1623 nt, Artificial Sequence
  derived and/or modified sequence opt4 from Cardif__Homo_sapiens__ABA54890
augcccuucgccgaggacaagaccuacaaguacaucugcagaaacuucagcaacuucugcaacguggacgugguggagauccugcccuaccugcccugccugaccgccagagaccaggacagacugagagccaccugcacccugagcggcaacagagacacccuguggcaccuguucaacacccugcagagaagacccggcuggguggaguacuucaucgccgcccugagaggcugcgagcugguggaccuggccgacgagguggccagcguguaccagagcuaccagcccagaaccagcgacagaccccccgacccccuggagccccccagccugcccgccgagagacccggcccccccacccccgccgccgcccacagcauccccuacaacagcugcagagagaaggagcccagcuaccccaugcccgugcaggagacccaggcccccgagagccccggcgagaacagcgagcaggcccugcagacccugagccccagagccauccccagaaaccccgacggcggcccccuggagagcagcagcgaccuggccgcccugagcccccugaccagcagcggccaccaggagcaggacaccgagcugggcagcacccacaccgccggcgccaccagcagccugacccccagcagaggccccgugagccccagcgugagcuuccagccccuggccagaagcacccccagagccagcagacugcccggccccaccggcagcguggugagcaccggcaccagcuucagcagcagcagccccggccuggccagcgccggcgccgccgagggcaagcagggcgccgagagcgaccaggccgagcccaucaucugcagcagcggcgccgaggcccccgccaacagccugcccagcaaggugcccaccacccugaugcccgugaacaccguggcccugaaggugcccgccaaccccgccagcgugagcaccgugcccagcaagcugcccaccagcagcaagccccccggcgccgugcccagcaacgcccugaccaaccccgcccccagcaagcugcccaucaacagcaccagagccggcauggugcccagcaaggugcccaccagcauggugcugaccaaggugagcgccagcaccgugcccaccgacggcagcagcagaaacgaggagacccccgccgcccccacccccgccggcgccaccggcggcagcagcgccuggcuggacagcagcagcgagaacagaggccugggcagcgagcugagcaagcccggcgugcuggccagccagguggacagccccuucagcggcugcuucgaggaccuggccaucagcgccagcaccagccugggcaugggccccugccacggccccgaggagaacgaguacaagagcgagggcaccuucggcauccacguggccgagaaccccagcauccagcugcuggagggcaaccccggcccccccgccgaccccgacggcggccccagaccccaggccgacagaaaguuccaggagagagaggugcccugccacagacccagccccggcgcccuguggcugcagguggccgugaccggcgugcugguggugacccugcugguggugcuguacagaagaagacugcacuga

SEQ ID NO: 7792 - RNA, 1623 nt, Artificial Sequence
  derived and/or modified sequence opt5 from Cardif__Homo_sapiens__ABA54890
augcccuucgccgaggacaagaccuacaaauauaucugcagaaacuuuagcaauuucuguaacguggaugucguugaaauucugccuuaccucccgugccugacagcucgggaccaggaucgccuuagagccacguguacccuguccggcaaucgggacacacucuggcaccuguuuaacacccuucaacgcagacccggguggguggaguauuucaucgcggcucugcggggaugcgaacucguggaucuggccgacgaggucgccucuguguaccagagcuaucagccucgcacauccgauagacccccugacccccuggaaccuccgucucuccccgcugagcggccugggcccccuacccccgccgcugcccauagcauuccguacaauuccugucgcgagaaggaaccuucuuaucccaugccuguucaggagacacaagcgcccgaaagccccggcgagaacuccgagcaggcccugcagacccuuagcccuagagcuaucccgcggaaucccgauggaggcccucuggaaucuuccagcgaccucgccgcucugucuccccuuacguccagcgggcaccaggagcaagauaccgaacugggaucuacacauaccgccggcgcgacauccagccucaccccuucccgcggccccgugucuccgagcgucuccuuucagccucuggccagaagcacgccccgggcuucucgccugccugggcccacaggauccgugguuagcaccggcacaucuuucagcuccucuagcccugggcucgccuccgcuggagccgccgagggcaaacagggggcugaaagcgaccaggcggagcccauuaucuguucuuccggagccgaggcuccggccaacagccugccuucuaaggugcccaccacccuuaugcccgucaauacaguggcccugaaagugccugcuaacccggccuccgucagcacgguucccuccaagcucccuaccucuagcaagcccccuggcgcggugcccuccaaugcucugacaaacccugcccccucuaaacuuccgaucaauagcaccagagccggcauggugccuuccaagguccccacaagcauggugcugaccaaaguuucugcuuccacggugccuacagaugggagcucucggaacgaagagacccccgccgcuccgaccccugccggagcgacaggcggguccagcgccuggcucgacucuagcuccgaaaauagaggacugggcagcgagcugucuaagcccgggguccucgcuucccaaguggacagcccuuuuuccggaugcuucgaagaucuggccauuucugcuagcaccucccuuggcaugggccccugccacgggcccgaggagaacgaauacaaaucugagggaacauuuggcauccauguugccgaaaacccuagcauucagcugcucgaggggaauccgggacccccugcggaccccgauggcgggccucgcccccaggccgaccggaaguuccaagaaagagaggugccuugucaccgcccgucccccggcgcucuguggcuucaggucgccgugacgggaguccuggugguuacccuccuggugguccuguaccggagacgccuccacuga

SEQ ID NO: 7793 - protein, 128 aa, Artificial Sequence
  CD59,Beta-Defensin__Homo_sapiens__P13987
MGIQGGSVLFGLLLVLAVFCHSGHSLQCYNCPNPTADCKTAVNCSSDFDACLITKAGLQVYNKCWKFEHCNFNDVTTRLRENELTYYCCKKDLCNFNEQLENGGTSLSEKTVLLLVTPFLAAAWSLHP

SEQ ID NO: 7794 - RNA, 387 nt, Artificial Sequence
  CD59,Beta-Defensin__Homo_sapiens__AAA51952
augggaauccaaggagggucuguccuguucgggcugcugcucguccuggcugucuucugccauucaggucauagccugcagugcuacaacuguccuaacccaacugcugacugcaaaacagccgucaauuguucaucugauuuugaugcgugucucauuaccaaagcuggguuacaaguguauaacaaguguuggaaguuugagcauugcaauuucaacgacgucacaacccgcuugagggaaaaugagcuaacguacuacugcugcaagaaggaccuguguaacuuuaacgaacagcuugaaaauggugggacauccuuaucagagaaaacaguucuucugcuggugacuccauuucuggcagcagccuggagccuucaucccuaa

SEQ ID NO: 7795 - RNA, 387 nt, Artificial Sequence
  derived and/or modified sequence opt1 from CD59,Beta-Defensin__Homo_sapiens__AAA51952
augggcauccagggcgggagcgugcuguucgggcuccugcugguccucgccguguucugccacuccggccacagccugcagugcuacaacugccccaacccgaccgccgacugcaagaccgcggugaacugcuccagcgacuucgacgccugccugaucacgaaggccgggcuccaggucuacaacaagugcuggaaguucgagcacugcaacuucaacgacgugaccacccgccugcgggagaacgagcugaccuacuacugcugcaagaaggaccucugcaacuucaacgagcagcuggagaacggcggcacgucccugagcgagaagaccgugcuccugcuggucacccccuuccucgccgccgcguggucccugcaccccuga

SEQ ID NO: 7796 - RNA, 387 nt, Artificial Sequence
  derived and/or modified sequence opt2 from CD59,Beta-Defensin__Homo_sapiens__AAA51952
augggcauccagggcggcuccguccucuucggccuccuccucguccucgccgucuucugccacuccggccacucccuccagugcuacaacugccccaaccccaccgccgacugcaagaccgccgucaacugcuccuccgacuucgacgccugccucaucaccaaggccggccuccaggucuacaacaagugcuggaaguucgagcacugcaacuucaacgacgucaccacccgccuccgcgagaacgagcucaccuacuacugcugcaagaaggaccucugcaacuucaacgagcagcucgagaacggcggcaccucccucuccgagaagaccguccuccuccucgucacccccuuccucgccgccgccuggucccuccaccccuga

SEQ ID NO: 7797 - RNA, 387 nt, Artificial Sequence
  derived and/or modified sequence opt3 from CD59,Beta-Defensin__Homo_sapiens__AAA51952
augggcauccaagggggaagcgugcuguucggucuccuucuggucuuggccguguuuugccacuccggccauucuuuacaguguuacaacugccccaauccuaccgcugacuguaagacagcaguuaacugcucaagugauuucgacgccugucugauuacuaaagcggggcuacagguauauaauaagugcuggaaauuugagcacuguaacuucaaugaugugacgaccagacucagggaaaacgagcugacauacuauugcuguaagaaagaccuuugcaauuuuaacgaacagcuggagaauggaggcacuagcuuguccgaaaagaccguccuccugcuggugacaccauuccucgcugccgcauggucuuuacauccguga

SEQ ID NO: 7798 - RNA, 387 nt, Artificial Sequence
  derived and/or modified sequence opt4 from CD59,Beta-Defensin__Homo_sapiens__AAA51952
augggcauccagggcggcagcgugcuguucggccugcugcuggugcuggccguguucugccacagcggccacagccugcagugcuacaacugccccaaccccaccgccgacugcaagaccgccgugaacugcagcagcgacuucgacgccugccugaucaccaaggccggccugcagguguacaacaagugcuggaaguucgagcacugcaacuucaacgacgugaccaccagacugagagagaacgagcugaccuacuacugcugcaagaaggaccugugcaacuucaacgagcagcuggagaacggcggcaccagccugagcgagaagaccgugcugcugcuggugacccccuuccuggccgccgccuggagccugcaccccuga

SEQ ID NO: 7799 - RNA, 387 nt, Artificial Sequence
  derived and/or modified sequence opt5 from CD59,Beta-Defensin__Homo_sapiens__AAA51952
augggcauccaagggggaagcgugcuguucggccuccugcuuguccuggccguguuuugccacuccgggcauucucuccaguguuacaacugccccaauccuaccgcugacuguaagacagccguuaacugcagcuccgauuucgacgcgugucugauuacgaaagcuggacuucagguguauaauaagugcuggaaauuugagcacuguaacuucaaugaugucaccacaagacugcgggaaaacgagcucaccuacuauugcuguaagaaagaccugugcaauuuuaacgaacagcuggagaauggcgggacaucucucagcgaaaagaccgugcugcuucugguuacaccguuccucgccgccgcuuggucccugcaucccuga

SEQ ID NO: 7800 - protein, 128 aa, Artificial Sequence; identical to SEQ ID NO: 7793
  CD59,Beta-Defensin__Homo_sapiens__Q6FHM9

SEQ ID NO: 7801 - RNA, 387 nt, Artificial Sequence; identical to SEQ ID NO: 7794
  CD59,Beta-Defensin__Homo_sapiens__BAG34721

SEQ ID NO: 7802 - RNA, 387 nt, Artificial Sequence; identical to SEQ ID NO: 7795
  derived and/or modified sequence opt1 from CD59,Beta-Defensin__Homo_sapiens__BAG34721

SEQ ID NO: 7803 - RNA, 387 nt, Artificial Sequence; identical to SEQ ID NO: 7796
  derived and/or modified sequence opt2 from CD59,Beta-Defensin__Homo_sapiens__BAG34721

SEQ ID NO: 7804 - RNA, 387 nt, Artificial Sequence; identical to SEQ ID NO: 7797
  derived and/or modified sequence opt3 from CD59,Beta-Defensin__Homo_sapiens__BAG34721

SEQ ID NO: 7805 - RNA, 387 nt, Artificial Sequence; identical to SEQ ID NO: 7798
  derived and/or modified sequence opt4 from CD59,Beta-Defensin__Homo_sapiens__BAG34721

SEQ ID NO: 7806 - RNA, 387 nt, Artificial Sequence; identical to SEQ ID NO: 7799
  derived and/or modified sequence opt5 from CD59,Beta-Defensin__Homo_sapiens__BAG34721

SEQ ID NO: 7807 - protein, 191 aa, Artificial Sequence
  Cdc42__Homo_sapiens__A0A024RAE4
MQTIKCVVVGDGAVGKTCLLISYTTNKFPSEYVPTVFDNYAVTVMIGGEPYTLGLFDTAGQEDYDRLRPLSYPQTDVFLVCFSVVSPSSFENVKEKWVPEITHHCPKTPFLLVGTQIDLRDDPSTIEKLAKNKQKPITPETAEKLARDLKAVKYVECSALTQKGLKNVFDEAILAALEPPEPKKSRRCVLL

SEQ ID NO: 7808 - RNA, 576 nt, Artificial Sequence
  Cdc42__Homo_sapiens__EAW95002
augcagacaauuaaguguguuguugugggcgauggugcuguugguaaaacaugucuccugauauccuacacaacaaacaaauuuccaucggaauauguaccgacuguuuuugacaacuaugcagucacaguuaugauugguggagaaccauauacucuuggacuuuuugauacugcagggcaagaggauuaugacagauuacgaccgcugaguuauccacaaacagauguauuucuagucuguuuuucaguggucucuccaucuucauuugaaaacgugaaagaaaagugggugccugagauaacucaccacuguccaaagacuccuuucuugcuuguugggacucaaauugaucucagagaugaccccucuacuauugagaaacuugccaagaacaaacagaagccuaucacuccagagacugcugaaaagcuggcccgugaccugaaggcugucaaguauguggaguguucugcacuuacacagaaaggccuaaagaauguauuugacgaagcaauauuggcugcccuggagccuccagaaccgaagaagagccgcaggugugugcugcuauga

SEQ ID NO: 7809 - RNA, 576 nt, Artificial Sequence
  derived and/or modified sequence opt1 from Cdc42__Homo_sapiens__EAW95002
augcagaccaucaagugcguggucgugggcgacggggccgugggcaagaccugccugcucaucagcuacacgaccaacaaguuccccuccgaguacgucccgaccguguucgacaacuacgccgugaccgucaugaucgggggcgagcccuacacgcuggggcuguucgacaccgcgggccaggaggacuacgaccgccuccggccccugagcuacccccagaccgacguguuccuggugugcuucuccgucgugagcccguccagcuucgagaacgugaaggagaaguggguccccgagaucacccaccacugccccaagacgcccuuccuccuggugggcacccagaucgaccugcgcgacgacccguccaccaucgagaagcucgccaagaacaagcagaagcccaucacccccgagacggccgagaagcuggcccgggaccugaaggccgugaaguacgucgagugcagcgcgcucacccagaaggggcugaagaacguguucgacgaggccauccuggccgcccucgagcccccggagcccaagaagucccgccggugcgugcugcuguga

SEQ ID NO: 7810 - RNA, 576 nt, Artificial Sequence
  derived and/or modified sequence opt2 from Cdc42__Homo_sapiens__EAW95002
augcagaccaucaagugcgucgucgucggcgacggcgccgucggcaagaccugccuccucaucuccuacaccaccaacaaguuccccuccgaguacguccccaccgucuucgacaacuacgccgucaccgucaugaucggcggcgagcccuacacccucggccucuucgacaccgccggccaggaggacuacgaccgccuccgcccccucuccuacccccagaccgacgucuuccucgucugcuucuccgucgucucccccuccuccuucgagaacgucaaggagaaguggguccccgagaucacccaccacugccccaagacccccuuccuccucgucggcacccagaucgaccuccgcgacgaccccuccaccaucgagaagcucgccaagaacaagcagaagcccaucacccccgagaccgccgagaagcucgcccgcgaccucaaggccgucaaguacgucgagugcuccgcccucacccagaagggccucaagaacgucuucgacgaggccauccucgccgcccucgagccccccgagcccaagaagucccgccgcugcguccuccucuga

SEQ ID NO: 7811 - RNA, 576 nt, Artificial Sequence
  derived and/or modified sequence opt3 from Cdc42__Homo_sapiens__EAW95002
augcagaccaucaagugcguggucguuggcgacggggccgugggaaaaacaugucugcucauuagcuacacuacgaacaaguuccccuccgaguauguaccuaccguguuugauaauuacgcugucacagugaugauagguggcgaaccauauacucuugggcuguucgacaccgcaggacaagaggauuacgacagauugaggccguuaucuuauccccagacagauguuuuucuggugugcuucucagucgugaguccuagcuccuuugaaaacguaaaagagaaguggguuccagaaaucacccaccauugucccaaaacuccuuuccuacucgugggcacacagauugaccugcgggaugacccaucuaccaucgagaaacuugccaagaauaagcagaagcccauuacgccugagacugcggaaaaacuggcucgcgauuugaaggccgucaaauacguggagugcucggcacucacccaaaagggucugaagaacguguuugacgaagccauccuggcugcacucgagccaccggagcccaaaaagucacgacguugugucuuacuguga

SEQ ID NO: 7812 - RNA, 576 nt, Artificial Sequence
  derived and/or modified sequence opt4 from Cdc42__Homo_sapiens__EAW95002
augcagaccaucaagugcgugguggugggcgacggcgccgugggcaagaccugccugcugaucagcuacaccaccaacaaguuccccagcgaguacgugcccaccguguucgacaacuacgccgugaccgugaugaucggcggcgagcccuacacccugggccuguucgacaccgccggccaggaggacuacgacagacugagaccccugagcuacccccagaccgacguguuccuggugugcuucagcguggugagccccagcagcuucgagaacgugaaggagaagugggugcccgagaucacccaccacugccccaagacccccuuccugcuggugggcacccagaucgaccugagagacgaccccagcaccaucgagaagcuggccaagaacaagcagaagcccaucacccccgagaccgccgagaagcuggccagagaccugaaggccgugaaguacguggagugcagcgcccugacccagaagggccugaagaacguguucgacgaggccauccuggccgcccuggagccccccgagcccaagaagagcagaagaugcgugcugcuguga

SEQ ID NO: 7813 - RNA, 576 nt, Artificial Sequence
  derived and/or modified sequence opt5 from Cdc42__Homo_sapiens__EAW95002
augcagaccaucaagugcguggucguuggcgacggggccgugggaaaaacaugucugcucauuagcuacacgaccaacaaguuccccuccgaguaugugccuacagucuuugauaauuacgcugugaccguuaugaucggcggggaaccguauacacugggacuuuucgacaccgccggccaagaggauuacgacagacugcggccccucucuuauccucagacagauguguuucuggucugcuucagcgugguuucccccucuagcuuugaaaacgugaaagagaagugggucccugaaauuacccaccauugucccaaaacgccuuuccuucugguggggacccagaucgaccuccgcgaugacccguccacaauugagaagcuggcgaagaauaaacagaagcccaucaccccugagacagcugaaaaacuggccagagaucucaaggccgugaaauacgucgagugcucugcucugacccaaaagggacuuaagaacguuuuugacgaagccauccuggcugcccucgagcccccugagcccaaaaagagccggcgcugugugcugcuuuga

SEQ ID NO: 7814 - protein, 191 aa, Artificial Sequence
  Cdc42__Homo_sapiens__A0A024RAE6
MQTIKCVVVGDGAVGKTCLLISYTTNKFPSEYVPTVFDNYAVTVMIGGEPYTLGLFDTAGQEDYDRLRPLSYPQTDVFLVCFSVVSPSSFENVKEKWVPEITHHCPKTPFLLVGTQIDLRDDPSTIEKLAKNKQKPITPETAEKLARDLKAVKYVECSALTQRGLKNVFDEAILAALEPPETQPKRKCCIF

SEQ ID NO: 7815 - RNA, 576 nt, Artificial Sequence
  Cdc42__Homo_sapiens__EAW95006
augcagacaauuaaguguguuguugugggcgauggugcuguugguaaaacaugucuccugauauccuacacaacaaacaaauuuccaucggaauauguaccgacuguuuuugacaacuaugcagucacaguuaugauugguggagaaccauauacucuuggacuuuuugauacugcagggcaagaggauuaugacagauuacgaccgcugaguuauccacaaacagauguauuucuagucuguuuuucaguggucucuccaucuucauuugaaaacgugaaagaaaagugggugccugagauaacucaccacuguccaaagacuccuuucuugcuuguugggacucaaauugaucucagagaugaccccucuacuauugagaaacuugccaagaacaaacagaagccuaucacuccagagacugcugaaaagcuggcccgugaccugaaggcugucaaguauguggaguguucugcacuuacacagagaggucugaagaauguguuugaugaggcuauccuagcugcccucgagccuccggaaacucaacccaaaaggaagugcuguauauucuaa

SEQ ID NO: 7816 - RNA, 576 nt, Artificial Sequence
  derived and/or modified sequence opt1 from Cdc42__Homo_sapiens__EAW95006
augcagaccaucaagugcguggucgugggcgacggggccgugggcaagaccugccugcucaucagcuacacgaccaacaaguuccccuccgaguacgucccgaccguguucgacaacuacgccgugaccgucaugaucgggggcgagcccuacacgcuggggcuguucgacaccgcgggccaggaggacuacgaccgccuccggccccugagcuacccccagaccgacguguuccuggugugcuucuccgucgugagcccguccagcuucgagaacgugaaggagaaguggguccccgagaucacccaccacugccccaagacgcccuuccuccuggugggcacccagaucgaccugcgcgacgacccguccaccaucgagaagcucgccaagaacaagcagaagcccaucacccccgagacggccgagaagcuggcccgggaccugaaggccgugaaguacgucgagugcagcgcgcucacccagcgcgggcugaagaacguguucgacgaggccauccuggccgcccucgagcccccggagacccagcccaagcggaagugcugcaucuucuga

SEQ ID NO: 7817 - RNA, 576 nt, Artificial Sequence
  derived and/or modified sequence opt2 from Cdc42__Homo_sapiens__EAW95006
augcagaccaucaagugcgucgucgucggcgacggcgccgucggcaagaccugccuccucaucuccuacaccaccaacaaguuccccuccgaguacguccccaccgucuucgacaacuacgccgucaccgucaugaucggcggcgagcccuacacccucggccucuucgacaccgccggccaggaggacuacgaccgccuccgcccccucuccuacccccagaccgacgucuuccucgucugcuucuccgucgucucccccuccuccuucgagaacgucaaggagaaguggguccccgagaucacccaccacugccccaagacccccuuccuccucgucggcacccagaucgaccuccgcgacgaccccuccaccaucgagaagcucgccaagaacaagcagaagcccaucacccccgagaccgccgagaagcucgcccgcgaccucaaggccgucaaguacgucgagugcuccgcccucacccagcgcggccucaagaacgucuucgacgaggccauccucgccgcccucgagccccccgagacccagcccaagcgcaagugcugcaucuucuga

SEQ ID NO: 7818 - RNA, 576 nt, Artificial Sequence
  derived and/or modified sequence opt3 from Cdc42__Homo_sapiens__EAW95006
augcagaccaucaagugcguggucguuggcgacggggccgugggaaaaacaugucugcucauuagcuacacuacgaacaaguuccccuccgaguauguaccuaccguguuugauaauuacgcugucacagugaugauagguggcgaaccauauacucuugggcuguucgacaccgcaggacaagaggauuacgacagauugaggccguuaucuuauccccagacagauguuuuucuggugugcuucucagucgugaguccuagcuccuuugaaaacguaaaagagaaguggguuccagaaaucacccaccauugucccaaaacuccuuuccuacucgugggcacacagauugaccugcgggaugacccaucuaccaucgagaaacuugccaagaauaagcagaagcccauuacgccugagacugcggaaaaacuggcucgcgauuugaaggccgucaaauacguggagugcucggcacucacccaacgaggucugaagaacguguuugacgaagccauccuggcugcacucgagccaccggagacacagcccaagcguaaauguugcauauucuga

SEQ ID NO: 7819 - RNA, 576 nt, Artificial Sequence
  derived and/or modified sequence opt4 from Cdc42__Homo_sapiens__EAW95006
augcagaccaucaagugcgugguggugggcgacggcgccgugggcaagaccugccugcugaucagcuacaccaccaacaaguuccccagcgaguacgugcccaccguguucgacaacuacgccgugaccgugaugaucggcggcgagcccuacacccugggccuguucgacaccgccggccaggaggacuacgacagacugagaccccugagcuacccccagaccgacguguuccuggugugcuucagcguggugagccccagcagcuucgagaacgugaaggagaagugggugcccgagaucacccaccacugccccaagacccccuuccugcuggugggcacccagaucgaccugagagacgaccccagcaccaucgagaagcuggccaagaacaagcagaagcccaucacccccgagaccgccgagaagcuggccagagaccugaaggccgugaaguacguggagugcagcgcccugacccagagaggccugaagaacguguucgacgaggccauccuggccgcccuggagccccccgagacccagcccaagagaaagugcugcaucuucuga

SEQ ID NO: 7820 - RNA, 576 nt, Artificial Sequence
  derived and/or modified sequence opt5 from Cdc42__Homo_sapiens__EAW95006
augcagaccaucaagugcguggucguuggcgacggggccgugggaaaaacaugucugcucauuagcuacacgaccaacaaguuccccuccgaguaugugccuacagucuuugauaauuacgcugugaccguuaugaucggcggggaaccguauacacugggacuuuucgacaccgccggccaagaggauuacgacagacugcggccccucucuuauccucagacagauguguuucuggucugcuucagcgugguuucccccucuagcuuugaaaacgugaaagagaagugggucccugaaauuacccaccauugucccaaaacgccuuuccuucugguggggacccagaucgaccuccgcgaugacccguccacaauugagaagcuggcgaagaauaaacagaagcccaucaccccugagacagcugaaaaacuggccagagaucucaaggccgugaaauacgucgagugcucugcucugacccaacggggacuuaagaacguuuuugacgaagccauccuggcugcccucgagcccccugagacgcagcccaagcgcaaauguugcauuuucuga

SEQ ID NO: 7821 - protein, 191 aa, Artificial Sequence; identical to SEQ ID NO: 7807
  Cdc42__Homo_sapiens__P60953

SEQ ID NO: 7822 - RNA, 576 nt, Artificial Sequence; identical to SEQ ID NO: 7808
  Cdc42__Homo_sapiens__AAA52592

SEQ ID NO: 7823 - RNA, 576 nt, Artificial Sequence; identical to SEQ ID NO: 7809
  derived and/or modified sequence opt1 from Cdc42__Homo_sapiens__AAA52592

SEQ ID NO: 7824 - RNA, 576 nt, Artificial Sequence; identical to SEQ ID NO: 7810
  derived and/or modified sequence opt2 from Cdc42__Homo_sapiens__AAA52592

SEQ ID NO: 7825 - RNA, 576 nt, Artificial Sequence; identical to SEQ ID NO: 7811
  derived and/or modified sequence opt3 from Cdc42__Homo_sapiens__AAA52592

SEQ ID NO: 7826 - RNA, 576 nt, Artificial Sequence; identical to SEQ ID NO: 7812
  derived and/or modified sequence opt4 from Cdc42__Homo_sapiens__AAA52592

SEQ ID NO: 7827 - RNA, 576 nt, Artificial Sequence; identical to SEQ ID NO: 7813
  derived and/or modified sequence opt5 from Cdc42__Homo_sapiens__AAA52592

SEQ ID NO: 7828 - protein, 253 aa, Artificial Sequence
  CFAD__Homo_sapiens__P00746
MHSWERLAVLVLLGAAACAAPPRGRILGGREAEAHARPYMASVQLNGAHLCGGVLVAEQWVLSAAHCLEDAADGKVQVLLGAHSLSQPEPSKRLYDVLRAVPHPDSQPDTIDHDLLLLQLSEKATLGPAVRPLPWQRVDRDVAPGTLCDVAGWGIVNHAGRRPDSLQHVLLPVLDRATCNRRTHHDGAITERLMCAESNRRDSCKGDSGGPLVCGGVLEGVVTSGSRVCGNRKKPGIYTRVASYAAWIDSVLA

SEQ ID NO: 7829 - RNA, 762 nt, Artificial Sequence
  CFAD__Homo_sapiens__CCDS12046.1
augcacagcugggagcgccuggcaguucugguccuccuaggagcggccgccugcgcggcgccgccccguggucggauccugggcggcagagaggccgaggcgcacgcgcggcccuacauggcgucggugcagcugaacggcgcgcaccugugcggcggcguccugguggcggagcagugggugcugagcgcggcgcacugccuggaggacgcggccgacgggaaggugcagguucuccugggcgcgcacucccugucgcagccggagcccuccaagcgccuguacgacgugcuccgcgcagugccccacccggacagccagcccgacaccaucgaccacgaccuccugcugcuacagcugucggagaaggccacacugggcccugcugugcgcccccugcccuggcagcgcguggaccgcgacguggcaccgggaacucucugcgacguggccggcuggggcauagucaaccacgcgggccgccgcccggacagccugcagcacgugcucuugccagugcuggaccgcgccaccugcaaccggcgcacgcaccacgacggcgccaucaccgagcgcuugaugugcgcggagagcaaucgccgggacagcugcaagggugacuccgggggcccgcuggugugcgggggcgugcucgagggcguggucaccucgggcucgcgcguuugcggcaaccgcaagaagcccgggaucuacacccgcguggcgagcuaugcggccuggaucgacagcguccuggccuag

SEQ ID NO: 7830 - RNA, 762 nt, Artificial Sequence
  derived and/or modified sequence opt1 from CFAD__Homo_sapiens__CCDS12046.1
augcacagcugggagcgccuggccgugcucguccugcugggcgccgcggccugcgccgcgcccccgcgggggcgcauccucggcgggcgggaggccgaggcccacgcccgccccuacauggccuccgugcagcugaacggcgcccaccugugcgggggcgugcucgucgcggagcagugggugcugagcgccgcccacugccuggaggacgccgccgacggcaaggugcagguccuccugggggcgcacucccugagccagcccgagcccuccaagcggcucuacgacgugcugcgcgccgugccgcaccccgacagccagcccgacaccaucgaccacgaccugcuccugcugcagcucuccgagaaggccacccugggccccgccguccggccgcugcccuggcagcgcguggaccgggacguggcccccgggacgcucugcgacgucgcgggcugggggaucgugaaccacgccggccgccggcccgacagccugcagcacgugcugcucccgguccuggaccgcgcgaccugcaaccggcgcacccaccacgacggcgccaucaccgagcggcugaugugcgccgaguccaaccgccgggacagcugcaagggggacuccggcgggccccucgugugcggcggcgugcuggagggggucgugacgagcggcucccgcgugugcgggaaccggaagaagcccggcaucuacacccgcgucgccagcuacgccgccuggaucgacuccgugcuggccuga

SEQ ID NO: 7831 - RNA, 762 nt, Artificial Sequence
  derived and/or modified sequence opt2 from CFAD__Homo_sapiens__CCDS12046.1
augcacuccugggagcgccucgccguccucguccuccucggcgccgccgccugcgccgcccccccccgcggccgcauccucggcggccgcgaggccgaggcccacgcccgccccuacauggccuccguccagcucaacggcgcccaccucugcggcggcguccucgucgccgagcaguggguccucuccgccgcccacugccucgaggacgccgccgacggcaagguccagguccuccucggcgcccacucccucucccagcccgagcccuccaagcgccucuacgacguccuccgcgccgucccccaccccgacucccagcccgacaccaucgaccacgaccuccuccuccuccagcucuccgagaaggccacccucggccccgccguccgcccccuccccuggcagcgcgucgaccgcgacgucgcccccggcacccucugcgacgucgccggcuggggcaucgucaaccacgccggccgccgccccgacucccuccagcacguccuccuccccguccucgaccgcgccaccugcaaccgccgcacccaccacgacggcgccaucaccgagcgccucaugugcgccgaguccaaccgccgcgacuccugcaagggcgacuccggcggcccccucgucugcggcggcguccucgagggcgucgucaccuccggcucccgcgucugcggcaaccgcaagaagcccggcaucuacacccgcgucgccuccuacgccgccuggaucgacuccguccucgccuga

SEQ ID NO: 7832 - RNA, 762 nt, Artificial Sequence
  derived and/or modified sequence opt3 from CFAD__Homo_sapiens__CCDS12046.1
augcacagcugggagagacuggccgugcucguccuucugggcgcugcagccugcgcggcucccccuagggggcggaucuugggaggucgcgaagccgaggcacaugcccgaccauacauggcuuccguucaguuaaacggcgcacaccugugugggggagugcuaguagccgaacaaugggugcucucugcugcccauugccuggaggacgcggcagauggcaagguccaggugcuucugggugcccacucauugagucagccggaacccagcaaacgucucuaugacguucugagagcugugccucauccagauucccagcccgacaccauugaucacgaccugcucuuacugcaacuuucugagaaggccacauuggggccugcagucaggccacugcccuggcagcggguggaucgcgacguagcuccuggaacucuaugugauguugccggcuggggcauagugaaucacgcggggagaaggccagacucgcuccagcauguccugcuuccggugcuggaucgggccacgugcaaccgccgaacccaccaugacggagcaaucacagagagauugaugugugcugaaucaaauaggcgggauagcugcaaaggugacaguggcgggccccucguguguggaggcguccuggaggguguugugacuuccgggucucguguaugcggaaaccgcaagaaaccuggcauuuacaccagaguggccagcuaugcugccuggaucgacuccgucuuagcauga

SEQ ID NO: 7833 - RNA, 762 nt, Artificial Sequence
  derived and/or modified sequence opt4 from CFAD__Homo_sapiens__CCDS12046.1
augcacagcugggagagacuggccgugcuggugcugcugggcgccgccgccugcgccgccccccccagaggcagaauccugggcggcagagaggccgaggcccacgccagacccuacauggccagcgugcagcugaacggcgcccaccugugcggcggcgugcugguggccgagcagugggugcugagcgccgcccacugccuggaggacgccgccgacggcaaggugcaggugcugcugggcgcccacagccugagccagcccgagcccagcaagagacuguacgacgugcugagagccgugccccaccccgacagccagcccgacaccaucgaccacgaccugcugcugcugcagcugagcgagaaggccacccugggccccgccgugagaccccugcccuggcagagaguggacagagacguggcccccggcacccugugcgacguggccggcuggggcaucgugaaccacgccggcagaagacccgacagccugcagcacgugcugcugcccgugcuggacagagccaccugcaacagaagaacccaccacgacggcgccaucaccgagagacugaugugcgccgagagcaacagaagagacagcugcaagggcgacagcggcggcccccuggugugcggcggcgugcuggagggcguggugaccagcggcagcagagugugcggcaacagaaagaagcccggcaucuacaccagaguggccagcuacgccgccuggaucgacagcgugcuggccuga

SEQ ID NO: 7834 - RNA, 762 nt, Artificial Sequence
  derived and/or modified sequence opt5 from CFAD__Homo_sapiens__CCDS12046.1
augcacagcugggagagacuggccgugcucguccugcuuggcgcugccgcgugcgcugcucccccucgggggcgcauccugggaggcagagaagccgaggcccaugcccggccguacauggcuuccguucagcucaacggggcccaccuguguggaggcgugcuuguggcggaacaauggguccugucugccgcucauugccucgaggacgccgcugaugggaaggugcagguucugcugggagcccacagccucucccagcccgaaccuucuaaacgccuguaugacgugcuuagagcggucccccauccugauagccagcccgacaccauugaucacgaccugcuccugcuucaacuguccgagaaggccacacucggcccugcugugcggccgcugcccuggcagcgcguugauagagacguggccccuggcacgcugugugaugucgcuggguggggaaucgugaaucacgccggccggcgccccgacucucuccagcaugugcugcuuccuguccuggauagagcuaccugcaaccggcgcacacaccaugacggggccauuaccgagagacucaugugugcggaaagcaaucggcgcgauuccugcaaaggagacagcggcgggccccugguuuguggaggcgugcuugagggcguggucacaucuggguccagagugugcggaaaccggaagaaaccgggcaucuacaccagaguugccagcuaugcugccuggauugacucugugcuggccuga

SEQ ID NO: 7835 - protein, 1231 aa, Artificial Sequence
  CFAH__Homo_sapiens__P08603
MRLLAKIICLMLWAICVAEDCNELPPRRNTEILTGSWSDQTYPEGTQAIYKCRPGYRSLGNVIMVCRKGEWVALNPLRKCQKRPCGHPGDTPFGTFTLTGGNVFEYGVKAVYTCNEGYQLLGEINYRECDTDGWTNDIPICEVVKCLPVTAPENGKIVSSAMEPDREYHFGQAVRFVCNSGYKIEGDEEMHCSDDGFWSKEKPKCVEISCKSPDVINGSPISQKIIYKENERFQYKCNMGYEYSERGDAVCTESGWRPLPSCEEKSCDNPYIPNGDYSPLRIKHRTGDEITYQCRNGFYPATRGNTAKCTSTGWIPAPRCTLKPCDYPDIKHGGLYHENMRRPYFPVAVGKYYSYYCDEHFETPSGSYWDHIHCTQDGWSPAVPCLRKCYFPYLENGYNQNHGRKFVQGKSIDVACHPGYALPKAQTTVTCMENGWSPTPRCIRVKTCSKSSIDIENGFISESQYTYALKEKAKYQCKLGYVTADGETSGSITCGKDGWSAQPTCIKSCDIPVFMNARTKNDFTWFKLNDTLDYECHDGYESNTGSTTGSIVCGYNGWSDLPICYERECELPKIDVHLVPDRKKDQYKVGEVLKFSCKPGFTIVGPNSVQCYHFGLSPDLPICKEQVQSCGPPPELLNGNVKEKTKEEYGHSEVVEYYCNPRFLMKGPNKIQCVDGEWTTLPVCIVEESTCGDIPELEHGWAQLSSPPYYYGDSVEFNCSESFTMIGHRSITCIHGVWTQLPQCVAIDKLKKCKSSNLIILEEHLKNKKEFDHNSNIRYRCRGKEGWIHTVCINGRWDPEVNCSMAQIQLCPPPPQIPNSHNMTTTLNYRDGEKVSVLCQENYLIQEGEEITCKDGRWQSIPLCVEKIPCSQPPQIEHGTINSSRSSQESYAHGTKLSYTCEGGFRISEENETTCYMGKWSSPPQCEGLPCKSPPEISHGVVAHMSDSYQYGEEVTYKCFEGFGIDGPAIAKCLGEKWSHPPSCIKTDCLSLPSFENAIPMGEKKDVYKAGEQVTYTCATYYKMDGASNVTCINSRWTGRPTCRDTSCVNPPTVQNAYIVSRQMSKYPSGERVRYQCRSPYEMFGDEEVMCLNGNWTEPPQCKDSTGKCGPPPPIDNGDITSFPLSVYAPASSVEYQCQNLYQLEGNKRITCRNGQWSEPPKCLHPCVISREIMENYNIALRWTAKQKLYSRTGESVEFVCKRGYRLSSRSHTLRTTCWDGKLEYPTCAKR

SEQ ID NO: 7836 - RNA, 3696 nt, Artificial Sequence
  CFAH__Homo_sapiens__CCDS1385.1
augagacuucuagcaaagauuauuugccuuauguuaugggcuauuuguguagcagaagauugcaaugaacuuccuccaagaagaaauacagaaauucugacagguuccuggucugaccaaacauauccagaaggcacccaggcuaucuauaaaugccgcccuggauauagaucucuuggaaauguaauaaugguaugcaggaagggagaauggguugcucuuaauccauuaaggaaaugucagaaaaggcccuguggacauccuggagauacuccuuuugguacuuuuacccuuacaggaggaaauguguuugaauaugguguaaaagcuguguauacauguaaugagggguaucaauugcuaggugagauuaauuaccgugaaugugacacagauggauggaccaaugauauuccuauaugugaaguugugaaguguuuaccagugacagcaccagagaauggaaaaauugucaguagugcaauggaaccagaucgggaauaccauuuuggacaagcaguacgguuuguauguaacucaggcuacaagauugaaggagaugaagaaaugcauuguucagacgaugguuuuuggaguaaagagaaaccaaaguguguggaaauuucaugcaaauccccagauguuauaaauggaucuccuauaucucagaagauuauuuauaaggagaaugaacgauuucaauauaaauguaacauggguuaugaauacagugaaagaggagaugcuguaugcacugaaucuggauggcguccguugccuucaugugaagaaaaaucaugugauaauccuuauauuccaaauggugacuacucaccuuuaaggauuaaacacagaacuggagaugaaaucacguaccaguguagaaaugguuuuuauccugcaacccggggaaauacagcaaaaugcacaaguacuggcuggauaccugcuccgagauguaccuugaaaccuugugauuauccagacauuaaacauggaggucuauaucaugagaauaugcguagaccauacuuuccaguagcuguaggaaaauauuacuccuauuacugugaugaacauuuugagacuccgucaggaaguuacugggaucacauucauugcacacaagauggauggucgccagcaguaccaugccucagaaaauguuauuuuccuuauuuggaaaauggauauaaucaaaaucauggaagaaaguuuguacaggguaaaucuauagacguugccugccauccuggcuacgcucuuccaaaagcgcagaccacaguuacauguauggagaauggcuggucuccuacucccagaugcauccgugucaaaacauguuccaaaucaaguauagauauugagaauggguuuauuucugaaucucaguauacauaugccuuaaaagaaaaagcgaaauaucaaugcaaacuaggauauguaacagcagauggugaaacaucaggaucaauuacaugugggaaagauggauggucagcucaacccacgugcauuaaaucuugugauaucccaguauuuaugaaugccagaacuaaaaaugacuucacaugguuuaagcugaaugacacauuggacuaugaaugccaugaugguuaugaaagcaauacuggaagcaccacugguuccauagugugugguuacaaugguuggucugauuuacccauauguuaugaaagagaaugcgaacuuccuaaaauagauguacacuuaguuccugaucgcaagaaagaccaguauaaaguuggagagguguugaaauucuccugcaaaccaggauuuacaauaguuggaccuaauuccguucagugcuaccacuuuggauugucuccugaccucccaauauguaaagagcaaguacaaucaugugguccaccuccugaacuccucaaugggaauguuaaggaaaaaacgaaagaagaauauggacacagugaagugguggaauauuauugcaauccuagauuucuaaugaagggaccuaauaaaauucaauguguugauggagaguggacaacuuuaccaguguguauuguggaggagaguaccuguggagauauaccugaacuugaacauggcugggcccagcuuucuuccccuccuuauuacuauggagauucaguggaauucaauugcucagaaucauuuacaaugauuggacacagaucaauuacguguauucauggaguauggacccaacuuccccaguguguggcaauagauaaacuuaagaagugcaaaucaucaaauuuaauuauacuugaggaacauuuaaaaaacaagaaggaauucgaucauaauucuaacauaagguacagauguagaggaaaagaaggauggauacacacagucugcauaaauggaagaugggauccagaagugaacugcucaauggcacaaauacaauuaugcccaccuccaccucagauucccaauucucacaauaugacaaccacacugaauuaucgggauggagaaaaaguaucuguucuuugccaagaaaauuaucuaauucaggaaggagaagaaauuacaugcaaagauggaagauggcagucaauaccacucuguguugaaaaaauuccauguucacaaccaccucagauagaacacggaaccauuaauucauccaggucuucacaagaaaguuaugcacaugggacuaaauugaguuauacuugugagggugguuucaggauaucugaagaaaaugaaacaacaugcuacaugggaaaauggaguucuccaccucagugugaaggccuuccuuguaaaucuccaccugagauuucucaugguguuguagcucacaugucagacaguuaucaguauggagaagaaguuacguacaaauguuuugaagguuuuggaauugaugggccugcaauugcaaaaugcuuaggagaaaaauggucucacccuccaucaugcauaaaaacagauugucucaguuuaccuagcuuugaaaaugccauacccaugggagagaagaaggauguguauaaggcgggugagcaagugacuuacacuugugcaacauauuacaaaauggauggagccaguaauguaacaugcauuaauagcagauggacaggaaggccaacaugcagagacaccuccugugugaauccgcccacaguacaaaaugcuuauauagugucgagacagaugaguaaauauccaucuggugagagaguacguuaucaauguaggagcccuuaugaaauguuuggggaugaagaagugauguguuuaaauggaaacuggacggaaccaccucaaugcaaagauucuacaggaaaaugugggcccccuccaccuauugacaauggggacauuacuucauucccguugucaguauaugcuccagcuucaucaguugaguaccaaugccagaacuuguaucaacuugaggguaacaagcgaauaacauguagaaauggacaauggucagaaccaccaaaaugcuuacauccguguguaauaucccgagaaauuauggaaaauuauaacauagcauuaagguggacagccaaacagaagcuuuauucgagaacaggugaaucaguugaauuuguguguaaacggggauaucgucuuucaucacguucucacacauugcgaacaacauguugggaugggaaacuggaguauccaacuugugcaaaaagauag

SEQ ID NO: 7837 - RNA, 3696 nt, Artificial Sequence
  derived and/or modified sequence opt1 from CFAH__Homo_sapiens__CCDS1385.1
augcgccugcucgccaagaucaucugccugaugcugugggccaucugcguggcggaggacugcaacgagcuccccccgcggcgcaacaccgagauccugaccggcagcugguccgaccagacguaccccgaggggacccaggccaucuacaagugccggcccggcuaccgcagccuggggaacgucaucauggugugccggaagggcgaguggguggcccucaacccccugcgcaagugccagaagcggccgugcgggcaccccggcgacacccccuucggcaccuucacgcugaccgggggcaacgucuucgaguacggggugaaggccguguacaccugcaacgagggcuaccagcuccugggggagaucaacuaccgcgagugcgacaccgacggcuggacgaacgacauccccaucugcgaggucgugaagugccugccggugaccgcccccgagaacggcaagaucgucuccagcgcgauggagcccgaccgggaguaccacuucgggcaggccgugcgcuucgugugcaacuccggcuacaagaucgagggggacgaggagaugcacugcagcgacgacggcuucugguccaaggagaagcccaagugcgucgagaucagcugcaaguccccggacgugaucaacggcagccccaucucccagaagaucaucuacaaggagaacgagcgguuccaguacaagugcaacaugggguacgaguacagcgagcgcggcgacgccgugugcaccgaguccggguggcggccccuccccagcugcgaggagaaguccugcgacaacccguacauccccaacggcgacuacagcccccugcgcaucaagcaccggaccggggacgagaucacguaccagugccgcaacggcuucuaccccgccacccggggcaacaccgcgaagugcaccuccacgggguggaucccggccccccgcugcacccugaagcccugcgacuaccccgacaucaagcacggcgggcucuaccacgagaacaugcggcgcccguacuuccccgucgccgugggcaaguacuacagcuacuacugcgacgagcacuucgagacccccuccgggagcuacugggaccacauccacugcacccaggacggcuggagccccgccgugccgugccugcggaagugcuacuuccccuaccuggagaacggcuacaaccagaaccacgggcgcaaguucguccagggcaaguccaucgacguggccugccaccccggguacgcgcucccgaaggcccagacgaccgugaccugcauggagaacggcuggagccccaccccccgcugcauccgggucaagacgugcuccaagagcuccaucgacaucgagaacggguucaucagcgagucccaguacaccuacgcccugaaggagaaggccaaguaccagugcaagcugggcuacgugaccgccgacggcgagaccagcggguccaucacgugcggcaaggacggguggagcgcgcagcccaccugcaucaaguccugcgacaucccgguguucaugaacgcccgcaccaagaacgacuucaccugguucaagcucaacgacacgcuggacuacgagugccacgacggcuacgagagcaacaccggcuccaccaccgggagcaucgucugcggcuacaacgggugguccgaccugcccaucugcuacgagcgggagugcgagcuccccaagaucgacgugcaccugguccccgaccgcaagaaggaccaguacaaggugggcgaggugcugaaguucagcugcaagccgggguucacgaucgucggccccaacuccgugcagugcuaccacuucggccucagccccgaccugcccaucugcaaggagcaggugcaguccugcgggccgccccccgagcugcucaacggcaacgucaaggagaagaccaaggaggaguacgggcacagcgaggugguggaguacuacugcaacccccgguuccugaugaagggcccgaacaagauccagugcgucgacggggaguggaccacccugcccgugugcaucguggaggagagcaccugcggcgacauccccgagcucgagcacggcugggcccagcuguccagccccccguacuacuacggggacuccgucgaguucaacugcagcgaguccuucacgaugaucggccaccgcagcaucaccugcauccacgggguguggacccagcugccccagugcguggccaucgacaagcucaagaagugcaaguccagcaaccugaucauccuggaggagcaccucaagaacaagaaggaguucgaccacaacuccaacauccgguaccgcugccggggcaaggagggguggauccacaccgucugcaucaacggccgcugggaccccgaggugaacugcagcauggcccagauccagcugugccccccgcccccccagaucccgaacucccacaacaugacgaccacccugaacuaccgggacggcgagaaggugagcguccucugccaggagaacuaccugauccaggagggggaggagaucaccugcaaggacggccgcuggcaguccaucccccugugcguggagaagauccccugcagccagcccccgcagaucgagcacgggacgaucaacuccagccgguccagccaggagagcuacgcgcacggcaccaagcucuccuacaccugcgaggggggcuuccgcaucagcgaggagaacgagaccacgugcuacaugggcaagugguccagccccccccagugcgaggggcugcccugcaaguccccgcccgagaucagccacggcguggucgcccacauguccgacagcuaccaguacggggaggaggugaccuacaagugcuucgagggcuucggcaucgacgggcccgccaucgccaagugccugggcgagaaguggucccaccccccgagcugcaucaagaccgacugccucucccugcccagcuucgagaacgccauccccaugggggagaagaaggacguguacaaggcgggcgagcaggucaccuacacgugcgccaccuacuacaagauggacggggccuccaacgugaccugcaucaacagccgguggaccggccgccccacgugccgggacaccuccugcgugaacccgcccaccguccagaacgccuacaucgugagccgccagauguccaaguaccccagcggcgagcgggugcgcuaccagugccgcucccccuacgagauguucggggacgaggaggucaugugccugaacggcaacuggaccgagccgccccagugcaaggacagcacggggaagugcggcccccccccgcccaucgacaacggggacaucaccagcuucccccuguccguguacgcgcccgccagcuccguggaguaccagugccagaaccucuaccagcuggagggcaacaagcggaucaccugccgcaacggccaguggagcgagccgcccaagugccugcaccccugcgucaucucccgggagaucauggagaacuacaacaucgcccuccgcuggaccgccaagcagaagcuguacagccggacgggggaguccguggaguucgugugcaagcgcggcuaccggcugagcucccgcagccacacccuccggaccaccugcugggacgggaagcuggaguacccgacgugcgccaagcgcuga

SEQ ID NO: 7838 - RNA, 3696 nt, Artificial Sequence
  derived and/or modified sequence opt2 from CFAH__Homo_sapiens__CCDS1385.1
augcgccuccucgccaagaucaucugccucaugcucugggccaucugcgucgccgaggacugcaacgagcuccccccccgccgcaacaccgagauccucaccggcuccugguccgaccagaccuaccccgagggcacccaggccaucuacaagugccgccccggcuaccgcucccucggcaacgucaucauggucugccgcaagggcgagugggucgcccucaacccccuccgcaagugccagaagcgccccugcggccaccccggcgacacccccuucggcaccuucacccucaccggcggcaacgucuucgaguacggcgucaaggccgucuacaccugcaacgagggcuaccagcuccucggcgagaucaacuaccgcgagugcgacaccgacggcuggaccaacgacauccccaucugcgaggucgucaagugccuccccgucaccgcccccgagaacggcaagaucgucuccuccgccauggagcccgaccgcgaguaccacuucggccaggccguccgcuucgucugcaacuccggcuacaagaucgagggcgacgaggagaugcacugcuccgacgacggcuucugguccaaggagaagcccaagugcgucgagaucuccugcaagucccccgacgucaucaacggcucccccaucucccagaagaucaucuacaaggagaacgagcgcuuccaguacaagugcaacaugggcuacgaguacuccgagcgcggcgacgccgucugcaccgaguccggcuggcgcccccuccccuccugcgaggagaaguccugcgacaaccccuacauccccaacggcgacuacuccccccuccgcaucaagcaccgcaccggcgacgagaucaccuaccagugccgcaacggcuucuaccccgccacccgcggcaacaccgccaagugcaccuccaccggcuggauccccgccccccgcugcacccucaagcccugcgacuaccccgacaucaagcacggcggccucuaccacgagaacaugcgccgccccuacuuccccgucgccgucggcaaguacuacuccuacuacugcgacgagcacuucgagacccccuccggcuccuacugggaccacauccacugcacccaggacggcuggucccccgccguccccugccuccgcaagugcuacuuccccuaccucgagaacggcuacaaccagaaccacggccgcaaguucguccagggcaaguccaucgacgucgccugccaccccggcuacgcccuccccaaggcccagaccaccgucaccugcauggagaacggcuggucccccaccccccgcugcauccgcgucaagaccugcuccaaguccuccaucgacaucgagaacggcuucaucuccgagucccaguacaccuacgcccucaaggagaaggccaaguaccagugcaagcucggcuacgucaccgccgacggcgagaccuccggcuccaucaccugcggcaaggacggcugguccgcccagcccaccugcaucaaguccugcgacauccccgucuucaugaacgcccgcaccaagaacgacuucaccugguucaagcucaacgacacccucgacuacgagugccacgacggcuacgaguccaacaccggcuccaccaccggcuccaucgucugcggcuacaacggcugguccgaccuccccaucugcuacgagcgcgagugcgagcuccccaagaucgacguccaccucguccccgaccgcaagaaggaccaguacaaggucggcgagguccucaaguucuccugcaagcccggcuucaccaucgucggccccaacuccguccagugcuaccacuucggccucucccccgaccuccccaucugcaaggagcagguccaguccugcggccccccccccgagcuccucaacggcaacgucaaggagaagaccaaggaggaguacggccacuccgaggucgucgaguacuacugcaacccccgcuuccucaugaagggccccaacaagauccagugcgucgacggcgaguggaccacccuccccgucugcaucgucgaggaguccaccugcggcgacauccccgagcucgagcacggcugggcccagcucuccuccccccccuacuacuacggcgacuccgucgaguucaacugcuccgaguccuucaccaugaucggccaccgcuccaucaccugcauccacggcgucuggacccagcucccccagugcgucgccaucgacaagcucaagaagugcaaguccuccaaccucaucauccucgaggagcaccucaagaacaagaaggaguucgaccacaacuccaacauccgcuaccgcugccgcggcaaggagggcuggauccacaccgucugcaucaacggccgcugggaccccgaggucaacugcuccauggcccagauccagcucugccccccccccccccagauccccaacucccacaacaugaccaccacccucaacuaccgcgacggcgagaaggucuccguccucugccaggagaacuaccucauccaggagggcgaggagaucaccugcaaggacggccgcuggcaguccaucccccucugcgucgagaagauccccugcucccagcccccccagaucgagcacggcaccaucaacuccucccgcuccucccaggaguccuacgcccacggcaccaagcucuccuacaccugcgagggcggcuuccgcaucuccgaggagaacgagaccaccugcuacaugggcaagugguccucccccccccagugcgagggccuccccugcaaguccccccccgagaucucccacggcgucgucgcccacauguccgacuccuaccaguacggcgaggaggucaccuacaagugcuucgagggcuucggcaucgacggccccgccaucgccaagugccucggcgagaaguggucccacccccccuccugcaucaagaccgacugccucucccuccccuccuucgagaacgccauccccaugggcgagaagaaggacgucuacaaggccggcgagcaggucaccuacaccugcgccaccuacuacaagauggacggcgccuccaacgucaccugcaucaacucccgcuggaccggccgccccaccugccgcgacaccuccugcgucaacccccccaccguccagaacgccuacaucgucucccgccagauguccaaguaccccuccggcgagcgcguccgcuaccagugccgcucccccuacgagauguucggcgacgaggaggucaugugccucaacggcaacuggaccgagcccccccagugcaaggacuccaccggcaagugcggcccccccccccccaucgacaacggcgacaucaccuccuucccccucuccgucuacgcccccgccuccuccgucgaguaccagugccagaaccucuaccagcucgagggcaacaagcgcaucaccugccgcaacggccagugguccgagccccccaagugccuccaccccugcgucaucucccgcgagaucauggagaacuacaacaucgcccuccgcuggaccgccaagcagaagcucuacucccgcaccggcgaguccgucgaguucgucugcaagcgcggcuaccgccucuccucccgcucccacacccuccgcaccaccugcugggacggcaagcucgaguaccccaccugcgccaagcgcuga

SEQ ID NO: 7839 - RNA, 3696 nt, Artificial Sequence
  derived and/or modified sequence opt3 from CFAH__Homo_sapiens__CCDS1385.1
augagacugcucgccaagaucauuugccuuaugcugugggcuauauguguggcagaggacugcaacgaauugcccccuaggcggaauaccgagaucuuaacaggcagcugguccgaucagacuuacccagaagggacgcaagccauuuauaaaugucgcccgggauaccgaucucuggguaacgucaucaugguuugccguaagggcgaguggguggcgcuaaauccccucagaaaaugucagaagaggccuugcgggcacccaggagacacccccuucggcacauuuacucugaccggugggaacguauucgaauauggagugaaagcugucuacacauguaaugagggcuaucagcuucugggcgagauuaacuaccgggaaugcgauaccgacggguggacuaaugauaucccuauaugugaggugguuaagugcuugccagugacagcccccgaaaacggaaagaucgucucaagugcaauggagccugaccgcgaguaucauuuuggucaggccgugagauucguauguaauagcggcuacaaaauugaaggggaugaggaaaugcacugcuccgacgauggauuuuggucuaaggagaaaccaaagugcguugaaaucucguguaaaucaccggacgugauuaacggcagccccaucagucaaaagauaauuuacaaggagaaugagagguuccaguauaaaugcaacauggguuacgaauauuccgagcgcggggaugcugucuguaccgaaucuggauggcggccucucccaagcugcgaggaaaaguccugugacaaucccuacaucccuaacggcgauuauucaccacugcgaauuaaacauagaacgggcgacgagaucacuuaccagugcaggaauggguuuuaucccgcaacccggggaaacacagccaaguguacuuccaccgguuggaucccggcuccucguugcacacugaaacccugugacuacccagauauuaagcacggcgggcucuaccaugagaacaugcgcagaccuuauuuccccguggccgugggaaaauacuauagcuacuauugcgacgaacacuuugagaccccaucuggcuccuacugggaucacauacauuguacgcaggacgguuggucacccgcggucccuugcuuaaggaagugcuauuucccauaccuggaaaauggguacaaccaaaaucacggccggaaguuuguucagggaaaaagcaucgauguggcaugucauccgggcuaugcccuucccaaggcucagacuacaguaaccugcauggagaacggguggaguccuacuccacgauguauucgcgugaaaacaugcucuaaguccagcaucgacauagaaaauggauucauuucggagucucaguacaccuaugccuugaaagagaaggcaaaguaccaauguaaacuggguuaugucacggcugauggcgaaaccuccgggucaaucacaugcggaaaggacggcuggagugcccagcccacuuguaucaaaagcugcgauauuccuguguuuaugaacgcgagaaccaagaaugacuucacaugguucaaacuaaacgauacucucgacuacgagugucacgacgguuaugaauccaauaccgggucuacaaccggcagcaucguuugcggauacaacggcuggucagaucugccaauuuguuacgagagggagugcgaacuucccaagauagacgugcaccuggucccggaucggaagaaagaccaguauaaggugggggagguauugaaauuuaguugcaagccuggauucacuaucguugguccaaauuccgugcaauguuaccauuuuggccucagccccgaucugccuauuugcaaagaacagguccagucuugugggcccccaccugaguuacugaacggaaaugugaaggaaaagacgaaagaggaguauggccacucagaagucguggaguacuauugcaacccccgcuuccucaugaaggguccaaauaaaauccaguguguugacggggaauggacaacccuuccggugugcaucguagaggaaaguacuuguggcgauauuccugagcuggagcauggaugggcccaauugagcagucccccauacuauuacggcgacucugucgaauuuaacugcucggagagcuucaccaugauagggcacagauccaucacauguauucauggaguguggacccagcuaccccagugcguugcaaucgauaagcugaaaaaguguaaaucaaguaaccucauuauccuggaagaacaccuuaagaauaagaaagaauuugaccacaacucuaauauaagguaccguugccggggcaaggaggguuggauccauacugugugcauuaacgggcgaugggauccugaggucaauuguagcauggcucagauccaacugugcccacccccuccgcagauuccaaacucccacaauaugacaacgaccuugaacuauagagacggagaaaaagugucaguacucugucaggagaauuaccugauccaggaaggcgaggagauaacuugcaaggaugguagguggcaaagcauucccuuauguguggagaaaaucccuugcucucagccaccccagauugagcauggcacaaucaacuccagucgcagcucucaggaauccuaugcccacgggaccaagcugucauacacaugugagggaggcuuccggauaagugaagagaaugagacuaccugcuauauggggaaguggagcucgccuccgcaaugugaaggacuacccugcaaauccccaccugagaucucucacggcguugucgcucauaugagcgacucauaccaguauggugaagaggugacguacaaguguuuugaaggguucggaauugacggccccgccaucgcaaaaugccucggugagaaguggagucacccaccuuccugcauuaaaaccgauugucugucucuucccagcuuugagaacgccaucccaaugggcgaaaagaaggacguguacaaagcuggggagcaggucacauauacuugcgcgaccuacuauaagauggauggagcauccaauguuacauguauaaacucaagauggacuggcaggccgaccugccgcgacacgagcugugugaauccucccacagugcaaaacgccuacauuguaagucgacagaugucuaaauauccauccggggaacggguccguuaccagugcagaagccccuaugagauguucggagaugaagaggugauguguuugaacggcaauuggaccgagccuccacagugcaaggacucgacugguaaaugugggcccccuccgccaaucgauaacggagacaucacaucauuuccccugucuguuuacgcuccugccaguuccguggaauaccaaugccagaaucucuaucagcuggagggcaacaagaggauuaccugucgcaauggucaguggagcgaacccccaaagugccuucauccuugcgucaucucucgggagauuauggagaacuacaauauagcacugagauggacugccaaacaaaaguuguauagcaggaccggcgaauccguggaguucguuuguaaacgaggguaccgccucucaagucggagccacacacugagaacgaccugcugggauggaaaguuagaauaucccacuugugcuaaaagguga

SEQ ID NO: 7840 - RNA, 3696 nt, Artificial Sequence
  derived and/or modified sequence opt4 from CFAH__Homo_sapiens__CCDS1385.1
augagacugcuggccaagaucaucugccugaugcugugggccaucugcguggccgaggacugcaacgagcugccccccagaagaaacaccgagauccugaccggcagcuggagcgaccagaccuaccccgagggcacccaggccaucuacaagugcagacccggcuacagaagccugggcaacgugaucauggugugcagaaagggcgaguggguggcccugaacccccugagaaagugccagaagagacccugcggccaccccggcgacacccccuucggcaccuucacccugaccggcggcaacguguucgaguacggcgugaaggccguguacaccugcaacgagggcuaccagcugcugggcgagaucaacuacagagagugcgacaccgacggcuggaccaacgacauccccaucugcgagguggugaagugccugcccgugaccgcccccgagaacggcaagaucgugagcagcgccauggagcccgacagagaguaccacuucggccaggccgugagauucgugugcaacagcggcuacaagaucgagggcgacgaggagaugcacugcagcgacgacggcuucuggagcaaggagaagcccaagugcguggagaucagcugcaagagccccgacgugaucaacggcagccccaucagccagaagaucaucuacaaggagaacgagagauuccaguacaagugcaacaugggcuacgaguacagcgagagaggcgacgccgugugcaccgagagcggcuggagaccccugcccagcugcgaggagaagagcugcgacaaccccuacauccccaacggcgacuacagcccccugagaaucaagcacagaaccggcgacgagaucaccuaccagugcagaaacggcuucuaccccgccaccagaggcaacaccgccaagugcaccagcaccggcuggauccccgcccccagaugcacccugaagcccugcgacuaccccgacaucaagcacggcggccuguaccacgagaacaugagaagacccuacuuccccguggccgugggcaaguacuacagcuacuacugcgacgagcacuucgagacccccagcggcagcuacugggaccacauccacugcacccaggacggcuggagccccgccgugcccugccugagaaagugcuacuuccccuaccuggagaacggcuacaaccagaaccacggcagaaaguucgugcagggcaagagcaucgacguggccugccaccccggcuacgcccugcccaaggcccagaccaccgugaccugcauggagaacggcuggagccccacccccagaugcaucagagugaagaccugcagcaagagcagcaucgacaucgagaacggcuucaucagcgagagccaguacaccuacgcccugaaggagaaggccaaguaccagugcaagcugggcuacgugaccgccgacggcgagaccagcggcagcaucaccugcggcaaggacggcuggagcgcccagcccaccugcaucaagagcugcgacauccccguguucaugaacgccagaaccaagaacgacuucaccugguucaagcugaacgacacccuggacuacgagugccacgacggcuacgagagcaacaccggcagcaccaccggcagcaucgugugcggcuacaacggcuggagcgaccugcccaucugcuacgagagagagugcgagcugcccaagaucgacgugcaccuggugcccgacagaaagaaggaccaguacaaggugggcgaggugcugaaguucagcugcaagcccggcuucaccaucgugggccccaacagcgugcagugcuaccacuucggccugagccccgaccugcccaucugcaaggagcaggugcagagcugcggccccccccccgagcugcugaacggcaacgugaaggagaagaccaaggaggaguacggccacagcgaggugguggaguacuacugcaaccccagauuccugaugaagggccccaacaagauccagugcguggacggcgaguggaccacccugcccgugugcaucguggaggagagcaccugcggcgacauccccgagcuggagcacggcugggcccagcugagcagcccccccuacuacuacggcgacagcguggaguucaacugcagcgagagcuucaccaugaucggccacagaagcaucaccugcauccacggcguguggacccagcugccccagugcguggccaucgacaagcugaagaagugcaagagcagcaaccugaucauccuggaggagcaccugaagaacaagaaggaguucgaccacaacagcaacaucagauacagaugcagaggcaaggagggcuggauccacaccgugugcaucaacggcagaugggaccccgaggugaacugcagcauggcccagauccagcugugccccccccccccccagauccccaacagccacaacaugaccaccacccugaacuacagagacggcgagaaggugagcgugcugugccaggagaacuaccugauccaggagggcgaggagaucaccugcaaggacggcagauggcagagcaucccccugugcguggagaagauccccugcagccagcccccccagaucgagcacggcaccaucaacagcagcagaagcagccaggagagcuacgcccacggcaccaagcugagcuacaccugcgagggcggcuucagaaucagcgaggagaacgagaccaccugcuacaugggcaaguggagcagccccccccagugcgagggccugcccugcaagagcccccccgagaucagccacggcgugguggcccacaugagcgacagcuaccaguacggcgaggaggugaccuacaagugcuucgagggcuucggcaucgacggccccgccaucgccaagugccugggcgagaaguggagccacccccccagcugcaucaagaccgacugccugagccugcccagcuucgagaacgccauccccaugggcgagaagaaggacguguacaaggccggcgagcaggugaccuacaccugcgccaccuacuacaagauggacggcgccagcaacgugaccugcaucaacagcagauggaccggcagacccaccugcagagacaccagcugcgugaacccccccaccgugcagaacgccuacaucgugagcagacagaugagcaaguaccccagcggcgagagagugagauaccagugcagaagccccuacgagauguucggcgacgaggaggugaugugccugaacggcaacuggaccgagcccccccagugcaaggacagcaccggcaagugcggcccccccccccccaucgacaacggcgacaucaccagcuucccccugagcguguacgcccccgccagcagcguggaguaccagugccagaaccuguaccagcuggagggcaacaagagaaucaccugcagaaacggccaguggagcgagccccccaagugccugcaccccugcgugaucagcagagagaucauggagaacuacaacaucgcccugagauggaccgccaagcagaagcuguacagcagaaccggcgagagcguggaguucgugugcaagagaggcuacagacugagcagcagaagccacacccugagaaccaccugcugggacggcaagcuggaguaccccaccugcgccaagagauga

SEQ ID NO: 7841 - RNA, 3696 nt, Artificial Sequence
  derived and/or modified sequence opt5 from CFAH__Homo_sapiens__CCDS1385.1
augagacugcucgccaagaucauuugccugaugcuuugggcuaucuguguggccgaggacugcaacgaacugcccccucggcgcaauaccgagauucucacaggcagcugguccgaucagacguacccggaagggacccaagcgaucuauaaauguagacccggauaccggucucugggcaacgucauuaugguuugccgcaagggggaguggguggcucuuaauccucugagaaaaugucagaagcggcccugcggacacccuggcgacacacccuucgggaccuuuacacucaccggaggcaacguguucgaauauggcgucaaagccguguacacauguaaugagggguaucagcugcugggagagaucaacuaccgcgaaugcgauaccgacggcuggacgaaugauaucccuauuugugagguugugaagugccucccggucaccgcccccgaaaacgggaagaucgugagcuccgcuauggagccugacagagaguaucauuuuggacaggccguucgguucguguguaauucuggcuacaaaauugaaggggaugaggaaaugcacugcagcgacgauggauuuugguccaaggagaaacccaagugcgucgaaaucucuuguaaaagcccugacgugauuaacggcucccccaucagccaaaagauuaucuacaaggagaaugagcgcuuccaguauaaaugcaacaugggcuacgaauauucugagagaggggaugcuguguguacagaauccggauggcggccgcugccuagcugcgaggaaaagucuugugacaaucccuacaucccuaacggcgauuauagcccccuucgcauuaaacauagaaccggggacgagaucacauaccagugccggaauggauuuuaucccgccacccgcggcaacacggcgaaguguacauccaccggguggauuccugccccgagaugcacacugaaacccugugacuacccugauaucaagcacggaggccucuaccaugagaacaugcggagacccuauuucccugucgcuguuggcaaauacuauucuuacuauugcgacgaacacuuugagacccccuccgggagcuacugggaucacauucauuguacccaggacggaugguccccggccgugccuugccugcgcaagugcuauuuccccuaccuugaaaauggcuacaaccaaaaucacgggcggaaguuugugcagggaaaaucuaucgaugucgcuugucauccuggcuaugcccugcccaaggcgcagacaacggugaccugcauggagaacggguggagcccuacacccagauguauccgcguuaaaaccugcuccaagagcucuauugacaucgaaaauggcuucauuuccgagagccaguacacauaugcccucaaagagaaggcuaaguaccaauguaaacugggauaugugaccgccgauggcgaaacgucugggagcaucacaugcggaaaggacggcugguccgcucagccgaccuguauuaaaucuugcgauaucccugucuuuaugaacgcccggaccaagaaugacuucacaugguucaaacugaacgauacccucgacuacgagugucacgacggguaugaaagcaauacaggauccacgaccggcagcaucgugugcggguacaacggcuggucugaucugcccauuuguuacgagagagagugcgaacuucccaagaucgacguucaccuggugccugaucgcaagaaagaccaguauaaggucggagaggugcucaaauuuuccugcaagccgggcuucacaauugucgggcccaauagcgugcaauguuaccauuuuggacugucuccugaucuucccaucugcaaagaacagguucaguccuguggcccucccccugagcugcucaacgggaaugugaaggaaaagaccaaagaggaguauggacacagcgaagucguggaguacuauugcaacccccgguuccugaugaagggcccgaauaaaauucaguguguugacggggaauggacaacccugccugugugcaucgucgaggaauccacguguggcgauauucccgagcucgagcauggaugggcccaacugucuagcccucccuacuauuacggcgacuccguggaauuuaacugcucugagagcuucaccaugaucgggcacagauccaucacauguauucauggaguguggacccagcuuccgcagugcguugcuaucgauaagcugaaaaaguguaaaagcucuaaccucauuauccuggaggagcaccuuaagaauaagaaagaauuugaccacaacuccaauauucgcuaccggugcagaggcaaggagggguggauccauacagucugcaucaacggacgcugggauccugaggugaauuguagcauggcgcagauucaacugugucccccuccuccccagauccccaacucucacaauaugaccacgacacucaacuaucgggacggcgaaaaaguguccguccugugccaggagaauuaccugauucaggaaggggaggagauuaccugcaaggauggcagauggcaaagcaucccgcucuguguggagaaaauccccugcucucagccuccccagaucgaacauggaacaauuaacagcucccggagcucucaggaauccuaugcccacggcaccaagcugagcuacaccugugaagggggauuccgcaucuccgaagagaaugagacaacgugcuauaugggcaaguggucuagcccuccccaaugugaagggcuuccuugcaaauccccgcccgagauuucucacggaguuguggcucauaugagcgacuccuaccaguauggcgaagaggucaccuacaaguguuuugaaggcuucgggaucgacggaccugccauugccaaaugccugggcgagaaguggucucaucccccuagcugcaucaaaacagauugucucucccugcccagcuuugagaacgcuaucccgaugggggaaaagaaggacguguacaaagccggagagcagguuaccuauacaugcgcgaccuacuauaagauggauggcgcuucuaaugugacguguauuaacuccagauggacagggcggccuaccugcagagacaccagcugugucaauccucccacagugcaaaacgccuacaucguuucucgccagauguccaaauaucccagcggagaacgggugagauaccagugccgcucucccuaugagauguucggcgaugaagaggucaugugucugaacggcaauuggaccgagccuccgcagugcaaggacuccacagggaaauguggacccccucccccuauugauaacggcgacaucacgagcuuuccccuuuccguguacgccccggcuagcucuguggaauaccaaugccagaaucucuaucagcuggaggggaacaagagaauuaccugucggaauggacaguggagcgaaccucccaagugccugcacccuugcgucaucucccgcgagauuauggagaacuacaauaucgcccucagauggacagcuaaacaaaagcuguauucucggaccggcgaaagcguugaguucguguguaaacgcggguacagacuuuccucucggagccacacacugcgcaccacgugcugggauggaaagcucgaauaucccaccugugccaaaagauga

SEQ ID NO: 7842 - protein, 583 aa, Artificial Sequence
  CFAI__Homo_sapiens__P05156
MKLLHVFLLFLCFHLRFCKVTYTSQEDLVEKKCLAKKYTHLSCDKVFCQPWQRCIEGTCVCKLPYQCPKNGTAVCATNRRSFPTYCQQKSLECLHPGTKFLNNGTCTAEGKFSVSLKHGNTDSEGIVEVKLVDQDKTMFICKSSWSMREANVACLDLGFQQGADTQRRFKLSDLSINSTECLHVHCRGLETSLAECTFTKRRTMGYQDFADVVCYTQKADSPMDDFFQCVNGKYISQMKACDGINDCGDQSDELCCKACQGKGFHCKSGVCIPSQYQCNGEVDCITGEDEVGCAGFASVTQEETEILTADMDAERRRIKSLLPKLSCGVKNRMHIRRKRIVGGKRAQLGDLPWQVAIKDASGITCGGIYIGGCWILTAAHCLRASKTHRYQIWTTVVDWIHPDLKRIVIEYVDRIIFHENYNAGTYQNDIALIEMKKDGNKKDCELPRSIPACVPWSPYLFQPNDTCIVSGWGREKDNERVFSLQWGEVKLISNCSKFYGNRFYEKEMECAGTYDGSIDACKGDSGGPLVCMDANNVTYVWGVVSWGENCGKPEFPGVYTKVANYFDWISYHVGRPFISQYNV

SEQ ID NO: 7843 - RNA, 1752 nt, Artificial Sequence
  CFAI__Homo_sapiens__CCDS34049.1
augaagcuucuucauguuuuccuguuauuucugugcuuccacuuaagguuuugcaaggucacuuauacaucucaagaggaucugguggagaaaaagugcuuagcaaaaaaauauacucaccucuccugcgauaaagucuucugccagccauggcagagaugcauugagggcaccuguguuuguaaacuaccguaucagugcccaaagaauggcacugcagugugugcaacuaacaggagaagcuucccaacauacugucaacaaaagaguuuggaaugucuucauccagggacaaaguuuuuaaauaacggaacaugcacagccgaaggaaaguuuaguguuuccuugaagcauggaaauacagauucagagggaauaguugaaguaaaacuuguggaccaagauaagacaauguucauaugcaaaagcagcuggagcaugagggaagccaacguggccugccuugaccuuggguuucaacaaggugcugauacucaaagaagguuuaaguugucugaucucucuauaaauuccacugaaugucuacaugugcauugccgaggauuagagaccaguuuggcugaauguacuuuuacuaagagaagaacuauggguuaccaggauuucgcugaugugguuuguuauacacagaaagcagauucuccaauggaugacuucuuucagugugugaaugggaaauacauuucucagaugaaagccugugaugguaucaaugauuguggagaccaaagugaugaacuguguuguaaagcaugccaaggcaaaggcuuccauugcaaaucggguguuugcauuccaagccaguaucaaugcaauggugagguggacugcauuacaggggaagaugaaguuggcugugcaggcuuugcaucugugacucaagaagaaacagaaauuuugacugcugacauggaugcagaaagaagacggauaaaaucauuauuaccuaaacuaucuuguggaguuaaaaacagaaugcacauucgaaggaaacgaauugugggaggaaagcgagcacaacugggagaccucccauggcagguggcaauuaaggaugccaguggaaucaccugugggggaauuuauauugguggcuguuggauucugacugcugcacauugucucagagccaguaaaacucaucguuaccaaauauggacaacaguaguagacuggauacaccccgaccuuaaacguauaguaauugaauacguggauagaauuauuuuccaugaaaacuacaaugcaggcacuuaccaaaaugacaucgcuuugauugaaaugaaaaaagacggaaacaaaaaagauugugagcugccucguuccaucccugccuguguccccuggucuccuuaccuauuccaaccuaaugauacaugcaucguuucuggcuggggacgagaaaaagauaacgaaagagucuuuucacuucaguggggugaaguuaaacuaauaagcaacugcucuaaguuuuacggaaaucguuucuaugaaaaagaaauggaaugugcagguacauaugaugguuccaucgaugccuguaaaggggacucuggaggccccuuagucuguauggaugccaacaaugugacuuaugucugggguguugugaguuggggggaaaacuguggaaaaccagaguucccagguguuuacaccaaaguggccaauuauuuugacuggauuagcuaccauguaggaaggccuuuuauuucucaguacaauguauaa

SEQ ID NO: 7844 - RNA, 1752 nt, Artificial Sequence
  derived and/or modified sequence opt1 from CFAI__Homo_sapiens__CCDS34049.1
augaagcugcuccacguguuccugcuguuccucugcuuccaccuccgcuucugcaaggucaccuacaccagccaggaggaccugguggagaagaagugccuggccaagaaguacacgcaccuguccugcgacaagguguucugccagcccuggcagcggugcaucgaggggaccugcgucugcaagcugccguaccagugccccaagaacgggaccgccgugugcgcgaccaaccgccggagcuuccccacguacugccagcagaagucccucgagugccugcaccccggcaccaaguuccugaacaacgggaccugcaccgccgagggcaaguucagcgugucccucaagcacgggaacacggacagcgagggcaucgucgaggugaagcugguggaccaggacaagaccauguucaucugcaaguccagcugguccaugcgcgaggccaacgucgccugccuggaccucggcuuccagcagggggccgacacccagcggcgcuucaagcugagcgaccuguccaucaacagcaccgagugccuccacgugcacugccggggccuggagacgucccuggcggagugcaccuucaccaagcgccggaccaugggguaccaggacuucgccgacguggucugcuacacgcagaaggccgacagcccgauggacgacuucuuccagugcgugaacggcaaguacaucucccagaugaaggccugcgacgggaucaacgacugcggcgaccagagcgacgagcucugcugcaaggcgugccagggcaagggguuccacugcaaguccggcgugugcauccccagccaguaccagugcaacggggaggucgacugcaucaccggcgaggacgaggugggcugcgccggguucgccuccgugacccaggaggagaccgagauccugacggccgacauggacgccgagcgccggcgcaucaagagccugcuccccaagcugagcugcggcgucaagaaccggaugcacauccgccggaagcgcaucgucgggggcaagcgggcgcagcugggggaccuccccuggcaggucgccaucaaggacgccuccggcaucacgugcggcgggaucuacaucggcgggugcuggauccugaccgccgcccacugccugcgcgcgagcaagacccaccgguaccagaucuggaccaccgugguggacuggauccacccggaccucaagcgcaucgugaucgaguacguggaccggaucaucuuccacgagaacuacaacgccggcaccuaccagaacgacaucgcccugaucgagaugaagaaggacgggaacaagaaggacugcgagcugccccgcuccauccccgccugcgugcccuggagcccguaccucuuccagcccaacgacacgugcaucgucuccggcuggggccgcgagaaggacaacgagcggguguucagccugcaguggggcgaggugaagcugaucuccaacugcagcaaguucuacggcaaccgcuucuacgagaaggagauggagugcgccgggaccuacgacggcuccaucgacgcgugcaagggggacagcggcggcccccucgucugcauggacgccaacaacgugaccuacguguggggcgucguguccuggggcgagaacugcgggaagcccgaguucccggggguguacaccaaggucgccaacuacuucgacuggaucagcuaccacgugggccggcccuucaucucccaguacaacguguga

SEQ ID NO: 7845 - RNA, 1752 nt, Artificial Sequence
  derived and/or modified sequence opt2 from CFAI__Homo_sapiens__CCDS34049.1
augaagcuccuccacgucuuccuccucuuccucugcuuccaccuccgcuucugcaaggucaccuacaccucccaggaggaccucgucgagaagaagugccucgccaagaaguacacccaccucuccugcgacaaggucuucugccagcccuggcagcgcugcaucgagggcaccugcgucugcaagcuccccuaccagugccccaagaacggcaccgccgucugcgccaccaaccgccgcuccuuccccaccuacugccagcagaagucccucgagugccuccaccccggcaccaaguuccucaacaacggcaccugcaccgccgagggcaaguucuccgucucccucaagcacggcaacaccgacuccgagggcaucgucgaggucaagcucgucgaccaggacaagaccauguucaucugcaaguccuccugguccaugcgcgaggccaacgucgccugccucgaccucggcuuccagcagggcgccgacacccagcgccgcuucaagcucuccgaccucuccaucaacuccaccgagugccuccacguccacugccgcggccucgagaccucccucgccgagugcaccuucaccaagcgccgcaccaugggcuaccaggacuucgccgacgucgucugcuacacccagaaggccgacucccccauggacgacuucuuccagugcgucaacggcaaguacaucucccagaugaaggccugcgacggcaucaacgacugcggcgaccaguccgacgagcucugcugcaaggccugccagggcaagggcuuccacugcaaguccggcgucugcauccccucccaguaccagugcaacggcgaggucgacugcaucaccggcgaggacgaggucggcugcgccggcuucgccuccgucacccaggaggagaccgagauccucaccgccgacauggacgccgagcgccgccgcaucaagucccuccuccccaagcucuccugcggcgucaagaaccgcaugcacauccgccgcaagcgcaucgucggcggcaagcgcgcccagcucggcgaccuccccuggcaggucgccaucaaggacgccuccggcaucaccugcggcggcaucuacaucggcggcugcuggauccucaccgccgcccacugccuccgcgccuccaagacccaccgcuaccagaucuggaccaccgucgucgacuggauccaccccgaccucaagcgcaucgucaucgaguacgucgaccgcaucaucuuccacgagaacuacaacgccggcaccuaccagaacgacaucgcccucaucgagaugaagaaggacggcaacaagaaggacugcgagcucccccgcuccauccccgccugcguccccuggucccccuaccucuuccagcccaacgacaccugcaucgucuccggcuggggccgcgagaaggacaacgagcgcgucuucucccuccaguggggcgaggucaagcucaucuccaacugcuccaaguucuacggcaaccgcuucuacgagaaggagauggagugcgccggcaccuacgacggcuccaucgacgccugcaagggcgacuccggcggcccccucgucugcauggacgccaacaacgucaccuacgucuggggcgucgucuccuggggcgagaacugcggcaagcccgaguuccccggcgucuacaccaaggucgccaacuacuucgacuggaucuccuaccacgucggccgccccuucaucucccaguacaacgucuga

SEQ ID NO: 7846 - RNA, 1752 nt, Artificial Sequence
  derived and/or modified sequence opt3 from CFAI__Homo_sapiens__CCDS34049.1
augaagcugcuccacguguuccuucuguuuuugugcuuccauuuaagauuuuguaaagucaccuacacaagccaggaggaccugguugaaaagaaaugccuagccaagaaauauacucaccucuccugugauaagguguucugccaacccuggcagagguguaucgagggcacgugcguauguaagcugccuuaccagugcccgaaaaacgggaccgcugugugugcaacaaaucggcgcucuuuuccaacuuauugccagcaaaagucacuugaaugucugcaucccggaaccaaauucuugaacaaugguacaugcaccgccgagggcaaguuuagugucagccucaaacacgggaacacugacuccgaaggaauuguggagguuaagcugguggaucaggacaagacaauguucauaugcaaaucuucguggucaaugcgagaggcgaaugucgcuugucuggaucucggcuuucagcagggugccgacacccaacguagauucaaguuaagcgaucugaguaucaacuccacggaaugccuucaugugcacuguaggggguuggagacuucucuggcagaaugcaccuuuacaaaacggcgcacuaugggauaccaggacuucgccgauguaguuuguuauacccagaaggcugacagcccuauggaugacuuuuuccagugcgugaauggcaaauacauuucccaaaugaaggcaugugauggcaucaacgacugcggggaccagucagaugagcuauguugcaaagccugucagggaaaggguuuccacugcaagaguggcgucugcauuccaagccaauaucaguguaauggggagguggacugcaucacaggagaagaugaggugggcugugcugguuuugccucugucacccaggaagagacggaaauacucacugcggacauggaugcagagagaaggcggaucaaaucccugcuucccaagcugucaugcgggguuaaaaaccgcaugcauauucgaagaaagaggaucgugggaggcaaacgggcccaguugggcgaccucccuuggcaaguagcuauuaaggaugccagcgggaucacauguggagguauauacauuggcgggugcuggauccugaccgcagcucacuguuuacgugccaguaagacucaucgcuaccagauuuggacaaccguggucgacuggauccacccagaucugaaaagaaucgugauugaguauguugacaggauaaucuuccacgaaaauuacaacgcgggaacguaucagaaugauauugcccucaucgagaugaagaaagacggcaacaagaaagacugcgaacuuccccggucuauaccugcaugugugccaugguccccguaccuguuucagcccaaugauaccugcauugucagcgguugggggcgagagaaggacaacgaacgcguguucucguugcaauggggcgagguaaagcuaaucucuaacuguuccaaauuuuauggaaauagauucuacgagaaggaaauggagugcgcuggcacauaugaugggucaaucgacgccugcaaaggagauagugguggcccucugguuuguauggacgcuaacaaugugacuuacgucuggggaguggucagcuggggcgaaaacugcgggaagccagaguuucccgguguguacaccaaaguugccaauuauuucgauuggauuuccuaccauguggggaggccuuuuaucucucaguauaacguauga

SEQ ID NO: 7847 - RNA, 1752 nt, Artificial Sequence
  derived and/or modified sequence opt4 from CFAI__Homo_sapiens__CCDS34049.1
augaagcugcugcacguguuccugcuguuccugugcuuccaccugagauucugcaaggugaccuacaccagccaggaggaccugguggagaagaagugccuggccaagaaguacacccaccugagcugcgacaagguguucugccagcccuggcagagaugcaucgagggcaccugcgugugcaagcugcccuaccagugccccaagaacggcaccgccgugugcgccaccaacagaagaagcuuccccaccuacugccagcagaagagccuggagugccugcaccccggcaccaaguuccugaacaacggcaccugcaccgccgagggcaaguucagcgugagccugaagcacggcaacaccgacagcgagggcaucguggaggugaagcugguggaccaggacaagaccauguucaucugcaagagcagcuggagcaugagagaggccaacguggccugccuggaccugggcuuccagcagggcgccgacacccagagaagauucaagcugagcgaccugagcaucaacagcaccgagugccugcacgugcacugcagaggccuggagaccagccuggccgagugcaccuucaccaagagaagaaccaugggcuaccaggacuucgccgacguggugugcuacacccagaaggccgacagccccauggacgacuucuuccagugcgugaacggcaaguacaucagccagaugaaggccugcgacggcaucaacgacugcggcgaccagagcgacgagcugugcugcaaggccugccagggcaagggcuuccacugcaagagcggcgugugcauccccagccaguaccagugcaacggcgagguggacugcaucaccggcgaggacgaggugggcugcgccggcuucgccagcgugacccaggaggagaccgagauccugaccgccgacauggacgccgagagaagaagaaucaagagccugcugcccaagcugagcugcggcgugaagaacagaaugcacaucagaagaaagagaaucgugggcggcaagagagcccagcugggcgaccugcccuggcagguggccaucaaggacgccagcggcaucaccugcggcggcaucuacaucggcggcugcuggauccugaccgccgcccacugccugagagccagcaagacccacagauaccagaucuggaccaccgugguggacuggauccaccccgaccugaagagaaucgugaucgaguacguggacagaaucaucuuccacgagaacuacaacgccggcaccuaccagaacgacaucgcccugaucgagaugaagaaggacggcaacaagaaggacugcgagcugcccagaagcauccccgccugcgugcccuggagccccuaccuguuccagcccaacgacaccugcaucgugagcggcuggggcagagagaaggacaacgagagaguguucagccugcaguggggcgaggugaagcugaucagcaacugcagcaaguucuacggcaacagauucuacgagaaggagauggagugcgccggcaccuacgacggcagcaucgacgccugcaagggcgacagcggcggcccccuggugugcauggacgccaacaacgugaccuacguguggggcguggugagcuggggcgagaacugcggcaagcccgaguuccccggcguguacaccaagguggccaacuacuucgacuggaucagcuaccacgugggcagacccuucaucagccaguacaacguguga

SEQ ID NO: 7848 - RNA, 1752 nt, Artificial Sequence
  derived and/or modified sequence opt5 from CFAI__Homo_sapiens__CCDS34049.1
augaagcugcuccacguguuccugcuuuuucugugcuuccaucucagauuuuguaaagucaccuacacaagccaggaggaccugguugaaaagaaaugccuugccaagaaauauacgcaccuguccugugauaagguguucugccaacccuggcagcgguguaucgaggggaccugcguguguaagcucccuuaccagugcccgaaaaacgggacagcugucugugccaccaaucgcagaucuuuucccacauauugccagcaaaagagccuggaaugucugcauccuggaaccaaauuccucaacaauggcacaugcaccgcggaggggaaguuuuccgugucucugaaacacggaaacacggacagcgaaggcauuguugaggugaaacuugucgaucaggacaagaccauguucaucugcaaguccucuuggagcaugcgggaggcuaauguggccugucuggaucucggguuucagcagggagccgacacacaacgcagauucaagcuguccgaucuuagcauuaacucuaccgaaugccugcauguucacugucggggccucgagacaucccuggcugaaugcaccuuuacgaaacgcagaacaaugggcuaccaggacuucgccgauguggucuguuauacccagaaggcugacagccccauggaugacuuuuuccagugcgugaaugggaaauacaucucucaaaugaaggccugugauggaauuaacgacugcggcgaccaguccgaugagcuguguugcaaagcgugucaggggaagggauuccacugcaagagcggcgugugcaucccuucucaauaucaguguaauggggaggucgacugcaucacaggagaagaugagguuggcugugccggcuuugcuuccgugacccaggaagagaccgaaauucucacagccgacauggaugcugagcggcgcagaaucaaaagccugcuucccaagcuguccugcggggugaaaaaccggaugcauauucgcagaaagcggaucgucggaggcaaacgcgcccagcucggggaccugccuuggcaaguggcgauuaaggaugccucuggaaucacguguggcgggauuuacaucggaggcugcuggauccuuaccgcugcccacugucugagagcuagcaagacacaucgguaccagauuuggaccacaguuguggacuggauccacccggaucucaaaagaauugucaucgaguauguggaccgcauuaucuuccacgaaaauuacaacgccggcaccuaucagaaugauaucgcccugauugagaugaagaaagacgggaacaagaaagacugcgaacugccccgguccaucccugcuuguguucccuggagcccuuaccucuuucagcccaaugauacgugcauugugucuggauggggcagagagaaggacaacgaacgcgucuucucccugcaauggggcgaggugaaacuuaucagcaacuguucuaaguuuuauggaaaucgguucuacgagaaggaaauggagugcgcgggcacauaugaugggagcauugacgccugcaaaggcgauuccggaggcccgcuggucuguauggacgcuaacaaugugaccuacguuuggggaguggucucuuggggcgaaaacugcgggaagccugaguuucccgggguguacaccaaaguugccaauuauuucgauuggaucagcuaccaugugggaagaccuuuuaucucccaguauaacgucuga

SEQ ID NO: 7849 - protein, 573 aa, Artificial Sequence; identical to SEQ ID NO: 7657
  CH60__Homo_sapiens__NP_002147.2

SEQ ID NO: 7850 - RNA, 1722 nt, Artificial Sequence; identical to SEQ ID NO: 7658
  CH60__Homo_sapiens__NM_002156.4

SEQ ID NO: 7851 - RNA, 1722 nt, Artificial Sequence; identical to SEQ ID NO: 7659
  derived and/or modified sequence opt1 from CH60__Homo_sapiens__NM_002156.4

SEQ ID NO: 7852 - RNA, 1722 nt, Artificial Sequence; identical to SEQ ID NO: 7660
  derived and/or modified sequence opt2 from CH60__Homo_sapiens__NM_002156.4

SEQ ID NO: 7853 - RNA, 1722 nt, Artificial Sequence; identical to SEQ ID NO: 7661
  derived and/or modified sequence opt3 from CH60__Homo_sapiens__NM_002156.4

SEQ ID NO: 7854 - RNA, 1722 nt, Artificial Sequence; identical to SEQ ID NO: 7662
  derived and/or modified sequence opt4 from CH60__Homo_sapiens__NM_002156.4

SEQ ID NO: 7855 - RNA, 1722 nt, Artificial Sequence; identical to SEQ ID NO: 7663
  derived and/or modified sequence opt5 from CH60__Homo_sapiens__NM_002156.4

SEQ ID NO: 7856 - protein, 353 aa, Artificial Sequence
  CIITA__Homo_sapiens__Q29704
MRCLAPRPAGSYLSEPQGSSQCATMELGPLEGGYLELLNSDADPLCLYHFYDQMDLAGEEEIELYSEPDTDTINCDQFSRLLCDMEGDEETREAYANIAELDQYVFQDSQLEGLSKDIFKHIGPDEVIGESMEMPAEVGQKSQKRPFPEELPADLKHWKPAEPPTVVTGSLLVGPVSDCSTLPCLPLPALFNQEPASGQMRLEKTDQIPMPFSSSSLSCLNLPEGPIQFVPTISTLPHGLWQISEAGTGVSSIFIYHGEVPQASQVPPPSGFTVHGLPTSPDRPGSTSPFAPSATDLPSMPEPALTSRANMTEHKTSPTQCPAAGEVSNKLPKWPGREVPRKTQLGSSLLFGT

SEQ ID NO: 7857 - RNA, 1062 nt, Artificial Sequence
  CIITA__Homo_sapiens__AAA92364
augcguugccuggcuccacgcccugcuggguccuaccugucagagccccaaggcagcucacagugugccaccauggaguuggggccccuagaagguggcuaccuggagcuucuuaacagcgaugcugacccccugugccucuaccacuucuaugaccagauggaccuggcuggagaagaagagauugagcucuacucagaacccgacacagacaccaucaacugcgaccaguucagcaggcuguugugugacauggaaggugaugaagagaccagggaggcuuaugccaauaucgcggaacuggaccaguaugucuuccaggacucccagcuggagggccugagcaaggacauuuucaagcacauaggaccagaugaagugaucggugagaguauggagaugccagcagaaguugggcagaaaagucagaaaagacccuucccagaggagcuuccggcagaccugaagcacuggaagccagcugagccccccacuguggugacuggcagucuccuagugggaccagugagcgacugcuccacccugcccugccugccacugccugcgcuguucaaccaggagccagccuccggccagaugcgccuggagaaaaccgaccagauucccaugccuuucuccaguuccucguugagcugccugaaucucccugagggacccauccaguuuguccccaccaucuccacucugccccaugggcucuggcaaaucucugaggcuggaacaggggucuccaguauauucaucuaccauggugaggugccccaggccagccaaguacccccucccaguggauucacuguccacggccucccaacaucuccagaccggccaggcuccaccagccccuucgcuccaucagccacugaccugcccagcaugccugaaccugcccugaccucccgagcaaacaugacagagcacaagacgucccccacccaaugcccggcagcuggagaggucuccaacaagcuuccaaaauggccuggacgagaaguuccucggaagacacagcuggggagcucccugcuguucgggaccuaa

SEQ ID NO: 7858 - RNA, 1062 nt, Artificial Sequence
  derived and/or modified sequence opt1 from CIITA__Homo_sapiens__AAA92364
augcgcugccuggcgccccggccggccggcagcuaccucuccgagccccaggggagcucccagugcgccaccauggagcugggcccccuggagggcggguaccucgagcugcugaacagcgacgccgacccccucugccuguaccacuucuacgaccagauggaccuggccggggaggaggagaucgagcucuacuccgagccggacaccgacacgaucaacugcgaccaguucagccgccugcugugcgacauggagggcgacgaggagacccgggaggccuacgccaacaucgcggagcucgaccaguacguguuccaggacucccagcuggagggccugagcaaggacaucuucaagcacaucgggcccgacgaggucaucggcgaguccauggagaugcccgccgagguggggcagaagucccagaagcgccccuucccggaggagcuccccgccgaccugaagcacuggaagcccgccgagcccccgaccguggucaccggcagccugcucguggggcccgugagcgacugcuccacgcugcccugccugccccucccggcgcuguucaaccaggagcccgccagcggccagaugcggcuggagaagaccgaccagauccccaugcccuucuccagcuccagccucuccugccugaaccugccggagggccccauccaguucguccccaccaucagcacccucccccacgggcuguggcagaucagcgaggccggcacggggguguccagcaucuucaucuaccacggcgaggugccgcaggccucccaggucccgccgcccagcggcuucaccgugcacgggcugcccaccucccccgaccgccccggcagcaccucccccuucgcccccagcgcgacggaccuccccuccaugcccgagccggcccugaccagccgggccaacaugaccgagcacaagaccucccccacgcagugccccgccgccggggaggugagcaacaagcugcccaaguggccgggccgcgaggucccccggaagacccagcucggguccagccugcuguucggcaccuga

SEQ ID NO: 7859 - RNA, 1062 nt, Artificial Sequence
  derived and/or modified sequence opt2 from CIITA__Homo_sapiens__AAA92364
augcgcugccucgccccccgccccgccggcuccuaccucuccgagccccagggcuccucccagugcgccaccauggagcucggcccccucgagggcggcuaccucgagcuccucaacuccgacgccgacccccucugccucuaccacuucuacgaccagauggaccucgccggcgaggaggagaucgagcucuacuccgagcccgacaccgacaccaucaacugcgaccaguucucccgccuccucugcgacauggagggcgacgaggagacccgcgaggccuacgccaacaucgccgagcucgaccaguacgucuuccaggacucccagcucgagggccucuccaaggacaucuucaagcacaucggccccgacgaggucaucggcgaguccauggagaugcccgccgaggucggccagaagucccagaagcgccccuuccccgaggagcuccccgccgaccucaagcacuggaagcccgccgagccccccaccgucgucaccggcucccuccucgucggccccgucuccgacugcuccacccuccccugccucccccuccccgcccucuucaaccaggagcccgccuccggccagaugcgccucgagaagaccgaccagauccccaugcccuucuccuccuccucccucuccugccucaaccuccccgagggccccauccaguucguccccaccaucuccacccucccccacggccucuggcagaucuccgaggccggcaccggcgucuccuccaucuucaucuaccacggcgaggucccccaggccucccagguccccccccccuccggcuucaccguccacggccuccccaccucccccgaccgccccggcuccaccucccccuucgcccccuccgccaccgaccuccccuccaugcccgagcccgcccucaccucccgcgccaacaugaccgagcacaagaccucccccacccagugccccgccgccggcgaggucuccaacaagcuccccaaguggcccggccgcgaggucccccgcaagacccagcucggcuccucccuccucuucggcaccuga

SEQ ID NO: 7860 - RNA, 1062 nt, Artificial Sequence
  derived and/or modified sequence opt3 from CIITA__Homo_sapiens__AAA92364
augagaugccuggcccccaggccugcuggcagcuaccucuccgagccacaggggucuucacaaugugcaaccauggaacuuggaccgcuggaggguggcuauuuggaauuacugaacagugacgccgauccccuaugccucuaccacuucuaugaccagauggaucuggcgggggaggaagagaucgagcuuuacagcgaaccugacacagauacuauuaauugugaccaguuuucccggcuguugugcgauauggagggagacgaagagacgcgcgaggcuuaugccaacauagcagaacucgaucaguacguguuccaagacucucagcuggagggccugucgaaggauaucuuuaaacauauugguccagacgaagucaucggggagucaauggaaaugcccgccgagguuggacaaaagagccagaaacgaccuuucccagaggaacuccccgcugauuuaaagcacuggaaaccugcagagccaccgaccgugguaacaggcagucugcuugugggccccgucuccgacuguucuacuuugccuugccugccacuacccgcccucuuuaaucaggaaccugcuagcgggcagaugcgucuggagaagaccgaccagauuccaaugcccuucuccucaaguagccuuucuugucugaacuugccggaaggaccuauccaguuugugcccacaauauccacccucccacauggucuguggcaaaucucagaggccggcacugggguuagcaguauuuucaucuaucacggagaggugccucaggcgucucaggugcccccacccuccggcuuuacaguccaugguuuaccuaccagcccagauagaccggggucgacgucucccuucgcaccuuccgccacugaccugccaucaaugcccgaaccugcucucaccaguagggccaauaugacagagcacaagacuagcccaacccaaugccccgcagcuggagaaguauccaacaaacuuccgaaguggccuggccgggagguuccacgcaaaacacagcugggcucuagcuugcuauuugggaccuga

SEQ ID NO: 7861 - RNA, 1062 nt, Artificial Sequence
  derived and/or modified sequence opt4 from CIITA__Homo_sapiens__AAA92364
augagaugccuggcccccagacccgccggcagcuaccugagcgagccccagggcagcagccagugcgccaccauggagcugggcccccuggagggcggcuaccuggagcugcugaacagcgacgccgacccccugugccuguaccacuucuacgaccagauggaccuggccggcgaggaggagaucgagcuguacagcgagcccgacaccgacaccaucaacugcgaccaguucagcagacugcugugcgacauggagggcgacgaggagaccagagaggccuacgccaacaucgccgagcuggaccaguacguguuccaggacagccagcuggagggccugagcaaggacaucuucaagcacaucggccccgacgaggugaucggcgagagcauggagaugcccgccgaggugggccagaagagccagaagagacccuuccccgaggagcugcccgccgaccugaagcacuggaagcccgccgagccccccaccguggugaccggcagccugcuggugggccccgugagcgacugcagcacccugcccugccugccccugcccgcccuguucaaccaggagcccgccagcggccagaugagacuggagaagaccgaccagauccccaugcccuucagcagcagcagccugagcugccugaaccugcccgagggccccauccaguucgugcccaccaucagcacccugccccacggccuguggcagaucagcgaggccggcaccggcgugagcagcaucuucaucuaccacggcgaggugccccaggccagccaggugcccccccccagcggcuucaccgugcacggccugcccaccagccccgacagacccggcagcaccagccccuucgcccccagcgccaccgaccugcccagcaugcccgagcccgcccugaccagcagagccaacaugaccgagcacaagaccagccccacccagugccccgccgccggcgaggugagcaacaagcugcccaaguggcccggcagagaggugcccagaaagacccagcugggcagcagccugcuguucggcaccuga

SEQ ID NO: 7862 - RNA, 1062 nt, Artificial Sequence
  derived and/or modified sequence opt5 from CIITA__Homo_sapiens__AAA92364
augagaugccuggcuccccggccugccggcagcuaccucuccgagccgcaggggucuagccaaugugccaccauggaacugggaccccuugagggcggguaucuggaacuccugaacuccgacgcggauccucuuugccuguaccacuucuaugaccagauggaucucgcuggagaggaagagaucgagcuguacucugaacccgacacagauacgauuaauugugaccaguuuagccgccugcucugcgauauggagggcgacgaagagaccagagaggccuaugccaacaucgcugaacuggaucaguacguguuccaagacucccagcuugaggggcugucuaaggauauuuuuaaacauaucggaccugacgaagucauuggcgagagcauggaaaugcccgccgagguuggccagaagucccagaaacggccuuucccggaggaacuccccgcugaucugaagcacuggaaaccugccgagcccccuacaguggugaccgggagccuucuggucggacccgugucugacuguuccacacucccgugccugccucugcccgcgcucuuuaaucaagaaccugccagcggccagaugcgccuggagaagaccgaccagauccccaugcccuucucuuccagcucucuuuccugucugaaccucccugaagggccgauccaguuuguucccacaauuagcacccugccucauggacuuuggcaaaucuccgaggcuggcacgggggugucuagcauuuucaucuaucacggagaggucccccaggccucccaggugccucccccgagcggcuuuaccguucauggccugccuacaucucccgauagaccuggguccaccagccccuucgcuccuucugccacagaccuccccagcaugccggaaccugcgcugaccucccgggccaauaugacggagcacaagacaucucccacccaaugccccgcugccggagaagugagcaacaaacugccuaaguggccgggccgcgagguccccagaaaaacacagcucggguccagccugcuuuuuggaaccuga

SEQ ID NO: 7863 - protein, 423 aa, Artificial Sequence [sequence omitted]

SEQ ID NO: 7864 - RNA, 1272 nt, Artificial Sequence
  c-Jun__Homo_sapiens__BAG51230
auguccgccucggcugucuucauucuggacguuaagggcaagccauugaucagccgcaacuacaagggcgauguggccaugagcaagauugagcacuucaugccuuugcugguacagcgggaggaggaaggcgcccuggccccgcugcugagccacggccagguccacuuccuauggaccaaacacagcaaccucuacuugguggccaccacaucgaagaaugccaaugccucccugguguacuccuuccuguauaagacaauagagguauucugcgaauacuucaaggagcuggaggaggagagcauccgggacaacuuugucaucgucuacgaguugcuggacgagcucauggacuuuggcuucccgcagaccaccgacagcaagauccugcaggaguacaucacucagcagagcaacaagcuggagacgggcaagucacgggugccacccacugucaccaacgcuguguccuggcgcuccgaggguaucaaguauaagaagaacgaggucuucauugaugucauagagucugucaaccugcuggucaaugccaacggcagcguccuucugagcgaaaucgucgguaccaucaagcucaagguguuucugucgggaaugccagagcugcggcugggccucaaugaccgcgugcucuucgagcucacuggccgcagcaagaacaaaucaguagagcuggaggauguaaaauuccaccagugcgugcggcucucucgcuuugacaacgaccgcaccaucuccuucaucccgccugauggugacuuugagcucaugucauaccgccucagcacccaggucaagccacugaucuggauugagucugucauugagaaguucucccacagccgcguggagaucacggucaaggccaaggggcaguuuaagaaacagucaguggccaacgguguggagauaucugugccuguacccagcgaugccgacucccccagauucaagaccagugugggcagcgccaaguaugugccggagagaaacgucgugauuuggaguauuaagucuuucccggggggcaaggaguacuugaugcgagcccacuuuggccuccccaguguggaaaaggaagagguggagggccggccccccaucggggucaaguuugagauccccuacuucaccgucucugggauccagguccgauacaugaagaucauugagaaaagugguuaccaggcccugcccuggguucgcuacaucacccagaguggugauuaccaacuucguaccagcuag

SEQ ID NO: 7865 - RNA, 1272 nt, Artificial Sequence
  derived and/or modified sequence opt1 from c-Jun__Homo_sapiens__BAG51230
augagcgccuccgccguguucauccuggacgucaagggcaagccccucaucagccgcaacuacaagggggacguggcgauguccaagaucgagcacuucaugccgcugcuggugcagcgggaggaggagggcgcccucgcgccccugcugagccacgggcagguccacuuccucuggaccaagcacuccaaccuguaccugguggccaccacgagcaagaacgccaacgccucccucguguacagcuuccuguacaagaccaucgaggucuucugcgaguacuucaaggagcuggaggaggaguccauccgcgacaacuucgugaucguguacgagcuccuggacgagcugauggacuucggcuucccccagaccaccgacagcaagauccuccaggaguacaucacgcagcaguccaacaagcuggagaccggcaagagccgggugcccccgaccgucaccaacgccguguccuggcgcagcgaggggaucaaguacaagaagaacgaggucuucaucgacgugaucgaguccgugaaccugcucgucaacgccaacggcagcgugcugcuguccgagaucguggggacgaucaagcucaaggucuuccugagcggcaugcccgagcugcggcucgggcugaacgaccgcgugcuguucgagcucaccggccgguccaagaacaagagcguggagcuggaggacgucaaguuccaccagugcgugcgccugagccgguucgacaacgaccgcaccaucuccuucaucccgcccgacggggacuucgagcucaugagcuaccggcuguccacccaggugaagccccugaucuggaucgagagcgucaucgagaaguucucccacagccgcguggagaucacggucaaggccaagggccaguucaagaagcaguccguggcgaacggcguggagaucagcguccccgugcccuccgacgccgacagcccccgguucaagaccuccguggggagcgccaaguacgucccggagcgcaacguggugaucugguccaucaagagcuuccccggcgggaaggaguaccucaugcgggcccacuucggccugcccuccgucgagaaggaggagguggagggccggcccccgaucggggugaaguucgagauccccuacuucaccgucagcggcauccaggugcgcuacaugaagaucaucgagaaguccggguaccaggcccugcccugggugcgcuacaucacccagagcggcgacuaccagcuccggacguccuga

SEQ ID NO: 7866 - RNA, 1272 nt, Artificial Sequence
  derived and/or modified sequence opt2 from c-Jun__Homo_sapiens__BAG51230
auguccgccuccgccgucuucauccucgacgucaagggcaagccccucaucucccgcaacuacaagggcgacgucgccauguccaagaucgagcacuucaugccccuccucguccagcgcgaggaggagggcgcccucgccccccuccucucccacggccagguccacuuccucuggaccaagcacuccaaccucuaccucgucgccaccaccuccaagaacgccaacgccucccucgucuacuccuuccucuacaagaccaucgaggucuucugcgaguacuucaaggagcucgaggaggaguccauccgcgacaacuucgucaucgucuacgagcuccucgacgagcucauggacuucggcuucccccagaccaccgacuccaagauccuccaggaguacaucacccagcaguccaacaagcucgagaccggcaagucccgcgucccccccaccgucaccaacgccgucuccuggcgcuccgagggcaucaaguacaagaagaacgaggucuucaucgacgucaucgaguccgucaaccuccucgucaacgccaacggcuccguccuccucuccgagaucgucggcaccaucaagcucaaggucuuccucuccggcaugcccgagcuccgccucggccucaacgaccgcguccucuucgagcucaccggccgcuccaagaacaaguccgucgagcucgaggacgucaaguuccaccagugcguccgccucucccgcuucgacaacgaccgcaccaucuccuucaucccccccgacggcgacuucgagcucauguccuaccgccucuccacccaggucaagccccucaucuggaucgaguccgucaucgagaaguucucccacucccgcgucgagaucaccgucaaggccaagggccaguucaagaagcaguccgucgccaacggcgucgagaucuccguccccguccccuccgacgccgacuccccccgcuucaagaccuccgucggcuccgccaaguacguccccgagcgcaacgucgucaucugguccaucaaguccuuccccggcggcaaggaguaccucaugcgcgcccacuucggccuccccuccgucgagaaggaggaggucgagggccgcccccccaucggcgucaaguucgagauccccuacuucaccgucuccggcauccagguccgcuacaugaagaucaucgagaaguccggcuaccaggcccuccccuggguccgcuacaucacccaguccggcgacuaccagcuccgcaccuccuga

SEQ ID NO: 7867 - RNA, 1272 nt, Artificial Sequence
  derived and/or modified sequence opt3 from c-Jun__Homo_sapiens__BAG51230
augagcgccuccgcuguguucauccuggacgucaagggcaaaccccucauuucuagaaacuacaagggggauguugcaaugucaaaaauagagcacuuuaugccucuucuggugcagagggaagaggaaggagccuuggcgccauuacugagucauggucaaguacacuuccuauggaccaagcauagcaaucucuaucugguggcuacaacuuccaaaaacgccaaugcaucucuugucuacucguuucuguauaagacgaucgagguguucugcgaauacuuuaaggaguuggaggaagagucaauucgggacaacuucguuaucguguaugaacuccuggaugagcugauggacuuuggcuucccgcagaccacagauagcaaaauucuccaggaguacaucacucagcaaaguaauaaguuagaaaccgggaaaucccgcgugcccccuacagugaccaacgccguaucuuggcgaagcgagggaauaaaguauaaaaagaaugaaguuuuuaucgacgugauugaguccgucaaccugcuugugaaugcuaacggcucaguguugcugagugaaaucgucgguacuauuaagcuaaaaguuuuccucagcgggaugccagagcugcgucuuggacugaaugauagaguguuguuugagcucacaggcaggucuaagaacaaauccguagaacuggaggacgugaaguuccaccaguguguccgguuaucacgcuuugauaaugacagaaccaucagcuucauacccccugauggcgacuucgaacugaugaguuacaggcucucuacgcaggucaaaccacuuauuuggaucgaguccguuauugaaaaguuuagccauucgcggguggagaucacugucaaagcaaaggggcaguucaagaaacaaucuguggccaacggaguagagaucuccguucccgugccuucagaugcugacaguccacgcuuuaagaccagcgucgguuccgccaaauacgugccggaacgaaaugucgugauuuggucuauaaagagcuuccccggcgggaaagaguaucugaugagagcgcacuuuggauugccuucaguugaaaaggaggaaguggagggcaggccacccaucgguguaaaguucgagauuccuuacuuuacagucagugggauccaggugcgguauaugaaaauaauugaaaaguccggauaccaggcacuaccauggguucguuauaucacucagagcggcgacuaccaacugcgcaccucuuga

SEQ ID NO: 7868 - RNA, 1272 nt, Artificial Sequence
  derived and/or modified sequence opt4 from c-Jun__Homo_sapiens__BAG51230
augagcgccagcgccguguucauccuggacgugaagggcaagccccugaucagcagaaacuacaagggcgacguggccaugagcaagaucgagcacuucaugccccugcuggugcagagagaggaggagggcgcccuggccccccugcugagccacggccaggugcacuuccuguggaccaagcacagcaaccuguaccugguggccaccaccagcaagaacgccaacgccagccugguguacagcuuccuguacaagaccaucgagguguucugcgaguacuucaaggagcuggaggaggagagcaucagagacaacuucgugaucguguacgagcugcuggacgagcugauggacuucggcuucccccagaccaccgacagcaagauccugcaggaguacaucacccagcagagcaacaagcuggagaccggcaagagcagagugccccccaccgugaccaacgccgugagcuggagaagcgagggcaucaaguacaagaagaacgagguguucaucgacgugaucgagagcgugaaccugcuggugaacgccaacggcagcgugcugcugagcgagaucgugggcaccaucaagcugaagguguuccugagcggcaugcccgagcugagacugggccugaacgacagagugcuguucgagcugaccggcagaagcaagaacaagagcguggagcuggaggacgugaaguuccaccagugcgugagacugagcagauucgacaacgacagaaccaucagcuucaucccccccgacggcgacuucgagcugaugagcuacagacugagcacccaggugaagccccugaucuggaucgagagcgugaucgagaaguucagccacagcagaguggagaucaccgugaaggccaagggccaguucaagaagcagagcguggccaacggcguggagaucagcgugcccgugcccagcgacgccgacagccccagauucaagaccagcgugggcagcgccaaguacgugcccgagagaaacguggugaucuggagcaucaagagcuuccccggcggcaaggaguaccugaugagagcccacuucggccugcccagcguggagaaggaggagguggagggcagaccccccaucggcgugaaguucgagauccccuacuucaccgugagcggcauccaggugagauacaugaagaucaucgagaagagcggcuaccaggcccugcccugggugagauacaucacccagagcggcgacuaccagcugagaaccagcuga

SEQ ID NO: 7869 - RNA, 1272 nt, Artificial Sequence
  derived and/or modified sequence opt5 from c-Jun__Homo_sapiens__BAG51230
augagcgcuuccgcuguguucauccuggacgucaagggcaaaccccucauuucuagaaacuacaagggggauguugccaugagcaaaaucgagcacuuuaugccucugcuugugcagcgggaagaggaaggagcgcuggcuccgcuccugucccauggccaagugcacuuccuuuggaccaagcauucuaaucuguaucucgucgccacaacgagcaaaaacgccaaugcuucccugguguacucuuuucuguauaagaccauugagguuuucugcgaauacuuuaaggagcucgaggaagagagcauccgcgacaacuucgugauugucuaugaacugcuugaugagcugauggacuuuggguucccccagacaaccgauuccaaaauccuccaggaguacaucacacagcaaagcaauaagcuggaaaccggaaaaucuagagugccucccacaguuaccaacgccguguccuggcggagcgagggcauuaaguauaaaaagaaugaagucuuuaucgacgugauugagucugugaaccuucuggucaaugcuaacggguccguucuccugagcgaaaucgugggaacgauuaagcugaaaguguuccucucuggcaugccugagcugcgccuuggccugaaugauagaguccucuuugagcugaccgggcgguccaagaacaaaagcguggaacuugaggacguuaaguuccaccagugugugcgccuguccagauuugauaaugaccggacaaucucuuucauucccccugauggagacuucgaacucaugagcuaccgccuguccacccaggucaaaccgcugaucuggaucgagagcgugauugaaaaguuuucucauuccagaguugagaucacagugaaagccaagggccaguucaagaaacaaagcgucgcgaacgggguggagauuucuguccccgugccuagcgaugccgacucuccccgguuuaagaccuccguuggaagcgcuaaauacgugccugaacgcaaugucgugaucugguccauuaagagcuuccccggcgggaaagaguaucucaugagagcccacuuuggacugccgucuguugaaaaggaggaaguggagggccggccucccaucggcgucaaguucgagaucccuuacuuuacgguguccgggauucaggugcgcuauaugaaaaucauugaaaagagcggauaccaggcccuucccuggguuagauauaucacacagucuggcgacuaccaacugcggaccuccuga

SEQ ID NO: 7870 - protein, 247 aa, Artificial Sequence
  c-Jun__Homo_sapiens__B3KNW1
MRSALLERMPVMEKVTTNGPTEIVQTNGETEPAPLETKPPPSGPQPTSQANDLLDLLGGNDITPVIPTAPTSKPSSAGGELLDLLGDINLTGAPAAAPAPASVPQISQPPFLLDGLSSQPLFNDIAAGIPSITAYSKNGLKIEFTFERSNTNPSVTVITIQASNSTELDMTDFVFQAAVPKTFQLQLLSPSSSIVPAFNTGTITQVIKVLNPQKQQLRMRIKLTYNHKGSAMQDLAEVNNFPPQSWQ

SEQ ID NO: 7871 - RNA, 744 nt, Artificial Sequence
  c-Jun__Homo_sapiens__BAG51473
augaggucugcccuacuugagagaaugccugucauggaaaaagugaccacaaauggcccuacugagauugugcagacaaauggagagacagaaccagcuccacuagagaccaaaccgccacccucugggccacagcccaccagccaggccaaugauuuauuggauuuguugggaggaaaugacauaacaccuguuauuccaacugcgccuacaagcaaaccaucuucugcugguggagaacuucuugauuugcugggagacaucaaccuuacaggugcuccagcugcugcucccgccccugccucagucccacagauaucccagccccccuucuuguuggaugggcuuucaucacagccucucuucaaugauauugcugcaggcauccccuccaucacagcauacaguaagaauggcuugaagauagaauucaccuuugaacggucaaauaccaaccccaguguaacagugauaacgauacaggccuccaacagcacagagcuagauaugacggacuuuguuuuccaagcugcaguaccaaagacauuccagcugcagcucuugucuccuagcagcagcauugucccagcauuuaacacggggaccaucacacaagucauuaaaguucugaacccucagaagcaacagcugcgaaugcggaucaagcuuacauauaaucacaagggcucagcaaugcaagaucuagcagaggugaacaacuuucccccucaguccuggcaauga

SEQ ID NO: 7872 - RNA, 744 nt, Artificial Sequence
  derived and/or modified sequence opt1 from c-Jun__Homo_sapiens__BAG51473
augcgcagcgcccugcucgagcggaugcccgugauggagaaggucaccaccaacggccccacggagaucgugcagaccaacggggagaccgagcccgcgccccuggagaccaagcccccgcccuccggcccccagcccacgagccaggccaacgaccugcucgaccugcucgggggcaacgacaucaccccggugauccccaccgcccccaccuccaagcccagcuccgccgggggcgagcugcuggaccugcucggcgacaucaaccugacgggggccccggccgcggcccccgcccccgccagcgucccccagaucucccagccgcccuuccugcucgacggccugagcucccagccccuguucaacgacaucgcggccgggauccccagcaucaccgccuacuccaagaacggccucaagaucgaguucaccuucgagcgcagcaacaccaacccguccgugacggugaucaccauccaggccagcaacuccaccgagcuggacaugaccgacuucgucuuccaggccgcggugcccaagacguuccagcugcagcuccugagccccuccagcuccaucgugcccgccuucaacaccgggaccaucacccaggucaucaaggugcugaacccgcagaagcagcagcuccggaugcgcaucaagcugacguacaaccacaagggcagcgccaugcaggaccuggccgaggugaacaacuucccgccccagagcuggcaguga

SEQ ID NO: 7873 - RNA, 744 nt, Artificial Sequence
  derived and/or modified sequence opt2 from c-Jun__Homo_sapiens__BAG51473
augcgcuccgcccuccucgagcgcaugcccgucauggagaaggucaccaccaacggccccaccgagaucguccagaccaacggcgagaccgagcccgccccccucgagaccaagcccccccccuccggcccccagcccaccucccaggccaacgaccuccucgaccuccucggcggcaacgacaucacccccgucauccccaccgcccccaccuccaagcccuccuccgccggcggcgagcuccucgaccuccucggcgacaucaaccucaccggcgcccccgccgccgcccccgcccccgccuccgucccccagaucucccagccccccuuccuccucgacggccucuccucccagccccucuucaacgacaucgccgccggcauccccuccaucaccgccuacuccaagaacggccucaagaucgaguucaccuucgagcgcuccaacaccaaccccuccgucaccgucaucaccauccaggccuccaacuccaccgagcucgacaugaccgacuucgucuuccaggccgccguccccaagaccuuccagcuccagcuccucucccccuccuccuccaucguccccgccuucaacaccggcaccaucacccaggucaucaagguccucaacccccagaagcagcagcuccgcaugcgcaucaagcucaccuacaaccacaagggcuccgccaugcaggaccucgccgaggucaacaacuuccccccccaguccuggcaguga

SEQ ID NO: 7874 - RNA, 744 nt, Artificial Sequence
  derived and/or modified sequence opt3 from c-Jun__Homo_sapiens__BAG51473
augagaagcgcccugcucgagaggaugcccgugauggaaaaggucaccacaaacggcccuacugagaucguucagacgaauggggaaaccgagccagcuccgcuugaaacaaaacccccuccauccggaccccaaccuacuucucaggcaaacgaccuguuggauuuacuggguggcaaugacauuaccccagugauacccacagccccuaccucaaagccaaguagcgcgggaggagagcuacucgaucugcuuggcgacaucaaccugacuggugcuccggccgcagcccccgcuccugcauccguaccacagauuucucagcccccuuucuugcucgaugggcugucgucacaaccacuguucaaugacaucgccgcugggauucccagcaucacagccuacaguaaaaacggccucaagauagaguucaccuuugaacgguccaauacgaacccgucugugacugucaucaccauucaggcgagcaauuccacagaguuagauaugacugacuucguguuucaggcagccguuccuaaaaccuuccagcugcaacuuuugucacccaguagcucuaucgugccagcuuuuaacacaggcaccauuacgcaggucaucaaggugcugaauccucagaagcagcaacuacgcaugcgaauaaaacucacuuauaaccacaagggguccgccaugcaggaucuggcagaaguaaauaacuuucccccacagucauggcaauga

SEQ ID NO: 7875 - RNA, 744 nt, Artificial Sequence
  derived and/or modified sequence opt4 from c-Jun__Homo_sapiens__BAG51473
augagaagcgcccugcuggagagaaugcccgugauggagaaggugaccaccaacggccccaccgagaucgugcagaccaacggcgagaccgagcccgccccccuggagaccaagcccccccccagcggcccccagcccaccagccaggccaacgaccugcuggaccugcugggcggcaacgacaucacccccgugauccccaccgcccccaccagcaagcccagcagcgccggcggcgagcugcuggaccugcugggcgacaucaaccugaccggcgcccccgccgccgcccccgcccccgccagcgugccccagaucagccagccccccuuccugcuggacggccugagcagccagccccuguucaacgacaucgccgccggcauccccagcaucaccgccuacagcaagaacggccugaagaucgaguucaccuucgagagaagcaacaccaaccccagcgugaccgugaucaccauccaggccagcaacagcaccgagcuggacaugaccgacuucguguuccaggccgccgugcccaagaccuuccagcugcagcugcugagccccagcagcagcaucgugcccgccuucaacaccggcaccaucacccaggugaucaaggugcugaacccccagaagcagcagcugagaaugagaaucaagcugaccuacaaccacaagggcagcgccaugcaggaccuggccgaggugaacaacuuccccccccagagcuggcaguga

SEQ ID NO: 7876 - RNA, 744 nt, Artificial Sequence
  derived and/or modified sequence opt5 from c-Jun__Homo_sapiens__BAG51473
augagaagcgcccugcucgagcggaugcccgugauggaaaaggucaccacaaacggcccuacggagaucguucagaccaauggggaaacagagccggcuccccuggaaaccaaaccucccccuuccggaccccaaccuacaucucaggccaacgaccuucuggaucuccugggcgggaaugacauuaccccggugauccccacagcgccuaccagcaagcccuccucugcuggaggcgagcuucuggaucuccugggggacauuaaccugacgggagccccugccgcugcccccgcuccggccagcgugccucagaucucccagcccccuuuccuccuggauggccuuucuagccaaccccuguuuaaugacauugcggccggcauccccuccaucaccgcuuacagcaaaaacgggcucaagauugaguucacauuugaacgcucuaauaccaacccuuccgucacagugaucaccauucaggccagcaauucuacggagcuggauaugacagacuucguuuuucaggcugccgugccgaaaaccuuccagcuucaacugcucucccccucuagcuccaucgucccugcguuuaacacaggaaccauuacccaggugaucaagguucugaauccccagaagcagcaacugagaaugcggauuaaacucacauauaaccacaagggcagcgccaugcaggaucuggcugaagugaauaacuucccuccccaguccuggcaauga

SEQ ID NO: 7877 - protein, 845 aa, Artificial Sequence
  c-Jun__Homo_sapiens__B3KXW5
MEKNINLRNCQTLNTYVMLTHLRMPAPIRLRELIRTIRTARTQAEEREMIQKECAAIRSSFREEDNTYRCRNVAKLLYMHMLGYPAHFGQLECLKLIASQKFTDKRIGYLGAMLLLDERQDVHLLMTNCIKNDLNHSTQFVQGLALCTLGCMGSSEMCRDLAGEVEKLLKTSNSYLRKKAALCAVHVIRKVPELMEMFLPATKNLLNEKNHGVLHTSVVLLTEMCERSPDMLAHFRKLVPQLVRILKNLIMSGYSPEHDVSGISDPFLQVRILRLLRILGRNDDDSSEAMNDILAQVATNTETSKNVGNAILYETVLTIMDIKSESGLRVLAINILGRFLLNNDKNIRYVALTSLLKTVQTDHNAVQRHRSTIVDCLKDLDVSIKRRAMELSFALVNGNNIRGMMKELLYFLDSCEPEFKADCASGIFLAAEKYAPSKRWHIDTIMRVLTTAGSYVRDDAVPNLIQLITNSVEMHAYTVQRLYKAILGDYSQQPLVQVAAWCIGEYGDLLVSGQCEEEEPIQVTEDEVLDILESVLISNMSTSVTRGYALTAIMKLSTRFTCTVNRIKKVVSIYGSSIDVELQQRAVEYNALFKKYDHMRSALLERMPVMEKVTTNGPTEIVQTNGETEPAPLETKPPPSGPQPTSQANDLLDLLGGNDITPVIPTAPTSKPSSAGGELLDLLGDINLTGAPAAAPAPASVPQISQPPFLLDGLSSQPLFNDIAAGIPSITAYSKNGLKIEFTFERSNTNPSVTVITIQASNSTELDMTDFVFQAAVPKTFQLQLLSPSSSIVPAFNTGTITQVIKVLNPQKQQLRMRIKLTYNHKGSAMQDLAEVNNFPPQSWQ

SEQ ID NO: 7878 - RNA, 2538 nt, Artificial Sequence
  c-Jun__Homo_sapiens__BAG54627
auggagaaaaauauuaaucugaggaacugucaaacacugaacaccuauguaaugcucacucauuuaaggaugccagcccccaucagauugcgggagcugauccggaccauccggacagcccgaacccaagcugaagaacgagaaaugauccagaaagaaugugcugcaauccggucaucuuuuagagaagaagacaauacauaccgaugucggaauguggcaaaauuacuguauaugcacaugcugggcuacccugcucacuuuggacaguuggagugccucaagcuuauugccucucaaaaauuuacagacaaacgcauuggcuauuuaggggcaaugcugcuguuagaugaaagacaagauguccaucuucucaugaccaacuguaucaagaaugaucuuaaucauagcacgcaauucguacagggguuagcacuuuguacccucggcugcaugggcuccucagagaugugcagagaucuugcaggagagguagagaagcuccugaaaaccuccaacucuuacuuaagaaaaaaggcagcacugugugcuguucaugucaucaggaaaguuccugaacuuauggagauguuuuuaccagcaacaaaaaauuuauugaaugagaagaaccaugguguccuccacacaucuguaguccuccucacagaaaugugugagcgaagcccagacaugcuugcgcauuucagaaagcuugugccccaauuaguucguauuuuaaagaaccucaucauguccggauauucaccagaacaugauguuucugguaucagugaccccuuuuugcagguacgaauuuugcgguuauuaagaauuuuaggacgaaaugaugaugauucaagugaagcuaugaaugauauauuagcacagguugccacuaauacugagacuaguaaaaauguaggaaaugcuauucuuuaugaaacgguuuugacuaucauggauauuaagucagagaguggauugcgaguccuagccauaaauauccugggucguuucuuauugaacaaugacaagaauauuagauauguggcucugacaucuuuguugaagacuguacagacagaucauaaugcaguacagaggcacagaagcacaauuguggacugucuuaaagauuuggaugucucaauaaaacggcgugcaauggaauugaguuuugcccugguaaaugggaauaauauccgaggcaugaugaaagaauuacuuuauuuucuggauucgugugagccagaauuuaaagcagacugugcaucuggaaucuuucuugcugcagaaaaguaugcaccuuccaaacgauggcauauagacacaauuaugcguguuuugacaacggcaggaaguuauguucgugaugaugcaguccccaauuuaauccaguuaauaacuaauaguguggagaugcaugccuauacuguccagcgccuguacaaagcaauucuuggugauuauucucaacaaccuuugguacaaguggcugcaugguguauaggugaauauggugaucuucuuguaucuggccagugugaagaggaagagccuauucagguaacagaggaugaaguguuggauauuuuagaaaguguccuaaucucuaauauguccaccucugugacacgagguuaugcccucacugccauuaugaagcuuuccacucgauucacuuguacuguaaaccgaauuaagaaagugguuuccaucuacggaagcagcauugauguggaacuccagcagagggcaguagaauauaaugcacuuuucaagaaauaugaccacaugaggucugcccuacuugagagaaugccugucauggaaaaagugaccacaaauggcccuacugagauugugcagacaaauggagagacagaaccagcuccacuagagaccaaaccgccacccucugggccacagcccaccagccaggccaaugauuuauuggauuuguugggaggaaaugacauaacaccuguuauuccaacugcgccuacaagcaaaccaucuucugcugguggagaacuucuugauuugcugggagacaucaaccuuacaggugcuccagcugcugcuccugccccugccucagucccacagauaucccagccccccuucuuguuggaugggcuuucaucacagccucucuucaaugauauugcugcaggcauccccuccaucacagcauacaguaagaauggcuugaagauagaauucaccuuugaacggucaaauaccaaccccaguguaacagugauaacgauacaggccuccaacagcacagagcuagauaugacggacuuuguuuuccaagcugcaguaccaaagacauuccagcugcagcucuugucuccuagcagcagcauugucccagcauuuaacacggggaccaucacacaagucauuaaaguucugaacccucagaagcaacagcugcgaaugcggaucaagcuuacauauaaucacaagggcucagcaaugcaagaucuagcagaggugaacaacuuucccccucaguccuggcaauga

SEQ ID NO: 7879 - RNA, 2538 nt, Artificial Sequence
  derived and/or modified sequence opt1 from c-Jun__Homo_sapiens__BAG54627
auggagaagaacaucaaccugcgcaacugccagacccucaacaccuacgugaugcugacgcaccuccggaugcccgccccgauccgccugcgggagcugauccgcaccauccggaccgcccgcacccaggcggaggagcgggagaugauccagaaggagugcgccgccauccgcagcuccuuccgggaggaggacaacacguaccgcugccggaacgucgccaagcugcucuacaugcacaugcugggcuaccccgcccacuucgggcagcuggagugccucaagcugaucgcgagccagaaguucaccgacaagcgcaucggcuaccugggggccaugcuccugcuggacgagcggcaggacgugcaccuccugaugaccaacugcaucaagaacgaccugaaccacuccacccaguucgugcagggccucgcccugugcacgcuggggugcaugggcagcuccgagaugugccgcgaccucgccggcgaggucgagaagcugcugaagaccagcaacuccuaccuccggaagaaggcggcccugugcgccgugcacgugauccgcaagguccccgagcugauggagauguuccuccccgccaccaagaaccugcugaacgagaagaaccacggggugcuccacaccagcgugguccugcugacggagaugugcgagcgguccccggacaugcucgcccacuuccgcaagcuggugccccagcuggugcggauccucaagaaccugaucaugagcggcuacucccccgagcacgacgucagcgggaucuccgaccccuuccuccaggugcgcauccugcggcugcugcgcauccucggccgcaacgacgacgacagcuccgaggcgaugaacgacauccuggcccagguggccaccaacaccgagaccagcaagaacgucgggaacgccauccuguacgagacggugcucaccaucauggacaucaaguccgagagcggccugcgggugcuggccaucaacauccucggccgcuuccugcugaacaacgacaagaacauccgguacgucgcgcugaccucccuccugaagaccgugcagacggaccacaacgccgugcagcgccaccggagcaccaucgucgacugccugaaggaccucgacgugagcaucaagcgccgggccauggagcuguccuucgcccuggugaacgggaacaacauccgcggcaugaugaaggagcuccuguacuuccuggacagcugcgagccggaguucaaggccgacugcgcguccgggaucuuccucgccgccgagaaguacgcccccagcaagcgguggcacaucgacaccaucaugcgcguccugaccacggccggcuccuacgugcgggacgacgcgguccccaaccugauccagcucaucaccaacagcguggagaugcacgccuacaccgugcagcgccuguacaaggccauccugggcgacuacucccagcagccccucguccagguggccgcguggugcaucggggaguacggcgaccugcuggugagcgggcagugcgaggaggaggagccgauccaggucaccgaggacgaggugcucgacauccuggaguccgugcugaucagcaacauguccacgagcgucacccggggcuacgcccucaccgccaucaugaagcuguccacccgcuucacgugcaccgugaaccggaucaagaagguggucagcaucuacggguccagcaucgacguggagcugcagcagcgcgccguggaguacaacgcccucuucaagaaguacgaccacaugcgguccgcgcugcuggagcgcaugcccgucauggagaaggugaccaccaacggccccacggagaucgugcagaccaacggcgagaccgagcccgccccgcucgagaccaagcccccgcccagcgggccccagcccaccucccaggccaacgaccugcuggaccuccugggcgggaacgacaucacgcccgucauccccaccgccccgaccagcaagcccagcuccgccggcggggagcugcucgaccugcugggcgacaucaaccucaccggcgcgcccgccgccgcccccgccccggcgagcgugccccagaucucccagcccccguuccugcuggacgggcucagcucccagccccuguucaacgacaucgccgccggcauccccagcaucacggccuacuccaagaacgggcugaagaucgaguucaccuucgagcggagcaacaccaaccccuccgugaccgucaucacgauccaggcgagcaacuccaccgagcucgacaugaccgacuucguguuccaggccgccgugccgaagaccuuccagcugcagcugcucagccccuccagcuccaucguccccgccuucaacacgggcaccaucacccaggugaucaaggugcugaacccccagaagcagcagcugcgcaugcgcaucaagcucaccuacaaccacaaggggagcgccaugcaggaccuggcggaggucaacaacuucccgccccaguccuggcaguga

SEQ ID NO: 7880 - RNA, 2538 nt, Artificial Sequence
  derived and/or modified sequence opt2 from c-Jun__Homo_sapiens__BAG54627
auggagaagaacaucaaccuccgcaacugccagacccucaacaccuacgucaugcucacccaccuccgcaugcccgcccccauccgccuccgcgagcucauccgcaccauccgcaccgcccgcacccaggccgaggagcgcgagaugauccagaaggagugcgccgccauccgcuccuccuuccgcgaggaggacaacaccuaccgcugccgcaacgucgccaagcuccucuacaugcacaugcucggcuaccccgcccacuucggccagcucgagugccucaagcucaucgccucccagaaguucaccgacaagcgcaucggcuaccucggcgccaugcuccuccucgacgagcgccaggacguccaccuccucaugaccaacugcaucaagaacgaccucaaccacuccacccaguucguccagggccucgcccucugcacccucggcugcaugggcuccuccgagaugugccgcgaccucgccggcgaggucgagaagcuccucaagaccuccaacuccuaccuccgcaagaaggccgcccucugcgccguccacgucauccgcaagguccccgagcucauggagauguuccuccccgccaccaagaaccuccucaacgagaagaaccacggcguccuccacaccuccgucguccuccucaccgagaugugcgagcgcucccccgacaugcucgcccacuuccgcaagcucgucccccagcucguccgcauccucaagaaccucaucauguccggcuacucccccgagcacgacgucuccggcaucuccgaccccuuccuccagguccgcauccuccgccuccuccgcauccucggccgcaacgacgacgacuccuccgaggccaugaacgacauccucgcccaggucgccaccaacaccgagaccuccaagaacgucggcaacgccauccucuacgagaccguccucaccaucauggacaucaaguccgaguccggccuccgcguccucgccaucaacauccucggccgcuuccuccucaacaacgacaagaacauccgcuacgucgcccucaccucccuccucaagaccguccagaccgaccacaacgccguccagcgccaccgcuccaccaucgucgacugccucaaggaccucgacgucuccaucaagcgccgcgccauggagcucuccuucgcccucgucaacggcaacaacauccgcggcaugaugaaggagcuccucuacuuccucgacuccugcgagcccgaguucaaggccgacugcgccuccggcaucuuccucgccgccgagaaguacgcccccuccaagcgcuggcacaucgacaccaucaugcgcguccucaccaccgccggcuccuacguccgcgacgacgccguccccaaccucauccagcucaucaccaacuccgucgagaugcacgccuacaccguccagcgccucuacaaggccauccucggcgacuacucccagcagccccucguccaggucgccgccuggugcaucggcgaguacggcgaccuccucgucuccggccagugcgaggaggaggagcccauccaggucaccgaggacgagguccucgacauccucgaguccguccucaucuccaacauguccaccuccgucacccgcggcuacgcccucaccgccaucaugaagcucuccacccgcuucaccugcaccgucaaccgcaucaagaaggucgucuccaucuacggcuccuccaucgacgucgagcuccagcagcgcgccgucgaguacaacgcccucuucaagaaguacgaccacaugcgcuccgcccuccucgagcgcaugcccgucauggagaaggucaccaccaacggccccaccgagaucguccagaccaacggcgagaccgagcccgccccccucgagaccaagcccccccccuccggcccccagcccaccucccaggccaacgaccuccucgaccuccucggcggcaacgacaucacccccgucauccccaccgcccccaccuccaagcccuccuccgccggcggcgagcuccucgaccuccucggcgacaucaaccucaccggcgcccccgccgccgcccccgcccccgccuccgucccccagaucucccagccccccuuccuccucgacggccucuccucccagccccucuucaacgacaucgccgccggcauccccuccaucaccgccuacuccaagaacggccucaagaucgaguucaccuucgagcgcuccaacaccaaccccuccgucaccgucaucaccauccaggccuccaacuccaccgagcucgacaugaccgacuucgucuuccaggccgccguccccaagaccuuccagcuccagcuccucucccccuccuccuccaucguccccgccuucaacaccggcaccaucacccaggucaucaagguccucaacccccagaagcagcagcuccgcaugcgcaucaagcucaccuacaaccacaagggcuccgccaugcaggaccucgccgaggucaacaacuuccccccccaguccuggcaguga

SEQ ID NO: 7881 - RNA, 2538 nt, Artificial Sequence
  derived and/or modified sequence opt3 from c-Jun__Homo_sapiens__BAG54627
auggagaagaacaucaaucugagaaacugccagacccucaauacauacgugaugcuuacucaccugaggaugcccgccccuauucgguugcgcgaauuaauacgaacgauccguaccgcuagaacacaagcagaggaaagggagaugauucagaaagaaugugccgcgauccggagcuccuuccgcgaggaggacaacacuuauagaugcaggaaugucgcuaagcugcuauacaugcauaugcucggcuauccagcccacuuugggcagcuggaaugucuuaaacugauugcaucucagaaguucaccgauaaacggaucggauacuugggugccaugcuccugcuggacgagcgccaagauguucaucucuuaaugacaaacugcauaaagaaugaccugaaccacucaacccaguuugugcagggccuugcuuuguguacucuggggugcaugggaaguagcgaaaugugucgagaucuagcaggcgagguagagaagcuccugaaaacauccaauucuuaucuuagaaagaaagccgcucugugcgccgugcaugucaucaggaaggugccggaauugauggagauguuccuccccgcgaccaaaaaccuguuaaaugaaaagaaccacgguguucugcacacgucggugguccuccuuacugagaugugugaacggucaccugacaugcuggcacauuuucguaaguuggugccacagcuaguacgcauucugaaaaaucucaucaugagcggguacagucccgagcacgauguuuccggaauuucugacccuuuccugcaagugagaauccuuaggcuguugcggauacucggccgaaacgaugacgauagcuccgaggccaugaaugacauucuggcucaggucgccaccaacacagaaacuucaaagaacgugggcaaugcaaucuuauaugagaccgugcugacaauuauggauaucaaaagugaaagcgggcuacgcguccucgcuaucaacauucugggaagauuucuuuugaauaacgacaagaauauaagguacguugcccugaccucucuccugaaaacggugcagacugaccauaacgcgguacagcggcaccgcuccacaaucguggauugccuuaaggaccuggaugucucaauuaaaagaagggccauggaguugagcuucgcacucgugaaugguaacaauauccguggcaugaugaaggaacuguuauacuuucuggacaguugugagccagaguucaaggcugauugcgccucugggauauuucuagcugccgaaaaauaugcacccuccaagcgguggcacauugacaccaucaugcgaguucucacuacagccggaagcuacgugagagaugacgcugucccuaaccugauccaacuuauuaccaauucgguggagaugcaugcguauacgguacagagguuguacaaagcaauccugggcgauuauucucagcaaccacucguucagguggccgcuuggugcauuggugaauacggggaccuguuagucuccggacagugugaggaagaggagccgauacaggugaccgaagaugagguccuggacauccuugaaucaguguugauuaguaacaugagcacauccguuacucgcggcuaugcccucaccgcaaucaugaagcugucuacacgguucacuugcaccgugaauagaaucaaaaagguagucagcauuuacggcucaaguauagacguggagcuacaacagagggccguugaguacaacgcucuguuuaagaaauaugaucacaugcgcuccgcccuccuggaacgaaugcccgugauggagaaggucacaaccaaugggccuacugaaaucgugcagacgaacggagagacagaaccagcaccccuugagaccaaaccuccacccagcgguccgcagccuacuucucaagcgaacgacuugcuggauuuacucggcgggaaugacauuacccccguaaucccaacagcuccuaccucaaagcccaguagcgccggaggcgagcugcuugaucuguugggugacauuaaccucacuggggcaccagccgcugcccccgcuccugcauccgugccacagaucucucagccgcccuuccugcuagauggccugucgagccagccucucuucaaugacauagccgcgggaaucccauccauuacagccuacagcaaaaacggccugaagaucgaauuuacguucgagcggaguaauaccaaccccucuguuacugucauuacaauccaagcuagcaauuccaccgaacuugauaugacagacuuuguguuccaggcagccgugccuaagacuuuucaguugcagcuguuaucaccaucaucuuccauaguccccgcuuucaacaccgggacgauuacccaaguuaucaaagugcucaauccgcagaagcagcaacugcguaugagaauuaaacuuacauauaaccauaagggaagugccaugcaggaucuggcagaggugaauaacuuuccuccacagagcuggcaguga

SEQ ID NO: 7882 - RNA, 2538 nt, Artificial Sequence
  derived and/or modified sequence opt4 from c-Jun__Homo_sapiens__BAG54627
auggagaagaacaucaaccugagaaacugccagacccugaacaccuacgugaugcugacccaccugagaaugcccgcccccaucagacugagagagcugaucagaaccaucagaaccgccagaacccaggccgaggagagagagaugauccagaaggagugcgccgccaucagaagcagcuucagagaggaggacaacaccuacagaugcagaaacguggccaagcugcuguacaugcacaugcugggcuaccccgcccacuucggccagcuggagugccugaagcugaucgccagccagaaguucaccgacaagagaaucggcuaccugggcgccaugcugcugcuggacgagagacaggacgugcaccugcugaugaccaacugcaucaagaacgaccugaaccacagcacccaguucgugcagggccuggcccugugcacccugggcugcaugggcagcagcgagaugugcagagaccuggccggcgagguggagaagcugcugaagaccagcaacagcuaccugagaaagaaggccgcccugugcgccgugcacgugaucagaaaggugcccgagcugauggagauguuccugcccgccaccaagaaccugcugaacgagaagaaccacggcgugcugcacaccagcguggugcugcugaccgagaugugcgagagaagccccgacaugcuggcccacuucagaaagcuggugccccagcuggugagaauccugaagaaccugaucaugagcggcuacagccccgagcacgacgugagcggcaucagcgaccccuuccugcaggugagaauccugagacugcugagaauccugggcagaaacgacgacgacagcagcgaggccaugaacgacauccuggcccagguggccaccaacaccgagaccagcaagaacgugggcaacgccauccuguacgagaccgugcugaccaucauggacaucaagagcgagagcggccugagagugcuggccaucaacauccugggcagauuccugcugaacaacgacaagaacaucagauacguggcccugaccagccugcugaagaccgugcagaccgaccacaacgccgugcagagacacagaagcaccaucguggacugccugaaggaccuggacgugagcaucaagagaagagccauggagcugagcuucgcccuggugaacggcaacaacaucagaggcaugaugaaggagcugcuguacuuccuggacagcugcgagcccgaguucaaggccgacugcgccagcggcaucuuccuggccgccgagaaguacgcccccagcaagagauggcacaucgacaccaucaugagagugcugaccaccgccggcagcuacgugagagacgacgccgugcccaaccugauccagcugaucaccaacagcguggagaugcacgccuacaccgugcagagacuguacaaggccauccugggcgacuacagccagcagccccuggugcagguggccgccuggugcaucggcgaguacggcgaccugcuggugagcggccagugcgaggaggaggagcccauccaggugaccgaggacgaggugcuggacauccuggagagcgugcugaucagcaacaugagcaccagcgugaccagaggcuacgcccugaccgccaucaugaagcugagcaccagauucaccugcaccgugaacagaaucaagaagguggugagcaucuacggcagcagcaucgacguggagcugcagcagagagccguggaguacaacgcccuguucaagaaguacgaccacaugagaagcgcccugcuggagagaaugcccgugauggagaaggugaccaccaacggccccaccgagaucgugcagaccaacggcgagaccgagcccgccccccuggagaccaagcccccccccagcggcccccagcccaccagccaggccaacgaccugcuggaccugcugggcggcaacgacaucacccccgugauccccaccgcccccaccagcaagcccagcagcgccggcggcgagcugcuggaccugcugggcgacaucaaccugaccggcgcccccgccgccgcccccgcccccgccagcgugccccagaucagccagccccccuuccugcuggacggccugagcagccagccccuguucaacgacaucgccgccggcauccccagcaucaccgccuacagcaagaacggccugaagaucgaguucaccuucgagagaagcaacaccaaccccagcgugaccgugaucaccauccaggccagcaacagcaccgagcuggacaugaccgacuucguguuccaggccgccgugcccaagaccuuccagcugcagcugcugagccccagcagcagcaucgugcccgccuucaacaccggcaccaucacccaggugaucaaggugcugaacccccagaagcagcagcugagaaugagaaucaagcugaccuacaaccacaagggcagcgccaugcaggaccuggccgaggugaacaacuuccccccccagagcuggcaguga

SEQ ID NO: 7883 - RNA, 2538 nt, Artificial Sequence
  derived and/or modified sequence opt5 from c-Jun__Homo_sapiens__BAG54627
auggagaagaacaucaaucugagaaacugccagacccucaauacauacgugaugcugacgcaccuucggaugcccgccccuauucgccugagagaacucauccggaccauucgcacagcuagaacccaagccgaggaacgggagaugauccagaaagaaugugcggcuauucgcagcuccuucagagaggaggacaacacauaucggugccgcaaugucgccaagcugcuuuacaugcauaugcugggcuauccggcccacuuugggcagcucgaaugucugaaacugaucgcuucucagaaguucaccgauaaaagaaucggauaccucggcgccaugcugcuucuggacgagcggcaagauguucaucuccugaugacaaacugcauuaagaaugaccuuaaccacagcacccaguuugugcaggggcuggcucucuguacgcugggaugcaugggcuccucugaaaugugucgcgaucuggccggggagguggagaagcuccugaaaaccagcaauuccuaucuuagaaagaaagcggcccugugcgcuguccaugugauccggaagguucccgaacucauggagauguuccugccugccaccaaaaaccuucugaaugaaaagaaccacggagugcuccacaccucugucgugcugcugacagagaugugugaacgcagccccgacaugcucgcucauuuuagaaagcugguuccucagcuugugcggauucugaaaaaucucaucauguccggcuacagccccgagcacgaugucucuggcauuuccgacccuuuccugcaagugagaauccuucgccugcuccggauucuggggagaaacgaugacgauagcucugaggccaugaaugacauccuggcccagguggccaccaacacggaaacauccaagaacgucggaaaugcuauccucuaugagaccguucugacaauuauggauaucaaaagcgaaucuggccuucgcgugcuggccauuaacauccucgggcgguuucugcugaauaacgacaagaauauuagauacguggcucuuaccucccuccugaaaaccguccagacagaccauaacgccgugcagcgccaccggagcacgaucguugauugccugaaggaccucgauguguccaucaaaagacgcgccauggagcugucuuucgcucuugucaauggaaacaauauucggggcaugaugaaggaacugcucuacuuucuggacagcugugagccggaguucaaggcggauugcgccuccgggaucuuucuggcugccgaaaaauaugcccccagcaagagauggcacauugacaccaucaugcgcgugcuuacaaccgcuggaucuuacguucgggaugacgccgugccuaaccucauucaacugaucacaaauuccgucgagaugcaugcguauaccgugcagagacuguacaaagcuauccucggcgauuauagccagcaaccccugguccagguggccgccuggugcauuggcgaauacggggaccuucugguuucuggacagugugaggaagaggagccuauccaggugacggaagaugagguccucgacauucuggaaagcgugcugaucuccaacaugucuacaagcguuacccggggcuaugcucuuaccgccauuaugaagcucuccacacgcuucacaugcacagugaauagaaucaaaaaggucgugagcauuuacgggucuuccaucgacguggagcugcaacagcgggcuguugaguacaacgcccuguuuaagaaauaugaucacaugagaagcgcgcuccuggaacgcaugcccgucauggagaaggugacgaccaauggaccgacagaaaucgugcagaccaacggcgagacagaaccugcgccccuugagaccaaaccuccucccucugggccccagccgacgucccaagcuaacgaccugcucgaucugcugggaggcaaugacauuacccccgucaucccuacagcccccaccagcaagccuuccucugcuggcggggagcuucucgaucugcugggagacauuaaccucacaggcgcccccgcggccgcuccggccccugcuagcgugccccagaucucccagccucccuuccugcuugaugggcugucuagccagccucucuucaaugacauugccgccggaauccccuccaucaccgcuuacagcaaaaacggccugaagauugaauuuacguucgagcggucuaauacaaacccguccguuaccgugaucacaauucaagcgagcaauucuaccgaacuggauaugaccgacuuugucuuccaggccgcugugccuaagacauuucagcuucagcugcucucccccagcucuagcaucguucccgccuucaacacggggaccauuacacaagugaucaaaguccugaauccucagaagcagcaacucagaaugcgcaucaaacugaccuauaaccauaagggcuccgccaugcaggaucuugcugaggugaauaacuuuccgccccagagcuggcaguga

SEQ ID NO: 7884 - protein, 310 aa, Artificial Sequence
  c-Jun__Homo_sapiens__B4DED9
MADRAEMFSLSTFHSLSPPGCRPPQDISLEEFDDEDLSEITDDCGLGLSYDSDHCEKDSLSLGRSEQPHPICSFQDDFQEFEMIDVNGEEREQTHRAVFRFIPRHPDELELDVDDPVLVEAEEDDFWFRGFNMRTGERGVFPAFYAHAVPGPAKDLLGSKRSPCWVERFDVQFLGSVEVPCHQGNGILCAAMQKIATARKLTVHLRPPASCDLEISLRGVKLSLSGGGPEFQRCSHFFQMKNISFCGCHPRNSCYFGFITKHPLLSRFACHVFVSQESMRPVAQSVGRAFLEYYQEHLAYACPTEDIYLE

SEQ ID NO: 7885 - RNA, 933 nt, Artificial Sequence
  c-Jun__Homo_sapiens__BAG57050
auggcggaucgcgcggagauguuuucucucuccaccuuccacucgcugucgccgccgggcugcaggccuccccaggacauaagccuggaagaauuugacgacgaagaucugucugagaucacugaugacuguggccugggccucagcuacgacucagaccacugugagaaggacagccucucccuggggcgcucggagcagccgcaccccaucugcuccuuccaggaugacuuccaggaguuugagaugaucgaugucaacggcgaggagcgagagcagacucaccgggcuguguucagguucaucccgcggcauccagacgagcuggagcuggauguggaugacccuguguugguggaggccgaggaggacgacuucugguuccguggcuucaacaugcgcacgggggagcgcgguguguuuccugccuucuacgcccaugcggugcccggcccugccaaggaccugcuggggaguaagcggagccccugcuggguggagcgcuuugacgugcaguuccugggcuccguggaggugcccugccaccagggcaacggcauccugugugcagccaugcagaagauugccacugcccggaaacugaccguccaccugcgcccuccugccuccugugaccucgagaucucucuucggggggucaagcugagucugagcggaggagggccugaguuccagcgcugcagccauuucuuccagaugaagaacaucuccuucugcggcugccauccccgcaacagcugcuauuucggcuucaucaccaaacacccccugcugagccgcuucgccugccacgucuuugucucccaggaguccaugaggccaguggcgcagagugugggccgcgccuuccuggaguacuaccaagagcaccuggcguacgccugccccacggaggacaucuaccuggaguag

SEQ ID NO: 7886 - RNA, 933 nt, Artificial Sequence
  derived and/or modified sequence opt1 from c-Jun__Homo_sapiens__BAG57050
auggccgaccgcgccgagauguucagccuguccaccuuccacagccucuccccgcccggcugccggccgccccaggacaucagccuggaggaguucgacgacgaggaccuguccgagaucaccgacgacugcgggcucggccugagcuacgacuccgaccacugcgagaaggacagccugucccucgggcgcagcgagcagccccaccccaucugcuccuuccaggacgacuuccaggaguucgagaugaucgacgugaacggcgaggagcgggagcagacgcaccgcgcggucuuccgguucaucccccgccaccccgacgagcuggagcuggacguggacgaccccgugcucgucgaggccgaggaggacgacuucugguuccggggguucaacaugcgcaccggcgagcggggcguguucccggccuucuacgcccacgccgugcccgggcccgcgaaggaccugcugggcagcaagcgcucccccugcugggucgagcgguucgacgugcaguuccucgggagcguggaggucccgugccaccagggcaacgggauccugugcgccgccaugcagaagaucgccaccgcgcgcaagcugaccgugcaccuccggccgcccgccuccugcgaccuggagaucagccugcgcggcgugaagcucucccugagcggcgggggccccgaguuccagcggugcucccacuucuuccagaugaagaacaucagcuucugcgggugccacccccgcaacagcugcuacuucggcuucaucacgaagcacccccugcucucccgguucgccugccacgucuucgugagccaggaguccaugcgccccguggcccagagcgucggccgggccuuccuggaguacuaccaggagcaccuggcguacgccugccccaccgaggacaucuaccucgaguga

SEQ ID NO: 7887 - RNA, 933 nt, Artificial Sequence
  derived and/or modified sequence opt2 from c-Jun__Homo_sapiens__BAG57050
auggccgaccgcgccgagauguucucccucuccaccuuccacucccucuccccccccggcugccgccccccccaggacaucucccucgaggaguucgacgacgaggaccucuccgagaucaccgacgacugcggccucggccucuccuacgacuccgaccacugcgagaaggacucccucucccucggccgcuccgagcagccccaccccaucugcuccuuccaggacgacuuccaggaguucgagaugaucgacgucaacggcgaggagcgcgagcagacccaccgcgccgucuuccgcuucaucccccgccaccccgacgagcucgagcucgacgucgacgaccccguccucgucgaggccgaggaggacgacuucugguuccgcggcuucaacaugcgcaccggcgagcgcggcgucuuccccgccuucuacgcccacgccguccccggccccgccaaggaccuccucggcuccaagcgcucccccugcugggucgagcgcuucgacguccaguuccucggcuccgucgagguccccugccaccagggcaacggcauccucugcgccgccaugcagaagaucgccaccgcccgcaagcucaccguccaccuccgcccccccgccuccugcgaccucgagaucucccuccgcggcgucaagcucucccucuccggcggcggccccgaguuccagcgcugcucccacuucuuccagaugaagaacaucuccuucugcggcugccacccccgcaacuccugcuacuucggcuucaucaccaagcacccccuccucucccgcuucgccugccacgucuucgucucccaggaguccaugcgccccgucgcccaguccgucggccgcgccuuccucgaguacuaccaggagcaccucgccuacgccugccccaccgaggacaucuaccucgaguga

SEQ ID NO: 7888 - RNA, 933 nt, Artificial Sequence
  derived and/or modified sequence opt3 from c-Jun__Homo_sapiens__BAG57050
auggccgacagagcugagauguucagccuguccaccuuucacucucucucacccccuggcugcaggccaccgcaggauaucagucuugaagaguucgacgaugaagaccugagcgagauuacagaugacuguggguugggauuauccuacgauucugaccauugcgaaaaggauucgcugucacuaggucggagcgagcaaccccacccuauauguaguuuucaggacgauuuccaggaguuugaaaugaucgacgugaacggcgaggaacgcgagcagacucaucgagcagucuuccguuuuauuccaagacaccccgaugagcucgaacuggacguugacgauccugugcuuguagaggccgaagaggacgauuucugguuuaggggguucaauaugcggacgggagaacgcggcguguuuccagcguucuaugcucaugccguccccgguccugcaaaagaccuguugggguccaagagaucuccaugcuggguggagagguuugauguucaauuccucggaagcguggaggucccgugucaccagggcaacggcauccugugcgccgcuaugcagaaaauugcaaccgcccggaagcugacagugcaccuccgacccccugcuuccugugacuuagaaaucucacugcgcgggguaaaacuuaguuugagcggagguggcccagaguuccagagaugcucucacuuuuuccaaaugaagaauauauccuuuugugggugccaucccaggaacucauguuacuucggauuuaucacuaagcauccucugcuaagccgguucgccugccacguuuuugugagucaggaaucuaugcguccagucgcgcaguccgugggccgcgcauuccucgaguauuaccaggaacaccuggccuaugcuugccccaccgaggauauuuaccuugaguga

SEQ ID NO: 7889 - RNA, 933 nt, Artificial Sequence
  derived and/or modified sequence opt4 from c-Jun__Homo_sapiens__BAG57050
auggccgacagagccgagauguucagccugagcaccuuccacagccugagcccccccggcugcagacccccccaggacaucagccuggaggaguucgacgacgaggaccugagcgagaucaccgacgacugcggccugggccugagcuacgacagcgaccacugcgagaaggacagccugagccugggcagaagcgagcagccccaccccaucugcagcuuccaggacgacuuccaggaguucgagaugaucgacgugaacggcgaggagagagagcagacccacagagccguguucagauucauccccagacaccccgacgagcuggagcuggacguggacgaccccgugcugguggaggccgaggaggacgacuucugguucagaggcuucaacaugagaaccggcgagagaggcguguuccccgccuucuacgcccacgccgugcccggccccgccaaggaccugcugggcagcaagagaagccccugcuggguggagagauucgacgugcaguuccugggcagcguggaggugcccugccaccagggcaacggcauccugugcgccgccaugcagaagaucgccaccgccagaaagcugaccgugcaccugagaccccccgccagcugcgaccuggagaucagccugagaggcgugaagcugagccugagcggcggcggccccgaguuccagagaugcagccacuucuuccagaugaagaacaucagcuucugcggcugccaccccagaaacagcugcuacuucggcuucaucaccaagcacccccugcugagcagauucgccugccacguguucgugagccaggagagcaugagacccguggcccagagcgugggcagagccuuccuggaguacuaccaggagcaccuggccuacgccugccccaccgaggacaucuaccuggaguga

SEQ ID NO: 7890 - RNA, 933 nt, Artificial Sequence
  derived and/or modified sequence opt5 from c-Jun__Homo_sapiens__BAG57050
auggccgacagagcugagauguucagccuguccaccuuucacucucucagcccucccggcugccggccgccccaggauaucucccuggaagaguucgacgaugaagaccuuucugagauuacagaugacugugggcugggacucagcuacgauuccgaccauugcgaaaaggauucucugagccuuggccgcuccgagcaaccucaccccaucuguagcuuucaggacgauuuccaggaguuugaaaugauugacgugaacggggaggaaagagagcagacgcaucgggccgucuuccgcuuuaucccuagacaccccgaugagcuggaacucgacguugacgauccugugcugguggaggcggaagaggacgauuucugguuucggggauucaauaugcgcaccggcgaaagaggggucuuuccggcuuucuaugcccaugccgugcccggaccugcuaaagaccugcucggcucuaagcggucccccugcuggguugagcgcuuugaugugcaauuccugggcagcgucgaggugccuugucaccaggggaacggcauucuuugcgccgcuaugcagaaaaucgccacagcgagaaagcugaccguucaccuccggcccccggccucuugugaccuggaaaucucccuucgcggagugaaacugagccucucugggggaggcccugaguuccagagaugcucccacuuuuuccaaaugaagaauauuagcuuuugugggugccauccccggaacuccuguuacuucggauuuaucacaaagcauccucugcugucucgcuucgcuugccacgucuuugugagccaggaauccaugagacccguggcccagagcgucggccgggcuuuccucgaguauuaccaggaacaccuggccuaugcgugccccaccgaggauauuuaccuugaguga

SEQ ID NO: 7891 - protein, 547 aa, Artificial Sequence
  c-Jun__Homo_sapiens__B4DFU7
MADRAEMFSLSTFHSLSPPGCRPPQDISLEEFDDEDLSEITDDCGLGLSYDSDHCEKDSLSLGRSEQPHPICSFQDDFQEFEMIDDNEEEDDEDEEEEEEEEEGDGEGQEGGDPGSEAPAPGPLIPSPSVEEPHKHRPTTLRLTTLGAQDSLNNNGGFDLVRPASWQETALCSPAPEALRELPGPLPATDTGPGGAQSPVRPGCDCEGNRPAEPPAPGGTSPSSDPGIEADLRSRSSGGRGGRRSSQELSSPGSDSEDAGGARLGRMISSISETELELSSDGGSSSSGRSSHLTFSKKFLNVFVNSTSRSSSTESFGLFSCLVNGEEREQTHRAVFRFIPRHPDELELDVDDPVLVEAEEDDFWFRGFNMRTGERGVFPAFYAHAVPGPAKDLLGSKRSPCWVERFDVQFLGSVEVPCHQGNGILCAAMQKIATARKLTVHLRPPASCDLEISLRGVKLSLSGGGPEFQRCSHFFQMKNISFCGCHPRNSCYFGFITKHPLLSRFACHVFVSQESMRPVAQSVGRAFLEYYQEHLAYACPTEDIYLE

SEQ ID NO: 7892 - RNA, 1644 nt, Artificial Sequence
  c-Jun__Homo_sapiens__BAG57558
auggcggaucgcgcggagauguuuucucucuccaccuuccacucgcugucgccgccgggcugcaggccuccccaggacauaagccuggaagaauuugacgacgaagaucugucugagaucacugaugacuguggccugggccucagcuacgacucagaccacugugagaaggacagccucucccuggggcgcucggagcagccgcaccccaucugcuccuuccaggaugacuuccaggaguuugagaugaucgaugacaaugaagaggaggacgaugaggacgaggaagaggaggaggaggaggaggagggagauggggaaggccaggagggaggagacccuggcucagaggcaccugcccccgggccccuuauccccuccccuuccguggaggagccccacaagcaccggcccaccacccuccgucugaccacacugggggcccaggacucccuaaacaacaacggaggcuuugaccuggugcguccggccuccuggcaggagacagcgcuaugcucacccgccccggaggcccucagagagcucccgggcccccucccugccacggacaccgggcccggcggggcgcagucgccagugcgcccggguugcgacugcgaagggaaccggccugcggaaccccccgcgccaggggggacuucgcccuccucagaucccggcaucgaggcugaccugagaagccgcucgagcggcggccgcgggggacgucgcagcagccaggagcuguccucgcccggcuccgacucggaggacgcgggcggcgcgcgccuggggcgcaugaucucguccaucucggagacggagcuggagcugagcagcgauggcggaagcagcagcagcggccgcuccucgcaccucacuuucuccaagaaguuccucaaugucuucgucaacagcacaucucgguccuccagcaccgaguccuuuggccuuuucuccugucuggucaacggcgaggagcgagagcagacucaccgggcuguguucagguucaucccgcggcauccagacgagcuggagcuggauguggaugacccuguguugguggaggccgaggaggacgacuucugguuccguggcuucaacaugcgcacgggggagcgcgguguguuuccugccuucuacgcccaugcggugcccggcccugccaaggaccugcuggggaguaagcggagccccugcuggguggagcgcuuugacgugcaguuccugggcuccguggaggugcccugccaccagggcaacggcauccugugugcagccaugcagaagauugccacugcccggaaacugaccguccaccugcgcccuccugccuccugugaccucgagaucucucuucggggggucaagcugagucugagcggaggagggccugaguuccagcgcugcagccauuucuuccagaugaagaacaucuccuucugcggcugccauccccgcaacagcugcuauuucggcuucaucaccaaacacccccugcugagccgcuucgccugccacgucuuugucucccaggaguccaugaggccgguggcgcagagugugggccgcgccuuccuggaguacuaccaagagcaccuggcguacgccugccccacggaggacaucuaccuggaguag

SEQ ID NO: 7893 - RNA, 1644 nt, Artificial Sequence
  derived and/or modified sequence opt1 from c-Jun__Homo_sapiens__BAG57558
auggccgaccgcgccgagauguucagccuguccaccuuccacagccucuccccgcccggcugccggccgccccaggacaucagccuggaggaguucgacgacgaggaccuguccgagaucaccgacgacugcgggcucggccugagcuacgacuccgaccacugcgagaaggacagccugucccucgggcgcagcgagcagccccaccccaucugcuccuuccaggacgacuuccaggaguucgagaugaucgacgacaacgaggaggaggacgacgaggacgaggaggaggaggaggaggaggaggagggcgacggggagggccaggagggcggggaccccggcagcgaggcgcccgcccccgggccgcugauccccucccccagcguggaggagccccacaagcaccggccgacgacccugcgccucaccacccugggcgcccaggacucccugaacaacaacgggggcuucgaccucguccggcccgccagcuggcaggagacggcccugugcucccccgcgcccgaggcccugcgcgagcucccgggcccccugcccgccaccgacaccgggcccggcggggcccagagcccggugcggcccggcugcgacugcgagggcaaccgccccgcggagcccccggcccccgggggcaccucccccagcagcgaccccgggaucgaggccgaccugcggucccgcagcuccggcgggcggggcggccgccggagcucccaggagcucagcuccccggggagcgacuccgaggacgccggcggggcccgccugggccggaugaucagcuccaucagcgagacggagcuggagcucuccagcgacgggggcuccagcuccagcggccgcuccagccaccugaccuucagcaagaaguuccugaacguguucgucaacuccaccagccgguccagcuccaccgagagcuucgggcuguucuccugccuggugaacggcgaggagcgcgagcagacgcaccgggcgguguuccgcuucaucccccggcaccccgacgagcuggagcucgacgucgacgacccggugcugguggaggccgaggaggacgacuucugguuccgcggguucaacaugcgcaccggcgagcgcggggucuuccccgccuucuacgcccacgccgugcccggccccgcgaaggaccugcucggcagcaagcgguccccgugcuggguggagcgguucgacguccaguuccuggggagcguggaggugcccugccaccagggcaacgggauccugugcgccgccaugcagaagaucgccaccgcccgcaagcucaccguccaccuccggccgcccgcguccugcgaccuggagaucagccuccgcggcgugaagcugucccugagcggcgggggccccgaguuccagcggugcucccacuucuuccagaugaagaacaucagcuucugcgggugccacccccgcaacuccugcuacuucggcuucaucacgaagcacccccuccugagccgguucgccugccacguguucgucagccaggaguccaugcgccccguggcccagagcguggggcgggccuuccuggaguacuaccaggagcaccucgccuacgcgugcccgaccgaggacaucuaccuggaguga

SEQ ID NO: 7894 - RNA, 1644 nt, Artificial Sequence
  derived and/or modified sequence opt2 from c-Jun__Homo_sapiens__BAG57558
auggccgaccgcgccgagauguucucccucuccaccuuccacucccucuccccccccggcugccgccccccccaggacaucucccucgaggaguucgacgacgaggaccucuccgagaucaccgacgacugcggccucggccucuccuacgacuccgaccacugcgagaaggacucccucucccucggccgcuccgagcagccccaccccaucugcuccuuccaggacgacuuccaggaguucgagaugaucgacgacaacgaggaggaggacgacgaggacgaggaggaggaggaggaggaggaggagggcgacggcgagggccaggagggcggcgaccccggcuccgaggcccccgcccccggcccccucauccccucccccuccgucgaggagccccacaagcaccgccccaccacccuccgccucaccacccucggcgcccaggacucccucaacaacaacggcggcuucgaccucguccgccccgccuccuggcaggagaccgcccucugcucccccgcccccgaggcccuccgcgagcuccccggcccccuccccgccaccgacaccggccccggcggcgcccagucccccguccgccccggcugcgacugcgagggcaaccgccccgccgagccccccgcccccggcggcaccucccccuccuccgaccccggcaucgaggccgaccuccgcucccgcuccuccggcggccgcggcggccgccgcuccucccaggagcucuccucccccggcuccgacuccgaggacgccggcggcgcccgccucggccgcaugaucuccuccaucuccgagaccgagcucgagcucuccuccgacggcggcuccuccuccuccggccgcuccucccaccucaccuucuccaagaaguuccucaacgucuucgucaacuccaccucccgcuccuccuccaccgaguccuucggccucuucuccugccucgucaacggcgaggagcgcgagcagacccaccgcgccgucuuccgcuucaucccccgccaccccgacgagcucgagcucgacgucgacgaccccguccucgucgaggccgaggaggacgacuucugguuccgcggcuucaacaugcgcaccggcgagcgcggcgucuuccccgccuucuacgcccacgccguccccggccccgccaaggaccuccucggcuccaagcgcucccccugcugggucgagcgcuucgacguccaguuccucggcuccgucgagguccccugccaccagggcaacggcauccucugcgccgccaugcagaagaucgccaccgcccgcaagcucaccguccaccuccgcccccccgccuccugcgaccucgagaucucccuccgcggcgucaagcucucccucuccggcggcggccccgaguuccagcgcugcucccacuucuuccagaugaagaacaucuccuucugcggcugccacccccgcaacuccugcuacuucggcuucaucaccaagcacccccuccucucccgcuucgccugccacgucuucgucucccaggaguccaugcgccccgucgcccaguccgucggccgcgccuuccucgaguacuaccaggagcaccucgccuacgccugccccaccgaggacaucuaccucgaguga

SEQ ID NO: 7895 - RNA, 1644 nt, Artificial Sequence
  derived and/or modified sequence opt3 from c-Jun__Homo_sapiens__BAG57558
auggccgacagagcugagauguucagccuguccaccuuucacucucucucacccccuggcugcaggccaccgcaggauaucagucuugaagaguucgacgaugaagaccugagcgagauuacagaugacuguggguugggauuauccuacgauucugaccauugcgaaaaggauucgcugucacuaggucggagcgagcaaccccacccuauauguaguuuucaggacgauuuccaggaguuugaaaugaucgacgauaacgaggaagaggacgacgaggaugaagaggaagaggaagaggaggaagagggcgacggggaaggacaggagggcggugauccaggguccgaagcacccgccccuggaccacucauucccucuccuagcguggaggagccacauaaacaccgcccgacuacgcugcgacuuaccacacugggcgcgcaagacuccuugaauaacaauggcggguucgaucucguccgucccgcuucauggcaggaaacugcccugugcaguccugcaccagaggcccugagagaacuccccggaccuuuaccagcuaccgacacaggucccggcggggcacagagcccgguuaggccuggaugugauugcgagggcaaccggcccgccgaacccccugcucccggugggaccucuccauccucagaccccggaaucgaggccgaucugcgcagcagaaguucuggcggcaggggaggacggcgcuccagccaggagcuuucgucuccugguuccgacucagaagaugcgggcggggcacgauugggaagaaugauuaguagcaucuccgagacugaacuggagcuaucuagcgacggcgguucaaguuccagcgggaggucuucacaucucacauuuaguaagaaauuccugaauguguuuguaaacagcaccucccggucuucgagcacggaguccuucggccuguuuucaugucuugugaauggagaggaacgugaacaaacucaccgcgccgucuucagauuuauaccaaggcacccggacgaguuggaacucgauguggacgaucccguucugguggaggcugaggaagacgauuucugguuccggggcuuuaacaugcgaaccggggagcgcggagucuucccugccuuuuaugcacaugcugugccaggucccgccaaggacuuacugggcaguaaaagaucuccuugcuggguagaaagguucgauguucaguuucucgggagcguggaggucccaugucaccagggaaauggcauccuuugcgcggccaugcagaagauugcaacagcucggaagcugacugugcauuugcgcccaccggccuccugugaccuagaaaucucacugagaggugugaaacucagccugucugggggcggaccugaguuccaaaggugcucccacuuuuuccagaugaagaacauuaguuuuugcggcugucacccacguaauagcugcuacuucggguuuaucaccaaacauccccuucugucucgguucgcuugucacgucuuuguuucccaggagucaaugcgaccuguggcccaaaguguagggagagcauucuuggaauauuaccaggagcaucucgccuaugcuugccccacagaagauauauaccuggaguga

SEQ ID NO: 7896 - RNA, 1644 nt, Artificial Sequence
  derived and/or modified sequence opt4 from c-Jun__Homo_sapiens__BAG57558
auggccgacagagccgagauguucagccugagcaccuuccacagccugagcccccccggcugcagacccccccaggacaucagccuggaggaguucgacgacgaggaccugagcgagaucaccgacgacugcggccugggccugagcuacgacagcgaccacugcgagaaggacagccugagccugggcagaagcgagcagccccaccccaucugcagcuuccaggacgacuuccaggaguucgagaugaucgacgacaacgaggaggaggacgacgaggacgaggaggaggaggaggaggaggaggagggcgacggcgagggccaggagggcggcgaccccggcagcgaggcccccgcccccggcccccugauccccagccccagcguggaggagccccacaagcacagacccaccacccugagacugaccacccugggcgcccaggacagccugaacaacaacggcggcuucgaccuggugagacccgccagcuggcaggagaccgcccugugcagccccgcccccgaggcccugagagagcugcccggcccccugcccgccaccgacaccggccccggcggcgcccagagccccgugagacccggcugcgacugcgagggcaacagacccgccgagccccccgcccccggcggcaccagccccagcagcgaccccggcaucgaggccgaccugagaagcagaagcagcggcggcagaggcggcagaagaagcagccaggagcugagcagccccggcagcgacagcgaggacgccggcggcgccagacugggcagaaugaucagcagcaucagcgagaccgagcuggagcugagcagcgacggcggcagcagcagcagcggcagaagcagccaccugaccuucagcaagaaguuccugaacguguucgugaacagcaccagcagaagcagcagcaccgagagcuucggccuguucagcugccuggugaacggcgaggagagagagcagacccacagagccguguucagauucauccccagacaccccgacgagcuggagcuggacguggacgaccccgugcugguggaggccgaggaggacgacuucugguucagaggcuucaacaugagaaccggcgagagaggcguguuccccgccuucuacgcccacgccgugcccggccccgccaaggaccugcugggcagcaagagaagccccugcuggguggagagauucgacgugcaguuccugggcagcguggaggugcccugccaccagggcaacggcauccugugcgccgccaugcagaagaucgccaccgccagaaagcugaccgugcaccugagaccccccgccagcugcgaccuggagaucagccugagaggcgugaagcugagccugagcggcggcggccccgaguuccagagaugcagccacuucuuccagaugaagaacaucagcuucugcggcugccaccccagaaacagcugcuacuucggcuucaucaccaagcacccccugcugagcagauucgccugccacguguucgugagccaggagagcaugagacccguggcccagagcgugggcagagccuuccuggaguacuaccaggagcaccuggccuacgccugccccaccgaggacaucuaccuggaguga

SEQ ID NO: 7897 - RNA, 1644 nt, Artificial Sequence
  derived and/or modified sequence opt5 from c-Jun__Homo_sapiens__BAG57558
auggccgacagagcugagauguucagccuguccaccuuucacucucucagcccucccggcugccggccgccccaggauaucucccuggaagaguucgacgaugaagaccuuucugagauuacagaugacugugggcugggacucagcuacgauuccgaccauugcgaaaaggauucucugagccuuggccgcuccgagcaaccucaccccaucuguagcuuucaggacgauuuccaggaguuugaaaugauugacgauaacgaggaagaggacgacgaggaugaagaggaagaggaagaggaggaagagggggacggagaaggccaggaagggggagauccuggcucugaggcccccgcgccuggcccgcugauccccuccccuagcguggaggagccccauaaacacagaccuacgacccuccggcugacaacccugggggcucaagacucucucaauaacaauggaggcuucgaucugguccgccccgccuccuggcaggaaacagcccuuugcagcccggcuccugaggcccugagagaacuccccgggccucugcccgcuaccgacacaggacccggcggggcccagucuccuguucggccgggaugugauugcgagggcaaccgccccgcggaaccucccgccccuggcgggaccucccccagcuccgacccgggaauugaggcugaucuuagaucucggagcuccggcgggcgcggaggcagacggagcucucaggagcuguccagcccugggucugacagcgaagaugccggaggcgcucgccucggcagaaugaucuccucuaucagcgagacggaacuggagcuguccagcgacgggggaucuuccagcucuggccgguccagccaucucaccuuuuccaagaaauuccugaauguguuugugaacucuacaagccgcuccucuagcaccgaguccuucgggcuuuuuagcugucuggucaauggagaagagagagaacaaacacaccgggccguguucagauuuauuccccgccacccugacgagcucgaacuggauguugacgaucccgugcuugucgaggcggaggaagacgauuucugguuccggggcuuuaacaugagaaccggggagcgcggcguguucccugccuuuuaugcucaugccguucccggaccggcuaaggaccugcucggcucuaaacgguccccuugcuggguggaaagauucgauguccaguuucuggggagcguggaggugcccugucaccagggaaauggcauccugugcgccgccaugcagaagauugcuacggcgcgcaagcucacaguccaucugcggcccccugccucuugugaccuugaaaucucccugagagggguuaaacucagccugucuggaggcgggccggaguuccaacgcugcagccacuuuuuccagaugaagaacauuuccuuuugcggcugucacccccggaauagcugcuacuucggauuuaucaccaaacauccucuucugucuagauucgcuugucacguguuugugucccaggagagcaugcgccccgucgcccaauccgugggccgggccuuccucgaauauuaccaggagcaucuggcuuaugccugcccuacagaagauauuuaccuggaguga

SEQ ID NO: 7898 - protein, 176 aa, Artificial Sequence
  c-Jun__Homo_sapiens__B4DGE1
MPAPIRLRELIRTIRTARTQAEEREMIQKECAAIRSSFREEDNTYRCRNVAKLLYMHMLGYPAHFGQLECLKLIASQKFTDKRIGYLGAMLLLDERQDVHLLMTNCIKNDLNHSTQFVQGLALCTLGCMGSSEMCRDLAGEVEKLLKTSNSYLRKKEMIYKQTNVTGYILGGIPNS

SEQ ID NO: 7899 - RNA, 531 nt, Artificial Sequence
  c-Jun__Homo_sapiens__BAG57752
augccagcccccaucagauugcgggagcugauccggaccauccggacagcccgaacccaagcugaagaacgagaaaugauccagaaagaaugugcugcaauccggucaucuuuuagagaagaagacaauacauaccgaugucggaauguggcaaaauuacuguauaugcacaugcugggcuacccugcucacuuuggacaguuggagugccucaagcuuauugccucucaaaaauuuacagacaaacgcauuggcuauuuaggggcaaugcugcuguuagaugaaagacaagauguccaucuucucaugaccaacuguaucaagaaugaucuuaaucauagcacgcaauucguacagggguuagcacuuuguacccucggcugcaugggcuccucagagaugugcagagaucuugcaggagagguagagaagcuccugaaaaccuccaacucuuacuuaagaaaaaaggaaaugauuuauaaacaaacaaauguuacuggauauauccuagguggcauaccaaauuccuaa

SEQ ID NO: 7900 - RNA, 531 nt, Artificial Sequence
  derived and/or modified sequence opt1 from c-Jun__Homo_sapiens__BAG57752
augcccgccccgauccgccugcgggagcucauccgcaccauccggaccgcccgcacgcaggcggaggagcgggagaugauccagaaggagugcgccgccauccgcagcuccuuccgggaggaggacaacaccuaccgcugccggaacguggccaagcugcuguacaugcacaugcucggcuaccccgcccacuucgggcagcuggagugccugaagcucaucgcgagccagaaguucaccgacaagcgcaucggcuaccugggggccaugcugcuccuggacgagcggcaggacguccaccuccugaugaccaacugcaucaagaacgaccugaaccacuccacgcaguucgugcagggccuggcccucugcacccuggggugcaugggcagcuccgagaugugccgcgaccuggccggcgagguggagaagcuccugaagaccagcaacuccuaccugcggaagaaggagaugaucuacaagcagaccaacgucacgggguacauccucggcgggauccccaacagcuga

SEQ ID NO: 7901 - RNA, 531 nt, Artificial Sequence
  derived and/or modified sequence opt2 from c-Jun__Homo_sapiens__BAG57752
augcccgcccccauccgccuccgcgagcucauccgcaccauccgcaccgcccgcacccaggccgaggagcgcgagaugauccagaaggagugcgccgccauccgcuccuccuuccgcgaggaggacaacaccuaccgcugccgcaacgucgccaagcuccucuacaugcacaugcucggcuaccccgcccacuucggccagcucgagugccucaagcucaucgccucccagaaguucaccgacaagcgcaucggcuaccucggcgccaugcuccuccucgacgagcgccaggacguccaccuccucaugaccaacugcaucaagaacgaccucaaccacuccacccaguucguccagggccucgcccucugcacccucggcugcaugggcuccuccgagaugugccgcgaccucgccggcgaggucgagaagcuccucaagaccuccaacuccuaccuccgcaagaaggagaugaucuacaagcagaccaacgucaccggcuacauccucggcggcauccccaacuccuga

SEQ ID NO: 7902 - RNA, 531 nt, Artificial Sequence
  derived and/or modified sequence opt3 from c-Jun__Homo_sapiens__BAG57752
augccggccccuaucagacugagggagcucauucggaccauacgcacagcucgaacucaggcagaggaacgugaaaugauccaaaaggagugcgccgcgauuagaagcuccuucagggaagaggacaacacguaccggugucgcaauguggcuaaacuucuguauaugcacauguugggauacccagcccauuuugggcaguuagagugccugaagcuaaucgcaucucagaaauucaccgauaagagaauuggauaucucggugccaugcugcuucuggacgaaaggcaggauguccacuugcucaugacaaacuguaucaaaaaugaccugaaccauucaacucaauuuguucagggccuggcucucugcaccuuaggguguaugggaaguagcgagaugugccgggaucuggcaggcgaaguggagaaacuuuugaagacauccaauucuuaccugcgcaagaaggagaugauauauaaacagaccaacguaacugguuacauccuagggggcauucccaauucguga

SEQ ID NO: 7903 - RNA, 531 nt, Artificial Sequence
  derived and/or modified sequence opt4 from c-Jun__Homo_sapiens__BAG57752
augcccgcccccaucagacugagagagcugaucagaaccaucagaaccgccagaacccaggccgaggagagagagaugauccagaaggagugcgccgccaucagaagcagcuucagagaggaggacaacaccuacagaugcagaaacguggccaagcugcuguacaugcacaugcugggcuaccccgcccacuucggccagcuggagugccugaagcugaucgccagccagaaguucaccgacaagagaaucggcuaccugggcgccaugcugcugcuggacgagagacaggacgugcaccugcugaugaccaacugcaucaagaacgaccugaaccacagcacccaguucgugcagggccuggcccugugcacccugggcugcaugggcagcagcgagaugugcagagaccuggccggcgagguggagaagcugcugaagaccagcaacagcuaccugagaaagaaggagaugaucuacaagcagaccaacgugaccggcuacauccugggcggcauccccaacagcuga

SEQ ID NO: 7904 - RNA, 531 nt, Artificial Sequence
  derived and/or modified sequence opt5 from c-Jun__Homo_sapiens__BAG57752
augcccgccccuaucagacugcgggagcucauucgcaccaucagaacagcucggacgcaggccgaggaacgcgaaaugauucaaaaggagugcgcggcuaucagaagcuccuuccgggaagaggacaacaccuaccgcuguagaaauguggccaaacugcuuuauaugcacaugcugggcuacccggcccauuuugggcagcucgagugccugaaacuuauugcuucucagaaguucacagauaagcggaucggauaucugggcgccaugcuccugcuggacgaacgccaggauguccaccuccugaugaccaacuguaucaaaaaugaccuuaaccauagcacacaauuuguucaggggcuggcucucugcacccugggauguaugggcuccucugagaugugcagagaucuugccggggaaguggagaagcugcucaagacaagcaauuccuaccugcggaaaaaggagaugauuuauaaacagaccaacgugacgggauacauccugggcggcauucccaauucuuga

SEQ ID NO: 7905 - protein, 467 aa, Artificial Sequence
  c-Jun__Homo_sapiens__B4DJ64
MAPPGGPPAAPPGGRGHSHRDRIHYQADVRLEATEEIYLTPVQRPPDAAEPTSAFLPPTESRMSVSSDPDPAAYPSTAGRPHPSISEEEEGFDCLSSPERAEPPGGGWRGSLGEPPPPPRASLSSDTSALSYDSVKYTLVVDEHAQLELVSLRPCFGDYSDESDSATVYDNCASVSSPYESAIGEEYEEAPRPQPPACLSEDSTPDEPDVHFSKKFLNVFMSGRSRSSSAESFGLFSCIINGEEQEQTHRAIFRFVPRHEDELELEVDDPLLVELQAEDYWYEAYNMRTGARGVFPAYYAIEVTKEPEHMAALAKNSDWVDQFRVKFLGSVQVPYHKGNDVLCAAMQKIATTRRLTVHFNPPSSCVLEISVRGVKIGVKADDSQEAKGNKCSHFFQLKNISFCGYHPKNNKYFGFITKHPADHRFACHVFVSEDSTKALAESVGRAFQQFYKQFVEYTCPTEDIYLE

SEQ ID NO: 7906 - RNA, 1404 nt, Artificial Sequence
  c-Jun__Homo_sapiens__BAG58726
auggcaccuccggguggucccccugcugccccgccugggggucggggccacucgcaucgagaccgaauccacuaccaggccgaugugcgacuagaggccacugaggagaucuaccugaccccagugcagaggcccccagacgcugcagagcccaccuccgccuuccugccgcccacugagagccggaugucagucagcuccgauccagacccugccgccuaccccuccacggcagggcggccgcaccccuccaucagugaagaggaagagggcuucgacugccugucguccccagagcgggcugagcccccaggcggaggguggcgggggagccugggggagccgccgccaccuccacgggccucucugagcucggacaccagcgcccuguccuaugacucugucaaguacacgcuggugguagaugagcaugcacagcuggagcuggugagccugcggccgugcuucggagacuacagugacgagagugacucugccaccgucuaugacaacugugccuccgucuccucgcccuaugagucggccaucggagaggaauaugaggaggccccgcggccccagcccccugccugccucuccgaggacuccacgccugaugaacccgacguccauuucuccaagaaauuccugaacgucuucaugaguggccgcucccgcuccuccagugcugaguccuucgggcuguucuccugcaucaucaacggggaggagcaggagcagacccaccgggccauauucagguuugugccucgacacgaagacgaacuugagcuggaaguggaugacccucugcuaguggagcuccaggcugaagacuacugguacgaggccuacaacaugcgcacuggugcccggggugucuuuccugccuauuacgccaucgaggucaccaaggagcccgagcacauggcagcccuggccaaaaacagugacuggguggaccaguuccgggugaaguuccugggcucaguccagguucccuaucacaagggcaaugacguccucugugcugcuaugcaaaagauugccaccacccgccggcucaccgugcacuuuaacccgcccuccagcuguguccuggagaucagcgugcggggugugaagauaggcgucaaggccgaugacucccaggaggccaaggggaauaaauguagccacuuuuuccaguuaaaaaacaucucuuucugcggauaucauccaaagaacaacaaguacuuuggguucaucaccaagcaccccgccgaccaccgguuugccugccacgucuuugugucugaagacuccaccaaagcccuggcagaguccguggggagagcauuccagcaguucuacaagcaguuuguggaguacaccugccccacagaagauaucuaccuggaguag

SEQ ID NO: 7907 - RNA, 1404 nt, Artificial Sequence
  derived and/or modified sequence opt1 from c-Jun__Homo_sapiens__BAG58726
auggccccgcccggcgggccgcccgccgcgccgcccggcgggcgcggccacagccaccgggaccgcauccacuaccaggccgacgugcggcuggaggccaccgaggagaucuaccucacccccguccagcgcccgcccgacgccgccgagcccacguccgcguuccugccgcccaccgagagccggauguccgugagcuccgaccccgaccccgccgccuaccccagcaccgccgggcgcccccaccccuccaucagcgaggaggaggagggcuucgacugccuguccagccccgagcgggcggagccgcccggcgggggcuggcgcgggucccucggcgagcccccgcccccgccccgggccagccuguccagcgacaccuccgcccugagcuacgacuccgugaaguacacgcucgucguggacgagcacgcccagcuggagcuggugagccuccgccccugcuucggggacuacuccgacgagagcgacagcgccaccgucuacgacaacugcgcguccgugagcucccccuacgagagcgccaucggcgaggaguacgaggaggcgccccggccccagccgcccgccugccuguccgaggacagcacccccgacgagcccgacgugcacuucuccaagaaguuccugaacgucuucaugagcggccgcucccggagcuccagcgccgaguccuucggccucuucagcugcaucaucaacggggaggagcaggagcagacccaccgcgccaucuuccgguucgugccccgccacgaggacgagcuggagcuggagguggacgacccccuccuggucgagcugcaggccgaggacuacugguacgaggccuacaacaugcggacgggggcccgcggcguguuccccgccuacuacgcgaucgaggugaccaaggagccggagcacauggccgcccucgccaagaacuccgacugggucgaccaguuccgggugaaguuccugggcagcgugcagguccccuaccacaaggggaacgacgugcugugcgccgcgaugcagaagaucgccaccacccgccggcucacggugcacuucaacccgcccuccagcugcguccuggagaucuccgugcgcggcgugaagaucggggucaaggccgacgacagccaggaggccaagggcaacaagugcagccacuucuuccagcugaagaacaucuccuucugcggguaccaccccaagaacaacaaguacuucggcuucaucaccaagcaccccgcggaccaccgcuucgccugccacguguucgucagcgaggacuccaccaaggcccucgccgagagcgugggccgggccuuccagcaguucuacaagcaguucguggaguacacgugccccaccgaggacaucuaccuggaguga

SEQ ID NO: 7908 - RNA, 1404 nt, Artificial Sequence
  derived and/or modified sequence opt2 from c-Jun__Homo_sapiens__BAG58726
auggccccccccggcggcccccccgccgccccccccggcggccgcggccacucccaccgcgaccgcauccacuaccaggccgacguccgccucgaggccaccgaggagaucuaccucacccccguccagcgcccccccgacgccgccgagcccaccuccgccuuccucccccccaccgagucccgcauguccgucuccuccgaccccgaccccgccgccuaccccuccaccgccggccgcccccaccccuccaucuccgaggaggaggagggcuucgacugccucuccucccccgagcgcgccgagccccccggcggcggcuggcgcggcucccucggcgagccccccccccccccccgcgccucccucuccuccgacaccuccgcccucuccuacgacuccgucaaguacacccucgucgucgacgagcacgcccagcucgagcucgucucccuccgccccugcuucggcgacuacuccgacgaguccgacuccgccaccgucuacgacaacugcgccuccgucuccucccccuacgaguccgccaucggcgaggaguacgaggaggccccccgcccccagccccccgccugccucuccgaggacuccacccccgacgagcccgacguccacuucuccaagaaguuccucaacgucuucauguccggccgcucccgcuccuccuccgccgaguccuucggccucuucuccugcaucaucaacggcgaggagcaggagcagacccaccgcgccaucuuccgcuucgucccccgccacgaggacgagcucgagcucgaggucgacgacccccuccucgucgagcuccaggccgaggacuacugguacgaggccuacaacaugcgcaccggcgcccgcggcgucuuccccgccuacuacgccaucgaggucaccaaggagcccgagcacauggccgcccucgccaagaacuccgacugggucgaccaguuccgcgucaaguuccucggcuccguccagguccccuaccacaagggcaacgacguccucugcgccgccaugcagaagaucgccaccacccgccgccucaccguccacuucaacccccccuccuccugcguccucgagaucuccguccgcggcgucaagaucggcgucaaggccgacgacucccaggaggccaagggcaacaagugcucccacuucuuccagcucaagaacaucuccuucugcggcuaccaccccaagaacaacaaguacuucggcuucaucaccaagcaccccgccgaccaccgcuucgccugccacgucuucgucuccgaggacuccaccaaggcccucgccgaguccgucggccgcgccuuccagcaguucuacaagcaguucgucgaguacaccugccccaccgaggacaucuaccucgaguga

SEQ ID NO: 7909 - RNA, 1404 nt, Artificial Sequence
  derived and/or modified sequence opt3 from c-Jun__Homo_sapiens__BAG58726
auggcucccccuggcgggccaccggccgcacccccuggagguagaggccacagccauagggaccggauccacuaccaggccgaugugcgccuggaggcgaccgaagagauuuaucucacaccaguccaacgacccccugacgcugccgaaccaacuuccgcauuccuucccccuacggagucucguaugucaguuaguagcgauccagacccggccgcuuaccccuccaccgcagggagaccucauccaucuauaucggaagaggaggaaggauuugauugccugucaagccccgagagggccgaaccuccaggcgguggguggcggggaaguuugggcgagcccccgccucccccacgcgcuuccuuaucuagcgacacauccgcccugucauaugauagugugaaguacacucuaguaguggacgagcacgcgcagcucgaacuggucagccuuagaccuuguuucggcgauuauucugacgaguccgauucagcaaccguguacgacaacugcgccagcguuaguucucccuaugaauccgcuaucggggaggaauacgaggaggccccaaggccccagccuccagcaugucugagcgaagauucgacaccggacgagcccgacgugcauuuuucuaaaaaguucuugaaugucuuuauguccggacggucacgcaguagcuccgcugaaucuuucggucucuuuagcugcauuaucaacggcgaggaacaggagcaaacccaccgagccauuuucagauuugugccuaggcacgaggaugaacuggagcuggaaguagacgauccacucuuaguugagcugcaggcggaagacuacugguaugaggccuacaauaugcggacuggggcacguggaguguuccccgcuuauuacgccaucgaggucacaaaagaaccugagcauauggcugcccuugcaaagaacucagauuggguggaccaguuucgcgugaaauucuugggcaguguccagguuccauaucacaaggguaaugaugugcugugugccgcuaugcaaaagauagcgaccacgagaaggcuaacuguacauuuuaaucccccguccagcugcgugcucgaaaucucuguccgaggggugaaaauuggaguuaaggcagacgauucacaggaggccaaaggcaacaaguguagucacuucuuccagcugaaaaacaucagcuuuugcggcuaccacccuaagaauaacaaguauuucggguuuauuaccaaacauccagcugaccaccgguucgccugucauguguuugucuccgaggauucuacaaaggcacuugccgaaucggugggacgcgcuuuccagcaauuuuacaaacaguucguagaguacacuugccccaccgaagacaucuaucuggaguga

SEQ ID NO: 7910 - RNA, 1404 nt, Artificial Sequence
  derived and/or modified sequence opt4 from c-Jun__Homo_sapiens__BAG58726
auggccccccccggcggcccccccgccgccccccccggcggcagaggccacagccacagagacagaauccacuaccaggccgacgugagacuggaggccaccgaggagaucuaccugacccccgugcagagaccccccgacgccgccgagcccaccagcgccuuccugccccccaccgagagcagaaugagcgugagcagcgaccccgaccccgccgccuaccccagcaccgccggcagaccccaccccagcaucagcgaggaggaggagggcuucgacugccugagcagccccgagagagccgagccccccggcggcggcuggagaggcagccugggcgagcccccccccccccccagagccagccugagcagcgacaccagcgcccugagcuacgacagcgugaaguacacccuggugguggacgagcacgcccagcuggagcuggugagccugagacccugcuucggcgacuacagcgacgagagcgacagcgccaccguguacgacaacugcgccagcgugagcagccccuacgagagcgccaucggcgaggaguacgaggaggcccccagaccccagccccccgccugccugagcgaggacagcacccccgacgagcccgacgugcacuucagcaagaaguuccugaacguguucaugagcggcagaagcagaagcagcagcgccgagagcuucggccuguucagcugcaucaucaacggcgaggagcaggagcagacccacagagccaucuucagauucgugcccagacacgaggacgagcuggagcuggagguggacgacccccugcugguggagcugcaggccgaggacuacugguacgaggccuacaacaugagaaccggcgccagaggcguguuccccgccuacuacgccaucgaggugaccaaggagcccgagcacauggccgcccuggccaagaacagcgacuggguggaccaguucagagugaaguuccugggcagcgugcaggugcccuaccacaagggcaacgacgugcugugcgccgccaugcagaagaucgccaccaccagaagacugaccgugcacuucaacccccccagcagcugcgugcuggagaucagcgugagaggcgugaagaucggcgugaaggccgacgacagccaggaggccaagggcaacaagugcagccacuucuuccagcugaagaacaucagcuucugcggcuaccaccccaagaacaacaaguacuucggcuucaucaccaagcaccccgccgaccacagauucgccugccacguguucgugagcgaggacagcaccaaggcccuggccgagagcgugggcagagccuuccagcaguucuacaagcaguucguggaguacaccugccccaccgaggacaucuaccuggaguga

SEQ ID NO: 7911 - RNA, 1404 nt, Artificial Sequence
  derived and/or modified sequence opt5 from c-Jun__Homo_sapiens__BAG58726
auggcucccccuggcgggccgcccgccgccccucccggaggcagagggcacagccaucgggaccgcauccacuaccaggcggaugugagacuggaggcuaccgaagagauuuaucucacaccuguccaacggcccccugacgccgccgaaccgacguccgcuuuccugcccccuaccgagucucgcaugagcguuuccucugaucccgacccugccgcuuaccccagcacagccggaagaccgcauccuuccaucucugaagaggaggaaggcuuugauugccuuagcucccccgagcgggcggaaccucccgggggaggcuggcgcggcagccugggggagcccccuccgcccccuagagccucucucuccagcgacaccucugcucuguccuaugauagcgugaaguacacacuuguggucgacgagcacgcccagcuggaacucgugucucugcggcccuguuucggagauuauuccgacgagagcgauuccgcuaccguuuacgacaacugcgccucugugagcuccccuuaugaaagcgcgauuggcgaggaauacgaggaggcuccccgcccgcagccucccgccugucugucugaagauuccacaccugacgagcccgacguccauuuuagcaaaaaguuccucaauguguuuaugucugggagaagccgguccucuagcgccgaauccuucggacuguuuagcugcaucauuaacggcgaggaacaggagcaaacccaccgcgcuaucuucagauuuguuccucggcacgaggaugaacuugagcuggaaguggacgauccccuccuggucgagcuucaggccgaagacuacugguaugaggccuacaauaugcgcacgggggcuagaggaguguucccggcguauuacgccaucgaggugaccaaagaaccugagcauauggcugcccuggccaagaacucugauugggucgaccaguuucggguuaaauuccucggcuccguccaggugcccuaucacaagggcaaugaugugcugugugcugccaugcaaaagauugcgacaaccagacgccugacagugcauuuuaaucccccuagcucuugcguucucgaaaucuccgugagaggggucaaaauuggagugaaggcugacgauagccaggaggccaaaggcaacaaguguucccacuucuuccagcugaaaaacaucucuuuuugcggguaccacccgaagaauaacaaguauuucggauuuauuaccaaacaucccgccgaccaccgguucgcuugucauguuuuugugagcgaggauuccacgaaggcccuugcugaaucugucggccgcgccuuccagcaauuuuacaaacaguucguggaguacacaugcccuaccgaagacaucuaucuggaguga

SEQ ID NO: 7912 - protein, 921 aa, Artificial Sequence [sequence omitted]

SEQ ID NO: 7913 - RNA, 2766 nt, Artificial Sequence
  c-Jun__Homo_sapiens__BAG61498
augguuaugagguggggagaacggaaugacgucaucgcuugggagcugcugcaggauggaguggaaaccaaaaaugcuuugaacauagugaagaaugauuugauagcaaaaguggaugaacugaccugugagaaagaugugcugcaaggggaauuggaggcugugaagcaagccaaacugaaacuagaggaaaagaacagagaauuggaggaagagcuuaggaaagcucgggcagaaacugaagaugcaaggcaaaaagcaaaagaugacgaugauagugauauucccacagcccagaggaagcgguuuacuagaguagaaauggcccguguucucauggagcgaaaccaguauaaagagagauugauggagcuucaggaagcuguucgauggacagagaugauucgggcaucacgagaaaauccagccaugcaggaaaaaaaaaggucaagcauuuggcaguuuuucagccgacuuuucagcuccucaaguaacacgacuaagaagccugaaccaccuguuaaucugaaguacaaugcacccacgucucauguuacuccguccgucaagaaaagaagcagcaccuuaucucagcucccuggggauaaguccaaagccuuugauuuccuuagugaagaaacugaagcuaguuuagccucacgcagagaacaaaagagagagcaguaucgucagguaaaagcacauguucagaaggaagacgguagagugcaggcuuuuggcuggagucugccucagaaguacaaacagguaaccaauggucaaggcgaaaauaagaugaaaaauuuaccugugccugucuaucucagaccucuggaugaaaaagauacaucaaugaagcuguggugugcuguuggagucaauuuaucuggugggaagaccagagauggugguucuguuguuggagcaaguguauuuuacaaggauguugcugguuuggauacagaaggcaguaaacagcgaagugccucucagaguaguuuagauaaguuagaucaggaacuuaaggaacagcagaaggaguuaaaaaaucaagaagaauuauccagucuaguuuggaucuguaccagcacucauucggcuacaaaaguucuuauuauugaugcuguucaaccuggcaacauccuagacaguuucacuguuugcaacucucauguucugugcauugcaagugugccaggugcacgagaaacagacuacccugcaggagaagaucuuucagaaucuggucagguagacaaagcaucuuuauguggaaguaugacaagcaacagcucagcagagacagacagccuguuaggaggcaucacagugguugguuguucugcagaaggugugacgggagcugccacuuccccuaguacaaauggugcuucuccagugauggauaaaccaccagaaauggaagcagaaaauagugagguugaugaaaauguuccaacagcagaagaagcaacugaagcuacagaagggaaugcggggucagcugaagacacaguggacaucucccaaacuggcgucuacacagagcaugucuuuacagauccuuugggaguucagaucccagaagaccucuccccaguguaucagucgagcaaugacucagaugcauauaaagaucaaauaucaguacugccaaaugaacaagacuuggugagagaagaagcccagaaaaugaguagucuuuuaccaacuauguggcuuggagcucaaaauggcuguuuguauguccauucaucuguagcccaguggaggaaaugucuccauuccauuaaacuuaaagauucgauucucaguauuguacacgugaagggaaucguguuaguagcccuggcugacggcacccuugcaaucuuucacagaggaguggaugggcagugggauuugucaaacuaucaccucuuagaccuuggacggccucaucauuccauccguugcaugacugugguacaugacaaagucugguguggcuauaggaacaaaaucuauguggugcagccaaaggccaugaaaauagagaaaucuuuugaugcacaucccaggaaggagagccaagugcgacagcuugcgugggugggggauggcgugugggucuccauucgcuuggauucuacgcuccgucucuaucaugcacacacuuaucaacaucuacaggauguggacauugagccuuauguaagcaaaauguuagguacuggaaaacugggcuucucuuuugugagaauuacagcucuuauggugucuuguaaucguuuguggguggggacaggaaauggugucauuaucuccaucccauugacagaaacaaauaaaaccucagguguaccaggaaaucguccuggaaguguaauccguguauauggugaugaaaacagugauaaagugacuccagggacauuuauacccuauuguucaauggcacaugcacagcuuugcuuccaugggcaccgggaugcugugaaauucuuuguggcagucccaggucaagucaucagcccacaaaguagcaguaguggcacggaucugacgggugacaaagcagggccaucugcacaggagccugguagucagacgcccuugaagucuaugcuugucaucaguggaggagagggcuacaucgacuuccgaaugggugaugaagguggagaaucagaacuucuuggagaggaucuuccucuugaaccuucuaucaccaaagcagaaaggagucacuugauaguguggcaagugauguauggcaaugaguga

SEQ ID NO: 7914 - RNA, 2766 nt, Artificial Sequence
  derived and/or modified sequence opt1 from c-Jun__Homo_sapiens__BAG61498
auggugaugcgcuggggcgagcggaacgacgugaucgccugggagcugcuccaggacgggguggagaccaagaacgcccugaacaucgugaagaacgaccugaucgcgaaggucgacgagcugaccugcgagaaggacgugcugcagggcgagcuggaggccgugaagcaggccaagcucaagcuggaggagaagaaccgcgagcuggaggaggagcuccggaaggcccgcgccgagaccgaggacgcgcggcagaaggccaaggacgacgacgacagcgacauccccaccgcccagcgcaagcgguucacccgcgucgagauggcccgggugcugauggagcgcaaccaguacaaggagcggcugauggagcuccaggaggcggugcgcuggaccgagaugauccgggccucccgcgagaacccggccaugcaggagaagaagcggagcuccaucuggcaguucuucagccgccuguucuccagcuccagcaacacgaccaagaagcccgagccgcccgucaaccugaaguacaacgcccccaccucccacgugacccccagcgugaagaagcgguccagcacgcucucccagcugcccggggacaagagcaaggccuucgacuuccuguccgaggagaccgaggcgagccucgccucccgccgggagcagaagcgcgagcaguaccggcaggucaaggcccacgugcagaaggaggacggccgcgugcaggccuucggguggagccugccccagaaguacaagcaggucaccaacggccagggcgagaacaagaugaagaaccugccggugcccguguaccuccgcccccuggacgagaaggacaccuccaugaagcuguggugcgccgucggggugaaccucagcggcgggaagacgcgggacggcgggagcguggucggcgcguccguguucuacaaggacguggccggccuggacaccgaggggagcaagcagcgcuccgccagccaguccagccuggacaagcucgaccaggagcugaaggagcagcagaaggagcugaagaaccaggaggagcucuccagccuggucuggaucugcaccuccacccacagcgccacgaaggugcugaucaucgacgccguccagcccggcaacauccucgacuccuucaccgugugcaacagccacgugcugugcaucgcguccgucccgggggcccgggagaccgacuaccccgccggcgaggaccugagcgaguccggccagguggacaaggccagccucugcggguccaugaccagcaacuccagcgccgagacggacagccugcugggcgggaucaccguggucggcugcuccgcggagggggugaccggcgccgccaccagccccuccacgaacggcgccagccccgugauggacaagccgcccgagauggaggcggagaacuccgaggucgacgagaacgugcccaccgccgaggaggccaccgaggccaccgaggggaacgccggcagcgcggaggacacgguggacaucucccagaccggggucuacaccgagcacguguucaccgacccccucggcgugcagaucccggaggaccugagccccgucuaccaguccagcaacgacuccgacgccuacaaggaccagaucagcgugcugcccaacgagcaggaccucgugcgcgaggaggcccagaagauguccagccugcugcccacgauguggcucggggcccagaacggcugccuguacguccacuccagcguggcccaguggcggaagugccugcacuccaucaagcucaaggacagcauccugagcaucgugcacgucaagggcaucgugcugguggcgcuggccgacgggacccucgccaucuuccaccgcggcgucgacgggcagugggaccuguccaacuaccaccuccucgaccugggccggccgcaccacagcauccgcugcaugaccguggugcacgacaaggucuggugcggguaccggaacaagaucuacguggugcagcccaaggccaugaagaucgagaaguccuucgacgcccacccccgcaaggagagccagguccggcagcuggcgugggugggcgacggcgugugggucuccauccgccucgacagcacccugcggcuguaccacgcccacacguaccagcaccuccaggacguggacaucgagcccuacguguccaagaugcuggggaccggcaagcugggguucagcuucguccgcaucaccgcccucaugguguccugcaaccggcugugggugggcaccggcaacggggucaucaucagcaucccgcugaccgagacgaacaagaccuccggcgugcccgggaaccgccccggcagcgugauccgggucuacggggacgagaacuccgacaaggugaccccgggcaccuucauccccuacugcagcauggcccacgcgcagcucugcuuccacggccaccgcgacgccgugaaguucuucgucgccgugcccggccaggugaucagcccccaguccuccagcuccgggacggaccugaccggggacaaggccggcccgagcgcccaggagcccgggagccagacgccccugaaguccaugcucgucaucagcggcggcgagggguacaucgacuuccggaugggcgacgagggcggggaguccgagcugcugggggaggaccucccccuggagccgagcaucaccaaggcggagcgcucccaccugaucguguggcaggucauguacggcaacgaguga

SEQ ID NO: 7915 - RNA, 2766 nt, Artificial Sequence
  derived and/or modified sequence opt2 from c-Jun__Homo_sapiens__BAG61498
auggucaugcgcuggggcgagcgcaacgacgucaucgccugggagcuccuccaggacggcgucgagaccaagaacgcccucaacaucgucaagaacgaccucaucgccaaggucgacgagcucaccugcgagaaggacguccuccagggcgagcucgaggccgucaagcaggccaagcucaagcucgaggagaagaaccgcgagcucgaggaggagcuccgcaaggcccgcgccgagaccgaggacgcccgccagaaggccaaggacgacgacgacuccgacauccccaccgcccagcgcaagcgcuucacccgcgucgagauggcccgcguccucauggagcgcaaccaguacaaggagcgccucauggagcuccaggaggccguccgcuggaccgagaugauccgcgccucccgcgagaaccccgccaugcaggagaagaagcgcuccuccaucuggcaguucuucucccgccucuucuccuccuccuccaacaccaccaagaagcccgagccccccgucaaccucaaguacaacgcccccaccucccacgucacccccuccgucaagaagcgcuccuccacccucucccagcuccccggcgacaaguccaaggccuucgacuuccucuccgaggagaccgaggccucccucgccucccgccgcgagcagaagcgcgagcaguaccgccaggucaaggcccacguccagaaggaggacggccgcguccaggccuucggcuggucccucccccagaaguacaagcaggucaccaacggccagggcgagaacaagaugaagaaccuccccguccccgucuaccuccgcccccucgacgagaaggacaccuccaugaagcucuggugcgccgucggcgucaaccucuccggcggcaagacccgcgacggcggcuccgucgucggcgccuccgucuucuacaaggacgucgccggccucgacaccgagggcuccaagcagcgcuccgccucccaguccucccucgacaagcucgaccaggagcucaaggagcagcagaaggagcucaagaaccaggaggagcucuccucccucgucuggaucugcaccuccacccacuccgccaccaagguccucaucaucgacgccguccagcccggcaacauccucgacuccuucaccgucugcaacucccacguccucugcaucgccuccguccccggcgcccgcgagaccgacuaccccgccggcgaggaccucuccgaguccggccaggucgacaaggccucccucugcggcuccaugaccuccaacuccuccgccgagaccgacucccuccucggcggcaucaccgucgucggcugcuccgccgagggcgucaccggcgccgccaccucccccuccaccaacggcgccucccccgucauggacaagccccccgagauggaggccgagaacuccgaggucgacgagaacguccccaccgccgaggaggccaccgaggccaccgagggcaacgccggcuccgccgaggacaccgucgacaucucccagaccggcgucuacaccgagcacgucuucaccgacccccucggcguccagauccccgaggaccucucccccgucuaccaguccuccaacgacuccgacgccuacaaggaccagaucuccguccuccccaacgagcaggaccucguccgcgaggaggcccagaagauguccucccuccuccccaccauguggcucggcgcccagaacggcugccucuacguccacuccuccgucgcccaguggcgcaagugccuccacuccaucaagcucaaggacuccauccucuccaucguccacgucaagggcaucguccucgucgcccucgccgacggcacccucgccaucuuccaccgcggcgucgacggccagugggaccucuccaacuaccaccuccucgaccucggccgcccccaccacuccauccgcugcaugaccgucguccacgacaaggucuggugcggcuaccgcaacaagaucuacgucguccagcccaaggccaugaagaucgagaaguccuucgacgcccacccccgcaaggagucccagguccgccagcucgccugggucggcgacggcgucugggucuccauccgccucgacuccacccuccgccucuaccacgcccacaccuaccagcaccuccaggacgucgacaucgagcccuacgucuccaagaugcucggcaccggcaagcucggcuucuccuucguccgcaucaccgcccucauggucuccugcaaccgccucugggucggcaccggcaacggcgucaucaucuccaucccccucaccgagaccaacaagaccuccggcguccccggcaaccgccccggcuccgucauccgcgucuacggcgacgagaacuccgacaaggucacccccggcaccuucauccccuacugcuccauggcccacgcccagcucugcuuccacggccaccgcgacgccgucaaguucuucgucgccguccccggccaggucaucuccccccaguccuccuccuccggcaccgaccucaccggcgacaaggccggccccuccgcccaggagcccggcucccagaccccccucaaguccaugcucgucaucuccggcggcgagggcuacaucgacuuccgcaugggcgacgagggcggcgaguccgagcuccucggcgaggaccucccccucgagcccuccaucaccaaggccgagcgcucccaccucaucgucuggcaggucauguacggcaacgaguga

SEQ ID NO: 7916 - RNA, 2766 nt, Artificial Sequence
  derived and/or modified sequence opt3 from c-Jun__Homo_sapiens__BAG61498
auggugaugagauggggcgagaggaacgacgucaucgccugggaacugcuccaggaugggguugagaccaagaaugcucuuaacauugugaaaaaugaccugauagcaaagguagaugaauugacaugcgagaaagacguguuacaaggagaacuggaggccgucaagcaggcgaaacuaaagcucgaggaaaagaaccgggagcuggaagaggagcuucgcaaagcucgagccgaaacugaggaugcacgucagaaggccaaagacgaugacgauagcgacauccccacggcucagagaaagagguucacccggguggaaauggcacgcguucugauggagagaaaucaauacaaagaaagguugauggagcuccaggaggccgugcgguggacagaaaugauucgcgcuucccgagagaacccugccaugcaggaaaagaagagaucuucaaucuggcaguuuuucaguaggcuguuuagcuccucuucgaauacuaccaaaaagccagagccgcccgucaaccugaaauauaaugcgccuacaucacacgugaccccaagcguaaagaaacggaguuccacucucucucaauuacccggugauaagagcaaagcauucgacuuucuguccgaagagacagaggccucacuugcuagucgucgcgaacagaagagagagcaguacaggcagguuaaggcccaugugcaaaaagaagauggccggguccaggcauucggguggagcuugccucagaaguauaaacaagugaccaacggacagggcgagaauaagaugaaaaaccugccagugcccgucuaccuacgaccucucgacgaaaaggacacgucuaugaagcuguggugugcuguuggugugaaucuuuccgggggaaaaacucgcgauggcggcucaguagugggggccagcgucuuuuauaaggacguggcgggacuggauaccgaggguaguaaacagagaucugccucccagagcucguuggacaagcucgaucaagagcugaaagaacagcagaaggaguuaaagaaccaggaggaacugucuucccucguuuggauuugcacaucaacucacagugcaaccaaagugcuuaucauagacgcuguccaaccaggcaauauccuggauagcuucacaguguguaacucccauguauugugcauugccucuguuccgggggcuagggagaccgacuaccccgccggagaagaucuaagcgagucaggccagguggacaaggcaagucugugugguuccaugacgagcaacucuucagccgaaacugauagucuccuugggggaaucacagucgugggcugcagcgcugagggcgucaccggggcggcaacuuccccuucuacaaauggagccucgccagugauggacaaacccccugaaauggaggcugagaacagcgaaguugacgagaaugugccaaccgccgaagaggcaacggaagccaccgaggguaacgcuggcuccgccgaggauacaguagacauuucacagacuggggucuauaccgaacacguguuuacagauccccugggaguucagaucccggaggaccugaguccuguguaccaaucuagcaaugauuccgacgcauacaaggaucagauaucagucuugcccaacgaacaggaccucgugcgggaggaagcgcagaaaaugagcucucuguuaccaacuauguggcugggcgcucaaaaugguugucuauauguacauuccaguguggcccaguggcgcaagugccuccacagcauuaagcugaaagauucuauccuuuccauuguucacgucaaggggaucguguugguggcacuggccgacggcacccucgcuaucuuccauagaggagucgauggccagugggaccugucaaacuaccaccuucuggauuuggggaggccucaucacaguauucguuguaugacaguugugcacgacaaaguguggugcggauaucggaauaagauauacguaguccaacccaaagccaugaagaucgagaaaucguuugacgcacauccacgaaaggagagccaggugagacagcucgcuuggguuggugauggcgugugggucuccauuaggcuggacucuaccuuacgccuguaucacgcccauacuuaccagcaccuacaagauguggacaucgaacccuauguuagcaagaugcucgggacgggaaaacugggcuucucauuugugcggauaacagcgcuuaugguaaguuguaacagauugugggucgguaccgggaauggcgugauuaucuccaucccucugacugagaccaacaagacaucuggagugccaggcaauaggccggggagcgucauucgcguuuacggagaugaaaacuccgacaaagugacccccgguacuuucaucccuuacugcucaauggcccaugcucagcucugcuuccacggccaccgagaugcaguaaaguuuuucguggccgucccaggacaggugauuagcccccagaguucuuccagcgggacagaccugacgggcgauaaagcugguccuucggcccaagagccagggucacagacccccuuaaagucuaugcugguuauaaguggcggagagggcuauaucgacuuucggaugggggaugaaggaggcgaguccgaacuuuugggugaggaccucccgcuggaaccuagcauuacuaaggcagagcguucucaucuaaucguguggcaggucauguacgggaaugaguga

SEQ ID NO: 7917 - RNA, 2766 nt, Artificial Sequence
  derived and/or modified sequence opt4 from c-Jun__Homo_sapiens__BAG61498
auggugaugagauggggcgagagaaacgacgugaucgccugggagcugcugcaggacggcguggagaccaagaacgcccugaacaucgugaagaacgaccugaucgccaagguggacgagcugaccugcgagaaggacgugcugcagggcgagcuggaggccgugaagcaggccaagcugaagcuggaggagaagaacagagagcuggaggaggagcugagaaaggccagagccgagaccgaggacgccagacagaaggccaaggacgacgacgacagcgacauccccaccgcccagagaaagagauucaccagaguggagauggccagagugcugauggagagaaaccaguacaaggagagacugauggagcugcaggaggccgugagauggaccgagaugaucagagccagcagagagaaccccgccaugcaggagaagaagagaagcagcaucuggcaguucuucagcagacuguucagcagcagcagcaacaccaccaagaagcccgagccccccgugaaccugaaguacaacgcccccaccagccacgugacccccagcgugaagaagagaagcagcacccugagccagcugcccggcgacaagagcaaggccuucgacuuccugagcgaggagaccgaggccagccuggccagcagaagagagcagaagagagagcaguacagacaggugaaggcccacgugcagaaggaggacggcagagugcaggccuucggcuggagccugccccagaaguacaagcaggugaccaacggccagggcgagaacaagaugaagaaccugcccgugcccguguaccugagaccccuggacgagaaggacaccagcaugaagcuguggugcgccgugggcgugaaccugagcggcggcaagaccagagacggcggcagcguggugggcgccagcguguucuacaaggacguggccggccuggacaccgagggcagcaagcagagaagcgccagccagagcagccuggacaagcuggaccaggagcugaaggagcagcagaaggagcugaagaaccaggaggagcugagcagccugguguggaucugcaccagcacccacagcgccaccaaggugcugaucaucgacgccgugcagcccggcaacauccuggacagcuucaccgugugcaacagccacgugcugugcaucgccagcgugcccggcgccagagagaccgacuaccccgccggcgaggaccugagcgagagcggccagguggacaaggccagccugugcggcagcaugaccagcaacagcagcgccgagaccgacagccugcugggcggcaucaccguggugggcugcagcgccgagggcgugaccggcgccgccaccagccccagcaccaacggcgccagccccgugauggacaagccccccgagauggaggccgagaacagcgagguggacgagaacgugcccaccgccgaggaggccaccgaggccaccgagggcaacgccggcagcgccgaggacaccguggacaucagccagaccggcguguacaccgagcacguguucaccgacccccugggcgugcagauccccgaggaccugagccccguguaccagagcagcaacgacagcgacgccuacaaggaccagaucagcgugcugcccaacgagcaggaccuggugagagaggaggcccagaagaugagcagccugcugcccaccauguggcugggcgcccagaacggcugccuguacgugcacagcagcguggcccaguggagaaagugccugcacagcaucaagcugaaggacagcauccugagcaucgugcacgugaagggcaucgugcugguggcccuggccgacggcacccuggccaucuuccacagaggcguggacggccagugggaccugagcaacuaccaccugcuggaccugggcagaccccaccacagcaucagaugcaugaccguggugcacgacaagguguggugcggcuacagaaacaagaucuacguggugcagcccaaggccaugaagaucgagaagagcuucgacgcccaccccagaaaggagagccaggugagacagcuggccugggugggcgacggcgugugggugagcaucagacuggacagcacccugagacuguaccacgcccacaccuaccagcaccugcaggacguggacaucgagcccuacgugagcaagaugcugggcaccggcaagcugggcuucagcuucgugagaaucaccgcccugauggugagcugcaacagacugugggugggcaccggcaacggcgugaucaucagcaucccccugaccgagaccaacaagaccagcggcgugcccggcaacagacccggcagcgugaucagaguguacggcgacgagaacagcgacaaggugacccccggcaccuucauccccuacugcagcauggcccacgcccagcugugcuuccacggccacagagacgccgugaaguucuucguggccgugcccggccaggugaucagcccccagagcagcagcagcggcaccgaccugaccggcgacaaggccggccccagcgcccaggagcccggcagccagaccccccugaagagcaugcuggugaucagcggcggcgagggcuacaucgacuucagaaugggcgacgagggcggcgagagcgagcugcugggcgaggaccugccccuggagcccagcaucaccaaggccgagagaagccaccugaucguguggcaggugauguacggcaacgaguga

SEQ ID NO: 7918 - RNA, 2766 nt, Artificial Sequence
  derived and/or modified sequence opt5 from c-Jun__Homo_sapiens__BAG61498
auggugaugagauggggcgagcggaacgacgucaucgccugggaacugcuccaggaugggguugagaccaagaaugcucugaacauugugaaaaaugaccuuaucgccaagguggaugaacugacaugcgagaaagacguccuccagggagaacuggaggcggugaagcaggcuaaacuuaagcuggaggaaaagaaccgcgagcucgaagaggagcugagaaaagcccgggccgaaacggaggaugcucgccagaaggccaaagacgaugacgauagcgacauucccaccgcucagagaaagcgguucacacgcguugaaauggccagagugcugauggagcggaaucaauacaaagaacgccucauggagcugcaggaggcggucagauggaccgaaaugauccgggccucccgcgagaacccugcuaugcaggaaaagaagagaucuagcauuuggcaguuuuucucccggcuguuuucuagcuccucuaauacaaccaaaaagccggagcccccugugaaccugaaauauaaugcccccacaagccacguuaccccuuccgugaagaaacgcagcucuacgcucucccaacugcccggcgauaagagcaaggcuuucgacuuucuuucugaagagaccgaggccucccuggcgagcagacgggaacagaaaagagagcaguaccgccaggucaaggcccaugugcaaaaagaagaugggcgggugcaggcuuucggauggucucucccucagaaguauaaacaagucacaaacggccagggggagaauaagaugaaaaaccugccgguucccguguaccugagaccucucgacgaaaaggacaccuccaugaagcuguggugugccgugggagucaaucuuagcggcggcaaaacacgcgaugggggauccgugguuggcgcuucuguguuuuauaaggacgucgccgggcuggauaccgagggaagcaaacagcgguccgccagccagucuucccucgacaagcuggaucaagagcuuaaagaacagcagaaggagcugaagaaccaggaggaacucagcucucugguguggaucugcacgagcacacacuccgcuaccaaaguucugaucauugacgcggugcaacccggcaauauccucgauucuuucacagucuguaacagccaugugcugugcauugccuccgucccuggggcuagagagaccgacuaccccgccggagaagaucuuagcgagucuggccagguggacaaggccucccuguguggcagcaugaccucuaacuccagcgcugaaacagauucccuccuugggggaaucacgguugugggcugcucugccgagggggucaccggagcggcuacaagcccguccaccaauggcgccucuccugugauggacaaacccccugaaauggaggccgagaacagcgaaguugacgagaaugugcccacagcugaagaggccaccgaagcuacggaggggaacgccggauccgcggaggauacagucgacauuagccagaccggcguguauaccgaacacguguuuacagauccccuuggcguucagaucccugaggaccugucuccggucuaccaauccagcaaugauucugacgccuacaaggaucagauuuccgugcuccccaacgaacaggaccuggugcgcgaggaagcucagaaaaugagcucucugcucccuaccauguggcugggggcccaaaauggaugucuuuauguccauagcuccguggcucaguggcggaagugccugcacagcaucaagcucaaagauucuauccuguccauuguucacgugaagggcaucguccugguggcccuugcggacgggacacucgccauuuuccauagaggaguugauggccagugggaccugagcaacuaccaucugcucgaucuggggcgcccccaccacuccauccgguguaugacggugguccacgacaaaguguggugcggcuauagaaauaagauuuacguugugcaaccuaaagcuaugaagaucgagaaaucuuuugacgcccauccccgcaaggagagccagguccggcagcuugcuugggugggagauggcgugugggucuccaucagacuggacucuacccuccggcuguaucacgcccauacauaccagcaucugcaagauguugacauugaaccguaugugagcaagaugcuugggaccggaaaacucggcuucuccuuugugcgcaucacagcccugauggucucuuguaacagacuguggguggggaccggaaauggcguuauuaucagcauuccucucacggagaccaacaagacauccggggugcccggcaaucggccuggaagcgucaucagaguguacggcgaugaaaacucugacaaaguuacccccgggacauucaucccuuacugcuccauggcucacgcgcagcugugcuuccacggacaccgcgaugccgugaaguuuuucgucgcugugcccggccagguuauuagcccgcagucuuccagcucugggaccgaccuuacgggagauaaagccggcccuuccgcccaagagcccgggagccagacaccccugaaguccaugcucgugaucagcggcggagagggcuauauugacuuucggaugggggaugaaggaggcgagucugaacugcugggggaggaccuuccucucgaaccgagcaucaccaaggcugagagaucccaucugauugucuggcaagugauguacggaaaugaguga

SEQ ID NO: 7919 - protein, 357 aa, Artificial Sequence [sequence omitted]

SEQ ID NO: 7920 - RNA, 1074 nt, Artificial Sequence
  c-Jun__Homo_sapiens__BAH11553
augcagcuggugcugaagauggauucgagcccagacaaugacagcugguuggaggaucaaugggagcgcuggcucacccaugacaucagccuggaggaguuugaggaugaagaccucucggagaucacugaugaguguggcaucagcuuacagugcaaagacacccuguccuuacggcccccgcgcgccgggcugcucucugcgggcggcggcggcgcggggagccgguugcaggccgagaugcugcagauggaccugaucgacgcgacggaggacuccacgccugaugaacccgacguccauuucuccaagaaauuccugaacgucuucaugaguggccgcucccgcuccuccagugcugaguccuucgggcuguucuccugcaucaucaacggggaggagcaggagcagacccaccgggccauauucagguuugugccucgacacgaagacgaacuugagcuggaaguggaugacccucugcuaguggagcuccaggcugaagacuacugguacgagaccuacaacaugcgcacuggugcccggggugucuuuccugccuauuacgccaucgaggucaccaaggagcccgagcacauggcagcccuggccaaaaacagugacuggguggaccaguuccgggugaaguuccugggcucaguccagguucccuaucacaagggcaaugacguccucugugcugcuaugcaaaagauugccaccacccgccggcucaccgugcacuuuaacccgcccuccagcuguguccuggagaucagcgugcggggugugaagauaggcgucaaggccgaugacucccaggaggccaaggggaauaaauguagccacuuuuuccaguuaaaaaacaucucuuucugcggauaucauccaaagaacaacaaguacuuuggguucaucaccaagcaccccgccgaccaccgguuugccugccacgccuuugugucugaagacuccaccaaagcccuggcagaguccguggggagagcauuccagcaguucuacaagcaguuuguggaguacaccugccccacagaagauaucuaccuggaguag

SEQ ID NO: 7921 - RNA, 1074 nt, Artificial Sequence
  derived and/or modified sequence opt1 from c-Jun__Homo_sapiens__BAH11553
augcagcuggugcucaagauggacagcucccccgacaacgacagcuggcuggaggaccagugggagcgcuggcugacccacgacaucucccucgaggaguucgaggacgaggaccugagcgagaucaccgacgagugcggcaucucccugcagugcaaggacacgcucagccugcggccgccccgcgccgggcugcucuccgccggcgggggcggggcgggcagccggcugcaggccgagaugcugcagauggaccucaucgacgccaccgaggacuccacccccgacgagcccgacguccacuucagcaagaaguuccugaacguguucauguccggccgcagccgguccagcuccgccgagagcuucgggcuguucuccugcaucaucaacggcgaggagcaggagcagacccaccgcgccaucuuccgguucgugccgcgccacgaggacgagcucgagcuggaggucgacgacccccugcucguggagcugcaggcggaggacuacugguacgagacguacaacaugcggaccggggcccgcggcguguuccccgccuacuacgccaucgaggucaccaaggagcccgagcacauggcggcccuggccaagaacagcgacuggguggaccaguuccgggugaaguuccucggguccguccaggugccguaccacaagggcaacgacgugcugugcgccgccaugcagaagaucgcgaccacgcgccggcugaccguccacuucaacccgcccagcagcugcgugcucgagaucuccgugcgcggcgucaagaucggggugaaggccgacgacagccaggaggccaagggcaacaagugcucccacuucuuccagcugaagaacaucagcuucugcggguaccaccccaagaacaacaaguacuucggcuucaucaccaagcaccccgccgaccaccgguucgccugccacgcguucguguccgaggacagcaccaaggcccuggccgaguccgucggccgcgccuuccagcaguucuacaagcaguucguggaguacacgugccccaccgaggacaucuaccucgaguga

SEQ ID NO: 7922 - RNA, 1074 nt, Artificial Sequence
  derived and/or modified sequence opt2 from c-Jun__Homo_sapiens__BAH11553
augcagcucguccucaagauggacuccucccccgacaacgacuccuggcucgaggaccagugggagcgcuggcucacccacgacaucucccucgaggaguucgaggacgaggaccucuccgagaucaccgacgagugcggcaucucccuccagugcaaggacacccucucccuccgccccccccgcgccggccuccucuccgccggcggcggcggcgccggcucccgccuccaggccgagaugcuccagauggaccucaucgacgccaccgaggacuccacccccgacgagcccgacguccacuucuccaagaaguuccucaacgucuucauguccggccgcucccgcuccuccuccgccgaguccuucggccucuucuccugcaucaucaacggcgaggagcaggagcagacccaccgcgccaucuuccgcuucgucccccgccacgaggacgagcucgagcucgaggucgacgacccccuccucgucgagcuccaggccgaggacuacugguacgagaccuacaacaugcgcaccggcgcccgcggcgucuuccccgccuacuacgccaucgaggucaccaaggagcccgagcacauggccgcccucgccaagaacuccgacugggucgaccaguuccgcgucaaguuccucggcuccguccagguccccuaccacaagggcaacgacguccucugcgccgccaugcagaagaucgccaccacccgccgccucaccguccacuucaacccccccuccuccugcguccucgagaucuccguccgcggcgucaagaucggcgucaaggccgacgacucccaggaggccaagggcaacaagugcucccacuucuuccagcucaagaacaucuccuucugcggcuaccaccccaagaacaacaaguacuucggcuucaucaccaagcaccccgccgaccaccgcuucgccugccacgccuucgucuccgaggacuccaccaaggcccucgccgaguccgucggccgcgccuuccagcaguucuacaagcaguucgucgaguacaccugccccaccgaggacaucuaccucgaguga

SEQ ID NO: 7923 - RNA, 1074 nt, Artificial Sequence
  derived and/or modified sequence opt3 from c-Jun__Homo_sapiens__BAH11553
augcagcuggugcucaagauggacagcucccccgauaacgacucuuggcuugaggaucaaugggaaagauggcugacccacgacaucucauuggaggaguucgaagaugaagacuuaagugagauuacagaugagugcggcauaagccugcaguguaaagacacucuaucccucaggccuccacgggccgggcugcuuucugcuggagguggcggggcaggaucgcgccugcaggccgaaauguugcagauggaucucaucgacgcgacggaggauucaaccccggacgaacccgauguccauuuuagcaagaaauuccugaauguuuuuaugaguggccgaucccguucuagcuccgcugagucauucggucuguuuaguugcauuaucaacggggaggaacaagagcagacacacagagccauuuucagguuugugccucggcaugaagacgagcucgaauuagagguagacgauccacugcuuguggaguugcaggcagaagacuacugguaugagacuuacaauaugcgcaccggagccagaggcgucuuccccgcuuauuacgcaaucgaagugacaaaggagccugaacacauggccgcucuggccaaaaacagcgauuggguugaccaguuuagggugaaguuccuaggcucuguccaagugccauaucauaaggggaaugauguacucugugcggcaaugcagaaaauagccaccacucggcgccugacaguucacuuuaaucccccuuccucaugcgugcuugagaucagcguccgaggagugaagauuggugugaaagcugacgauagucaggaggccaagggcaacaaauguucucacuucuuucagcugaagaacaucuccuucugcggguaccauccaaagaauaacaaauauuucggauuuauuaccaagcacccggcagaccauagauucgcuugucacgccuuugucagcgaagauucgacgaaagcguuggccgagucuguuggcagggcauuccaacaguuuuacaagcaguucguggaauacacuugccccaccgaggacaucuaucucgaauga

SEQ ID NO: 7924 - RNA, 1074 nt, Artificial Sequence
  derived and/or modified sequence opt4 from c-Jun__Homo_sapiens__BAH11553
augcagcuggugcugaagauggacagcagccccgacaacgacagcuggcuggaggaccagugggagagauggcugacccacgacaucagccuggaggaguucgaggacgaggaccugagcgagaucaccgacgagugcggcaucagccugcagugcaaggacacccugagccugagaccccccagagccggccugcugagcgccggcggcggcggcgccggcagcagacugcaggccgagaugcugcagauggaccugaucgacgccaccgaggacagcacccccgacgagcccgacgugcacuucagcaagaaguuccugaacguguucaugagcggcagaagcagaagcagcagcgccgagagcuucggccuguucagcugcaucaucaacggcgaggagcaggagcagacccacagagccaucuucagauucgugcccagacacgaggacgagcuggagcuggagguggacgacccccugcugguggagcugcaggccgaggacuacugguacgagaccuacaacaugagaaccggcgccagaggcguguuccccgccuacuacgccaucgaggugaccaaggagcccgagcacauggccgcccuggccaagaacagcgacuggguggaccaguucagagugaaguuccugggcagcgugcaggugcccuaccacaagggcaacgacgugcugugcgccgccaugcagaagaucgccaccaccagaagacugaccgugcacuucaacccccccagcagcugcgugcuggagaucagcgugagaggcgugaagaucggcgugaaggccgacgacagccaggaggccaagggcaacaagugcagccacuucuuccagcugaagaacaucagcuucugcggcuaccaccccaagaacaacaaguacuucggcuucaucaccaagcaccccgccgaccacagauucgccugccacgccuucgugagcgaggacagcaccaaggcccuggccgagagcgugggcagagccuuccagcaguucuacaagcaguucguggaguacaccugccccaccgaggacaucuaccuggaguga

SEQ ID NO: 7925 - RNA, 1074 nt, Artificial Sequence
  derived and/or modified sequence opt5 from c-Jun__Homo_sapiens__BAH11553
augcagcuggugcucaagauggacagcucccccgauaacgacucuuggcuggaggaucaaugggaaagauggcuuacccacgacaucagccuggaggaguucgaagaugaagaccucuccgagauuacagaugagugcggcaucucucugcaguguaaagacacgcuuagccugcggccuccgcgcgccgggcuccuguccgcuggaggcgggggagccggcucuagacugcaggcggaaaugcuccagauggaucugauugacgcuaccgaggauagcacacccgacgaaccugauguccauuuuuccaagaaauuccuuaauguuuuuaugagcgggcggucucgcuccagcucugccgaguccuucggacuguuuagcugcaucauuaacggcgaggaacaagagcagacccacagagccaucuuccgguuugugccccgccaugaagacgagcucgaacuggagguggacgauccucuucuggucgagcuccaggcugaagacuacugguaugagacauacaauaugagaaccggcgcccgcgggguguuccccgcuuauuacgccaucgaaguuacaaaggagccugaacacauggcggcccuggcuaaaaacucugauuggguggaccaguuucgggucaaguuccugggauccgugcaaguuccguaucauaagggcaaugaugugcucugugccgcuaugcagaaaauugccaccacgagacggcugaccguccacuuuaaucccccuagcuccugcgugcuugagaucucugugcgcggggucaagauuggaguuaaagcggacgauagccaggaggccaagggcaacaaauguucccacuucuuucagcugaagaacaucagcuucugcggguaccaucccaagaauaacaaauauuucggauuuauuacaaagcacccugcugaccauagauucgccugucacgcuuuugugucugaagauuccaccaaagcccucgccgagagcgugggccgggcuuuccaacaguuuuacaagcaguucgucgaauacacaugccccaccgaggacaucuaucuggaauga

SEQ ID NO: 7926 - protein, 251 aa, Artificial Sequence [sequence omitted]

SEQ ID NO: 7927 - RNA, 756 nt, Artificial Sequence
  c-Jun__Homo_sapiens__BAK64147
augauggagauccagauggacgagggcggcggcguggugguguaccaggacgacuacugcuccggcucggugaugucggagcgggugucgggccuggcgggcuccaucuaccgcgaguucgagcgccucauccacugcuacgacgaggagguggucaaggagcucaugccgcugguggugaacgugcuggagaaccuagacucggugcucagcgagaaccaggagcacgagguggagcuggagcugcugcgcgaggacaacgagcagcugcucacccaguacgagcgugagaaggcgcugcgcaggcaggcggaggagaaauucauugaguuugaagaugcucuggaacaagagaagaaagagcugcaaauccagguggagcacuacgaguuccagacgcgccagcuggagcugaaggccaagaacuaugccgaucagauuucccgguuggaggagcgggagucggagaugaagaaggaguacaaugcccugcaccagcggcacacagagaugauacagaccuacguggagcacauugagagguccaagaugcagcaggucggaggaaacagccagaccgagagcagccugccggggcggagcaggaaggagcgccccaccucccugaacguguucccccuggcugacggcacgguacgugcacagaucgggggcaagcucgugccugcgggggaccacuggcaccugagugaccucggccagcugcaguccagcuccagcuaccagguuuuguag

SEQ ID NO: 7928 - RNA, 756 nt, Artificial Sequence
  derived and/or modified sequence opt1 from c-Jun__Homo_sapiens__BAK64147
augauggagauccagauggacgagggcgggggcguggucguguaccaggacgacuacugcagcggguccgugaugagcgagcgcgucuccggccuggccgggagcaucuaccgggaguucgagcgccucauccacugcuacgacgaggagguggugaaggagcugaugccccuggucgugaacgugcucgagaaccuggacuccguccugagcgagaaccaggagcacgagguggagcucgagcugcugcgggaggacaacgagcagcuccugacccaguacgagcgcgagaaggcccugcggcgccaggcggaggagaaguucaucgaguucgaggacgcccucgagcaggagaagaaggagcugcagauccagguggagcacuacgaguuccagacccggcagcuggagcucaaggccaagaacuacgccgaccagaucucccgccuggaggagcgggagagcgagaugaagaaggaguacaacgcccugcaccagcgccacacggagaugauccagaccuacgucgagcacaucgagcgguccaagaugcagcaggucggcggcaacagccagaccgaguccagccucccggggcgcucccggaaggagcgccccaccagccugaacguguucccccuggcggacggcacggugcgggcccagaucgggggcaagcucgugcccgccggggaccacuggcaccuguccgaccugggccagcuccagagcuccagcuccuaccaggugcuguga

SEQ ID NO: 7929 - RNA, 756 nt, Artificial Sequence
  derived and/or modified sequence opt2 from c-Jun__Homo_sapiens__BAK64147
augauggagauccagauggacgagggcggcggcgucgucgucuaccaggacgacuacugcuccggcuccgucauguccgagcgcgucuccggccucgccggcuccaucuaccgcgaguucgagcgccucauccacugcuacgacgaggaggucgucaaggagcucaugccccucgucgucaacguccucgagaaccucgacuccguccucuccgagaaccaggagcacgaggucgagcucgagcuccuccgcgaggacaacgagcagcuccucacccaguacgagcgcgagaaggcccuccgccgccaggccgaggagaaguucaucgaguucgaggacgcccucgagcaggagaagaaggagcuccagauccaggucgagcacuacgaguuccagacccgccagcucgagcucaaggccaagaacuacgccgaccagaucucccgccucgaggagcgcgaguccgagaugaagaaggaguacaacgcccuccaccagcgccacaccgagaugauccagaccuacgucgagcacaucgagcgcuccaagaugcagcaggucggcggcaacucccagaccgaguccucccuccccggccgcucccgcaaggagcgccccaccucccucaacgucuucccccucgccgacggcaccguccgcgcccagaucggcggcaagcucguccccgccggcgaccacuggcaccucuccgaccucggccagcuccaguccuccuccuccuaccagguccucuga

SEQ ID NO: 7930 - RNA, 756 nt, Artificial Sequence
  derived and/or modified sequence opt3 from c-Jun__Homo_sapiens__BAK64147
augauggagauccagauggacgaaggcgggggaguggucguuuaccaagaugacuauugcagcgguuccgugaugucugagagaguaucaggccuggccgggaguauuuacagggaguucgaacggcucauacacuguuaugaugaagagguggucaaggagcuuaugccccuggugguuaacguguuggaaaauuuagacagcguccuguccgagaaccaggaacaugagguggagcuagaacuccugcgcgaggauaaugaacagcuucugacccaguacgagcgagaaaaggcuuugcguagacaagcagaggagaaauuuaucgaguucgaagacgcccucgaacaggagaaaaaggaacugcagauucagguagagcacuaugaguuucaaacaaggcagcuggaacucaaagcgaagaacuacgcugaucagaucucucgguuagaggaacgcgagucggaaaugaagaaagaguauaaugcccugcaucagagacacacugagaugauucaaacguacguugaacauaucgagaggucaaagaugcaacaggugggaggcaacagccagaccgaaaguucccuuccuggucggucucgcaaagagcgaccaacuagcuugaaugucuucccgcuggcagacgggacagugagagcccagauaggaggcaagcuagugcccgcuggcgaucacuggcaccucuccgaccuggggcagcuucagucaaguagcucuuaccaaguccuguga

SEQ ID NO: 7931 - RNA, 756 nt, Artificial Sequence
  derived and/or modified sequence opt4 from c-Jun__Homo_sapiens__BAK64147
augauggagauccagauggacgagggcggcggcguggugguguaccaggacgacuacugcagcggcagcgugaugagcgagagagugagcggccuggccggcagcaucuacagagaguucgagagacugauccacugcuacgacgaggagguggugaaggagcugaugccccugguggugaacgugcuggagaaccuggacagcgugcugagcgagaaccaggagcacgagguggagcuggagcugcugagagaggacaacgagcagcugcugacccaguacgagagagagaaggcccugagaagacaggccgaggagaaguucaucgaguucgaggacgcccuggagcaggagaagaaggagcugcagauccagguggagcacuacgaguuccagaccagacagcuggagcugaaggccaagaacuacgccgaccagaucagcagacuggaggagagagagagcgagaugaagaaggaguacaacgcccugcaccagagacacaccgagaugauccagaccuacguggagcacaucgagagaagcaagaugcagcaggugggcggcaacagccagaccgagagcagccugcccggcagaagcagaaaggagagacccaccagccugaacguguucccccuggccgacggcaccgugagagcccagaucggcggcaagcuggugcccgccggcgaccacuggcaccugagcgaccugggccagcugcagagcagcagcagcuaccaggugcuguga

SEQ ID NO: 7932 - RNA, 756 nt, Artificial Sequence
  derived and/or modified sequence opt5 from c-Jun__Homo_sapiens__BAK64147
augauggagauccagauggacgaaggcgggggaguggucguuuaccaagaugacuauugcagcggcuccgugaugucugagagagugagcgggcuggccggauccauuuaccgggaguucgaacgccucauccacuguuaugaugaagaggucgugaaggagcugaugccccuuguugugaacguccuggaaaaucucgacucugugcugagcgagaaccaggaacaugagguugagcuugaacugcucagagaggauaaugaacagcugcugacccaguacgagcgggaaaaagcucuccgcagacaagccgaggagaaguuuauugaguucgaagacgcgcuggaacaggagaaaaaggaacuucagauccagguggagcacuaugaguuucaaacacggcagcuggaacucaaagcuaagaacuacgccgaucagauuucccgccuggaggaaagagagucugaaaugaagaaagaguauaaugcccuucaucagcggcacacggagaugauccaaaccuacgucgaacauaucgagcgcagcaagaugcaacaggugggcgggaacucccagacagaaagcucucugccuggaagaucccggaaagagcgcccgaccagccucaauguguucccccuggcugacggcacagucagagcccagauuggcgggaagcugguuccugcuggagaucacuggcaccucucugaccugggccagcuucaguccucuagcuccuaccaagugcuguga

SEQ ID NO: 7933 - protein, 81 aa, Artificial Sequence
  c-Jun__Homo_sapiens__G5E966
MIHFILLFSRQGKLRLQKWYITLPDKERKKITREIVQIILSRGHRTSSFVDWKELKLVYKRSVSWILSLILKRLISSWTSL

SEQ ID NO: 7934 - RNA, 246 nt, Artificial Sequence
  c-Jun__Homo_sapiens__EAW70814
augauacauuucauauugcucuucagucgacaagggaaauuacggcuacagaaaugguacaucacucucccugauaaagagaggaagaagaucacccgggaaauuguucagauuauucucucccguggucacaggacaagcaguuuuguugacuggaaggagcuaaaacuuguuuauaaaaggucugugagcuggauauuaucuuuaauuuugaaaaggcuuauuucauccuggacgaguuuauaa

SEQ ID NO: 7935 - RNA, 246 nt, Artificial Sequence
  derived and/or modified sequence opt1 from c-Jun__Homo_sapiens__EAW70814
augauccacuucauccuccuguucagccgccagggcaagcugcggcugcagaagugguacaucacccuccccgacaaggagcgcaagaagaucacccgggagaucgugcagaucauccugucccgcgggcaccggacgagcuccuucgucgacuggaaggagcugaagcucguguacaagcgcagcguguccuggauccugagccugauccucaagcggcugaucuccagcuggaccucccuguga

SEQ ID NO: 7936 - RNA, 246 nt, Artificial Sequence
  derived and/or modified sequence opt2 from c-Jun__Homo_sapiens__EAW70814
augauccacuucauccuccucuucucccgccagggcaagcuccgccuccagaagugguacaucacccuccccgacaaggagcgcaagaagaucacccgcgagaucguccagaucauccucucccgcggccaccgcaccuccuccuucgucgacuggaaggagcucaagcucgucuacaagcgcuccgucuccuggauccucucccucauccucaagcgccucaucuccuccuggaccucccucuga

SEQ ID NO: 7937 - RNA, 246 nt, Artificial Sequence
  derived and/or modified sequence opt3 from c-Jun__Homo_sapiens__EAW70814
augauccacuucauucugcucuuuagcagacagggcaaacuuaggcugcaaaagugguacauaaccuugcccgacaaggagcggaaaaagaucacacgcgaaauugugcagaucauuuuaucccgagggcaucguacuucuucauucgucgauuggaaagagcugaagcuaguuuauaagagaagugugagcuggauccucucccugauacuuaaaaggcugaucucuucguggacgucauuguga

SEQ ID NO: 7938 - RNA, 246 nt, Artificial Sequence
  derived and/or modified sequence opt4 from c-Jun__Homo_sapiens__EAW70814
augauccacuucauccugcuguucagcagacagggcaagcugagacugcagaagugguacaucacccugcccgacaaggagagaaagaagaucaccagagagaucgugcagaucauccugagcagaggccacagaaccagcagcuucguggacuggaaggagcugaagcugguguacaagagaagcgugagcuggauccugagccugauccugaagagacugaucagcagcuggaccagccuguga

SEQ ID NO: 7939 - RNA, 246 nt, Artificial Sequence
  derived and/or modified sequence opt5 from c-Jun__Homo_sapiens__EAW70814
augauccacuucauucugcucuuuagcagacagggcaagcugcggcuucaaaaaugguacaucacccugcccgacaaggagcgcaaaaagauuacaagagaaaucgugcagauuauccucucccgggggcaucgcacgucuagcuucgucgauuggaaagagcugaaacuuguuuauaagagauccgugucuuggauccugagccucauucugaagcggcugaucuccucuuggaccagccucuga

SEQ ID NO: 7940 - protein, 785 aa, Artificial Sequence
  c-Jun__Homo_sapiens__O75843
MVVPSLKLQDLIEEIRGAKTQAQEREVIQKECAHIRASFRDGDPVHRHRQLAKLLYVHMLGYPAHFGQMECLKLIASSRFTDKRVGYLGAMLLLDERHDAHLLITNSIKNDLSQGIQPVQGLALCTLSTMGSAEMCRDLAPEVEKLLLQPSPYVRKKAILTAVHMIRKVPELSSVFLPPCAQLLHERHHGILLGTITLITELCERSPAALRHFRKVVPQLVHILRTLVTMGYSTEHSISGVSDPFLQVQILRLLRILGRNHEESSETMNDLLAQVATNTDTSRNAGNAVLFETVLTIMDIRSAAGLRVLAVNILGRFLLNSDRNIRYVALTSLLRLVQSDHSAVQRHRPTVVECLRETDASLSRRALELSLALVNSSNVRAMMQELQAFLESCPPDLRADCASGILLAAERFAPTKRWHIDTILHVLTTAGTHVRDDAVANLTQLIGGAQELHAYSVRRLYNALAEDISQQPLVQVAAWCIGEYGDLLLAGNCEEIEPLQVDEEEVLALLEKVLQSHMSLPATRGYALTALMKLSTRLCGDNNRIRQVVSIYGSCLDVELQQRAVEYDTLFRKYDHMRAAILEKMPLVERDGPQADEEAKESKEAAQLSEAAPVPTEPQASQLLDLLDLLDGASGDVQHPPHLDPSPGGALVHLLDLPCVPPPPAPIPDLKVFEREGVQLNLSFIRPPENPALLLITITATNFSEGDVTHFICQAAVPKSLQLQLQAPSGNTVPARGGLPITQLFRILNPNKAPLRLKLRLTYDHFHQSVQEIFEVNNLPVESWQ

SEQ ID NO: 7941 - RNA, 2358 nt, Artificial Sequence
  c-Jun__Homo_sapiens__BAA33390
augguggugccuucgcugaagcuucaggaccucaucgaagagauucgcggggccaagacucaggcccaggagcgggaggugauccaaaaggagugugcccacauccgggccuccuuccgcgacggggacccagugcacaggcaccggcagcuggccaaacugcucuacguccacauguugggcuaccccgcccacuuuggacagauggagugccugaaacugaucgccuccuccagauucacagacaagagggugggcuaccugggggccaugcuucuauuggaugagaggcacgaugcccaccugcucauuaccaacagcaucaagaaugaccugagccaggggauucagccaguacaaggccuggccuugugcacuuugagcaccaugggcucugcugagaugugccgagaccuggccccagagguggagaaacugcuccugcagcccagucccuacgugcgcaagaaggcuauucugacugcagugcacaugauccggaaggucccugaacucuccagugucuuccucccacccugugcccaacugcuucaugagcgucaccauggcauccugcugggcaccaucacgcugaucacggagcucugcgaacgaagcccugcagcccucaggcacuuccgaaaggugguaccccagcugguacacauccuccggacucuggugacaaugggauacuccacagaacacagcauaucuggagucagcgaccccuuccugcagguccagauacuucgucugcuucggauccugggccggaaccacgaggagagcagugagaccaugaaugacuugcuggcccagguggccacuaacacggacaccagccgaaaugccggaaaugcgguccuguuugagacaguacucaccaucauggauauccgcucugcagcuggccuacggguucuagcugucaacauucuuggucgcuuccuacucaacagugacaggaacauuagguauguagcccugacaucacugcuucgacuggugcagucugaucacagugcugugcagcggcaucggcccacugugguggaaugucuacgggaaacugaugccucccucagccggagagcccuggaacuaagccuggcucugguaaauagcuccaaugugcgagccaugaugcaagagcugcaggccuuucuggaguccugcccuccugaccuacgggcugacugugccucaggcauccugcuggcugcagagagguuugcuccaaccaaacgcuggcacauagacaccauccugcaugugcugacaacggcgggcacccaugugcgggaugaugcaguggccaaccugacccagcugauugggggggcccaggagcuacaugccuacucugugcgccgccucuacaaugcccuggcagaagacauuucccagcaaccacuggugcagguggcagccuggugcauuggggaguauggggaccuccugcuggcagggaacugcgaggagauugagccccuucagguggacgaagaggaagugcuggcauugcuggaaaaggugcugcagucccacaugucccugccagccacucgaggauaugcccucacagcccucaugaagcucagcacucgccucuguggggacaacaaccgcauccgccaggugguguccaucuacgggagcugcuuggacguggagcugcagcagcgggcuguggaguaugacacacucuuccggaaauacgaccacaugagggcugccauccuggaaaaaaugccucuuguggagcgagauggcccucaggcugaugaggaagcaaaggaaagcaaagaagcagcccagcuuucagaagcagccccagugcccacagagccccaggccucacagcuccuggaucugcuagaucuccuggauggggcuucuggggauguccagcauccuccccaucuggaccccuccccaggaggugcccugguacaccugcuugaccuucccuguguaccuccacccccagcucccaucccagaucucaaaguguuugagcgugagggaguacagcugaaucugucuuucauucgacccccugaaaacccugcuuugcuguuaaucaccaucacugccaccaacuucucagagggugaugucacccauuucaucugccaggcugcugugcccaagagucuccagcugcagcugcaggcccccagugggaacacaguuccagcucgggguggccuuccuaucacccagcucuucagaauccucaauccuaacaaggccccccugcggcuaaagcugcgccucaccuacgaccacuuucaccagucggugcaggagaucuuugaggugaacaacuugccuguggaaucguggcaguaa

SEQ ID NO: 7942 - RNA, 2358 nt, Artificial Sequence
  derived and/or modified sequence opt1 from c-Jun__Homo_sapiens__BAA33390
auggugguccccagccugaagcuccaggaccugaucgaggagauccgcggcgccaagacccaggcccaggagcgggaggugauccagaaggagugcgcgcacauccgcgccuccuuccgggacggggacccggugcaccgccaccggcagcuggccaagcuccuguacguccacaugcugggcuaccccgcccacuucgggcagauggagugccucaagcugaucgccagcucccgcuucaccgacaagcgggugggcuaccugggggcgaugcuccugcuggacgagcgccacgacgcccaccuccugaucacgaacagcaucaagaacgaccugucccagggcauccagcccgugcagggccucgcccugugcacccugagcaccaugggguccgccgagaugugccgggaccucgcgcccgaggucgagaagcugcugcuccagccgagccccuacgugcgcaagaaggccauccugaccgccgugcacaugauccggaagguccccgagcuguccagcguguuccugcccccgugcgcccagcugcugcacgagcgccaccacggcauccuccuggggacgaucacccugaucaccgagcucugcgagcggucccccgccgcgcugcgccacuuccggaagguggucccccagcuggugcacauccuccgcacccuggugacgaugggcuacagcaccgagcacuccaucagcggggucuccgaccccuuccuccaggugcagauccuccggcugcugcgcauccucggccggaaccacgaggagagcuccgagaccaugaacgaccugcuggcccagguggccaccaacacggacaccagccgcaacgccggcaacgccguccucuucgagaccgugcugaccaucauggacauccgguccgcggccgggcugcgcgugcucgccgucaacauccugggccgcuuccugcucaacagcgaccggaacauccgcuacguggcccugacgagccugcugcggcucgugcaguccgaccacagcgccguccagcgccaccggccgaccguggucgagugccugcgcgagaccgacgcgucccugagccggcgcgcccucgagcugucccuggcccucgugaacagcuccaacgugcgggccaugaugcaggagcugcaggccuuccuggagagcugcccgcccgaccuccgcgcggacugcgccuccgggauccugcuggccgccgagcgguucgcgcccaccaagcgcuggcacaucgacacgauccuccacguccugaccaccgccggcacccacgugcgggacgacgccguggccaaccugacgcagcucaucggcggggcccaggagcugcacgcguacagcguccgccggcuguacaacgcccucgccgaggacaucucccagcagccccugguccagguggccgccuggugcaucggcgaguacggggaccugcuccuggcgggcaacugcgaggagaucgagccccuccagguggacgaggaggaggugcuggcccugcuggagaaggugcuccagagccacaugucccugcccgccacccgcggguacgcccugaccgcccucaugaagcugagcacccggcugugcggcgacaacaaccgcauccggcaggucguguccaucuacggcagcugccucgacguggagcugcagcagcgcgcggucgaguacgacacgcuguuccgcaaguacgaccacaugcgggccgccauccucgagaagaugccccugguggagcgcgacgggccgcaggccgacgaggaggcgaaggaguccaaggaggccgcccagcugagcgaggccgcccccgugcccaccgagccccaggcgucccagcuccuggaccugcucgaccugcuggacggcgccagcggggacguccagcacccgccccaccucgaccccagccccggcggggcccuggugcaccuccucgaccugccgugcgugcccccgccgcccgcccccauccccgaccugaaggucuucgagcgggagggcgugcagcucaaccuguccuucauccgcccgcccgagaaccccgcccugcuccugaucaccaucaccgcgacgaacuucagcgagggcgacgugacccacuucaucugccaggccgccguccccaagucccugcagcuccagcugcaggcccccagcgggaacaccgugcccgcccggggcgggcugcccaucacccagcuguuccgcauccugaaccccaacaaggcgccgcugcggcucaagcugcgccugacguacgaccacuuccaccaguccgugcaggagaucuucgaggucaacaaccuccccguggagagcuggcaguga

SEQ ID NO: 7943 - RNA, 2358 nt, Artificial Sequence
  derived and/or modified sequence opt2 from c-Jun__Homo_sapiens__BAA33390
auggucguccccucccucaagcuccaggaccucaucgaggagauccgcggcgccaagacccaggcccaggagcgcgaggucauccagaaggagugcgcccacauccgcgccuccuuccgcgacggcgaccccguccaccgccaccgccagcucgccaagcuccucuacguccacaugcucggcuaccccgcccacuucggccagauggagugccucaagcucaucgccuccucccgcuucaccgacaagcgcgucggcuaccucggcgccaugcuccuccucgacgagcgccacgacgcccaccuccucaucaccaacuccaucaagaacgaccucucccagggcauccagcccguccagggccucgcccucugcacccucuccaccaugggcuccgccgagaugugccgcgaccucgcccccgaggucgagaagcuccuccuccagcccucccccuacguccgcaagaaggccauccucaccgccguccacaugauccgcaagguccccgagcucuccuccgucuuccucccccccugcgcccagcuccuccacgagcgccaccacggcauccuccucggcaccaucacccucaucaccgagcucugcgagcgcucccccgccgcccuccgccacuuccgcaaggucgucccccagcucguccacauccuccgcacccucgucaccaugggcuacuccaccgagcacuccaucuccggcgucuccgaccccuuccuccagguccagauccuccgccuccuccgcauccucggccgcaaccacgaggaguccuccgagaccaugaacgaccuccucgcccaggucgccaccaacaccgacaccucccgcaacgccggcaacgccguccucuucgagaccguccucaccaucauggacauccgcuccgccgccggccuccgcguccucgccgucaacauccucggccgcuuccuccucaacuccgaccgcaacauccgcuacgucgcccucaccucccuccuccgccucguccaguccgaccacuccgccguccagcgccaccgccccaccgucgucgagugccuccgcgagaccgacgccucccucucccgccgcgcccucgagcucucccucgcccucgucaacuccuccaacguccgcgccaugaugcaggagcuccaggccuuccucgaguccugcccccccgaccuccgcgccgacugcgccuccggcauccuccucgccgccgagcgcuucgcccccaccaagcgcuggcacaucgacaccauccuccacguccucaccaccgccggcacccacguccgcgacgacgccgucgccaaccucacccagcucaucggcggcgcccaggagcuccacgccuacuccguccgccgccucuacaacgcccucgccgaggacaucucccagcagccccucguccaggucgccgccuggugcaucggcgaguacggcgaccuccuccucgccggcaacugcgaggagaucgagccccuccaggucgacgaggaggagguccucgcccuccucgagaagguccuccagucccacaugucccuccccgccacccgcggcuacgcccucaccgcccucaugaagcucuccacccgccucugcggcgacaacaaccgcauccgccaggucgucuccaucuacggcuccugccucgacgucgagcuccagcagcgcgccgucgaguacgacacccucuuccgcaaguacgaccacaugcgcgccgccauccucgagaagaugccccucgucgagcgcgacggcccccaggccgacgaggaggccaaggaguccaaggaggccgcccagcucuccgaggccgcccccguccccaccgagccccaggccucccagcuccucgaccuccucgaccuccucgacggcgccuccggcgacguccagcaccccccccaccucgaccccucccccggcggcgcccucguccaccuccucgaccuccccugcgucccccccccccccgcccccauccccgaccucaaggucuucgagcgcgagggcguccagcucaaccucuccuucauccgcccccccgagaaccccgcccuccuccucaucaccaucaccgccaccaacuucuccgagggcgacgucacccacuucaucugccaggccgccguccccaagucccuccagcuccagcuccaggcccccuccggcaacaccguccccgcccgcggcggccuccccaucacccagcucuuccgcauccucaaccccaacaaggccccccuccgccucaagcuccgccucaccuacgaccacuuccaccaguccguccaggagaucuucgaggucaacaaccuccccgucgaguccuggcaguga

SEQ ID NO: 7944 - RNA, 2358 nt, Artificial Sequence
  derived and/or modified sequence opt3 from c-Jun__Homo_sapiens__BAA33390
auggugguccccagccugaagcuccaggaccuuaucgaggaaauuagaggcgccaaaacccaagcucaggagagggaaguuauacagaaggagugcgcacacauccgggccuccuuccgcgauggggacccugugcaucgacaccgucagcuggcgaaauuguuauacguacauaugcugggauauccagcucacuuuggucaaauggaaugucuaaagcucauugccucuucaagauucacagauaaaagggugggcuaccugggggcaaugcuucuguuggacgagcggcaugaugcccaccuccugaucacuaacaguauuaagaaugaccugagccagggaauccagccgguccagggccucgcuuuaugcacgcuguccaccauggguucugcagagaugugucgcgaucuugcccccgaaguggagaaguugcugcuacaaccuucgccauauguuagaaagaaagcuauacucacagccgugcacaugaucaggaaaguccccgaacugucaagcguguuucuuccuccaugcgcgcagcuguugcaugagcggcaccaugggauucuccugggaacuaucaccuuaauuacagagcugugugaacgcagucccgcagcccuccgacacuucagaaagguaguuccucagcuugugcacauccugaggaccuuggucacuaugggcuacuccacagagcauucuauaagcggcguguccgacccauuucuacaggugcaaauucugcggcuccugcguauccuugggcgcaaccacgaagagucaagugaaaccaugaaugaucuguuggcucaggucgccacgaacacugacaccagcagaaaugcaggaaacgcuguucucuucgagacagugcugacuauuauggauaucaggucugccgcggguuuacggguacuggccgugaauauccuaggccgauuucuccugaacuccgaccgcaauauuagauaugucgcacuuaccucauugcugaggcucgugcagagcgaucauagugcuguucaacggcaccgcccgacaguggucgagugccugagagaaaccgacgccucucuuuccaggcgugcucuggaguugagccucgcccuggugaacucgucuaauguacgggcaaugaugcaggaauuacaggccuuccuggaguccugucccccugaccuacgagcugauugcgcgucagggauacuccuggcagccgaaagauuugcuccaacgaaaagguggcauaucgacacuauucuucacguuuugacaaccgccggaacucacgugcgcgaugacgcagucgccaaccugacacagcucaucggcggugcucaagagcugcaugccuacagugugcggagauuauauaaugcacuggcggaggauauaagccagcagccccuuguccagguggcugccugguguauuggggaauacggagacuugcuccuggcaggcaacugcgaggaaaucgagccucuacaaguugaugaagaggaggugcuggcccuccuggaaaagguacuucagucccacaugucuuugccagcuaccaggggcuacgcccugacggcauuaaugaagcucagcacccgccuguguggggacaauaaccgaauccggcaggucgugucaauuuauggaaguugccuugauguugagcugcagcaacgugcuguggaauacgacacauuguucagaaaauaugaucauaugagggccgcgauccucgagaagaugccccuggucgagcgcgacgguccgcaggccgacgaagaggcuaaagaauccaaggaggcagcccagcuaagcgaagcugccccugugcccacugagccacaggcaucucaacugcucgaucugcuugacuugcuggauggcgcgucaggggacguacagcacccuccccacuuagauccaagucccggaggcgcccucgugcaucugcuugaccugccuugcguuccaccgcccccugcuccaauucccgaucuaaaagucuuugagcgggaaggugugcagcucaaccugagcuucauaagaccuccagagaaucccgccuugcuguuaaucaccauuacagcaacuaacuuuuccgaaggggacgugacccacuucaucugucaagcugccgucccgaagucucuccagcugcagcuucaggcaccuucgggcaauacaguuccagccaggggaggccugcccaucacccaauuguuccgcauucucaacccuaauaaagcuccccugcgacuaaagcugcggcuuacuuacgaucauuuucaccagagcgugcaggagauauucgaagugaacaaucucccaguagaguccuggcaguga

SEQ ID NO: 7945 - RNA, 2358 nt, Artificial Sequence
  derived and/or modified sequence opt4 from c-Jun__Homo_sapiens__BAA33390
augguggugcccagccugaagcugcaggaccugaucgaggagaucagaggcgccaagacccaggcccaggagagagaggugauccagaaggagugcgcccacaucagagccagcuucagagacggcgaccccgugcacagacacagacagcuggccaagcugcuguacgugcacaugcugggcuaccccgcccacuucggccagauggagugccugaagcugaucgccagcagcagauucaccgacaagagagugggcuaccugggcgccaugcugcugcuggacgagagacacgacgcccaccugcugaucaccaacagcaucaagaacgaccugagccagggcauccagcccgugcagggccuggcccugugcacccugagcaccaugggcagcgccgagaugugcagagaccuggcccccgagguggagaagcugcugcugcagcccagccccuacgugagaaagaaggccauccugaccgccgugcacaugaucagaaaggugcccgagcugagcagcguguuccugccccccugcgcccagcugcugcacgagagacaccacggcauccugcugggcaccaucacccugaucaccgagcugugcgagagaagccccgccgcccugagacacuucagaaagguggugccccagcuggugcacauccugagaacccuggugaccaugggcuacagcaccgagcacagcaucagcggcgugagcgaccccuuccugcaggugcagauccugagacugcugagaauccugggcagaaaccacgaggagagcagcgagaccaugaacgaccugcuggcccagguggccaccaacaccgacaccagcagaaacgccggcaacgccgugcuguucgagaccgugcugaccaucauggacaucagaagcgccgccggccugagagugcuggccgugaacauccugggcagauuccugcugaacagcgacagaaacaucagauacguggcccugaccagccugcugagacuggugcagagcgaccacagcgccgugcagagacacagacccaccgugguggagugccugagagagaccgacgccagccugagcagaagagcccuggagcugagccuggcccuggugaacagcagcaacgugagagccaugaugcaggagcugcaggccuuccuggagagcugcccccccgaccugagagccgacugcgccagcggcauccugcuggccgccgagagauucgcccccaccaagagauggcacaucgacaccauccugcacgugcugaccaccgccggcacccacgugagagacgacgccguggccaaccugacccagcugaucggcggcgcccaggagcugcacgccuacagcgugagaagacuguacaacgcccuggccgaggacaucagccagcagccccuggugcagguggccgccuggugcaucggcgaguacggcgaccugcugcuggccggcaacugcgaggagaucgagccccugcagguggacgaggaggaggugcuggcccugcuggagaaggugcugcagagccacaugagccugcccgccaccagaggcuacgcccugaccgcccugaugaagcugagcaccagacugugcggcgacaacaacagaaucagacagguggugagcaucuacggcagcugccuggacguggagcugcagcagagagccguggaguacgacacccuguucagaaaguacgaccacaugagagccgccauccuggagaagaugccccugguggagagagacggcccccaggccgacgaggaggccaaggagagcaaggaggccgcccagcugagcgaggccgcccccgugcccaccgagccccaggccagccagcugcuggaccugcuggaccugcuggacggcgccagcggcgacgugcagcaccccccccaccuggaccccagccccggcggcgcccuggugcaccugcuggaccugcccugcgugccccccccccccgcccccauccccgaccugaagguguucgagagagagggcgugcagcugaaccugagcuucaucagaccccccgagaaccccgcccugcugcugaucaccaucaccgccaccaacuucagcgagggcgacgugacccacuucaucugccaggccgccgugcccaagagccugcagcugcagcugcaggcccccagcggcaacaccgugcccgccagaggcggccugcccaucacccagcuguucagaauccugaaccccaacaaggccccccugagacugaagcugagacugaccuacgaccacuuccaccagagcgugcaggagaucuucgaggugaacaaccugcccguggagagcuggcaguga

SEQ ID NO: 7946 - RNA, 2358 nt, Artificial Sequence
  derived and/or modified sequence opt5 from c-Jun__Homo_sapiens__BAA33390
auggugguccccagccugaagcuccaggaccugaucgaggaaauuagaggcgccaaaacccaagcucaggagcgggaaguuauccagaaggagugcgcccacauucgcgcguccuucagagauggggacccugugcaucggcaccgccagcuugcuaaacugcucuacgugcauaugcugggauauccggcccacuuuggccaaauggaaugucuuaagcugaucgccucuagcagauucacagauaaacgggucggguaccucggagcuaugcugcugcucgacgagcgccaugaugcccaucugcuuauuacgaacuccaucaagaaugaccugucucagggcauccagcccgugcaggggcucgcucugugcacccuuagcacaaugggauccgccgagauguguagagaucuggcgccugaaguugagaagcuccugcugcaacccucuccuuaugugcggaaaaaggccauucucaccgcuguccacaugauccgcaaagugcccgaacugagcuccguuuuucuuccuccgugcgcccagcugcuccacgagagacaccauggcauucugcuuggcacaaucacccugauuacagagcucugugaacggagccccgcugcccugcgccacuucagaaagguggucccucagcuggugcacauccuccggacccuggugacgaugggguacucuaccgagcauuccauuagcggagucucugaccccuuucuucagguucaaauccugcgccuccugagaauccuuggccggaaccacgaagaguccagcgaaacaaugaaugaucugcucgcccagguggcgaccaacacagacaccucuagaaaugcugggaacgccgugcuguucgagacgguccugacaauuauggauauccgcuccgcugccggacuccgggugcuggccguuaauauucuuggcagauuucugcucaacagcgaccgcaauauccgguauguggcucugaccucccugcuuagacucguccagucugaucauagcgcggugcaacgccaccggccuacaguuguggagugccugagagaaaccgacgccucccugagccgccgggcucucgagcugucucuugcccuggucaacuccagcaaugugagagccaugaugcaggaacuccaggcuuuccuggagucuugucccccggaccugcgcgccgauugcgcgagcgggauucuucucgcugccgaacgguuugccccuaccaaaagauggcauaucgacacaauccugcacguccugacgaccgcuggaacacacgugcgggaugacgccguugcuaaccucacccagcugauuggcggcgcccaagagcuucaugcguacuccgugcgcagacuguauaaugcccucgcugaggauaucucucagcagccccugguccagguggccgcuugguguauuggggaauacggagaccugcuucucgccggcaacugcgaggaaaucgagccucugcaaguugaugaagaggaggugcuggcgcuccuggaaaagguccuucagagccacaugucccugcccgccacacggggguacgcucucaccgcccugaugaagcugagcacgagacuuuguggagacaauaaccgcauuagacagguggugucuaucuauggcuccugccucgauguugagcugcagcaacgggcugucgaauacgacacacuguuccgcaaauaugaucauaugagagccgccauccucgagaagaugccccugguggagcgggacgggccucaggcugacgaagaggcgaaagaaagcaaggaggccgcucagcuuucugaagccgccccggugcccaccgagccucaggcuucccaacugcucgaucugcuggaccuucuggauggagccagcggcgacguccagcaucccccucaccucgaucccuccccgggcggggcgcuggugcaccuccuggaccuuccuugcguucccccucccccugcucccauuccggaucugaaaguguuugagcgcgaaggaguccagcucaaccugucuuucaucagaccucccgagaaucccgcccugcuucugauuaccaucacagccaccaacuuuagcgaaggcgacgugacacacuucauuugucaagcugccguuccuaagucccuccagcugcagcuccaggcgccgucugggaauacggugcccgcucggggaggccugccuaucacccaacuuuuccgcauucugaaccccaauaaagccccucucagacugaagcugcggcuuacauacgaucauuuucaccagagcguccaggagaucuucgaagugaacaaucugcccguugaguccuggcaguga

SEQ ID NO: 7947 - protein, 331 aa, Artificial Sequence
  c-Jun__Homo_sapiens__P05412
MTAKMETTFYDDALNASFLPSESGPYGYSNPKILKQSMTLNLADPVGSLKPHLRAKNSDLLTSPDVGLLKLASPELERLIIQSSNGHITTTPTPTQFLCPKNVTDEQEGFAEGFVRALAELHSQNTLPSVTSAAQPVNGAGMVAPAVASVAGGSGSGGFSASLHSEPPVYANLSNFNPGALSSGGGAPSYGAAGLAFPAQPQQQQQPPHHLPQQMPVQHPRLQALKEEPQTVPEMPGETPPLSPIDMESQERIKAERKRMRNRIAASKCRKRKLERIARLEEKVKTLKAQNSELASTANMLREQVAQLKQKVMNHVNSGCQLMLTQQLQTF

SEQ ID NO: 7948 - RNA, 996 nt, Artificial Sequence
  c-Jun__Homo_sapiens__AAA59197
augacugcaaagauggaaacgaccuucuaugacgaugcccucaacgccucguuccucccguccgagagcggaccuuauggcuacaguaaccccaagauccugaaacagagcaugacccugaaccuggccgacccaguggggagccugaagccgcaccuccgcgccaagaacucggaccuccucaccucgcccgacguggggcugcucaagcuggcgucgcccgagcuggagcgccugauaauccaguccagcaacgggcacaucaccaccacgccgacccccacccaguuccugugccccaagaacgugacagaugagcaggagggguucgccgagggcuucgugcgcgcccuggccgaacugcacagccagaacacgcugcccagcgucacgucggcggcgcagccggucaacggggcaggcaugguggcucccgcgguagccucgguggcagggggcagcggcagcggcggcuucagcgccagccugcacagcgagccgccggucuacgcaaaccucagcaacuucaacccaggcgcgcugagcagcggcggcggggcgcccuccuacggcgcggccggccuggccuuucccgcgcaaccccagcagcagcagcagccgccgcaccaccugccccagcagaugcccgugcagcacccgcggcugcaggcccugaaggaggagccucagacagugcccgagaugcccggcgagacaccgccccugucccccaucgacauggagucccaggagcggaucaaggcggagaggaagcgcaugaggaaccgcaucgcugccuccaagugccgaaaaaggaagcuggagagaaucgcccggcuggaggaaaaagugaaaaccuugaaagcucagaacucggagcuggcguccacggccaacaugcucagggaacagguggcacagcuuaaacagaaagucaugaaccacguuaacagugggugccaacucaugcuaacgcagcaguugcaaacauuuuga

SEQ ID NO: 7949 - RNA, 996 nt, Artificial Sequence
  derived and/or modified sequence opt1 from c-Jun__Homo_sapiens__AAA59197
augaccgccaagauggagaccacguucuacgacgacgcccugaacgcgagcuuccuccccuccgagagcggcccguacggguacuccaaccccaagauccugaagcagagcaugacccugaaccucgccgaccccgugggcucccugaagccccaccuccgcgccaagaacagcgaccugcugaccuccccggacgucgggcugcucaagcuggccagccccgagcuggagcggcucaucauccaguccagcaacggccacaucaccacgacccccacccccacccaguuccugugcccgaagaacgugacggacgagcaggagggguucgccgagggcuucgugcgcgcgcuggccgagcuccacucccagaacacccugcccagcgucaccuccgccgcccagcccgugaacggcgcggggaugguggcccccgccgucgccagcguggccggcggguccggcagcgggggcuucuccgcgagccugcacuccgagccgcccguguacgccaaccucagcaacuucaaccccggcgcccugagcuccgggggcggggcccccagcuacggcgccgcgggccuggccuucccggcccagccccagcagcagcagcagccgccccaccaccucccccagcagaugcccguccagcacccccggcugcaggcccugaaggaggagccccagaccgugccggagaugcccggggagacgccgccccucucccccaucgacauggagagccaggagcgcaucaaggccgagcggaagcgcaugcggaaccgcaucgcggccuccaagugccggaagcgcaagcuggagcggaucgcccgccuggaggagaaggugaagacccucaaggcccagaacagcgagcuggccuccaccgcgaacaugcugcgggagcaggucgcccagcucaagcagaaggugaugaaccacgugaacagcggcugccagcugaugcugacccagcagcuccagacguucuga

SEQ ID NO: 7950 - RNA, 996 nt, Artificial Sequence
  derived and/or modified sequence opt2 from c-Jun__Homo_sapiens__AAA59197
augaccgccaagauggagaccaccuucuacgacgacgcccucaacgccuccuuccuccccuccgaguccggccccuacggcuacuccaaccccaagauccucaagcaguccaugacccucaaccucgccgaccccgucggcucccucaagccccaccuccgcgccaagaacuccgaccuccucaccucccccgacgucggccuccucaagcucgccucccccgagcucgagcgccucaucauccaguccuccaacggccacaucaccaccacccccacccccacccaguuccucugccccaagaacgucaccgacgagcaggagggcuucgccgagggcuucguccgcgcccucgccgagcuccacucccagaacacccuccccuccgucaccuccgccgcccagcccgucaacggcgccggcauggucgcccccgccgucgccuccgucgccggcggcuccggcuccggcggcuucuccgccucccuccacuccgagccccccgucuacgccaaccucuccaacuucaaccccggcgcccucuccuccggcggcggcgcccccuccuacggcgccgccggccucgccuuccccgcccagccccagcagcagcagcagcccccccaccaccucccccagcagaugcccguccagcacccccgccuccaggcccucaaggaggagccccagaccguccccgagaugcccggcgagacccccccccucucccccaucgacauggagucccaggagcgcaucaaggccgagcgcaagcgcaugcgcaaccgcaucgccgccuccaagugccgcaagcgcaagcucgagcgcaucgcccgccucgaggagaaggucaagacccucaaggcccagaacuccgagcucgccuccaccgccaacaugcuccgcgagcaggucgcccagcucaagcagaaggucaugaaccacgucaacuccggcugccagcucaugcucacccagcagcuccagaccuucuga

SEQ ID NO: 7951 - RNA, 996 nt, Artificial Sequence
  derived and/or modified sequence opt3 from c-Jun__Homo_sapiens__AAA59197
augaccgccaagauggagacaacuuucuacgacgaugcucugaacgcauccuuucuccccuccgaaucuggcccuuauggguacucaaauccaaaaauccuuaagcagaguaugacgcugaacuuggccgacccgguggguagcuuaaaaccccaccugagagcgaagaauagcgaucuacucaccucuccugacgucggacugcuuaaacuggcuucgccagaguuggaaaggcucauuauacaaucaagcaacggccauaucacaacuacccccacaccuacccaguuccugugcccaaagaauguuacugaugagcaggaaggguuugccgagggauucgugcgggcacuggccgagcuccacagucagaacacauuacccuccguaaccucugcugcacaaccugugaauggcgccgguauggucgcuccagccguggcgagcguugcagggggauccggcucaggcggguuuagugccagccugcauucugaaccgcccguguaugcuaaccuuuccaauuucaacccuggagccuugucaagcgguggcggggcaccaaguuacggagcugccggccuggcguuucccgcccagccucagcagcaacagcagccaccccaccaucuaccgcagcaaaugccuguccagcacccccgccuccaggcacugaaggaggaaccacaaacggugccugagaugcccggugagacuccaccccuuucuccuauugacauggaaucccaggagcgaaucaaagcugaacguaagagaaugaggaaucggauugccgcuagcaaaugucgcaagagaaaacuggagaggaucgcccgguuggaagagaagguaaagacccucaaagcacagaacucggagcuggccucuacagcuaauauguuacgcgaacagguugcgcaacugaagcagaaagugaugaaccacgucaauuccgggugccagcucaugcuuacucagcaacugcagaccuucuga

SEQ ID NO: 7952 - RNA, 996 nt, Artificial Sequence
  derived and/or modified sequence opt4 from c-Jun__Homo_sapiens__AAA59197
augaccgccaagauggagaccaccuucuacgacgacgcccugaacgccagcuuccugcccagcgagagcggccccuacggcuacagcaaccccaagauccugaagcagagcaugacccugaaccuggccgaccccgugggcagccugaagccccaccugagagccaagaacagcgaccugcugaccagccccgacgugggccugcugaagcuggccagccccgagcuggagagacugaucauccagagcagcaacggccacaucaccaccacccccacccccacccaguuccugugccccaagaacgugaccgacgagcaggagggcuucgccgagggcuucgugagagcccuggccgagcugcacagccagaacacccugcccagcgugaccagcgccgcccagcccgugaacggcgccggcaugguggcccccgccguggccagcguggccggcggcagcggcagcggcggcuucagcgccagccugcacagcgagccccccguguacgccaaccugagcaacuucaaccccggcgcccugagcagcggcggcggcgcccccagcuacggcgccgccggccuggccuuccccgcccagccccagcagcagcagcagcccccccaccaccugccccagcagaugcccgugcagcaccccagacugcaggcccugaaggaggagccccagaccgugcccgagaugcccggcgagacccccccccugagccccaucgacauggagagccaggagagaaucaaggccgagagaaagagaaugagaaacagaaucgccgccagcaagugcagaaagagaaagcuggagagaaucgccagacuggaggagaaggugaagacccugaaggcccagaacagcgagcuggccagcaccgccaacaugcugagagagcagguggcccagcugaagcagaaggugaugaaccacgugaacagcggcugccagcugaugcugacccagcagcugcagaccuucuga

SEQ ID NO: 7953 - RNA, 996 nt, Artificial Sequence
  derived and/or modified sequence opt5 from c-Jun__Homo_sapiens__AAA59197
augaccgccaagauggagacaacguucuacgacgaugcucugaacgccagcuuucuccccuccgaaucuggcccuuauggguacagcaauccgaaaauccugaagcaguccaugacccuuaaccuggcggaccccgugggaucucucaaaccucaccugagagcuaagaauagcgaucuucugacaucccccgacgugggccuccugaaacuggccucuccugagcucgaacggcugauuauccaaagcuccaacgggcauauuaccacaacccccacaccuacccaguuccuuugcccgaagaauguuacggaugagcaggaaggauuugccgagggcuucgugcgcgcucuggccgagcuccacagccagaacacccugcccucugugacauccgcugcccaaccugucaauggggcgggaaugguggcccccgcuguugccagcguggcuggcggcucuggguccggaggcuuuagcgccucucuucauuccgaaccucccgucuaugcgaaccugagcaauuucaacccgggggcccucuccucuggaggcggggcuccuagcuacggagccgcuggccuggccuuucccgcccagccucagcagcaacagcagccuccccaccaucugccccagcaaaugccggugcagcaccccagacuccaggcucugaaggaggaaccucaaaccguucccgagaugccuggcgagacacccccgcuuuccccuaucgacauggaaagccaggagcggauuaaagcggaacgcaagagaaugcggaaucgcaucgccgcuucuaaauguagaaagcggaaacuggagcgcaucgccagacucgaagagaaggugaagacccugaaagcccagaacuccgagcuugcuagcacggccaauaugcugcgggaacaggucgcgcaacucaagcagaaagugaugaaccacgucaauucugggugccagcugaugcugacacagcaacuccagaccuucuga

SEQ ID NO: 7954 - protein, 418 aa, Artificial Sequence
  c-Jun__Homo_sapiens__P53677
MIHSLFLINSSGDIFLEKHWKSVVSRSVCDYFFEAQERATEAENVPPVIPTPHHYLLSVYRHKIFFVAVIQTEVPPLFVIEFLHRVVDTFQDYFGVCSEPVIKDNVVVVYEVLEEMLDNGFPLATESNILKELIKPPTILRTVVNTITGSTNVGDQLPTGQLSVVPWRRTGVKYTNNEAYFDVIEEIDAIIDKSGSTITAEIQGVIDACVKLTGMPDLTLSFMNPRLLDDVSFHPCVRFKRWESERILSFIPPDGNFRLLSYHVSAQNLVAIPVYVKHNISFRDSSSLGRFEITVGPKQTMGKTIEGVTVTSQMPKGVLNMSLTPSQGTHTFDPVTKMLSWDVGKINPQKLPSLKGTMSLQAGASKPDENPTINLQFKIQQLAISGLKVNRLDMYGEKYKPFKGIKYMTKAGKFQVRT

SEQ ID NO: 7955 - RNA, 1257 nt, Artificial Sequence
  c-Jun__Homo_sapiens__AAH56398
augauccauagucuuuucuugaucaacuccucuggagacauuuuccuggagaaacauuggaaaaguguggucagccguucuguuugugauuacuuuuuugaggcgcaagagagagcuacugaggcagaaaaugugccuccgguuaucccuaccccucaccacuaucucuuaaguguuuaccgccacaagaucuuuuuuguggccgugauccagacggagguccccccucuguuugucauugaguuucuucaccgagugguggacacauuucaggauuauuuuggagucuguucagagccagugaucaaagacaauguaguugugguuuaugagguauuggaagagaugcuugacaaugguuuuccauuggcuaccgagucgaacauucuuaaagaacucauaaagccuccuaccauccuucgaacgguugucaacaccaucacaggaagcacgaaugugggugaccagcuucccacugggcagcugucaguggugccuuggcgacggacuggggugaaauauaccaacaaugaggccuauuuugaugugauugaagagauugaugcaauuauugauaaaucaggcuccacaauuacugcugagauccagggggugauugaugccugugucaagcugacuggcaugccagaccuuacacuuuccuucaugaacccuagguuguuggaugaugucagcuuccauccuuguguucguuucaaacgcugggaaucugagcgcauccucuccuucaucccuccugauggaaacuuccgccugcugucuuaccaugucagugcacagaaucugguugcaaucccaguguaugucaaacauaacaucaguuuccgggacaguaguucccuuggacgcuuugaaauaacggugggacccaagcagacgauggggaagaccauugagggagugacugucaccagccagaugcccaaggggguccugaacaugagccuuacuccaucacaggggacacacacauucgacccagucacaaagaugcugucuugggauguaggaaaaauaaauccacaaaagcuaccaaguuugaaggggaccaugagucuucaggcuggagcuuccaaaccagaugaaaaccccacaauuaaccugcaguuuaagauccagcagcuggccauuucuggacucaaggugaaucgucuggauauguauggagaaaaguacaaacccuuuaagggcauaaaauacaugaccaaagcugggaaguuccaaguucgaaccuga

SEQ ID NO: 7956 - RNA, 1257 nt, Artificial Sequence
  derived and/or modified sequence opt1 from c-Jun__Homo_sapiens__AAH56398
augauccacagccuguuccucaucaacuccagcggcgacaucuuccuggagaagcacuggaaguccguggucagccgcuccgugugcgacuacuucuucgaggcccaggagcgggccaccgaggcggagaacgugcccccggucauccccacgccccaccacuaccugcucagcguguaccgccacaagaucuucuucguggccgucauccagaccgaggugcccccgcuguucgugaucgaguuccugcaccgggucguggacaccuuccaggacuacuucggggugugcuccgagcccgucaucaaggacaacgugguggucguguacgaggugcucgaggagaugcuggacaacggcuucccccuggccaccgagagcaacauccucaaggagcugaucaagcccccgaccauccugcgcacggucgugaacaccaucaccggguccaccaacgugggcgaccagcuccccacggggcagcugagcgucgugcccuggcggcgcaccggcgugaaguacaccaacaacgaggccuacuucgacgucaucgaggagaucgacgccaucaucgacaaguccggcagcaccaucacggcggagauccagggggugaucgacgccugcgucaagcugaccggcaugcccgaccucacccuguccuucaugaacccgcggcugcucgacgacgugagcuuccaccccugcgugcgcuucaagcggugggaguccgagcgcauccugagcuucaucccgcccgacgggaacuuccggcugcucuccuaccacgucagcgcccagaaccugguggccauccccguguacgucaagcacaacaucuccuuccgcgacagcagcucccugggccgguucgagaucaccguggggcccaagcagacgaugggcaagaccaucgagggcgugaccgucaccagccagaugcccaagggggugcucaacaugucccugacgcccagccagggcacccacaccuucgacccggugaccaagaugcuguccugggacgucgggaagaucaacccccagaagcuccccagccugaagggcacgaugucccugcaggcgggcgccagcaagcccgacgagaacccgaccaucaaccuccaguucaagauccagcagcuggccaucuccgggcugaaggugaaccgccucgacauguacggcgagaaguacaagcccuucaaggggaucaaguacaugaccaaggccggcaaguuccaggugcggaccuga

SEQ ID NO: 7957 - RNA, 1257 nt, Artificial Sequence
  derived and/or modified sequence opt2 from c-Jun__Homo_sapiens__AAH56398
augauccacucccucuuccucaucaacuccuccggcgacaucuuccucgagaagcacuggaaguccgucgucucccgcuccgucugcgacuacuucuucgaggcccaggagcgcgccaccgaggccgagaacgucccccccgucauccccaccccccaccacuaccuccucuccgucuaccgccacaagaucuucuucgucgccgucauccagaccgagguccccccccucuucgucaucgaguuccuccaccgcgucgucgacaccuuccaggacuacuucggcgucugcuccgagcccgucaucaaggacaacgucgucgucgucuacgagguccucgaggagaugcucgacaacggcuucccccucgccaccgaguccaacauccucaaggagcucaucaagccccccaccauccuccgcaccgucgucaacaccaucaccggcuccaccaacgucggcgaccagcuccccaccggccagcucuccgucguccccuggcgccgcaccggcgucaaguacaccaacaacgaggccuacuucgacgucaucgaggagaucgacgccaucaucgacaaguccggcuccaccaucaccgccgagauccagggcgucaucgacgccugcgucaagcucaccggcaugcccgaccucacccucuccuucaugaacccccgccuccucgacgacgucuccuuccaccccugcguccgcuucaagcgcugggaguccgagcgcauccucuccuucaucccccccgacggcaacuuccgccuccucuccuaccacgucuccgcccagaaccucgucgccauccccgucuacgucaagcacaacaucuccuuccgcgacuccuccucccucggccgcuucgagaucaccgucggccccaagcagaccaugggcaagaccaucgagggcgucaccgucaccucccagaugcccaagggcguccucaacaugucccucacccccucccagggcacccacaccuucgaccccgucaccaagaugcucuccugggacgucggcaagaucaacccccagaagcuccccucccucaagggcaccaugucccuccaggccggcgccuccaagcccgacgagaaccccaccaucaaccuccaguucaagauccagcagcucgccaucuccggccucaaggucaaccgccucgacauguacggcgagaaguacaagcccuucaagggcaucaaguacaugaccaaggccggcaaguuccagguccgcaccuga

SEQ ID NO: 7958 - RNA, 1257 nt, Artificial Sequence
  derived and/or modified sequence opt3 from c-Jun__Homo_sapiens__AAH56398
augauccacagccuguuccucauuaacuccucuggcgacauauuucuugagaagcauuggaaaucaguggucaguagaagcguuugcgauuacuucuuugaagcccaggagagggcuaccgaagcagagaaugugcccccuguaaucccaacaccgcaccauuaucuguuguccguguaccggcacaagauuuucuuugucgccgugauccaaacugaaguucccccuuuauucgugauugaguuucugcaucgcgucguggacacguuccaggauuauuuugggguauguucugagccaguuaucaaagacaacguggucgugguguacgaaguccuagaggaaaugcucgauaauggauucccccuggcgaccgagucgaacauacuuaaggagcugaucaaaccuccaacaauuuugcgaacuguugugaauaccaucacagguucaaccaacguaggcgaccagcuccccacugggcagcugagcguggucccuuggcguagaacaggagugaaguauaccaauaacgaggcuuacuuugauguuauugaagaaaucgacgccauaauugauaagaguggcuccacgaucacugcagagauucaaggugugaucgacgccugcgucaaacugaccgggaugccagaucucacauuaucuuucaugaauccgaggcugcuugacgaugugagcuuucaccccuguguacgguucaagcgcugggaauccgagagaaucuugucauucauuccuccagacggaaacuuuaggcugcuaaguuaucacguuagcgcucagaaucucguggcaauacccgucuacgugaaacauaacaucucuuuccgggacuccucaagccugggccgcuuugagauuacugucggcccuaagcagaccauggggaaaacaaucgaaggagugaccguuacgagucagaugccaaagggugugcuuaauaugucucugacucccucccaaggcacacacaccuucgauccgguaacuaagauguugagcugggacgucgggaaaauaaacccucagaagcuccccucgcugaaaggaacaaugucuuuacaggccggcgcuuccaagccagaugagaauccuaccauuaaccugcaguuuaaaauccaacagcucgccaucucaggucuuaaggugaaccgacuggacauguacggggaaaaauauaagcccuucaagggaauuaaauacaugacgaaggcgggcaaauuucagguuagaaccuga

SEQ ID NO: 7959 - RNA, 1257 nt, Artificial Sequence
  derived and/or modified sequence opt4 from c-Jun__Homo_sapiens__AAH56398
augauccacagccuguuccugaucaacagcagcggcgacaucuuccuggagaagcacuggaagagcguggugagcagaagcgugugcgacuacuucuucgaggcccaggagagagccaccgaggccgagaacgugccccccgugauccccaccccccaccacuaccugcugagcguguacagacacaagaucuucuucguggccgugauccagaccgaggugcccccccuguucgugaucgaguuccugcacagagugguggacaccuuccaggacuacuucggcgugugcagcgagcccgugaucaaggacaacgugguggugguguacgaggugcuggaggagaugcuggacaacggcuucccccuggccaccgagagcaacauccugaaggagcugaucaagccccccaccauccugagaaccguggugaacaccaucaccggcagcaccaacgugggcgaccagcugcccaccggccagcugagcguggugcccuggagaagaaccggcgugaaguacaccaacaacgaggccuacuucgacgugaucgaggagaucgacgccaucaucgacaagagcggcagcaccaucaccgccgagauccagggcgugaucgacgccugcgugaagcugaccggcaugcccgaccugacccugagcuucaugaaccccagacugcuggacgacgugagcuuccaccccugcgugagauucaagagaugggagagcgagagaauccugagcuucaucccccccgacggcaacuucagacugcugagcuaccacgugagcgcccagaaccugguggccauccccguguacgugaagcacaacaucagcuucagagacagcagcagccugggcagauucgagaucaccgugggccccaagcagaccaugggcaagaccaucgagggcgugaccgugaccagccagaugcccaagggcgugcugaacaugagccugacccccagccagggcacccacaccuucgaccccgugaccaagaugcugagcugggacgugggcaagaucaacccccagaagcugcccagccugaagggcaccaugagccugcaggccggcgccagcaagcccgacgagaaccccaccaucaaccugcaguucaagauccagcagcuggccaucagcggccugaaggugaacagacuggacauguacggcgagaaguacaagcccuucaagggcaucaaguacaugaccaaggccggcaaguuccaggugagaaccuga

SEQ ID NO: 7960 - RNA, 1257 nt, Artificial Sequence
  derived and/or modified sequence opt5 from c-Jun__Homo_sapiens__AAH56398
augauccacagccuguuccucauuaacuccucuggcgacaucuuucuggagaagcauuggaaaagcguggucuccagaucuguuugcgauuacuucuuugaagcccaggagcgggcuaccgaagccgagaaugugcccccugugauuccgacaccccaccauuaucuucugagcgucuaccgccacaagaucuucuuuguggcgguuauucaaacggaagugccuccccucuucgucaucgaguuucugcauagagugguugacaccuuccaggauuauuuugggguguguuccgagccugucaucaaagacaacgugguggucguuuacgaagugcuugaggaaaugcuggauaauggauucccccucgcuacagagucuaacauucugaaggagcugaucaaaccuccgaccauucuccggacaguggucaauaccaucacaggcagcaccaacgugggggaccagcugcccacgggacagcuuuccguugugccuuggcgcagaaccggcgucaaguauacaaauaacgaagccuacuuugaugugauugaggaaaucgacgccauuaucgauaagagcgggucuaccaucacagcugagauucaaggaguuaucgacgccugcgugaaacugaccggcaugcccgaucucacgcuguccuucaugaauccucggcuucuggacgaugucagcuuucaccccugugugcgcuucaagagaugggaaucugagcggauucucuccuucaucccgccugacggcaacuuucgccugcugagcuaucacgucucugcucagaaucucguggccauucccguuuacgugaaacauaacaucuccuucagagacagcuccucucuggggcgguuugagaucacagucggaccuaagcagaccaugggcaaaacaauugaaggggugaccguuaccagccagaugcccaagggagugcuuaauaugucccugacacccagccaaggcacgcacaccuucgauccugucacaaagaugcucucuugggacguggggaaaaucaacccgcagaagcugcccucccuuaaaggaaccaugagccugcaggcgggcgccucuaagccugaugagaaucccacaauuaaccuccaguuuaaaauccaacagcuggcuauuagcggccugaaggugaaccgccucgacauguacggggaaaaauauaagccuuucaagggaaucaaauacaugaccaaggccggcaaauuucagguuagaacguga

SEQ ID NO: 7961 - protein, 158 aa, Artificial Sequence
  c-Jun__Homo_sapiens__P61966
MMRFMLLFSRQGKLRLQKWYLATSDKERKKMVRELMQVVLARKPKMCSFLEWRDLKVVYKRYASLYFCCAIEGQDNELITLELIHRYVELLDKYFGSVCELDIIFNFEKAYFILDEFLMGGDVQDTSKKSVLKAIEQADLLQEEDESPRSVLEEMGLA

SEQ ID NO: 7962 - RNA, 477 nt, Artificial Sequence
  c-Jun__Homo_sapiens__BAA33391
augaugcgguucaugcuauuauucagccggcagggaaaacugcggcugcaaaaaugguaccuggccacuucggacaaggaacggaagaagauggugcgcgagcucaugcagguuguccuggcucgaaagcccaagaugugcagcuuccuggaguggagggaccucaaaguugucuauaagagauaugccagccucuacuucugcugcgccaucgagggccaagacaaugagcucaucacacuggagcugauccaccgauacguggagcucuuagacaaauacuuuggcagugugugcgagcuggacaucaucuucaacuuugagaaggccuacuucauccuggaugaguuuuugauggggggggauguccaggacaccuccaagaagagugugcugaaagccaucgagcaggcugaccuacugcaagaggaggaugagucgccacggagugugcuggaggagauggguuuggcauag

SEQ ID NO: 7963 - RNA, 477 nt, Artificial Sequence
  derived and/or modified sequence opt1 from c-Jun__Homo_sapiens__BAA33391
augaugcgcuucaugcuccuguucagccggcagggcaagcugcgccugcagaagugguaccucgccaccuccgacaaggagcggaagaagauggugcgcgagcugaugcaggucgugcuggcccggaagcccaagaugugcagcuuccucgaguggcgcgaccugaagguggucuacaagcgguacgcgucccuguacuucugcugcgccaucgaggggcaggacaacgagcucaucacccuggagcugauccaccgcuacguggagcuccuggacaaguacuucggcagcgugugcgagcuggacaucaucuucaacuucgagaaggccuacuucauccucgacgaguuccugaugggcggggacguccaggacacguccaagaaguccgugcugaaggccaucgagcaggccgaccuccugcaggaggaggacgagagcccgcggagcgugcuggaggagauggggcucgcguga

SEQ ID NO: 7964 - RNA, 477 nt, Artificial Sequence
  derived and/or modified sequence opt2 from c-Jun__Homo_sapiens__BAA33391
augaugcgcuucaugcuccucuucucccgccagggcaagcuccgccuccagaagugguaccucgccaccuccgacaaggagcgcaagaagaugguccgcgagcucaugcaggucguccucgcccgcaagcccaagaugugcuccuuccucgaguggcgcgaccucaaggucgucuacaagcgcuacgccucccucuacuucugcugcgccaucgagggccaggacaacgagcucaucacccucgagcucauccaccgcuacgucgagcuccucgacaaguacuucggcuccgucugcgagcucgacaucaucuucaacuucgagaaggccuacuucauccucgacgaguuccucaugggcggcgacguccaggacaccuccaagaaguccguccucaaggccaucgagcaggccgaccuccuccaggaggaggacgaguccccccgcuccguccucgaggagaugggccucgccuga

SEQ ID NO: 7965 - RNA, 477 nt, Artificial Sequence
  derived and/or modified sequence opt3 from c-Jun__Homo_sapiens__BAA33391
augaugagauucaugcugcucuuuagcaggcagggcaaacuucggcugcaaaagugguacuuggccaccuccgacaaggagcgcaaaaagauggugcgagaauuaaugcaggucguucuggcucguaaacccaagaugugcucuuuccuagaguggagagaucucaaggugguauauaaaagguacgcaucacuguauuuuuguugcgccaucgaagggcaggacaacgagcuuauuacacuggaauugauacaccgguacguggagcuccuggauaaguauuucggaagugucugugagcuggacaucauuuuuaauuucgaaaaagcguacuuuauccucgaugaguucuuaauggguggcgacgugcaggauacuagcaagaaauccguucugaaggcuauugaacaagccgaccuuuugcaggaggaggaugaaucuccucgcucggugcuggaggaaauggggcuagcauga

SEQ ID NO: 7966 - RNA, 477 nt, Artificial Sequence
  derived and/or modified sequence opt4 from c-Jun__Homo_sapiens__BAA33391
augaugagauucaugcugcuguucagcagacagggcaagcugagacugcagaagugguaccuggccaccagcgacaaggagagaaagaagauggugagagagcugaugcagguggugcuggccagaaagcccaagaugugcagcuuccuggaguggagagaccugaaggugguguacaagagauacgccagccuguacuucugcugcgccaucgagggccaggacaacgagcugaucacccuggagcugauccacagauacguggagcugcuggacaaguacuucggcagcgugugcgagcuggacaucaucuucaacuucgagaaggccuacuucauccuggacgaguuccugaugggcggcgacgugcaggacaccagcaagaagagcgugcugaaggccaucgagcaggccgaccugcugcaggaggaggacgagagccccagaagcgugcuggaggagaugggccuggccuga

SEQ ID NO: 7967 - RNA, 477 nt, Artificial Sequence
  derived and/or modified sequence opt5 from c-Jun__Homo_sapiens__BAA33391
augaugagauucaugcugcucuuuagccggcagggcaagcugcgccuucaaaaaugguaccuggccaccuccgacaaggagcggaaaaagauggugagagaacucaugcaggucguucuggcucgcaaacccaagaugugcucuuuccuugaguggagagaucugaaggugguguauaaacgguacgccagccucuauuuuuguugcgcgaucgaagggcaggacaacgagcugauuacacuggaacucauccaccgcuacgucgagcugcuugauaaguauuucggauccgugugugagcuggacauuaucuuuaauuucgaaaaagccuacuuuauucucgaugaguuccugaugggcggggacguucaggauacgucuaagaaaagcgugcuuaaggcuaucgaacaagccgaccugcuccaggaggaggaugaauccccuagaucuguccuggaggaaaugggacuggcuuga

SEQ ID NO: 7968 - protein, 302 aa, Artificial Sequence
  c-Jun__Homo_sapiens__Q63HQ0
MGNCCWTQCFGLLRKEAGRLQRVGGGGGSKYFRTCSRGEHLTIEFENLVESDEGESPGSSHRPLTEEEIVDLRERHYDSIAEKQKDLDKKIQKELALQEEKLRLEEEALYAAQREAARAAKQRKLLEQERQRIVQQYHPSNNGEYQSSGPEDDFESCLRNMKSQYEVFRSSRLSSDATVLTPNTESSCDLMTKTKSTSGNDDSTSLDLEWEDEEGMNRMLPMRERSKTEEDILRAALKYSNKKTGSNPTSASDDSNGLEWENDFVSAEMDDNGNSEYSGFVNPVLELSDSGIRHSDTDQQTR

SEQ ID NO: 7969 - RNA, 909 nt, Artificial Sequence
  c-Jun__Homo_sapiens__AAY40962
auggggaacugcugcuggacgcagugcuucggacugcuucgcaaggaagcggggcggcugcagcgaguaggcggcggcggaggauccaaguauuuuagaacaugcucaagaggugagcacuuaacaauagaguuugagaaucuaguagaaagugaugaaggggagagcccaggaagcagucauaggccucuuacugaggaagaaauuguugaccuaagagaaaggcauuaugauuccauugccgaaaaacaaaaagaucuugauaagaaaauucaaaaagaguuagccuuacaagaagagaaguuaagacuagaagaagaagcuuuauacgcugcacagcgugaagcagccagggcagcaaagcagcgaaagcucuuggagcaagaaaggcagagaauugugcagcaauaucauccuuccaacaauggagaauaucaaaguucaggaccagaagaugacuucgaaucuuguuugagaaauaugaagucacaguaugaaguuuuucgaaguaguagacucucaucagaugcuacaguuuugacaccaaauacagaaagcaguugugauuuaaugaccaaaacuaaaucaacuaguggaaaugacgacagcacauccuuagaucuagagugggaagaugaagaaggaaugaauagaaugcuuccaaugagagaacguuccaaaacagaggaagacauucuacgggcagcacuuaaguauagcaacaagaagacuggaaguaauccuacaucagccucugaugauuccaaugggcuggagugggaaaaugauuuuguuagugccgaaauggaugauaauggaaauuccgaguauucuggauuuguaaauccuguauuagaacugucugauucuggcauaaggcauucugacacagaucaacagacucgauag

SEQ ID NO: 7970 - RNA, 909 nt, Artificial Sequence
  derived and/or modified sequence opt1 from c-Jun__Homo_sapiens__AAY40962
augggcaacugcugcuggacccagugcuucgggcugcuccgcaaggaggccggccggcugcagcgcgucgggggcgggggcggcagcaaguacuuccggaccugcucccgcggggagcaccugacgaucgaguucgagaaccucguggagagcgacgagggcgagucccccgggagcucccaccggccgcugaccgaggaggagaucguggaccugcgcgagcggcacuacgacagcaucgccgagaagcagaaggaccucgacaagaagauccagaaggagcuggcgcugcaggaggagaagcuccgccuggaggaggaggcccuguacgccgcccagcgggaggccgcgcgcgccgccaagcagcggaagcuccuggagcaggagcgccagcggaucgugcagcaguaccaccccuccaacaacggcgaguaccagagcuccgggcccgaggacgacuucgagagcugccugcgcaacaugaagucccaguacgaggucuuccggagcucccgccucagcuccgacgccaccgugcugacccccaacacggagagcuccugcgaccugaugaccaagaccaagagcaccuccggcaacgacgacagcacgagccucgaccuggagugggaggacgaggagggcaugaaccggaugcugccgaugcgcgagcgguccaagaccgaggaggacauccuccgcgcggcccugaaguacagcaacaagaagaccggguccaaccccaccagcgccuccgacgacagcaacggccuggagugggagaacgacuucguguccgccgagauggacgacaacgggaacagcgaguacuccggcuucgucaaccccgugcucgagcugagcgacuccggcauccggcacagcgacacggaccagcagacccgcuga

SEQ ID NO: 7971 - RNA, 909 nt, Artificial Sequence
  derived and/or modified sequence opt2 from c-Jun__Homo_sapiens__AAY40962
augggcaacugcugcuggacccagugcuucggccuccuccgcaaggaggccggccgccuccagcgcgucggcggcggcggcggcuccaaguacuuccgcaccugcucccgcggcgagcaccucaccaucgaguucgagaaccucgucgaguccgacgagggcgagucccccggcuccucccaccgcccccucaccgaggaggagaucgucgaccuccgcgagcgccacuacgacuccaucgccgagaagcagaaggaccucgacaagaagauccagaaggagcucgcccuccaggaggagaagcuccgccucgaggaggaggcccucuacgccgcccagcgcgaggccgcccgcgccgccaagcagcgcaagcuccucgagcaggagcgccagcgcaucguccagcaguaccaccccuccaacaacggcgaguaccaguccuccggccccgaggacgacuucgaguccugccuccgcaacaugaagucccaguacgaggucuuccgcuccucccgccucuccuccgacgccaccguccucacccccaacaccgaguccuccugcgaccucaugaccaagaccaaguccaccuccggcaacgacgacuccaccucccucgaccucgagugggaggacgaggagggcaugaaccgcaugcuccccaugcgcgagcgcuccaagaccgaggaggacauccuccgcgccgcccucaaguacuccaacaagaagaccggcuccaaccccaccuccgccuccgacgacuccaacggccucgagugggagaacgacuucgucuccgccgagauggacgacaacggcaacuccgaguacuccggcuucgucaaccccguccucgagcucuccgacuccggcauccgccacuccgacaccgaccagcagacccgcuga

SEQ ID NO: 7972 - RNA, 909 nt, Artificial Sequence
  derived and/or modified sequence opt3 from c-Jun__Homo_sapiens__AAY40962
augggcaacugcuguuggacccagugcuucgggcugcucagaaaggaggccggaaggcuucaacggguggguggcgggggaggcagcaaauacuuucgcacauguucccgaggugaacaccugacuaucgaguucgaaaauuuggucgagucugacgaaggggagucacccggaaguagccaucguccuuuaacggaggaagagauuguugaucugagagaaaggcacuaugacuccauagcugagaagcagaaagaucuagacaagaaaauccagaaggagcucgcacugcaggaagagaaacuucggcuggaagaggaagccuuguacgcggcucaacgcgaggccgcaagagccgcuaagcagaggaagcuccuggagcaggaacggcagcgcauugugcaacaguaucauccaucuaacaauggcgaguaccagucgucaggcccggaagaugacuuugagagcugccugcgaaacaugaaaagucaguaugaaguauucagauccucuaggcucagcuccgaugcaaccguguuaacacccaauacugagucaaguugugaccugaugaccaagacaaaaagcaccucugggaacgaugacuccacuucacuugauuuggagugggaagacgaggaaggaaugaaucggaugcugccuaugcgugagcgcagcaagacagaagaggauauccuaagagccgcucucaaguacaguaacaaaaagaccgguucuaauccaacguccgccagcgacgacucgaacggccuggagugggaaaaugauuuugucucugcggagauggacgauaacggaaauuccgaauauucaggguucgugaaccccguucuugagcugagugacagcggcauuaggcacuccgauacugaccaacagacccgguga

SEQ ID NO: 7973 - RNA, 909 nt, Artificial Sequence
  derived and/or modified sequence opt4 from c-Jun__Homo_sapiens__AAY40962
augggcaacugcugcuggacccagugcuucggccugcugagaaaggaggccggcagacugcagagagugggcggcggcggcggcagcaaguacuucagaaccugcagcagaggcgagcaccugaccaucgaguucgagaaccugguggagagcgacgagggcgagagccccggcagcagccacagaccccugaccgaggaggagaucguggaccugagagagagacacuacgacagcaucgccgagaagcagaaggaccuggacaagaagauccagaaggagcuggcccugcaggaggagaagcugagacuggaggaggaggcccuguacgccgcccagagagaggccgccagagccgccaagcagagaaagcugcuggagcaggagagacagagaaucgugcagcaguaccaccccagcaacaacggcgaguaccagagcagcggccccgaggacgacuucgagagcugccugagaaacaugaagagccaguacgagguguucagaagcagcagacugagcagcgacgccaccgugcugacccccaacaccgagagcagcugcgaccugaugaccaagaccaagagcaccagcggcaacgacgacagcaccagccuggaccuggagugggaggacgaggagggcaugaacagaaugcugcccaugagagagagaagcaagaccgaggaggacauccugagagccgcccugaaguacagcaacaagaagaccggcagcaaccccaccagcgccagcgacgacagcaacggccuggagugggagaacgacuucgugagcgccgagauggacgacaacggcaacagcgaguacagcggcuucgugaaccccgugcuggagcugagcgacagcggcaucagacacagcgacaccgaccagcagaccagauga

SEQ ID NO: 7974 - RNA, 909 nt, Artificial Sequence
  derived and/or modified sequence opt5 from c-Jun__Homo_sapiens__AAY40962
augggcaacugcuguuggacccagugcuucgggcugcucagaaaggaggccggacggcugcaacgcgugggcgggggaggcgggagcaaauacuuuagaacauguucccggggagaacaccuuacgaucgaguucgaaaaucuggucgagucugacgaaggcgagagccccggcuccucucaucgcccucucaccgaggaagagauuguugaucugagagaacggcacuaugacagcaucgcugagaagcagaaagaucuugacaagaaaauucagaaggagcuggcccuccaggaagagaagcugcgccuggaagaggaagcgcucuacgcugcccaaagagaggccgcucgggccgcuaaacagcgcaagcugcuugagcaggaaagacagcggaucgugcaacaguaucauccguccaacaauggggaguaccagucuagcggacccgaagaugacuuugaguccugccugcgcaacaugaaaagccaguaugaaguguucagaucuucccggcucagcucugaugccacaguccugaccccuaauacagaguccagcugugaccuuaugaccaagacaaaaucuaccuccggcaacgaugacagcacgucccuggaucucgagugggaagacgaggaagggaugaaucgcaugcugcccaugagagagcggucuaagaccgaagaggauauucugagagcggcccucaaguacagcaacaaaaagacaggauccaauccuaccagcgcuucugacgacuccaacggccuggagugggaaaaugauuuugugagcgccgagauggacgauaacggaaauucugaauauagcggguucguuaaccccgugcuugagcuguccgacucuggcauccgccacagcgauacagaccaacagacccgguga

SEQ ID NO: 7975 - protein, 200 aa, Artificial Sequence
  c-Jun__Homo_sapiens__Q7Z5Q8
MLGTGKLGFSFVRITALMVSCNRLWVGTGNGVIISIPLTETVILHQGRLLGLRANKTSGVPGNRPGSVIRVYGDENSDKVTPGTFIPYCSMAHAQLCFHGHRDAVKFFVAVPGQVISPQSSSSGTDLTGDKAGPSAQEPGSQTPLKSMLVISGGEGYIDFRMGDEGGESELLGEDLPLEPSVTKAERSHLIVWQVMYGNE

SEQ ID NO: 7976 - RNA, 603 nt, Artificial Sequence
  c-Jun__Homo_sapiens__AAN12270
auguuagguacuggaaaacugggcuucucuuuugugagaauuacagcucuuauggugucuuguaaucguuuguggguggggacaggaaauggugucauuaucuccaucccauugacagaaaccguaauccuccaccagggacguuuacuggggcugagggcaaauaaaaccucagguguaccaggaaaucguccuggaaguguaauccguguauauggugaugaaaacagugauaaagugacuccagggacauuuauacccuauuguucaauggcacaugcacagcuuugcuuccaugggcaccgggaugcugugaaauucuuuguggcagucccaggucaagucaucagcccacaaaguagcaguaguggcacggaucugacgggugacaaagcagggccaucugcacaggagccugguagucagacgcccuugaagucuaugcuugucaucaguggaggagagggcuacaucgacuuccgaaugggugaugaagguggagaaucagaacuucuuggagaggaucuuccacuugaaccuucugucaccaaagcagaaaggagucacuugauaguguggcaagugauguauggcaaugaguga

SEQ ID NO: 7977 - RNA, 603 nt, Artificial Sequence
  derived and/or modified sequence opt1 from c-Jun__Homo_sapiens__AAN12270
augcugggcaccgggaagcucggcuucagcuucgugcgcaucaccgcccugauggucuccugcaaccggcuguggguggggacgggcaacggggugaucaucagcaucccccucaccgagaccgucauccugcaccagggccgccugcucggccugcgggccaacaagaccuccggggugccgggcaaccgccccgggagcgugauccgggucuacggcgacgagaacuccgacaaggugacgcccgggaccuucauccccuacugcagcauggcgcacgcccagcugugcuuccacggccaccgcgacgccgugaaguucuucgucgccgugccgggccaggugaucagcccccagagcuccagcuccgggaccgaccucaccggcgacaaggccgggcccagcgcgcaggagcccggcucccagacgccgcugaaguccaugcuggucaucuccggcggggagggcuacaucgacuuccggaugggggacgagggcggggagagcgagcuccugggcgaggaccugccccucgagcccuccgugaccaaggccgagcgcagccaccugaucguguggcaggucauguacggcaacgaguga

SEQ ID NO: 7978 - RNA, 603 nt, Artificial Sequence
  derived and/or modified sequence opt2 from c-Jun__Homo_sapiens__AAN12270
augcucggcaccggcaagcucggcuucuccuucguccgcaucaccgcccucauggucuccugcaaccgccucugggucggcaccggcaacggcgucaucaucuccaucccccucaccgagaccgucauccuccaccagggccgccuccucggccuccgcgccaacaagaccuccggcguccccggcaaccgccccggcuccgucauccgcgucuacggcgacgagaacuccgacaaggucacccccggcaccuucauccccuacugcuccauggcccacgcccagcucugcuuccacggccaccgcgacgccgucaaguucuucgucgccguccccggccaggucaucuccccccaguccuccuccuccggcaccgaccucaccggcgacaaggccggccccuccgcccaggagcccggcucccagaccccccucaaguccaugcucgucaucuccggcggcgagggcuacaucgacuuccgcaugggcgacgagggcggcgaguccgagcuccucggcgaggaccucccccucgagcccuccgucaccaaggccgagcgcucccaccucaucgucuggcaggucauguacggcaacgaguga

SEQ ID NO: 7979 - RNA, 603 nt, Artificial Sequence
  derived and/or modified sequence opt3 from c-Jun__Homo_sapiens__AAN12270
augcugggcaccgggaagcucggauucagcuuugugagaaucacagcccuuauggucuccugcaacaggcuguggguugguacuggcaauggggugauuauaucuauccccuugacggagaccguaauuuuacaccagggacggcugcuaggccuccgcgcuaacaaaacaucaggugugccugggaaucgaccaggaagugucauccguguguacggcgacgaaaacagcgauaagguuacuccgggcaccuucauucccuauuguuccauggcacaugcccagcugugcuuucacgggcauagagacgcggugaaauucuuugucgcugugccuggacagguaaucucuccacagucgucaagcagugguacagaucuuaccggcgacaaggccgggcccuccgcacaggagccuggaucucaaacuccacugaaaagcauguugguuauauccggcggugaaggguacaucgauuucaggaugggagacgagggcggcgaaucagagcuccugggggaggaucugccccucgaaccuagugugacaaaggccgagcggagccacuuaauugucuggcaagugauguauggaaaugaauga

SEQ ID NO: 7980 - RNA, 603 nt, Artificial Sequence
  derived and/or modified sequence opt4 from c-Jun__Homo_sapiens__AAN12270
augcugggcaccggcaagcugggcuucagcuucgugagaaucaccgcccugauggugagcugcaacagacugugggugggcaccggcaacggcgugaucaucagcaucccccugaccgagaccgugauccugcaccagggcagacugcugggccugagagccaacaagaccagcggcgugcccggcaacagacccggcagcgugaucagaguguacggcgacgagaacagcgacaaggugacccccggcaccuucauccccuacugcagcauggcccacgcccagcugugcuuccacggccacagagacgccgugaaguucuucguggccgugcccggccaggugaucagcccccagagcagcagcagcggcaccgaccugaccggcgacaaggccggccccagcgcccaggagcccggcagccagaccccccugaagagcaugcuggugaucagcggcggcgagggcuacaucgacuucagaaugggcgacgagggcggcgagagcgagcugcugggcgaggaccugccccuggagcccagcgugaccaaggccgagagaagccaccugaucguguggcaggugauguacggcaacgaguga

SEQ ID NO: 7981 - RNA, 603 nt, Artificial Sequence
  derived and/or modified sequence opt5 from c-Jun__Homo_sapiens__AAN12270
augcugggcaccgggaagcucggauucagcuuugugagaaucacagcccugauggucuccugcaaccggcuuuggguuggcacggggaauggagugauuaucucuauuccccugaccgagacagugauccuccaccagggccgccugcuugggcugagagcuaacaaaaccagcggagucccuggcaaucggccgggcuccgugauucgcguuuacggggacgaaaacucugauaaggugacacccggaaccuucaucccuuauuguagcauggcccaugcgcaacucugcuuucacggccauagagacgcugucaaauucuuuguggccguucccggacaggugaucuccccucagucuagcuccagcgggacagaucugaccggcgacaaggccgggcccucugcucaggagccuggaucccaaacgccgcugaaaagcaugcucgucauuucuggcggcgaaggguacaucgauuuccggaugggagacgagggcggggaauccgagcugcuuggagaggaucugccccucgaaccuagcgugaccaaggccgagcgcucucaccugauuguguggcaggucauguauggcaaugaauga

SEQ ID NO: 7982 - protein, 154 aa, Artificial Sequence
  c-Jun__Homo_sapiens__Q96PC3
MIHFILLFSRQGKLRLQKWYITLPDKERKKITREIVQIILSRGHRTSSFVDWKELKLVYKRYASLYFCCAIENQDNELLTLEIVHRYVELLDKYFGNVCELDIIFNFEKAYFILDEFIIGGEIQETSKKIAVKAIEDSDMLQEVSTVSQTMGER

SEQ ID NO: 7983 - RNA, 465 nt, Artificial Sequence
  c-Jun__Homo_sapiens__AAL09586
augauacauuucauauugcucuucagucgacaagggaaauuacggcuacagaaaugguacaucacucucccugauaaagagaggaagaagaucacccgggaaauuguucagauuauucucucccguggucacaggacaagcaguuuuguugacuggaaggagcuaaaacuuguuuauaaaagguaugcuaguuuauauuuuugcugugcaauagaaaaucaggacaaugagcucuugacgcuagagauugugcaucguuacguggagcugcuggacaaauauuuuggaaaugucugugagcuggauauuaucuuuaauuuugaaaaggcuuauuucauccuggacgaguuuauaauagguggggaaauucaggaaacauccaagaaaauugcugucaaagccauugaagacucugauauguuacaggaggucaguacgguuucccaaaccaugggagaaagauga

SEQ ID NO: 7984 - RNA, 465 nt, Artificial Sequence
  derived and/or modified sequence opt1 from c-Jun__Homo_sapiens__AAL09586
augauccacuucauccuccuguucagccgccagggcaagcugcggcugcagaagugguacaucacccuccccgacaaggagcgcaagaagaucacccgggagaucgugcagaucauccugucccgcgggcaccggacgagcuccuucgucgacuggaaggagcugaagcucguguacaagcgcuacgccagccuguacuucugcugcgccaucgagaaccaggacaacgagcugcucacccuggagaucgugcaccgguacgucgagcugcucgacaaguacuucggcaacgugugcgagcuggacaucaucuucaacuucgagaaggcguacuucauccuggacgaguucaucaucgggggcgagauccaggagaccuccaagaagaucgccgugaaggccaucgaggacagcgacaugcuccaggaggucuccaccgugagccagacgaugggggagcgcuga

SEQ ID NO: 7985 - RNA, 465 nt, Artificial Sequence
  derived and/or modified sequence opt2 from c-Jun__Homo_sapiens__AAL09586
augauccacuucauccuccucuucucccgccagggcaagcuccgccuccagaagugguacaucacccuccccgacaaggagcgcaagaagaucacccgcgagaucguccagaucauccucucccgcggccaccgcaccuccuccuucgucgacuggaaggagcucaagcucgucuacaagcgcuacgccucccucuacuucugcugcgccaucgagaaccaggacaacgagcuccucacccucgagaucguccaccgcuacgucgagcuccucgacaaguacuucggcaacgucugcgagcucgacaucaucuucaacuucgagaaggccuacuucauccucgacgaguucaucaucggcggcgagauccaggagaccuccaagaagaucgccgucaaggccaucgaggacuccgacaugcuccaggaggucuccaccgucucccagaccaugggcgagcgcuga

SEQ ID NO: 7986 - RNA, 465 nt, Artificial Sequence
  derived and/or modified sequence opt3 from c-Jun__Homo_sapiens__AAL09586
augauccacuucauucugcucuuuagcagacagggcaaacuuaggcugcaaaagugguacauaaccuugcccgacaaggagcggaaaaagaucacacgcgaaauugugcagaucauuuuaucccgagggcaucguacuucuucauucgucgauuggaaagagcugaagcuaguuuauaagagauacgccagucucuauuuuugcugugcuaucgaaaaccaggacaaugagcugcuuacgcuggaaauagugcacagguacguagaguugcucgauaaauauuucggaaacgugugcgagcuggacaucauuuuuaauuucgaaaaggcauacuuuauccuggaugaguucauuaucgguggcgaaauacaggagaccagcaaaaagauugccgucaaagcgaucgaggacuccgauaugcuccaagaagugucuacaguuucgcagacuaugggggagcgguga

SEQ ID NO: 7987 - RNA, 465 nt, Artificial Sequence
  derived and/or modified sequence opt4 from c-Jun__Homo_sapiens__AAL09586
augauccacuucauccugcuguucagcagacagggcaagcugagacugcagaagugguacaucacccugcccgacaaggagagaaagaagaucaccagagagaucgugcagaucauccugagcagaggccacagaaccagcagcuucguggacuggaaggagcugaagcugguguacaagagauacgccagccuguacuucugcugcgccaucgagaaccaggacaacgagcugcugacccuggagaucgugcacagauacguggagcugcuggacaaguacuucggcaacgugugcgagcuggacaucaucuucaacuucgagaaggccuacuucauccuggacgaguucaucaucggcggcgagauccaggagaccagcaagaagaucgccgugaaggccaucgaggacagcgacaugcugcaggaggugagcaccgugagccagaccaugggcgagagauga

SEQ ID NO: 7988 - RNA, 465 nt, Artificial Sequence
  derived and/or modified sequence opt5 from c-Jun__Homo_sapiens__AAL09586
augauccacuucauucugcucuuuagcagacagggcaagcugcggcuucaaaaaugguacaucacccugcccgacaaggagcgcaaaaagauuacaagagaaaucgugcagauuauccucucccgggggcaucgcacgucuagcuucgucgauuggaaagagcugaaacuuguuuauaagagauacgccucccuguauuuuugcugugcuaucgaaaaccaggacaaugagcuccugacccuggaaauugugcaccgguacguggagcuccuggauaaguauuucggaaacgucugcgagcuugacaucauuuuuaauuucgaaaaggccuacuuuauccuggaugaguucauuaucggcggggaaauucaggagacaucuaaaaagaucgcggugaaagcuaucgaggacagcgauaugcuccaagaaguuuccaccgugucucagacaaugggagagcgcuga

SEQ ID NO: 7989 - protein, 423 aa, Artificial Sequence
  c-Jun__Homo_sapiens__Q9BXS5
MSASAVYVLDLKGKVLICRNYRGDVDMSEVEHFMPILMEKEEEGMLSPILAHGGVRFMWIKHNNLYLVATSKKNACVSLVFSFLYKVVQVFSEYFKELEEESIRDNFVIIYELLDELMDFGYPQTTDSKILQEYITQEGHKLETGAPRPPATVTNAVSWRSEGIKYRKNEVFLDVIESVNLLVSANGNVLRSEIVGSIKMRVFLSGMPELRLGLNDKVLFDNTGRGKSKSVELEDVKFHQCVRLSRFENDRTISFIPPDGEFELMSYRLNTHVKPLIWIESVIEKHSHSRIEYMIKAKSQFKRRSTANNVEIHIPVPNDADSPKFKTTVGSVKWVPENSEIVWSIKSFPGGKEYLMRAHFGLPSVEAEDKEGKPPISVKFEIPYFTTSGIQVRYLKIIEKSGYQALPWVRYITQNGDYQLRTQ

SEQ ID NO: 7990 - RNA, 1272 nt, Artificial Sequence
  c-Jun__Homo_sapiens__AAK28024
auguccgccagcgccgucuacgugcuggaccugaagggcaaggugcucaucugccggaacuaccguggcgacguggacaugucagagguggagcacuucaugcccauccugauggagaaggaggaggaggggaugcugucgcccauccuggcccacggggggguccguuucauguggaucaaacacaacaaccuguaucugguugccacauccaagaagaacgcgugcgugucgcuggucuuuucuuuccucuauaagguggugcagguguuuuccgaguacuucaaggagcuggaggaggagagcauccgggacaacuuuguuaucaucuacgagcugcuggacgagcucauggacuucggcuacccccagaccaccgacagcaagauccugcaggaguacaucacucaggaaggccacaagcuggaaacaggggccccgcggccaccagccaccgucaccaacgcgguguccuggcgguccgaaggcaucaaguaucggaagaaugagguguucuuggacgucaucgagucugucaaccucuuggucagcgccaacggcaauguccugcgcagcgagaucgugggcuccaucaagaugcgagucuuccucucgggcaugcccgagcugcgccugggccucaacgacaagguccucuuugacaacacgggccgcggcaaaagcaaauccguggagcuggaggaugugaaguuccaccagugugugcggcuaucacgcuucgagaaugaccgcaccaucuccuucaucccacccgacggcgaguucgagcucauguccuaccggcucaacacccacgucaagccuuugauauggaucgagucggugaucgagaagcacucccacagccgcaucgaguacaugaucaaggccaaaagccaguucaagcggcggucaacagccaacaacguggagauccacauucccgugcccaaugaugccgacucacccaaguucaagacgacgguggggagcguuaaguggguccccgagaacagcgagaucgugugguccaucaaguccuucccgggcggcaaggaguaccugaugcgggcccacuucggccugccuaguguggaggccgaagacaaggagggcaagcccccgaucagugucaaguucgagaucccuuacuucacuaccuccggcauccaggugcgcuaccugaagaucauugagaagaguggguaccaggcccugcccugggugcguuauaucacgcagaauggagauuaccagcuccggacccaguga

SEQ ID NO: 7991 - RNA, 1272 nt, Artificial Sequence
  derived and/or modified sequence opt1 from c-Jun__Homo_sapiens__AAK28024
augagcgccagcgccguguacguccuggaccucaagggcaaggugcugaucugccgcaacuaccgcggggacguggacaugagcgaggucgagcacuucaugcccauccugauggagaaggaggaggagggcaugcucuccccgauccuggcgcacgggggcgugcgcuucauguggaucaagcacaacaaccuguaccucguggccaccagcaagaagaacgccugcgucucccugguguucagcuuccuguacaaggugguccagguguucuccgaguacuucaaggagcucgaggaggagagcauccgggacaacuucgugaucaucuacgagcugcuggacgagcucauggacuucggguacccccagaccacggacuccaagauccugcaggaguacaucacccaggagggccacaagcuggagaccggcgcgccccggcccccggccaccgucacgaacgccgugagcuggcgguccgaggggaucaaguaccgcaagaacgagguguuccucgacgucaucgagagcgugaaccugcugguguccgccaacggcaacguccuccggagcgagaucgugggguccaucaagaugcgcguguuccugagcggcaugcccgagcugcggcucgggcugaacgacaagguccuguucgacaacaccggccgcggcaaguccaagagcguggagcucgaggacgugaaguuccaccagugcguccggcugucccgcuucgagaacgaccggaccaucagcuucaucccgcccgacggggaguucgagcugaugagcuaccgccucaacacccacgugaagccccugaucuggaucgaguccgucaucgagaagcacagccacucccggaucgaguacaugaucaaggccaagagccaguucaagcgccgguccacggccaacaacguggagauccacauccccgugcccaacgacgcggacagccccaaguucaagaccaccgucggcuccgugaagugggugccggagaacagcgagaucgucugguccaucaagagcuuccccgggggcaaggaguaccugaugcgcgcccacuucggccuccccuccguggaggccgaggacaaggaggggaagcccccgaucagcgugaaguucgagauccccuacuucaccacguccggcauccagguccgguaccugaagaucaucgagaaguccggguaccaggcccugcccugggugcgcuacaucacccagaacggcgacuaccagcuccggacccaguga

SEQ ID NO: 7992 - RNA, 1272 nt, Artificial Sequence
  derived and/or modified sequence opt2 from c-Jun__Homo_sapiens__AAK28024
auguccgccuccgccgucuacguccucgaccucaagggcaagguccucaucugccgcaacuaccgcggcgacgucgacauguccgaggucgagcacuucaugcccauccucauggagaaggaggaggagggcaugcucucccccauccucgcccacggcggcguccgcuucauguggaucaagcacaacaaccucuaccucgucgccaccuccaagaagaacgccugcgucucccucgucuucuccuuccucuacaaggucguccaggucuucuccgaguacuucaaggagcucgaggaggaguccauccgcgacaacuucgucaucaucuacgagcuccucgacgagcucauggacuucggcuacccccagaccaccgacuccaagauccuccaggaguacaucacccaggagggccacaagcucgagaccggcgccccccgcccccccgccaccgucaccaacgccgucuccuggcgcuccgagggcaucaaguaccgcaagaacgaggucuuccucgacgucaucgaguccgucaaccuccucgucuccgccaacggcaacguccuccgcuccgagaucgucggcuccaucaagaugcgcgucuuccucuccggcaugcccgagcuccgccucggccucaacgacaagguccucuucgacaacaccggccgcggcaaguccaaguccgucgagcucgaggacgucaaguuccaccagugcguccgccucucccgcuucgagaacgaccgcaccaucuccuucaucccccccgacggcgaguucgagcucauguccuaccgccucaacacccacgucaagccccucaucuggaucgaguccgucaucgagaagcacucccacucccgcaucgaguacaugaucaaggccaagucccaguucaagcgccgcuccaccgccaacaacgucgagauccacauccccguccccaacgacgccgacucccccaaguucaagaccaccgucggcuccgucaaguggguccccgagaacuccgagaucgucugguccaucaaguccuuccccggcggcaaggaguaccucaugcgcgcccacuucggccuccccuccgucgaggccgaggacaaggagggcaagccccccaucuccgucaaguucgagauccccuacuucaccaccuccggcauccagguccgcuaccucaagaucaucgagaaguccggcuaccaggcccuccccuggguccgcuacaucacccagaacggcgacuaccagcuccgcacccaguga

SEQ ID NO: 7993 - RNA, 1272 nt, Artificial Sequence
  derived and/or modified sequence opt3 from c-Jun__Homo_sapiens__AAK28024
augagcgccuccgcuguguacguccuggaccucaagggcaaaguucuuaucugcagaaacuauaggggagauguggacaugucugagguagaacacuucaugcccauucugauggagaaggaagaggaagggauguugucaccuauauuagcacaugguggcgugcgguuuauguggaucaaacacaauaaccuguaccuagucgccaccaguaagaaaaaugcgugugugagccucguuuucuccuuucuguauaaggugguccagguguucucugaguacuuuaaggagcuugaagaggaaucgauucgcgauaacuucguaaucauuuaugagcuguuggacgagcucauggauuuuggguacccacaaacaacugacucaaaaauccugcaggaauauauaacgcaggagggacauaagcuggaaaccggcgcuccgcgacccccugccacaguuacuaaugcagugagcuggcguagugaggguaucaaauacagaaagaacgaagucuuccucgaugugauugaguccgugaauuuacuggucucugccaacgggaauguucuuaggagcgagaucgugggauccauuaaaaugcggguauuuuugucaggcaugccagaacugcgccuaggccucaacgacaaggugcuguucgauaauaccgggagaggaaagaguaaaagcgucgagcuugaagacgugaaguuucaccagugcguuaggcugucucgguucgagaacgaucgcacaaucuccuuuauacccccugacggugaguucgaauugaugucauaccgacucaauacccaugugaaaccacugauuuggaucgagagcgucauugaaaagcacagucacucuagaaucgaguauaugaucaaagcuaagucccaauucaaaaggcggagcacugcaaacaauguggaaauucauauacccguaccuaacgaugccgacucgccaaaguuuaagacaaccguuggcucugugaaaugggucccggagaacuccgaaaucguguggucaauuaagaguuuccccgggggaaaagaguacuuaaugcgugcucacuuuggccugccuagcgucgaggccgaagacaaggaggguaaaccacccaucuccgugaaguucgaaauaccuuauuuuacgacuucugggauucagguucgcuaccucaagaucaucgagaaaagcggauaucaggcgcuuccaugggugagauacauuacccagaauggcgauuaucaacugaggacacaguga

SEQ ID NO: 7994 - RNA, 1272 nt, Artificial Sequence
  derived and/or modified sequence opt4 from c-Jun__Homo_sapiens__AAK28024
augagcgccagcgccguguacgugcuggaccugaagggcaaggugcugaucugcagaaacuacagaggcgacguggacaugagcgagguggagcacuucaugcccauccugauggagaaggaggaggagggcaugcugagccccauccuggcccacggcggcgugagauucauguggaucaagcacaacaaccuguaccugguggccaccagcaagaagaacgccugcgugagccugguguucagcuuccuguacaagguggugcagguguucagcgaguacuucaaggagcuggaggaggagagcaucagagacaacuucgugaucaucuacgagcugcuggacgagcugauggacuucggcuacccccagaccaccgacagcaagauccugcaggaguacaucacccaggagggccacaagcuggagaccggcgcccccagaccccccgccaccgugaccaacgccgugagcuggagaagcgagggcaucaaguacagaaagaacgagguguuccuggacgugaucgagagcgugaaccugcuggugagcgccaacggcaacgugcugagaagcgagaucgugggcagcaucaagaugagaguguuccugagcggcaugcccgagcugagacugggccugaacgacaaggugcuguucgacaacaccggcagaggcaagagcaagagcguggagcuggaggacgugaaguuccaccagugcgugagacugagcagauucgagaacgacagaaccaucagcuucaucccccccgacggcgaguucgagcugaugagcuacagacugaacacccacgugaagccccugaucuggaucgagagcgugaucgagaagcacagccacagcagaaucgaguacaugaucaaggccaagagccaguucaagagaagaagcaccgccaacaacguggagauccacauccccgugcccaacgacgccgacagccccaaguucaagaccaccgugggcagcgugaagugggugcccgagaacagcgagaucguguggagcaucaagagcuuccccggcggcaaggaguaccugaugagagcccacuucggccugcccagcguggaggccgaggacaaggagggcaagccccccaucagcgugaaguucgagauccccuacuucaccaccagcggcauccaggugagauaccugaagaucaucgagaagagcggcuaccaggcccugcccugggugagauacaucacccagaacggcgacuaccagcugagaacccaguga

SEQ ID NO: 7995 - RNA, 1272 nt, Artificial Sequence
  derived and/or modified sequence opt5 from c-Jun__Homo_sapiens__AAK28024
augagcgccuccgcuguguacguccuggaccucaagggcaaaguucugaucugcagaaacuaucgcggggauguggacaugucugagguggaacacuucaugcccauucuuauggagaaggaagaggaaggaaugcugagcccuauccucgcccauggcgggguccgguuuauguggauuaaacacaauaaccuguaccuuguggcgaccuccaagaaaaaugcuuguguuucucugguguucagcuuucucuauaaggucgugcagguuuucuccgaguacuuuaaggagcuggaagaggaaucuaucagagauaacuucgugauuaucuaugagcugcucgacgagcugauggauuuuggauacccgcaaacaacggacagcaaaauccuucaggaauauauuacccaggagggccauaagcuggaaacaggggcuccccggccucccgccaccgucacaaaugccguguccuggcgcagcgagggaaucaaauacagaaagaacgaaguguuccucgaugucauugagucuguuaaucugcuuguguccgccaacggcaaugugcugcggagcgagaucgucggcucuauuaaaaugcgcguguuucucuccgggaugccugaacugagacugggacucaacgacaagguucuguucgauaauaccggccggggaaagagcaaaucuguggagcuugaagacgucaaguuucaccagugcgugcgccuguccagauucgagaacgaucggacaaucagcuuuauucccccugacggggaguucgaacucauguccuaccgccugaauacccauguuaaaccgcuuaucuggaucgagucugugauugaaaagcacagccacuccagaaucgaguauaugauuaaagcuaagagccaauucaaacggcgcucuacggccaacaaugucgaaauccauauucccgugccuaacgaugcggacucccccaaguuuaagaccacagucggcagcgugaaauggguuccugagaacucugaaaucguguggagcaucaaguccuuccccgggggaaaagaguaccugaugagagcccacuuuggccucccgucugucgaggcugaagacaaggagggcaaaccucccauuagcgugaaguucgaaaucccuuauuuuaccacauccgggauucagguucgguaccugaagaucauugagaaaagcggauaucaggcccugcccugggugagauacaucacccagaauggcgauuaucaacuccgcacgcaguga

SEQ ID NO: 7996 - protein, 423 aa, Artificial Sequence
  c-Jun__Homo_sapiens__Q9Y6Q5
MSASAVFILDVKGKPLISRNYKGDVAMSKIEHFMPLLVQREEEGALAPLLSHGQVHFLWIKHSNLYLVATTSKNANASLVYSFLYKTIEVFCEYFKELEEESIRDNFVIVYELLDELMDFGFPQTTDSKILQEYITQQSNKLETGKSRVPPTVTNAVSWRSEGIKYKKNEVFIDVIESVNLLVNANGSVLLSEIVGTIKLKVFLSGMPELRLGLNDRVLFELTGRSKNKSVELEDVKFHQCVRLSRFDNDRTISFIPPDGDFELMSYRLSTQVKPLIWIESVIEKFSHSRVEIMVKAKGQFKKQSVANGVEISVPVPSDADSPRFKTSVGSAKYVPERNVVIWSIKSFPGGKEYLMRAHFGLPSVEKEEVEGRPPIGVKFEIPYFTVSGIQVRYMKIIEKSGYQALPWVRYITQSGDYQLRTS

SEQ ID NO: 7997 - RNA, 1272 nt, Artificial Sequence
  c-Jun__Homo_sapiens__AAD25870
auguccgccucggcugucuucauucuggacguuaagggcaagccauugaucagccgcaacuacaagggcgauguggccaugagcaagauugagcacuucaugccuuugcugguacagcgggaggaggaaggcgcccuggccccgcugcugagccacggccagguccacuuccuauggaucaaacacagcaaccucuacuugguggccaccacaucgaagaaugccaaugccucccugguguacuccuuccuguauaagacaauagagguauucugcgaauacuucaaggagcuggaggaggagagcauccgggacaacuuugucaucgucuacgaguugcuggacgagcucauggacuuuggcuucccgcagaccaccgacagcaagauccugcaggaguacaucacucagcagagcaacaagcuggagacgggcaagucacgggugccacccacugucaccaacgcuguguccuggcgcuccgaggguaucaaguauaagaagaacgaggucuucauugaugucauagagucugucaaccugcuggucaaugccaacggcagcguccuucugagcgaaaucgucgguaccaucaagcucaagguguuucugucaggaaugccagagcugcggcugggccucaaugaccgcgugcucuucgagcucacuggccgcagcaagaacaaaucaguagagcuggaggauguaaaauuccaccagugcgugcggcucucucgcuuugacaacgaccgcaccaucuccuucaucccgccugauggugacuuugagcucaugucauaccgccucagcacccaggucaagccacugaucuggauugagucugucauugagaaguucucccacagccgcguggagaucauggucaaggccaaggggcaguuuaagaaacagucaguggccaacgguguggagauaucugugccuguacccagcgaugccgacucccccagauucaagaccagugugggcagcgccaaguaugugccggagagaaacgucgugauuuggaguauuaagucuuucccggggggcaaggaguacuugaugcgagcccacuuuggccuccccaguguggaaaaggaagagguggagggccggccccccaucggggucaaguuugagauccccuacuucaccgucucugggauccagguccgauacaugaagaucauugagaaaagugguuaccaggcccugcccuggguucgcuacaucacccagaguggcgauuaccaacuucguaccagcuag

SEQ ID NO: 7998 - RNA, 1272 nt, Artificial Sequence
  derived and/or modified sequence opt1 from c-Jun__Homo_sapiens__AAD25870
augagcgccuccgccguguucauccuggacgucaagggcaagccccucaucagccgcaacuacaagggggacguggcgauguccaagaucgagcacuucaugccgcugcuggugcagcgggaggaggagggcgcccucgcgccccugcugagccacgggcagguccacuuccucuggaucaagcacuccaaccuguaccugguggccaccaccagcaagaacgccaacgccucccucguguacagcuuccuguacaagacgaucgaggucuucugcgaguacuucaaggagcuggaggaggaguccauccgcgacaacuucgugaucguguacgagcuccuggacgagcugauggacuucggcuucccccagaccaccgacagcaagauccuccaggaguacaucacccagcaguccaacaagcuggagacgggcaagagccgggugcccccgaccgucaccaacgccguguccuggcgcagcgaggggaucaaguacaagaagaacgaggucuucaucgacgugaucgaguccgugaaccugcucgucaacgccaacggcagcgugcugcuguccgagaucguggggaccaucaagcucaaggucuuccugagcggcaugcccgagcugcggcucgggcugaacgaccgcgugcuguucgagcucacgggccgguccaagaacaagagcguggagcuggaggacgucaaguuccaccagugcgugcgccugagccgguucgacaacgaccgcaccaucuccuucaucccgcccgacggggacuucgagcucaugagcuaccggcuguccacccaggugaagccccugaucuggaucgagagcgucaucgagaaguucucccacagccgcguggagaucauggucaaggccaagggccaguucaagaagcaguccguggcgaacggcguggagaucagcguccccgugcccuccgacgccgacagcccccgguucaagaccuccguggggagcgccaaguacgucccggagcgcaacguggugaucugguccaucaagagcuuccccggcgggaaggaguaccucaugcgggcccacuucggccugcccuccgucgagaaggaggagguggagggccggcccccgaucggggugaaguucgagauccccuacuucacggucagcggcauccaggugcgcuacaugaagaucaucgagaaguccggguaccaggcccugcccugggugcgcuacaucacccagagcggcgacuaccagcuccggaccuccuga

SEQ ID NO: 7999 - RNA, 1272 nt, Artificial Sequence
  derived and/or modified sequence opt2 from c-Jun__Homo_sapiens__AAD25870
auguccgccuccgccgucuucauccucgacgucaagggcaagccccucaucucccgcaacuacaagggcgacgucgccauguccaagaucgagcacuucaugccccuccucguccagcgcgaggaggagggcgcccucgccccccuccucucccacggccagguccacuuccucuggaucaagcacuccaaccucuaccucgucgccaccaccuccaagaacgccaacgccucccucgucuacuccuuccucuacaagaccaucgaggucuucugcgaguacuucaaggagcucgaggaggaguccauccgcgacaacuucgucaucgucuacgagcuccucgacgagcucauggacuucggcuucccccagaccaccgacuccaagauccuccaggaguacaucacccagcaguccaacaagcucgagaccggcaagucccgcgucccccccaccgucaccaacgccgucuccuggcgcuccgagggcaucaaguacaagaagaacgaggucuucaucgacgucaucgaguccgucaaccuccucgucaacgccaacggcuccguccuccucuccgagaucgucggcaccaucaagcucaaggucuuccucuccggcaugcccgagcuccgccucggccucaacgaccgcguccucuucgagcucaccggccgcuccaagaacaaguccgucgagcucgaggacgucaaguuccaccagugcguccgccucucccgcuucgacaacgaccgcaccaucuccuucaucccccccgacggcgacuucgagcucauguccuaccgccucuccacccaggucaagccccucaucuggaucgaguccgucaucgagaaguucucccacucccgcgucgagaucauggucaaggccaagggccaguucaagaagcaguccgucgccaacggcgucgagaucuccguccccguccccuccgacgccgacuccccccgcuucaagaccuccgucggcuccgccaaguacguccccgagcgcaacgucgucaucugguccaucaaguccuuccccggcggcaaggaguaccucaugcgcgcccacuucggccuccccuccgucgagaaggaggaggucgagggccgcccccccaucggcgucaaguucgagauccccuacuucaccgucuccggcauccagguccgcuacaugaagaucaucgagaaguccggcuaccaggcccuccccuggguccgcuacaucacccaguccggcgacuaccagcuccgcaccuccuga

SEQ ID NO: 8000 - RNA, 1272 nt, Artificial Sequence
  derived and/or modified sequence opt3 from c-Jun__Homo_sapiens__AAD25870
augagcgccuccgcuguguucauccuggacgucaagggcaaaccccucauuucuagaaacuacaagggggauguugcaaugucaaaaauagagcacuuuaugccucuucuggugcagagggaagaggaaggagccuuggcgccauuacugagucauggucaaguacacuuccuauggaucaagcauagcaaucucuaucugguggcuaccacauccaaaaacgccaaugcaucucuugucuacucguuucuguauaagacuauugagguguucugcgaauacuuuaaggaguuggaggaagagucaauccgggacaacuucguuauuguguaugaacuccuggaugagcugauggacuuuggcuucccgcagacgaccgauagcaaaauccuccaggaguacauaacacagcaaaguaauaaguuagaaacugggaaaucccgcgugcccccuaccgucacaaacgccguaucuuggcgaagcgagggaaucaaguauaaaaagaaugaaguuuuuauugacgugaucgaguccgucaaccugcuugugaaugcuaacggcucaguguugcugagugaaauugucgguaccaucaagcuaaaaguuuuccucagcgggaugccagagcugcgucuuggacugaaugauagaguguuguuugagcucacuggcaggucuaagaacaaauccguagaacuggaggacgugaaguuccaccaguguguccgguuaucacgcuuugauaaugacagaacaauuagcuucauacccccugauggcgacuucgaacugaugaguuacaggcucucuacccaggugaaaccacuuaucuggauugaguccguuaucgaaaaguuuagccauucgcggguggagaucauggucaaagcaaaggggcaguucaagaaacaaucuguggccaacggaguagagauuuccguucccgugccuucagaugcugacaguccacgcuuuaagacgagcgucgguuccgccaaauacgugccggaacgaaaugucgugauauggucuaucaagagcuuccccggcgggaaagaguaucugaugagagcgcacuuuggauugccuucaguugaaaaggaggaaguggagggcaggccacccauugguguaaaguucgagaucccuuacuuuacugucagugggauacaggugcgguauaugaaaauuaucgaaaaguccggauaccaggcacuaccauggguucguuauaucacccagagcggcgacuaccaacugcgcacaucuuga

SEQ ID NO: 8001 - RNA, 1272 nt, Artificial Sequence
  derived and/or modified sequence opt4 from c-Jun__Homo_sapiens__AAD25870
augagcgccagcgccguguucauccuggacgugaagggcaagccccugaucagcagaaacuacaagggcgacguggccaugagcaagaucgagcacuucaugccccugcuggugcagagagaggaggagggcgcccuggccccccugcugagccacggccaggugcacuuccuguggaucaagcacagcaaccuguaccugguggccaccaccagcaagaacgccaacgccagccugguguacagcuuccuguacaagaccaucgagguguucugcgaguacuucaaggagcuggaggaggagagcaucagagacaacuucgugaucguguacgagcugcuggacgagcugauggacuucggcuucccccagaccaccgacagcaagauccugcaggaguacaucacccagcagagcaacaagcuggagaccggcaagagcagagugccccccaccgugaccaacgccgugagcuggagaagcgagggcaucaaguacaagaagaacgagguguucaucgacgugaucgagagcgugaaccugcuggugaacgccaacggcagcgugcugcugagcgagaucgugggcaccaucaagcugaagguguuccugagcggcaugcccgagcugagacugggccugaacgacagagugcuguucgagcugaccggcagaagcaagaacaagagcguggagcuggaggacgugaaguuccaccagugcgugagacugagcagauucgacaacgacagaaccaucagcuucaucccccccgacggcgacuucgagcugaugagcuacagacugagcacccaggugaagccccugaucuggaucgagagcgugaucgagaaguucagccacagcagaguggagaucauggugaaggccaagggccaguucaagaagcagagcguggccaacggcguggagaucagcgugcccgugcccagcgacgccgacagccccagauucaagaccagcgugggcagcgccaaguacgugcccgagagaaacguggugaucuggagcaucaagagcuuccccggcggcaaggaguaccugaugagagcccacuucggccugcccagcguggagaaggaggagguggagggcagaccccccaucggcgugaaguucgagauccccuacuucaccgugagcggcauccaggugagauacaugaagaucaucgagaagagcggcuaccaggcccugcccugggugagauacaucacccagagcggcgacuaccagcugagaaccagcuga

SEQ ID NO: 8002 - RNA, 1272 nt, Artificial Sequence
  derived and/or modified sequence opt5 from c-Jun__Homo_sapiens__AAD25870
augagcgcuuccgcuguguucauccuggacgucaagggcaaaccccucauuucuagaaacuacaagggggauguugccaugagcaaaaucgagcacuuuaugccucugcuugugcagcgggaagaggaaggagcgcuggcuccgcuccugucccauggccaagugcacuuccuuuggauuaagcauucuaaucuguaucucgucgccaccacaagcaaaaacgccaaugcuucccugguguacucuuuucuguauaagacgaucgagguuuucugcgaauacuuuaaggagcucgaggaagagagcauucgcgacaacuucgugaucgucuaugaacugcuugaugagcugauggacuuuggguucccccagaccacagauuccaaaauccuccaggaguacauuacccagcaaagcaauaagcuggaaacaggaaaaucuagagugccucccaccguuacaaacgccguguccuggcggagcgagggcaucaaguauaaaaagaaugaagucuuuauugacgugaucgagucugugaaccuucuggucaaugcuaacggguccguucuccugagcgaaauugugggaaccaucaagcugaaaguguuccucucuggcaugccugagcugcgccuuggccugaaugauagaguccucuuugagcugacggggcgguccaagaacaaaagcguggaacuugaggacguuaaguuccaccagugugugcgccuguccagauuugauaaugaccggaccauuucuuucauucccccugauggagacuucgaacucaugagcuaccgccuguccacacaggucaaaccgcugaucuggaucgagagcgugaucgaaaaguuuucucauuccagaguugagauuauggugaaagccaagggccaguucaagaaacaaagcgucgcgaacgggguggagaucucuguccccgugccuagcgaugccgacucuccccgguuuaagaccuccguuggaagcgcuaaauacgugccugaacgcaaugucgugauuugguccaucaagagcuuccccggcgggaaagaguaucucaugagagcccacuuuggacugccgucuguugaaaaggaggaaguggagggccggccucccaucggcgucaaguucgagauuccuuacuuuacaguguccgggauccaggugcgcuauaugaaaauuaucgaaaagagcggauaccaggcccuucccuggguuagauauauuacccagucuggcgacuaccaacugcggacguccuga

SEQ ID NO: 8003 - protein, 584 aa, Artificial Sequence
  CO8A__Homo_sapiens__P07357
MFAVVFFILSLMTCQPGVTAQEKVNQRVRRAATPAAVTCQLSNWSEWTDCFPCQDKKYRHRSLLQPNKFGGTICSGDIWDQASCSSSTTCVRQAQCGQDFQCKETGRCLKRHLVCNGDQDCLDGSDEDDCEDVRAIDEDCSQYEPIPGSQKAALGYNILTQEDAQSVYDASYYGGQCETVYNGEWRELRYDSTCERLYYGDDEKYFRKPYNFLKYHFEALADTGISSEFYDNANDLLSKVKKDKSDSFGVTIGIGPAGSPLLVGVGVSHSQDTSFLNELNKYNEKKFIFTRIFTKVQTAHFKMRKDDIMLDEGMLQSLMELPDQYNYGMYAKFINDYGTHYITSGSMGGIYEYILVIDKAKMESLGITSRDITTCFGGSLGIQYEDKINVGGGLSGDHCKKFGGGKTERARKAMAVEDIISRVRGGSSGWSGGLAQNRSTITYRSWGRSLKYNPVVIDFEMQPIHEVLRHTSLGPLEAKRQNLRRALDQYLMEFNACRCGPCFNNGVPILEGTSCRCQCRLGSLGAACEQTQTEGAKADGSWSCWSSWSVCRAGIQERRRECDNPAPQNGGASCPGRKVQTQAC

SEQ ID NO: 8004 - RNA, 1755 nt, Artificial Sequence
  CO8A__Homo_sapiens__AAA52200
auguuugcuguuguuuucuucaucuugucuuugaugacuugucagccugggguaacugcacaggagaaggugaaccagagaguaagacgggcagcuacacccgcagcaguuaccugccagcugagcaacuggucagaguggacagauugcuuuccgugccaggacaaaaaguaccgacaccggagccucuugcagccaaacaaguuugggggaaccaucugcaguggugacaucugggaucaagccagcugcuccaguucuacaacuuguguaaggcaagcacaguguggacaggauuuccaguguaaggagacaggucgcugccugaaacgccaccuuguguguaauggagaccaggacugccuugauggcucugaugaggacgacugugaagaugucagggccauugacgaagacugcagccaguaugaaccaauuccaggaucacagaaggcagccuugggguacaauauccugacccaggaagaugcucagaguguguacgaugccaguuauuaugggggccagugugagacgguauacaauggggaauggagggagcuucgauaugacuccaccugugaacgucucuacuauggagaugaugagaaauacuuucggaaacccuacaacuuucugaaguaccacuuugaagcccuggcagauacuggaaucuccucagaguuuuaugauaaugcaaaugaccuucuuuccaaaguuaaaaaagacaagucugacucauuuggagugaccaucggcauaggcccagccggcagcccuuuauugguggguguagguguaucccacucacaagacacuucauucuugaacgaauuaaacaaguauaaugagaagaaauucauuuucacaagaaucuucacaaaggugcagacugcacauuuuaagaugaggaaggaugacauuaugcuggaugaaggaaugcugcagucauuaauggagcuuccagaucaguacaauuauggcauguaugccaaguucaucaaugacuauggcacccauuacaucacaucuggauccauggguggcauuuaugaauauauccuggugauugacaaagcaaaaauggaaucccuugguauuaccagcagagauaucacgacauguuuuggaggcuccuugggcauucaauaugaagacaaaauaaauguugguggagguuuaucaggagaccauuguaaaaaauuuggagguggcaaaacugaaagggccaggaaggccauggcuguggaagacauuauuucucgggugcgagguggcaguucuggcuggagcgguggcuuggcacagaacaggagcaccauuacauaccguuccugggggaggucauuaaaguauaauccuguuguuaucgauuuugagaugcagccuauccacgaggugcugcggcacacaagccuggggccucuggaggccaagcgccagaaccugcgccgcgccuuggaccaguaucugauggaauucaaugccugccgaugugggccuugcuucaacaauggggugcccauccucgagggcaccagcugcaggugccagugccgccuggguagcuugggugcugccugugagcaaacacagacagaaggagccaaagcagaugggagcuggaguugcuggagcuccuggucuguaugcagagcaggcauccaggaaaggagaagagagugugacaauccagcaccucagaauggaggggccucguguccagggcggaaaguacagacgcaggcuugcuga

SEQ ID NO: 8005 - RNA, 1755 nt, Artificial Sequence
  derived and/or modified sequence opt1 from CO8A__Homo_sapiens__AAA52200
auguucgccguggucuucuucauccugagccucaugaccugccagcccggcgugaccgcccaggagaaggugaaccagcgcguccggcgcgccgccacgccggccgccgugaccugccagcuguccaacuggagcgaguggaccgacugcuuccccugccaggacaagaaguaccggcaccgcucccugcuccagcccaacaaguucgggggcaccaucugcagcggggacaucugggaccaggccuccugcagcuccagcacgaccugcgugcggcaggcgcagugcggccaggacuuccagugcaaggagaccgggcgcugccugaagcggcaccuggucugcaacggcgaccaggacugccucgacggcuccgacgaggacgacugcgaggacgugcgcgccaucgacgaggacugcagccaguacgagcccaucccggggucccagaaggccgcccugggcuacaacauccugacccaggaggacgcgcagagcguguacgacgccuccuacuacgggggccagugcgagacggucuacaacggggaguggcgggagcuccgcuacgacagcacgugcgagcggcuguacuacggcgacgacgagaaguacuuccgcaagcccuacaacuuccugaaguaccacuucgaggcccucgccgacaccggcaucuccagcgaguucuacgacaacgccaacgaccugcuguccaaggugaagaaggacaagagcgacuccuucggggugaccaucggcaucgggcccgcgggcagcccccuccuggucggcgugggggugagccacucccaggacaccagcuuccugaacgagcucaacaaguacaacgagaagaaguucaucuucacccggaucuucaccaagguccagaccgcccacuucaagaugcgcaaggacgacaucaugcuggacgagggcaugcugcagucccucauggagcugccggaccaguacaacuacgggauguacgccaaguucaucaacgacuacggcacgcacuacaucaccagcggguccaugggcggcaucuacgaguacauccuggugaucgacaaggccaagauggagagccucgggaucaccucccgggacaucaccacgugcuucggcgggagccugggcauccaguacgaggacaagaucaacgucgggggcggccuguccggggaccacugcaagaaguucggcgggggcaagaccgagcgcgcccggaaggcgauggccguggaggacaucaucagccgcgugcgcgggggcuccagcggcugguccgggggccucgcccagaaccggagcaccaucaccuaccgguccugggggcgcagccugaaguacaaccccguggucaucgacuucgagaugcagcccauccacgaggugcugcgccacacgucccucggcccccuggaggccaagcggcagaaccugcgccgggcccucgaccaguaccugauggaguucaacgcgugccgcugcggcccgugcuucaacaacggggugcccauccuggagggcaccagcugccggugccagugccgccucgggucccugggcgccgccugcgagcagacccagaccgagggggccaaggccgacggcagcuggagcugcugguccagcugguccgucugccgggcgggcauccaggagcgccggcgcgagugcgacaaccccgcgccccagaacgggggcgccagcugcccggggcggaaggugcagacgcaggccugcuga

SEQ ID NO: 8006 - RNA, 1755 nt, Artificial Sequence
  derived and/or modified sequence opt2 from CO8A__Homo_sapiens__AAA52200
auguucgccgucgucuucuucauccucucccucaugaccugccagcccggcgucaccgcccaggagaaggucaaccagcgcguccgccgcgccgccacccccgccgccgucaccugccagcucuccaacugguccgaguggaccgacugcuuccccugccaggacaagaaguaccgccaccgcucccuccuccagcccaacaaguucggcggcaccaucugcuccggcgacaucugggaccaggccuccugcuccuccuccaccaccugcguccgccaggcccagugcggccaggacuuccagugcaaggagaccggccgcugccucaagcgccaccucgucugcaacggcgaccaggacugccucgacggcuccgacgaggacgacugcgaggacguccgcgccaucgacgaggacugcucccaguacgagcccauccccggcucccagaaggccgcccucggcuacaacauccucacccaggaggacgcccaguccgucuacgacgccuccuacuacggcggccagugcgagaccgucuacaacggcgaguggcgcgagcuccgcuacgacuccaccugcgagcgccucuacuacggcgacgacgagaaguacuuccgcaagcccuacaacuuccucaaguaccacuucgaggcccucgccgacaccggcaucuccuccgaguucuacgacaacgccaacgaccuccucuccaaggucaagaaggacaaguccgacuccuucggcgucaccaucggcaucggccccgccggcuccccccuccucgucggcgucggcgucucccacucccaggacaccuccuuccucaacgagcucaacaaguacaacgagaagaaguucaucuucacccgcaucuucaccaagguccagaccgcccacuucaagaugcgcaaggacgacaucaugcucgacgagggcaugcuccagucccucauggagcuccccgaccaguacaacuacggcauguacgccaaguucaucaacgacuacggcacccacuacaucaccuccggcuccaugggcggcaucuacgaguacauccucgucaucgacaaggccaagauggagucccucggcaucaccucccgcgacaucaccaccugcuucggcggcucccucggcauccaguacgaggacaagaucaacgucggcggcggccucuccggcgaccacugcaagaaguucggcggcggcaagaccgagcgcgcccgcaaggccauggccgucgaggacaucaucucccgcguccgcggcggcuccuccggcugguccggcggccucgcccagaaccgcuccaccaucaccuaccgcuccuggggccgcucccucaaguacaaccccgucgucaucgacuucgagaugcagcccauccacgagguccuccgccacaccucccucggcccccucgaggccaagcgccagaaccuccgccgcgcccucgaccaguaccucauggaguucaacgccugccgcugcggccccugcuucaacaacggcguccccauccucgagggcaccuccugccgcugccagugccgccucggcucccucggcgccgccugcgagcagacccagaccgagggcgccaaggccgacggcuccugguccugcugguccuccugguccgucugccgcgccggcauccaggagcgccgccgcgagugcgacaaccccgccccccagaacggcggcgccuccugccccggccgcaagguccagacccaggccugcuga

SEQ ID NO: 8007 - RNA, 1755 nt, Artificial Sequence
  derived and/or modified sequence opt3 from CO8A__Homo_sapiens__AAA52200
auguucgccguggucuuuuucauccugagccucaugaccugccagcccggcguuacagcucaagagaaggugaaccagagaguaaggcgggcagccacuccugcggcugugacgugucagcuuuccaauuggucugaauggaccgacugcuuuccaugucaggauaaaaaguaccgccaccgaucacuguugcaaccgaacaaauucgggggaacaauuugcaguggugacauaugggaucaggccagcuguuccucuucgacuaccugcguccgucaggcacaguguggccaagacuuucagugcaaggagacagggagauguuuaaaaaggcaucuggugugcaauggagaucaggacugucuagauggcucagacgaagaugacugcgaggauguucgggccaucgacgaagauugcagccaguaugagcccauuccugguagucaaaaggcugcacucggguacaacauccugacccaggaggacgcccaguccguguaugacgcuucuuacuauggaggccaaugugaaacugucuacaauggcgaguggcgcgaacuuagauaugauagcacaugcgagaggcuguacuacggggacgaugagaaguauuuccggaaaccauacaacuuuuugaaguaucacuucgaagcccucgcggacaccggaauuuccucagaguuuuacgauaaugcaaacgaccugcugaguaaagugaagaaagauaagagcgacucuuucgguguaacgaucggcauagggcccgccggauccccucucuuaguuggcgugggugucucacauagccaggauaccaguuuucugaaugaacuuaacaaguauaaugagaaaaaguucaucuuuacucgcauuuucacaaaagugcagacugcucacuucaagaugcgaaaagacgauaucauguuggacgaagggaugcugcagucucuaauggagcucccagaccaauacaacuauggaauguacgccaaguuuauuaaugauuacggcacccauuauaucacauccggcagcaugggagggauauacgaguauauucuggugaucgacaaagcaaagauggaaucgcuugguauuaccucuagagauaucacgacuuguuucggcgggucccugggaauccaguacgaggacaagauuaacgucggcgguggguugucaggcgaucacugcaaaaaguuuggaggcgggaaaacagaaagggcucggaaggccauggcgguugaggacauaaucagucgugugcgcggagguagcuccggcuggucugggggacucgcccagaauagaagcaccauuacuuauaggucauggggccggagucugaaauacaaccccguagugaucgauuucgaaaugcagccuauacacgaggucuuacgacauacaucccuggguccacucgaggcaaagcgccaaaaccuuagaagggcucuggaccaguauuugauggaauuuaaugccugucggugcgggccguguuucaacaauggcgugcccauucuagagggaaccagcugccgcugucagugcagacugggcucucucggggcugccugugaacagacgcaaaccgagggagcaaaggccgaugguucauggaguugcuggagcuccuggucuguuugcagggcuggcauccaggaacgucggcgagagugugacaacccugcgccacagaaugggggagcaucgugccccggcagaaaagugcagacacaagccuguuga

SEQ ID NO: 8008 - RNA, 1755 nt, Artificial Sequence
  derived and/or modified sequence opt4 from CO8A__Homo_sapiens__AAA52200
auguucgccgugguguucuucauccugagccugaugaccugccagcccggcgugaccgcccaggagaaggugaaccagagagugagaagagccgccacccccgccgccgugaccugccagcugagcaacuggagcgaguggaccgacugcuuccccugccaggacaagaaguacagacacagaagccugcugcagcccaacaaguucggcggcaccaucugcagcggcgacaucugggaccaggccagcugcagcagcagcaccaccugcgugagacaggcccagugcggccaggacuuccagugcaaggagaccggcagaugccugaagagacaccuggugugcaacggcgaccaggacugccuggacggcagcgacgaggacgacugcgaggacgugagagccaucgacgaggacugcagccaguacgagcccauccccggcagccagaaggccgcccugggcuacaacauccugacccaggaggacgcccagagcguguacgacgccagcuacuacggcggccagugcgagaccguguacaacggcgaguggagagagcugagauacgacagcaccugcgagagacuguacuacggcgacgacgagaaguacuucagaaagcccuacaacuuccugaaguaccacuucgaggcccuggccgacaccggcaucagcagcgaguucuacgacaacgccaacgaccugcugagcaaggugaagaaggacaagagcgacagcuucggcgugaccaucggcaucggccccgccggcagcccccugcuggugggcgugggcgugagccacagccaggacaccagcuuccugaacgagcugaacaaguacaacgagaagaaguucaucuucaccagaaucuucaccaaggugcagaccgcccacuucaagaugagaaaggacgacaucaugcuggacgagggcaugcugcagagccugauggagcugcccgaccaguacaacuacggcauguacgccaaguucaucaacgacuacggcacccacuacaucaccagcggcagcaugggcggcaucuacgaguacauccuggugaucgacaaggccaagauggagagccugggcaucaccagcagagacaucaccaccugcuucggcggcagccugggcauccaguacgaggacaagaucaacgugggcggcggccugagcggcgaccacugcaagaaguucggcggcggcaagaccgagagagccagaaaggccauggccguggaggacaucaucagcagagugagaggcggcagcagcggcuggagcggcggccuggcccagaacagaagcaccaucaccuacagaagcuggggcagaagccugaaguacaaccccguggugaucgacuucgagaugcagcccauccacgaggugcugagacacaccagccugggcccccuggaggccaagagacagaaccugagaagagcccuggaccaguaccugauggaguucaacgccugcagaugcggccccugcuucaacaacggcgugcccauccuggagggcaccagcugcagaugccagugcagacugggcagccugggcgccgccugcgagcagacccagaccgagggcgccaaggccgacggcagcuggagcugcuggagcagcuggagcgugugcagagccggcauccaggagagaagaagagagugcgacaaccccgccccccagaacggcggcgccagcugccccggcagaaaggugcagacccaggccugcuga

SEQ ID NO: 8009 - RNA, 1755 nt, Artificial Sequence
  derived and/or modified sequence opt5 from CO8A__Homo_sapiens__AAA52200
auguucgccguggucuuuuucauccugagccucaugaccugccagcccggcguuacagcucaagagaaggugaaccagagagugcggcgcgccgcgacgccugcugccgucaccugucagcuguccaauuggucugaauggacagacugcuuuccgugucaggauaaaaaguacagacaccggagccuucugcaacccaacaaauucgggggaaccauuugcuccggcgacaucugggaucaggccucuuguagcuccucuacaaccugcgugcgccaggcucagugugggcaagacuuucagugcaaggagacaggaagaugucucaaacggcaucugguuugcaauggcgaucaggacugucuugaugggagcgacgaagaugacugcgaggaugugcgcgccauugacgaagauugcucccaguaugagccuauccccggaagccaaaaggcugcccugggcuacaacauucucacccaggaggacgcgcagucugucuaugacgccuccuacuauggcgggcaaugugaaacgguguacaauggagaguggagagaacugcgguaugauagcacaugcgagcgccuguacuacggcgacgaugagaaguauuucagaaaaccuuacaacuuucucaaguaucacuucgaagcucuggccgacacagggaucucuuccgaguuuuacgauaaugcuaacgaccuucugagcaaaguuaagaaagauaagucugacuccuucggagugaccaucggcauugggcccgccggaagcccucuccuggucggcgugggcgugucccauucucaggauaccagcuuucuuaaugaacugaacaaguauaaugagaaaaaguucaucuuuacccggauuuucacgaaaguccagacagcgcacuucaagaugcgcaaagacgauaucaugcucgacgaagggaugcugcagucccugauggagcucccggaccaauacaacuauggaauguacgccaaguuuauuaaugauuacggcacccauuauaucacaagcgggucuaugggaggcauuuacgaguauauccugguuaucgacaaagcuaagauggaaucccuugggauuaccagcagagauaucaccacauguuucggaggcucucugggcauucaguacgaggacaagaucaacgucgggggaggccucagcggggaucacugcaaaaaguuuggaggcgggaaaacggaacgggcccgcaaggcuauggccguggaggacauuaucuccagagugcggggcggaucuagcggcugguccgggggacuggcccagaauagaagcaccaucacauaucgcucuuggggccggucccuuaaauacaaccccgugguuauugauuucgaaaugcagccuauccacgaggugcugagacauaccagccucgggccccuggaggcuaagcgccaaaaccugcggagagcgcucgaccaguaucugauggaauuuaaugccugucgcugcggaccuuguuucaacaauggcguccccauucuugaggggacaucuugccggugucagugcagacugggcucccucggagcugccugugaacagacccaaacggagggcgccaaggcugaugggagcugguccugcuggucuagcugguccgugugccgcgccggaauccaggaacggagacgcgagugugacaacccggcgccucagaauggcggggcuucuugccccggacggaaaguucagacacaagccuguuga

SEQ ID NO: 8010 - protein, 591 aa, Artificial Sequence
  CO8B__Homo_sapiens__P07358
MKNSRTWAWRAPVELFLLCAALGCLSLPGSRGERPHSFGSNAVNKSFAKSRQMRSVDVTLMPIDCELSSWSSWTTCDPCQKKRYRYAYLLQPSQFHGEPCNFSDKEVEDCVTNRPCRSQVRCEGFVCAQTGRCVNRRLLCNGDNDCGDQSDEANCRRIYKKCQHEMDQYWGIGSLASGINLFTNSFEGPVLDHRYYAGGCSPHYILNTRFRKPYNVESYTPQTQGKYEFILKEYESYSDFERNVTEKMASKSGFSFGFKIPGIFELGISSQSDRGKHYIRRTKRFSHTKSVFLHARSDLEVAHYKLKPRSLMLHYEFLQRVKRLPLEYSYGEYRDLFRDFGTHYITEAVLGGIYEYTLVMNKEAMERGDYTLNNVHACAKNDFKIGGAIEEVYVSLGVSVGKCRGILNEIKDRNKRDTMVEDLVVLVRGGASEHITTLAYQELPTADLMQEWGDAVQYNPAIIKVKVEPLYELVTATDFAYSSTVRQNMKQALEEFQKEVSSCHCAPCQGNGVPVLKGSRCDCICPVGSQGLACEVSYRKNTPIDGKWNCWSNWSSCSGRRKTRQRQCNNPPPQNGGSPCSGPASETLDCS

SEQ ID NO: 8011 - RNA, 1776 nt, Artificial Sequence
  CO8B__Homo_sapiens__AAI30576
augaagaauuccaggacaugggcuuggagggcgccgguggagcuauuucuucucugugcugcccugggcugucucaguuugccuggcuccagaggugaaaggccacauuccuuugggucaaaugcagucaacaagagcuuugcuaagagcagacagaugcggaguguggauguuacccugaugcccauugauugugagcugucuaguugguccucuuggaccacaugugaccccugucagaagaaaagguacagguaugccuacuugcuccagcccucucaguuccauggggaaccgugcaacuucucugacaaggaagucgaagacuguguuaccaacagaccaugcagaagucaagugcgaugugaaggcuuugugugugcacagacaggaagguguguaaaccgcagacuucuuugcaauggggacaaugacuguggagaccagucagaugaagcaaacuguagaaggauuuauaaaaaaugucagcaugaaauggaccaauacuggggaauuggcagucuggccagugggauaaauuuguucacaaacaguuuugagggcccaguucuugaucacagguauuaugcagguggaugcuccccgcauuacauccugaacacgagguuuaggaagcccuacaauguggaaagcuacacgccacagacccaaggcaaauacgaauucauauuaaaagaguaugaaucauacucagauuuugaacgcaaugucacagagaaaauggcaagcaagucugguuucaguuuugguuuuaaaauaccuggaauauuugaacuuggcaucaguagucaaagugaucgaggcaaacacuauauuaggagaaccaaacgauucucucauacuaaaagcguauuucugcaugcacgcucugaccuugaaguagcacauuacaagcugaaacccagaagccucaugcuccauuacgaguuccuucagagaguuaagcggcugccccuggaguacagcuacggggaauacagagaucucuuccgugauuuugggacccacuacaucacagaggcugugcuugggggcauuuaugaauacacccucguuaugaacaaagaggccauggagagaggagauuauacucuuaacaacguccaugccugugccaaaaaugauuuuaaaauugguggugccauugaagaggucuacgucagucugggugugucuguaggcaaaugcagagguauucugaaugaaauaaaagacagaaacaagagggacaccaugguggaggacuuggugguccugguacgaggaggggcaagugagcacaucaccacccuggcauaccaggagcugccgacggcggaccugaugcaggaguggggagacgcugugcaguacaacccagccaucaucaaaguuaagguggagccucuguaugaacuagugacagccacagauuuugccuauuccagcacagugaggcagaacaugaagcaggcacuggaggaguuccagaaggaaguuaguuccugccacugugcucccugccaaggaaauggagucccuguccugaaaggaucacgcugugacugcaucuguccuguuggaucccaaggccuagccugugaggucuccuaucggaagaauacccccauugaugggaaguggaauugcuggucaaauuggucuucaugcucuggaagacguaagacaagacaaaggcaguguaacaauccaccuccucaaaauggggguagccccuguucaggcccugcuucagaaacacuugacugcuccuag

SEQ ID NO: 8012 - RNA, 1776 nt, Artificial Sequence
  derived and/or modified sequence opt1 from CO8B__Homo_sapiens__AAI30576
augaagaacagccgcaccugggccuggcgggcccccguggagcuguuccuccugugcgcggcccugggcugccucucccugcccgggagccgcggcgagcggccccacuccuucgggagcaacgccgucaacaaguccuucgccaagagccgccagaugcgguccguggacgugacccugaugcccaucgacugcgagcucagcuccuggagcuccuggacgaccugcgaccccugccagaagaagcgcuaccgguacgccuaccugcugcagccgagccaguuccacggcgagcccugcaacuucuccgacaaggaggucgaggacugcgugaccaaccgccccugccggagccaggugcgcugcgagggguucgucugcgcgcagaccggccggugcgugaaccgccggcuccugugcaacggcgacaacgacugcggggaccaguccgacgaggccaacugccgccggaucuacaagaagugccagcacgagauggaccaguacuggggcaucgggagccuggccuccggcaucaaccucuucacgaacagcuucgaggggcccgugcuggaccaccgcuacuacgccggcggcugcuccccgcacuacauccugaacacccgguuccgcaagcccuacaacgucgagagcuacacgccccagacccaggggaaguacgaguucauccucaaggaguacgagagcuacuccgacuucgagcggaacgugaccgagaagauggcgagcaaguccggcuucagcuucggguucaagauccccggcaucuucgagcugggcaucuccagccaguccgaccgcgggaagcacuacauccggcgcaccaagcgcuucagccacaccaaguccguguuccugcacgcccggagcgaccucgaggucgcccacuacaagcugaagccgcgcucccugaugcuccacuacgaguuccugcagcgggugaagcgccugccccucgaguacagcuacggcgaguaccgggaccuguuccgcgacuucgggacccacuacaucacggaggccgugcugggcgggaucuacgaguacacccucgucaugaacaaggaggccauggagcggggcgacuacacccugaacaacgugcacgcgugcgccaagaacgacuucaagaucggcggggccaucgaggagguguacgucucccugggcgugagcguggggaagugccgcggcauccucaacgagaucaaggaccggaacaagcgcgacaccauggucgaggaccugguggugcugguccgcgggggcgccuccgagcacaucacgacccucgccuaccaggagcugcccaccgcggaccugaugcaggaguggggcgacgccgugcaguacaaccccgccaucaucaaggucaagguggagccgcucuacgagcuggugaccgccacggacuucgccuacagcuccaccguccggcagaacaugaagcaggcgcuggaggaguuccagaaggaggugagcuccugccacugcgcccccugccaggggaacggcgugcccguccucaaggggagccggugcgacugcaucugccccgugggcagccaggggcuggccugcgagguguccuaccgcaagaacaccccgaucgacggcaaguggaacugcuggagcaacugguccagcugcuccggccggcgcaagacccggcagcgccagugcaacaacccgccgccccagaacgggggcagccccugcuccgggcccgccagcgagacgcuggacugcuccuga

SEQ ID NO: 8013 - RNA, 1776 nt, Artificial Sequence
  derived and/or modified sequence opt2 from CO8B__Homo_sapiens__AAI30576
augaagaacucccgcaccugggccuggcgcgcccccgucgagcucuuccuccucugcgccgcccucggcugccucucccuccccggcucccgcggcgagcgcccccacuccuucggcuccaacgccgucaacaaguccuucgccaagucccgccagaugcgcuccgucgacgucacccucaugcccaucgacugcgagcucuccuccugguccuccuggaccaccugcgaccccugccagaagaagcgcuaccgcuacgccuaccuccuccagcccucccaguuccacggcgagcccugcaacuucuccgacaaggaggucgaggacugcgucaccaaccgccccugccgcucccagguccgcugcgagggcuucgucugcgcccagaccggccgcugcgucaaccgccgccuccucugcaacggcgacaacgacugcggcgaccaguccgacgaggccaacugccgccgcaucuacaagaagugccagcacgagauggaccaguacuggggcaucggcucccucgccuccggcaucaaccucuucaccaacuccuucgagggccccguccucgaccaccgcuacuacgccggcggcugcuccccccacuacauccucaacacccgcuuccgcaagcccuacaacgucgaguccuacaccccccagacccagggcaaguacgaguucauccucaaggaguacgaguccuacuccgacuucgagcgcaacgucaccgagaagauggccuccaaguccggcuucuccuucggcuucaagauccccggcaucuucgagcucggcaucuccucccaguccgaccgcggcaagcacuacauccgccgcaccaagcgcuucucccacaccaaguccgucuuccuccacgcccgcuccgaccucgaggucgcccacuacaagcucaagccccgcucccucaugcuccacuacgaguuccuccagcgcgucaagcgccucccccucgaguacuccuacggcgaguaccgcgaccucuuccgcgacuucggcacccacuacaucaccgaggccguccucggcggcaucuacgaguacacccucgucaugaacaaggaggccauggagcgcggcgacuacacccucaacaacguccacgccugcgccaagaacgacuucaagaucggcggcgccaucgaggaggucuacgucucccucggcgucuccgucggcaagugccgcggcauccucaacgagaucaaggaccgcaacaagcgcgacaccauggucgaggaccucgucguccucguccgcggcggcgccuccgagcacaucaccacccucgccuaccaggagcuccccaccgccgaccucaugcaggaguggggcgacgccguccaguacaaccccgccaucaucaaggucaaggucgagccccucuacgagcucgucaccgccaccgacuucgccuacuccuccaccguccgccagaacaugaagcaggcccucgaggaguuccagaaggaggucuccuccugccacugcgcccccugccagggcaacggcguccccguccucaagggcucccgcugcgacugcaucugccccgucggcucccagggccucgccugcgaggucuccuaccgcaagaacacccccaucgacggcaaguggaacugcugguccaacugguccuccugcuccggccgccgcaagacccgccagcgccagugcaacaacccccccccccagaacggcggcucccccugcuccggccccgccuccgagacccucgacugcuccuga

SEQ ID NO: 8014 - RNA, 1776 nt, Artificial Sequence
  derived and/or modified sequence opt3 from CO8B__Homo_sapiens__AAI30576
augaagaacagcagaaccugggccuggagggcucccguggagcuguuccuccuuugcgcagcccugggcuguuuguccuuaccugggucucggggagaacgcccacacucauuugguaguaaugcggucaacaagagcuucgcuaaaucccgacagaugcguucuguugacgugacacugaugccgaucgauugcgagcuaucgucauggagcaguuggacuacgugugaccccugccagaaaaagagauacagguaugccuaccuccugcaaccuucccaguuucauggcgaaccauguaauuucucugauaaagagguagaagacugcgugaccaaccggcccugucgcagccaggucagaugcgagggguuugugugugcacaaacaggaaggugcguuaaucggcgccuucuguguaacggcgauaaugacugcggugaucaguccgacgaggccaacugccgaagaauuuauaagaagugucagcacgaaauggaucaguacugggggauaggaucauuggcuaguggcaucaaucucuucacuaacagcuuugagggcccugugcuggaccauagguauuacgcagggggaugcucuccacacuauauucugaauacccgguuccguaaacccuacaacgucgaauccuacacaccucaaacccaggguaaguaugaguuuauccucaaagaguacgaaucauauagcgauuucgagcgcaaugugacugaaaagauggccaguaaaucuggcuuuuccuucggguuuaagauuccaggaaucuucgaguuaggcauaagcucgcagucugacagagguaagcauuacaucaggcggacaaaacgauucucccacaccaagucaguauuucugcacgcucgcagugaucuugaaguugcccauuauaaauugaagccgagaagccugaugcuacacuacgaguuccuccagagggugaaacggcugccccuugaguauuccuacggggaauaccgcgaccuguuuagagacuucggaacgcauuauauuacugaggcggucuugggcggcaucuacgaauauacccucgugaugaacaaggaggcaauggaacguggggauuacacacugaauaacgugcacgccugugcuaaaaacgacuuuaagauuggaggugccaucgaggaggucuauguuucuuuaggcgugagcguagggaagugcaggggaauacugaaugaaauuaaagaucggaacaagcgagacacuaugguggaggaucucgucgugcuuguuagaggcggugcaucagaacacaucaccacacuggcuuaccaagaguugccuaccgccgaccuaaugcaggaauggggcgaugcggugcaguauaauccagccauuaucaaagucaagguggagccccuguacgagcucguaacggcaacugacuucgcuuacaguuccacaguuaggcaaaacaugaaacaggcccuggaagaguuucagaaggaagugagcucuugucauugcgcuccuugucaggggaauggagucccagugcuuaagggcucacgcugcgauuguaucugccccgucgggagucaaggacuggccugugaggugagcuaucggaaaaacaccccgauugacgguaaguggaauugcugguccaacuggucuucgugcagcggcagaaggaaaacucgccagcgacaguguaauaacccucccccacagaaugggggauccccuugcucaggccccgcaagugagacauuggauuguucuuga

SEQ ID NO: 8015 - RNA, 1776 nt, Artificial Sequence
  derived and/or modified sequence opt4 from CO8B__Homo_sapiens__AAI30576
augaagaacagcagaaccugggccuggagagcccccguggagcuguuccugcugugcgccgcccugggcugccugagccugcccggcagcagaggcgagagaccccacagcuucggcagcaacgccgugaacaagagcuucgccaagagcagacagaugagaagcguggacgugacccugaugcccaucgacugcgagcugagcagcuggagcagcuggaccaccugcgaccccugccagaagaagagauacagauacgccuaccugcugcagcccagccaguuccacggcgagcccugcaacuucagcgacaaggagguggaggacugcgugaccaacagacccugcagaagccaggugagaugcgagggcuucgugugcgcccagaccggcagaugcgugaacagaagacugcugugcaacggcgacaacgacugcggcgaccagagcgacgaggccaacugcagaagaaucuacaagaagugccagcacgagauggaccaguacuggggcaucggcagccuggccagcggcaucaaccuguucaccaacagcuucgagggccccgugcuggaccacagauacuacgccggcggcugcagcccccacuacauccugaacaccagauucagaaagcccuacaacguggagagcuacaccccccagacccagggcaaguacgaguucauccugaaggaguacgagagcuacagcgacuucgagagaaacgugaccgagaagauggccagcaagagcggcuucagcuucggcuucaagauccccggcaucuucgagcugggcaucagcagccagagcgacagaggcaagcacuacaucagaagaaccaagagauucagccacaccaagagcguguuccugcacgccagaagcgaccuggagguggcccacuacaagcugaagcccagaagccugaugcugcacuacgaguuccugcagagagugaagagacugccccuggaguacagcuacggcgaguacagagaccuguucagagacuucggcacccacuacaucaccgaggccgugcugggcggcaucuacgaguacacccuggugaugaacaaggaggccauggagagaggcgacuacacccugaacaacgugcacgccugcgccaagaacgacuucaagaucggcggcgccaucgaggagguguacgugagccugggcgugagcgugggcaagugcagaggcauccugaacgagaucaaggacagaaacaagagagacaccaugguggaggaccugguggugcuggugagaggcggcgccagcgagcacaucaccacccuggccuaccaggagcugcccaccgccgaccugaugcaggaguggggcgacgccgugcaguacaaccccgccaucaucaaggugaagguggagccccuguacgagcuggugaccgccaccgacuucgccuacagcagcaccgugagacagaacaugaagcaggcccuggaggaguuccagaaggaggugagcagcugccacugcgcccccugccagggcaacggcgugcccgugcugaagggcagcagaugcgacugcaucugccccgugggcagccagggccuggccugcgaggugagcuacagaaagaacacccccaucgacggcaaguggaacugcuggagcaacuggagcagcugcagcggcagaagaaagaccagacagagacagugcaacaacccccccccccagaacggcggcagccccugcagcggccccgccagcgagacccuggacugcagcuga

SEQ ID NO: 8016 - RNA, 1776 nt, Artificial Sequence
  derived and/or modified sequence opt5 from CO8B__Homo_sapiens__AAI30576
augaagaacagcagaaccugggccuggcgggcucccguggagcuguuccuccugugcgccgcgcuuggcugucugucccucccugggucucgcggagaaagaccgcacagcuuuggcuccaaugcugucaacaaaucuuucgccaagagccggcagaugcgcuccguugacgugacacugaugcccaucgauugcgagcuuucuagcugguccagcuggacgaccugugacccuugccagaaaaagagauaccgguaugccuaccugcuccaacccucucaguuucauggggaaccuuguaauuucuccgauaaagagguggaagacugcgucacaaaccgccccuguagaagccaggugcggugcgagggauuuguuugugcucaaaccggccgcugcgugaauagacggcugcuguguaacggggauaaugacugcggagaucagucugacgaggccaacugccgcagaauuuauaagaagugucagcacgaaauggaucaguacuggggcaucggcucccucgcuagcgggauuaaucuguucacaaacucuuuugagggaccuguccuugaccaucgguauuacgccggcgggugcuccccgcacuauauccugaauacccgcuucagaaaacccuacaacguggaaagcuacacaccucaaacccagggaaaguaugaguuuauucucaaagaguacgaauccuauucugauuucgagcggaauguuacggaaaagauggcgagcaaauccggcuuuagcuucggguuuaagauccccggaaucuucgagcugggcauuucuucccagagcgacagaggcaagcauuacauccgccggaccaaaagauucucucacacaaagagcguguuucuucacgcccgcuccgaucuggaagucgcucauuauaaacucaagccucggucucugaugcugcacuacgaguuccuccagagagugaaacgccugccccuugaguauagcuacggggaauaccgggaccuguuuagagacuucggaacccauuauauuacagaggccgugcucggcgggaucuacgaauauacccuggucaugaacaaggaggcuauggaacgcggagauuacacgcuuaauaacguucacgccugugcgaaaaacgacuuuaagauuggcggggccaucgaggagguguaugugucccugggagucagcgugggcaagugccggggcauucucaaugaaaucaaagauagaaacaagcgcgacacaaugguugaggaucuggugguccuggugagagggggagcuucugaacacaucaccacacucgccuaccaagagcugccgaccgcugaccuuaugcaggaauggggcgaugccguucaguauaauccugccauuaucaaagugaaggucgagccccuguacgagcucgugaccgcuacagacuucgcguacuccagcacgguccggcaaaacaugaaacaggcccuggaagaguuucagaaggaagugucuuccugucauugcgcuccuugucaggggaauggaguucccgugcuuaagggcagccggugcgauuguauuugccccgucgggucccaaggccuggccugugaggugucuuaucgcaaaaacaccccuaucgacggaaaguggaauugcuggagcaacugguccucuugcagcggcagacggaaaacaagacagcgccaguguaauaacccgcccccucagaaugggggaucccccugcagcggcccugccucugagacccucgauuguuccuga

SEQ ID NO: 8017 - protein, 202 aa, Artificial Sequence
  CO8G__Homo_sapiens__P07360
MLPPGTATLLTLLLAAGSLGQKPQRPRRPASPISTIQPKANFDAQQFAGTWLLVAVGSACRFLQEQGHRAEATTLHVAPQGTAMAVSTFRKLDGICWQVRQLYGDTGVLGRFLLQARDARGAVHVVVAETDYQSFAVLYLERAGQLSVKLYARSLPVSDSVLSGFEQRVQEAHLTEDQIFYFPKYGFCEAADQFHVLDEVRR

SEQ ID NO: 8018 - RNA, 609 nt, Artificial Sequence
  CO8G__Homo_sapiens__CCDS7017.1
augcugcccccugggacugcgacccucuugacucugcuccuggcagcuggcucgcugggccagaagccucagaggccacgccggcccgcaucccccaucagcaccauccagcccaaggccaauuuugaugcucagcaguuugcagggaccuggcuccuuguggcugugggcuccgcuugccguuuccugcaggagcagggccaccgggccgaggccaccacacugcauguggcuccccagggcacagccauggcugucaguaccuuccgaaagcuggaugggaucugcuggcaggugcgccagcucuauggagacacagggguccucggccgcuuccugcuucaagcccgagacgcccgaggggcugugcacgugguugucgcugagaccgacuaccagaguuucgcuguccuguaccuggagcgggcggggcagcugucagugaagcucuacgcccgcucgcucccugugagcgacucgguccugaguggguuugagcagcggguccaggaggcccaccugacugaggaccagaucuucuacuuccccaaguacggcuucugcgaggcugcagaccaguuccacguccuggacgaagugaggagguga

SEQ ID NO: 8019 - RNA, 609 nt, Artificial Sequence
  derived and/or modified sequence opt1 from CO8G__Homo_sapiens__CCDS7017.1
augcugcccccgggcaccgccacccuccugacgcugcuccuggccgcggggagccugggccagaagccccagcgcccccggcgccccgccuccccgaucagcaccauccagcccaaggccaacuucgacgcccagcaguucgccgggaccuggcuccugguggcggucggcuccgccugccgguuccugcaggagcaggggcaccgcgccgaggccaccacgcuccacguggcgccccagggcaccgccauggccgugagcaccuuccggaagcuggacggcaucugcuggcagguccgccagcuguacggggacaccggcgugcucgggcgguuccugcugcaggcccgcgacgcccggggcgcggugcacgucgugguggccgagacggacuaccaguccuucgccguccucuaccuggagcgcgccgggcagcugagcgugaagcucuacgcccggucccugcccgugagcgacuccguccugagcggcuucgagcagcgcgugcaggaggcgcaccucaccgaggaccagaucuucuacuucccgaaguacggcuucugcgaggccgccgaccaguuccacgugcuggacgagguccggcgcuga

SEQ ID NO: 8020 - RNA, 609 nt, Artificial Sequence
  derived and/or modified sequence opt2 from CO8G__Homo_sapiens__CCDS7017.1
augcucccccccggcaccgccacccuccucacccuccuccucgccgccggcucccucggccagaagccccagcgcccccgccgccccgccucccccaucuccaccauccagcccaaggccaacuucgacgcccagcaguucgccggcaccuggcuccucgucgccgucggcuccgccugccgcuuccuccaggagcagggccaccgcgccgaggccaccacccuccacgucgccccccagggcaccgccauggccgucuccaccuuccgcaagcucgacggcaucugcuggcagguccgccagcucuacggcgacaccggcguccucggccgcuuccuccuccaggcccgcgacgcccgcggcgccguccacgucgucgucgccgagaccgacuaccaguccuucgccguccucuaccucgagcgcgccggccagcucuccgucaagcucuacgcccgcucccuccccgucuccgacuccguccucuccggcuucgagcagcgcguccaggaggcccaccucaccgaggaccagaucuucuacuuccccaaguacggcuucugcgaggccgccgaccaguuccacguccucgacgagguccgccgcuga

SEQ ID NO: 8021 - RNA, 609 nt, Artificial Sequence
  derived and/or modified sequence opt3 from CO8G__Homo_sapiens__CCDS7017.1
augcugcccccuggcaccgccacacuccuuacucuguuguuagcugcagggagccugggacagaagccacaaagaccgaggcggcccgccuccccuaucucuacgauucagccaaaagcgaacuucgacgcucagcaguuugccgguaccuggcuacucguggcagucggcucagccugccgcuuccugcaagagcaggggcaccgagcugaagcaacaacucuucauguugcuccccagggaaccgccauggccgugaguacauuucguaagcuggauggcauauguuggcagguaagacaauuguacggugacaccggggugcucggaagguuccugcugcaggcgcgggaugcacgcggcgccguccacgugguuguggcugagacugacuaucagagcuuugccguccucuacuuagaaagagcaggccagcuguccgugaaacuuuaugcuaggucuuugccuguaucggauucaguucugagcggguucgagcaacgggugcaggaagcccaucuaacagaggaccagaucuuuuacuucccaaaguauggauuuugcgaggcggccgaucaauuccacguccucgacgaagugcgccgauga

SEQ ID NO: 8022 - RNA, 609 nt, Artificial Sequence
  derived and/or modified sequence opt4 from CO8G__Homo_sapiens__CCDS7017.1
augcugccccccggcaccgccacccugcugacccugcugcuggccgccggcagccugggccagaagccccagagacccagaagacccgccagccccaucagcaccauccagcccaaggccaacuucgacgcccagcaguucgccggcaccuggcugcugguggccgugggcagcgccugcagauuccugcaggagcagggccacagagccgaggccaccacccugcacguggccccccagggcaccgccauggccgugagcaccuucagaaagcuggacggcaucugcuggcaggugagacagcuguacggcgacaccggcgugcugggcagauuccugcugcaggccagagacgccagaggcgccgugcacguggugguggccgagaccgacuaccagagcuucgccgugcuguaccuggagagagccggccagcugagcgugaagcuguacgccagaagccugcccgugagcgacagcgugcugagcggcuucgagcagagagugcaggaggcccaccugaccgaggaccagaucuucuacuuccccaaguacggcuucugcgaggccgccgaccaguuccacgugcuggacgaggugagaagauga

SEQ ID NO: 8023 - RNA, 609 nt, Artificial Sequence
  derived and/or modified sequence opt5 from CO8G__Homo_sapiens__CCDS7017.1
augcugcccccuggcaccgccacacuccugacgcuucugcucgcugccgggagccugggacagaagccgcaaagaccccggcgcccugcgucccccauuucuaccauucagccuaaagcuaacuucgacgcccagcaguuugccggcacauggcuucugguggcugucgggagcgccugcagauuccuccaagagcagggacaccgggcugaagccaccacacugcauguugcgccccagggcaccgccauggcuguguccacauuucgcaagcuggaugggaucuguuggcaagugagacagcucuacggagacaccggcguccugggccgguuccuucugcaggcccgcgaugcuagaggggccgugcacguuguggucgcggagacggacuaucagucuuuugccgugcucuaccuggaacgggcuggacagcuuagcguuaaacuguaugcccgcucccucccugugucugauagcguccuguccggcuucgagcaaagagugcaggaagcucaucugaccgaggaccagaucuuuuacuucccgaaguauggguuuugcgaggccgccgaucaauuccacgugcucgacgaaguccggcgcuga

SEQ ID NO: 8024 - protein, 500 aa, Artificial Sequence
  complement_system_component_C1INH__Homo_sapiens__P05155
MASRLTLLTLLLLLLAGDRASSNPNATSSSSQDPESLQDRGEGKVATTVISKMLFVEPILEVSSLPTTNSTTNSATKITANTTDEPTTQPTTEPTTQPTIQPTQPTTQLPTDSPTQPTTGSFCPGPVTLCSDLESHSTEAVLGDALVDFSLKLYHAFSAMKKVETNMAFSPFSIASLLTQVLLGAGENTKTNLESILSYPKDFTCVHQALKGFTTKGVTSVSQIFHSPDLAIRDTFVNASRTLYSSSPRVLSNNSDANLELINTWVAKNTNNKISRLLDSLPSDTRLVLLNAIYLSAKWKTTFDPKKTRMEPFHFKNSVIKVPMMNSKKYPVAHFIDQTLKAKVGQLQLSHNLSLVILVPQNLKHRLEDMEQALSPSVFKAIMEKLEMSKFQPTLLTLPRIKVTTSQDMLSIMEKLEFFDFSYDLNLCGLTEDPDLQVSAMQHQTVLELTETGVEAAAASAISVARTLLVFEVQQPFLFVLWDQQHKFPVFMGRVYDPRA

SEQ ID NO: 8025 - RNA, 1503 nt, Artificial Sequence
  complement_system_component_C1INH__Homo_sapiens__AAM21515
auggccuccaggcugacccugcugacccuccugcugcugcugcuggcuggggauagagccuccucaaauccaaaugcuaccagcuccagcucccaggauccagagaguuugcaagacagaggcgaagggaaggucgcaacaacaguuaucuccaagaugcuauucguugaacccauccuggagguuuccagcuugccgacaaccaacucaacaaccaauucagccaccaaaauaacagcuaauaccacugaugaacccaccacacaacccaccacagagcccaccacccaacccaccauccaacccacccaaccaacuacccagcucccaacagauucuccuacccagcccacuacuggguccuucugcccaggaccuguuacucucugcucugacuuggagagucauucaacagaggccguguugggggaugcuuugguagauuucucccugaagcucuaccacgccuucucagcaaugaagaagguggagaccaacauggccuuuuccccauucagcaucgccagccuccuuacccagguccugcucggggcuggggagaacaccaaaacaaaccuggagagcauccucucuuaccccaaggacuucaccuguguccaccaggcccugaagggcuucacgaccaaaggugucaccucagucucucagaucuuccacagcccagaccuggccauaagggacaccuuugugaaugccucucggacccuguacagcagcagccccagaguccuaagcaacaacagugacgccaacuuggagcucaucaacaccuggguggccaagaacaccaacaacaagaucagccggcugcuagacagucugcccuccgauacccgccuuguccuccucaaugcuaucuaccugagugccaaguggaagacaacauuugaucccaagaaaaccagaauggaacccuuucacuucaaaaacucaguuauaaaagugcccaugaugaauagcaagaaguacccuguggcccauuucauugaccaaacuuugaaagccaagguggggcagcugcagcucucccacaaucugaguuuggugauccugguaccccagaaccugaaacaucgucuugaagacauggaacaggcucucagcccuucuguuuucaaggccaucauggagaaacuggagauguccaaguuccagcccacucuccuaacacuaccccgcaucaaagugacgaccagccaggauaugcucucaaucauggagaaauuggaauucuucgauuuuucuuaugaccuuaaccugugugggcugacagaggacccagaucuucagguuucugcgaugcagcaccagacagugcuggaacugacagagacugggguggaggcggcugcagccuccgccaucucuguggcccgcacccugcuggucuuugaagugcagcagcccuuccucuucgugcucugggaccagcagcacaaguucccugucuucauggggcgaguauaugaccccagggccuga

SEQ ID NO: 8026 - RNA, 1503 nt, Artificial Sequence
  derived and/or modified sequence opt1 from complement_system_component_C1INH__Homo_sapiens__AAM21515
auggccagccgccugacccuccugacccugcuccugcugcuccuggccggcgaccgggcguccagcaaccccaacgccacguccagcuccagccaggacccggagucccugcaggaccgcggggagggcaagguggccaccaccgucaucagcaagaugcuguucguggagcccauccuggagguguccagccugcccaccacgaacuccaccaccaacagcgccaccaagaucacggccaacaccaccgacgagcccaccacgcagccgaccaccgagcccaccacgcagcccaccauccagcccacccagccgaccacgcagcuccccaccgacucccccacccagcccaccacggggagcuucugcccgggccccgucacccugugcuccgaccuggagagccacuccaccgaggcggugcucggggacgcccugguggacuucagccugaagcucuaccacgccuucuccgccaugaagaaggucgagaccaacauggcguucagccccuucagcaucgccucccugcugacccaggugcuccugggcgccggcgagaacaccaagaccaaccuggagagcauccucuccuaccccaaggacuucacgugcgugcaccaggcccugaagggguucacgaccaagggcgucaccagcgugucccagaucuuccacagcccggaccuggccauccgggacaccuucgugaacgcgucccgcacgcucuacagcuccagcccccggguccuguccaacaacagcgacgccaaccuggagcucaucaacaccuggguggccaagaacaccaacaacaagaucucccgccugcuggacagccuccccuccgacacccggcuggugcugcucaacgccaucuaccugagcgccaaguggaagaccacguucgaccccaagaagacccgcauggagccguuccacuucaagaacuccgucaucaaggugcccaugaugaacagcaagaaguaccccguggcgcacuucaucgaccagacccugaaggccaaggucgggcagcuccagcugucccacaaccugagccucgugauccuggugccccagaaccugaagcaccggcucgaggacauggagcaggcccugagcccguccgucuucaaggccaucauggagaagcuggagaugagcaaguuccagcccacccuccugacgcugccccgcaucaaggugaccaccucccaggacaugcugagcaucauggagaagcucgaguucuucgacuucuccuacgaccugaaccugugcggccucaccgaggaccccgaccuccaggugagcgccaugcagcaccagacgguccuggagcucaccgagaccgggguggaggcggccgccgccuccgccaucagcgucgcgcggacccugcugguguucgaggugcagcagccguuccucuucguccugugggaccagcagcacaaguuccccguguucaugggccgcguguacgacccccgggccuga

SEQ ID NO: 8027 - RNA, 1503 nt, Artificial Sequence
  derived and/or modified sequence opt2 from complement_system_component_C1INH__Homo_sapiens__AAM21515
auggccucccgccucacccuccucacccuccuccuccuccuccucgccggcgaccgcgccuccuccaaccccaacgccaccuccuccuccucccaggaccccgagucccuccaggaccgcggcgagggcaaggucgccaccaccgucaucuccaagaugcucuucgucgagcccauccucgaggucuccucccuccccaccaccaacuccaccaccaacuccgccaccaagaucaccgccaacaccaccgacgagcccaccacccagcccaccaccgagcccaccacccagcccaccauccagcccacccagcccaccacccagcuccccaccgacucccccacccagcccaccaccggcuccuucugccccggccccgucacccucugcuccgaccucgagucccacuccaccgaggccguccucggcgacgcccucgucgacuucucccucaagcucuaccacgccuucuccgccaugaagaaggucgagaccaacauggccuucucccccuucuccaucgccucccuccucacccagguccuccucggcgccggcgagaacaccaagaccaaccucgaguccauccucuccuaccccaaggacuucaccugcguccaccaggcccucaagggcuucaccaccaagggcgucaccuccgucucccagaucuuccacucccccgaccucgccauccgcgacaccuucgucaacgccucccgcacccucuacuccuccuccccccgcguccucuccaacaacuccgacgccaaccucgagcucaucaacaccugggucgccaagaacaccaacaacaagaucucccgccuccucgacucccuccccuccgacacccgccucguccuccucaacgccaucuaccucuccgccaaguggaagaccaccuucgaccccaagaagacccgcauggagcccuuccacuucaagaacuccgucaucaagguccccaugaugaacuccaagaaguaccccgucgcccacuucaucgaccagacccucaaggccaaggucggccagcuccagcucucccacaaccucucccucgucauccucgucccccagaaccucaagcaccgccucgaggacauggagcaggcccucucccccuccgucuucaaggccaucauggagaagcucgagauguccaaguuccagcccacccuccucacccucccccgcaucaaggucaccaccucccaggacaugcucuccaucauggagaagcucgaguucuucgacuucuccuacgaccucaaccucugcggccucaccgaggaccccgaccuccaggucuccgccaugcagcaccagaccguccucgagcucaccgagaccggcgucgaggccgccgccgccuccgccaucuccgucgcccgcacccuccucgucuucgagguccagcagcccuuccucuucguccucugggaccagcagcacaaguuccccgucuucaugggccgcgucuacgacccccgcgccuga

SEQ ID NO: 8028 - RNA, 1503 nt, Artificial Sequence
  derived and/or modified sequence opt3 from complement_system_component_C1INH__Homo_sapiens__AAM21515
auggccagcagacugacccuccuuacacuguuguuacugcuacucgcuggcgacagggcauccucuaaccccaaugccacuucaaguagcucccaggauccugagucucugcaagaccgcggggaaggaaagguggcgacgaccgucaucucgaaaaugcuuuucguugagccaauucuggaagugagcucauugccgacaacuaacaguaccacaaauuccgcuaccaagauaacugccaacacaaccgaugagcccacgacucagccuaccacagaaccaacuacccagcccacaauccagccuacccaaccaacgacucagcuccccacagacucuccuacccagccaacuacagguagcuuuugcccgggccccguaacccuguguuccgaucuggagucacacaguacggaggcagugcucggggacgccuuagucgauuucagccugaaacuuuaccaugcuuuuucugcaaugaagaaaguggaaaccaauauggccuucuccccuuuuucaauugcuagcuugcugacacagguucuacucggagccggcgagaacacuaagaccaaucuggaaaguauccuuucuuauccaaaggacuucacaugcgugcaccaagcgcugaaagguuuuacuaccaagggggucacauccgugagccagauuuuccauucgcccgauuuggcaauccgggacaccuuuguaaacgccucucgaacucucuacuccucaaguccucguguucugagcaauaacuccgaugcuaauuuagagcugauaaacacguggguggccaaaaauacaaacaauaagaucucuagacuccuugacagccugccaucagauaccagguugguccuacugaacgcaauuuaucucagugcuaaauggaagacuaccuucgaccccaagaaaacacggauggagccguuucacuucaagaacuccgugaucaaagugccuaugaugaauagcaagaaauaccccgucgcccauuuuauugaccagacccugaaggcgaaaguuggacagcuucaacugucucacaacuugucacucgugauccugguaccacagaauuuaaagcaccgccuggaagauauggagcaggcccuaaguccuagcguguucaaggcaauaauggaaaaacucgagauguccaaguuccaacccacucugcuuacauugccaagaauuaaagucacgaccucucaggacaugcugucgaucauggaaaagcucgaguuuuucgauuuuagcuaugaccugaaccuuuguggccugacugaggaucccgaccuccagguguccgcuaugcagcaucaaacaguuuuggaacugaccgagacaggcguggaagccgcugccgcaucagccauuagugucgcuaggacuuuacugguguucgagguacagcagccuuuucuauucguucucugggaucagcaacacaaauuuccaguguucauggggcgggucuacgacccgcgcgcguga

SEQ ID NO: 8029 - RNA, 1503 nt, Artificial Sequence
  derived and/or modified sequence opt4 from complement_system_component_C1INH__Homo_sapiens__AAM21515
auggccagcagacugacccugcugacccugcugcugcugcugcuggccggcgacagagccagcagcaaccccaacgccaccagcagcagcagccaggaccccgagagccugcaggacagaggcgagggcaagguggccaccaccgugaucagcaagaugcuguucguggagcccauccuggaggugagcagccugcccaccaccaacagcaccaccaacagcgccaccaagaucaccgccaacaccaccgacgagcccaccacccagcccaccaccgagcccaccacccagcccaccauccagcccacccagcccaccacccagcugcccaccgacagccccacccagcccaccaccggcagcuucugccccggccccgugacccugugcagcgaccuggagagccacagcaccgaggccgugcugggcgacgcccugguggacuucagccugaagcuguaccacgccuucagcgccaugaagaagguggagaccaacauggccuucagccccuucagcaucgccagccugcugacccaggugcugcugggcgccggcgagaacaccaagaccaaccuggagagcauccugagcuaccccaaggacuucaccugcgugcaccaggcccugaagggcuucaccaccaagggcgugaccagcgugagccagaucuuccacagccccgaccuggccaucagagacaccuucgugaacgccagcagaacccuguacagcagcagccccagagugcugagcaacaacagcgacgccaaccuggagcugaucaacaccuggguggccaagaacaccaacaacaagaucagcagacugcuggacagccugcccagcgacaccagacuggugcugcugaacgccaucuaccugagcgccaaguggaagaccaccuucgaccccaagaagaccagaauggagcccuuccacuucaagaacagcgugaucaaggugcccaugaugaacagcaagaaguaccccguggcccacuucaucgaccagacccugaaggccaaggugggccagcugcagcugagccacaaccugagccuggugauccuggugccccagaaccugaagcacagacuggaggacauggagcaggcccugagccccagcguguucaaggccaucauggagaagcuggagaugagcaaguuccagcccacccugcugacccugcccagaaucaaggugaccaccagccaggacaugcugagcaucauggagaagcuggaguucuucgacuucagcuacgaccugaaccugugcggccugaccgaggaccccgaccugcaggugagcgccaugcagcaccagaccgugcuggagcugaccgagaccggcguggaggccgccgccgccagcgccaucagcguggccagaacccugcugguguucgaggugcagcagcccuuccuguucgugcugugggaccagcagcacaaguuccccguguucaugggcagaguguacgaccccagagccuga

SEQ ID NO: 8030 - RNA, 1503 nt, Artificial Sequence
  derived and/or modified sequence opt5 from complement_system_component_C1INH__Homo_sapiens__AAM21515
auggccagcagacugacccuccugacacuucugcuccugcuucuggcuggcgaccgggccuccucuaaccccaaugcgacgagcuccucuagccaggauccugagucccuccaagaccgcggggaaggaaagguggcuaccacagucaucucuaaaaugcuguucguugagccgauucuggaagugagcucccuccccaccacaaacagcaccacaaauucugccaccaagaucacggccaacaccacagaugagccuaccacacagcccaccacggaaccuacaacccagcccacaauucagccuacccaaccgaccacacagcugcccacggacuccccuacccagcccacaaccggcagcuuuugcccugggcccgugacacuuuguucugaucuggagucccacagcaccgaggcuguccucggagacgcccugguggauuucucucuuaaacuguaccaugcuuuuuccgccaugaagaaaguugaaacgaauauggcguucagcccguuuuccaucgccucucuccugacacaggugcugcucggcgcuggggagaacaccaagaccaaucuggaaagcauucuuuccuauccuaaggacuucacaugcguccaccaagcccugaaaggauuuaccacaaagggcgugacgagcguuucucagaucuuccauucccccgaucucgcuaucagagacaccuuugugaacgccagccggacacuguacucuagcuccccucgcguccuuucuaauaacagcgaugcgaaucuggagcucauuaacaccuggguggccaaaaauacaaacaauaagaucuccagacugcuggacagccuccccucugauacccggcuggugcuucugaacgcuauuuaucucuccgccaaauggaagacgaccuucgaccccaagaaaacacgcauggagccuuuucacuucaagaacagcgucaucaaaguuccgaugaugaacucuaagaaauaccccguggcucauuuuauugaccagacccugaaggccaaagugggccagcuucaacugucccacaaucucagccuggucauccuggugccucagaaucucaagcacagacuggaagauauggagcaggcccuuucccccucuguuuucaaggcuauuauggaaaaacuggagaugagcaaguuccaaccuacacuccugacccugccccggaucaaagugacgacaucccaggacaugcuuucuaucauggaaaagcucgaguuuuucgauuuuagcuaugaccugaaccugugugggcucaccgaggauccggaccugcaggucuccgcgaugcagcaucaaacagugcuugaacugaccgagaccggaguugaagccgcugccgccagcgcuauuucuguggcccgcacacuccuggucuucgaggugcagcagccuuuucuguucguccuuugggaucagcaacacaaauuucccguguucaugggcagaguuuacgacccucgggcguga

SEQ ID NO: 8031 - protein, 652 aa, Artificial Sequence [sequence omitted]

SEQ ID NO: 8032 - RNA, 1959 nt, Artificial Sequence
  complement_system_component_C1qR__Homo_sapiens__CAC82720
auggccaccuccaugggccugcugcugcugcugcugcugcuccugacccagcccggggcggggacgggagcugacacggaggcgguggucugcguggggaccgccugcuacacggcccacucgggcaagcugagcgcugccgaggcccagaaccacugcaaccagaacgggggcaaccuggccacugugaagagcaaggaggaggcccagcacguccagcgaguacuggcccagcuccugaggcgggaggcagcccugacggcgaggaugagcaaguucuggauugggcuccagcgagagaagggcaagugccuggacccuagucugccgcugaagggcuucagcugggugggcgggggggaggacacgccuuacucuaacuggcacaaggagcuccggaacucgugcaucuccaagcgcugugugucucugcugcuggaccugucccagccgcuccuucccagccgccuccccaaguggucugagggccccugugggagcccaggcucccccggaaguaacauugagggcuucgugugcaaguucagcuucaaaggcaugugccggccucuggcccuggggggcccaggucaggugaccuacaccacccccuuccagaccaccaguuccuccuuggaggcugugcccuuugccucugcggccaauguagccuguggggaaggugacaaggacgagacucagagucauuauuuccugugcaaggagaaggcccccgauguguucgacuggggcagcucgggcccccucugugucagccccaaguauggcugcaacuucaacaaugggggcugccaccaggacugcuuugaagggggggauggcuccuuccucugcggcugccgaccaggauuccggcugcuggaugaccuggugaccugugccucucgaaacccuugcagcuccagcccaugucgugggggggccacgugcgcccugggaccccaugggaaaaacuacacgugccgcugcccccaaggguaccagcuggacucgagucagcuggacuguguggacguggaugaaugccaggacucccccugugcccaggagugugucaacaccccugggggcuuccgcugcgaaugcuggguuggcuaugagccgggcgguccuggagagggggccugucaggauguggaugagugugcucugggucgcucgccuugcgcccagggcugcaccaacacagauggcucauuucacugcuccugugaggagggcuacguccuggccggggaggacgggacucagugccaggacguggaugagugugugggcccggggggcccccucugcgacagcuugugcuucaacacacaaggguccuuccacuguggcugccugccaggcugggugcuggccccaaauggggucucuugcaccauggggccugugucucugggaccaccaucugggccccccgaugaggaggacaaaggagagaaagaagggagcaccgugccccgcgcugcaacagccagucccacaaggggccccgagggcacccccaaggcuacacccaccacaaguagaccuucgcugucaucugacgcccccaucacaucugccccacucaagaugcuggcccccaguggguccucaggcgucuggagggagcccagcauccaucacgccacagcugccucuggcccccaggagccugcagguggggacuccuccguggccacacaaaacaacgauggcacugacgggcaaaagcugcuuuuauucuacauccuaggcaccgugguggccauccuacuccugcuggcccuggcucuggggcuacuggucuaucgcaagcggagagcgaagagggaggagaagaaggagaagaagccccagaaugcggcagacaguuacuccuggguuccagagcgagcugagagcagggccauggagaaccaguacaguccgacaccugggacagacugcuga

SEQ ID NO: 8033 - RNA, 1959 nt, Artificial Sequence
  derived and/or modified sequence opt1 from complement_system_component_C1qR__Homo_sapiens__CAC82720
auggccaccagcaugggccugcuccugcugcuccugcugcuccugacccagcccggggccggcacgggggcggacaccgaggccguggucugcgugggcaccgccugcuacaccgcccacuccgggaagcugagcgccgcggaggcccagaaccacugcaaccagaacggcggcaaccucgccacggugaaguccaaggaggaggcccagcacguccagcgcgugcuggcgcagcugcuccggcgcgaggccgcccugaccgcccggaugagcaaguucuggaucgggcugcagcgcgagaagggcaagugccucgacccgucccugccccugaagggguucagcugggugggcgggggcgaggacacccccuacuccaacuggcacaaggagcuccggaacagcugcaucuccaagcgcugcgucagccugcugcucgaccugucccagccccugcucccgagccggcugcccaagugguccgagggccccugcgggagccccggcuccccggggagcaacaucgagggcuucgugugcaaguucuccuucaagggcaugugccgcccccuggcccucgggggccccggccaggugaccuacacgacccccuuccagaccaccagcuccagccuggaggcggucccguucgccagcgccgccaacguggccugcggggagggggacaaggacgagacgcagucccacuacuuccugugcaaggagaaggcgcccgacguguucgacuggggcagcuccggcccccucugcgucagccccaaguacgggugcaacuucaacaacggcgggugccaccaggacugcuucgagggcggggacggcuccuuccugugcggcugccggccgggguuccgccugcucgacgaccuggugaccugcgccagccggaaccccugcuccagcucccccugccgcggcggggcgaccugcgcccugggcccccacgggaagaacuacacgugccggugcccgcagggcuaccagcucgacagcucccagcuggacugcguggacgucgacgagugccaggacagccccugcgcccaggagugcgugaacacccccggcggguuccgcugcgagugcugggugggcuacgagcccgggggcccgggcgagggggccugccaggacgucgacgagugcgcccugggccggucccccugcgcccaggggugcaccaacaccgacggcagcuuccacugcuccugcgaggagggguacgugcucgccggcgaggacggcacccagugccaggacguggacgagugcgucgggcccggcgggccccugugcgacagccugugcuucaacacgcagggcuccuuccacugcgggugccucccgggcugggugcuggcccccaacggcgugagcugcaccauggggcccgucucccugggcccgcccagcgggccgcccgacgaggaggacaagggcgagaaggaggggagcaccgugccccgcgcggccaccgccucccccacgcggggccccgagggcacccccaaggccaccccgaccacgagccgccccucccucagcuccgacgcgcccaucaccagcgcgccccugaagaugcuggccccguccgggagcuccggcgucuggcgggagcccagcauccaccacgccaccgccgccuccgggccccaggagcccgccggcggggacagcuccguggccacccagaacaacgacggcacggacggccagaagcuccugcuguucuacauccuggggaccguggucgccauccuccugcugcucgcccuggcgcugggccuccugguguaccgcaagcggcgcgccaagcgcgaggagaagaaggagaagaagccgcagaacgccgccgacagcuacuccugggugcccgagcgggccgagagccgcgcgauggagaaccaguacucccccacccccgggaccgacugcuga

SEQ ID NO: 8034 - RNA, 1959 nt, Artificial Sequence
  derived and/or modified sequence opt2 from complement_system_component_C1qR__Homo_sapiens__CAC82720
auggccaccuccaugggccuccuccuccuccuccuccuccuccucacccagcccggcgccggcaccggcgccgacaccgaggccgucgucugcgucggcaccgccugcuacaccgcccacuccggcaagcucuccgccgccgaggcccagaaccacugcaaccagaacggcggcaaccucgccaccgucaaguccaaggaggaggcccagcacguccagcgcguccucgcccagcuccuccgccgcgaggccgcccucaccgcccgcauguccaaguucuggaucggccuccagcgcgagaagggcaagugccucgaccccucccucccccucaagggcuucuccugggucggcggcggcgaggacacccccuacuccaacuggcacaaggagcuccgcaacuccugcaucuccaagcgcugcgucucccuccuccucgaccucucccagccccuccuccccucccgccuccccaagugguccgagggccccugcggcucccccggcucccccggcuccaacaucgagggcuucgucugcaaguucuccuucaagggcaugugccgcccccucgcccucggcggccccggccaggucaccuacaccacccccuuccagaccaccuccuccucccucgaggccguccccuucgccuccgccgccaacgucgccugcggcgagggcgacaaggacgagacccagucccacuacuuccucugcaaggagaaggcccccgacgucuucgacuggggcuccuccggcccccucugcgucucccccaaguacggcugcaacuucaacaacggcggcugccaccaggacugcuucgagggcggcgacggcuccuuccucugcggcugccgccccggcuuccgccuccucgacgaccucgucaccugcgccucccgcaaccccugcuccuccucccccugccgcggcggcgccaccugcgcccucggcccccacggcaagaacuacaccugccgcugcccccagggcuaccagcucgacuccucccagcucgacugcgucgacgucgacgagugccaggacucccccugcgcccaggagugcgucaacacccccggcggcuuccgcugcgagugcugggucggcuacgagcccggcggccccggcgagggcgccugccaggacgucgacgagugcgcccucggccgcucccccugcgcccagggcugcaccaacaccgacggcuccuuccacugcuccugcgaggagggcuacguccucgccggcgaggacggcacccagugccaggacgucgacgagugcgucggccccggcggcccccucugcgacucccucugcuucaacacccagggcuccuuccacugcggcugccuccccggcuggguccucgcccccaacggcgucuccugcaccaugggccccgucucccucggcccccccuccggcccccccgacgaggaggacaagggcgagaaggagggcuccaccgucccccgcgccgccaccgccucccccacccgcggccccgagggcacccccaaggccacccccaccaccucccgccccucccucuccuccgacgcccccaucaccuccgccccccucaagaugcucgcccccuccggcuccuccggcgucuggcgcgagcccuccauccaccacgccaccgccgccuccggcccccaggagcccgccggcggcgacuccuccgucgccacccagaacaacgacggcaccgacggccagaagcuccuccucuucuacauccucggcaccgucgucgccauccuccuccuccucgcccucgcccucggccuccucgucuaccgcaagcgccgcgccaagcgcgaggagaagaaggagaagaagccccagaacgccgccgacuccuacuccuggguccccgagcgcgccgagucccgcgccauggagaaccaguacucccccacccccggcaccgacugcuga

SEQ ID NO: 8035 - RNA, 1959 nt, Artificial Sequence
  derived and/or modified sequence opt3 from complement_system_component_C1qR__Homo_sapiens__CAC82720
auggccaccagcaugggccugcuccuucuguuguuacugcuacucacacagcccggggcuggaacuggugcagacacggaggccguggucugcguuggcaccgcguguuacacagcucacuccgggaagcugucugccgcagaagcccaaaaccauugcaaucagaacggaggcaaucuugcuacugugaaaucaaaggaggaagcacagcacguacagagagugcuggcccaauugcucaggcgggaggcugcccugaccgcgcgcaugaguaaauucuggaucggucugcagcgagaaaaggggaaaugucucgauccuagcuuaccacugaagggauuuuccugggucggcggcggggaggacacaccguauucuaacuggcauaaggagcuucguaauucgugcauuucaaaaagaugugugagcuugcugcuagaucucagucagccccugcuuccuuccaggcugccaaaguggucugaaggacccugcgguagcccuggcuccccagggucaaacauagagggauucguuuguaaauuuaguuucaagggcaugugccggcccuuggcacucggugggccuggacaggugaccuacacuacaccauuucaaaccacgucuagcucccuggaagccgucccguucgcuucagccgcaaauguggcuuguggcgagggcgacaaagaugagacucagagccacuacuuuuuaugcaaggaaaaggcccccgacguauucgauugggggaguucuggaccucuguguguuuccccaaaauaugguugcaacuuuaauaacggcgggugccaucaggacuguuucgagggaggcgaugguagcuuucucugcgggugucgccccggcuucagacuucuggacgauuuggugaccugcgcgucgaggaauccuuguucuuccucaccaugccggggaggcgccacaugugcacuagggccccacggaaagaacuauacuugccgcuguccgcaggguuaccaacuggacaguagccagcucgauugcgucgacguggacgaaugucaggauuccccuugcgcucaagagugcgugaauacccccggcggguuucgaugugaaugcugggucggauaugagccaggcgguccuggggagggcgccugucaggacguugaugaaugcgcucugggaagaucucccugugcccagggcugcacaaacaccgacgggagcuuccacuguucaugcgaggaaggauacgugcuugccggugaggauggcacgcagugucaagacguagaugaaugcguggggccaggaggcccccugugugacaguuugugcuucaauacucaggguuccuuucauugcgggugucucccuggcuggguccuggcaccaaacggagugagcugcacaaugggcccgguuucuuuagggcccccuucaggaccacccgaugaggaggacaaaggcgaaaaggaggguaguaccgugccuagggcugcgacugcaagcccaacacgggggcccgaaggaaccccgaaagccacgccuaccacaucccguccaucucugucgagcgaugcucccaucacuuccgccccucuaaagaugcucgcacccucaggcaguucuggugucuggcgcgagccaagcauucaccaugccaccgcugccuccggcccucaggaacccgcagggggagacucaagcguggcgacacagaacaaugacggcacugaugggcaaaaacugcuuuuguucuacauccugggaaccguaguugcuauucuccugcuucuggccuuggcacucggccuguuaguguauagaaagaggcgggccaagcgagaggagaaaaaggagaaaaagccacagaacgcugccgacucuuacuccugggucccggaacgcgcagaaaguagagcuauggagaaucaguauagcccuacacccgguaccgauuguuga

SEQ ID NO: 8036 - RNA, 1959 nt, Artificial Sequence
  derived and/or modified sequence opt4 from complement_system_component_C1qR__Homo_sapiens__CAC82720
auggccaccagcaugggccugcugcugcugcugcugcugcugcugacccagcccggcgccggcaccggcgccgacaccgaggccguggugugcgugggcaccgccugcuacaccgcccacagcggcaagcugagcgccgccgaggcccagaaccacugcaaccagaacggcggcaaccuggccaccgugaagagcaaggaggaggcccagcacgugcagagagugcuggcccagcugcugagaagagaggccgcccugaccgccagaaugagcaaguucuggaucggccugcagagagagaagggcaagugccuggaccccagccugccccugaagggcuucagcugggugggcggcggcgaggacacccccuacagcaacuggcacaaggagcugagaaacagcugcaucagcaagagaugcgugagccugcugcuggaccugagccagccccugcugcccagcagacugcccaaguggagcgagggccccugcggcagccccggcagccccggcagcaacaucgagggcuucgugugcaaguucagcuucaagggcaugugcagaccccuggcccugggcggccccggccaggugaccuacaccacccccuuccagaccaccagcagcagccuggaggccgugcccuucgccagcgccgccaacguggccugcggcgagggcgacaaggacgagacccagagccacuacuuccugugcaaggagaaggcccccgacguguucgacuggggcagcagcggcccccugugcgugagccccaaguacggcugcaacuucaacaacggcggcugccaccaggacugcuucgagggcggcgacggcagcuuccugugcggcugcagacccggcuucagacugcuggacgaccuggugaccugcgccagcagaaaccccugcagcagcagccccugcagaggcggcgccaccugcgcccugggcccccacggcaagaacuacaccugcagaugcccccagggcuaccagcuggacagcagccagcuggacugcguggacguggacgagugccaggacagccccugcgcccaggagugcgugaacacccccggcggcuucagaugcgagugcugggugggcuacgagcccggcggccccggcgagggcgccugccaggacguggacgagugcgcccugggcagaagccccugcgcccagggcugcaccaacaccgacggcagcuuccacugcagcugcgaggagggcuacgugcuggccggcgaggacggcacccagugccaggacguggacgagugcgugggccccggcggcccccugugcgacagccugugcuucaacacccagggcagcuuccacugcggcugccugcccggcugggugcuggcccccaacggcgugagcugcaccaugggccccgugagccugggcccccccagcggcccccccgacgaggaggacaagggcgagaaggagggcagcaccgugcccagagccgccaccgccagccccaccagaggccccgagggcacccccaaggccacccccaccaccagcagacccagccugagcagcgacgcccccaucaccagcgccccccugaagaugcuggcccccagcggcagcagcggcguguggagagagcccagcauccaccacgccaccgccgccagcggcccccaggagcccgccggcggcgacagcagcguggccacccagaacaacgacggcaccgacggccagaagcugcugcuguucuacauccugggcaccgugguggccauccugcugcugcuggcccuggcccugggccugcugguguacagaaagagaagagccaagagagaggagaagaaggagaagaagccccagaacgccgccgacagcuacagcugggugcccgagagagccgagagcagagccauggagaaccaguacagccccacccccggcaccgacugcuga

SEQ ID NO: 8037 - RNA, 1959 nt, Artificial Sequence
  derived and/or modified sequence opt5 from complement_system_component_C1qR__Homo_sapiens__CAC82720
auggccaccagcaugggccugcuccugcuucugcuccugcuucugacacagcccggggcuggaacgggcgccgacaccgaggcgguggucugcguugggacagcuuguuacaccgcccacuccggaaagcucucugccgcugaagcccaaaaccauugcaaucagaacggcgggaaucuggcuacagugaaaagcaaggaggaagcccagcacgugcagagaguccuggcgcaacuccugcggcgcgaggccgcucuuaccgccagaauguccaaauucuggaucggacugcagcgggaaaagggcaaaugucucgauccuucucugccgcuuaagggcuuuagcugggugggaggaggcgaggacacacccuauuccaacuggcauaaggagcugcgcaauucuugcauuagcaaaagauguguuucccuccugcuggaucucagccagccucugcuucccucucggcugccuaagugguccgaagggcccugcggaagcccuggcucuccgggguccaacaucgagggauucguguguaaauuuagcuucaagggcaugugccgcccccucgcucugggcgggccuggacaggucaccuacacgacccccuuucaaacaaccucuuccagccuugaagccgugccuuucgcguccgccgcuaauguugccuguggcgagggggacaaagaugagacacagucucacuauuuucugugcaaggaaaaggcucccgacguguucgauuggggaagcuccggcccgcucugugucagcccuaaauacgggugcaacuuuaauaacggaggcugccaucaggacuguuucgagggcggggauggaucuuuucugugcggcuguagacccggguuccggcugcucgacgaucuggugaccugcgccucccgcaauccuuguagcucuagccccugcagaggaggcgccacgugugcucuugggccccacggcaagaacuauacaugccgguguccucagggauaccaacuggacuccucucagcucgauugcguggacgucgacgaaugucaggauagcccgugcgcgcaagagugcguuaauacccccggcggguuucgcugugaaugcugggugggauaugagccuggcgggcccggagagggcgccugucaggacguggaugaaugcgcucuggggagauccccuugugcccagggcugcacaaacaccgacgggagcuuccacuguucuugcgaggaaggcuacguccuugccggggaggauggaacccagugucaagacguggaugaaugcguuggccccgggggaccgcugugugacucccucugcuucaauacacagggcagcuuucauugcgggugucugccuggcugggugcuggcucccaacggagucucuugcacgaugggcccugugucccucgggcccccuagcggacccccggaugaggaggacaaaggcgaaaaggagggguccaccguuccucgggccgcgacagcuucucccacccgcggacccgaaggcacaccuaaagccaccccgacgacaagcagacccucccugucuagcgaugccccuauuaccuccgcuccccuuaagaugcuggccccuagcgggucuuccggcguguggcgggagcccagcauccaccaugcuaccgccgcgucuggaccucaggaacccgccggcggggacuccagcgucgcuacacagaacaaugacggaaccgauggccaaaaacuccugcuguucuacauucuugggacaguggucgccauccuccugcugcucgcucuggcccuuggacugcucguguauagaaagcgccgggcgaagagagaggagaaaaaggagaaaaagccgcagaacgccgcugacucuuacagcuggguuccugaacgcgccgaaucccgggcuauggagaaucaguauagccccacgccuggcaccgauuguuga

SEQ ID NO: 8038 - protein, 688 aa, Artificial Sequence
  complement_system_component_C1s__Homo_sapiens__P09871
MWCIVLFSLLAWVYAEPTMYGEILSPNYPQAYPSEVEKSWDIEVPEGYGIHLYFTHLDIELSENCAYDSVQIISGDTEEGRLCGQRSSNNPHSPIVEEFQVPYNKLQVIFKSDFSNEERFTGFAAYYVATDINECTDFVDVPCSHFCNNFIGGYFCSCPPEYFLHDDMKNCGVNCSGDVFTALIGEIASPNYPKPYPENSRCEYQIRLEKGFQVVVTLRREDFDVEAADSAGNCLDSLVFVAGDRQFGPYCGHGFPGPLNIETKSNALDIIFQTDLTGQKKGWKLRYHGDPMPCPKEDTPNSVWEPAKAKYVFRDVVQITCLDGFEVVEGRVGATSFYSTCQSNGKWSNSKLKCQPVDCGIPESIENGKVEDPESTLFGSVIRYTCEEPYYYMENGGGGEYHCAGNGSWVNEVLGPELPKCVPVCGVPREPFEEKQRIIGGSDADIKNFPWQVFFDNPWAGGALINEYWVLTAAHVVEGNREPTMYVGSTSVQTSRLAKSKMLTPEHVFIHPGWKLLEVPEGRTNFDNDIALVRLKDPVKMGPTVSPICLPGTSSDYNLMDGDLGLISGWGRTEKRDRAVRLKAARLPVAPLRKCKEVKVEKPTADAEAYVFTPNMICAGGEKGMDSCKGDSGGAFAVQDPNDKTKFYAAGLVSWGPQCGTYGLYTRVKNYVDWIMKTMQENSTPRED

SEQ ID NO: 8039 - RNA, 2067 nt, Artificial Sequence
  complement_system_component_C1s__Homo_sapiens__AAA51852
auguggugcauuguccuguuuucacuuuuggcauggguuuaugcugagccuaccauguauggggagauccuguccccuaacuauccucaggcauaucccagugagguagagaaaucuugggacauagaaguuccugaaggguaugggauucaccucuacuucacccaucuggacauugagcugucagagaacugugcguaugacucagugcagauaaucucaggagacacugaagaagggaggcucuguggacagaggagcaguaacaauccccacucuccaauuguggaagaguuccaagucccauacaacaaacuccaggugaucuuuaagucagacuuuuccaaugaagagcguuuuacgggguuugcugcauacuauguugccacagacauaaaugaaugcacagauuuuguagaugucccuuguagccacuucugcaacaauuucauuggugguuacuucugcuccugccccccggaauauuuccuccaugaugacaugaagaauugcggaguuaauugcaguggggauguauucacugcacugauuggggagauugcaagucccaauuaucccaaaccauauccagagaacucaaggugugaauaccagauccgguuggagaaaggguuccaagugguggugaccuugcggagagaagauuuugauguggaagcagcugacucagcgggaaacugccuugacaguuuaguuuuuguugcaggagaucggcaauuugguccuuacuguggucauggauucccugggccucuaaauauugaaaccaagaguaaugcucuugauaucaucuuccaaacugaucuaacagggcaaaaaaagggcuggaaacuucgcuaucauggagauccaaugcccugcccuaaggaagacacucccaauucuguuugggagccugcgaaggcaaaauaugucuuuagagauguggugcagauaaccugucuggauggguuugaaguuguggagggacguguuggugcaacaucuuucuauucgacuugucaaagcaauggaaaguggaguaauuccaaacugaaaugucaaccuguggacuguggcauuccugaauccauugagaaugguaaaguugaagacccagagagcacuuuguuugguucugucauccgcuacacuugugaggagccauauuacuacauggaaaauggaggagguggggaguaucacugugcugguaacgggagcugggugaaugaggugcugggcccggagcugccgaaauguguuccagucuguggaguccccagagaacccuuugaagaaaaacagaggauaauuggaggauccgaugcagauauuaaaaacuuccccuggcaagucuucuuugacaacccaugggcugguggagcgcucauuaaugaguacugggugcugacggcugcucauguuguggagggaaacagggagccaacaauguauguuggguccaccucagugcagaccucacggcuggcaaaauccaagaugcucacuccugagcauguguuuauucauccgggauggaagcugcuggaagucccagaaggacgaaccaauuuugauaaugacauugcacuggugcggcugaaagacccagugaaaaugggacccaccgucucucccaucugccuaccaggcaccucuuccgacuacaaccucauggauggggaccugggacugaucucaggcuggggccgaacagagaagagagaucgugcuguucgccucaaggcggcaagguuaccuguagcuccuuuaagaaaaugcaaagaagugaaaguggagaaacccacagcagaugcagaggccuauguuuucacuccuaacaugaucugugcuggaggagagaagggcauggauagcuguaaaggggacagugguggggccuuugcuguacaggaucccaaugacaagaccaaauucuacgcagcuggccugguguccugggggccccagugugggaccuaugggcucuacacacggguaaagaacuauguugacuggauaaugaagacuaugcaggaaaauagcaccccccgugaggacuaa

SEQ ID NO: 8040 - RNA, 2067 nt, Artificial Sequence
  derived and/or modified sequence opt1 from complement_system_component_C1s__Homo_sapiens__AAA51852
auguggugcaucgugcuguucagccuccuggccugggucuacgccgagcccaccauguacggcgagauccuguccccgaacuacccccaggcguaccccagcgagguggagaaguccugggacaucgaggugcccgagggguacggcauccaccucuacuucacccaccuggacaucgagcugagcgagaacugcgccuacgacuccguccagaucaucagcggggacacggaggagggccgccucugcgggcagcgguccagcaacaacccgcacucccccaucguggaggaguuccaggugcccuacaacaagcugcaggucaucuucaagagcgacuucuccaacgaggagcgcuucaccggcuucgccgccuacuacguggccaccgacaucaacgagugcaccgacuucguggacguccccugcagccacuucugcaacaacuucaucggcggguacuucugcuccugcccgcccgaguacuuccugcacgacgacaugaagaacugcggcgugaacugcagcggggacguguucacggcgcucaucggcgagaucgccucccccaacuaccccaagccguaccccgagaacagccggugcgaguaccagauccgccuggagaagggguuccaggucguggugacccugcggcgcgaggacuucgacgucgaggccgccgacuccgcgggcaacugccucgacagccugguguucguggccggcgaccggcaguucgggcccuacugcggccacggguuccccggcccgcugaacaucgagaccaaguccaacgcccucgacaucaucuuccagaccgaccugacgggccagaagaagggguggaagcugcgcuaccacggcgaccccaugcccugccccaaggaggacaccccgaacagcgucugggagcccgccaaggccaaguacguguuccgggacgugguccagaucaccugccucgacggguucgaggugguggagggccgcgucggggcgaccagcuucuacuccacgugccagagcaacggcaagugguccaacagcaagcugaagugccagcccguggacugcggcauccccgaguccaucgagaacgggaaggucgaggacccggagagcacccuguucggcuccgugauccgguacaccugcgaggagcccuacuacuacauggagaacgggggcgggggcgaguaccacugcgccggcaacgggagcugggugaacgagguccucggccccgagcugcccaagugcgugccggugugcggggucccccgcgagcccuucgaggagaagcagcggaucaucggcggguccgacgccgacaucaagaacuucccguggcagguguucuucgacaaccccugggccggcggcgcccugaucaacgaguacugggugcucaccgcggcccacgucguggaggggaaccgcgagcccacgauguacgugggcagcaccuccguccagaccagccggcuggccaaguccaagaugcugacccccgagcacguguucauccacccgggguggaagcuccuggaggugcccgagggccgcacgaacuucgacaacgacaucgcccugguccggcucaaggaccccgugaagaugggccccaccgugagcccgaucugccugcccgggaccuccagcgacuacaaccugauggacggcgaccucgggcugaucuccggcugggggcgcaccgagaagcgggaccgcgccguccggcugaaggcggcccgccuccccguggccccccugcgcaagugcaaggaggugaaggucgagaagccgacggccgacgccgaggcguacguguucacccccaacaugaucugcgccggcggcgagaaggggauggacagcugcaagggcgacuccgggggcgccuucgccgugcaggaccccaacgacaagaccaaguucuacgcggccgggcuggucagcuggggcccccagugcggcaccuacgggcucuacacgcgggugaagaacuacguggacuggaucaugaagaccaugcaggagaacagcaccccgcgcgaggacuga

SEQ ID NO: 8041 - RNA, 2067 nt, Artificial Sequence
  derived and/or modified sequence opt2 from complement_system_component_C1s__Homo_sapiens__AAA51852
auguggugcaucguccucuucucccuccucgccugggucuacgccgagcccaccauguacggcgagauccucucccccaacuacccccaggccuaccccuccgaggucgagaaguccugggacaucgagguccccgagggcuacggcauccaccucuacuucacccaccucgacaucgagcucuccgagaacugcgccuacgacuccguccagaucaucuccggcgacaccgaggagggccgccucugcggccagcgcuccuccaacaacccccacucccccaucgucgaggaguuccagguccccuacaacaagcuccaggucaucuucaaguccgacuucuccaacgaggagcgcuucaccggcuucgccgccuacuacgucgccaccgacaucaacgagugcaccgacuucgucgacguccccugcucccacuucugcaacaacuucaucggcggcuacuucugcuccugcccccccgaguacuuccuccacgacgacaugaagaacugcggcgucaacugcuccggcgacgucuucaccgcccucaucggcgagaucgccucccccaacuaccccaagcccuaccccgagaacucccgcugcgaguaccagauccgccucgagaagggcuuccaggucgucgucacccuccgccgcgaggacuucgacgucgaggccgccgacuccgccggcaacugccucgacucccucgucuucgucgccggcgaccgccaguucggccccuacugcggccacggcuuccccggcccccucaacaucgagaccaaguccaacgcccucgacaucaucuuccagaccgaccucaccggccagaagaagggcuggaagcuccgcuaccacggcgaccccaugcccugccccaaggaggacacccccaacuccgucugggagcccgccaaggccaaguacgucuuccgcgacgucguccagaucaccugccucgacggcuucgaggucgucgagggccgcgucggcgccaccuccuucuacuccaccugccaguccaacggcaagugguccaacuccaagcucaagugccagcccgucgacugcggcauccccgaguccaucgagaacggcaaggucgaggaccccgaguccacccucuucggcuccgucauccgcuacaccugcgaggagcccuacuacuacauggagaacggcggcggcggcgaguaccacugcgccggcaacggcuccugggucaacgagguccucggccccgagcuccccaagugcguccccgucugcggcgucccccgcgagcccuucgaggagaagcagcgcaucaucggcggcuccgacgccgacaucaagaacuuccccuggcaggucuucuucgacaaccccugggccggcggcgcccucaucaacgaguacuggguccucaccgccgcccacgucgucgagggcaaccgcgagcccaccauguacgucggcuccaccuccguccagaccucccgccucgccaaguccaagaugcucacccccgagcacgucuucauccaccccggcuggaagcuccucgagguccccgagggccgcaccaacuucgacaacgacaucgcccucguccgccucaaggaccccgucaagaugggccccaccgucucccccaucugccuccccggcaccuccuccgacuacaaccucauggacggcgaccucggccucaucuccggcuggggccgcaccgagaagcgcgaccgcgccguccgccucaaggccgcccgccuccccgucgccccccuccgcaagugcaaggaggucaaggucgagaagcccaccgccgacgccgaggccuacgucuucacccccaacaugaucugcgccggcggcgagaagggcauggacuccugcaagggcgacuccggcggcgccuucgccguccaggaccccaacgacaagaccaaguucuacgccgccggccucgucuccuggggcccccagugcggcaccuacggccucuacacccgcgucaagaacuacgucgacuggaucaugaagaccaugcaggagaacuccaccccccgcgaggacuga

SEQ ID NO: 8042 - RNA, 2067 nt, Artificial Sequence
  derived and/or modified sequence opt3 from complement_system_component_C1s__Homo_sapiens__AAA51852
auguggugcaucgugcuguucagccuccuugccugggucuacgcugagcccaccauguauggcgaaauucuguccccuaacuacccacaggcauauccgucugagguugaaaagucaugggacauagaggugcccgaaggguacggaauccacuuguauuuuacacauuuagauauugagcugagugagaauugugccuacgacagcguacaaaucauuuccggugauacugaagagggcagacuaugcgggcagaggucuucgaacaauccucacucaccaaucguggaagaguuccagguccccuauaacaaacuccaggugauauuuaagagcgacuucaguaaugaggaacgguuuacgggauucgcggcuuacuacguugccaccgauaucaacgaguguacagacuuuguggaugucccuugcucccauuucuguaauaacuuuauuggcgguuauuucugcucuuguccacccgaauacuuucugcacgacgauaugaaaaauugcggggugaacuguagcggagacguauucacugcacuuaucggcgagauugccuccccuaauuauccaaagccguaccccgaaaacucacgcugcgaguaucaaauccgacuggagaaaggcuuucagguuguggucaccuugcguagagaagauuucgacguggaggcugcagauagugccgggaauugucucgacagccugguguucgucgcuggagacaggcaguuugguccuuacugcggccauggguucccaggaccccugaacauagaaacaaagucuaaugcccucgauauuaucuuucagaccgacuuaacuggccaaaagaaagguuggaagcugcgguaucacggggauccuaugccaugccccaaagaggacacaccgaacuccguuugggaaccugcgaaggcaaaauacguguuccgcgauguagugcagauuaccugucuugacggauuugaggucguggagggcagaguuggcgccacgucauucuacagcacuugccagaguaacgggaaguggucuaauuccaaguugaaaugucagcccguggauugcggaaucccagaaagcaucgagaacgguaaggucgaagacccugagucgacccuguuuggcucugugauuagguauacaugugaggaacccuacuauuacauggagaaugggggaggcggugaauaucacugcgcugggaacggcuccuggguaaaugagguucuaggaccagaacuccccaaaugugugccugucugcggcgugccacgggagccguucgaggaaaagcaacgcauaaucgggggaucagaugccgacauuaaaaacuuucccuggcaggucuucuuugauaauccuugggcugguggcgcacugaucaacgaguacugggugcuuacugccgcgcauguuguggaagggaaucgagagccaaccauguauguaggaaguacaagcguccagaccuccagacuggccaagucuaaaauguugacgcccgaacacguguucauacauccuggcuggaagcuccuggagguuccagaggguaggacuaacuuugacaaugacauugcauuagugcggcugaaggaucccgucaaaauggggccgacagugagcccuaucugucucccaggcaccucaagugacuacaaccuuauggauggagaccugggcuugaucuccggguggggacguacugaaaagcgcgauagagcuguaaggcuaaaagccgcucggcugcccguggccccucuccgaaagugcaaagagguuaaggucgaaaagcccacagcagacgccgaggcuuacguguucaccccaaauaugauuugugcggguggcgaaaaagggauggauagcugcaagggagacucuggcggugcauucgccgugcaagauccuaacgacaaaacgaaguuuuaugcugccgggcuggucucauggggcccccagugcggaaccuacggccuuuauacacgcguuaaaaauuacguggauuggaucaugaagacuaugcaggagaacaguaccccaagagaggacuga

SEQ ID NO: 8043 - RNA, 2067 nt, Artificial Sequence
  derived and/or modified sequence opt4 from complement_system_component_C1s__Homo_sapiens__AAA51852
auguggugcaucgugcuguucagccugcuggccuggguguacgccgagcccaccauguacggcgagauccugagccccaacuacccccaggccuaccccagcgagguggagaagagcugggacaucgaggugcccgagggcuacggcauccaccuguacuucacccaccuggacaucgagcugagcgagaacugcgccuacgacagcgugcagaucaucagcggcgacaccgaggagggcagacugugcggccagagaagcagcaacaacccccacagccccaucguggaggaguuccaggugcccuacaacaagcugcaggugaucuucaagagcgacuucagcaacgaggagagauucaccggcuucgccgccuacuacguggccaccgacaucaacgagugcaccgacuucguggacgugcccugcagccacuucugcaacaacuucaucggcggcuacuucugcagcugcccccccgaguacuuccugcacgacgacaugaagaacugcggcgugaacugcagcggcgacguguucaccgcccugaucggcgagaucgccagccccaacuaccccaagcccuaccccgagaacagcagaugcgaguaccagaucagacuggagaagggcuuccaggugguggugacccugagaagagaggacuucgacguggaggccgccgacagcgccggcaacugccuggacagccugguguucguggccggcgacagacaguucggccccuacugcggccacggcuuccccggcccccugaacaucgagaccaagagcaacgcccuggacaucaucuuccagaccgaccugaccggccagaagaagggcuggaagcugagauaccacggcgaccccaugcccugccccaaggaggacacccccaacagcgugugggagcccgccaaggccaaguacguguucagagacguggugcagaucaccugccuggacggcuucgaggugguggagggcagagugggcgccaccagcuucuacagcaccugccagagcaacggcaaguggagcaacagcaagcugaagugccagcccguggacugcggcauccccgagagcaucgagaacggcaagguggaggaccccgagagcacccuguucggcagcgugaucagauacaccugcgaggagcccuacuacuacauggagaacggcggcggcggcgaguaccacugcgccggcaacggcagcugggugaacgaggugcugggccccgagcugcccaagugcgugcccgugugcggcgugcccagagagcccuucgaggagaagcagagaaucaucggcggcagcgacgccgacaucaagaacuuccccuggcagguguucuucgacaaccccugggccggcggcgcccugaucaacgaguacugggugcugaccgccgcccacgugguggagggcaacagagagcccaccauguacgugggcagcaccagcgugcagaccagcagacuggccaagagcaagaugcugacccccgagcacguguucauccaccccggcuggaagcugcuggaggugcccgagggcagaaccaacuucgacaacgacaucgcccuggugagacugaaggaccccgugaagaugggccccaccgugagccccaucugccugcccggcaccagcagcgacuacaaccugauggacggcgaccugggccugaucagcggcuggggcagaaccgagaagagagacagagccgugagacugaaggccgccagacugcccguggccccccugagaaagugcaaggaggugaagguggagaagcccaccgccgacgccgaggccuacguguucacccccaacaugaucugcgccggcggcgagaagggcauggacagcugcaagggcgacagcggcggcgccuucgccgugcaggaccccaacgacaagaccaaguucuacgccgccggccuggugagcuggggcccccagugcggcaccuacggccuguacaccagagugaagaacuacguggacuggaucaugaagaccaugcaggagaacagcacccccagagaggacuga

SEQ ID NO: 8044 - RNA, 2067 nt, Artificial Sequence
  derived and/or modified sequence opt5 from complement_system_component_C1s__Homo_sapiens__AAA51852
auguggugcaucgugcuguucagccuccuggccugggucuacgcugagcccaccauguauggcgaaauucuuuccccuaacuacccgcaggccuaucccucugagguugaaaagagcugggacaucgaggugccugaaggguacggcauucaccuguauuuuacacaucucgauaucgagcuguccgagaauugugcguacgacucugugcaaauuaucagcggagauacggaagaggggagacuuugcggacagcgguccucuaacaauccccacagcccuaucgucgaagaguuccaggugcccuauaacaaacugcagguuauuuuuaaguccgacuucagcaaugaggaacgcuuuaccggcuucgcugccuacuacguggccacagauaucaacgaguguaccgacuuugucgaugugccuugcucucauuucuguaauaacuuuauugggggauauuucugcuccuguccgcccgaauacuuucuccacgacgauaugaaaaauugcggcguuaacuguagcggcgacguguucacagcucugaucggggagauugccucuccuaauuaucccaagccuuaccccgaaaacuccagaugcgaguaucaaauccggcuggagaaaggauuucaggucguggugacccuccgcagagaagauuucgacgucgaggcugccgauagcgcgggcaauugucuggacucucuuguuuucguggccggggaccggcaguuuggaccguacugcggccauggguucccuggaccccugaacauugaaacaaaguccaaugcucucgauaucaucuuucagaccgaccugacgggccaaaagaaaggcuggaaacuucgcuaucacggggauccuaugcccugccccaaggaggacaccccuaacagcgugugggaaccggccaaggcuaaauacgucuucagagaugugguucagauuacaugucuggacggauuugagguggucgagggccgggugggggccaccuccuucuacucuacaugccagagcaacggaaagugguccaauagcaagcucaaaugucagcccguugauugcggcaucccugaaucuauugagaacgggaagguggaagaccccgaguccacccuguuuggaagcgucauccgcuauacgugugaggaaccuuacuauuacauggagaauggcggcgggggagaauaucacugcgcgggcaacgggucuugggugaaugagguccugggacccgaacucccgaaaugugugccuguuugcggcgugcccagagagccuuucgaggaaaagcaacggauuaucgggggcagcgaugccgacaucaaaaacuuucccuggcaggucuucuuugauaauccuugggcuggaggcgcccugauuaacgaguacugggugcuuacagcugcccauguuguggaagggaaucgcgagcccaccauguaugucggauccacaucugugcagaccagcagacuggccaaguccaaaaugcucaccccggaacacguguucauccauccuggcuggaagcugcuugagguucccgaggggcggacaaacuuugacaaugacauugcucugguccgccucaaggaucccgugaaaaugggaccuacggugagcccgaucugucugcccggcaccucuuccgacuacaaccugauggauggggaccucggccugauuagcggauggggcagaacagaaaagcgggauagagcgguccgccuuaaagccgcucggcugccuguggcgccccucagaaagugcaaagagguuaagguggaaaagccuaccgccgacgcugaggccuacgucuucacacccaauaugaucugugccgggggagaaaaaggcauggauucuugcaagggggacuccggaggcgcuuucgccgugcaagauccuaacgacaaaaccaaguuuuaugccgcugggcugguuagcuggggcccccagugcggaacguacggccuuuauacacgcgugaaaaauuacgucgauuggaucaugaagaccaugcaggagaacuccaccccgcgggaggacuga

SEQ ID NO: 8045 - protein, 597 aa, Artificial Sequence
  complement_system_component_C4bp__Homo_sapiens__P04003
MHPPKTPSGALHRKRKMAAWPFSRLWKVSDPILFQMTLIAALLPAVLGNCGPPPTLSFAAPMDITLTETRFKTGTTLKYTCLPGYVRSHSTQTLTCNSDGEWVYNTFCIYKRCRHPGELRNGQVEIKTDLSFGSQIEFSCSEGFFLIGSTTSRCEVQDRGVGWSHPLPQCEIVKCKPPPDIRNGRHSGEENFYAYGFSVTYSCDPRFSLLGHASISCTVENETIGVWRPSPPTCEKITCRKPDVSHGEMVSGFGPIYNYKDTIVFKCQKGFVLRGSSVIHCDADSKWNPSPPACEPNSCINLPDIPHASWETYPRPTKEDVYVVGTVLRYRCHPGYKPTTDEPTTVICQKNLRWTPYQGCEALCCPEPKLNNGEITQHRKSRPANHCVYFYGDEISFSCHETSRFSAICQGDGTWSPRTPSCGDICNFPPKIAHGHYKQSSSYSFFKEEIIYECDKGYILVGQAKLSCSYSHWSAPAPQCKALCRKPELVNGRLSVDKDQYVEPENVTIQCDSGYGVVGPQSITCSGNRTWYPEVPKCEWETPEGCEQVLTGKRLMQCLPNPEDVKMALEVYKLSLEIEQLELQRDSARQSTLDKEL

SEQ ID NO: 8046 - RNA, 1794 nt, Artificial Sequence
  complement_system_component_C4bp__Homo_sapiens__AAA36506
augcaccccccaaaaacuccaucuggggcucuucauagaaaaaggaaaauggcagccuggcccuucuccaggcuguggaaagucucugauccaauucucuuccaaaugaccuugaucgcugcucuguugccugcuguucuuggcaauugugguccuccacccacuuuaucauuugcugccccgauggauauuacguugacugagacacgcuucaaaacuggaacuacucugaaauacaccugccucccuggcuacgucagaucccauucaacucagacgcuuaccuguaauucugauggcgaauggguguauaacaccuucuguaucuacaaacgaugcagacacccaggagaguuacguaaugggcaaguagagauuaagacagauuuaucuuuuggaucacaaauagaauucagcuguucagaaggauuuuucuuaauuggcucaaccacuagucguugugaaguccaagauagaggaguuggcuggagucauccucucccacaaugugaaauugucaaguguaagccuccuccagacaucaggaauggaaggcacagcggugaagaaaauuucuacgcauacggcuuuucugucaccuacagcugugacccccgcuucucacucuugggccaugccuccauuucuugcacuguggagaaugaaacaauaggcguuuggagaccaagcccuccuaccugugaaaaaaucaccugucgcaagccagauguuucacauggggaaauggucucuggauuuggacccaucuauaauuacaaagacacuauuguguuuaagugccaaaaagguuuuguucucagaggcagcaguguaauucauugugaugcugauagcaaauggaauccuucuccuccugcuugugagcccaauaguuguauuaauuuaccagacauuccacaugcuuccugggaaacauauccuaggccgacaaaagaggauguguauguuguugggacuguguuaagguaccgcugucauccuggcuacaaacccacuacagaugagccuacgacugugauuugucagaaaaauuugagauggaccccauaccaaggaugugaggcguuauguugcccugaaccaaagcuaaauaauggugaaaucacucaacacaggaaaagucguccugccaaucacuguguuuauuucuauggagaugagauuucauuuucaugucaugagaccaguagguuuucagcuauaugccaaggagauggcacguggaguccccgaacaccaucauguggagacauuugcaauuuuccuccuaaaauugcccaugggcauuauaaacaaucuaguucauacagcuuuuucaaagaagagauuauauaugaaugugauaaaggcuacauucuggucggacaggcgaaacucuccugcaguuauucacacuggucagcuccagccccucaauguaaagcucugugucggaaaccagaauuagugaauggaagguugucuguggauaaggaucaguauguugagccugaaaaugucaccauccaaugugauucuggcuauggugugguugguccccaaaguaucacuugcucugggaacagaaccugguacccagaggugcccaagugugagugggagacccccgaaggcugugaacaagugcucacaggcaaaagacucaugcagugucucccaaacccagaggaugugaaaauggcccuggagguauauaagcugucucuggaaauugaacaacuggaacuacagagagacagcgcaagacaauccacuuuggauaaagaacuauaa

SEQ ID NO: 8047 - RNA, 1794 nt, Artificial Sequence
  derived and/or modified sequence opt1 from complement_system_component_C4bp__Homo_sapiens__AAA36506
augcacccgcccaagacccccagcggcgcccugcaccgcaagcggaagauggccgcguggcccuucucccgccucuggaaggugagcgaccccauccuguuccagaugacccugaucgccgcccuccugccggccguccuggggaacugcggcccgccgcccacgcucuccuucgccgcgcccauggacaucacccugaccgagacccgguucaagacggggaccacccugaaguacacgugccuccccggcuacgugcgcagccacuccacgcagacccugaccugcaacagcgacggggaguggguguacaacaccuucugcaucuacaagcggugccgccaccccggcgagcugcggaacggccaggucgagaucaagacggaccucuccuucgggagccagaucgaguucuccugcagcgagggcuucuuccugaucggguccaccaccagccgcugcgaggugcaggaccggggcgugggguggucccacccccugccccagugcgagaucgucaagugcaagcccccgcccgacauccgcaacggccggcacagcggcgaggagaacuucuacgccuacggguucuccgugaccuacagcugcgacccccgcuucucccuccugggccacgccagcaucuccugcaccguggagaacgagaccaucggggucuggcggcccagcccgcccacgugcgagaagaucacgugccgcaagcccgacgugagccacggcgagaugguguccggcuucgggcccaucuacaacuacaaggacaccaucgucuucaagugccagaagggcuucgugcugcgggggagcuccgugauccacugcgacgccgacagcaaguggaaccccagcccgcccgcgugcgagcccaacuccugcaucaaccuccccgacaucccccacgccuccugggagaccuacccgcgccccaccaaggaggacgucuacguggugggcaccguccugcgguaccgcugccaccccggguacaagccgaccaccgacgagcccaccaccgugaucugccagaagaaccugcgguggacgcccuaccagggcugcgaggcccucugcugccccgagccgaagcugaacaacggcgagaucacccagcaccgcaagagccggcccgccaaccacugcguguacuucuacggggacgagaucuccuucagcugccacgagaccucccgcuucagcgccaucugccagggcgacgggaccuggagcccccgcacgcccuccugcggcgacaucugcaacuucccgcccaagaucgcgcacgggcacuacaagcaguccagcuccuacagcuucuucaaggaggagaucaucuacgagugcgacaagggcuacauccuggucggccaggccaagcucuccugcagcuacagccacugguccgcccccgcgccccagugcaaggcccugugccggaagccggagcuggugaacgggcgccucagcguggacaaggaccaguacgucgagcccgagaacgugaccauccagugcgacuccggcuacggggucgugggcccccagagcaucacgugcuccgggaaccggaccugguaccccgaggugccgaagugcgagugggagacccccgagggcugcgagcagguccugaccggcaagcgccugaugcagugccuccccaaccccgaggacgugaagauggcccuggagguguacaagcugagccucgagaucgagcagcuggagcugcagcgggacuccgcccgccagagcacccucgacaaggagcuguga

SEQ ID NO: 8048 - RNA, 1794 nt, Artificial Sequence
  derived and/or modified sequence opt2 from complement_system_component_C4bp__Homo_sapiens__AAA36506
augcacccccccaagacccccuccggcgcccuccaccgcaagcgcaagauggccgccuggcccuucucccgccucuggaaggucuccgaccccauccucuuccagaugacccucaucgccgcccuccuccccgccguccucggcaacugcggccccccccccacccucuccuucgccgcccccauggacaucacccucaccgagacccgcuucaagaccggcaccacccucaaguacaccugccuccccggcuacguccgcucccacuccacccagacccucaccugcaacuccgacggcgagugggucuacaacaccuucugcaucuacaagcgcugccgccaccccggcgagcuccgcaacggccaggucgagaucaagaccgaccucuccuucggcucccagaucgaguucuccugcuccgagggcuucuuccucaucggcuccaccaccucccgcugcgagguccaggaccgcggcgucggcuggucccacccccucccccagugcgagaucgucaagugcaagcccccccccgacauccgcaacggccgccacuccggcgaggagaacuucuacgccuacggcuucuccgucaccuacuccugcgacccccgcuucucccuccucggccacgccuccaucuccugcaccgucgagaacgagaccaucggcgucuggcgccccuccccccccaccugcgagaagaucaccugccgcaagcccgacgucucccacggcgagauggucuccggcuucggccccaucuacaacuacaaggacaccaucgucuucaagugccagaagggcuucguccuccgcggcuccuccgucauccacugcgacgccgacuccaaguggaaccccuccccccccgccugcgagcccaacuccugcaucaaccuccccgacaucccccacgccuccugggagaccuacccccgccccaccaaggaggacgucuacgucgucggcaccguccuccgcuaccgcugccaccccggcuacaagcccaccaccgacgagcccaccaccgucaucugccagaagaaccuccgcuggacccccuaccagggcugcgaggcccucugcugccccgagcccaagcucaacaacggcgagaucacccagcaccgcaagucccgccccgccaaccacugcgucuacuucuacggcgacgagaucuccuucuccugccacgagaccucccgcuucuccgccaucugccagggcgacggcaccugguccccccgcacccccuccugcggcgacaucugcaacuucccccccaagaucgcccacggccacuacaagcaguccuccuccuacuccuucuucaaggaggagaucaucuacgagugcgacaagggcuacauccucgucggccaggccaagcucuccugcuccuacucccacugguccgcccccgccccccagugcaaggcccucugccgcaagcccgagcucgucaacggccgccucuccgucgacaaggaccaguacgucgagcccgagaacgucaccauccagugcgacuccggcuacggcgucgucggcccccaguccaucaccugcuccggcaaccgcaccugguaccccgagguccccaagugcgagugggagacccccgagggcugcgagcagguccucaccggcaagcgccucaugcagugccuccccaaccccgaggacgucaagauggcccucgaggucuacaagcucucccucgagaucgagcagcucgagcuccagcgcgacuccgcccgccaguccacccucgacaaggagcucuga

SEQ ID NO: 8049 - RNA, 1794 nt, Artificial Sequence
  derived and/or modified sequence opt3 from complement_system_component_C4bp__Homo_sapiens__AAA36506
augcacccuccuaagaccccaagcggcgcccugcauagaaaaaggaagauggcugcauggccguucucccggcucuggaaagugucugaccccauccuuuuucagaugacacugauugccgcguuguuaccugcuguccuggggaacugcggaccacccccuacucuaucauucgccgcaccaauggauauaacgcucaccgagacacgcuuuaagacugguaccacacugaaauacaccugucuucccggcuauguucgaagucacagcacucaaacacugaccugcaauuccgacggggaauggguguacaacacguucuguaucuauaagcguugcagacauccuggagaguugaggaauggccagguagaaauuaagacugaucucucuuuugguucgcagaucgaguucucauguagcgaaggguuuuuccugauuggaaguaccacaucccggugcgaggugcaggaccgcggcgucggcuggucucacccacugccgcaaugugagaucgugaaaugcaagcccccuccagauauaagaaacgggaggcauagcggagaagagaauuuuuacgccuaugguuucuccguuacuuacucaugugacccccgguuuagucucuuaggccacgcuagcaucucuugcaccguggaaaacgagacaauuggggucuggcgcccuuccccacccaccugugagaaaaucacgugccgaaagccggaugugucacacggagaaaugguaagcggcuucgguccuauuuauaauuacaaagacacuaucguuuuuaagugccagaagggguucgugcugagaggaaguucugucauacauugugaugcagacuccaaauggaaccccagcccacccgccugcgagcccaauucguguauuaaccuuccagauaucccccacgcuucuugggaaacauacccuaggccaaccaaggaggacguguauguggucggcacuguuuugcgguaccguugccauccgggcuauaaacccacaaccgaugaaccuacgaccgugauuugucagaagaaucugcgcuggacaccauaccaggggugcgaggcccuauguugccccgagccuaaacucaacaauggagaaaucacucaacacagaaaguccaggccagcgaaccacuguguauauuucuacggugacgagaucucauuuaguugccaugaaaccagccgguucuccgcaauuugucagggcgacgggacauggucuccccgaacuccgagcugcggagauauaugcaauuuuccuccaaaaaucgcccacggccauuauaagcagucaaguuccuacagcuucuuuaaggaggaaauuaucuacgagugugacaaagguuauauacugguggggcaggcuaaacuuucuugcucauacagucacuggagcgcccccgcaccucaauguaaggcucugugccgcaagcccgaguuggucaacggcagacucuccguggauaaagaccaguauguugaaccagagaacgugaccauucagugugauucuggauacggcgucguggggccucaaucgaucacaugcagcggaaauaggaccugguaucccgaaguaccaaagugugagugggaaacuccggaggguugcgagcagguucugacgggcaagcgguuaaugcagugucugccuaaccccgaagacgugaaaauggcccucgaggucuacaaacuuucccuggaaaucgagcaguuggagcuacaacgcgauucagcgagacagaguacacuggacaaggaacucuga

SEQ ID NO: 8050 - RNA, 1794 nt, Artificial Sequence
  derived and/or modified sequence opt4 from complement_system_component_C4bp__Homo_sapiens__AAA36506
augcacccccccaagacccccagcggcgcccugcacagaaagagaaagauggccgccuggcccuucagcagacuguggaaggugagcgaccccauccuguuccagaugacccugaucgccgcccugcugcccgccgugcugggcaacugcggccccccccccacccugagcuucgccgcccccauggacaucacccugaccgagaccagauucaagaccggcaccacccugaaguacaccugccugcccggcuacgugagaagccacagcacccagacccugaccugcaacagcgacggcgaguggguguacaacaccuucugcaucuacaagagaugcagacaccccggcgagcugagaaacggccagguggagaucaagaccgaccugagcuucggcagccagaucgaguucagcugcagcgagggcuucuuccugaucggcagcaccaccagcagaugcgaggugcaggacagaggcgugggcuggagccacccccugccccagugcgagaucgugaagugcaagcccccccccgacaucagaaacggcagacacagcggcgaggagaacuucuacgccuacggcuucagcgugaccuacagcugcgaccccagauucagccugcugggccacgccagcaucagcugcaccguggagaacgagaccaucggcguguggagacccagcccccccaccugcgagaagaucaccugcagaaagcccgacgugagccacggcgagauggugagcggcuucggccccaucuacaacuacaaggacaccaucguguucaagugccagaagggcuucgugcugagaggcagcagcgugauccacugcgacgccgacagcaaguggaaccccagcccccccgccugcgagcccaacagcugcaucaaccugcccgacaucccccacgccagcugggagaccuaccccagacccaccaaggaggacguguacguggugggcaccgugcugagauacagaugccaccccggcuacaagcccaccaccgacgagcccaccaccgugaucugccagaagaaccugagauggacccccuaccagggcugcgaggcccugugcugccccgagcccaagcugaacaacggcgagaucacccagcacagaaagagcagacccgccaaccacugcguguacuucuacggcgacgagaucagcuucagcugccacgagaccagcagauucagcgccaucugccagggcgacggcaccuggagccccagaacccccagcugcggcgacaucugcaacuucccccccaagaucgcccacggccacuacaagcagagcagcagcuacagcuucuucaaggaggagaucaucuacgagugcgacaagggcuacauccuggugggccaggccaagcugagcugcagcuacagccacuggagcgcccccgccccccagugcaaggcccugugcagaaagcccgagcuggugaacggcagacugagcguggacaaggaccaguacguggagcccgagaacgugaccauccagugcgacagcggcuacggcguggugggcccccagagcaucaccugcagcggcaacagaaccugguaccccgaggugcccaagugcgagugggagacccccgagggcugcgagcaggugcugaccggcaagagacugaugcagugccugcccaaccccgaggacgugaagauggcccuggagguguacaagcugagccuggagaucgagcagcuggagcugcagagagacagcgccagacagagcacccuggacaaggagcuguga

SEQ ID NO: 8051 - RNA, 1794 nt, Artificial Sequence
  derived and/or modified sequence opt5 from complement_system_component_C4bp__Homo_sapiens__AAA36506
augcaucccccuaagaccccgagcggcgcccugcacagaaaacggaagauggcugccuggcccuucucccgccucuggaaagugucugacccuauccuguuucagaugacacuuauugcggcucugcuccccgccguccuggggaacugcggaccucccccuacgcuuagcuucgccgcuccgauggauaucacccugacagagaccagauuuaagacaggcaccacacucaaauacaccugucugcccggguauguucggucccacucuacgcaaacccugacaugcaauagcgacggagaauggguguacaacaccuucuguauuuauaagcgcugcagacauccuggcgagcuccggaauggacagguggaaaucaagacagaucuguccuuugggucucagauugaguucagcuguuccgaaggcuuuuuccuuaucggcagcaccacgucucgcugcgagguccaggacagaggggugggauggucccacccccugccucaaugugagaucguuaaaugcaagcccccgccugauauucggaacggccgccauagcggggaagagaauuuuuacgccuauggauucucugugacauacuccugugaccccagauuuagccuccugggccacgcuucuaucuccugcaccgucgaaaacgagacaauugggguguggcggccuagcccucccaccugugagaaaauuaccugccgcaagcccgauguuucccacggagaaauggugucuggcuucggcccgaucuauaauuacaaagacacaaucgucuuuaagugccagaagggguucgugcuuagaggaagcuccgugauucauugugaugccgacagcaaauggaaccccucuccucccgcgugcgagccuaauuccuguaucaaccugcccgauaucccgcacgccagcugggaaacguacccucggcccaccaaggaggacgucuauguugugggcacagugcuccgcuacagaugccauccuggguauaaacccaccacagaugaaccuaccacggucauuugucagaagaaucugcgguggacacccuaccagggaugcgaggcucuguguugcccggagccuaaacucaacaauggcgaaaucacccaacacagaaagucucgccccgccaaccacuguguguauuucuacggggacgagauuagcuuuuccugccaugaaaccucucgguucagcgcuaucugucagggagacggcacauggucccccagaaccccuagcugcggcgauauuugcaauuuuccgcccaaaaucgcccacgggcauuauaagcagucuuccagcuacucuuucuuuaaggaggaaaucauuuacgagugugacaaaggauauauccugguuggccaggcgaaacuuuccugcagcuacucccacuggucugccccugcuccccaauguaaggcccugugccgcaagccugagcucgugaacgggcggcugagcgucgauaaagaccaguauguggaacccgagaacguuacaauucagugugauuccggauacggcguggucgggccucaaucuaucacgugcagcggcaauagaaccugguaucccgaagugccgaagugugagugggaaacaccugagggaugcgagcagguccuuaccggcaagcgccugaugcagugucuccccaacccugaagacgugaaaauggcucuggagguuuacaagcugucccucgaaauugagcagcuggagcuucaacgggauagcgccagacagucuacacuggacaaagaacucuga

SEQ ID NO: 8052 - protein, 934 aa, Artificial Sequence
  complement_system_component_C6__Homo_sapiens__P13671
MARRSVLYFILLNALINKGQACFCDHYAWTQWTSCSKTCNSGTQSRHRQIVVDKYYQENFCEQICSKQETRECNWQRCPINCLLGDFGPWSDCDPCIEKQSKVRSVLRPSQFGGQPCTAPLVAFQPCIPSKLCKIEEADCKNKFRCDSGRCIARKLECNGENDCGDNSDERDCGRTKAVCTRKYNPIPSVQLMGNGFHFLAGEPRGEVLDNSFTGGICKTVKSSRTSNPYRVPANLENVGFEVQTAEDDLKTDFYKDLTSLGHNENQQGSFSSQGGSSFSVPIFYSSKRSENINHNSAFKQAIQASHKKDSSFIRIHKVMKVLNFTTKAKDLHLSDVFLKALNHLPLEYNSALYSRIFDDFGTHYFTSGSLGGVYDLLYQFSSEELKNSGLTEEEAKHCVRIETKKRVLFAKKTKVEHRCTTNKLSEKHEGSFIQGAEKSISLIRGGRSEYGAALAWEKGSSGLEEKTFSEWLESVKENPAVIDFELAPIVDLVRNIPCAVTKRNNLRKALQEYAAKFDPCQCAPCPNNGRPTLSGTECLCVCQSGTYGENCEKQSPDYKSNAVDGQWGCWSSWSTCDATYKRSRTRECNNPAPQRGGKRCEGEKRQEEDCTFSIMENNGQPCINDDEEMKEVDLPEIEADSGCPQPVPPENGFIRNEKQLYLVGEDVEISCLTGFETVGYQYFRCLPDGTWRQGDVECQRTECIKPVVQEVLTITPFQRLYRIGESIELTCPKGFVVAGPSRYTCQGNSWTPPISNSLTCEKDTLTKLKGHCQLGQKQSGSECICMSPEEDCSHHSEDLCVFDTDSNDYFTSPACKFLAEKCLNNQQLHFLHIGSCQDGRQLEWGLERTRLSSNSTKKESCGYDTCYDWEKCSASTSKCVCLLPPQCFKGGNQLYCVKMGSSTSEKTLNICEVGTIRCANRKMEILHPGKCLA

SEQ ID NO: 8053 - RNA, 2805 nt, Artificial Sequence
  complement_system_component_C6__Homo_sapiens__AAA51860
auggccagacgcucugucuuguacuucauccugcugaaugcucugaucaacaagggccaagccugcuucugugaucacuaugcauggacucaguggaccagcugcucaaaaacuugcaauucuggaacccagagcagacacagacaaauaguaguagauaaguacuaccaggaaaacuuuugugaacagauuugcagcaagcaggagacuagagaauguaacuggcaaagaugccccaucaacugccuccugggagauuuuggaccauggucagacugugacccuuguauugaaaaacagucuaaaguuagaucugucuugcgucccagucaguuugggggacagccaugcacugcgccucugguagccuuucaaccaugcauuccaucuaagcucugcaaaauugaagaggcugacugcaagaauaaauuucgcugugacaguggccgcugcauugccagaaaguuagaaugcaauggagaaaaugacuguggagacaauucagaugaaagggacugugggaggacaaaggcaguaugcacacggaaguauaaucccaucccuaguguacaguugaugggcaauggguuucauuuucuggcaggagagcccagaggagaaguccuugauaacucuuucacuggaggaauauguaaaacugucaaaagcaguaggacaaguaauccauaccguguuccggccaaucuggaaaaugucggcuuugagguacaaacugcagaagaugacuugaaaacagauuucuacaaggauuuaacuucucuuggacacaaugaaaaucaacaaggcucauucucaagucagggggggagcucuuucaguguaccaauuuuuuauuccucaaagagaagugaaaauaucaaccauaauucugccuucaaacaagccauucaagccucucacaaaaaggauucuaguuuuauuaggauccauaaagugaugaaagucuuaaacuucacaacgaaagcuaaagaucugcaccuuucugaugucuuuuugaaagcacuuaaccaucugccucuagaauacaacucugcuuuguacagccgaauauucgaugacuuugggacucauuacuucaccucuggcucccugggaggcguguaugaccuucucuaucaguuuagcagugaggaacuaaagaacucagguuuaaccgaggaagaagccaaacacugugucaggauugaaacaaagaaacgcguuuuauuugcuaagaaaacaaaaguggaacauaggugcaccaccaacaagcugucagagaaacaugaagguucauuuauacagggagcagagaaauccauaucccugauucgagguggaaggagugaauauggagcagcuuuggcaugggagaaagggagcucuggucuggaggagaagacauuuucugagugguuagaaucagugaaggaaaauccugcugugauugacuuugagcuugcccccaucguggacuugguaagaaacauccccugugcagugacaaaacggaacaaccucaggaaagcuuugcaagaguaugcagccaaguucgauccuugccagugugcuccaugcccuaauaauggccgacccacccucucagggacugaaugucugugugugugucagaguggcaccuauggugagaacugugagaaacagucuccagauuauaaauccaaugcaguagacggacagugggguuguuggucuuccuggaguaccugugaugcuacuuauaagagaucgagaacccgagaaugcaauaauccugccccccaacgaggagggaaacgcugugagggggagaagcgacaagaggaagacugcacauuuucaaucauggaaaacaauggacaaccauguaucaaugaugaugaagaaaugaaagaggucgaucuuccugagauagaagcagauuccggguguccucagccaguuccuccagaaaauggauuuauccggaaugaaaagcaacuauacuugguuggagaagauguugaaauuucaugccuuacuggcuuugaaacuguuggauaccaguacuucagaugcuuaccagacgggaccuggagacaaggggauguggaaugccaacggacggagugcaucaagccaguugugcaggaaguccugacaauuacaccauuucagagauuguauagaauuggugaauccauugagcuaacuugccccaaaggcuuuguuguugcugggccaucaagguacacaugccaggggaauuccuggacaccacccauuucaaacucucucaccugugaaaaagauacucuaacaaaauuaaaaggccauugucagcugggacagaaacaaucaggaucugaaugcauuuguaugucuccagaagaagacuguagccaucauucagaagaucucuguguguuugacacagacuccaacgauuacuuuacuucacccgcuuguaaguuuuuggcugagaaauguuuaaauaaucagcaacuccauuuucuacauauugguuccugccaagacggccgccaguuagaauggggucuugaaaggacaagacuuucauccaacagcacaaagaaagaauccuguggcuaugacaccugcuaugacugggaaaaauguucagccuccacuuccaaaugugucugccuauugcccccacagugcuucaaggguggaaaccaacucuacugugucaaaaugggaucaucaacaagugagaaaacauugaacaucugugaagugggaacuauaagaugugcaaacaggaagauggaaauacugcauccuggaaaguguuuggccuag

SEQ ID NO: 8054 - RNA, 2805 nt, Artificial Sequence
  derived and/or modified sequence opt1 from complement_system_component_C6__Homo_sapiens__AAA51860
auggcccgccggagcgugcuguacuucauccuccugaacgcccugaucaacaagggccaggcgugcuucugcgaccacuacgccuggacccaguggaccuccugcagcaagacgugcaacuccgggacccagagccgccaccggcagaucgucguggacaaguacuaccaggagaacuucugcgagcagaucugcuccaagcaggagacccgcgagugcaacuggcagcggugccccaucaacugccuccugggcgacuucgggccguggagcgacugcgaccccugcaucgagaagcaguccaaggugcgcagcguccugcggcccucccaguucggcgggcagcccugcaccgccccgcucguggccuuccagcccugcauccccagcaagcugugcaagaucgaggaggccgacugcaagaacaaguuccgcugcgacuccggccggugcaucgcgcgcaagcuggagugcaacggcgagaacgacugcggggacaacagcgacgagcgggacugcggccgcacgaaggccgugugcacccggaaguacaaccccaucccguccguccagcucauggggaacggcuuccacuuccuggccggggagccccgcggcgaggugcuggacaacagcuucaccggcgggaucugcaagaccgugaaguccagccggacguccaaccccuaccgcguccccgccaaccucgagaacgugggcuucgaggugcagaccgcggaggacgaccugaagaccgacuucuacaaggaccugaccagccucgggcacaacgagaaccagcagggcuccuucagcagccagggcggguccagcuucuccgucccgaucuucuacagcuccaagcggagcgagaacaucaaccacaacuccgccuucaagcaggccauccaggccagccacaagaaggacuccagcuucauccgcauccacaaggugaugaaggugcugaacuucacgaccaaggccaaggaccugcaccucuccgacgucuuccugaaggcgcugaaccaccucccccuggaguacaacagcgcccuguacucccggaucuucgacgacuucggcacccacuacuucaccagcgggucccucggcgggguguacgaccugcuguaccaguucagcuccgaggagcucaagaacagcggccugacggaggaggaggccaagcacugcgugcgcaucgagaccaagaagcggguccuguucgccaagaagaccaagguggagcaccgcugcaccacgaacaagcucuccgagaagcacgagggcagcuucauccagggggccgagaaguccaucagccugauccgcggcgggcggagcgaguacggcgcggcccuggccugggagaagggguccagcggccucgaggagaagaccuucuccgaguggcuggagagcgugaaggagaaccccgccgucaucgacuucgagcuggcccccaucguggaccucgugcgcaacaucccgugcgcggucaccaagcggaacaaccugcgcaaggcccugcaggaguacgccgccaaguucgaccccugccagugcgcccccugccccaacaacggccggccgacccucuccgggacggagugccugugcgugugccagagcggcaccuacggggagaacugcgagaagcagucccccgacuacaagagcaacgcggucgacggccagugggggugcugguccagcugguccacgugcgacgccaccuacaagcgcagccggacccgcgagugcaacaaccccgcgccccagcggggcggcaagcgcugcgagggggagaagcggcaggaggaggacugcaccuucuccaucauggagaacaacggccagccgugcaucaacgacgacgaggagaugaaggagguggaccugcccgagaucgaggccgacagcgggugcccccagcccgugccgcccgagaacggcuucauccgcaacgagaagcagcucuaccuggucggcgaggacguggagaucuccugccugaccggguucgagaccgugggcuaccaguacuuccggugccuccccgacgggacguggcgccagggcgacgucgagugccagcggaccgagugcaucaagccgguggugcaggagguccugaccaucacccccuuccagcgccuguaccggaucggggagagcaucgagcucacgugccccaagggcuucgugguggccggccccagccgcuacacgugccaggggaacuccuggaccccgcccaucagcaacucccugaccugcgagaaggacacccugaccaagcugaagggccacugccagcucgggcagaagcagagcggcuccgagugcaucugcaugagccccgaggaggacugcucccaccacagcgaggaccugugcgucuucgacaccgacuccaacgacuacuucaccagccccgccugcaaguuccuggccgagaagugccucaacaaccagcagcugcacuuccugcacaucggguccugccaggacggccggcagcucgaguggggccuggagcgcacccgccugagcuccaacagcacgaagaaggaguccugcggguacgacacgugcuacgacugggagaagugcagcgccuccaccagcaagugcgugugccuccugccgccccagugcuucaagggcgggaaccagcuguacugcgugaagaugggcuccagcaccagcgagaagacccucaacaucugcgaggucgggaccauccggugcgccaaccgcaagauggagauccugcaccccggcaagugccuggcguga

SEQ ID NO: 8055 - RNA, 2805 nt, Artificial Sequence
  derived and/or modified sequence opt2 from complement_system_component_C6__Homo_sapiens__AAA51860
auggcccgccgcuccguccucuacuucauccuccucaacgcccucaucaacaagggccaggccugcuucugcgaccacuacgccuggacccaguggaccuccugcuccaagaccugcaacuccggcacccagucccgccaccgccagaucgucgucgacaaguacuaccaggagaacuucugcgagcagaucugcuccaagcaggagacccgcgagugcaacuggcagcgcugccccaucaacugccuccucggcgacuucggccccugguccgacugcgaccccugcaucgagaagcaguccaagguccgcuccguccuccgccccucccaguucggcggccagcccugcaccgccccccucgucgccuuccagcccugcauccccuccaagcucugcaagaucgaggaggccgacugcaagaacaaguuccgcugcgacuccggccgcugcaucgcccgcaagcucgagugcaacggcgagaacgacugcggcgacaacuccgacgagcgcgacugcggccgcaccaaggccgucugcacccgcaaguacaaccccauccccuccguccagcucaugggcaacggcuuccacuuccucgccggcgagccccgcggcgagguccucgacaacuccuucaccggcggcaucugcaagaccgucaaguccucccgcaccuccaaccccuaccgcguccccgccaaccucgagaacgucggcuucgagguccagaccgccgaggacgaccucaagaccgacuucuacaaggaccucaccucccucggccacaacgagaaccagcagggcuccuucuccucccagggcggcuccuccuucuccguccccaucuucuacuccuccaagcgcuccgagaacaucaaccacaacuccgccuucaagcaggccauccaggccucccacaagaaggacuccuccuucauccgcauccacaaggucaugaagguccucaacuucaccaccaaggccaaggaccuccaccucuccgacgucuuccucaaggcccucaaccaccucccccucgaguacaacuccgcccucuacucccgcaucuucgacgacuucggcacccacuacuucaccuccggcucccucggcggcgucuacgaccuccucuaccaguucuccuccgaggagcucaagaacuccggccucaccgaggaggaggccaagcacugcguccgcaucgagaccaagaagcgcguccucuucgccaagaagaccaaggucgagcaccgcugcaccaccaacaagcucuccgagaagcacgagggcuccuucauccagggcgccgagaaguccaucucccucauccgcggcggccgcuccgaguacggcgccgcccucgccugggagaagggcuccuccggccucgaggagaagaccuucuccgaguggcucgaguccgucaaggagaaccccgccgucaucgacuucgagcucgcccccaucgucgaccucguccgcaacauccccugcgccgucaccaagcgcaacaaccuccgcaaggcccuccaggaguacgccgccaaguucgaccccugccagugcgcccccugccccaacaacggccgccccacccucuccggcaccgagugccucugcgucugccaguccggcaccuacggcgagaacugcgagaagcagucccccgacuacaaguccaacgccgucgacggccaguggggcugcugguccuccugguccaccugcgacgccaccuacaagcgcucccgcacccgcgagugcaacaaccccgccccccagcgcggcggcaagcgcugcgagggcgagaagcgccaggaggaggacugcaccuucuccaucauggagaacaacggccagcccugcaucaacgacgacgaggagaugaaggaggucgaccuccccgagaucgaggccgacuccggcugcccccagcccgucccccccgagaacggcuucauccgcaacgagaagcagcucuaccucgucggcgaggacgucgagaucuccugccucaccggcuucgagaccgucggcuaccaguacuuccgcugccuccccgacggcaccuggcgccagggcgacgucgagugccagcgcaccgagugcaucaagcccgucguccaggagguccucaccaucacccccuuccagcgccucuaccgcaucggcgaguccaucgagcucaccugccccaagggcuucgucgucgccggccccucccgcuacaccugccagggcaacuccuggaccccccccaucuccaacucccucaccugcgagaaggacacccucaccaagcucaagggccacugccagcucggccagaagcaguccggcuccgagugcaucugcaugucccccgaggaggacugcucccaccacuccgaggaccucugcgucuucgacaccgacuccaacgacuacuucaccucccccgccugcaaguuccucgccgagaagugccucaacaaccagcagcuccacuuccuccacaucggcuccugccaggacggccgccagcucgaguggggccucgagcgcacccgccucuccuccaacuccaccaagaaggaguccugcggcuacgacaccugcuacgacugggagaagugcuccgccuccaccuccaagugcgucugccuccuccccccccagugcuucaagggcggcaaccagcucuacugcgucaagaugggcuccuccaccuccgagaagacccucaacaucugcgaggucggcaccauccgcugcgccaaccgcaagauggagauccuccaccccggcaagugccucgccuga

SEQ ID NO: 8056 - RNA, 2805 nt, Artificial Sequence
  derived and/or modified sequence opt3 from complement_system_component_C6__Homo_sapiens__AAA51860
auggccagaaggagcgugcuguacuucauccuccuuaacgcucugauuaauaagggccaggcaugcuuuugugaccacuaugccuggacccaauggacauccugcucuaaaacuuguaacucagggacgcagagucggcaucgccagauagucguugauaaguacuaucaggagaauuucugcgaacaaaucuguagcaaacaggagacccgagaaugcaacuggcagcguugucccauuaauugcuuguuaggagacuuugguccuugguccgauugugacccaugcaucgagaagcagucuaaagugagaucgguacugaggccgucacaauucggcgggcagcccuguacagcgccucuaguggcuuuucagccaugcauucccagcaagcucugcaagaucgaagaggccgauuguaaaaacaaguuccggugcgacaguggacgcuguauagcaagaaaacuggagugcaauggcgaaaacgauuguggugacaauuccgaugagagggacugcgggcggacuaaggccgucuguacccgcaaauacaacccuaucccaucugugcagcuuaugggaaauggcuuucacuuccuggcuggcgaaccccgaggggagguuuuggauaacagcuuuacaggagguauuugcaagaccgugaaguccucaagaacaaguaauccuuauagggucccagcaaaccucgagaaugugggcuucgaaguacaaacagccgaggacgaucugaaaaccgacuuuuacaaggaccugacgagccucgggcauaacgaaaaccagcagggaucuuucuccucacaaggcgguagcaguuuuucuguuccgaucuucuauuccagcaaacggucggagaauauuaaccacaauucugcuuucaagcaggccauccaggcgucccauaaaaaggauucaaguuuuauacguauucacaaagugaugaaggucuuaaacuucacuaccaaggcaaaagaccugcaccuuagcgauguguuuuugaaggcccugaaucaucuaccccucgaauacaacuccgcucuguacucucgcaucuucgacgauuuugggacacacuauuucacuagcggaucacuuggcggcguguacgaccuguuguaucaguuuaguuccgaggagcucaaaaauagcgggcugaccgaagaggaagccaagcauugugucagaauugagacuaaaaagaggguuuuauucgcaaagaaaaccaagguggaacaccggugcacgacuaacaaacugucugagaagcacgagggaucauuuauccaaggugcugagaaaaguaucagccucauucgaggcgggcgcuccgaauacggagccgcgcuugccugggaaaaggggucuucgggucuggaggaaaagacauucagcgagugguuggaguccguaaaagaaaauccugcagugauagauuuugagcuagcuccaaucgucgaccuggugagaaacauucccugugccguuaccaagaggaauaaccuccggaaagcucugcaggaauaugccgcaaaguucgauccuugccagugcgccccaugucccaauaacgggcgcccgacucuuucaggcacagagugccugugugugugccagaguggaaccuacggcgagaauugugaaaaacaaucuccugacuauaagagcaacgcugucgaugggcaguggggaugcugguccucauggagcacgugugacgcgaccuacaagagaucuaggacacgugagugcaacaaucccgcaccacagcgggguggcaaacgaugugaaggggagaagagacaggaagaggacugcacuuuuuccaucauggagaacaauggacaaccuuguauaaacgaugacgaagagaugaaagaaguggauuugcccgagauugaagccgacaguggcugcccacagcccguaccuccagagaaugguuucaucaggaacgagaagcagcucuaccugguuggggaagauguggagaucagcugcuuaaccggcuucgaaacagucggauaucaguacuuucgcugucugccggacggcacuuggcggcaaggggauguggagugccagagaaccgaauguauuaaacccgucgugcaggagguucuaacaaucaccccuuuccaaaggcucuaucgcauuggagagucuauagaacugacuugcccaaaggguuuugugguagcuggccccucccgauacacgugucagggcaauucauggacaccuccaaucaguaacagccuuaccugcgagaaagacacuuugaccaagcugaagggacauugucagcucggccagaaacaaucggguuccgaaugcauuuguaugucucccgaggaggauugcagccaccauucagaagaccugugugucuucgauacagacaguaaugauuauuuuaccuccccggccugcaaguuccuugcagagaaaugccugaacaaucagcaguugcacuuucuccauaucgggucuugucaggacggccggcaacuggaauggggauuagagcguacuagacugagcuccaacucaacaaagaaagaaagcugcggcuacgacacguguuaugauugggagaagugcagugccucuaccuccaagugugugugccuacucccuccacaguguuucaaagggggaaaucagcuguacugcguuaagaugggcagcucgacuucagagaaaacacuuaacaucugugaaguggguaccauuaggugcgcuaaucgcaagauggagauauugcaccccgggaaaugucuggccuga

SEQ ID NO: 8057 - RNA, 2805 nt, Artificial Sequence
  derived and/or modified sequence opt4 from complement_system_component_C6__Homo_sapiens__AAA51860
auggccagaagaagcgugcuguacuucauccugcugaacgcccugaucaacaagggccaggccugcuucugcgaccacuacgccuggacccaguggaccagcugcagcaagaccugcaacagcggcacccagagcagacacagacagaucgugguggacaaguacuaccaggagaacuucugcgagcagaucugcagcaagcaggagaccagagagugcaacuggcagagaugccccaucaacugccugcugggcgacuucggccccuggagcgacugcgaccccugcaucgagaagcagagcaaggugagaagcgugcugagacccagccaguucggcggccagcccugcaccgccccccugguggccuuccagcccugcauccccagcaagcugugcaagaucgaggaggccgacugcaagaacaaguucagaugcgacagcggcagaugcaucgccagaaagcuggagugcaacggcgagaacgacugcggcgacaacagcgacgagagagacugcggcagaaccaaggccgugugcaccagaaaguacaaccccauccccagcgugcagcugaugggcaacggcuuccacuuccuggccggcgagcccagaggcgaggugcuggacaacagcuucaccggcggcaucugcaagaccgugaagagcagcagaaccagcaaccccuacagagugcccgccaaccuggagaacgugggcuucgaggugcagaccgccgaggacgaccugaagaccgacuucuacaaggaccugaccagccugggccacaacgagaaccagcagggcagcuucagcagccagggcggcagcagcuucagcgugcccaucuucuacagcagcaagagaagcgagaacaucaaccacaacagcgccuucaagcaggccauccaggccagccacaagaaggacagcagcuucaucagaauccacaaggugaugaaggugcugaacuucaccaccaaggccaaggaccugcaccugagcgacguguuccugaaggcccugaaccaccugccccuggaguacaacagcgcccuguacagcagaaucuucgacgacuucggcacccacuacuucaccagcggcagccugggcggcguguacgaccugcuguaccaguucagcagcgaggagcugaagaacagcggccugaccgaggaggaggccaagcacugcgugagaaucgagaccaagaagagagugcuguucgccaagaagaccaagguggagcacagaugcaccaccaacaagcugagcgagaagcacgagggcagcuucauccagggcgccgagaagagcaucagccugaucagaggcggcagaagcgaguacggcgccgcccuggccugggagaagggcagcagcggccuggaggagaagaccuucagcgaguggcuggagagcgugaaggagaaccccgccgugaucgacuucgagcuggcccccaucguggaccuggugagaaacauccccugcgccgugaccaagagaaacaaccugagaaaggcccugcaggaguacgccgccaaguucgaccccugccagugcgcccccugccccaacaacggcagacccacccugagcggcaccgagugccugugcgugugccagagcggcaccuacggcgagaacugcgagaagcagagccccgacuacaagagcaacgccguggacggccaguggggcugcuggagcagcuggagcaccugcgacgccaccuacaagagaagcagaaccagagagugcaacaaccccgccccccagagaggcggcaagagaugcgagggcgagaagagacaggaggaggacugcaccuucagcaucauggagaacaacggccagcccugcaucaacgacgacgaggagaugaaggagguggaccugcccgagaucgaggccgacagcggcugcccccagcccgugccccccgagaacggcuucaucagaaacgagaagcagcuguaccuggugggcgaggacguggagaucagcugccugaccggcuucgagaccgugggcuaccaguacuucagaugccugcccgacggcaccuggagacagggcgacguggagugccagagaaccgagugcaucaagcccguggugcaggaggugcugaccaucacccccuuccagagacuguacagaaucggcgagagcaucgagcugaccugccccaagggcuucgugguggccggccccagcagauacaccugccagggcaacagcuggaccccccccaucagcaacagccugaccugcgagaaggacacccugaccaagcugaagggccacugccagcugggccagaagcagagcggcagcgagugcaucugcaugagccccgaggaggacugcagccaccacagcgaggaccugugcguguucgacaccgacagcaacgacuacuucaccagccccgccugcaaguuccuggccgagaagugccugaacaaccagcagcugcacuuccugcacaucggcagcugccaggacggcagacagcuggaguggggccuggagagaaccagacugagcagcaacagcaccaagaaggagagcugcggcuacgacaccugcuacgacugggagaagugcagcgccagcaccagcaagugcgugugccugcugcccccccagugcuucaagggcggcaaccagcuguacugcgugaagaugggcagcagcaccagcgagaagacccugaacaucugcgaggugggcaccaucagaugcgccaacagaaagauggagauccugcaccccggcaagugccuggccuga

SEQ ID NO: 8058 - RNA, 2805 nt, Artificial Sequence
  derived and/or modified sequence opt5 from complement_system_component_C6__Homo_sapiens__AAA51860
auggccagacggagcgugcuguacuucauccuccugaacgcucuuauuaauaagggccaggccugcuuuugugaccacuaugcguggacccaauggacauccugcucuaaaacguguaacagcgggacccagucccgccauagacagaucgucguugauaaguacuaucaggagaauuucugcgaacaaauuuguucuaaacaggagacacgggaaugcaacuggcagcgcugucccaucaauugccugcucggagacuuuggcccuuggagcgauugugacccgugcauugagaagcaguccaaagugagaucugugcugcggcccagccaauucgggggacagccuuguaccgcuccccuugucgccuuucagccuugcauccccuccaagcugugcaagaucgaagaggccgauuguaaaaacaaguuccgcugcgacagcggcagauguauugcucggaaacucgagugcaauggggaaaacgauuguggagacaauucugaugagcgcgacugcggcagaacaaaggccguguguacccggaaauacaacccuaucccguccguucagcugaugggcaauggguuucacuuccuggcuggagaaccccgcggcgaggugcucgauaacagcuuuacagggggaauuugcaagaccgucaagucuuccagaacgagcaauccuuaucgggugcccgccaaccuggagaauguuggcuucgaagugcaaaccgcggaggacgaucuuaaaacagacuuuuacaaggaccugaccucucucgggcauaacgaaaaccagcagggauccuucagcucccaaggcggcucuagcuuuuccgucccuaucuucuauagcucuaaacgcuccgagaauauuaaccacaauagcgccuucaagcaggcuauccaggccucucauaaaaaggauagcuccuuuauuagaauccacaaagugaugaaggugcugaacuucacaaccaaggcuaaagaccuucaccugucugaugucuuucucaaggcccugaaucaucugccccucgaauacaacagcgcgcuguacucccggaucuucgacgauuuugggacgcacuauuucacaagcggaucucuuggcgggguuuacgaccugcucuaucaguuuuccagcgaggagcugaaaaauucuggacuuaccgaagaggaagccaagcauugugugagaauugagacaaagaagcgcgugcuguucgcuaagaaaaccaaggucgaacaccggugcaccacaaacaaacucuccgagaagcacgagggcagcuuuauccaaggggccgaaaaauccauuucucugaucagaggaggccgcagcgaguacggcgcugcccuggccugggaaaagggguccucuggacucgaggaaaagacguucagcgaguggcuggaguccgugaaagaaaauccggcuguuauugauuuugagcuugcgccuaucguggaccugguccggaacauccccugugccgugaccaagagaaauaaccuccgcaaagcucugcaggaauaugccgccaaguucgauccuugccagugcgcucccugucccaauaacggccggccuacacuuagcgggaccgagugccuguguguuugccagucuggaacauacggcgagaauugugaaaaacaauccccggacuauaagagcaacgccguggaugggcaguggggcugcuggucuuccuggagcaccugugacgcgacguacaagagaucucgcacacgggagugcaacaaucccgcuccucagagaggaggcaaacgcugugaaggggagaagcggcaggaagaggacugcaccuuuagcauuauggagaacaauggacaacccuguaucaacgaugacgaagagaugaaagaagucgaucucccugagauugaagccgacuccggcugcccccagccggugccucccgagaauggguucaucagaaacgagaagcagcuguaccuggucggagaagauguggagauuagcugccucaccggcuucgaaacaguuggguaucaguacuuucggugucugccugacggcaccuggcgccaaggagauguggagugccagagaacagaauguaucaaacccgucgugcaggagguucuuacgaucaccccuuuccaacggcuguauagaauuggcgagucuaucgaacucacaugccccaagggguuuguggucgccggaccgucccgcuacaccugucagggcaauagcuggacaccucccauuuccaacucucugaccugcgagaaagacacgcugaccaaacuuaaggggcauugucagcucggacagaaacaaagcggcuccgaaugcaucuguaugucucccgaggaggauugcagccaccauuccgaagaccuguguguguucgauacagacucuaaugauuauuuuaccagcccugcuugcaaguuccuggccgagaaaugccucaacaaucagcagcugcacuuucuucauauuggguccugucaggacggccggcaacuggaauggggacucgagagaacacgccugagcucuaacuccaccaagaaagaaagcugcggcuacgacacguguuaugauugggagaagugcucugcuuccacaagcaagugugugugccugcuuccgccccaguguuucaaagggggaaaucagcucuacugcguuaagauggggucuuccaccagcgagaaaacacugaacaucugugaagucggcaccauuagaugcgccaaucggaagauggagauccugcacccuggaaaaugucucgcguga

SEQ ID NO: 8059 - protein, 843 aa, Artificial Sequence
  complement_system_component_C7__Homo_sapiens__P10643
MKVISLFILVGFIGEFQSFSSASSPVNCQWDFYAPWSECNGCTKTQTRRRSVAVYGQYGGQPCVGNAFETQSCEPTRGCPTEEGCGERFRCFSGQCISKSLVCNGDSDCDEDSADEDRCEDSERRPSCDIDKPPPNIELTGNGYNELTGQFRNRVINTKSFGGQCRKVFSGDGKDFYRLSGNVLSYTFQVKINNDFNYEFYNSTWSYVKHTSTEHTSSSRKRSFFRSSSSSSRSYTSHTNEIHKGKSYQLLVVENTVEVAQFINNNPEFLQLAEPFWKELSHLPSLYDYSAYRRLIDQYGTHYLQSGSLGGEYRVLFYVDSEKLKQNDFNSVEEKKCKSSGWHFVVKFSSHGCKELENALKAASGTQNNVLRGEPFIRGGGAGFISGLSYLELDNPAGNKRRYSAWAESVTNLPQVIKQKLTPLYELVKEVPCASVKKLYLKWALEEYLDEFDPCHCRPCQNGGLATVEGTHCLCHCKPYTFGAACEQGVLVGNQAGGVDGGWSCWSSWSPCVQGKKTRSRECNNPPPSGGGRSCVGETTESTQCEDEELEHLRLLEPHCFPLSLVPTEFCPSPPALKDGFVQDEGTMFPVGKNVVYTCNEGYSLIGNPVARCGEDLRWLVGEMHCQKIACVLPVLMDGIQSHPQKPFYTVGEKVTVSCSGGMSLEGPSAFLCGSSLKWSPEMKNARCVQKENPLTQAVPKCQRWEKLQNSRCVCKMPYECGPSLDVCAQDERSKRILPLTVCKMHVLHCQGRNYTLTGRDSCTLPASAEKACGACPLWGKCDAESSKCVCREASECEEEGFSICVEVNGKEQTMSECEAGALRCRGQSISVTSIRPCAAETQ

SEQ ID NO: 8060 - RNA, 2532 nt, Artificial Sequence
  complement_system_component_C7__Homo_sapiens__AAH63851
augaaggugauaagcuuauucauuuuggugggauuuauaggagaguuccaaaguuuuucaagugccuccucuccagucaacugccagugggacuucuaugccccuuggucagaaugcaauggcuguaccaagacucagacucgcaggcggucaguugcuguguaugggcaguauggaggccagccuuguguuggaaaugcuuuugaaacacaguccugugaaccuacaagaggauguccaacagaggagggauguggagagcguuucaggugcuuuucaggucagugcaucagcaaaucauugguuugcaauggggauucugacugugaugaagacagugcugaugaagacagaugugaggacucagaaaggagaccuuccugugauaucgauaaaccuccuccuaacauagaacuuacuggaaaugguuacaaugaacucacuggccaguuuaggaacagagucaucaauaccaaaaguuuugguggucaauguagaaagguguuuaguggggauggaaaagauuucuacaggcugaguggaaauguccuguccuauacauuccaggugaaaauaaauaaugauuuuaauuaugaauuuuacaauaguacuuggucuuauguaaaacauacgucgacagaacacacaucaucuagucggaagcgcuccuuuuuuagaucuucaucaucuucuucacgcaguuauacuucacauaccaaugaaauccauaaaggaaagaguuaccaacugcugguuguugagaacacuguugaaguggcucaguucauuaauaacaauccagaauuuuuacaacuugcugagccauucuggaaggagcuuucccaccuccccucucuguaugacuacagugccuaccgaagauuaaucgaccaguacgggacacauuaucugcaaucugggucguuaggaggagaauacagaguucuauuuuauguggacucagaaaaauuaaaacaaaaugauuuuaauucagucgaagaaaagaaauguaaauccucagguuggcauuuugucguuaaauuuucaagucauggaugcaaggaacuggaaaacgcuuuaaaagcugcuucaggaacccagaacaauguauugcgaggagaaccguucaucagagggggaggugcaggcuucauaucuggccuuaguuaccuagagcuggacaauccugcuggaaacaaaaggcgauauucugccugggcagaaucugugacuaaucuuccucaagucauaaaacaaaagcugacaccuuuauaugagcugguaaaggaaguaccuugugccucugugaaaaaacuauaccugaaaugggcucuugaagaguaucuggaugaauuugaccccugucauugccggccuugucaaaauggugguuuggcuacuguugaggggacccauugucugugccauugcaaaccguacacauuuggugcggcgugugagcaaggaguccucguagggaaucaagcaggagggguugauggagguuggaguugcugguccucuuggagccccuguguccaagggaagaaaacaagaagccgugaaugcaauaacccaccucccagugggggugggagauccugcguuggagaaacgacagaaagcacacaaugcgaagaugaggagcuggagcacuugagguugcuugaaccacauugcuuuccuuugucuuugguuccaacagaauucuguccaucaccuccugccuugaaagauggauuuguucaagaugaagguacaauguuuccuguggggaaaaauguaguguacacuugcaaugaaggauacucucuuauuggaaacccaguggccagauguggagaagauuuacgguggcuuguuggggaaaugcauugucagaaaauugccuguguucuaccuguacugauggauggcauacagagucacccccaaaaaccuuucuacacaguuggugagaaggugacuguuuccuguucagguggcauguccuuagaagguccuucagcauuucucuguggcuccagccuuaaguggaguccugagaugaagaaugcccgcuguguacaaaaagaaaauccguuaacacaggcagugccuaaaugucagcgcugggagaaacugcagaauucaagauguguuuguaaaaugcccuacgaauguggaccuuccuuggauguaugugcucaagaugagagaagcaaaaggauacugccucugacaguuugcaagaugcauguucuccacugucaggguagaaauuacacccuuacugguagggacagcuguacucugccugccucagcugagaaagcuuguggugccugcccacuguggggaaaaugugaugcugagagcagcaaaugugucugccgagaagcaucggagugcgaggaagaaggguuuagcauuuguguggaagugaacggcaaggagcagacgaugucugagugugaggcgggcgcucugagaugcagagggcagagcaucucugucaccagcauaaggccuugugcugcggaaacccaguag

SEQ ID NO: 8061 - RNA, 2532 nt, Artificial Sequence
  derived and/or modified sequence opt1 from complement_system_component_C7__Homo_sapiens__AAH63851
augaaggugaucagccuguucauccucgucggcuucaucggggaguuccaguccuucagcuccgccagcucccccgugaacugccagugggacuucuacgccccguggagcgagugcaacggcugcaccaagacccagacgcgccggcgcuccguggcggucuacgggcaguacggcgggcagcccugcgugggcaacgccuucgagacccagagcugcgagcccacccggggcugccccaccgaggaggggugcggcgagcgcuuccggugcuucuccgggcagugcaucagcaagucccuggugugcaacggcgacagcgacugcgacgaggacuccgccgacgaggaccgcugcgaggacagcgagcggcgcccguccugcgacaucgacaagcccccgcccaacaucgagcugacggggaacggcuacaacgagcucaccggccaguuccggaaccgcgucaucaacaccaagagcuucgggggccagugccggaagguguucuccggggacggcaaggacuucuaccgccugagcggcaacgugcuguccuacaccuuccaggucaagaucaacaacgacuucaacuacgaguucuacaacagcacguggagcuacgugaagcacaccuccaccgagcacaccagcuccagccggaagcgcuccuucuuccggagcuccagcuccagcucccgcagcuacacgucccacaccaacgagauccacaagggcaagagcuaccagcuccugguggucgagaacaccguggagguggcccaguucaucaacaacaaccccgaguuccugcagcucgccgagcccuucuggaaggagcugucccaccuccccagccuguacgacuacuccgcguaccggcgccugaucgaccaguacgggacccacuaccugcagagcgggucccucggcggggaguaccggguccuguucuacguggacagcgagaagcugaagcagaacgacuucaacagcguggaggagaagaagugcaaguccagcggcuggcacuucgucgugaaguucuccagccacggcugcaaggagcucgagaacgcccugaaggccgccuccgggacgcagaacaacgugcugcgcggcgagcccuucauccgcgggggcggggcgggcuucaucagcggccucuccuaccuggagcuggacaacccggccgggaacaagcggcgcuacagcgccugggccgaguccgucaccaaccucccccaggugaucaagcagaagcugacgccccuguacgagcucgugaaggagguccccugcgccagcgugaagaagcuguaccugaagugggcgcucgaggaguaccuggacgaguucgacccgugccacugccggcccugccagaacggcgggcuggccaccgucgagggcacccacugccucugccacugcaagcccuacaccuucggggccgccugcgagcagggcgugcuggugggcaaccaggccgggggcgucgacgggggcugguccugcuggagcuccuggagccccugcgugcagggcaagaagacccgcucccgggagugcaacaacccgccgcccagcgggggcgggcgcuccugcgugggcgagaccacggagagcacccagugcgaggacgaggagcuggagcaccuccggcugcuggagccccacugcuucccccucagccugguccccaccgaguucugccccuccccgcccgcgcugaaggacggguucgugcaggacgagggcaccauguuccccgugggcaagaacgucguguacacgugcaacgagggguacagccucaucggcaaccccguggcccgcugcggggaggaccugcgguggcuggucggcgagaugcacugccagaagaucgccugcgugcucccggugcugauggacgggauccagucccacccccagaagcccuucuacaccgucggcgagaaggugaccgugagcugcuccggcgggaugagccuggagggccccuccgccuuccucugcgggagcucccugaaguggagcccggagaugaagaacgcccgcugcguccagaaggagaacccccugacccaggcggugcccaagugccagcggugggagaagcugcagaacucccgcugcgugugcaagaugcccuacgagugcggcccgagccucgacgucugcgcccaggacgagcgguccaagcgcauccugccccugacggugugcaagaugcacgugcuccacugccaggggcggaacuacacccugaccggccgcgacagcugcacccugcccgccuccgccgagaaggccugcggcgcgugcccccucugggggaagugcgacgccgagagcuccaagugcgucugccgggaggccagcgagugcgaggaggagggcuucuccaucugcguggaggugaacgggaaggagcagacgaugagcgagugcgaggccggcgcgcugcgcugccgggggcagagcaucuccgucaccagcauccgcccgugcgccgccgagacccaguga

SEQ ID NO: 8062 - RNA, 2532 nt, Artificial Sequence
  derived and/or modified sequence opt2 from complement_system_component_C7__Homo_sapiens__AAH63851
augaaggucaucucccucuucauccucgucggcuucaucggcgaguuccaguccuucuccuccgccuccucccccgucaacugccagugggacuucuacgcccccugguccgagugcaacggcugcaccaagacccagacccgccgccgcuccgucgccgucuacggccaguacggcggccagcccugcgucggcaacgccuucgagacccaguccugcgagcccacccgcggcugccccaccgaggagggcugcggcgagcgcuuccgcugcuucuccggccagugcaucuccaagucccucgucugcaacggcgacuccgacugcgacgaggacuccgccgacgaggaccgcugcgaggacuccgagcgccgccccuccugcgacaucgacaagcccccccccaacaucgagcucaccggcaacggcuacaacgagcucaccggccaguuccgcaaccgcgucaucaacaccaaguccuucggcggccagugccgcaaggucuucuccggcgacggcaaggacuucuaccgccucuccggcaacguccucuccuacaccuuccaggucaagaucaacaacgacuucaacuacgaguucuacaacuccaccugguccuacgucaagcacaccuccaccgagcacaccuccuccucccgcaagcgcuccuucuuccgcuccuccuccuccuccucccgcuccuacaccucccacaccaacgagauccacaagggcaaguccuaccagcuccucgucgucgagaacaccgucgaggucgcccaguucaucaacaacaaccccgaguuccuccagcucgccgagcccuucuggaaggagcucucccaccuccccucccucuacgacuacuccgccuaccgccgccucaucgaccaguacggcacccacuaccuccaguccggcucccucggcggcgaguaccgcguccucuucuacgucgacuccgagaagcucaagcagaacgacuucaacuccgucgaggagaagaagugcaaguccuccggcuggcacuucgucgucaaguucuccucccacggcugcaaggagcucgagaacgcccucaaggccgccuccggcacccagaacaacguccuccgcggcgagcccuucauccgcggcggcggcgccggcuucaucuccggccucuccuaccucgagcucgacaaccccgccggcaacaagcgccgcuacuccgccugggccgaguccgucaccaaccucccccaggucaucaagcagaagcucaccccccucuacgagcucgucaaggagguccccugcgccuccgucaagaagcucuaccucaagugggcccucgaggaguaccucgacgaguucgaccccugccacugccgccccugccagaacggcggccucgccaccgucgagggcacccacugccucugccacugcaagcccuacaccuucggcgccgccugcgagcagggcguccucgucggcaaccaggccggcggcgucgacggcggcugguccugcugguccuccuggucccccugcguccagggcaagaagacccgcucccgcgagugcaacaaccccccccccuccggcggcggccgcuccugcgucggcgagaccaccgaguccacccagugcgaggacgaggagcucgagcaccuccgccuccucgagccccacugcuucccccucucccucguccccaccgaguucugccccuccccccccgcccucaaggacggcuucguccaggacgagggcaccauguuccccgucggcaagaacgucgucuacaccugcaacgagggcuacucccucaucggcaaccccgucgcccgcugcggcgaggaccuccgcuggcucgucggcgagaugcacugccagaagaucgccugcguccuccccguccucauggacggcauccagucccacccccagaagcccuucuacaccgucggcgagaaggucaccgucuccugcuccggcggcaugucccucgagggccccuccgccuuccucugcggcuccucccucaaguggucccccgagaugaagaacgcccgcugcguccagaaggagaacccccucacccaggccguccccaagugccagcgcugggagaagcuccagaacucccgcugcgucugcaagaugcccuacgagugcggccccucccucgacgucugcgcccaggacgagcgcuccaagcgcauccucccccucaccgucugcaagaugcacguccuccacugccagggccgcaacuacacccucaccggccgcgacuccugcacccuccccgccuccgccgagaaggccugcggcgccugcccccucuggggcaagugcgacgccgaguccuccaagugcgucugccgcgaggccuccgagugcgaggaggagggcuucuccaucugcgucgaggucaacggcaaggagcagaccauguccgagugcgaggccggcgcccuccgcugccgcggccaguccaucuccgucaccuccauccgccccugcgccgccgagacccaguga

SEQ ID NO: 8063 - RNA, 2532 nt, Artificial Sequence
  derived and/or modified sequence opt3 from complement_system_component_C7__Homo_sapiens__AAH63851
augaaggugaucagccuguucauucucgucggcuuuauaggggaguuccaguccuuuucuucagccaguagccccguuaacugccaaugggacuucuacgcuccuugguccgaauguaauggaugcaccaaaacacagacuagaaggcggucuguggcaguauauggucaguacggcgggcagccaugugugggaaacgccuuugagacgcaaucgugcgaaccgacccgcggcugucccacagaggaagguugcggggagcgauuccguuguuuuucaggacagugcaucagcaagagucuugucuguaauggcgauuccgacugcgaugaggacucugcggaugaagacagaugugaggauagcgaaaggcggccuuccugcgacauugauaaaccacccccuaacaucgagcugacuggcaauggguauaacgaguugaccggacaguuccgcaauagagugauuaacacaaagucauuugguggccagugcaggaaaguuuucaguggggacggaaaggauuuuuaccgguuaagcggcaaugugcugucuuauaccuuccaagucaagaucaacaaugacuuuaacuacgaguucuauaauuccacuuggucauacgugaaacacacaagcaccgagcauacgaguucuucccgcaagaggagcuucuuuagaucgucuuccucaaguagcagguccuacacuucucacaccaacgaaauacauaaagguaagagcuaucagcuacucguaguugagaauacaguggaagucgcucaguucaucaacaacaauccagaguuucugcagcuugccgagcccuucuggaaagaacugucacacuugccuagucucuacgauuauuccgcauaccggcgucugauugaccaauaugggacucauuaccugcagagcggaucucucggcggcgaguaucgcguguuauuuuacguggacucagaaaagcugaagcagaacgauuucaauagugucgaggagaaaaaguguaaaagcuccggguggcacuuuguugugaaguucucuucgcacggaugcaaagaacuugagaacgccuugaaggcugcaagcgguacccaaaauaacguacugagaggcgaaccauuuauccgagggggaggcgccgguuucauuuccgggcuaucauaccucgagcuggacaauccggcuggcaacaaacggcgauauagugccugggcggaaucugugacaaaucuuccccaggucaucaagcagaagcugaccccuuuguacgagcucgugaaagaaguuccaugugcaagcgugaagaaacuguauuuaaagugggcccuggaggaguaccucgaugaauuugaccccugccauugucgcccuugccagaacggaggccuugcuacggucgaggggacucacugucugugccauuguaaaccauauacauucggagccgcaugcgaacaagguguguugguaggcaaucaggcugggggaguugauggcgguugguccuguuggucaagcuggucucccugcgugcaggggaagaagaccagauccagggagugcaacaauccgccucccaguggcggaggccggagcugugucggggagacuacagaaucuacccagugcgaggacgaagaacuagaacaucugcgccuccuggagccacacuguuuuccucuuucccuggugcccacggaguucugcccaucacccccugccuugaaagauggauucguccaagacgaagguaccauguuuccagugggcaagaacguuguguacacauguaaugagggguauagucucauaggaaacccgguagcgagaugcggcgaagaucugaggugguuagucggugagaugcacugucagaaaauugccugcgugcugcccguucuaauggacgggauccagagccacccucagaagccauucuacacugugggcgaaaaagucaccgugucguguuccggaggcaugucucucgaggggcccagcgcauuucugugcggaucaagucuuaagugguccccugagaugaagaacgcucguuguguacaaaaagaaaauccauugacacaggccgugcccaagugccagcggugggagaaacugcagaacucucgaugcguuuguaagaugccguacgaaugcggcccuagccucgaugucugugcucaagacgagagauccaaaaggauucugccacuuacugugugcaagaugcaugugcugcacugucagggucgcaauuauaccuugacagggcgggacucaugcacccuccccgccagcgcagaaaaggccuguggagcuugcccucuguggggcaaaugugaugcggagaguucuaagugcgucuguagagaggcauccgaaugcgaggaagaggguuucagcaucugcguugaggugaacggcaaagaacagacuaugucggagugugaagccggggcuuuaaggugccgcggacaaucaaucucugugacgaguauucgacccugugccgcagagacacaguga

SEQ ID NO: 8064 - RNA, 2532 nt, Artificial Sequence
  derived and/or modified sequence opt4 from complement_system_component_C7__Homo_sapiens__AAH63851
augaaggugaucagccuguucauccuggugggcuucaucggcgaguuccagagcuucagcagcgccagcagccccgugaacugccagugggacuucuacgcccccuggagcgagugcaacggcugcaccaagacccagaccagaagaagaagcguggccguguacggccaguacggcggccagcccugcgugggcaacgccuucgagacccagagcugcgagcccaccagaggcugccccaccgaggagggcugcggcgagagauucagaugcuucagcggccagugcaucagcaagagccuggugugcaacggcgacagcgacugcgacgaggacagcgccgacgaggacagaugcgaggacagcgagagaagacccagcugcgacaucgacaagcccccccccaacaucgagcugaccggcaacggcuacaacgagcugaccggccaguucagaaacagagugaucaacaccaagagcuucggcggccagugcagaaagguguucagcggcgacggcaaggacuucuacagacugagcggcaacgugcugagcuacaccuuccaggugaagaucaacaacgacuucaacuacgaguucuacaacagcaccuggagcuacgugaagcacaccagcaccgagcacaccagcagcagcagaaagagaagcuucuucagaagcagcagcagcagcagcagaagcuacaccagccacaccaacgagauccacaagggcaagagcuaccagcugcuggugguggagaacaccguggagguggcccaguucaucaacaacaaccccgaguuccugcagcuggccgagcccuucuggaaggagcugagccaccugcccagccuguacgacuacagcgccuacagaagacugaucgaccaguacggcacccacuaccugcagagcggcagccugggcggcgaguacagagugcuguucuacguggacagcgagaagcugaagcagaacgacuucaacagcguggaggagaagaagugcaagagcagcggcuggcacuucguggugaaguucagcagccacggcugcaaggagcuggagaacgcccugaaggccgccagcggcacccagaacaacgugcugagaggcgagcccuucaucagaggcggcggcgccggcuucaucagcggccugagcuaccuggagcuggacaaccccgccggcaacaagagaagauacagcgccugggccgagagcgugaccaaccugccccaggugaucaagcagaagcugaccccccuguacgagcuggugaaggaggugcccugcgccagcgugaagaagcuguaccugaagugggcccuggaggaguaccuggacgaguucgaccccugccacugcagacccugccagaacggcggccuggccaccguggagggcacccacugccugugccacugcaagcccuacaccuucggcgccgccugcgagcagggcgugcuggugggcaaccaggccggcggcguggacggcggcuggagcugcuggagcagcuggagccccugcgugcagggcaagaagaccagaagcagagagugcaacaaccccccccccagcggcggcggcagaagcugcgugggcgagaccaccgagagcacccagugcgaggacgaggagcuggagcaccugagacugcuggagccccacugcuucccccugagccuggugcccaccgaguucugccccagcccccccgcccugaaggacggcuucgugcaggacgagggcaccauguuccccgugggcaagaacgugguguacaccugcaacgagggcuacagccugaucggcaaccccguggccagaugcggcgaggaccugagauggcuggugggcgagaugcacugccagaagaucgccugcgugcugcccgugcugauggacggcauccagagccacccccagaagcccuucuacaccgugggcgagaaggugaccgugagcugcagcggcggcaugagccuggagggccccagcgccuuccugugcggcagcagccugaaguggagccccgagaugaagaacgccagaugcgugcagaaggagaacccccugacccaggccgugcccaagugccagagaugggagaagcugcagaacagcagaugcgugugcaagaugcccuacgagugcggccccagccuggacgugugcgcccaggacgagagaagcaagagaauccugccccugaccgugugcaagaugcacgugcugcacugccagggcagaaacuacacccugaccggcagagacagcugcacccugcccgccagcgccgagaaggccugcggcgccugcccccuguggggcaagugcgacgccgagagcagcaagugcgugugcagagaggccagcgagugcgaggaggagggcuucagcaucugcguggaggugaacggcaaggagcagaccaugagcgagugcgaggccggcgcccugagaugcagaggccagagcaucagcgugaccagcaucagacccugcgccgccgagacccaguga

SEQ ID NO: 8065 - RNA, 2532 nt, Artificial Sequence
  derived and/or modified sequence opt5 from complement_system_component_C7__Homo_sapiens__AAH63851
augaaggugaucagccuguucauucucgucggcuuuaucggggaguuccaguccuuuucuagcgccuccucucccguuaacugccaaugggacuucuacgcuccuuggagcgaauguaauggaugcaccaaaacacagacgagacggcgcuccguggccguguauggccaguacgggggacagccgugugucggcaacgcguuugagacccaaucuugcgaacccacaagaggguguccuaccgaggaaggaugcggcgagcgguuccgcuguuuuagcggccagugcauuuccaagagccugguguguaauggggauucugacugcgaugaggacuccgcugaugaagacagaugugaggauagcgaacggcgccccucuugcgacaucgauaaaccucccccuaacauugagcuuacaggaaauggcuauaacgagcugaccgggcaguucagaaaucggguuaucaacacaaaguccuuuggaggccagugccgcaaaguguucagcggggacggaaaggauuuuuacagacucucuggcaauguccuguccuauaccuuccaagugaagaucaacaaugacuuuaacuacgaguucuauaauagcacgugguccuacguuaaacacaccucuacagagcauaccagcuccagccggaagcgcucuuucuuuagauccagcucuagcuccucucggagcuacacaucccacaccaacgaaauucauaaaggcaagagcuaucagcuucugguggucgagaauacgguggaaguggcccaguucaucaacaacaauccggaguuucuccagcuggccgagcccuucuggaaagaacugucucaccucccuucccuguacgauuauagcgcuuaccgcagacuuauugaccaauaugggacacauuaccugcagucuggaucccucggcggggaguaucggguccuguuuuacguugacagcgaaaaacuuaagcagaacgauuucaauuccguggaggaaaagaaguguaaaucuagcggauggcacuuuguggucaaguucuccucucacggcugcaaagagcuggagaacgcccucaaggcugccagcgggacccaaaauaacgugcugagaggagaacccuuuauccgcggcggcggggcgggauucauuuccggccugagcuaccucgagcuggacaauccugccgggaacaaacggagauauucugcuugggccgaauccguuacaaaucuuccccaggugaucaagcagaagcugaccccgcucuacgagcuggucaaagaagugccuugugcuagcguuaagaaacuuuaucugaagugggcccucgaggaguaccuggaugaauuugaccccugccauugucgcccuugccagaacggaggccuggcgaccguggaggggacacacugucucugccauuguaaacccuauacguucggcgccgcuugcgaacaaggaguccuggugggcaaucaggccgggggagucgauggcggguggucuuguugguccagcuggucucccugcgugcagggaaagaagacccggagcagagagugcaacaauccuccgcccuccggcgggggccgcagcuguguuggagagacaaccgaaucuacacagugcgaggacgaagaacuugaacaucugcggcuccuggagccucacuguuuuccccuuucccuggugccuaccgaguucugccccagcccgccugcucucaaagauggcuucguccaagacgaagggacgauguuucccgugggaaagaacguuguguacacauguaaugagggcuauucccugauugggaacccugucgccagaugcggagaagaucugcgcuggcucgugggcgagaugcacugucagaaaaucgccugcgugcugcccguucuuauggacgggauccagucucacccucagaagcccuucuacaccgucggcgaaaaagugaccgugagcuguuccggaggcaugucucuggaggggccgagcgcuuuucucugcggauccucucugaaguggagcccugagaugaagaacgcgcgguguguccaaaaagaaaauccccugacacaggccgugcccaagugccagagaugggagaaacuucagaacucccgcugcguuuguaagaugccuuacgaaugcggcccgagccucgaugugugugcucaagacgagcggucuaaacggauucugccccugaccgucugcaagaugcaugugcuccacugucaggggagaaauuauacacugacgggacgcgacuccugcacccuuccugccagcgccgaaaaggcuuguggcgccugcccccugugggggaaaugugaugcggagucuuccaagugcguuuguagagaggcuagcgaaugcgaggaagagggcuucucuaucugcguggaggucaacggaaaagaacagacaauguccgagugugaagccggcgcccuccggugcagagggcaaagcauuuccgugaccagcauccgcccuugugcugccgagacacaguga

SEQ ID NO: 8066 - protein, 268 aa, Artificial Sequence
  complement_system_component_C8__Homo_sapiens__Q99618
MGSAKSVPVTPARPPPHNKHLARVADPRSPSAGILRTPIQVESSPQPGLPAGEQLEGLKHAQDSDPRSPTLGIARTPMKTSSGDPPSPLVKQLSEVFETEDSKSNLPPEPVLPPEAPLSSELDLPLGTQLSVEEQMPPWNQTEFPSKQVFSKEEARQPTETPVASQSSDKPSRDPETPRSSGSMRNRWKPNSSKVLGRSPLTILQDDNSPGTLTLRQGKRPSPLSENVSELKEGAILGTGRLLKTGGRAWEQGQDHDKENQHFPLVES

SEQ ID NO: 8067 - RNA, 807 nt, Artificial Sequence
  complement_system_component_C8__Homo_sapiens__AAB51327
augggcucagccaagagcgucccagucacaccagcgcggccuccgccgcacaacaagcaucuggcucgaguggcggacccccguucaccuagugcuggcauccugcgcacucccauccagguggagagcucuccacagccaggccuaccagcaggggagcaacuggagggucuuaaacaugcccaggacucagauccccgcucuccuacucuugguauugcacggacaccuaugaagaccagcaguggagaccccccaagcccacuggugaaacagcugagugaaguauuugaaacugaagacucuaaaucaaaucuucccccagagccuguucugcccccagaggcaccuuuaucuucugaauuggacuugccucuggguacccaguuaucuguugaggaacagaugccaccuuggaaccagacugaguuccccuccaaacagguguuuuccaaggaggaagcaagacagcccacagaaaccccuguggccagccagagcuccgacaagcccucaagggacccugagacucccagaucuucagguucuaugcgcaauagauggaaaccaaacagcagcaagguacuagggagauccccccucaccauccugcaggaugacaacuccccuggcacccugacacuacgacaggguaagcggccuucaccccuaagugaaaauguuagugaacuaaaggaaggagccauucuuggaacuggacgacuucugaaaacuggaggacgagcaugggagcaaggccaggaccaugacaaggaaaaucagcacuuucccuugguggagagcuag

SEQ ID NO: 8068 - RNA, 807 nt, Artificial Sequence
  derived and/or modified sequence opt1 from complement_system_component_C8__Homo_sapiens__AAB51327
augggcagcgccaaguccgugcccgucaccccggcccgcccgccgccccacaacaagcaccuggcgcggguggccgacccccgcagccccuccgccgggauccuccggacccccauccagguggagagcagcccccagcccggccugcccgccggggagcagcuggagggccucaagcacgcccaggacuccgacccccgcucccccacgcuggggaucgcgcggaccccgaugaagaccagcuccggcgacccgcccagcccccuggucaagcagcucuccgagguguucgagaccgaggacagcaaguccaaccugccgcccgagcccgugcugccgcccgaggcgccccucagcuccgagcuggaccugccccucggcacgcagcugagcgucgaggagcagaugccgcccuggaaccagaccgaguuccccuccaagcaggucuucagcaaggaggaggcccgccagcccaccgagacccccguggccucccagagcagcgacaagcccucccgggaccccgagacgccccgcagcuccgggagcaugcggaaccgcuggaagccgaacuccagcaaggugcugggccggagcccccucaccauccugcaggacgacaacucccccgggacccugacccuccgccagggcaagcggcccuccccgcugagcgagaacguguccgagcugaaggagggggccauccucggcacgggccgccugcugaagaccgggggccgggccugggagcaggggcaggaccacgacaaggagaaccagcacuucccccucguggagagcuga

SEQ ID NO: 8069 - RNA, 807 nt, Artificial Sequence
  derived and/or modified sequence opt2 from complement_system_component_C8__Homo_sapiens__AAB51327
augggcuccgccaaguccguccccgucacccccgcccgcccccccccccacaacaagcaccucgcccgcgucgccgacccccgcucccccuccgccggcauccuccgcacccccauccaggucgaguccuccccccagcccggccuccccgccggcgagcagcucgagggccucaagcacgcccaggacuccgacccccgcucccccacccucggcaucgcccgcacccccaugaagaccuccuccggcgacccccccuccccccucgucaagcagcucuccgaggucuucgagaccgaggacuccaaguccaaccucccccccgagcccguccucccccccgaggccccccucuccuccgagcucgaccucccccucggcacccagcucuccgucgaggagcagaugccccccuggaaccagaccgaguuccccuccaagcaggucuucuccaaggaggaggcccgccagcccaccgagacccccgucgccucccaguccuccgacaagcccucccgcgaccccgagaccccccgcuccuccggcuccaugcgcaaccgcuggaagcccaacuccuccaagguccucggccgcuccccccucaccauccuccaggacgacaacucccccggcacccucacccuccgccagggcaagcgccccuccccccucuccgagaacgucuccgagcucaaggagggcgccauccucggcaccggccgccuccucaagaccggcggccgcgccugggagcagggccaggaccacgacaaggagaaccagcacuucccccucgucgaguccuga

SEQ ID NO: 8070 - RNA, 807 nt, Artificial Sequence
  derived and/or modified sequence opt3 from complement_system_component_C8__Homo_sapiens__AAB51327
augggcagcgccaaguccgugcccgucaccccugcuagaccaccgccccacaacaaacaucuggcaaggguugccgacccucggucuccaucagcggggauccuccgcacacccauucagguggagaguagcccucaaccaggacuucccgcuggugaacagcuggagggcuugaagcacgcccaggauuccgacccucgaucuccaacuuuagggauagcacguacgccgaugaaaaccucgucaggagaucccccuagcccacugguaaagcagcuaagugaaguguucgagacagaagacuccaaaucuaaucucccucccgagccaguccugcccccggaggccccucuuagcuccgaacuggauuugccccucggcacucaacugucaguggaggaacagaugccaccuuggaaccagaccgaguuucccaguaagcagguuuucagcaaggaggaagcuagacaaccaacagagacccccguggcaucucaguccucagacaaaccuagcagggauccagaaacuccgcggaguucugguuccaugcgcaauagauggaagcccaacagcucgaaaguccuggggaggucuccucucacaaucuuacaggacgauaauuccccaggaacccugacgcuucggcagggcaagcgccccucaccuuugagugagaacgugagcgaacugaaagagggcgccauucuagggacuggacgacuccugaagaccgguggcagagcuugggagcaagggcaggaccaugauaaggaaaaucagcacuuuccacuuguagaguccuga

SEQ ID NO: 8071 - RNA, 807 nt, Artificial Sequence
  derived and/or modified sequence opt4 from complement_system_component_C8__Homo_sapiens__AAB51327
augggcagcgccaagagcgugcccgugacccccgccagaccccccccccacaacaagcaccuggccagaguggccgaccccagaagccccagcgccggcauccugagaacccccauccagguggagagcagcccccagcccggccugcccgccggcgagcagcuggagggccugaagcacgcccaggacagcgaccccagaagccccacccugggcaucgccagaacccccaugaagaccagcagcggcgacccccccagcccccuggugaagcagcugagcgagguguucgagaccgaggacagcaagagcaaccugccccccgagcccgugcugccccccgaggccccccugagcagcgagcuggaccugccccugggcacccagcugagcguggaggagcagaugccccccuggaaccagaccgaguuccccagcaagcagguguucagcaaggaggaggccagacagcccaccgagacccccguggccagccagagcagcgacaagcccagcagagaccccgagacccccagaagcagcggcagcaugagaaacagauggaagcccaacagcagcaaggugcugggcagaagcccccugaccauccugcaggacgacaacagccccggcacccugacccugagacagggcaagagacccagcccccugagcgagaacgugagcgagcugaaggagggcgccauccugggcaccggcagacugcugaagaccggcggcagagccugggagcagggccaggaccacgacaaggagaaccagcacuucccccugguggagagcuga

SEQ ID NO: 8072 - RNA, 807 nt, Artificial Sequence
  derived and/or modified sequence opt5 from complement_system_component_C8__Homo_sapiens__AAB51327
augggcagcgccaaguccgugcccgucaccccugcuagaccgcccccucacaacaaacaucuggcccggguugcggacccccgcucuccuagcgcugggauccucagaacacccauucagguggaguccucuccucaaccgggacugcccgccggcgaacagcuugaggggcugaagcacgcccaggauagcgacccucggucccccacgcucggaaucgcucgcaccccuaugaaaacaucuagcggcgaucccccguccccucuggugaagcagcuuagcgaagucuucgagaccgaagacucuaaauccaaucugcccccugagcccgugcugcccccugaggccccgcucagcucugaacuggaucucccccuggggacacaacuuuccguugaggaacagaugccucccuggaaccagaccgaguuuccuagcaaacagguguucucuaaggaggaagcuagacaacccacagagaccccggucgccucccagagcuccgacaagccuucucgggaucccgaaacgccucgcagcuccggaagcaugagaaaucgguggaagcccaacucuuccaaagugcugggccgcagcccucucaccauucugcaggacgauaauucucccggcacacuuacccugagacaggggaagcggccgagcccucucuccgagaacguuucugaacugaaagagggagcgauccugggcacagggcgccuccugaagaccggaggcagagccugggagcaagggcaggaccaugauaaggaaaaucagcacuuuccccuuguggagagcuga

SEQ ID NO: 8073 - protein, 559 aa, Artificial Sequence [sequence omitted]

SEQ ID NO: 8074 - RNA, 1680 nt, Artificial Sequence
  complement_system_component_C9__Homo_sapiens__EAW55986
augucagccugcuggagcuuugcaguugcaaucugcauuuuagaaauaagcauccucacagcacaguacacgaccaguuaugacccagagcuaacagaaagcaguggcucugcaucacacauagacugcagaaugagccccuggagugaauggucacaaugcgauccuugucucagacaaauguuucguucaagaagcauugaggucuuuggacaauuuaaugggaaaagaugcaccgacgcugugggagacagacgacagugugugcccacagagcccugugaggaugcugaggaugacugcggaaaugacuuucaaugcaguacaggcagaugcauaaagaugcgacuucgguguaauggugacaaugacugcggagacuuuucagaugaggaugauugugaaagugagccccguccccccugcagagacagagugguagaagagucugagcuggcacgaacagcaggcuaugggaucaacauuuuagggauggauccccuaagcacaccuuuugacaaugaguucuacaauggacucuguaaccgggaucgggauggaaacacucugacauacuaccgaagaccuuggaacguggcuucuuugaucuaugaaaccaaaggcgagaaaaauuucagaaccgaacauuacgaagaacaaauugaagcauuuaaaaguaucauccaagagaagacaucaaauuuuaaugcagcuauaucucuaaaauuuacacccacugaaacaaauaaagcugaacaauguugugaggaaacagccuccucaauuucuuuacauggcaaggguaguuuucgguuuucauauuccaaaaaugaaacuuaccaacuauuuuugucauauucuucaaagaaggaaaaaauguuucugcaugugaaaggagaaauucaucugggaagauuuguaaugagaaaucgcgauguugugcucacaacaacuuuuguggaugauauaaaagcuuugccaacuaccuaugaaaagggagaauauuuugccuuuuuggaaaccuauggaacucacuacaguagcucugggucucuaggaggacucuaugaacuaauauauguuuuggauaaagcuuccaugaagcggaaagguguugaacuaaaagacauaaagagaugccuuggguaucaucuggauguaucucuggcuuucucugaaaucucuguuggagcugaauuuaauaaagaugauuguguaaagaggggagaggguagagcuguaaacaucaccagugaaaaccucauagaugauguuguuucacucauaagagguggaaccagaaaauaugcauuugaacugaaagaaaagcuucuccgaggaaccgugauugaugugacugacuuugucaacugggccucuuccauaaaugaugcuccuguucucauuagucaaaaacugucuccuauauauaaucugguuccagugaaaaugaaaaaugcacaccuaaagaaacaaaacuuggaaagagccauugaagacuauaucaaugaauuuaguguaagaaaaugccacacaugccaaaauggagguacagugauucuaauggauggaaaguguuugugugccugcccauucaaauuugagggaauugccugugaaaucaguaaacaaaaaauuucugaaggauugccagcccuagaguuccccaaugaaaaauag

SEQ ID NO: 8075 - RNA, 1680 nt, Artificial Sequence
  derived and/or modified sequence opt1 from complement_system_component_C9__Homo_sapiens__EAW55986
augagcgccugcugguccuucgccguggcgaucugcauccuggagaucagcauccucaccgcccaguacaccacguccuacgaccccgagcugaccgagagcuccggcagcgccucccacaucgacugccgcaugagcccgugguccgaguggagccagugcgaccccugccugcggcagauguuccgcucccggagcaucgaggucuucgggcaguucaacggcaagcgcugcaccgacgccgugggggaccggcgccagugcgugcccaccgagcccugcgaggacgccgaggacgacugcggcaacgacuuccagugcuccacggggcggugcaucaagaugcgccuccggugcaacggcgacaacgacugcggcgacuucagcgacgaggacgacugcgaguccgagccgcgcccgcccugccgggaccgcgucguggaggagagcgagcuggcgcggaccgccggguacggcaucaacauccuggggauggacccccucuccacccccuucgacaacgaguucuacaacggccugugcaaccgcgaccgggacgggaacacccugacguacuaccgccggcccuggaacguggccagccucaucuacgagaccaagggcgagaagaacuuccgcaccgagcacuacgaggagcagaucgaggccuucaaguccaucauccaggagaagaccagcaacuucaacgcggccaucagccugaaguucacgcccaccgagaccaacaaggccgagcagugcugcgaggagaccgccuccagcaucucccugcacggcaaggggagcuuccgguucuccuacagcaagaacgagacguaccagcuguuccucuccuacagcuccaagaaggagaagauguuccugcacgucaagggcgagauccaccucgggcgcuucgugaugcggaaccgcgacgugguccugaccaccaccuucguggacgacaucaaggcccugcccacgaccuacgagaagggcgaguacuucgcguuccucgagaccuacggcacccacuacagcuccagcgggucccugggcgggcuguacgagcucaucuacgugcuggacaaggccagcaugaagcgcaagggcgucgagcugaaggacaucaagcggugccucggguaccaccuggacgugucccuggccuucagcgagaucuccgugggcgccgaguucaacaaggacgacugcgucaagcgcggcgaggggcgggccgugaacaucacgagcgagaaccucaucgacgacguggucucccugauccgcggcgggacccggaaguacgcguucgagcugaaggagaagcuccugcgcggcaccgugaucgacgugaccgacuucgucaacugggccagcagcaucaacgacgccccggugcugaucucccagaagcucagccccaucuacaaccuggugcccgucaagaugaagaacgcccaccugaagaagcagaaccucgagcgggccaucgaggacuacaucaacgaguucuccgugcgcaagugccacacgugccagaacgggggcaccgucauccugauggacggcaagugccugugcgcgugccccuucaaguucgaggggaucgccugcgagaucagcaagcagaagaucuccgagggccucccggcccuggaguuccccaacgagaaguga

SEQ ID NO: 8076 - RNA, 1680 nt, Artificial Sequence
  derived and/or modified sequence opt2 from complement_system_component_C9__Homo_sapiens__EAW55986
auguccgccugcugguccuucgccgucgccaucugcauccucgagaucuccauccucaccgcccaguacaccaccuccuacgaccccgagcucaccgaguccuccggcuccgccucccacaucgacugccgcaugucccccugguccgaguggucccagugcgaccccugccuccgccagauguuccgcucccgcuccaucgaggucuucggccaguucaacggcaagcgcugcaccgacgccgucggcgaccgccgccagugcguccccaccgagcccugcgaggacgccgaggacgacugcggcaacgacuuccagugcuccaccggccgcugcaucaagaugcgccuccgcugcaacggcgacaacgacugcggcgacuucuccgacgaggacgacugcgaguccgagccccgcccccccugccgcgaccgcgucgucgaggaguccgagcucgcccgcaccgccggcuacggcaucaacauccucggcauggacccccucuccacccccuucgacaacgaguucuacaacggccucugcaaccgcgaccgcgacggcaacacccucaccuacuaccgccgccccuggaacgucgccucccucaucuacgagaccaagggcgagaagaacuuccgcaccgagcacuacgaggagcagaucgaggccuucaaguccaucauccaggagaagaccuccaacuucaacgccgccaucucccucaaguucacccccaccgagaccaacaaggccgagcagugcugcgaggagaccgccuccuccaucucccuccacggcaagggcuccuuccgcuucuccuacuccaagaacgagaccuaccagcucuuccucuccuacuccuccaagaaggagaagauguuccuccacgucaagggcgagauccaccucggccgcuucgucaugcgcaaccgcgacgucguccucaccaccaccuucgucgacgacaucaaggcccuccccaccaccuacgagaagggcgaguacuucgccuuccucgagaccuacggcacccacuacuccuccuccggcucccucggcggccucuacgagcucaucuacguccucgacaaggccuccaugaagcgcaagggcgucgagcucaaggacaucaagcgcugccucggcuaccaccucgacgucucccucgccuucuccgagaucuccgucggcgccgaguucaacaaggacgacugcgucaagcgcggcgagggccgcgccgucaacaucaccuccgagaaccucaucgacgacgucgucucccucauccgcggcggcacccgcaaguacgccuucgagcucaaggagaagcuccuccgcggcaccgucaucgacgucaccgacuucgucaacugggccuccuccaucaacgacgcccccguccucaucucccagaagcucucccccaucuacaaccucguccccgucaagaugaagaacgcccaccucaagaagcagaaccucgagcgcgccaucgaggacuacaucaacgaguucuccguccgcaagugccacaccugccagaacggcggcaccgucauccucauggacggcaagugccucugcgccugccccuucaaguucgagggcaucgccugcgagaucuccaagcagaagaucuccgagggccuccccgcccucgaguuccccaacgagaaguga

SEQ ID NO: 8077 - RNA, 1680 nt, Artificial Sequence
  derived and/or modified sequence opt3 from complement_system_component_C9__Homo_sapiens__EAW55986
augagcgccugcugguccuucgcuguggcaaucuguauucuggagauaucuauccucaccgcccaauacacaacuucauaugaccccgaacuuacggagaguagcggcuccgcgucucacauugauugcagaaugucgccuuggucagaauggagccaaugugacccaugccugaggcagauguuucggagucgcuccaucgaggucuucgggcaguuuaacggaaagcgauguaccgaugcuguuggugaccguagacagugcgugccgacagaacccugugaggaugccgaggacgauugcggcaaugacuuccaauguucuacugggaggugcauuaaaaugcgguugcgcuguaacggagauaaugacugcggcgauuuuagcgacgaagaugacugcgaguccgaaccuagaccacccuguagggaccggguaguggaggagucagaauuagcacgcaccgccgguuacgggaucaacauacugggaauggauccucuaaguacaccauucgacaaugaguuuuauaacggccucugcaaucgagauagagacggcaacacccugacuuacuauaggcggcccuggaaugucgcuagccuuaucuacgaaacaaagggggagaaaaacuuccguaccgaacauuaugaggagcagauugaagcauuuaagucuaucauucaggagaaaacguccaauuucaacgccgcuaucucacugaaguuuacuccuaccgaaacaaauaaggccgagcaguguugcgaagagacugcgagcaguauaucuuugcacggaaaagguuccuuccgcuuuagcuacucgaagaacgagaccuaccaacucuuccugucuuauuccaguaaaaaggagaaaauguuccugcaugugaagggcgaaauucaccucgggagauuuguuaugaggaaucgggauguggucuuaacaaccacguucguggacgauaucaaggcacugccaacuacauacgaaaaaggagaguauuuugccuuccuugaaaccuacggcacucauuauucaagcuccgguucuuugggagggcuguacgagcuaauuuauguacucgacaaggcuagcaugaaacgaaagggcguugagcugaaagauaucaagcgcugucuuggcuaccaccuggacgugucauuggccuuuagugaaaucuccgucggggcagaguucaacaaagaugacugcgugaagagaggagaagguagggcugugaacauuacaagcgagaaucucauagacgaugucguuucucugauccggggcgggacccgcaaguacgccuuugaguuaaaagaaaagcugcucagaggaacggugauugacguaaccgauuucgugaacugggcgucaaguaucaaugacgccccgguccuuauaagccagaaacugucccccauuuauaacuuggugccuguuaagaugaaaaaugcacaccuaaagaagcagaaccuggagagggcuaucgaagauuacaucaaugaguuuucugugcguaaaugucauacaugccagaacggcgguacugucauucucauggacgggaagugucugugcgccuguccauucaaauuugaaggcaucgcuugcgagauuucgaagcagaaaauaagcgagggacuucccgcccuggaguucccuaaugaaaaguga

SEQ ID NO: 8078 - RNA, 1680 nt, Artificial Sequence
  derived and/or modified sequence opt4 from complement_system_component_C9__Homo_sapiens__EAW55986
augagcgccugcuggagcuucgccguggccaucugcauccuggagaucagcauccugaccgcccaguacaccaccagcuacgaccccgagcugaccgagagcagcggcagcgccagccacaucgacugcagaaugagccccuggagcgaguggagccagugcgaccccugccugagacagauguucagaagcagaagcaucgagguguucggccaguucaacggcaagagaugcaccgacgccgugggcgacagaagacagugcgugcccaccgagcccugcgaggacgccgaggacgacugcggcaacgacuuccagugcagcaccggcagaugcaucaagaugagacugagaugcaacggcgacaacgacugcggcgacuucagcgacgaggacgacugcgagagcgagcccagaccccccugcagagacagagugguggaggagagcgagcuggccagaaccgccggcuacggcaucaacauccugggcauggacccccugagcacccccuucgacaacgaguucuacaacggccugugcaacagagacagagacggcaacacccugaccuacuacagaagacccuggaacguggccagccugaucuacgagaccaagggcgagaagaacuucagaaccgagcacuacgaggagcagaucgaggccuucaagagcaucauccaggagaagaccagcaacuucaacgccgccaucagccugaaguucacccccaccgagaccaacaaggccgagcagugcugcgaggagaccgccagcagcaucagccugcacggcaagggcagcuucagauucagcuacagcaagaacgagaccuaccagcuguuccugagcuacagcagcaagaaggagaagauguuccugcacgugaagggcgagauccaccugggcagauucgugaugagaaacagagacguggugcugaccaccaccuucguggacgacaucaaggcccugcccaccaccuacgagaagggcgaguacuucgccuuccuggagaccuacggcacccacuacagcagcagcggcagccugggcggccuguacgagcugaucuacgugcuggacaaggccagcaugaagagaaagggcguggagcugaaggacaucaagagaugccugggcuaccaccuggacgugagccuggccuucagcgagaucagcgugggcgccgaguucaacaaggacgacugcgugaagagaggcgagggcagagccgugaacaucaccagcgagaaccugaucgacgacguggugagccugaucagaggcggcaccagaaaguacgccuucgagcugaaggagaagcugcugagaggcaccgugaucgacgugaccgacuucgugaacugggccagcagcaucaacgacgcccccgugcugaucagccagaagcugagccccaucuacaaccuggugcccgugaagaugaagaacgcccaccugaagaagcagaaccuggagagagccaucgaggacuacaucaacgaguucagcgugagaaagugccacaccugccagaacggcggcaccgugauccugauggacggcaagugccugugcgccugccccuucaaguucgagggcaucgccugcgagaucagcaagcagaagaucagcgagggccugcccgcccuggaguuccccaacgagaaguga

SEQ ID NO: 8079 - RNA, 1680 nt, Artificial Sequence
  derived and/or modified sequence opt5 from complement_system_component_C9__Homo_sapiens__EAW55986
augagcgccugcugguccuucgcuguggccaucuguauucuggagaucucuauucucaccgcgcaauacacaacgagcuaugaccccgaacugaccgaguccucuggcagcgcuucccacaucgauugcagaaugucuccuuggagcgaauggucccaaugugacccgugccuucggcagauguuucgcagcagaucuauugaggucuucgggcaguuuaacggaaagcgguguacagaugccguuggcgaccgcagacagugcgugcccaccgaaccuugugaggaugccgaggacgauugcgggaaugacuuccaauguuccacaggacggugcaucaaaaugcgccugagauguaacggcgauaaugacugcggggauuuuagcgacgaagaugacugcgagucugaaccccggccucccugucgcgacagaguggucgaggaguccgaacucgcucggaccgccggauacggcaucaacauucugggcauggauccucuuagcacaccguucgacaaugaguuuuauaacgggcugugcaaucgcgauagagacggaaacacccucacguacuaucggcgccccuggaauguggcuucucugaucuacgaaaccaagggcgagaaaaacuucagaacagaacauuaugaggagcagauugaagccuuuaaguccaucauucaggagaaaaccagcaauuucaacgcggccaucucccugaaguuuacaccuaccgaaacgaauaaggcugagcaguguugcgaagagacagccucuagcauuucccuccacgggaaaggcagcuuccgguuuucuuacuccaagaacgagaccuaccaacuguuccuuagcuauucuagcaaaaaggagaaaauguuccugcauguuaagggagaaauccaccucgggagauuugugaugcgcaaucgggaugucgugcugacaaccaccuucguugacgauaucaaggcccuucccacaacguacgaaaaaggagaguauuuugcuuuccuggaaaccuacggcacacauuauuccucuagcggcucccucgggggacuguacgagcugauuuaugugcucgacaaggcgagcaugaaaagaaagggcgucgagcugaaagauaucaagcgcugucuuggguaccaccuggacgugucucucgccuuuuccgaaauuagcgugggagcugaguucaacaaagaugacugcgucaagcggggcgaagggagagccguuaacaucaccucugagaaucugauugacgauguggugucccuuauccgcggaggcacacggaaguacgcuuuugagcugaaagaaaagcuccugagaggcaccgucaucgacgugacggauuucguuaacugggccagcuccauuaaugacgccccugugcugaucucucagaaacucagccccauuuauaaccuggucccggugaagaugaaaaaugcucaccuuaagaagcagaaccuggagcgcgcgaucgaagauuacauuaaugaguuuuccguucggaaaugucauacaugccagaacgggggaaccgugauccucauggacggcaagugucugugcgccuguccuuucaaauuugaagggaucgcuugcgagauuucuaagcagaaaaucagcgagggacuucccgcccuggaguucccuaaugaaaaguga

SEQ ID NO: 8080 - protein, 559 aa, Artificial Sequence
  complement_system_component_C9__Homo_sapiens__P02748
MSACRSFAVAICILEISILTAQYTTSYDPELTESSGSASHIDCRMSPWSEWSQCDPCLRQMFRSRSIEVFGQFNGKRCTDAVGDRRQCVPTEPCEDAEDDCGNDFQCSTGRCIKMRLRCNGDNDCGDFSDEDDCESEPRPPCRDRVVEESELARTAGYGINILGMDPLSTPFDNEFYNGLCNRDRDGNTLTYYRRPWNVASLIYETKGEKNFRTEHYEEQIEAFKSIIQEKTSNFNAAISLKFTPTETNKAEQCCEETASSISLHGKGSFRFSYSKNETYQLFLSYSSKKEKMFLHVKGEIHLGRFVMRNRDVVLTTTFVDDIKALPTTYEKGEYFAFLETYGTHYSSSGSLGGLYELIYVLDKASMKRKGVELKDIKRCLGYHLDVSLAFSEISVGAEFNKDDCVKRGEGRAVNITSENLIDDVVSLIRGGTRKYAFELKEKLLRGTVIDVTDFVNWASSINDAPVLISQKLSPIYNLVPVKMKNAHLKKQNLERAIEDYINEFSVRKCHTCQNGGTVILMDGKCLCACPFKFEGIACEISKQKISEGLPALEFPNEK

SEQ ID NO: 8081 - RNA, 1680 nt, Artificial Sequence
  complement_system_component_C9__Homo_sapiens__AAH20721
augucagccugccggagcuuugcaguugcaaucugcauuuuagaaauaagcauccucacagcacaguacacgaccaguuaugacccagagcuaacagaaagcaguggcucugcaucacacauagacugcagaaugagccccuggagugaauggucacaaugcgauccuugucucagacaaauguuucguucaagaagcauugaggucuuuggacaauuuaaugggaaaagaugcaccgacgcugugggagacagacgacagugugugcccacagagcccugugaggaugcugaggaugacugcggaaaugacuuucaaugcaguacaggcagaugcauaaagaugcgacuucgguguaauggugacaaugacugcggagacuuuucagaugaggaugauugugaaagugagccccguccccccugcagagacagagugguagaagagucugagcuggcacgaacagcaggcuaugggaucaacauuuuagggauggauccccuaagcacaccuuuugacaaugaguucuacaauggacucuguaaccgggaucgggauggaaacacucugacauacuaccgaagaccuuggaacguggcuucuuugaucuaugaaaccaaaggcgagaaaaauuucagaaccgaacauuacgaagaacaaauugaagcauuuaaaaguaucauccaagagaagacaucaaauuuuaaugcagcuauaucucuaaaauuuacacccacugaaacaaauaaagcugaacaauguugugaggaaacagccuccucaauuucuuuacauggcaaggguaguuuucgguuuucauauuccaaaaaugaaacuuaccaacuauuuuugucauauucuucaaagaaggaaaaaauguuucugcaugugaaaggagaaauucaucugggaagauuuguaaugagaaaucgcgauguugugcucacaacaacuuuuguggaugauauaaaagcuuugccaacuaccuaugaaaagggagaauauuuugccuuuuuggaaaccuauggaacucacuacaguagcucugggucucuaggaggacucuaugaacuaauauauguuuuggauaaagcuuccaugaagcggaaagguguugaacuaaaagacauaaagagaugccuuggguaucaucuggauguaucucuggcuuucucugaaaucucuguuggagcugaauuuaauaaagaugauuguguaaagaggggagaggguagagcuguaaacaucaccagugaaaaccucauagaugauguuguuucacucauaagagguggaaccagaaaauaugcauuugaacugaaagaaaagcuucuccgaggaaccgugauugaugugacugacuuugucaacugggccucuuccauaaaugaugcuccuguucucauuagucaaaaacugucuccuauauauaaucugguuccagugaaaaugaaaaaugcacaccuaaagaaacaaaacuuggaaagagccauugaagacuauaucaaugaauuuaguguaagaaaaugccacacaugccaaaauggagguacagugauucuaauggauggaaaguguuugugugccugcccauucaaauuugagggaauugccugugaaaucaguaaacaaaaaauuucugaaggauugccagcccuagaguuccccaaugaaaaauag

SEQ ID NO: 8082 - RNA, 1680 nt, Artificial Sequence
  derived and/or modified sequence opt1 from complement_system_component_C9__Homo_sapiens__AAH20721
augagcgccugccgcuccuucgccguggcgaucugcauccuggagaucagcauccucaccgcccaguacaccacguccuacgaccccgagcugaccgagagcuccggcagcgccucccacaucgacugccggaugagcccgugguccgaguggagccagugcgaccccugccugcgccagauguuccggucccgcagcaucgaggucuucgggcaguucaacggcaagcggugcaccgacgccgugggggaccgccggcagugcgugcccaccgagcccugcgaggacgccgaggacgacugcggcaacgacuuccagugcuccacggggcgcugcaucaagaugcggcuccgcugcaacggcgacaacgacugcggcgacuucagcgacgaggacgacugcgaguccgagccgcggccgcccugccgcgaccgggucguggaggagagcgagcuggcgcgcaccgccggguacggcaucaacauccuggggauggacccccucuccacccccuucgacaacgaguucuacaacggccugugcaaccgggaccgcgacgggaacacccugacguacuaccggcgccccuggaacguggccagccucaucuacgagaccaagggcgagaagaacuuccggaccgagcacuacgaggagcagaucgaggccuucaaguccaucauccaggagaagaccagcaacuucaacgcggccaucagccugaaguucacgcccaccgagaccaacaaggccgagcagugcugcgaggagaccgccuccagcaucucccugcacggcaaggggagcuuccgcuucuccuacagcaagaacgagacguaccagcuguuccucuccuacagcuccaagaaggagaagauguuccugcacgucaagggcgagauccaccucgggcgguucgugaugcgcaaccgcgacgugguccugaccaccaccuucguggacgacaucaaggcccugcccacgaccuacgagaagggcgaguacuucgcguuccucgagaccuacggcacccacuacagcuccagcgggucccugggcgggcuguacgagcucaucuacgugcuggacaaggccagcaugaagcggaagggcgucgagcugaaggacaucaagcgcugccucggguaccaccuggacgugucccuggccuucagcgagaucuccgugggcgccgaguucaacaaggacgacugcgucaagcggggcgaggggcgcgccgugaacaucacgagcgagaaccucaucgacgacguggucucccugauccggggcgggacccgcaaguacgcguucgagcugaaggagaagcuccugcggggcaccgugaucgacgugaccgacuucgucaacugggccagcagcaucaacgacgccccggugcugaucucccagaagcucagccccaucuacaaccuggugcccgucaagaugaagaacgcccaccugaagaagcagaaccucgagcgcgccaucgaggacuacaucaacgaguucuccgugcggaagugccacacgugccagaacgggggcaccgucauccugauggacggcaagugccugugcgcgugccccuucaaguucgaggggaucgccugcgagaucagcaagcagaagaucuccgagggccucccggcccuggaguuccccaacgagaaguga

SEQ ID NO: 8083 - RNA, 1680 nt, Artificial Sequence
  derived and/or modified sequence opt2 from complement_system_component_C9__Homo_sapiens__AAH20721
auguccgccugccgcuccuucgccgucgccaucugcauccucgagaucuccauccucaccgcccaguacaccaccuccuacgaccccgagcucaccgaguccuccggcuccgccucccacaucgacugccgcaugucccccugguccgaguggucccagugcgaccccugccuccgccagauguuccgcucccgcuccaucgaggucuucggccaguucaacggcaagcgcugcaccgacgccgucggcgaccgccgccagugcguccccaccgagcccugcgaggacgccgaggacgacugcggcaacgacuuccagugcuccaccggccgcugcaucaagaugcgccuccgcugcaacggcgacaacgacugcggcgacuucuccgacgaggacgacugcgaguccgagccccgcccccccugccgcgaccgcgucgucgaggaguccgagcucgcccgcaccgccggcuacggcaucaacauccucggcauggacccccucuccacccccuucgacaacgaguucuacaacggccucugcaaccgcgaccgcgacggcaacacccucaccuacuaccgccgccccuggaacgucgccucccucaucuacgagaccaagggcgagaagaacuuccgcaccgagcacuacgaggagcagaucgaggccuucaaguccaucauccaggagaagaccuccaacuucaacgccgccaucucccucaaguucacccccaccgagaccaacaaggccgagcagugcugcgaggagaccgccuccuccaucucccuccacggcaagggcuccuuccgcuucuccuacuccaagaacgagaccuaccagcucuuccucuccuacuccuccaagaaggagaagauguuccuccacgucaagggcgagauccaccucggccgcuucgucaugcgcaaccgcgacgucguccucaccaccaccuucgucgacgacaucaaggcccuccccaccaccuacgagaagggcgaguacuucgccuuccucgagaccuacggcacccacuacuccuccuccggcucccucggcggccucuacgagcucaucuacguccucgacaaggccuccaugaagcgcaagggcgucgagcucaaggacaucaagcgcugccucggcuaccaccucgacgucucccucgccuucuccgagaucuccgucggcgccgaguucaacaaggacgacugcgucaagcgcggcgagggccgcgccgucaacaucaccuccgagaaccucaucgacgacgucgucucccucauccgcggcggcacccgcaaguacgccuucgagcucaaggagaagcuccuccgcggcaccgucaucgacgucaccgacuucgucaacugggccuccuccaucaacgacgcccccguccucaucucccagaagcucucccccaucuacaaccucguccccgucaagaugaagaacgcccaccucaagaagcagaaccucgagcgcgccaucgaggacuacaucaacgaguucuccguccgcaagugccacaccugccagaacggcggcaccgucauccucauggacggcaagugccucugcgccugccccuucaaguucgagggcaucgccugcgagaucuccaagcagaagaucuccgagggccuccccgcccucgaguuccccaacgagaaguga

SEQ ID NO: 8084 - RNA, 1680 nt, Artificial Sequence
  derived and/or modified sequence opt3 from complement_system_component_C9__Homo_sapiens__AAH20721
augagcgccugcagauccuucgcuguggcaaucuguauucuggagauaucuauccucaccgcccaauacacaacuucauaugaccccgaacuuacggagaguagcggcuccgcgucucacauugauugcaggaugucgccuuggucagaauggagccaaugugacccaugccugcggcagauguuucgcagucgauccaucgaggucuucgggcaguuuaacggaaagcguuguaccgaugcuguuggugacagaaggcagugcgugccgacagaacccugugaggaugccgaggacgauugcggcaaugacuuccaauguucuacugggcggugcauuaaaaugcgcuugagauguaacggagauaaugacugcggcgauuuuagcgacgaagaugacugcgaguccgaaccuaggccacccugucgggaccgcguaguggaggagucagaauuagcacgaaccgccgguuacgggaucaacauacugggaauggauccucuaaguacaccauucgacaaugaguuuuauaacggccucugcaauagagauagggacggcaacacccugacuuacuaucggcgucccuggaaugucgcuagccuuaucuacgaaacaaagggggagaaaaacuuccgcaccgaacauuaugaggagcagauugaagcauuuaagucuaucauucaggagaaaacguccaauuucaacgccgcuaucucacugaaguuuacuccuaccgaaacaaauaaggccgagcaguguugcgaagagacugcgagcaguauaucuuugcacggaaaagguuccuucagauuuagcuacucgaagaacgagaccuaccaacucuuccugucuuauuccaguaaaaaggagaaaauguuccugcaugugaagggcgaaauucaccucgggagguuuguuaugcggaaucgagauguggucuuaacaaccacguucguggacgauaucaaggcacugccaacuacauacgaaaaaggagaguauuuugccuuccuugaaaccuacggcacucauuauucaagcuccgguucuuugggagggcuguacgagcuaauuuauguacucgacaaggcuagcaugaaacgcaagggcguugagcugaaagauaucaagagaugucuuggcuaccaccuggacgugucauuggccuuuagugaaaucuccgucggggcagaguucaacaaagaugacugcgugaagaggggagaaggucgggcugugaacauuacaagcgagaaucucauagacgaugucguuucucugauccgcggcgggaccagaaaguacgccuuugaguuaaaagaaaagcugcucaggggaacggugauugacguaaccgauuucgugaacugggcgucaaguaucaaugacgccccgguccuuauaagccagaaacugucccccauuuauaacuuggugccuguuaagaugaaaaaugcacaccuaaagaagcagaaccuggagcgugcuaucgaagauuacaucaaugaguuuucugugcggaaaugucauacaugccagaacggcgguacugucauucucauggacgggaagugucugugcgccuguccauucaaauuugaaggcaucgcuugcgagauuucgaagcagaaaauaagcgagggacuucccgcccuggaguucccuaaugaaaaguga

SEQ ID NO: 8085 - RNA, 1680 nt, Artificial Sequence
  derived and/or modified sequence opt4 from complement_system_component_C9__Homo_sapiens__AAH20721
augagcgccugcagaagcuucgccguggccaucugcauccuggagaucagcauccugaccgcccaguacaccaccagcuacgaccccgagcugaccgagagcagcggcagcgccagccacaucgacugcagaaugagccccuggagcgaguggagccagugcgaccccugccugagacagauguucagaagcagaagcaucgagguguucggccaguucaacggcaagagaugcaccgacgccgugggcgacagaagacagugcgugcccaccgagcccugcgaggacgccgaggacgacugcggcaacgacuuccagugcagcaccggcagaugcaucaagaugagacugagaugcaacggcgacaacgacugcggcgacuucagcgacgaggacgacugcgagagcgagcccagaccccccugcagagacagagugguggaggagagcgagcuggccagaaccgccggcuacggcaucaacauccugggcauggacccccugagcacccccuucgacaacgaguucuacaacggccugugcaacagagacagagacggcaacacccugaccuacuacagaagacccuggaacguggccagccugaucuacgagaccaagggcgagaagaacuucagaaccgagcacuacgaggagcagaucgaggccuucaagagcaucauccaggagaagaccagcaacuucaacgccgccaucagccugaaguucacccccaccgagaccaacaaggccgagcagugcugcgaggagaccgccagcagcaucagccugcacggcaagggcagcuucagauucagcuacagcaagaacgagaccuaccagcuguuccugagcuacagcagcaagaaggagaagauguuccugcacgugaagggcgagauccaccugggcagauucgugaugagaaacagagacguggugcugaccaccaccuucguggacgacaucaaggcccugcccaccaccuacgagaagggcgaguacuucgccuuccuggagaccuacggcacccacuacagcagcagcggcagccugggcggccuguacgagcugaucuacgugcuggacaaggccagcaugaagagaaagggcguggagcugaaggacaucaagagaugccugggcuaccaccuggacgugagccuggccuucagcgagaucagcgugggcgccgaguucaacaaggacgacugcgugaagagaggcgagggcagagccgugaacaucaccagcgagaaccugaucgacgacguggugagccugaucagaggcggcaccagaaaguacgccuucgagcugaaggagaagcugcugagaggcaccgugaucgacgugaccgacuucgugaacugggccagcagcaucaacgacgcccccgugcugaucagccagaagcugagccccaucuacaaccuggugcccgugaagaugaagaacgcccaccugaagaagcagaaccuggagagagccaucgaggacuacaucaacgaguucagcgugagaaagugccacaccugccagaacggcggcaccgugauccugauggacggcaagugccugugcgccugccccuucaaguucgagggcaucgccugcgagaucagcaagcagaagaucagcgagggccugcccgcccuggaguuccccaacgagaaguga

SEQ ID NO: 8086 - RNA, 1680 nt, Artificial Sequence
  derived and/or modified sequence opt5 from complement_system_component_C9__Homo_sapiens__AAH20721
augagcgccugcagauccuucgcuguggccaucuguauucuggagaucucuauucucaccgcgcaauacacaacgagcuaugaccccgaacugaccgaguccucuggcagcgcuucccacaucgauugccggaugucuccuuggagcgaauggucccaaugugacccgugccuucgccagauguuuagaagccggucuauugaggucuucgggcaguuuaacggaaagcgcuguacagaugccguuggcgacagacggcagugcgugcccaccgaaccuugugaggaugccgaggacgauugcgggaaugacuuccaauguuccacaggacgcugcaucaaaaugagacugcgguguaacggcgauaaugacugcggggauuuuagcgacgaagaugacugcgagucugaaccccgcccucccuguagagaccggguggucgaggaguccgaacucgcucgcaccgccggauacggcaucaacauucugggcauggauccucuuagcacaccguucgacaaugaguuuuauaacgggcugugcaauagagaucgggacggaaacacccucacguacuaucgcagacccuggaauguggcuucucugaucuacgaaaccaagggcgagaaaaacuuccggacagaacauuaugaggagcagauugaagccuuuaaguccaucauucaggagaaaaccagcaauuucaacgcggccaucucccugaaguuuacaccuaccgaaacgaauaaggcugagcaguguugcgaagagacagccucuagcauuucccuccacgggaaaggcagcuucagauuuucuuacuccaagaacgagaccuaccaacuguuccuuagcuauucuagcaaaaaggagaaaauguuccugcauguuaagggagaaauccaccucgggcgcuuugugaugcggaauagagaugucgugcugacaaccaccuucguugacgauaucaaggcccuucccacaacguacgaaaaaggagaguauuuugcuuuccuggaaaccuacggcacacauuauuccucuagcggcucccucgggggacuguacgagcugauuuaugugcucgacaaggcgagcaugaaacgcaagggcgucgagcugaaagauaucaagcggugucuuggguaccaccuggacgugucucucgccuuuuccgaaauuagcgugggagcugaguucaacaaagaugacugcgucaagagaggcgaagggcgcgccguuaacaucaccucugagaaucugauugacgauguggugucccuuauccggggaggcacaagaaaguacgcuuuugagcugaaagaaaagcuccugcgcggcaccgucaucgacgugacggauuucguuaacugggccagcuccauuaaugacgccccugugcugaucucucagaaacucagccccauuuauaaccuggucccggugaagaugaaaaaugcucaccuuaagaagcagaaccuggagcgggcgaucgaagauuacauuaaugaguuuuccguuagaaaaugucauacaugccagaacgggggaaccgugauccucauggacggcaagugucugugcgccuguccuuucaaauuugaagggaucgcuugcgagauuucuaagcagaaaaucagcgagggacuucccgcccuggaguucccuaaugaaaaguga

SEQ ID NO: 8087 - protein, 1033 aa, Artificial Sequence
  complement_system_component_CR2__Homo_sapiens__P20023
MGAAGLLGVFLALVAPGVLGISCGSPPPILNGRISYYSTPIAVGTVIRYSCSGTFRLIGEKSLLCITKDKVDGTWDKPAPKCEYFNKYSSCPEPIVPGGYKIRGSTPYRHGDSVTFACKTNFSMNGNKSVWCQANNMWGPTRLPTCVSVFPLECPALPMIHNGHHTSENVGSIAPGLSVTYSCESGYLLVGEKIINCLSSGKWSAVPPTCEEARCKSLGRFPNGKVKEPPILRVGVTANFFCDEGYRLQGPPSSRCVIAGQGVAWTKMPVCEEIFCPSPPPILNGRHIGNSLANVSYGSIVTYTCDPDPEEGVNFILIGESTLRCTVDSQKTGTWSGPAPRCELSTSAVQCPHPQILRGRMVSGQKDRYTYNDTVIFACMFGFTLKGSKQIRCNAQGTWEPSAPVCEKECQAPPNILNGQKEDRHMVRFDPGTSIKYSCNPGYVLVGEESIQCTSEGVWTPPVPQCKVAACEATGRQLLTKPQHQFVRPDVNSSCGEGYKLSGSVYQECQGTIPWFMEIRLCKEITCPPPPVIYNGAHTGSSLEDFPYGTTVTYTCNPGPERGVEFSLIGESTIRCTSNDQERGTWSGPAPLCKLSLLAVQCSHVHIANGYKISGKEAPYFYNDTVTFKCYSGFTLKGSSQIRCKADNTWDPEIPVCEKETCQHVRQSLQELPAGSRVELVNTSCQDGYQLTGHAYQMCQDAENGIWFKKIPLCKVIHCHPPPVIVNGKHTGMMAENFLYGNEVSYECDQGFYLLGEKKLQCRSDSKGHGSWSGPSPQCLRSPPVTRCPNPEVKHGYKLNKTHSAYSHNDIVYVDCNPGFIMNGSRVIRCHTDNTWVPGVPTCIKKAFIGCPPPPKTPNGNHTGGNIARFSPGMSILYSCDQGYLLVGEALLLCTHEGTWSQPAPHCKEVNCSSPADMDGIQKGLEPRKMYQYGAVVTLECEDGYMLEGSPQSQCQSDHQWNPPLAVCRSRSLAPVLCGIAAGLILLTFLIVITLYVISKHRARNYYTDTSQKEAFHLEAREVYSVDPYNPAS

SEQ ID NO: 8088 - RNA, 3102 nt, Artificial Sequence
  complement_system_component_CR2__Homo_sapiens__CCDS1478.1
augggcgccgcgggccugcucgggguuuucuuggcucucgucgcaccggggguccucgggauuucuuguggcucuccuccgccuauccuaaauggccggauuaguuauuauucuacccccauugcuguugguaccgugauaagguacaguuguucagguaccuuccgccucauuggagaaaaaagucuauuaugcauaacuaaagacaaaguggauggaaccugggauaaaccugcuccuaaaugugaauauuucaauaaauauucuucuugcccugagcccauaguaccaggaggauacaaaauuagaggcucuacacccuacagacauggugauucugugacauuugccuguaaaaccaacuucuccaugaacggaaacaagucuguuuggugucaagcaaauaauaugugggggccgacacgacuaccaaccuguguaaguguuuucccucucgaguguccagcacuuccuaugauccacaauggacaucacacaagugagaauguuggcuccauugcuccaggauugucugugacuuacagcugugaaucugguuacuugcuuguuggagaaaagaucauuaacuguuugucuucgggaaaauggagugcugucccccccacaugugaagaggcacgcuguaaaucucuaggacgauuucccaaugggaagguaaaggagccuccaauucuccggguugguguaacugcaaacuuuuucugugaugaaggguaucgacugcaaggcccaccuucuagucgguguguaauugcuggacagggaguugcuuggaccaaaaugccaguaugugaagaaauuuuuugcccaucaccucccccuauucucaauggaagacauauaggcaacucacuagcaaaugucucauauggaagcauagucacuuacacuugugacccggacccagaggaaggagugaacuucauccuuauuggagagagcacucuccguuguacaguugauagucagaagacugggaccuggaguggcccugccccacgcugugaacuuucuacuucugcgguucaguguccacauccccagauccuaagaggccgaaugguaucugggcagaaagaucgauauaccuauaacgacacugugauauuugcuugcauguuuggcuucaccuugaagggcagcaagcaaauccgaugcaaugcccaaggcacaugggagccaucugcaccagucugugaaaaggaaugccaggccccuccuaacauccucaaugggcaaaaggaagauagacacaugguccgcuuugacccuggaacaucuauaaaauauagcuguaacccuggcuaugugcuggugggagaagaauccauacaguguaccucugaggggguguggacacccccuguaccccaaugcaaaguggcagcgugugaagcuacaggaaggcaacucuugacaaaaccccagcaccaauuuguuagaccagaugucaacucuucuuguggugaaggguacaaguuaagugggaguguuuaucaggagugucaaggcacaauuccuugguuuauggagauucgucuuuguaaagaaaucaccugcccaccacccccuguuaucuacaauggggcacacaccgggaguuccuuagaagauuuuccauauggaaccacggucacuuacacauguaacccugggccagaaagaggaguggaauucagccucauuggagagagcaccauccguuguacaagcaaugaucaagaaagaggcaccuggaguggcccugcuccccuguguaaacuuucccuccuugcuguccagugcucacauguccauauugcaaauggauacaagauaucuggcaaggaagccccauauuucuacaaugacacugugacauucaaguguuauaguggauuuacuuugaagggcaguagucagauucguugcaaagcugauaacaccugggauccugaaauaccaguuugugaaaaagaaacaugccagcaugugagacagagucuucaagaacuuccagcugguucacguguggagcuaguuaauacguccugccaagauggguaccaguugacuggacaugcuuaucagaugugucaagaugcugaaaauggaauuugguucaaaaagauuccacuuuguaaaguuauucacugucacccuccaccagugauugucaaugggaagcacacaggcaugauggcagaaaacuuucuauauggaaaugaagucucuuaugaaugugaccaaggauucuaucuccugggagagaaaaaauugcagugcagaagugauucuaaaggacauggaucuuggagcgggccuuccccacagugcuuacgaucuccuccugugacucgcugcccuaauccagaagucaaacauggguacaagcucaauaaaacacauucugcauauucccacaaugacauaguguauguugacugcaauccuggcuucaucaugaaugguagucgcgugauuaggugucauacugauaacacaugggugccaggugugccaacuuguaucaaaaaagccuucauaggguguccaccuccgccuaagaccccuaacgggaaccauacugguggaaacauagcucgauuuucuccuggaaugucaauccuguacagcugugaccaaggcuaccugcuggugggagaggcacuccuucuuugcacacaugagggaaccuggagccaaccugccccucauuguaaagagguaaacuguagcucaccagcagauauggauggaauccagaaagggcuggaaccaaggaaaauguaucaguauggagcuguuguaacucuggagugugaagauggguauaugcuggaaggcaguccccagagccagugccaaucggaucaccaauggaacccuccccuggcgguuugcagaucccguucacuugcuccuguccuuugugguauugcugcagguuugauacuucuuaccuucuugauugucauuaccuuauacgugauaucaaaacacagagcacgcaauuauuauacagauacaagccagaaagaagcuuuucauuuagaagcacgagaaguauauucuguugauccauacaacccagccagcuga

SEQ ID NO: 8089 - RNA, 3102 nt, Artificial Sequence
  derived and/or modified sequence opt1 from complement_system_component_CR2__Homo_sapiens__CCDS1478.1
augggcgccgccgggcugcucggcguguuccuggcgcuggucgcccccggggugcucggcaucagcugcggguccccgccccccauccugaacggccgcaucagcuacuacuccacccccaucgccgugggcaccgucauccgguacagcugcuccgggacguuccgccugaucggcgagaagagccuccugugcaucaccaaggacaagguggacgggaccugggacaagccggcccccaagugcgaguacuucaacaaguacuccagcugccccgagcccaucgugccgggcggguacaagauccggggcuccacccccuaccgccacggcgacagcgucacguucgccugcaagaccaacuucuccaugaacgggaacaagagcguguggugccaggcgaacaacauguggggccccacccggcugcccaccugcguguccgucuucccgcucgagugccccgcccugcccaugauccacaacgggcaccacacgagcgagaacgugggcuccaucgcccccggccugagcgugaccuacuccugcgagagcggguaccuccuggucggcgagaagaucaucaacugccuguccagcgggaaguggagcgccgugccgcccaccugcgaggaggcgcgcugcaagucccucggccgguuccccaacgggaaggugaaggagcccccgauccugcgcgucggcgugaccgccaacuucuucugcgacgagggcuaccggcugcaggggccccccagcucccgcugcgugaucgccggccagggggucgccuggacgaagaugcccgugugcgaggagaucuucugcccgagccccccccccauccucaacggccggcacaucgggaacucccuggccaacgugagcuacggcuccaucgucaccuacaccugcgacccggaccccgaggagggcgugaacuucauccugaucggggagagcacccuccgcugcacgguggacucccagaagaccggcaccuggagcgggcccgcgccgcggugcgagcuguccaccagcgccguccagugcccccacccccagauccugcgcggccggaugguguccgggcagaaggaccgcuacacguacaacgacaccgucaucuucgccugcauguucggcuucacccucaagggcagcaagcagauccggugcaacgcccaggggaccugggagcccuccgccccggugugcgagaaggagugccaggcgccccccaacauccugaacggccagaaggaggaccgccacauggugcgguucgaccccgggacgagcaucaaguacuccugcaacccgggcuacguccuggugggcgaggagagcauccagugcaccuccgaggggguguggaccccccccgucccccagugcaagguggccgccugcgaggccaccggccgccagcuccugacgaagccgcagcaccaguucgugcggcccgacgucaacagcagcugcggggagggcuacaagcuguccgggagcguguaccaggagugccagggcaccauccccugguucauggagauccgccucugcaaggagaucaccugccccccgccccccgugaucuacaacggcgcccacaccggguccagccuggaggacuuccccuacggcacgaccgucaccuacaccugcaacccggggcccgagcgcggcguggaguucucccugaucggggagagcacgauccggugcaccuccaacgaccaggagcgcggcaccuggagcggccccgcgccccucugcaagcugucccugcucgccgugcagugcagccacguccacaucgccaacggguacaagaucuccggcaaggaggccccguacuucuacaacgacaccgugaccuucaagugcuacagcggguucacgcugaagggcuccagccagauccggugcaaggccgacaacaccugggaccccgagauccccgugugcgagaaggagaccugccagcacguccgccagucccugcaggagcucccggcggggagccggguggagcuggugaacaccuccugccaggacggcuaccagcugacgggccacgccuaccagaugugccaggacgccgagaacgggaucugguucaagaagaucccccucugcaaggucauccacugccacccccccccggugaucgugaacggcaagcacaccgggaugauggccgagaacuuccuguacggcaacgaggucagcuacgagugcgaccagggguucuaccugcucggcgagaagaagcugcagugccgcagcgacuccaagggccacgggagcugguccggccccagcccccagugccugcggucccccccggugacccgcugccccaaccccgaggugaagcacggguacaagcucaacaagacccacagcgcguacucccacaacgacaucgucuacguggacugcaaccccggcuucaucaugaacggcagccgggugauccgcugccacacggacaacaccugggucccgggggugcccaccugcaucaagaaggccuucaucggcugcccccccccgcccaagacccccaacgggaaccacacgggcgggaacaucgcccgguucucccccggcaugagcauccuguacuccugcgaccagggcuaccugcuggugggggaggcccuccugcugugcacccacgagggcaccuggagccagccggccccccacugcaaggaggucaacugcuccagccccgcggacauggacgggauccagaagggccucgagccccgcaagauguaccaguacggggccguggugacccuggagugcgaggacggcuacaugcuggagggcuccccgcagagccagugccaguccgaccaccaguggaaccccccccucgccgucugccggagccgcucccuggcccccgugcugugcgggaucgccgcgggccucauccugcugacguuccucaucgugaucacccuguacgucaucagcaagcaccgggcccgcaacuacuacaccgacaccagccagaaggaggccuuccaccuggaggcccgggagguguacuccguggacccguacaaccccgccagcuga

SEQ ID NO: 8090 - RNA, 3102 nt, Artificial Sequence
  derived and/or modified sequence opt2 from complement_system_component_CR2__Homo_sapiens__CCDS1478.1
augggcgccgccggccuccucggcgucuuccucgcccucgucgcccccggcguccucggcaucuccugcggcucccccccccccauccucaacggccgcaucuccuacuacuccacccccaucgccgucggcaccgucauccgcuacuccugcuccggcaccuuccgccucaucggcgagaagucccuccucugcaucaccaaggacaaggucgacggcaccugggacaagcccgcccccaagugcgaguacuucaacaaguacuccuccugccccgagcccaucguccccggcggcuacaagauccgcggcuccacccccuaccgccacggcgacuccgucaccuucgccugcaagaccaacuucuccaugaacggcaacaaguccgucuggugccaggccaacaacauguggggccccacccgccuccccaccugcgucuccgucuucccccucgagugccccgcccuccccaugauccacaacggccaccacaccuccgagaacgucggcuccaucgcccccggccucuccgucaccuacuccugcgaguccggcuaccuccucgucggcgagaagaucaucaacugccucuccuccggcaagugguccgccgucccccccaccugcgaggaggcccgcugcaagucccucggccgcuuccccaacggcaaggucaaggagccccccauccuccgcgucggcgucaccgccaacuucuucugcgacgagggcuaccgccuccagggcccccccuccucccgcugcgucaucgccggccagggcgucgccuggaccaagaugcccgucugcgaggagaucuucugccccucccccccccccauccucaacggccgccacaucggcaacucccucgccaacgucuccuacggcuccaucgucaccuacaccugcgaccccgaccccgaggagggcgucaacuucauccucaucggcgaguccacccuccgcugcaccgucgacucccagaagaccggcaccugguccggccccgccccccgcugcgagcucuccaccuccgccguccagugcccccacccccagauccuccgcggccgcauggucuccggccagaaggaccgcuacaccuacaacgacaccgucaucuucgccugcauguucggcuucacccucaagggcuccaagcagauccgcugcaacgcccagggcaccugggagcccuccgcccccgucugcgagaaggagugccaggccccccccaacauccucaacggccagaaggaggaccgccacaugguccgcuucgaccccggcaccuccaucaaguacuccugcaaccccggcuacguccucgucggcgaggaguccauccagugcaccuccgagggcgucuggaccccccccgucccccagugcaaggucgccgccugcgaggccaccggccgccagcuccucaccaagccccagcaccaguucguccgccccgacgucaacuccuccugcggcgagggcuacaagcucuccggcuccgucuaccaggagugccagggcaccauccccugguucauggagauccgccucugcaaggagaucaccugcccccccccccccgucaucuacaacggcgcccacaccggcuccucccucgaggacuuccccuacggcaccaccgucaccuacaccugcaaccccggccccgagcgcggcgucgaguucucccucaucggcgaguccaccauccgcugcaccuccaacgaccaggagcgcggcaccugguccggccccgccccccucugcaagcucucccuccucgccguccagugcucccacguccacaucgccaacggcuacaagaucuccggcaaggaggcccccuacuucuacaacgacaccgucaccuucaagugcuacuccggcuucacccucaagggcuccucccagauccgcugcaaggccgacaacaccugggaccccgagauccccgucugcgagaaggagaccugccagcacguccgccagucccuccaggagcuccccgccggcucccgcgucgagcucgucaacaccuccugccaggacggcuaccagcucaccggccacgccuaccagaugugccaggacgccgagaacggcaucugguucaagaagaucccccucugcaaggucauccacugccaccccccccccgucaucgucaacggcaagcacaccggcaugauggccgagaacuuccucuacggcaacgaggucuccuacgagugcgaccagggcuucuaccuccucggcgagaagaagcuccagugccgcuccgacuccaagggccacggcuccugguccggccccuccccccagugccuccgcuccccccccgucacccgcugccccaaccccgaggucaagcacggcuacaagcucaacaagacccacuccgccuacucccacaacgacaucgucuacgucgacugcaaccccggcuucaucaugaacggcucccgcgucauccgcugccacaccgacaacaccuggguccccggcguccccaccugcaucaagaaggccuucaucggcugcccccccccccccaagacccccaacggcaaccacaccggcggcaacaucgcccgcuucucccccggcauguccauccucuacuccugcgaccagggcuaccuccucgucggcgaggcccuccuccucugcacccacgagggcaccuggucccagcccgccccccacugcaaggaggucaacugcuccucccccgccgacauggacggcauccagaagggccucgagccccgcaagauguaccaguacggcgccgucgucacccucgagugcgaggacggcuacaugcucgagggcuccccccagucccagugccaguccgaccaccaguggaaccccccccucgccgucugccgcucccgcucccucgcccccguccucugcggcaucgccgccggccucauccuccucaccuuccucaucgucaucacccucuacgucaucuccaagcaccgcgcccgcaacuacuacaccgacaccucccagaaggaggccuuccaccucgaggcccgcgaggucuacuccgucgaccccuacaaccccgccuccuga

SEQ ID NO: 8091 - RNA, 3102 nt, Artificial Sequence
  derived and/or modified sequence opt3 from complement_system_component_CR2__Homo_sapiens__CCDS1478.1
augggcgccgcugggcugcucggaguguuccuugcacuggucgcccccgguguuuugggcaucagcugcggguccccuccaccgauuuuaaacggaagaauaucuuacuauucaacccccaucgcggugggcacaguaauuagguacaguuguagcgguacuuuucggcugaucggggagaagucccuacucugcauuacgaaagacaagguggauggaaccugggacaaaccugcuccaaagugugaauauuucaauaaauacucuucgugccccgagccuaucgucccaggcggcuauaagauacgcgggucaacacccuaccgacacggagauagcgugacuuuugccuguaagaccaacuucaguaugaaugguaacaaauccguuuggugccaggcaaauaacauguggggcccuacacgucugccaaccugugugucugucuuuccgcuugaaugccccgcccugccuaugauccauaaugggcaccauacuagcgagaacgugggauccauugcuccaggcuugucaguaacauauaguugugaaagcgguuaccuccugguuggggagaagaucauuaauugccugucuuccggaaaauggucagcagugcccccuaccugugaggaagccagaugcaagagccucggcagguucccaaacggcaaagucaaggagcccccgaucuuacgggugggggugacggcuaacuuuuucugcgacgaaggauaccgccugcaagguccucccaguucuagaugugucauagccggccaggggguugcguggacuaagaugccagugugcgaggagaucuuuuguccuuccccaccacccauucuuaauggaaggcacauuggcaauagcuuggcaaacguaucguaugguucuaucgugaccuacacaugcgauccugacccagaagagggggucaauuucauccugauuggcgaauccacucuacgguguaccguggauucacagaaaacaggaaccuggaguggcccggcuccccgcugcgagcucagcacguccgcuguucaguguccucauccacaaauacugcgagggagaauggugucuggacagaaggacagguauacuuacaacgauacagucaucuuugccugcauguucgguuuuacccuuaaaggcagcaagcagauucgguguaacgcacaggggacuugggaacccucagcuccugugugcgagaaagagugucaagccccacccaauauccugaacggacagaaggaagaccgucacaugguacgcuucgauccgggcacaaguauaaaauauuccugcaauccugguuacguuuuggugggggaggaaagcauucagugcaccucugagggcgucuggacgccacccgugccucaguguaaggucgcggccugcgaagcaaccggaagacaacuccugacaaagccccagcaccaguucgugaggccagacguuaacucaaguuguggcgagggguauaaauuaagcggauccguguaccaagagugccaggguacuaucccuugguuuauggaaauccggcuguguaaggagauuaccugcccacccccgccuguaaucuacaauggcgcucauacagggucuucgcucgaagauuuccccuauggaacuaccgucacauacaccuguaacccaggccccgagcgagguguggaauuuagccuuauuggggaguccacuauacgcugcacgucaaaugaccaggagagaggcacauggaguggaccugccccacuguguaaauugucucuacuggcuguucagugcagccacgugcauaucgccaacggcuauaagauuuccgggaaagaagcacccuacuucuauaaugacaccgucacuuuuaaguguuacucaggauucacccucaagggcagcucucaaaucaggugcaaagccgauaacacaugggacccugagaucccggugugcgaaaaggagaccugucagcacguacggcagucccugcaggagcuuccagcugguagucgcguggaacugguuaauacuagcugccaagauggguaucaguugacaggacacgcguaccagaugugucaggacgcagagaacggcauuugguuuaaaaagauaccccucugcaaagucauccauugucacccuccacccgugauugugaaugguaagcauacgggcaugauggccgaaaacuuccuguacgggaaugaggucucuuaugaaugcgaucaaggauuuuacuuacugggcgagaagaaacuacaguguagauccgacucaaaggggcacggaaguuggagcggcccuucgccgcagugccucagguccccucccguuacccguugucccaaccccgaggugaaacaugguuauaagcugaacaaaacucacucugcuuacagccacaaugauaucguguauguagacugcaacccaggguucauuaugaauggaucacgggucauccgaugucauacagauaacaccugggugccuggcguucccacaugcauaaagaaggccuuuaucgguugcccaccgccucccaaaacuccaaauggcaaccacaccgggggaaauauugcaagauucagucccggcauguccauccuuuacucuugugaccagggguauuugcuggugggagaagcccuccugcuuugcacgcaugagggcaccuggagccaaccugcuccacacuguaaggaagucaacugcuccucacccgccgauauggacgguauucagaaagggcuggagccuaggaagauguaccaguacggagcagugguuacauuggaaugugaggacggcuauaugcucgaggguagcccgcaaagucagugccagucugaucaccaguggaauccaccccuggcggugugucgcucccggagcuuagcuccuguacugugcggcaucgccgcagggcuaauacuccugacuuuucuuauugucaucaccuuguacgugauuucgaaacauagagccaggaacuauuacacagacacuucacaaaaggaagccuuccaccuggaggcccgcgaaguguauucugucgaucccuacaauccagcaaguuga

SEQ ID NO: 8092 - RNA, 3102 nt, Artificial Sequence
  derived and/or modified sequence opt4 from complement_system_component_CR2__Homo_sapiens__CCDS1478.1
augggcgccgccggccugcugggcguguuccuggcccugguggcccccggcgugcugggcaucagcugcggcagccccccccccauccugaacggcagaaucagcuacuacagcacccccaucgccgugggcaccgugaucagauacagcugcagcggcaccuucagacugaucggcgagaagagccugcugugcaucaccaaggacaagguggacggcaccugggacaagcccgcccccaagugcgaguacuucaacaaguacagcagcugccccgagcccaucgugcccggcggcuacaagaucagaggcagcacccccuacagacacggcgacagcgugaccuucgccugcaagaccaacuucagcaugaacggcaacaagagcguguggugccaggccaacaacauguggggccccaccagacugcccaccugcgugagcguguucccccuggagugccccgcccugcccaugauccacaacggccaccacaccagcgagaacgugggcagcaucgcccccggccugagcgugaccuacagcugcgagagcggcuaccugcuggugggcgagaagaucaucaacugccugagcagcggcaaguggagcgccgugccccccaccugcgaggaggccagaugcaagagccugggcagauuccccaacggcaaggugaaggagccccccauccugagagugggcgugaccgccaacuucuucugcgacgagggcuacagacugcagggcccccccagcagcagaugcgugaucgccggccagggcguggccuggaccaagaugcccgugugcgaggagaucuucugccccagccccccccccauccugaacggcagacacaucggcaacagccuggccaacgugagcuacggcagcaucgugaccuacaccugcgaccccgaccccgaggagggcgugaacuucauccugaucggcgagagcacccugagaugcaccguggacagccagaagaccggcaccuggagcggccccgcccccagaugcgagcugagcaccagcgccgugcagugcccccacccccagauccugagaggcagaauggugagcggccagaaggacagauacaccuacaacgacaccgugaucuucgccugcauguucggcuucacccugaagggcagcaagcagaucagaugcaacgcccagggcaccugggagcccagcgcccccgugugcgagaaggagugccaggccccccccaacauccugaacggccagaaggaggacagacacauggugagauucgaccccggcaccagcaucaaguacagcugcaaccccggcuacgugcuggugggcgaggagagcauccagugcaccagcgagggcguguggaccccccccgugccccagugcaagguggccgccugcgaggccaccggcagacagcugcugaccaagccccagcaccaguucgugagacccgacgugaacagcagcugcggcgagggcuacaagcugagcggcagcguguaccaggagugccagggcaccauccccugguucauggagaucagacugugcaaggagaucaccugcccccccccccccgugaucuacaacggcgcccacaccggcagcagccuggaggacuuccccuacggcaccaccgugaccuacaccugcaaccccggccccgagagaggcguggaguucagccugaucggcgagagcaccaucagaugcaccagcaacgaccaggagagaggcaccuggagcggccccgccccccugugcaagcugagccugcuggccgugcagugcagccacgugcacaucgccaacggcuacaagaucagcggcaaggaggcccccuacuucuacaacgacaccgugaccuucaagugcuacagcggcuucacccugaagggcagcagccagaucagaugcaaggccgacaacaccugggaccccgagauccccgugugcgagaaggagaccugccagcacgugagacagagccugcaggagcugcccgccggcagcagaguggagcuggugaacaccagcugccaggacggcuaccagcugaccggccacgccuaccagaugugccaggacgccgagaacggcaucugguucaagaagaucccccugugcaaggugauccacugccaccccccccccgugaucgugaacggcaagcacaccggcaugauggccgagaacuuccuguacggcaacgaggugagcuacgagugcgaccagggcuucuaccugcugggcgagaagaagcugcagugcagaagcgacagcaagggccacggcagcuggagcggccccagcccccagugccugagaagcccccccgugaccagaugccccaaccccgaggugaagcacggcuacaagcugaacaagacccacagcgccuacagccacaacgacaucguguacguggacugcaaccccggcuucaucaugaacggcagcagagugaucagaugccacaccgacaacaccugggugcccggcgugcccaccugcaucaagaaggccuucaucggcugcccccccccccccaagacccccaacggcaaccacaccggcggcaacaucgccagauucagccccggcaugagcauccuguacagcugcgaccagggcuaccugcuggugggcgaggcccugcugcugugcacccacgagggcaccuggagccagcccgccccccacugcaaggaggugaacugcagcagccccgccgacauggacggcauccagaagggccuggagcccagaaagauguaccaguacggcgccguggugacccuggagugcgaggacggcuacaugcuggagggcagcccccagagccagugccagagcgaccaccaguggaaccccccccuggccgugugcagaagcagaagccuggcccccgugcugugcggcaucgccgccggccugauccugcugaccuuccugaucgugaucacccuguacgugaucagcaagcacagagccagaaacuacuacaccgacaccagccagaaggaggccuuccaccuggaggccagagagguguacagcguggaccccuacaaccccgccagcuga

SEQ ID NO: 8093 - RNA, 3102 nt, Artificial Sequence
  derived and/or modified sequence opt5 from complement_system_component_CR2__Homo_sapiens__CCDS1478.1
augggcgccgcugggcugcucggaguguuccuggcccuugucgcgcccggcguucuggggaucagcugcggauccccuccgcccauucucaacggcagaaucucuuacuauagcaccccuauugcuguggggacagugauccgguacuccuguucuggaacguuucgccugauuggcgaaaagagccuucugugcaucaccaaagacaaggucgauggcacaugggacaaacccgccccuaagugugaguauuucaauaaauacuccucuugccccgagccuaucgugcccgggggauauaagauuagaggcagcacccccuaccggcacggggauuccguuacauuugccuguaagaccaacuucagcaugaauggaaacaaaucuguguggugccaggcuaauaacauguggggcccuacacgccuccccaccugugucuccguguuuccucuggaaugccccgcccugccgaugauccauaaugggcaccauacgagcgagaacguuggaucuauugcuccuggccucuccgugaccuauagcugugaaucuggcuaccugcuugucggggagaagaucauuaauugccuguccagcggaaaaugguccgccgugcccccuacaugugaggaagcgagaugcaagucucucggccgguuccccaacgggaaagugaaggagcccccuauccugcgcgucggaguuaccgccaacuuuuucugcgacgaaggcuacagacuucaagggccgcccagcucccggugugugauugcuggacagggcguggccuggacaaagaugccugucugcgaggagaucuuuugucccagcccucccccgauccugaauggccgccacauuggaaauucucucgcuaacguguccuaugggagcaucguuaccuacacgugcgauccugaccccgaagagggcgugaauuucauucugaucggggaaucuacacugagauguaccgucgauagccagaaaacaggaaccugguccggcccugcgccccggugcgagcucucuaccagcgccgugcaguguccucauccccaaauucugcgcgggagaaugguuuccggccagaaggaccgguauacauacaacgauacggugaucuuugccugcauguucggauuuacccuuaaaggcagcaagcagauccgcuguaacgcucaggggacaugggaaccgucugccccugucugcgagaaagagugucaagcuccgcccaauauucugaacggacagaaggaagacagacacauggugcgguucgauccuggcaccuccaucaaauauagcugcaauccgggguacguccucgugggagaggaaucuauucagugcacauccgagggcguuuggacgcccccugugccccaguguaaggucgccgccugcgaagcuaccgggagacaacugcuuacaaagccucagcaccaguucgugcgccccgacguuaacagcuccuguggcgagggauauaaacugucuggcagcguguaccaagagugccaggggaccaucccuugguuuauggaaauucggcucuguaaggagauuaccugcccgcccccucccgucaucuacaauggagcgcauacaggcuccucucuggaagauuucccuuaugggaccacagugacguacaccuguaaccccggaccggagagaggcguggaauuuagccugaucggggaguccacaauccgcugcaccagcaaugaccaggagcggggcacauggucuggaccugcuccccucuguaaacugucccuucuggccguucagugcagccacguccauauugccaacggcuauaagaucucugggaaagaagccccuuacuucuauaaugacaccgugacguuuaaguguuacuccggauucacccucaagggcagcucucaaauuagaugcaaagcugauaacacaugggaccccgagauccccgugugcgaaaaggagaccugucagcacguccgccagagccugcaggagcuuccugccgggucccggguggaacugguuaauacaagcugccaagauggauaucagcucaccggccacgcguaccagaugugucaggacgcugagaacgggauuugguuuaaaaagaucccgcugugcaaagugauccauugucaucccccucccgucauugugaauggcaagcacacgggaaugauggccgaaaacuuccuguacggcaaugagguuucuuaugaaugcgaucaaggguuuuaccuccugggagagaagaaacuucaguguagauccgacagcaagggccacggguccuggucuggaccuagcccccagugccugcgcuccccuccggugacacggugucccaacccugaggucaaacauggcuauaagcucaacaaaacccacucugccuacagccacaaugauaucguguauguugacugcaaccccggcuucauuaugaauggguccagagugauccgcugucauacagauaacaccugggucccuggagugccgaccugcauuaagaaggcuuuuaucggcugucccccuccucccaaaacacccaaugggaaccacacgggaggcaauaucgcccgguucucucccgggaugagcauucuguacuccugcgaccagggauaucugcuugugggcgaagcucuccugcugugcacccaugagggcacauggagccaaccugccccgcacuguaaggaagucaacuguucuucccccgcggauauggacgggauccagaaaggacucgagccuagaaagauguaccaguacggcgccguugugacccuggaaugcgaggacggguauaugcuugagggaagcccccaaucucagugccaguccgaucaccaguggaauccuccccuggcugugugucggagccgcucucucgccccgguccugugcggcauugcugccgggcugauccuucucacauuucugauugugaucacccuguacguuaucuccaaacauagagcgcggaacuauuacacggacacaagccaaaaggaagccuuccaccucgaggcuagagaaguguauuccgucgauccuuacaaucccgccagcuga

SEQ ID NO: 8094 - protein, 712 aa, Artificial Sequence
  complement_system_component_CR3__Homo_sapiens__D3DSM0
MLGLRPPLLALVGLLSLGCVLSQECTKFKVSSCRECIESGPGCTWCQKLNFTGPGDPDSIRCDTRPQLLMRGCAADDIMDPTSLAETQEDHNGGQKQLSPQKVTLYLRPGFGSFVDKTVLPFVNTHPDKLRNPCPNKEKECQPPFAFRHVLKLTNNSNQFQTEVGKQLISGNLDAPEGGLDAMMQVAACPEEIGWRNVTRLLVFATDDGFHFAGDGKLGAILTPNDGRCHLEDNLYKRSNEFDYPSVGQLAHKLAENNIQPIFAVTSRMVKTYEKLTEIIPKSAVGELSEDSSNVVHLIKNAYNKLSSRVFLDHNALPDTLKVTYDSFCSNGVTHRNQPRGDCDGVQINVPITFQVKVTATECIQEQSFVIRALGFTDIVTVQVLPQCECRCRDQSRDRSLCHGKGFLECGICRCDTGYIGKNCECQTQGRSSQELEGSCRKDNNSIICSGLGDCVCGQCLCHTSDVPGKLIYGQYCECDTINCERYNGQVCGGPGRGLCFCGKCRCHPGFEGSACQCERTTEGCLNPRRVECSGRGRCRCNVCECHSGYQLPLCQECPGCPSPCGKYISCAECLKFEKGPFGKNCSAACPGLQLSNNPVKGRTCKERDSEGCWVAYTLEQQDGMDRYLIYVDESRECVAGPNIAAIVGGTVAGIVLIGILLLVIWKALIHLSDLREYRRFEKEKLKSQWNNDNPLFKSATTTVMNPKFAES

SEQ ID NO: 8095 - RNA, 2139 nt, Artificial Sequence
  complement_system_component_CR3__Homo_sapiens__EAX09383
augcugggccugcgccccccacugcucgcccugguggggcugcucucccucgggugcguccucucucaggagugcacgaaguucaaggucagcagcugccgggaaugcaucgagucggggcccggcugcaccuggugccagaagcugaacuucacagggccgggggauccugacuccauucgcugcgacacccggccacagcugcucaugaggggcugugcggcugacgacaucauggaccccacaagccucgcugaaacccaggaagaccacaaugggggccagaagcagcuguccccacaaaaagugacgcuuuaccugcgaccaggcuucggguccuucguggacaagaccgugcugccguucgugaacacgcacccugauaagcugcgaaacccaugccccaacaaggagaaagagugccagcccccguuugccuucaggcacgugcugaagcugaccaacaacuccaaccaguuucagaccgaggucgggaagcagcugauuuccggaaaccuggaugcacccgagggugggcuggacgccaugaugcaggucgccgccugcccggaggaaaucggcuggcgcaacgucacgcggcugcugguguuugccacugaugacggcuuccauuucgcgggcgacgggaagcugggcgccauccugacccccaacgacggccgcugucaccuggaggacaacuuguacaagaggagcaacgaauucgacuacccaucggugggccagcuggcgcacaagcuggcugaaaacaacauccagcccaucuucgcggugaccaguaggauggugaagaccuacgagaaacucaccgagaucauccccaagucagccgugggggagcugucugaggacuccagcaaugugguccaucucauuaagaaugcuuacaauaaacucuccuccagggucuuccuggaucacaacgcccuccccgacacccugaaagucaccuacgacuccuucugcagcaauggagugacgcacaggaaccagcccagaggugacugugauggcgugcagaucaaugucccgaucaccuuccaggugaaggucacggccacagagugcauccaggagcagucguuugucauccgggcgcugggcuucacggacauagugaccgugcagguccuuccccagugugagugccggugccgggaccagagcagagaccgcagccucugccauggcaagggcuucuuggagugcggcaucugcaggugugacacuggcuacauugggaaaaacugugagugccagacacagggccggagcagccaggagcuggaaggaagcugccggaaggacaacaacuccaucaucugcucagggcugggggacugugucugcgggcagugccugugccacaccagcgacguccccggcaagcugauauacgggcaguacugcgagugugacaccaucaacugugagcgcuacaacggccaggucugcggcggcccggggagggggcucugcuucugcgggaagugccgcugccacccgggcuuugagggcucagcgugccagugcgagaggaccacugagggcugccugaacccgcggcguguugaguguaguggucguggccggugccgcugcaacguaugcgagugccauucaggcuaccagcugccucugugccaggagugccccggcugccccucacccuguggcaaguacaucuccugcgccgagugccugaaguucgaaaagggccccuuugggaagaacugcagcgcggcguguccgggccugcagcugucgaacaaccccgugaagggcaggaccugcaaggagagggacucagagggcugcuggguggccuacacgcuggagcagcaggacgggauggaccgcuaccucaucuauguggaugagagccgagaguguguggcaggccccaacaucgccgccaucgucgggggcaccguggcaggcaucgugcugaucggcauucuccugcuggucaucuggaaggcucugauccaccugagcgaccuccgggaguacaggcgcuuugagaaggagaagcucaagucccaguggaacaaugauaauccccuuuucaagagcgccaccacgacggucaugaaccccaaguuugcugagaguuag

SEQ ID NO: 8096 - RNA, 2139 nt, Artificial Sequence
  derived and/or modified sequence opt1 from complement_system_component_CR3__Homo_sapiens__EAX09383
augcugggccuccggcccccgcugcuggcccucguggggcugcugagccucggcugcguccugucccaggagugcaccaaguucaaggugagcuccugccgcgagugcaucgagagcgggcccggcugcaccuggugccagaagcugaacuucacggggcccggcgaccccgacuccauccgcugcgacacccggccgcagcuccugaugcgcggcugcgccgcggacgacaucauggaccccaccagccuggccgagacccaggaggaccacaacgggggccagaagcagcucagcccccagaaggugacgcuguaccugcggcccggguucggcuccuucgucgacaagaccgugcucccguucgugaacacccaccccgacaagcugcgcaaccccugccccaacaaggagaaggagugccagccgcccuucgccuuccggcacguccugaagcucaccaacaacuccaaccaguuccagacggagguggggaagcagcugaucagcggcaaccuggacgcccccgagggcgggcucgacgccaugaugcaggucgcggccugccccgaggagaucggcuggcgcaacgugacccggcugcugguguucgccaccgacgacggguuccacuucgccggcgacggcaagcucggggcgauccugaccccgaacgacggccgcugccaccuggaggacaaccucuacaagcgguccaacgaguucgacuaccccagcguggggcagcuggcccacaagcuggccgagaacaacauccagcccaucuucgccgucacgucccgcauggugaagaccuacgagaagcucaccgagaucauccccaagagcgccgugggcgagcuguccgaggacagcuccaacgucgugcaccugaucaagaacgcguacaacaagcucagcucccggguguuccuggaccacaacgcccugccggacacccucaaggucacguacgacagcuucugcagcaacggggugacccaccgcaaccagccccggggcgacugcgacggcgugcagaucaacguccccaucaccuuccaggugaaggugaccgccacggagugcauccaggagcaguccuucgucauccgcgcccugggguucaccgacaucgugaccguccaggugcugccccagugcgagugccggugccgcgaccagagccgggaccgcucccucugccacggcaagggguuccuggagugcggcaucugccggugcgacaccggguacaucggcaagaacugcgagugccagacgcagggccgcagcucccaggagcuggaggggagcugccgcaaggacaacaacuccaucaucugcagcggccucggggacugcgugugcggccagugccugugccacaccuccgacgucccggggaagcugaucuacggccaguacugcgagugcgacaccaucaacugcgagcgguacaacggccaggugugcgggggccccgggcgcggccucugcuucugcggcaagugccggugccaccccggguucgagggcagcgccugccagugcgagcgcaccacggaggggugccugaacccccggcgcguggagugcuccggccgggggcgcugccggugcaacgucugcgagugccacagcggcuaccagcugccgcucugccaggagugccccggcugccccuccccgugcgggaaguacaucagcugcgcggagugccugaaguucgagaagggccccuucgggaagaacugcuccgccgccugccccggccugcagcugagcaacaaccccgugaaggggcggaccugcaaggagcgcgacuccgagggcugcuggguggccuacacccucgagcagcaggacggcauggaccgcuaccugaucuacgucgacgagagccgggagugcguggccgggccgaacaucgcggccaucgugggcgggaccgucgccggcaucgugcugaucgggauccuccugcuggugaucuggaaggcccucauccaccuguccgaccugcgcgaguaccggcgcuucgagaaggagaagcucaagagccaguggaacaacgacaacccccuguucaagagcgccacgaccaccgucaugaaccccaaguucgcggaguccuga

SEQ ID NO: 8097 - RNA, 2139 nt, Artificial Sequence
  derived and/or modified sequence opt2 from complement_system_component_CR3__Homo_sapiens__EAX09383
augcucggccuccgccccccccuccucgcccucgucggccuccucucccucggcugcguccucucccaggagugcaccaaguucaaggucuccuccugccgcgagugcaucgaguccggccccggcugcaccuggugccagaagcucaacuucaccggccccggcgaccccgacuccauccgcugcgacacccgcccccagcuccucaugcgcggcugcgccgccgacgacaucauggaccccaccucccucgccgagacccaggaggaccacaacggcggccagaagcagcucuccccccagaaggucacccucuaccuccgccccggcuucggcuccuucgucgacaagaccguccuccccuucgucaacacccaccccgacaagcuccgcaaccccugccccaacaaggagaaggagugccagccccccuucgccuuccgccacguccucaagcucaccaacaacuccaaccaguuccagaccgaggucggcaagcagcucaucuccggcaaccucgacgcccccgagggcggccucgacgccaugaugcaggucgccgccugccccgaggagaucggcuggcgcaacgucacccgccuccucgucuucgccaccgacgacggcuuccacuucgccggcgacggcaagcucggcgccauccucacccccaacgacggccgcugccaccucgaggacaaccucuacaagcgcuccaacgaguucgacuaccccuccgucggccagcucgcccacaagcucgccgagaacaacauccagcccaucuucgccgucaccucccgcauggucaagaccuacgagaagcucaccgagaucauccccaaguccgccgucggcgagcucuccgaggacuccuccaacgucguccaccucaucaagaacgccuacaacaagcucuccucccgcgucuuccucgaccacaacgcccuccccgacacccucaaggucaccuacgacuccuucugcuccaacggcgucacccaccgcaaccagccccgcggcgacugcgacggcguccagaucaacguccccaucaccuuccaggucaaggucaccgccaccgagugcauccaggagcaguccuucgucauccgcgcccucggcuucaccgacaucgucaccguccagguccucccccagugcgagugccgcugccgcgaccagucccgcgaccgcucccucugccacggcaagggcuuccucgagugcggcaucugccgcugcgacaccggcuacaucggcaagaacugcgagugccagacccagggccgcuccucccaggagcucgagggcuccugccgcaaggacaacaacuccaucaucugcuccggccucggcgacugcgucugcggccagugccucugccacaccuccgacguccccggcaagcucaucuacggccaguacugcgagugcgacaccaucaacugcgagcgcuacaacggccaggucugcggcggccccggccgcggccucugcuucugcggcaagugccgcugccaccccggcuucgagggcuccgccugccagugcgagcgcaccaccgagggcugccucaacccccgccgcgucgagugcuccggccgcggccgcugccgcugcaacgucugcgagugccacuccggcuaccagcucccccucugccaggagugccccggcugccccucccccugcggcaaguacaucuccugcgccgagugccucaaguucgagaagggccccuucggcaagaacugcuccgccgccugccccggccuccagcucuccaacaaccccgucaagggccgcaccugcaaggagcgcgacuccgagggcugcugggucgccuacacccucgagcagcaggacggcauggaccgcuaccucaucuacgucgacgagucccgcgagugcgucgccggccccaacaucgccgccaucgucggcggcaccgucgccggcaucguccucaucggcauccuccuccucgucaucuggaaggcccucauccaccucuccgaccuccgcgaguaccgccgcuucgagaaggagaagcucaagucccaguggaacaacgacaacccccucuucaaguccgccaccaccaccgucaugaaccccaaguucgccgaguccuga

SEQ ID NO: 8098 - RNA, 2139 nt, Artificial Sequence
  derived and/or modified sequence opt3 from complement_system_component_CR3__Homo_sapiens__EAX09383
augcugggccucagacccccucuucuggccuuggugggguuacugagccuaggaugcguccucucccaggaguguaccaaguucaaaguuucuucaugcagggaauguaucgagagugguccaggcugcacauggugucaaaagcugaacuuuacugggccgggagaccccgauagcauucggugcgacacgcgcccucagcuucugaugcgaggcugugcugcagaugacauaauggauccaaccuccuuggccgaaacacaggaggaccacaauggugggcagaaacaacucucuccccagaaggugacucuguaccugcguccuggauucggcucguuuguagauaaaaccgugcucccauucgucaacacacaucccgacaaguuaagaaauccuugcccaaacaaggaaaaagagugucagccgcccuuugcguucaggcacgugcugaaacuuaccaauaacucaaaucaguuucaaacugagguuggcaagcaguugaucagcgggaaccuggaugcuccugaaggaggucuagacgccaugaugcaaguggcagccugcccagaggaaauuggcuggcggaaugucacacgccuccugguguucgcuaccgaugacggguuucauuucgcaggagauggcaaacuuggugccauccugacgcccaacgacgggagaugucacuuggaggacaaucucuauaagaggaguaacgaguuugauuacccuuccguaggacagcuggcucauaaguuagccgaaaauaacauucagccaaucuucgcgguuacuucucggauggugaagaccuaugagaaacugacagaaauaauccccaagagcgcagucggcgagcucuccgaagacucaaguaauguggugcaccuuauuaaaaacgccuacaacaagcugagcucucgcgucuuuuuggaucacaaugcucuaccggacacucugaaaguuaccuaugauuccuucugcucaaacggcgugacacaucgaaaucagccuagaggggacugcgauggaguacagaucaacgugcccauuaccuuccaagucaaggugacggccacugaguguauccaggagcagagcuuuguuauaagggcacucgguuucacagacauugugaccguccaggugcugccacaaugcgaaugucggugccgugaucagagucgcgacagaucucuuugucacggcaaaggguuucuggagugcggaaucuguaggugcgauacuggcuacauugguaagaauugugaaugccagacacaggggcgguccagccaagaguuggaaggcucgugucgaaaggacaacaauucuaucaucugcuccggacucggcgacugcguaugugggcagugccugugucauaccucagauguuccuggaaaauuaauuuauggucaguacugcgagugugacacgauaaacugcgagcgcuacaauggccaggugugugggggacccggcagaggucugugcuucugugggaaguguaggugccacccaggcuuugaaggaagugcuugccaaugcgagcggaccacagaaggcugucuaaacccccgcagagucgagugcagcgggaggggacguugucggugcaaugugugugaaugccacuccgguuaucagcucccucugugucaggagugcccaggcuguccgucucccugcgggaaauacaucagcugugccgagugccuuaaguucgaaaaaggaccuuuuggcaagaacugcucagcggccuguccagguuugcagcugaguaauaaccccgucaaggggcgaacuugcaaagagagagauuccgaaggcuguuggguggcauauacccucgagcaacaggacggaauggauagguaccugauuuauguugacgagagccgcgaaugcguggcuggcccuaauaucgccgcuauaguagggggaacagucgccggcauugugcuuaucgguauccuguugcucguuauuuggaaggcacugauccauuuaucugaucugcgggaguacagaagguucgaaaaagagaagcuaaaaucacaguggaacaacgacaauccacucuuuaagagugccacuaccacagugaugaaccccaaguucgcugaaagcuga

SEQ ID NO: 8099 - RNA, 2139 nt, Artificial Sequence
  derived and/or modified sequence opt4 from complement_system_component_CR3__Homo_sapiens__EAX09383
augcugggccugagacccccccugcuggcccuggugggccugcugagccugggcugcgugcugagccaggagugcaccaaguucaaggugagcagcugcagagagugcaucgagagcggccccggcugcaccuggugccagaagcugaacuucaccggccccggcgaccccgacagcaucagaugcgacaccagaccccagcugcugaugagaggcugcgccgccgacgacaucauggaccccaccagccuggccgagacccaggaggaccacaacggcggccagaagcagcugagcccccagaaggugacccuguaccugagacccggcuucggcagcuucguggacaagaccgugcugcccuucgugaacacccaccccgacaagcugagaaaccccugccccaacaaggagaaggagugccagccccccuucgccuucagacacgugcugaagcugaccaacaacagcaaccaguuccagaccgaggugggcaagcagcugaucagcggcaaccuggacgcccccgagggcggccuggacgccaugaugcagguggccgccugccccgaggagaucggcuggagaaacgugaccagacugcugguguucgccaccgacgacggcuuccacuucgccggcgacggcaagcugggcgccauccugacccccaacgacggcagaugccaccuggaggacaaccuguacaagagaagcaacgaguucgacuaccccagcgugggccagcuggcccacaagcuggccgagaacaacauccagcccaucuucgccgugaccagcagaauggugaagaccuacgagaagcugaccgagaucauccccaagagcgccgugggcgagcugagcgaggacagcagcaacguggugcaccugaucaagaacgccuacaacaagcugagcagcagaguguuccuggaccacaacgcccugcccgacacccugaaggugaccuacgacagcuucugcagcaacggcgugacccacagaaaccagcccagaggcgacugcgacggcgugcagaucaacgugcccaucaccuuccaggugaaggugaccgccaccgagugcauccaggagcagagcuucgugaucagagcccugggcuucaccgacaucgugaccgugcaggugcugccccagugcgagugcagaugcagagaccagagcagagacagaagccugugccacggcaagggcuuccuggagugcggcaucugcagaugcgacaccggcuacaucggcaagaacugcgagugccagacccagggcagaagcagccaggagcuggagggcagcugcagaaaggacaacaacagcaucaucugcagcggccugggcgacugcgugugcggccagugccugugccacaccagcgacgugcccggcaagcugaucuacggccaguacugcgagugcgacaccaucaacugcgagagauacaacggccaggugugcggcggccccggcagaggccugugcuucugcggcaagugcagaugccaccccggcuucgagggcagcgccugccagugcgagagaaccaccgagggcugccugaaccccagaagaguggagugcagcggcagaggcagaugcagaugcaacgugugcgagugccacagcggcuaccagcugccccugugccaggagugccccggcugccccagccccugcggcaaguacaucagcugcgccgagugccugaaguucgagaagggccccuucggcaagaacugcagcgccgccugccccggccugcagcugagcaacaaccccgugaagggcagaaccugcaaggagagagacagcgagggcugcuggguggccuacacccuggagcagcaggacggcauggacagauaccugaucuacguggacgagagcagagagugcguggccggccccaacaucgccgccaucgugggcggcaccguggccggcaucgugcugaucggcauccugcugcuggugaucuggaaggcccugauccaccugagcgaccugagagaguacagaagauucgagaaggagaagcugaagagccaguggaacaacgacaacccccuguucaagagcgccaccaccaccgugaugaaccccaaguucgccgagagcuga

SEQ ID NO: 8100 - RNA, 2139 nt, Artificial Sequence
  derived and/or modified sequence opt5 from complement_system_component_CR3__Homo_sapiens__EAX09383
augcugggccucagacccccucugcuugcccugguggggcuccugagccuuggaugcguccugucccaggaguguaccaaguucaaaguuucuagcugccgggaauguaucgaguccggcccggggugcacauggugucaaaagcucaacuuuacgggacccggcgacccugauucuauucgcugcgacaccagaccccagcugcugaugcgggggugugcugccgaugacaucauggauccuacaagccucgcggaaacccaggaggaccacaauggaggccagaaacaacugucuccccagaaggugacacuuuaccugcgcccuggcuucggguccuuuguggauaaaaccguccucccguucgugaacacacaucccgacaagcugagaaauccuugccccaacaaggaaaaagagugucagccucccuuugcuuuccggcacguucuuaagcugaccaauaacagcaaucaguuucaaacggaggugggaaaacagcucauuuccggcaaccuggaugccccggaagggggacuggacgccaugaugcaggucgcugccugcccugaggaaaucggcuggcgcaaugugaccagacuccugguuuucgcuacagaugacggguuucauuucgccggagauggcaaacuuggcgcgauucugacccccaacgacgggcggugucaccucgaggacaaucuguauaagcgcagcaacgaguuugauuacccuucugugggacagcuugcccauaagcuggcugaaaauaacauccaacccaucuucgccgucacauccagaauggugaagaccuaugagaaacucacggaaauuauccccaagagcgcugugggcgagcugucugaagacuccagcaaugucguucaccugauuaaaaacgccuacaacaagcucucuucccggguguuucuggaucacaaugcgcuuccugacacacugaaagugaccuaugauagcuucugcuccaacggggucacacaucgcaaucagccgagaggagacugcgauggcgugcagaucaacguucccauuaccuuccaagugaaggucaccgccacagaguguauccaggagcagucuuuugugauucgggcucucggguucacggacaucguuaccgugcagguccugccucaaugcgaaugucgcugcagagaucagagccgggacagaucccuuugucacggaaaaggcuuucuggagugcggcaucugucgcugcgauacaggguacauuggaaagaauugugaaugccagacccagggccggagcucucaagagcucgaaggguccuguagaaaggacaacaauagcaucauuugcucuggacugggcgacugcgugugugggcagugccugugucauacaagcgauguccccggcaaacucaucuauggacaguacugcgagugugacaccauuaacugcgagcgcuacaauggccaggugugugggggaccuggccgggggcugugcuucuguggaaagugcagaugucaccccggcuuugaaggguccgccugccaaugcgagcgcacgacagaaggcugucuuaacccgcggagaguugagugcucuggacgcggccgguguagaugcaaugugugugaaugccacagcggguaucagcugccucucugucaggagugccccggauguccuucccccugcggcaaauacaucagcugugcugagugccugaaguucgaaaaagggccuuuuggaaagaacugcucugccgccugucccggccugcagcuuuccaauaacccggucaaggggcggaccugcaaagagcgcgauagcgaaggcuguuggguggcuuauacccucgagcaacaggacggaauggauagauaccugaucuauguugacgagucucgggaaugcguggcgggcccuaauauugccgcuaucgucgggggaacaguggccggcauugugcugaucgggauucuccugcuuguuaucuggaaggcccugauccaucucuccgaucugcgcgaguacagacgguucgaaaaagagaagcugaaaagccaguggaacaacgacaauccccuuuuuaaguccgcuaccacaacggucaugaaccccaaguucgccgaaucuuga

SEQ ID NO: 8101 - protein, 769 aa, Artificial Sequence
  complement_system_component_CR3__Homo_sapiens__P05107
MLGLRPPLLALVGLLSLGCVLSQECTKFKVSSCRECIESGPGCTWCQKLNFTGPGDPDSIRCDTRPQLLMRGCAADDIMDPTSLAETQEDHNGGQKQLSPQKVTLYLRPGQAAAFNVTFRRAKGYPIDLYYLMDLSYSMLDDLRNVKKLGGDLLRALNEITESGRIGFGSFVDKTVLPFVNTHPDKLRNPCPNKEKECQPPFAFRHVLKLTNNSNQFQTEVGKQLISGNLDAPEGGLDAMMQVAACPEEIGWRNVTRLLVFATDDGFHFAGDGKLGAILTPNDGRCHLEDNLYKRSNEFDYPSVGQLAHKLAENNIQPIFAVTSRMVKTYEKLTEIIPKSAVGELSEDSSNVVQLIKNAYNKLSSRVFLDHNALPDTLKVTYDSFCSNGVTHRNQPRGDCDGVQINVPITFQVKVTATECIQEQSFVIRALGFTDIVTVQVLPQCECRCRDQSRDRSLCHGKGFLECGICRCDTGYIGKNCECQTQGRSSQELEGSCRKDNNSIICSGLGDCVCGQCLCHTSDVPGKLIYGQYCECDTINCERYNGQVCGGPGRGLCFCGKCRCHPGFEGSACQCERTTEGCLNPRRVECSGRGRCRCNVCECHSGYQLPLCQECPGCPSPCGKYISCAECLKFEKGPFGKNCSAACPGLQLSNNPVKGRTCKERDSEGCWVAYTLEQQDGMDRYLIYVDESRECVAGPNIAAIVGGTVAGIVLIGILLLVIWKALIHLSDLREYRRFEKEKLKSQWNNDNPLFKSATTTVMNPKFAES

SEQ ID NO: 8102 - RNA, 2310 nt, Artificial Sequence
  complement_system_component_CR3__Homo_sapiens__CAB90553
augcugggccugcgccccccacugcucgcccugguggggcugcucucccucgggugcguccucucucaggagugcacgaaguucaaggucagcagcugccgggaaugcaucgagucggggcccggcugcaccuggugccagaagcugaacuucacagggccgggggauccugacuccauucgcugcgacacccggccacagcugcucaugaggggcugugcggcugacgacaucauggaccccacaagccucgcugaaacccaggaagaccacaaugggggccagaagcagcuguccccacaaaaagugacgcuuuaccugcgaccaggccaggcagcagcguucaacgugaccuuccggcgggccaagggcuaccccaucgaccuguacuaucugauggaccucuccuacuccaugcuugaugaccucaggaaugucaagaagcuagguggcgaccugcuccgggcccucaacgagaucaccgaguccggccgcauuggcuucggguccuucguggacaagaccgugcugccguucgugaacacgcacccugauaagcugcgaaacccaugccccaacaaggagaaagagugccagcccccguuugccuucaggcacgugcugaagcugaccaacaacuccaaccaguuucagaccgaggucgggaagcagcugauuuccggaaaccuggaugcacccgagggugggcuggacgccaugaugcaggucgccgccugcccggaggaaaucggcuggcgcaacgucacgcggcugcugguguuugccacugaugacggcuuccauuucgcgggcgacgggaagcugggcgccauccugacccccaacgacggccgcugucaccuggaggacaacuuguacaagaggagcaacgaauucgacuacccaucggugggccagcuggcgcacaagcuggcugaaaacaacauccagcccaucuucgcggugaccaguaggauggugaagaccuacgagaaacucaccgagaucauccccaagucagccgugggggagcugucugaggacuccagcaaugugguccaacucauuaagaaugcuuacaauaaacucuccuccagggucuuccuggaucacaacgcccuccccgacacccugaaagucaccuacgacuccuucugcagcaauggagugacgcacaggaaccagcccagaggugacugugauggcgugcagaucaaugucccgaucaccuuccaggugaaggucacggccacagagugcauccaggagcagucguuugucauccgggcgcugggcuucacggacauagugaccgugcagguucuuccccagugugagugccggugccgggaccagagcagagaccgcagccucugccauggcaagggcuucuuggagugcggcaucugcaggugugacacuggcuacauugggaaaaacugugagugccagacacagggccggagcagccaggagcuggaaggaagcugccggaaggacaacaacuccaucaucugcucagggcugggggacugugucugcgggcagugccugugccacaccagcgacguccccggcaagcugauauacgggcaguacugcgagugugacaccaucaacugugagcgcuacaacggccaggucugcggcggcccggggagggggcucugcuucugcgggaagugccgcugccacccgggcuuugagggcucagcgugccagugcgagaggaccacugagggcugccugaacccgcggcguguugaguguaguggucguggccggugccgcugcaacguaugcgagugccauucaggcuaccagcugccucugugccaggagugccccggcugccccucacccuguggcaaguacaucuccugcgccgagugccugaaguucgaaaagggccccuuugggaagaacugcagcgcggcguguccgggccugcagcugucgaacaaccccgugaagggcaggaccugcaaggagagggacucagagggcugcuggguggccuacacgcuggagcagcaggacgggauggaccgcuaccucaucuauguggaugagagccgagaguguguggcaggccccaacaucgccgccaucgucgggggcaccguggcaggcaucgugcugaucggcauucuccugcuggucaucuggaaggcucugauccaccugagcgaccuccgggaguacaggcgcuuugagaaggagaagcucaagucccaguggaacaaugauaauccccuuuucaagagcgccaccacgacggucaugaaccccaaguuugcugagaguuag

SEQ ID NO: 8103 - RNA, 2310 nt, Artificial Sequence
  derived and/or modified sequence opt1 from complement_system_component_CR3__Homo_sapiens__CAB90553
augcugggccuccggcccccgcugcuggcccucguggggcugcugagccucggcugcguccugucccaggagugcaccaaguucaaggugagcuccugccgcgagugcaucgagagcgggcccggcugcaccuggugccagaagcugaacuucacggggcccggcgaccccgacuccauccgcugcgacacccggccgcagcuccugaugcgcggcugcgccgcggacgacaucauggaccccaccagccuggccgagacccaggaggaccacaacgggggccagaagcagcucagcccccagaaggugacgcuguaccugcggcccgggcaggccgccgccuucaacgucaccuuccgccgggcgaagggcuacccgaucgaccucuacuaccugauggaccuguccuacuccaugcucgacgaccugcgcaacgugaagaagcucgggggcgaccugcugcgggcccugaacgagaucaccgagagcggccgcaucggguucggcuccuucguggacaagaccguccuccccuucgugaacacgcaccccgacaagcugcggaaccccugcccgaacaaggagaaggagugccagccgcccuucgccuuccgccacgugcugaagcucaccaacaacagcaaccaguuccagaccgaggucgggaagcagcugaucuccggcaaccuggacgcccccgagggcgggcucgacgcgaugaugcaggucgccgccugccccgaggagaucggcuggcggaacgugacccgccugcugguguucgccacggacgacggguuccacuucgccggcgacgggaagcucggcgcgauccugacccccaacgacggccggugccaccuggaggacaaccucuacaagcgcagcaacgaguucgacuaccccuccguggggcagcuggcccacaagcuggccgagaacaacauccagcccaucuucgccgugaccagccggauggucaagaccuacgagaagcucacggagaucaucccgaaguccgccgugggcgagcugagcgaggacuccagcaacgugguccagcugaucaagaacgcguacaacaagcucagcucccgcguguuccuggaccacaacgcccugcccgacacccucaaggugaccuacgacagcuucugcuccaacggggucacccaccggaaccagccccgcggcgacugcgacggggugcagaucaacgugcccaucacguuccaggucaaggugaccgccaccgagugcauccaggagcagagcuucgucauccgggcccugggcuucaccgacaucgugacggugcagguccugccgcagugcgagugccgcugccgcgaccagucccgggaccgcagccucugccacggcaagggguuccuggagugcggcaucugccggugcgacaccggguacaucggcaagaacugcgagugccagacccaggggcgcuccagccaggagcuggagggcuccugccggaaggacaacaacagcaucaucugcuccggccugggggacugcgugugcggccagugccucugccacaccagcgacgugcccgggaagcugaucuacggccaguacugcgagugcgacacgaucaacugcgagcgcuacaacggccaggucugcgggggccccgggcggggccugugcuucugcgggaagugccgcugccaccccggcuucgagggcuccgccugccagugcgagcggaccaccgaggggugccucaacccgcgccggguggagugcagcggccgcgggcggugccgcugcaacgugugcgagugccacuccggcuaccagcugccccugugccaggagugccccgggugcccgagccccugcggcaaguacaucuccugcgcggagugccucaaguucgagaagggccccuucgggaagaacugcagcgccgccugccccggccugcagcuguccaacaacccggucaaggggcggaccugcaaggagcgcgacagcgagggcugcuggguggccuacacgcucgagcagcaggacgggauggaccgguaccugaucuacguggacgagagccgcgagugcgucgccggccccaacaucgcggccaucgugggcgggaccguggccggcaucguccugaucgggauccuccugcuggugaucuggaaggcccucauccaccuguccgaccugcgggaguaccgccgcuucgagaaggagaagcucaagagccaguggaacaacgacaacccccuguucaaguccgcgaccaccacggugaugaaccccaaguucgccgagagcuga

SEQ ID NO: 8104 - RNA, 2310 nt, Artificial Sequence
  derived and/or modified sequence opt2 from complement_system_component_CR3__Homo_sapiens__CAB90553
augcucggccuccgccccccccuccucgcccucgucggccuccucucccucggcugcguccucucccaggagugcaccaaguucaaggucuccuccugccgcgagugcaucgaguccggccccggcugcaccuggugccagaagcucaacuucaccggccccggcgaccccgacuccauccgcugcgacacccgcccccagcuccucaugcgcggcugcgccgccgacgacaucauggaccccaccucccucgccgagacccaggaggaccacaacggcggccagaagcagcucuccccccagaaggucacccucuaccuccgccccggccaggccgccgccuucaacgucaccuuccgccgcgccaagggcuaccccaucgaccucuacuaccucauggaccucuccuacuccaugcucgacgaccuccgcaacgucaagaagcucggcggcgaccuccuccgcgcccucaacgagaucaccgaguccggccgcaucggcuucggcuccuucgucgacaagaccguccuccccuucgucaacacccaccccgacaagcuccgcaaccccugccccaacaaggagaaggagugccagccccccuucgccuuccgccacguccucaagcucaccaacaacuccaaccaguuccagaccgaggucggcaagcagcucaucuccggcaaccucgacgcccccgagggcggccucgacgccaugaugcaggucgccgccugccccgaggagaucggcuggcgcaacgucacccgccuccucgucuucgccaccgacgacggcuuccacuucgccggcgacggcaagcucggcgccauccucacccccaacgacggccgcugccaccucgaggacaaccucuacaagcgcuccaacgaguucgacuaccccuccgucggccagcucgcccacaagcucgccgagaacaacauccagcccaucuucgccgucaccucccgcauggucaagaccuacgagaagcucaccgagaucauccccaaguccgccgucggcgagcucuccgaggacuccuccaacgucguccagcucaucaagaacgccuacaacaagcucuccucccgcgucuuccucgaccacaacgcccuccccgacacccucaaggucaccuacgacuccuucugcuccaacggcgucacccaccgcaaccagccccgcggcgacugcgacggcguccagaucaacguccccaucaccuuccaggucaaggucaccgccaccgagugcauccaggagcaguccuucgucauccgcgcccucggcuucaccgacaucgucaccguccagguccucccccagugcgagugccgcugccgcgaccagucccgcgaccgcucccucugccacggcaagggcuuccucgagugcggcaucugccgcugcgacaccggcuacaucggcaagaacugcgagugccagacccagggccgcuccucccaggagcucgagggcuccugccgcaaggacaacaacuccaucaucugcuccggccucggcgacugcgucugcggccagugccucugccacaccuccgacguccccggcaagcucaucuacggccaguacugcgagugcgacaccaucaacugcgagcgcuacaacggccaggucugcggcggccccggccgcggccucugcuucugcggcaagugccgcugccaccccggcuucgagggcuccgccugccagugcgagcgcaccaccgagggcugccucaacccccgccgcgucgagugcuccggccgcggccgcugccgcugcaacgucugcgagugccacuccggcuaccagcucccccucugccaggagugccccggcugccccucccccugcggcaaguacaucuccugcgccgagugccucaaguucgagaagggccccuucggcaagaacugcuccgccgccugccccggccuccagcucuccaacaaccccgucaagggccgcaccugcaaggagcgcgacuccgagggcugcugggucgccuacacccucgagcagcaggacggcauggaccgcuaccucaucuacgucgacgagucccgcgagugcgucgccggccccaacaucgccgccaucgucggcggcaccgucgccggcaucguccucaucggcauccuccuccucgucaucuggaaggcccucauccaccucuccgaccuccgcgaguaccgccgcuucgagaaggagaagcucaagucccaguggaacaacgacaacccccucuucaaguccgccaccaccaccgucaugaaccccaaguucgccgaguccuga

SEQ ID NO: 8105 - RNA, 2310 nt, Artificial Sequence
  derived and/or modified sequence opt3 from complement_system_component_CR3__Homo_sapiens__CAB90553
augcugggccucagacccccucuucuggccuuggugggguuacugagccuaggaugcguccucucccaggaguguaccaaguucaaaguuucuucaugcagggaauguaucgagagugguccaggcugcacauggugucaaaagcugaacuuuacugggccgggagaccccgauagcauucggugcgacacgcgcccucagcuucugaugcgaggcugugcugcagaugacauaauggauccaaccuccuuggccgaaacacaggaggaccacaauggugggcagaaacaacucucuccccagaaggugacucuguaccugcguccuggacaggcggcugccuucaacguaaccuuuagaagggcaaaaggcuauccaaucgaucucuacuauuuaauggaccugucguacucaaugcuugaugacuugcggaaugugaagaagcugggcggggaucuacuccgcgcccugaacgaaauuacagagagcggaagaaucgguuucggcaguuuugucgacaaaaccgugcuucccuucguuaauacucauccugauaagcugaggaacccaugcccgaauaaagagaaggaaugucagcccccuuuugcuuuccggcacguguugaaacucacaaacaauuccaaccaauuucagaccgaggucgggaagcagcugauuucuggaaauuuagacgcaccagaaggcggucuggacgccaugaugcaaguggcugccugccccgaggagaucggguggcgcaacguaacgcgacuccuuguuuucgcgacugaugacggauuucauuucgcaggcgauggcaagcugggggccauauugaccccuaaugacggaagaugucaccuagaagauaaccuguauaaaaggagcaaugaguuugacuacccauccgugggucagcucgcucauaagcuggccgaaaacaacauccagcccauuuucgcagucacaucacggauggugaaaacuuaugagaaacuuaccgaaaucauuccgaagagugcugugggcgagcugagcgaggauucuuccaaugucguucaguugaucaagaacgccuacaauaaacucucaagccguguguuccuggaccacaacgcguuaccugauacacugaagguaaccuacgacaguuuuugcucuaauggggugacgcaccgcaaccaacccagaggagauugcgacggcguccagauaaaugugccaauuacuuuccagguuaaggugacagccaccgaauguauccaggagcaauccuuugucauuagggcacuagguuucacugacaucgugacaguacagguucucccucagugcgaaugucggugccgagaucagagccgcgacagaucgcugugucaugggaaaggcuuucuugagugcggaaucuguaggugcgauaccggcuauauugggaagaacugugaaugccaaacgcagggacggucuucccaggaguuggaggguucaugucgcaaagacaauaacaguauaaucugcagcggccugggggauugcguguguggacagugccucugucacaccuccgacguccccggcaagcugauuuacggucaauauugcgaaugugauacaaucaauugcgagagauacaacggccaggugugugggggaccaggcagggggcuuugcuucuguggaaaaugccguugucaucccgguuuugaaggcucugcuugccagugcgagcggacuaccgaagggugucugaauccucgaagagucgagugcagcggaaggggccgcugucggugcaacgugugugagugccacucagguuaucaguugccacucugucaagaaugcccggggugucccaguccuugcggcaaguacauauccugugccgagugccugaaguucgaaaaaggaccauuuggcaagaauugcagcgcugccugucccggguuacagcugucuaacaacccuguuaaaggaagaacaugcaaggagagggacucagagggcuguuggguggcauauacucuagaacagcaagaugguauggaccgcuaccucauuuacguagaugagagucgagaaugcgucgccgggccaaauaucgcugcgaucgugggaggcaccguugcagguauugugcugaucggcauucuuuugcuggucauauggaaagcccucauccaccugagcgacuuacgggaguaucguagauucgaaaaggagaagcugaaaucccaguggaacaaugauaacccccuuuuuaagucugcuacaaccacugugaugaauccgaaauucgccgagucguga

SEQ ID NO: 8106 - RNA, 2310 nt, Artificial Sequence
  derived and/or modified sequence opt4 from complement_system_component_CR3__Homo_sapiens__CAB90553
augcugggccugagacccccccugcuggcccuggugggccugcugagccugggcugcgugcugagccaggagugcaccaaguucaaggugagcagcugcagagagugcaucgagagcggccccggcugcaccuggugccagaagcugaacuucaccggccccggcgaccccgacagcaucagaugcgacaccagaccccagcugcugaugagaggcugcgccgccgacgacaucauggaccccaccagccuggccgagacccaggaggaccacaacggcggccagaagcagcugagcccccagaaggugacccuguaccugagacccggccaggccgccgccuucaacgugaccuucagaagagccaagggcuaccccaucgaccuguacuaccugauggaccugagcuacagcaugcuggacgaccugagaaacgugaagaagcugggcggcgaccugcugagagcccugaacgagaucaccgagagcggcagaaucggcuucggcagcuucguggacaagaccgugcugcccuucgugaacacccaccccgacaagcugagaaaccccugccccaacaaggagaaggagugccagccccccuucgccuucagacacgugcugaagcugaccaacaacagcaaccaguuccagaccgaggugggcaagcagcugaucagcggcaaccuggacgcccccgagggcggccuggacgccaugaugcagguggccgccugccccgaggagaucggcuggagaaacgugaccagacugcugguguucgccaccgacgacggcuuccacuucgccggcgacggcaagcugggcgccauccugacccccaacgacggcagaugccaccuggaggacaaccuguacaagagaagcaacgaguucgacuaccccagcgugggccagcuggcccacaagcuggccgagaacaacauccagcccaucuucgccgugaccagcagaauggugaagaccuacgagaagcugaccgagaucauccccaagagcgccgugggcgagcugagcgaggacagcagcaacguggugcagcugaucaagaacgccuacaacaagcugagcagcagaguguuccuggaccacaacgcccugcccgacacccugaaggugaccuacgacagcuucugcagcaacggcgugacccacagaaaccagcccagaggcgacugcgacggcgugcagaucaacgugcccaucaccuuccaggugaaggugaccgccaccgagugcauccaggagcagagcuucgugaucagagcccugggcuucaccgacaucgugaccgugcaggugcugccccagugcgagugcagaugcagagaccagagcagagacagaagccugugccacggcaagggcuuccuggagugcggcaucugcagaugcgacaccggcuacaucggcaagaacugcgagugccagacccagggcagaagcagccaggagcuggagggcagcugcagaaaggacaacaacagcaucaucugcagcggccugggcgacugcgugugcggccagugccugugccacaccagcgacgugcccggcaagcugaucuacggccaguacugcgagugcgacaccaucaacugcgagagauacaacggccaggugugcggcggccccggcagaggccugugcuucugcggcaagugcagaugccaccccggcuucgagggcagcgccugccagugcgagagaaccaccgagggcugccugaaccccagaagaguggagugcagcggcagaggcagaugcagaugcaacgugugcgagugccacagcggcuaccagcugccccugugccaggagugccccggcugccccagccccugcggcaaguacaucagcugcgccgagugccugaaguucgagaagggccccuucggcaagaacugcagcgccgccugccccggccugcagcugagcaacaaccccgugaagggcagaaccugcaaggagagagacagcgagggcugcuggguggccuacacccuggagcagcaggacggcauggacagauaccugaucuacguggacgagagcagagagugcguggccggccccaacaucgccgccaucgugggcggcaccguggccggcaucgugcugaucggcauccugcugcuggugaucuggaaggcccugauccaccugagcgaccugagagaguacagaagauucgagaaggagaagcugaagagccaguggaacaacgacaacccccuguucaagagcgccaccaccaccgugaugaaccccaaguucgccgagagcuga

SEQ ID NO: 8107 - RNA, 2310 nt, Artificial Sequence
  derived and/or modified sequence opt5 from complement_system_component_CR3__Homo_sapiens__CAB90553
augcugggacucagacccccucugcuugcccugguggggcuccugagccuuggaugcguccugucccaggaguguaccaaguucaaaguuucuagcugccgggaauguaucgaguccggcccggggugcacauggugucaaaagcucaacuuuacgggacccggcgacccugauucuauucgcugcgacaccagaccccagcugcugaugcgggggugugcugccgaugacaucauggauccuacaagccucgcggaaacccaggaggaccacaauggaggccagaaacaacugagcccccagaaggugacacuuuaccugcgcccuggccaggcugccgccuucaacgugaccuuuagacgggcuaaaggguauccgauugaucucuacuaucugauggaccuuucuuacagcaugcuggaugaccuccgcaaugucaagaagcugggaggcgaucugcucagagcccugaacgaaaucacagaguccgggcggauuggauucggcagcuuuguggacaaaaccguucuucccuucgugaauacgcauccugauaagcugcgcaaccccugcccuaauaaagagaaggaaugucagcccccguuugcuuucagacacguccucaaacugaccaacaauucuaaccaauuucagacagagguggggaagcagcuuaucuccggaaaucuggacgccccugaaggcggccucgacgcgaugaugcagguugccgcuugccccgaggagaucggguggcggaacgugacccgccugcuggucuucgccacagaugacggauuucauuucgcuggcgaugggaagcucggagccauucugaccccuaaugacggcagaugucaccuugaagauaaccuguauaaacggagcaaugaguuugacuaccccucuguggggcaacucgcgcauaagcuggccgaaaacaacauccagcccauuuucgcugugacgucccgcauggucaaaacauaugagaaacuuaccgaaaucauuccuaagagcgccguuggagagcugucugaggauuccagcaauguggugcagcucaucaagaacgcuuacaauaaacuguccucuagagucuuccuggaccacaacgcccucccggauacacugaaggugaccuacgacagcuuuugcuccaauggcguuacccaccggaaccaacccagaggcgauugcgacggggugcagauuaaugucccuaucacauuccaggugaagguuacggccaccgaauguauccaggagcaauccuuugugauucgcgcucuuggauucacagacaucgucaccgugcagguccugccccagugcgaaugucggugcagagaucagucucgcgaccggucccucugucauggcaaaggguuucuggagugcggaauuuguagaugcgauacaggcuauaucgggaagaacugugaaugccaaacccagggccgcagcucucaggagcuggagggaagcugucggaaagacaauaacuccauuaucugcucuggccuuggggauugcguguguggacagugccucugucacacgagcgacguuccuggcaagcugaucuacgggcaauauugcgaaugugauacaauuaauugcgagagauacaacggacagguguguggcgggcccggccgcggacugugcuucuguggcaaaugccggugucauccgggguuugaaggauccgcgugccagugcgagagaaccaccgaaggcugucucaauccucgccgggucgagugcagcgggagaggacggugucgcugcaacgugugugagugccacucuggcuaucagcugccccuuugucaagaaugcccugggugucccuccccuugcggcaaguacaucagcugugccgagugccugaaguucgaaaaaggacccuuuggcaagaauugcucugcugccuguccggggcuccagcuguccaacaacccuguuaaaggaagaacaugcaaggagcgggacagcgagggcuguuggguggccuauacccuggaacagcaagaugggauggacagauaccuuauuuacgucgaugagucccgcgaaugcguggcuggacccaauaucgccgcgauugugggcgggacaguugcuggcaucguccucaucggcauucugcugcucgugaucuggaaagcccugauucaccuuucugaccugcgggaguauagacgcuucgaaaaggagaagcucaaaagccaguggaacaaugauaacccccuguuuaaguccgccacgaccacagugaugaauccuaaauucgcugagucuuga

SEQ ID NO: 8108 - protein, 699 aa, Artificial Sequence
  complement_system_component_MASP-1__Homo_sapiens__P48740
MRWLLLYYALCFSLSKASAHTVELNNMFGQIQSPGYPDSYPSDSEVTWNITVPDGFRIKLYFMHFNLESSYLCEYDYVKVETEDQVLATFCGRETTDTEQTPGQEVVLSPGSFMSITFRSDFSNEERFTGFDAHYMAVDVDECKEREDEELSCDHYCHNYIGGYYCSCRFGYILHTDNRTCRVECSDNLFTQRTGVITSPDFPNPYPKSSECLYTIELEEGFMVNLQFEDIFDIEDHPEVPCPYDYIKIKVGPKVLGPFCGEKAPEPISTQSHSVLILFHSDNSGENRGWRLSYRAAGNECPELQPPVHGKIEPSQAKYFFKDQVLVSCDTGYKVLKDNVEMDTFQIECLKDGTWSNKIPTCKIVDCRAPGELEHGLITFSTRNNLTTYKSEIKYSCQEPYYKMLNNNTGIYTCSAQGVWMNKVLGRSLPTCLPVCGLPKFSRKLMARIFNGRPAQKGTTPWIAMLSHLNGQPFCGGSLLGSSWIVTAAHCLHQSLDPEDPTLRDSDLLSPSDFKIILGKHWRLRSDENEQHLGVKHTTLHPQYDPNTFENDVALVELLESPVLNAFVMPICLPEGPQQEGAMVIVSGWGKQFLQRFPETLMEIEIPIVDHSTCQKAYAPLKKKVTRDMICAGEKEGGKDACAGDSGGPMVTLNRERGQWYLVGTVSWGDDCGKKDRYGVYSYIHHNKDWIQRVTGVRN

SEQ ID NO: 8109 - RNA, 2100 nt, Artificial Sequence
  complement_system_component_MASP-1__Homo_sapiens__CCDS33907.1
augagguggcugcuucucuauuaugcucugugcuucucccugucaaaggcuucagcccacaccguggagcuaaacaauauguuuggccagauccagucgccugguuauccagacuccuaucccagugauucagaggugacuuggaauaucacugucccagauggguuucggaucaagcuuuacuucaugcacuucaacuuggaauccuccuaccuuugugaauaugacuaugugaagguagaaacugaggaccaggugcuggcaaccuucuguggcagggagaccacagacacagagcagacucccggccaggaggugguccucuccccuggcuccuucauguccaucacuuuccggucagauuucuccaaugaggagcguuucacaggcuuugaugcccacuacauggcuguggauguggacgagugcaaggagagggaggacgaggagcuguccugugaccacuacugccacaacuacauuggcggcuacuacugcuccugccgcuucggcuacauccuccacacagacaacaggaccugccgaguggagugcagugacaaccucuucacucaaaggacuggggugaucaccagcccugacuucccaaacccuuaccccaagagcucugaaugccuguauaccaucgagcuggaggaggguuucauggucaaccugcaguuugaggacauauuugacauugaggaccauccugaggugcccugccccuaugacuacaucaagaucaaaguugguccaaaaguuuuggggccuuucuguggagagaaagccccagaacccaucagcacccagagccacaguguccugauccuguuccauagugacaacucgggagagaaccggggcuggaggcucucauacagggcugcaggaaaugagugcccagagcuacagccuccuguccaugggaaaaucgagcccucccaagccaaguauuucuucaaagaccaagugcucgucagcugugacacaggcuacaaagugcugaaggauaauguggagauggacacauuccagauugagugucugaaggaugggacguggaguaacaagauucccaccuguaaaauuguagacuguagagccccaggagagcuggaacacgggcugaucaccuucucuacaaggaacaaccucaccacauacaagucugagaucaaauacuccugucaggagcccuauuacaagaugcucaacaauaacacagguauauauaccuguucugcccaaggagucuggaugaauaaaguauuggggagaagccuacccaccugccuuccagugugugggcuccccaaguucucccggaagcugauggccaggaucuucaauggacgcccagcccagaaaggcaccacucccuggauugccaugcugucacaccugaaugggcagcccuucugcggaggcucccuucuaggcuccagcuggaucgugaccgccgcacacugccuccaccagucacucgauccggaagauccgacccuacgugauucagacuugcucagcccuucugacuucaaaaucauccugggcaagcauuggaggcuccggucagaugaaaaugaacagcaucucggcgucaaacacaccacucuccacccccaguaugaucccaacacauucgagaaugacguggcucugguggagcuguuggagagcccagugcugaaugccuucgugaugcccaucugucugccugagggaccccagcaggaaggagccauggucaucgucagcggcugggggaagcaguucuugcaaagguucccagagacccugauggagauugaaaucccgauuguugaccacagcaccugccagaaggcuuaugccccgcugaagaagaaagugaccagggacaugaucugugcuggggagaaggaagggggaaaggacgccugugcgggugacucuggaggccccauggugacccugaauagagaaagaggccagugguaccuggugggcacuguguccuggggugaugacugugggaagaaggaccgcuacggaguauacucuuacauccaccacaacaaggacuggauccagagggucaccggagugaggaacuga

SEQ ID NO: 8110 - RNA, 2100 nt, Artificial Sequence
  derived and/or modified sequence opt1 from complement_system_component_MASP-1__Homo_sapiens__CCDS33907.1
augcgcuggcugcuccuguacuacgcccugugcuucagccucuccaaggccagcgcgcacaccguggagcugaacaacauguucggccagauccagucccccggguacccggacagcuaccccuccgacagcgaggucaccuggaacaucacggugcccgacggcuuccggaucaagcuguacuucaugcacuucaaccucgaguccagcuaccugugcgaguacgacuacgugaaggucgagaccgaggaccaggugcuggccaccuucugcgggcgcgagaccacggacaccgagcagacccccggccaggaggugguccucuccccggggagcuucauguccaucaccuuccggagcgacuucuccaacgaggagcgcuucacgggcuucgacgcccacuacauggccguggacguggacgagugcaaggagcgggaggacgaggagcugagcugcgaccacuacugccacaacuacaucggcggguacuacugcuccugccgcuucggcuacauccugcacaccgacaaccggaccugccgcgucgagugcagcgacaaccucuucacccagcggacgggggugaucaccucccccgacuuccccaaccccuaccccaagagcuccgagugccuguacaccaucgagcuggaggagggcuucauggugaaccuccaguucgaggacaucuucgacaucgaggaccaccccgagguccccugccccuacgacuacaucaagaucaagguggggccgaaggugcugggccccuucugcggcgagaaggcccccgagcccaucagcacccagagccacuccguccugauccucuuccacagcgacaacuccggggagaaccgcggcuggcggcugagcuaccgcgcggccgggaacgagugcccggagcugcagccgcccgugcacggcaagaucgagcccucccaggccaaguacuucuucaaggaccaggugcucgucagcugcgacacgggcuacaaggugcugaaggacaacguggagauggacaccuuccagaucgagugccugaaggacgggaccugguccaacaagaucccgaccugcaagaucgucgacugccgggcccccggcgagcucgagcacgggcugaucacguucagcacccgcaacaaccugaccaccuacaaguccgagaucaaguacagcugccaggagcccuacuacaagaugcucaacaacaacacgggcaucuacacgugcuccgcgcaggggguguggaugaacaaggugcugggccggagccugccgaccugccuccccgucugcggccugcccaaguucucccgcaagcugauggcccggaucuucaacgggcgccccgcccagaagggcaccacccccuggaucgccaugcucagccaccugaacgggcagccguucugcggcgggucccugcucggcagcuccuggaucgugaccgccgcgcacugccugcaccagagccuggaccccgaggaccccacccuccgggacuccgaccugcugagcccgagcgacuucaagaucauccucggcaagcacuggcgccugcgguccgacgagaacgagcagcaccugggggucaagcacaccacgcuccacccccaguacgaccccaacaccuucgagaacgacguggcccugguggagcugcucgagagccccguccugaacgccuucgugaugccgaucugccugcccgagggcccccagcaggagggggccauggugaucgucuccggcugggggaagcaguuccugcagcgcuuccccgagacccucauggagaucgagaucccgaucguggaccacagcacgugccagaaggccuacgcgccccugaagaagaaggugacccgcgacaugaucugcgccggcgagaaggagggcgggaaggacgccugcgccggcgacuccgggggccccauggucacccugaaccgggagcgcggccagugguaccucguggggaccgugagcuggggcgacgacugcgggaagaaggaccgguacggcgucuacuccuacauccaccacaacaaggacuggauccagcgcgugaccggggugcggaacuga

SEQ ID NO: 8111 - RNA, 2100 nt, Artificial Sequence
  derived and/or modified sequence opt2 from complement_system_component_MASP-1__Homo_sapiens__CCDS33907.1
augcgcuggcuccuccucuacuacgcccucugcuucucccucuccaaggccuccgcccacaccgucgagcucaacaacauguucggccagauccagucccccggcuaccccgacuccuaccccuccgacuccgaggucaccuggaacaucaccguccccgacggcuuccgcaucaagcucuacuucaugcacuucaaccucgaguccuccuaccucugcgaguacgacuacgucaaggucgagaccgaggaccagguccucgccaccuucugcggccgcgagaccaccgacaccgagcagacccccggccaggaggucguccucucccccggcuccuucauguccaucaccuuccgcuccgacuucuccaacgaggagcgcuucaccggcuucgacgcccacuacauggccgucgacgucgacgagugcaaggagcgcgaggacgaggagcucuccugcgaccacuacugccacaacuacaucggcggcuacuacugcuccugccgcuucggcuacauccuccacaccgacaaccgcaccugccgcgucgagugcuccgacaaccucuucacccagcgcaccggcgucaucaccucccccgacuuccccaaccccuaccccaaguccuccgagugccucuacaccaucgagcucgaggagggcuucauggucaaccuccaguucgaggacaucuucgacaucgaggaccaccccgagguccccugccccuacgacuacaucaagaucaaggucggccccaagguccucggccccuucugcggcgagaaggcccccgagcccaucuccacccagucccacuccguccucauccucuuccacuccgacaacuccggcgagaaccgcggcuggcgccucuccuaccgcgccgccggcaacgagugccccgagcuccagccccccguccacggcaagaucgagcccucccaggccaaguacuucuucaaggaccagguccucgucuccugcgacaccggcuacaagguccucaaggacaacgucgagauggacaccuuccagaucgagugccucaaggacggcaccugguccaacaagauccccaccugcaagaucgucgacugccgcgcccccggcgagcucgagcacggccucaucaccuucuccacccgcaacaaccucaccaccuacaaguccgagaucaaguacuccugccaggagcccuacuacaagaugcucaacaacaacaccggcaucuacaccugcuccgcccagggcgucuggaugaacaagguccucggccgcucccuccccaccugccuccccgucugcggccuccccaaguucucccgcaagcucauggcccgcaucuucaacggccgccccgcccagaagggcaccacccccuggaucgccaugcucucccaccucaacggccagcccuucugcggcggcucccuccucggcuccuccuggaucgucaccgccgcccacugccuccaccagucccucgaccccgaggaccccacccuccgcgacuccgaccuccucucccccuccgacuucaagaucauccucggcaagcacuggcgccuccgcuccgacgagaacgagcagcaccucggcgucaagcacaccacccuccacccccaguacgaccccaacaccuucgagaacgacgucgcccucgucgagcuccucgagucccccguccucaacgccuucgucaugcccaucugccuccccgagggcccccagcaggagggcgccauggucaucgucuccggcuggggcaagcaguuccuccagcgcuuccccgagacccucauggagaucgagauccccaucgucgaccacuccaccugccagaaggccuacgccccccucaagaagaaggucacccgcgacaugaucugcgccggcgagaaggagggcggcaaggacgccugcgccggcgacuccggcggccccauggucacccucaaccgcgagcgcggccagugguaccucgucggcaccgucuccuggggcgacgacugcggcaagaaggaccgcuacggcgucuacuccuacauccaccacaacaaggacuggauccagcgcgucaccggcguccgcaacuga

SEQ ID NO: 8112 - RNA, 2100 nt, Artificial Sequence
  derived and/or modified sequence opt3 from complement_system_component_MASP-1__Homo_sapiens__CCDS33907.1
augagauggcugcuccuuuacuaugcccugugcuucagcuuguccaaggcuucugcacacaccguggaguuaaacaauauguuuggccagauccaaucacccggguacccugacaguuauccaagcgauuccgaagucacauggaacauuacuguuccggacggauucaggauaaaacuguacuuuaugcauuucaaucuagagucuucguaucucugugaauacgauuaugugaagguagagacggaagaccaggugcuggccaccuuuugcggucgggagacaacugauaccgagcagacacccggccaggaagucgugcuuucaccugggagcuucaugaguaucaccuuucgcuccgacuucucuaacgaggaacgauuuacuggauucgaugcgcacuacauggcuguugacguggaugaguguaaagagcgugaagacgaggaacugagcugcgaucauuacugucacaauuauauuggcgguuacuauugcuccuguagauuuggguacaucuugcauacagacaacaggaccugccgggucgaguguucagauaaucucuucacgcaacgcacuggagugauuaccaguccagacuuucccaacccuuauccaaagagcucugaaugccuguacacaaucgagcuggaggaaggcuucaugguaaaucuccaguucgaggacauauuugauaucgaagaccaccccgagguuccuuguccauaugauuacauuaaaaucaaggugggcccgaaggucuuagggcccuucugcggagaaaaagccccugagccaauuuccacucagucacacagcgugcugauccuuuuucauagugacaacucuggugagaauagaggcuggagguuguccuaccgggcagccgggaacgaaugccccgagcugcagccuccagugcacggaaagauagaacccagccaagcuaaauauuucuuuaaggaucagguccuaguuucgugugacaccggcuacaaagugcucaaggauaauguagagauggacacauuccagauugaaugccugaaggaugguaccuggucuaacaaaaucccgacguguaagauuguggacugccgcgcaccuggggagcuugagcauggacugaucacuuuuuccacacgaaauaacuugaccacuuauaaaucagaaaucaaguacaguugucaggagcccuauuacaaaaugcucaacaauaacacaggcauuuauaccugcagcgcccaaggcgucuggaugaauaaggugcuggggagauccuuaccaacgugucugccuguuugcggacuccccaaauucucuaggaaacuuauggcucggauauuuaacggucguccagcccagaagggcaccacacccuggaucgcgaugcugagccacuugaaugggcagccuuucuguggaggcucacuacuggguaguuccuggauugugacugcagcccacugccuccaucaaagccuggauccagaagacccgacccuucgcgacucugaucuguugucacccagugacuuuaaaaucauacucgggaagcacuggagacugaggagcgaugagaacgagcagcauuuaggcgucaaacacacaacucugcauccucaguacgacccaaauaccuucgaaaacgauguggcucuaguagagcuccuggaaucccccguucuuaaugccuuugugaugccuauuuguuugccagagggaccccagcaagaaggcgcaauggucaucgugucuggguggggaaagcaguuccugcagcgguucccggagacacucauggagaucgaaauuccuaucgucgaccacucgaccugccagaaggcuuacgccccacugaagaagaaagugacucgagauaugauuugcgcgggugagaaggaaggcgggaaagacgccugugcaggagauagcggcggucccaugguuacgcuuaaccgcgagagagggcaaugguaucuggugggcacaguauccuggggagacgauugcggcaagaaagacagguacggggucuauucauacauacaccauaauaaggauuggauccagcgggugaccggaguucgcaacuga

SEQ ID NO: 8113 - RNA, 2100 nt, Artificial Sequence
  derived and/or modified sequence opt4 from complement_system_component_MASP-1__Homo_sapiens__CCDS33907.1
augagauggcugcugcuguacuacgcccugugcuucagccugagcaaggccagcgcccacaccguggagcugaacaacauguucggccagauccagagccccggcuaccccgacagcuaccccagcgacagcgaggugaccuggaacaucaccgugcccgacggcuucagaaucaagcuguacuucaugcacuucaaccuggagagcagcuaccugugcgaguacgacuacgugaagguggagaccgaggaccaggugcuggccaccuucugcggcagagagaccaccgacaccgagcagacccccggccaggagguggugcugagccccggcagcuucaugagcaucaccuucagaagcgacuucagcaacgaggagagauucaccggcuucgacgcccacuacauggccguggacguggacgagugcaaggagagagaggacgaggagcugagcugcgaccacuacugccacaacuacaucggcggcuacuacugcagcugcagauucggcuacauccugcacaccgacaacagaaccugcagaguggagugcagcgacaaccuguucacccagagaaccggcgugaucaccagccccgacuuccccaaccccuaccccaagagcagcgagugccuguacaccaucgagcuggaggagggcuucauggugaaccugcaguucgaggacaucuucgacaucgaggaccaccccgaggugcccugccccuacgacuacaucaagaucaaggugggccccaaggugcugggccccuucugcggcgagaaggcccccgagcccaucagcacccagagccacagcgugcugauccuguuccacagcgacaacagcggcgagaacagaggcuggagacugagcuacagagccgccggcaacgagugccccgagcugcagccccccgugcacggcaagaucgagcccagccaggccaaguacuucuucaaggaccaggugcuggugagcugcgacaccggcuacaaggugcugaaggacaacguggagauggacaccuuccagaucgagugccugaaggacggcaccuggagcaacaagauccccaccugcaagaucguggacugcagagcccccggcgagcuggagcacggccugaucaccuucagcaccagaaacaaccugaccaccuacaagagcgagaucaaguacagcugccaggagcccuacuacaagaugcugaacaacaacaccggcaucuacaccugcagcgcccagggcguguggaugaacaaggugcugggcagaagccugcccaccugccugcccgugugcggccugcccaaguucagcagaaagcugauggccagaaucuucaacggcagacccgcccagaagggcaccacccccuggaucgccaugcugagccaccugaacggccagcccuucugcggcggcagccugcugggcagcagcuggaucgugaccgccgcccacugccugcaccagagccuggaccccgaggaccccacccugagagacagcgaccugcugagccccagcgacuucaagaucauccugggcaagcacuggagacugagaagcgacgagaacgagcagcaccugggcgugaagcacaccacccugcacccccaguacgaccccaacaccuucgagaacgacguggcccugguggagcugcuggagagccccgugcugaacgccuucgugaugcccaucugccugcccgagggcccccagcaggagggcgccauggugaucgugagcggcuggggcaagcaguuccugcagagauuccccgagacccugauggagaucgagauccccaucguggaccacagcaccugccagaaggccuacgccccccugaagaagaaggugaccagagacaugaucugcgccggcgagaaggagggcggcaaggacgccugcgccggcgacagcggcggccccauggugacccugaacagagagagaggccagugguaccuggugggcaccgugagcuggggcgacgacugcggcaagaaggacagauacggcguguacagcuacauccaccacaacaaggacuggauccagagagugaccggcgugagaaacuga

SEQ ID NO: 8114 - RNA, 2100 nt, Artificial Sequence
  derived and/or modified sequence opt5 from complement_system_component_MASP-1__Homo_sapiens__CCDS33907.1
augagauggcugcuccuguacuaugcccuuugcuucagccuguccaaggcuucugcccacaccguggagcucaacaauauguuuggccagauccaaagccccggguacccugacuccuauccgucugauagcgaagucacauggaacauuacgguucccgacggauuccggaucaaacuguacuuuaugcauuucaaucuugaguccucuuaucugugugaauacgauuaugugaagguggagaccgaagaccagguccucgcgacauuuugcggccgcgagaccacagauaccgagcagacaccugggcaggaagugguucugagccccggauccuucaugagcauuaccuuuagaucugacuucuccaacgaggaacgguuuacgggcuucgaugcucacuacauggccguggacgucgaugaguguaaagagcgcgaagacgaggaacugagcugcgaucauuacugucacaauuauaucgggggauacuauugcucuuguagauuuggcuacauucuccauaccgacaaccggacaugccgcguggaguguuccgauaaucuguucacccaaagaacaggcguuaucaccagcccugacuuucccaacccuuauccgaagucuuccgaaugccuuuacacgaucgagcuggaggaaggguucauggugaaucuccaguucgaggacauuuuugauaucgaagaccaccccgaggucccuugucccuaugauuacauuaaaaucaaggugggaccuaaggugcugggccccuucugcggggaaaaagccccggagccuauuagcacacagucccacucuguccuuauccuguuucauagcgacaacuccggagagaaucggggcuggcgccucagcuacagagcugccgggaacgaaugccccgagcugcagccucccguucacggaaagauugaacccucucaagcuaaauauuucuuuaaggaucaggugcugguguccugugacaccggcuacaaaguccucaaggauaauguggagauggacacauuccagaucgaaugccugaaggauggcaccuggagcaacaaaaucccuaccuguaagauuguugacugccgggccccgggggagcuugagcauggacugaucacauuuucuacgcgcaauaaccucaccacauauaaaagcgaaauuaaguacuccugucaggagcccuauuacaaaaugcugaacaauaacaccggcaucuauacaugcucugcgcaagggguguggaugaauaagguccuuggaagaagccugccuaccugucuccccgugugcggccugccuaaauucucccggaagcugauggcccgcauuuuuaacgggagacccgcucagaagggaacgacaccguggaucgccaugcucagccaccugaauggccagccuuucuguggcgggucucuucugggauccagcuggaucguuaccgcugcccacugccuccaucaaucucuggaucccgaagacccuacccuucgggacuccgaucugcucagccccuccgacuuuaaaauuauccugggcaagcacuggagacugcgcucugaugagaacgagcagcaucucggggugaaacacacaacccugcauccucaguacgaccccaauacauucgaaaacgaugucgcgcuuguggagcugcucgaaagcccgguccugaaugccuuugugaugccuauuugucugcccgagggaccccagcaagaaggcgcuaugguuaucguguccggguggggcaagcaguuccuucagcgguucccugagacgcucauggagauugaaaucccgaucgucgaccacucuaccugccagaaagccuacgcuccccugaagaagaaagugacaagagauaugauuugcgccggagagaaggaaggcgggaaagacgccugugcuggagauagcggcgggccuaugguuacccugaaccgcgagcggggacaaugguaucucgugggcacagucuccuggggcgacgauugcgggaagaaagacagauacggaguguauagcuacauccaccauaauaaggauuggauucagcgcgugaccggcguucggaacuga

SEQ ID NO: 8115 - protein, 686 aa, Artificial Sequence
  complement_system_component_MASP-2__Homo_sapiens__O00187
MRLLTLLGLLCGSVATPLGPKWPEPVFGRLASPGFPGEYANDQERRWTLTAPPGYRLRLYFTHFDLELSHLCEYDFVKLSSGAKVLATLCGQESTDTERAPGKDTFYSLGSSLDITFRSDYSNEKPFTGFEAFYAAEDIDECQVAPGEAPTCDHHCHNHLGGFYCSCRAGYVLHRNKRTCSALCSGQVFTQRSGELSSPEYPRPYPKLSSCTYSISLEEGFSVILDFVESFDVETHPETLCPYDFLKIQTDREEHGPFCGKTLPHRIETKSNTVTITFVTDESGDHTGWKIHYTSTAQPCPYPMAPPNGHVSPVQAKYILKDSFSIFCETGYELLQGHLPLKSFTAVCQKDGSWDRPMPACSIVDCGPPDDLPSGRVEYITGPGVTTYKAVIQYSCEETFYTMKVNDGKYVCEADGFWTSSKGEKSLPVCEPVCGLSARTTGGRIYGGQKAKPGDFPWQVLILGGTTAAGALLYDNWVLTAAHAVYEQKHDASALDIRMGTLKRLSPHYTQAWSEAVFIHEGYTHDAGFDNDIALIKLNNKVVINSNITPICLPRKEAESFMRTDDIGTASGWGLTQRGFLARNLMYVDIPIVDHQKCTAAYEKPPYPRGSVTANMLCAGLESGGKDSCRGDSGGALVFLDSETERWFVGGIVSWGSMNCGEAGQYGVYTKVINYIPWIENIISDF

SEQ ID NO: 8116 - RNA, 2061 nt, Artificial Sequence
  complement_system_component_MASP-2__Homo_sapiens__CCDS123.1
augaggcugcugacccuccugggccuucuguguggcucgguggccacccccuugggcccgaaguggccugaaccuguguucgggcgccuggcaucccccggcuuuccaggggaguaugccaaugaccaggagcggcgcuggacccugacugcaccccccggcuaccgccugcgccucuacuucacccacuucgaccuggagcucucccaccucugcgaguacgacuucgucaagcugagcucgggggccaaggugcuggccacgcugugcgggcaggagagcacagacacggagcgggccccuggcaaggacacuuucuacucgcugggcuccagccuggacauuaccuuccgcuccgacuacuccaacgagaagccguucacgggguucgaggccuucuaugcagccgaggacauugacgagugccagguggccccgggagaggcgcccaccugcgaccaccacugccacaaccaccugggcgguuucuacugcuccugccgcgcaggcuacguccugcaccguaacaagcgcaccugcucagcccugugcuccggccaggucuucacccagaggucuggggagcucagcagcccugaauacccacggccguaucccaaacucuccaguugcacuuacagcaucagccuggaggagggguucagugucauucuggacuuuguggaguccuucgauguggagacacacccugaaacccugugucccuacgacuuucucaagauucaaacagacagagaagaacauggcccauucugugggaagacauugccccacaggauugaaacaaaaagcaacacggugaccaucaccuuugucacagaugaaucaggagaccacacaggcuggaagauccacuacacgagcacagcgcagccuugcccuuauccgauggcgccaccuaauggccacguuucaccugugcaagccaaauacauccugaaagacagcuucuccaucuuuugcgagacuggcuaugagcuucugcaaggucacuugccccugaaauccuuuacugcaguuugucagaaagauggaucuugggaccggccaaugcccgcgugcagcauuguugacuguggcccuccugaugaucuacccaguggccgaguggaguacaucacagguccuggagugaccaccuacaaagcugugauucaguacagcugugaagagaccuucuacacaaugaaagugaaugaugguaaauaugugugugaggcugauggauucuggacgagcuccaaaggagaaaaaucacucccagucugugagccuguuuguggacuaucagcccgcacaacaggagggcguauauauggagggcaaaaggcaaaaccuggugauuuuccuuggcaaguccugauauuagguggaaccacagcagcaggugcacuuuuauaugacaacuggguccuaacagcugcucaugccgucuaugagcaaaaacaugaugcauccgcccuggacauucgaaugggcacccugaaaagacuaucaccucauuauacacaagccuggucugaagcuguuuuuauacaugaagguuauacucaugaugcuggcuuugacaaugacauagcacugauuaaauugaauaacaaaguuguaaucaauagcaacaucacgccuauuugucugccaagaaaagaagcugaauccuuuaugaggacagaugacauuggaacugcaucuggauggggauuaacccaaagggguuuucuugcuagaaaucuaauguaugucgacauaccgauuguugaccaucaaaaauguacugcugcauaugaaaagccacccuauccaaggggaaguguaacugcuaacaugcuuugugcuggcuuagaaagugggggcaaggacagcugcagaggugacagcggaggggcacugguguuucuagauagugaaacagagaggugguuugugggaggaauaguguccugggguuccaugaauuguggggaagcaggucaguauggagucuacacaaaaguuauuaacuauauucccuggaucgagaacauaauuagugauuuuuaa

SEQ ID NO: 8117 - RNA, 2061 nt, Artificial Sequence
  derived and/or modified sequence opt1 from complement_system_component_MASP-2__Homo_sapiens__CCDS123.1
augcgccugcucacccugcugggccuccugugcgggagcguggccacgccccugggcccgaaguggcccgagcccgucuucgggcggcucgccucccccggcuucccgggggaguacgcgaacgaccaggagcgccgguggacccugaccgccccgcccggcuaccgccugcggcucuacuucacccacuucgaccuggagcugagccaccucugcgaguacgacuucgugaagcuguccagcggcgccaaggugcuggccacccucugcgggcaggaguccacggacaccgagcgcgcccccggcaaggacaccuucuacagccugggguccagccuggacaucaccuuccgguccgacuacagcaacgagaagcccuucacgggcuucgaggcguucuacgccgccgaggacaucgacgagugccaggucgcccccggggaggcgccgaccugcgaccaccacugccacaaccaccucggcggcuucuacugcuccugccgcgccggguacgugcugcaccggaacaagcggaccugcagcgcccugugcuccggccagguguucacccagcgcagcggggagcucuccagccccgaguacccccgccccuaccccaagcuguccagcugcacguacuccaucagccuggaggagggcuucagcgucauccucgacuucguggaguccuucgacguggagacccaccccgagacccugugcccguacgacuuccugaagauccagaccgaccgggaggagcacggccccuucugcgggaagacgcucccccaccgcaucgagaccaagagcaacaccgucaccaucacguucgugaccgacgaguccggcgaccacaccggguggaagauccacuacaccagcacggcccagcccugcccguaccccauggccccgcccaacggccacgugucccccguccaggcgaaguacauccugaaggacagcuucuccaucuucugcgagaccggguacgagcugcuccagggccaccucccccucaagagcuucaccgccgugugccagaaggacggcuccugggaccggcccaugcccgccugcagcaucguggacugcgggccgcccgacgaccugcccuccggccgcgucgaguacaucaccgggccgggcgugacgaccuacaaggccgugauccaguacagcugcgaggagaccuucuacaccaugaaggucaacgacgggaaguacgugugcgaggccgacggcuucuggacguccagcaagggcgagaagucccugcccgugugcgagcccgucugcgggcugagcgcgcggaccaccggcgggcgcaucuacggcgggcagaaggccaagcccggcgacuucccguggcagguccugauccugggcgggaccacggccgccggcgcccugcucuacgacaacugggugcugaccgcggcccacgccguguacgagcagaagcacgacgccuccgcccuggacauccggauggggacccucaagcgccugagcccccacuacacccaggcgugguccgaggccguguucauccacgagggcuacacccacgacgccggcuucgacaacgacaucgcccugaucaagcucaacaacaaggucgugaucaacagcaacaucacgcccaucugccugccccggaaggaggcggagagcuucaugcgcaccgacgacaucgggaccgccuccggcugggggcugacccagcgcggcuuccucgcccggaaccugauguacguggacaucccgaucgucgaccaccagaagugcacggccgccuacgagaagccgcccuacccccgcgggagcgugaccgcgaacaugcugugcgccggccuggaguccggcgggaaggacagcugccggggcgacuccgggggcgcccucguguuccuggacagcgagaccgagcgcugguucgucgggggcaucguguccuggggcagcaugaacugcggggaggccggccaguacgggguguacaccaaggucaucaacuacauccccuggaucgagaacaucaucuccgacuucuga

SEQ ID NO: 8118 - RNA, 2061 nt, Artificial Sequence
  derived and/or modified sequence opt2 from complement_system_component_MASP-2__Homo_sapiens__CCDS123.1
augcgccuccucacccuccucggccuccucugcggcuccgucgccaccccccucggccccaaguggcccgagcccgucuucggccgccucgccucccccggcuuccccggcgaguacgccaacgaccaggagcgccgcuggacccucaccgccccccccggcuaccgccuccgccucuacuucacccacuucgaccucgagcucucccaccucugcgaguacgacuucgucaagcucuccuccggcgccaagguccucgccacccucugcggccaggaguccaccgacaccgagcgcgcccccggcaaggacaccuucuacucccucggcuccucccucgacaucaccuuccgcuccgacuacuccaacgagaagcccuucaccggcuucgaggccuucuacgccgccgaggacaucgacgagugccaggucgcccccggcgaggcccccaccugcgaccaccacugccacaaccaccucggcggcuucuacugcuccugccgcgccggcuacguccuccaccgcaacaagcgcaccugcuccgcccucugcuccggccaggucuucacccagcgcuccggcgagcucuccucccccgaguacccccgccccuaccccaagcucuccuccugcaccuacuccaucucccucgaggagggcuucuccgucauccucgacuucgucgaguccuucgacgucgagacccaccccgagacccucugccccuacgacuuccucaagauccagaccgaccgcgaggagcacggccccuucugcggcaagacccucccccaccgcaucgagaccaaguccaacaccgucaccaucaccuucgucaccgacgaguccggcgaccacaccggcuggaagauccacuacaccuccaccgcccagcccugccccuaccccauggccccccccaacggccacgucucccccguccaggccaaguacauccucaaggacuccuucuccaucuucugcgagaccggcuacgagcuccuccagggccaccucccccucaaguccuucaccgccgucugccagaaggacggcuccugggaccgccccaugcccgccugcuccaucgucgacugcggcccccccgacgaccuccccuccggccgcgucgaguacaucaccggccccggcgucaccaccuacaaggccgucauccaguacuccugcgaggagaccuucuacaccaugaaggucaacgacggcaaguacgucugcgaggccgacggcuucuggaccuccuccaagggcgagaagucccuccccgucugcgagcccgucugcggccucuccgcccgcaccaccggcggccgcaucuacggcggccagaaggccaagcccggcgacuuccccuggcagguccucauccucggcggcaccaccgccgccggcgcccuccucuacgacaacuggguccucaccgccgcccacgccgucuacgagcagaagcacgacgccuccgcccucgacauccgcaugggcacccucaagcgccucuccccccacuacacccaggccugguccgaggccgucuucauccacgagggcuacacccacgacgccggcuucgacaacgacaucgcccucaucaagcucaacaacaaggucgucaucaacuccaacaucacccccaucugccucccccgcaaggaggccgaguccuucaugcgcaccgacgacaucggcaccgccuccggcuggggccucacccagcgcggcuuccucgcccgcaaccucauguacgucgacauccccaucgucgaccaccagaagugcaccgccgccuacgagaagccccccuacccccgcggcuccgucaccgccaacaugcucugcgccggccucgaguccggcggcaaggacuccugccgcggcgacuccggcggcgcccucgucuuccucgacuccgagaccgagcgcugguucgucggcggcaucgucuccuggggcuccaugaacugcggcgaggccggccaguacggcgucuacaccaaggucaucaacuacauccccuggaucgagaacaucaucuccgacuucuga

SEQ ID NO: 8119 - RNA, 2061 nt, Artificial Sequence
  derived and/or modified sequence opt3 from complement_system_component_MASP-2__Homo_sapiens__CCDS123.1
augagacugcucacccuucugggcuuguuaugcgggagcguggccacaccccugggaccuaaguggccagagccggucuucgguaggcuagcuucccccggcuuuccuggggaauacgcaaacgaccaggagcggcgcuggacucucacggccccacccggauaucgacugcgucuuuacuucacccacuuugaucuggaauugucucaucucugugaguaugacuucguuaaacugucaaguggcgcgaaggugcuggcuacacucugcggucaagaaagcacugauaccgagagagccccugggaaagacacauuuuacuccuuaggaucuucgcuggauaucaccuucaggucagacuauagcaaugagaagccauuuacuggcuucgaagcauuuuacgccgcugaggauauugacgaaugucagguagcacccggcgaggccccuacaugcgaucaccauugucacaaccaucuugggggauucuauugcaguugucgggcugguuacguguugcaccgcaauaaaagaaccugcuccgcccuguguucuggccaggucuuuacgcagaggagcggggagcuauccucaccagaauacccgcggcccuauccuaagcucaguagcugcacuuacucuauaucccuggaggaaggauucucagugauccuugacuuuguugagagcuucgauguggaaacccacccagagacacugugucccuaugacuucuugaagauucaaacugaucgcgaggaacauggcccuuuuugcgguaaaacccucccacaccgaaucgagacaaagaguaacaccgucacgauuacuuucgugacagacgaaucuggggaccauaccggauggaaaauccacuacacuuccacagcgcagcccugcccguauccuauggcacccccaaauggccacguaagcccuguucaggccaaguacauacugaaagauucguuuucuaucuucugugagaccggcuaugaauuacugcaggggcaucucccccuuaaguccuuuacggcugugugccaaaaggacggaucaugggauagaccaaugcccgccuguaguauugucgacugcgguccuccagaugaccugccgagcggcaggguggaguacaucaccgggcccggagugacaacuuacaaagcagucauucaguauuccugugaggaaaccuucuacacaaugaagguuaacgauggcaaauaugugugcgaggcugacgguuuuuggacuucuagcaagggggaaaaaucauugccuguaugugagccagugugcggccuaagugcccggaccacaggaggccguaucuacgggggacagaaggcgaaacccggugauuucccuuggcagguccugauacucggcgggaccacugccgcaggagcucugcuuuaugacaauugggugcugacggccgcucacgccguuuacgaacaaaagcaugaugcauccgccuuggacauucgcaugggcacacucaagagacugagcccacacuauacccaggcuuggucugaggcgguguuuauccaugaggguuacacucacgacgcaggguucgauaacgacauugccuuaaucaaacugaauaacaaggucgugaucaauucaaacauuacccccauaugucuaccgaggaaagaagcugagaguuuuaugcggacagaugacaucggcaccgccagcggauggggccucacucagcgaggguuccuggcacgcaaucuuauguacguagauauuccuaucguugaccaccaaaagugcacagccgcuuaugaaaaaccacccuacccuagaggauccgugacggccaacauguugugugcaggucuggagucuggcgggaaggauucgugcaggggagacagcggcggugcgcucgucuuucuggauuccgagaccgaacggugguucgucgggggcauagugucauggggaaguaugaauugcggcgaggcugggcaguauggaguguacacuaagguuauuaacuauauccccuggaucgaaaacauuaucucugacuucuga

SEQ ID NO: 8120 - RNA, 2061 nt, Artificial Sequence
  derived and/or modified sequence opt4 from complement_system_component_MASP-2__Homo_sapiens__CCDS123.1
augagacugcugacccugcugggccugcugugcggcagcguggccaccccccugggccccaaguggcccgagcccguguucggcagacuggccagccccggcuuccccggcgaguacgccaacgaccaggagagaagauggacccugaccgccccccccggcuacagacugagacuguacuucacccacuucgaccuggagcugagccaccugugcgaguacgacuucgugaagcugagcagcggcgccaaggugcuggccacccugugcggccaggagagcaccgacaccgagagagcccccggcaaggacaccuucuacagccugggcagcagccuggacaucaccuucagaagcgacuacagcaacgagaagcccuucaccggcuucgaggccuucuacgccgccgaggacaucgacgagugccagguggcccccggcgaggcccccaccugcgaccaccacugccacaaccaccugggcggcuucuacugcagcugcagagccggcuacgugcugcacagaaacaagagaaccugcagcgcccugugcagcggccagguguucacccagagaagcggcgagcugagcagccccgaguaccccagacccuaccccaagcugagcagcugcaccuacagcaucagccuggaggagggcuucagcgugauccuggacuucguggagagcuucgacguggagacccaccccgagacccugugccccuacgacuuccugaagauccagaccgacagagaggagcacggccccuucugcggcaagacccugccccacagaaucgagaccaagagcaacaccgugaccaucaccuucgugaccgacgagagcggcgaccacaccggcuggaagauccacuacaccagcaccgcccagcccugccccuaccccauggccccccccaacggccacgugagccccgugcaggccaaguacauccugaaggacagcuucagcaucuucugcgagaccggcuacgagcugcugcagggccaccugccccugaagagcuucaccgccgugugccagaaggacggcagcugggacagacccaugcccgccugcagcaucguggacugcggcccccccgacgaccugcccagcggcagaguggaguacaucaccggccccggcgugaccaccuacaaggccgugauccaguacagcugcgaggagaccuucuacaccaugaaggugaacgacggcaaguacgugugcgaggccgacggcuucuggaccagcagcaagggcgagaagagccugcccgugugcgagcccgugugcggccugagcgccagaaccaccggcggcagaaucuacggcggccagaaggccaagcccggcgacuuccccuggcaggugcugauccugggcggcaccaccgccgccggcgcccugcuguacgacaacugggugcugaccgccgcccacgccguguacgagcagaagcacgacgccagcgcccuggacaucagaaugggcacccugaagagacugagcccccacuacacccaggccuggagcgaggccguguucauccacgagggcuacacccacgacgccggcuucgacaacgacaucgcccugaucaagcugaacaacaagguggugaucaacagcaacaucacccccaucugccugcccagaaaggaggccgagagcuucaugagaaccgacgacaucggcaccgccagcggcuggggccugacccagagaggcuuccuggccagaaaccugauguacguggacauccccaucguggaccaccagaagugcaccgccgccuacgagaagccccccuaccccagaggcagcgugaccgccaacaugcugugcgccggccuggagagcggcggcaaggacagcugcagaggcgacagcggcggcgcccugguguuccuggacagcgagaccgagagaugguucgugggcggcaucgugagcuggggcagcaugaacugcggcgaggccggccaguacggcguguacaccaaggugaucaacuacauccccuggaucgagaacaucaucagcgacuucuga

SEQ ID NO: 8121 - RNA, 2061 nt, Artificial Sequence
  derived and/or modified sequence opt5 from complement_system_component_MASP-2__Homo_sapiens__CCDS123.1
augagacugcucacccugcuuggccugcucugcgggagcguggccacaccccugggaccuaaguggccggagcccgucuucggccggcuugcuuccccuggguuucccggagaauacgccaacgaccaggagcgcagauggacgcugaccgcgccucccggcuaucggcuccgccuguacuucacacacuuugaucuggaacucucucaucugugugaguaugacuucguuaaacuuagcuccggggcuaaggugcuggccacccucugcggacaagaaucuacagauaccgagagagccccuggcaaagacacauuuuacagccugggcuccucucuugauaucaccuuccggagcgacuauuccaaugagaagccguuuacgggguucgaggcuuuuuacgccgcugaagauauugacgaaugucagguggcccccggagaggcgccuaccugcgaucaccauugucacaaccaucugggcggguucuauugcagcugucgcgccggauacguccuccacagaaauaaacggacaugcucugcucuguguuccggccagguguuuacccagcgcagcggggagcugucuucccccgaauacccuagacccuauccgaagcucagcucuugcacauacuccaucagccuggaggaaggauucuccguuauucuugacuuuguggagucuuucgaugucgaaacccacccugagacgcugugucccuaugacuuccucaagauccaaacagaucgggaggaacauggcccuuuuugcggcaaaacccugccccaccgcauugagacaaagagcaacaccgugaccaucacauucguuacggacgaauccggggaccauaccggauggaaaauccacuacacaagcaccgcccagcccugcccuuauccgauggcucccccuaauggccacgugucucccguccaggccaaguacauucuuaaagauuccuuuagcaucuucugugagacaggguaugaacugcuccagggacaucugccucugaagucuuuuaccgcggugugccaaaaggacggcagcugggauagacccaugccggccuguuccauuguggacugcgggccucccgaugaccucccuucuggacgggucgaguacaucacgggccccggcguuacaaccuacaaagcugugauucaguauagcugugaggaaaccuucuacacaaugaaggugaacgaugggaaauaugucugcgaggccgacggauuuuggaccuccagcaagggcgaaaaaucucugccugugugugagcccguuugcgggcuuuccgcucgcacaacgggaggcagaaucuacgggggccagaaggccaaaccgggagauuucccuuggcaagugcugauucucggcgggaccacagccgcuggagcgcugcuuuaugacaauuggguccugaccgccgcucacgccguguacgaacagaagcaugaugccagcgcucucgacauccggaugggcacacugaagagacugucuccccacuauacccaggccugguccgaggcgguuuuuauccaugagggguacacgcacgacgcuggauucgauaacgacauugcccucaucaaacugaauaacaagguggucauuaauagcaacaucacccccauuugucuuccucgcaaagaagccgaguccuuuaugcggacagaugacaucggcaccgcuucuggguggggccugacacagagaggauuccucgcccgcaaucugauguacguggauaucccgauugucgaccaccaaaagugcaccgcugccuaugaaaaacccccuuacccccggggcagcgugacggcgaacaugcugugugccgggcuugaguccggaggcaaggauucuugcagaggggacagcggaggcgcucucguuuuucuggauuccgagacagaacgcugguucgucgggggcaucgugagcuggggaucuaugaauugcggcgaggccgggcaguauggaguguacaccaagguuauuaacuauaucccuuggauugaaaacaucaucuccgacuucuga

SEQ ID NO: 8122 - protein, 248 aa, Artificial Sequence
  complement_system_component_MBL__Homo_sapiens__P11226
MSLFPSLPLLLLSMVAASYSETVTCEDAQKTCPAVIACSSPGINGFPGKDGRDGTKGEKGEPGQGLRGLQGPPGKLGPPGNPGPSGSPGPKGQKGDPGKSPDGDSSLAASERKALQTEMARIKKWLTFSLGKQVGNKFFLTNGEIMTFEKVKALCVKFQASVATPRNAAENGAIQNLIKEEAFLGITDEKTEGQFVDLTGNRLTYTNWNEGEPNNAGSDEDCVLLLKNGQWNDVPCSTSHLAVCEFPI

SEQ ID NO: 8123 - RNA, 747 nt, Artificial Sequence
  complement_system_component_MBL__Homo_sapiens__AAC31937
augucccuguuuccaucacucccucuccuucuccugaguaugguggcagcgucuuacucagaaacugugaccugugaggaugcccaaaagaccugcccugcagugauugccuguagcucuccaggcaucaacggcuucccaggcaaagaugggcgugauggcaccaagggagaaaagggggaaccaggccaagggcucagaggcuuacagggccccccuggaaaguuggggccuccaggaaauccagggccuucugggucaccaggaccaaagggccaaaaaggagacccuggaaaaaguccggauggugauaguagccuggcugccucagaaagaaaagcucugcaaacagaaauggcacguaucaaaaaguggcugaccuucucucugggcaaacaaguugggaacaaguucuuccugaccaauggugaaauaaugaccuuugaaaaagugaaggccuugugugucaaguuccaggccucuguggccacccccaggaaugcugcagagaauggagccauucagaaucucaucaaggaggaagccuuccugggcaucacugaugagaagacagaagggcaguuuguggaucugacaggaaauagacugaccuacacaaacuggaacgagggugaacccaacaaugcugguucugaugaagauuguguauugcuacugaaaaauggccaguggaaugacguccccugcuccaccucccaucuggccgucugugaguucccuaucuga

SEQ ID NO: 8124 - RNA, 747 nt, Artificial Sequence
  derived and/or modified sequence opt1 from complement_system_component_MBL__Homo_sapiens__AAC31937
augagccuguuccccucccucccgcugcugcuccugagcaugguggccgccuccuacagcgagaccgugaccugcgaggacgcgcagaagacgugccccgccgugaucgccugcuccagccccggcaucaacggguuccccggcaaggacgggcgcgacggcaccaagggggagaagggcgagccgggccaggggcugcggggccuccaggggccgcccggcaagcuggggccgcccggcaaccccggccccuccgggagccccggccccaaggggcagaagggcgaccccggcaagucccccgacggggacagcucccuggccgccagcgagcgcaaggcgcuccagaccgagauggcccggaucaagaaguggcugaccuucucccugggcaagcaggucgggaacaaguucuuccucacgaacggcgagaucaugaccuucgagaaggucaaggcccugugcgugaaguuccaggccagcguggcgacgccccgcaacgccgccgagaacggggccauccagaaccugaucaaggaggaggccuuccucggcaucaccgacgagaagaccgagggccaguucgucgaccugaccgggaaccggcugaccuacaccaacuggaacgagggcgagccgaacaacgcgggguccgacgaggacugcgugcuccugcugaagaacggccaguggaacgacgugcccugcagcacgucccaccucgccgucugcgaguuccccaucuga

SEQ ID NO: 8125 - RNA, 747 nt, Artificial Sequence
  derived and/or modified sequence opt2 from complement_system_component_MBL__Homo_sapiens__AAC31937
augucccucuuccccucccucccccuccuccuccucuccauggucgccgccuccuacuccgagaccgucaccugcgaggacgcccagaagaccugccccgccgucaucgccugcuccucccccggcaucaacggcuuccccggcaaggacggccgcgacggcaccaagggcgagaagggcgagcccggccagggccuccgcggccuccagggcccccccggcaagcucggcccccccggcaaccccggccccuccggcucccccggccccaagggccagaagggcgaccccggcaagucccccgacggcgacuccucccucgccgccuccgagcgcaaggcccuccagaccgagauggcccgcaucaagaaguggcucaccuucucccucggcaagcaggucggcaacaaguucuuccucaccaacggcgagaucaugaccuucgagaaggucaaggcccucugcgucaaguuccaggccuccgucgccaccccccgcaacgccgccgagaacggcgccauccagaaccucaucaaggaggaggccuuccucggcaucaccgacgagaagaccgagggccaguucgucgaccucaccggcaaccgccucaccuacaccaacuggaacgagggcgagcccaacaacgccggcuccgacgaggacugcguccuccuccucaagaacggccaguggaacgacguccccugcuccaccucccaccucgccgucugcgaguuccccaucuga

SEQ ID NO: 8126 - RNA, 747 nt, Artificial Sequence
  derived and/or modified sequence opt3 from complement_system_component_MBL__Homo_sapiens__AAC31937
augagccuguuccccucccucccucuucuguuguuaucuaugguggccgcuucauacagugagacugucacaugcgaagacgcacagaagacuuguccagccguuaucgcgugcagcuccccgggcauuaacggguuucccggaaaagaugguagagacggcacgaagggggagaaaggagaaccuggccaaggucugagggggcuacagggaccacccggcaagcucggcccuccagggaaucccggaccuucugguucgccaggcccgaaagggcagaagggagaucccggcaagucaccugacggugauagcagucuggcugccuccgagcggaaagcacuucagaccgaaauggcccgcauaaagaaauggcugacauucucuuuggggaagcaagugggaaacaaauuuuuccucacuaauggcgagaucaugaccuuugagaagguaaaggcucugugugugaaauuccaggcaagcgucgccacaccacgaaacgcugccgaaaauggcgcgauucagaaccugaucaaggaggaagcauuucucgggauuaccgacgagaaaacugagggacaguucguggauuuaacagguaaucgucugaccuauacgaacuggaaugaaggcgagcccaacaaugccggguccgacgaagauugcguucuuuugcugaagaacggacaauggaaugacgugccuuguucaaccagucaccuagcugucugcgaguuuccaaucuga

SEQ ID NO: 8127 - RNA, 747 nt, Artificial Sequence
  derived and/or modified sequence opt4 from complement_system_component_MBL__Homo_sapiens__AAC31937
augagccuguuccccagccugccccugcugcugcugagcaugguggccgccagcuacagcgagaccgugaccugcgaggacgcccagaagaccugccccgccgugaucgccugcagcagccccggcaucaacggcuuccccggcaaggacggcagagacggcaccaagggcgagaagggcgagcccggccagggccugagaggccugcagggcccccccggcaagcugggcccccccggcaaccccggccccagcggcagccccggccccaagggccagaagggcgaccccggcaagagccccgacggcgacagcagccuggccgccagcgagagaaaggcccugcagaccgagauggccagaaucaagaaguggcugaccuucagccugggcaagcaggugggcaacaaguucuuccugaccaacggcgagaucaugaccuucgagaaggugaaggcccugugcgugaaguuccaggccagcguggccacccccagaaacgccgccgagaacggcgccauccagaaccugaucaaggaggaggccuuccugggcaucaccgacgagaagaccgagggccaguucguggaccugaccggcaacagacugaccuacaccaacuggaacgagggcgagcccaacaacgccggcagcgacgaggacugcgugcugcugcugaagaacggccaguggaacgacgugcccugcagcaccagccaccuggccgugugcgaguuccccaucuga

SEQ ID NO: 8128 - RNA, 747 nt, Artificial Sequence
  derived and/or modified sequence opt5 from complement_system_component_MBL__Homo_sapiens__AAC31937
augagccuguuccccucccucccucugcuucugcucucuaugguggccgcuagcuacuccgagaccgucacaugcgaagacgcccagaagacguguccggcgguuaucgcuugcucuagccccggcauuaacggguuuccuggaaaagauggcagagacgggaccaagggagagaaaggcgaacccgggcaaggacugcggggccuucagggcccucccgggaagcugggaccuccgggcaaucccgggccuuccggaucucccggcccuaaagggcagaagggagaucccggcaagagcccggacggcgauuccagccucgccgccucugagcgcaaagcucugcagacagaaauggccagaaucaagaaauggcugaccuucucccucgggaagcaagugggaaacaaauuuuuccugacaaauggcgagauuaugaccuuugagaaggugaaggcucuuugugucaaauuccaggccagcguggcgacaccucggaacgccgcugaaaauggggccauccagaaccugauuaaggaggaagccuuucucggaaucaccgacgagaaaacggagggccaguucguugaucugaccgggaaucgccuuacauauaccaacuggaaugaaggagagcccaacaaugcuggcucugacgaagauugcgugcugcuccugaagaacggccaauggaaugacgucccuuguuccacaagccaccuggcggugugcgaguuucccaucuga

SEQ ID NO: 8129 - protein, 392 aa, Artificial Sequence [sequence omitted]

SEQ ID NO: 8130 - RNA, 1179 nt, Artificial Sequence
  complement_system_component_MCP__Homo_sapiens__AAW82433
auggagccucccggccgccgcgagugucccuuuccuuccuggcgcuuuccuggguugcuucuggcggccaugguguugcugcuguacuccuucuccgaugccugugaggagccaccaacauuugaagcuauggagcucauugguaaaccaaaacccuacuaugagauuggugaacgaguagauuauaaguguaaaaaaggauacuucuauauaccuccucuugccacccauacuauuugugaucggaaucauacauggcuaccugucucagaugacgccuguuauagagaaacauguccauauauacgggauccuuuaaauggccaagcagucccugcaaaugggacuuacgaguuugguuaucagaugcacuuuauuuguaaugaggguuauuacuuaauuggugaagaaauucuauauugugaacuuaaaggaucaguagcaauuuggagcgguaagcccccaauaugugaaaagguuuuguguacaccaccuccaaaaauaaaaaauggaaaacacaccuuuagugaaguagaaguauuugaguaucuugaugcaguaacuuauaguugugauccugcaccuggaccagauccauuuucacuuauuggagagagcacgauuuauuguggugacaauucaguguggagucgugcugcuccagaguguaaaguggucaaaugucgauuuccaguagucgaaaauggaaaacagauaucaggauuuggaaaaaaauuuuacuacaaagcaacaguuauguuugaaugcgauaaggguuuuuaccucgauggcagcgacacaauugucugugacaguaacaguacuugggaucccccaguuccaaagugucuuaaagugcugccuccaucuaguacaaaaccuccagcuuugagucauucagugucgacuucuuccacuacaaaaucuccagcguccagugccucagguccuaggccuacuuacaagccuccagucucaaauuauccaggauauccuaaaccugaggaaggaauacuugacaguuuggauguuugggucauugcugugauuguuauugccauaguuguuggaguugcaguaauuuguguugucccguacagauaucuucaaaggaggaagaagaaaggcacauaccuaacugaugagacccacagagaaguaaaauuuacuucucucuga

SEQ ID NO: 8131 - RNA, 1179 nt, Artificial Sequence
  derived and/or modified sequence opt1 from complement_system_component_MCP__Homo_sapiens__AAW82433
auggagcccccgggccgccgggagugccccuuccccagcuggcgcuuccccgggcugcuccuggccgccauggugcugcuccuguacuccuucagcgacgcgugcgaggagccgcccaccuucgaggccauggagcugaucggcaagcccaagcccuacuacgagaucggggagcgggucgacuacaagugcaagaagggcuacuucuacaucccgccccucgccacccacacgaucugcgaccgcaaccacaccuggcugcccguguccgacgacgccugcuaccgggagaccugccccuacauccgcgacccgcugaacgggcaggccgugcccgcgaacggcaccuacgaguucggcuaccagaugcacuucaucugcaacgagggguacuaccucaucggcgaggagauccuguacugcgagcugaaggggagcgucgccaucugguccggcaagccgcccaucugcgagaaggugcucugcacgcccccgcccaagaucaagaacgggaagcacaccuucagcgagguggaggucuucgaguaccuggacgccgugaccuacuccugcgaccccgcccccggccccgaccccuucagccugaucggcgaguccaccaucuacugcggggacaacagcguguggucccgggcggcccccgagugcaaggucgugaagugccgcuucccgguggucgagaacggcaagcagaucagcggguucggcaagaaguucuacuacaaggccacggugauguucgagugcgacaagggcuucuaccucgacggguccgacaccaucgugugcgacagcaacuccaccugggacccgcccguccccaagugccugaaggugcugccgcccagcuccaccaagccgcccgcccucagccacuccgugagcacgagcuccaccaccaagagccccgccuccagcgcguccggcccccggcccaccuacaagccgcccgucagcaacuaccccggguaccccaagcccgaggagggcauccuggacucccuggacgugugggugaucgccgucaucgugaucgccaucguggucgggguggccgucaucugcguggugcccuaccgcuaccuccagcggcgcaagaagaagggcacguaccugaccgacgagacccaccgggaggucaaguucaccagccuguga

SEQ ID NO: 8132 - RNA, 1179 nt, Artificial Sequence
  derived and/or modified sequence opt2 from complement_system_component_MCP__Homo_sapiens__AAW82433
auggagccccccggccgccgcgagugccccuuccccuccuggcgcuuccccggccuccuccucgccgccaugguccuccuccucuacuccuucuccgacgccugcgaggagccccccaccuucgaggccauggagcucaucggcaagcccaagcccuacuacgagaucggcgagcgcgucgacuacaagugcaagaagggcuacuucuacauccccccccucgccacccacaccaucugcgaccgcaaccacaccuggcuccccgucuccgacgacgccugcuaccgcgagaccugccccuacauccgcgacccccucaacggccaggccguccccgccaacggcaccuacgaguucggcuaccagaugcacuucaucugcaacgagggcuacuaccucaucggcgaggagauccucuacugcgagcucaagggcuccgucgccaucugguccggcaagccccccaucugcgagaagguccucugcacccccccccccaagaucaagaacggcaagcacaccuucuccgaggucgaggucuucgaguaccucgacgccgucaccuacuccugcgaccccgcccccggccccgaccccuucucccucaucggcgaguccaccaucuacugcggcgacaacuccgucuggucccgcgccgcccccgagugcaaggucgucaagugccgcuuccccgucgucgagaacggcaagcagaucuccggcuucggcaagaaguucuacuacaaggccaccgucauguucgagugcgacaagggcuucuaccucgacggcuccgacaccaucgucugcgacuccaacuccaccugggacccccccguccccaagugccucaagguccucccccccuccuccaccaagccccccgcccucucccacuccgucuccaccuccuccaccaccaagucccccgccuccuccgccuccggcccccgccccaccuacaagccccccgucuccaacuaccccggcuaccccaagcccgaggagggcauccucgacucccucgacgucugggucaucgccgucaucgucaucgccaucgucgucggcgucgccgucaucugcgucguccccuaccgcuaccuccagcgccgcaagaagaagggcaccuaccucaccgacgagacccaccgcgaggucaaguucaccucccucuga

SEQ ID NO: 8133 - RNA, 1179 nt, Artificial Sequence
  derived and/or modified sequence opt3 from complement_system_component_MCP__Homo_sapiens__AAW82433
auggagcccccuggcagaagggaaugcccauucccgagcuggcgguuucccgggcugcuccuugccgcuauggugcuguuguuauacuccuucucugacgcaugugaggaaccuccaaccuuugaggccauggaacugaucggaaagcccaaaccuuauuacgagauuggugagcgcgucgauuauaagugcaaaaagggcuacuucuauauaccaccccuagcgacacacacuaucugugaccgaaaccauacguggcucccuguuucagaugacgcuugcuaccgugaaaccuguccauauauuagagauccgcugaaugggcaggccgugcccgcaaacggaacauacgaguuuggcuaccaaaugcacuucaucugcaaugaagguuauuaccuuauuggggaggagauccuguauugugaauugaaaggaaguguagccauauggagcggcaagccuccaaucugcgagaaggugcucuguacucccccuccaaaaauuaagaacggcaaacauaccuuuuccgaagucgagguguucgaauaccuggacgcuguuacauauucuugcgaucccgcaccggggccugaccccuuuucgcugaucggagagucaaccauuuacuguggugauaauagcguguggaguagggccgcuccagagugcaaggucgugaaaugccgguucccuguaguugaaaacggcaagcagaucuccggguuuggaaagaaauucuauuacaaggccacugugauguuugagugugacaaaggcuucuaccucgaugguucugacacaauagucugcgauagcaauuccaccugggaucccccagugcccaaguguuuaaaagugcugccuccaucaaguacgaagccgcccgcgcuuagccacucugucuccacuucaagcaccacaaaaaguccugcaucuuccgccagcgggccacgccccacuuauaagccuccaguuucgaacuaccccggauauccgaagccugaagagggcauuuuggacucucuggacguguggguaaucgcugugauugucaucgccaucgugguuggcguggcagucauuugcgugguaccauacagauaucuacagaggcggaaaaagaaagggaccuaccucacagacgaaacccaucgcgagguuaaguucacgucccuguga

SEQ ID NO: 8134 - RNA, 1179 nt, Artificial Sequence
  derived and/or modified sequence opt4 from complement_system_component_MCP__Homo_sapiens__AAW82433
auggagccccccggcagaagagagugccccuuccccagcuggagauuccccggccugcugcuggccgccauggugcugcugcuguacagcuucagcgacgccugcgaggagccccccaccuucgaggccauggagcugaucggcaagcccaagcccuacuacgagaucggcgagagaguggacuacaagugcaagaagggcuacuucuacauccccccccuggccacccacaccaucugcgacagaaaccacaccuggcugcccgugagcgacgacgccugcuacagagagaccugccccuacaucagagacccccugaacggccaggccgugcccgccaacggcaccuacgaguucggcuaccagaugcacuucaucugcaacgagggcuacuaccugaucggcgaggagauccuguacugcgagcugaagggcagcguggccaucuggagcggcaagccccccaucugcgagaaggugcugugcacccccccccccaagaucaagaacggcaagcacaccuucagcgagguggagguguucgaguaccuggacgccgugaccuacagcugcgaccccgcccccggccccgaccccuucagccugaucggcgagagcaccaucuacugcggcgacaacagcguguggagcagagccgcccccgagugcaagguggugaagugcagauuccccgugguggagaacggcaagcagaucagcggcuucggcaagaaguucuacuacaaggccaccgugauguucgagugcgacaagggcuucuaccuggacggcagcgacaccaucgugugcgacagcaacagcaccugggacccccccgugcccaagugccugaaggugcugccccccagcagcaccaagccccccgcccugagccacagcgugagcaccagcagcaccaccaagagccccgccagcagcgccagcggccccagacccaccuacaagccccccgugagcaacuaccccggcuaccccaagcccgaggagggcauccuggacagccuggacgugugggugaucgccgugaucgugaucgccaucguggugggcguggccgugaucugcguggugcccuacagauaccugcagagaagaaagaagaagggcaccuaccugaccgacgagacccacagagaggugaaguucaccagccuguga

SEQ ID NO: 8135 - RNA, 1179 nt, Artificial Sequence
  derived and/or modified sequence opt5 from complement_system_component_MCP__Homo_sapiens__AAW82433
auggagcccccuggcagacgggaaugcccguuccccagcuggcgcuuuccugggcugcuccuggccgcuauggugcuucugcucuacuccuucucugacgccugugaggaacccccuaccuuugaggcgauggaacugaucggaaagcccaaaccuuauuacgagauuggcgagagagucgauuauaagugcaaaaagggguacuucuauaucccgccccuugcuacacacacgauuugugaccggaaccauaccuggcugccuguuagcgaugacgccugcuaccgcgaaacaugucccuauaucagagauccucucaauggacaggccgugcccgcuaacggcaccuacgaguuuggguaccaaaugcacuucauuugcaaugaaggauauuaccugaucggcgaggagauccuguauugugaacucaaaggcuccguggccauuuggucugggaagccgccuaucugcgagaagguccuguguacacccccucccaaaauuaagaacggaaaacauaccuuuagcgaaguggagguuuucgaauaccuugacgcugugacauauuccugcgaucccgccccuggcccggaccccuuuucucugaucggggagagcaccauuuacuguggagauaauuccgucuggagccgggcggccccugagugcaaggugguuaaaugccgcuuccccguggucgaaaacggcaagcagaucucuggguuuggaaagaaauucuauuacaaggcuacggugauguuugagugugacaaaggcuucuaccucgauggcuccgacaccauugugugcgauagcaauucuacaugggacccucccgucccgaagugucugaaaguucuuccucccuccagcaccaagccucccgcccugucucacuccgugagcacauccucuaccacgaaaagcccugcuuccagcgccucugggcccagaccgacauauaagccucccguguccaacuaccccggauauccuaagccggaagagggcauccucgacagccuggaugucugggugaucgcgguuauugugaucgccauugucguggggguugcugugaucugcgucgugcccuaccgguaucugcagcgccggaaaaagaaaggaaccuaccucacagacgaaacccauagagaggucaaguucaccucucuguga

SEQ ID NO: 8136 - protein, 348 aa, Artificial Sequence
  complement_system_component_MCP__Homo_sapiens__P40121
MYTAIPQSGSPFPGSVQDPGLHVWRVEKLKPVPVAQENQGVFFSGDSYLVLHNGPEEVSHLHLWIGQQSSRDEQGACAVLAVHLNTLLGERPVQHREVQGNESDLFMSYFPRGLKYQEGGVESAFHKTSTGAPAAIKKLYQVKGKKNIRATERALNWDSFNTGDCFILDLGQNIFAWCGGKSNILERNKARDLALAIRDSERQGKAQVEIVTDGEEPAEMIQVLGPKPALKEGNPEEDLTADKANAQAAALYKVSDATGQMNLTKVADSSPFALELLISDDCFVLDNGLCGKIYIWKGRKANEKERQAALQVAEGFISRMQYAPNTQVEILPQGHESPIFKQFFKDWK

SEQ ID NO: 8137 - RNA, 1047 nt, Artificial Sequence
  complement_system_component_MCP__Homo_sapiens__AAY24128
auguacacagccauuccccagaguggcucuccauucccaggcucagugcaggauccaggccugcauguguggcggguggagaagcugaagccggugccuguggcgcaagagaaccagggcgucuucuucucgggggacuccuaccuagugcugcacaauggcccagaagagguuucccaucugcaccuguggauaggccagcagucaucccgggaugagcagggggccugugccgugcuggcugugcaccucaacacgcugcugggagagcggccugugcagcaccgcgaggugcagggcaaugagucugaccucuucaugagcuacuucccacggggccucaaguaccaggaaggugguguggagucagcauuucacaagaccuccacaggagccccagcugccaucaagaaacucuaccaggugaaggggaagaagaacauccgugccaccgagcgggcacugaacugggacagcuucaacacuggggacugcuucauccuggaccugggccagaacaucuucgccuggugugguggaaaguccaacauccuggaacgcaacaaggcgagggaccuggcccuggccauccgggacagugagcgacagggcaaggcccagguggagauugucacugauggggaggagccugcugagaugauccagguccugggccccaagccugcucugaaggagggcaacccugaggaagaccucacagcugacaaggcaaaugcccaggccgcagcucuguauaaggucucugaugccacuggacagaugaaccugaccaagguggcugacuccagcccauuugcccuugaacugcugauaucugaugacugcuuugugcuggacaacgggcucuguggcaagaucuauaucuggaaggggcgaaaagcgaaugagaaggagcggcaggcagcccugcagguggccgagggcuucaucucgcgcaugcaguacgccccgaacacucagguggagauucugccucagggccaugagagucccaucuucaagcaauuuuucaaggacuggaaauga

SEQ ID NO: 8138 - RNA, 1047 nt, Artificial Sequence
  derived and/or modified sequence opt1 from complement_system_component_MCP__Homo_sapiens__AAY24128
auguacacggccaucccccagagcggcuccccguuccccgggagcgugcaggaccccggccugcacgucuggcgcguggagaagcugaagcccgugccggucgcccaggagaaccaggggguguucuucuccggcgacagcuaccuggugcugcacaacgggcccgaggaggucucccaccuccaccuguggaucggccagcagagcucccgggacgagcagggcgcgugcgccgugcuggccgugcaccucaacacccugcugggggagcgccccguccagcaccgggaggugcagggcaacgagagcgaccucuucauguccuacuucccccgcgggcugaaguaccaggagggcgggguggagagcgccuuccacaagacguccaccggcgccccggcggccaucaagaagcuguaccaggucaagggcaagaagaacauccgggccaccgagcgcgcccucaacugggacagcuucaacaccggggacugcuucauccuggaccugggccagaacaucuucgcguggugcgggggcaaguccaacauccucgagcggaacaaggcccgcgaccuggcccuggccauccgggacagcgagcgccagggcaaggcccagguggagaucgugacggacggggaggagcccgcggagaugauccagguccucggccccaagcccgcccugaaggaggggaacccggaggaggaccugaccgccgacaaggccaacgcccaggcggccgcccucuacaagguguccgacgccaccggccagaugaaccugaccaagguggccgacagcucccccuucgcgcuggagcuccugaucagcgacgacugcuucguccuggacaacgggcucugcggcaagaucuacaucuggaagggccggaaggccaacgagaaggagcgccaggccgcccuccagguggccgagggguucaucucccggaugcaguacgcgcccaacacccagguggagauccugccccagggccacgagagcccgaucuucaagcaguucuucaaggacuggaaguga

SEQ ID NO: 8139 - RNA, 1047 nt, Artificial Sequence
  derived and/or modified sequence opt2 from complement_system_component_MCP__Homo_sapiens__AAY24128
auguacaccgccaucccccaguccggcucccccuuccccggcuccguccaggaccccggccuccacgucuggcgcgucgagaagcucaagcccguccccgucgcccaggagaaccagggcgucuucuucuccggcgacuccuaccucguccuccacaacggccccgaggaggucucccaccuccaccucuggaucggccagcaguccucccgcgacgagcagggcgccugcgccguccucgccguccaccucaacacccuccucggcgagcgccccguccagcaccgcgagguccagggcaacgaguccgaccucuucauguccuacuucccccgcggccucaaguaccaggagggcggcgucgaguccgccuuccacaagaccuccaccggcgcccccgccgccaucaagaagcucuaccaggucaagggcaagaagaacauccgcgccaccgagcgcgcccucaacugggacuccuucaacaccggcgacugcuucauccucgaccucggccagaacaucuucgccuggugcggcggcaaguccaacauccucgagcgcaacaaggcccgcgaccucgcccucgccauccgcgacuccgagcgccagggcaaggcccaggucgagaucgucaccgacggcgaggagcccgccgagaugauccagguccucggccccaagcccgcccucaaggagggcaaccccgaggaggaccucaccgccgacaaggccaacgcccaggccgccgcccucuacaaggucuccgacgccaccggccagaugaaccucaccaaggucgccgacuccucccccuucgcccucgagcuccucaucuccgacgacugcuucguccucgacaacggccucugcggcaagaucuacaucuggaagggccgcaaggccaacgagaaggagcgccaggccgcccuccaggucgccgagggcuucaucucccgcaugcaguacgcccccaacacccaggucgagauccucccccagggccacgagucccccaucuucaagcaguucuucaaggacuggaaguga

SEQ ID NO: 8140 - RNA, 1047 nt, Artificial Sequence
  derived and/or modified sequence opt3 from complement_system_component_MCP__Homo_sapiens__AAY24128
auguacaccgccaucccccagagcggcuccccuuucccagggucugugcaagacccgggacugcacgucuggagaguugagaagcucaaacccgugccuguagcucaggaaaaccaggguguguuuuucucaggcgauaguuaucuuguccugcauaaugggccagaggaagugagccacuugcauuuauggauuggacagcaauccucuagggacgagcagggcgcaugcgccguucuggcggugcaccuaaacacacuccugggugaacggcccguccagcaucgcgaggugcaggggaaugagucggaucuuuuuaugucauacuucccucgaggacugaaguaucaagaaggcggcguagagagcgcuuuucacaaaacgaguacuggggccccagcagccauaaagaaauuguaccagguuaagggaaagaaaaacauccgugcuaccgaaagagcacucaauugggacuccuucaacacaggugauuguuuuauucuggaccugggccagaauaucuucgccuggugcgggggaaagucuaacauucucgagaggaauaaagcucgggauuuagcccuggcgauccgcgacagcgagagacagggcaaggcacaaguggaaauagucacugauggugaggaacccgccgagaugauccaggugcuugggccuaaaccagcuuugaaggaaggaaacccggaggaggaccugaccgccgauaaggcaaaugcucaggccgcggcccuauauaaaguguccgacgcaacaggccaaaugaaccucaccaaggucgcugauucaagucccuuugcccuggaacuucugauuagcgacgacuguuucguuuuggauaauggccucugcgggaaaaucuacauuuggaagggaaggaaagcuaacgagaaggaacggcaggccgcauuacagguggccgaggguuuuaucucucgcaugcaguaugcuccuaauacucaaguagaaauacugccacagggccacgagucccccauuuucaaacaguuuuucaaggacuggaaguga

SEQ ID NO: 8141 - RNA, 1047 nt, Artificial Sequence
  derived and/or modified sequence opt4 from complement_system_component_MCP__Homo_sapiens__AAY24128
auguacaccgccaucccccagagcggcagccccuuccccggcagcgugcaggaccccggccugcacguguggagaguggagaagcugaagcccgugcccguggcccaggagaaccagggcguguucuucagcggcgacagcuaccuggugcugcacaacggccccgaggaggugagccaccugcaccuguggaucggccagcagagcagcagagacgagcagggcgccugcgccgugcuggccgugcaccugaacacccugcugggcgagagacccgugcagcacagagaggugcagggcaacgagagcgaccuguucaugagcuacuuccccagaggccugaaguaccaggagggcggcguggagagcgccuuccacaagaccagcaccggcgcccccgccgccaucaagaagcuguaccaggugaagggcaagaagaacaucagagccaccgagagagcccugaacugggacagcuucaacaccggcgacugcuucauccuggaccugggccagaacaucuucgccuggugcggcggcaagagcaacauccuggagagaaacaaggccagagaccuggcccuggccaucagagacagcgagagacagggcaaggcccagguggagaucgugaccgacggcgaggagcccgccgagaugauccaggugcugggccccaagcccgcccugaaggagggcaaccccgaggaggaccugaccgccgacaaggccaacgcccaggccgccgcccuguacaaggugagcgacgccaccggccagaugaaccugaccaagguggccgacagcagccccuucgcccuggagcugcugaucagcgacgacugcuucgugcuggacaacggccugugcggcaagaucuacaucuggaagggcagaaaggccaacgagaaggagagacaggccgcccugcagguggccgagggcuucaucagcagaaugcaguacgcccccaacacccagguggagauccugccccagggccacgagagccccaucuucaagcaguucuucaaggacuggaaguga

SEQ ID NO: 8142 - RNA, 1047 nt, Artificial Sequence
  derived and/or modified sequence opt5 from complement_system_component_MCP__Homo_sapiens__AAY24128
auguacaccgccaucccccagagcggcuccccuuucccggggucugugcaagaccccggacugcacgucuggagaguugagaagcucaaaccugugcccguggcucaggaaaaccagggcgucuuuuucagcggggauuccuaucuggugcuucauaauggaccugaggaaguuucucaucugcaccucuggauuggccagcaaagcucccgggacgagcagggggccugcgcggugcuggcuguccaccuuaacacacugcucggagaacgccccgugcagcauagagagguucagggcaaugagucugaucuguuuaugagcuacuucccucggggccugaaguaucaagaagggggaguggaguccgccuuucacaaaacgagcaccggcgccccggcugccaucaagaaacucuaccaggucaaggggaagaaaaacauucgcgcuacagaaagagcccugaauugggacucuuucaacaccggagauuguuuuauccuugaccugggccagaauauuuucgcguggugcgggggaaaguccaacauccucgagcggaauaaagcccgcgaucuggcucuugccaucagagacagcgagcggcagggcaaggcucaaguggaaauugugacagauggcgaggaacccgccgagaugauccagguccuggggccuaaacccgcgcucaaggaaggaaacccugaggaggaccugaccgccgauaaggcuaaugcccaggcugccgcccuguauaaaguuucugacgcuacaggccaaaugaaccucaccaagguggcggauuccagccccuuugcccuggaacuucugauuucugacgacuguuucgugcucgauaaugggcugugcggaaaaaucuacauuuggaagggccgcaaagcuaacgagaaggaaagacaggccgcccuucaggucgcugagggguuuaucucccggaugcaguaugccccgaauacgcaaguggaaauucugccucagggacacgagagccccaucuucaaacaguuuuucaaggacuggaaguga

SEQ ID NO: 8143 - protein, 371 aa, Artificial Sequence
  CREB3__Homo_sapiens__CCDS6588.1
MELELDAGDQDLLAFLLEESGDLGTAPDEAVRAPLDWALPLSEVPSDWEVDDLLCSLLSPPASLNILSSSNPCLVHHDHTYSLPRETVSMDLESESCRKEGTQMTPQHMEELAEQEIARLVLTDEEKSLLEKEGLILPETLPLTKTEEQILKRVRRKIRNKRSAQESRRKKKVYVGGLESRVLKYTAQNMELQNKVQLLEEQNLSLLDQLRKLQAMVIEISNKTSSSSTCILVLLVSFCLLLVPAMYSSDTRGSLPAEHGVLSRQLRALPSEDPYQLELPALQSEVPKDSTHQWLDGSDCVLQAPGNTSCLLHYMPQAPSAEPPLEWPFPDLFSEPLCRGPILPLQANLTRKGGWLPTGSPSVILQDRYSG

SEQ ID NO: 8144 - RNA, 1116 nt, Artificial Sequence
  CREB3__Homo_sapiens__CCDS6588.1
auggagcuggaauuggaugcuggugaccaagaccugcuggccuuccugcuagaggaaaguggagauuuggggacggcacccgaugaggccgugagggccccacuggacugggcgcugccgcuuucugagguaccgagcgacugggaaguagaugauuugcugugcucccugcugagucccccagcgucguugaacauucucagcuccuccaaccccugccuuguccaccaugaccacaccuacucccucccacgggaaacugucucuauggaucuagagagugagagcuguagaaaagaggggacccagaugacuccacagcauauggaggagcuggcagagcaggagauugcuaggcuaguacugacagaugaggagaagagucuauuggagaaggaggggcuuauucugccugagacacuuccucucacuaagacagaggaacaaauucugaaacgugugcggaggaagauucgaaauaaaagaucugcucaagagagccgcaggaaaaagaagguguauguuggggguuuagagagcagggucuugaaauacacagcccagaauauggagcuucagaacaaaguacagcuucuggaggaacagaauuugucccuucuagaucaacugaggaaacuccaggccauggugauugagauaucaaacaaaaccagcagcagcagcaccugcaucuugguccuacuagucuccuucugccuccuccuuguaccugcuauguacuccucugacacaagggggagccugccagcugagcauggaguguugucccgccagcuucgugcccuccccagugaggacccuuaccagcuggagcugccugcccugcagucagaagugccgaaagacagcacacaccagugguuggacggcucagacuguguacuccaggccccuggcaacacuuccugccugcugcauuacaugccucaggcucccagugcagagccuccccuggaguggccauucccugaccucuucucagagccucucugccgaggucccauccucccccugcaggcaaaucucacaaggaagggaggauggcuuccuacugguagccccucugucauuuugcaggacagauacucaggcuag

SEQ ID NO: 8145 - RNA, 1116 nt, Artificial Sequence
  derived and/or modified sequence opt1 from CREB3__Homo_sapiens__CCDS6588.1
auggagcuggagcucgacgccggcgaccaggaccugcuggccuuccuccuggaggagagcggggaccugggcaccgcgcccgacgaggccgugcgcgccccgcucgacugggcccugccccuguccgagguccccagcgacugggagguggacgaccuccugugcucccugcucagcccgcccgccucccugaacauccugagcuccagcaaccccugccucgugcaccacgaccacaccuacucccugccccgggagacggucagcauggaccuggaguccgagagcugccgcaaggaggggacccagaugacgccccagcacauggaggagcucgcggagcaggagaucgcccggcuggugcugaccgacgaggagaagucccuccuggagaaggagggccugauccucccggagacccugccccugaccaagaccgaggagcagauccucaagcgcgugcggcgcaagauccggaacaagcgcagcgcccaggagucccggcgcaagaagaaggucuacgucgggggccuggagagccgggugcugaaguacaccgcccagaacauggagcuccagaacaaggugcagcugcuggaggagcagaaccucucccugcuggaccagcuccgcaagcugcaggcgauggugaucgagaucagcaacaagacguccagcagcuccacgugcauccuggugcuccuggucagcuucugccugcuccuggugcccgccauguacuccagcgacacccggggcucccugcccgccgagcacggggugcucagccgccagcugcgggcccugccguccgaggaccccuaccagcucgagcugcccgcccugcagagcgagguccccaaggacuccacccaccaguggcuggacggcagcgacugcgugcuccaggcgccggggaacaccuccugccugcugcacuacaugccccaggcccccagcgccgagcccccgcucgaguggcccuuccccgaccuguucuccgagccccugugccgcggcccgauccucccccugcaggccaaccugacccggaagggcggguggcuccccaccggcagccccuccgugauccugcaggaccgcuacagcggguga

SEQ ID NO: 8146 - RNA, 1116 nt, Artificial Sequence
  derived and/or modified sequence opt2 from CREB3__Homo_sapiens__CCDS6588.1
auggagcucgagcucgacgccggcgaccaggaccuccucgccuuccuccucgaggaguccggcgaccucggcaccgcccccgacgaggccguccgcgccccccucgacugggcccucccccucuccgagguccccuccgacugggaggucgacgaccuccucugcucccuccucuccccccccgccucccucaacauccucuccuccuccaaccccugccucguccaccacgaccacaccuacucccucccccgcgagaccgucuccauggaccucgaguccgaguccugccgcaaggagggcacccagaugaccccccagcacauggaggagcucgccgagcaggagaucgcccgccucguccucaccgacgaggagaagucccuccucgagaaggagggccucauccuccccgagacccucccccucaccaagaccgaggagcagauccucaagcgcguccgccgcaagauccgcaacaagcgcuccgcccaggagucccgccgcaagaagaaggucuacgucggcggccucgagucccgcguccucaaguacaccgcccagaacauggagcuccagaacaagguccagcuccucgaggagcagaaccucucccuccucgaccagcuccgcaagcuccaggccauggucaucgagaucuccaacaagaccuccuccuccuccaccugcauccucguccuccucgucuccuucugccuccuccucguccccgccauguacuccuccgacacccgcggcucccuccccgccgagcacggcguccucucccgccagcuccgcgcccuccccuccgaggaccccuaccagcucgagcuccccgcccuccaguccgagguccccaaggacuccacccaccaguggcucgacggcuccgacugcguccuccaggcccccggcaacaccuccugccuccuccacuacaugccccaggcccccuccgccgagcccccccucgaguggcccuuccccgaccucuucuccgagccccucugccgcggccccauccucccccuccaggccaaccucacccgcaagggcggcuggcuccccaccggcucccccuccgucauccuccaggaccgcuacuccggcuga

SEQ ID NO: 8147 - RNA, 1116 nt, Artificial Sequence
  derived and/or modified sequence opt3 from CREB3__Homo_sapiens__CCDS6588.1
auggagcuggaacucgacgccggcgaucaggaccuucuggcuuucuuguuagaggaaagcggggaucugggaaccgcacccgacgaggccgugagagcgccucuagauugggcucucccacuguccgaagucccgucugacugggagguugaugaccuucugugcucauugcucagucccccugccagccugaacauccuguccucuucgaauccaugucucgugcaccaugaucacacauacucauuacccagggagacuguaagcauggaccuggaaagugaguccugccggaaggaagguacgcaaaugaccccucagcauauggaggagcuugcagaacaggagauugcccgcuuggugcugacagaugaagagaaaucucuacucgaaaaggagggccugauacuuccagagacucugcccuugaccaaaacagaggaacagauccucaagcgaguccguagaaaaauuaggaacaagcggagcgcucaagaaucccgcagaaagaaaaagguguauguugggggacuggagucaaggguguuaaaauacaccgcacagaauauggaacugcagaacaagguccagcuccuugaggagcaaaaucugaguuugcuagaccagcugcggaaacuccaggccauggugaucgaaauuagcaacaagacuucuuccucaagcacauguauccugguacuucugguuaguuuuugcuugcuccuggugccugcuauguauucuuccgauacccgcggcagcuuaccagccgagcacgguguccugucgcgacagcuaagagcgcucccgucugaagaccccuaccaacuggagcuuccugcauugcaguccgaagugccaaaggacucaacgcaucaguggcuggaugggagugacugugugcuccaagcccccggaaauacuagcugccugcuucacuauaugccucaggcuccauccgccgagcccccgcuggaguggccuuuccccgauuuguuuucugaaccacucuguaggggcccuauacugcccuuacaggcaaaccugacccggaaaggcggguggcuaccaacaggaagccccucagucauccuccaggaccguuacagugguuga

SEQ ID NO: 8148 - RNA, 1116 nt, Artificial Sequence
  derived and/or modified sequence opt4 from CREB3__Homo_sapiens__CCDS6588.1
auggagcuggagcuggacgccggcgaccaggaccugcuggccuuccugcuggaggagagcggcgaccugggcaccgcccccgacgaggccgugagagccccccuggacugggcccugccccugagcgaggugcccagcgacugggagguggacgaccugcugugcagccugcugagcccccccgccagccugaacauccugagcagcagcaaccccugccuggugcaccacgaccacaccuacagccugcccagagagaccgugagcauggaccuggagagcgagagcugcagaaaggagggcacccagaugaccccccagcacauggaggagcuggccgagcaggagaucgccagacuggugcugaccgacgaggagaagagccugcuggagaaggagggccugauccugcccgagacccugccccugaccaagaccgaggagcagauccugaagagagugagaagaaagaucagaaacaagagaagcgcccaggagagcagaagaaagaagaagguguacgugggcggccuggagagcagagugcugaaguacaccgcccagaacauggagcugcagaacaaggugcagcugcuggaggagcagaaccugagccugcuggaccagcugagaaagcugcaggccauggugaucgagaucagcaacaagaccagcagcagcagcaccugcauccuggugcugcuggugagcuucugccugcugcuggugcccgccauguacagcagcgacaccagaggcagccugcccgccgagcacggcgugcugagcagacagcugagagcccugcccagcgaggaccccuaccagcuggagcugcccgcccugcagagcgaggugcccaaggacagcacccaccaguggcuggacggcagcgacugcgugcugcaggcccccggcaacaccagcugccugcugcacuacaugccccaggcccccagcgccgagcccccccuggaguggcccuuccccgaccuguucagcgagccccugugcagaggccccauccugccccugcaggccaaccugaccagaaagggcggcuggcugcccaccggcagccccagcgugauccugcaggacagauacagcggcuga

SEQ ID NO: 8149 - RNA, 1116 nt, Artificial Sequence
  derived and/or modified sequence opt5 from CREB3__Homo_sapiens__CCDS6588.1
auggagcuggaacucgacgccggcgaucaggaccugcuugcuuuccugcucgaggaaagcggggaucugggaaccgcccccgacgaggcggugagagcuccucuugauugggcccugccgcucuccgaaguccccucugacugggagguugaugaccugcugugcagccuccuguccccucccgccucucuuaacauccugagcuccucuaauccuugucucgugcaccaugaucacacauacagccugccccgggagacgguguccauggaccuugaaagcgagucuugccgcaaggaaggcacccaaaugacaccucagcauauggaggagcuggcugaacaggagauugccagacucguccugaccgaugaagagaaaucccugcucgaaaaggaggggcugauccuuccggagacacugccccucaccaaaacagaggaacagauucugaagcgggugcgcagaaaaauccggaacaagcgcagcgcucaagaaucuagacggaagaaaaagguuuaugugggaggccuugagucccgcguccugaaauacaccgcccagaauauggaacuccagaacaaggugcagcugcuggaggagcaaaaucucagccugcuugaccagcugagaaaacuccaggcgaugguuauugaaaucucuaacaagacguccagcuccucuaccuguauccuggugcuucuggucagcuuuugccuccugcuggugccugccauguauuccagcgauacacgggggucucuccccgcugagcacggagugcugucccgccagcuuagagcccugccuagcgaagaccccuaccaacucgagcugccggcucugcagucugaagucccuaaggacagcacccaucaguggcuugauggcuccgacuguguucuccaagcccccggcaauacaucuugccugcugcacuauaugccucaggcgcccagcgccgagcccccucucgaguggccguuccccgaucuguuuuccgaaccucuuugucgggggcccauucugccucuccaggcuaaccugacccgcaaaggaggcuggcugcccacggggagcccgucugugauccuucaggacagauacuccggauga

SEQ ID NO: 8150 - protein, 519 aa, Artificial Sequence
  CREB3L1__Homo_sapiens__Q96BA8
MDAVLEPFPADRLFPGSSFLDLGDLNESDFLNNAHFPEHLDHFTENMEDFSNDLFSSFFDDPVLDEKSPLLDMELDSPTPGIQAEHSYSLSGDSAPQSPLVPIKMEDTTQDAEHGAWALGHKLCSIMVKQEQSPELPVDPLAAPSAMAAAAAMATTPLLGLSPLSRLPIPHQAPGEMTQLPVIKAEPLEVNQFLKVTPEDLVQMPPTPPSSHGSDSDGSQSPRSLPPSSPVRPMARSSTAISTSPLLTAPHKLQGTSGPLLLTEEEKRTLIAEGYPIPTKLPLTKAEEKALKRVRRKIKNKISAQESRRKKKEYVECLEKKVETFTSENNELWKKVETLENANRTLLQQLQKLQTLVTNKISRPYKMAATQTGTCLMVAALCFVLVLGSLVPCLPEFSSGSQTVKEDPLAADGVYTASQMPSRSLLFYDDGAGLWEDGRSTLLPMEPPDGWEINPGGPAEQRPRDHLQHDHLDSTHETTKYLSEAWPKDGGNGTSPDFSHSKEWFHDRDLGPNTTIKLS

SEQ ID NO: 8151 - RNA, 1560 nt, Artificial Sequence
  CREB3L1__Homo_sapiens__CCDS53620.1
auggacgccgucuuggaacccuucccggccgacaggcuguuccccggauccagcuuccuggacuugggggaucugaacgagucggacuuccucaacaaugcgcacuuuccugagcaccuggaccacuuuacggagaacauggaggacuucuccaaugaccuguucagcagcuucuuugaugacccugugcuggaugagaagagcccucuauuggacauggaacuggacuccccuacgccaggcauccaggcggagcacagcuacucccugagcggcgacucagcgccccagagcccccuugugcccaucaagauggaggacaccacccaagaugcagagcauggagcaugggcgcugggacacaaacugugcuccaucauggugaagcaggagcagagcccggagcugcccguggacccucuggcugcccccucggccauggcugccgcggccgccauggccaccaccccgcugcugggccucagccccuuguccaggcugcccaucccccaccaggccccgggagagaugacucagcugccagugaucaaagcagagccucuggaggugaaccaguuccucaaagugacaccggaggaccuggugcagaugccuccgacgccccccagcagccauggcagugacagcgacggcucccagaguccccgcucucugccccccuccagcccugucaggcccauggcgcgcuccuccacggccaucuccaccuccccacuccucacugccccucacaaauuacaggggacaucagggccacugcuccugacagaggaggagaagcggacccugauugcugagggcuaccccauccccacaaaacucccccucaccaaagccgaggagaaggccuugaagagaguccggaggaaaaucaagaacaagaucucagcccaggagagccgucguaagaagaaggaguauguggagugucuagaaaagaagguggagacauuuacaucugagaacaaugaacuguggaagaagguggagacccuggagaaugccaacaggacccugcuccagcagcugcagaaacuccagacucuggucaccaacaagaucuccagaccuuacaagauggccgccacccagacugggaccugccucaugguggcagccuugugcuuuguucuggugcugggcucccucgugcccugccuucccgaguucuccuccggcucccagacugugaaggaagacccccuggccgcagacggcgucuacacggccagccagaugcccucccgaagccuccuauucuacgaugacggggcaggcuuaugggaagauggccgcagcacccugcugcccauggagcccccagauggcugggaaaucaaccccggggggccggcagagcagcggccccgggaccaccugcagcaugaucaccuggacagcacccacgagaccaccaaguaccugagugaggccuggccuaaagacgguggaaacggcaccagccccgacuucucccacuccaaggagugguuccacgacagggaucugggccccaacaccaccaucaaacucuccuag

SEQ ID NO: 8152 - RNA, 1560 nt, Artificial Sequence
  derived and/or modified sequence opt1 from CREB3L1__Homo_sapiens__CCDS53620.1
auggacgccgugcuggagcccuucccggccgaccgccucuuccccggcagcuccuuccuggaccugggggaccucaacgagagcgacuuccugaacaacgcgcacuuccccgagcaccuggaccacuucaccgagaacauggaggacuucuccaacgaccucuucagcuccuucuucgacgaccccguccuggacgagaaguccccgcugcucgacauggagcuggacagccccacccccggcauccaggccgagcacagcuacucccugagcggggacuccgcgccccagagcccgcucgugcccaucaagauggaggacacgacccaggacgccgagcacggcgccugggcccuggggcacaagcugugcuccaucauggugaagcaggagcagagccccgagcuccccgucgacccgcuggccgcccccuccgccauggcggccgccgccgccauggcgaccacgccccugcucggccugagcccccugucccggcucccgaucccccaccaggcccccggcgagaugacccagcugcccgugaucaaggccgagccgcuggaggugaaccaguuccucaaggucacccccgaggaccuggugcagaugccgcccaccccgcccagcucccacgggagcgacagcgacggcucccagagcccccgcucccugccgcccagcucccccgugcggcccauggcccgcagcuccaccgccaucagcacgagcccccuccugaccgcgccccacaagcugcaggggaccuccggcccccuccugcugaccgaggaggagaagcggacgcucaucgccgagggguaccccaucccgaccaagcugccccugaccaaggccgaggagaaggcccucaagcgcguccggcgcaagaucaagaacaagaucuccgcccaggagagccggcgcaagaagaaggaguacguggagugccuggagaagaagguggagaccuucacguccgagaacaacgagcuguggaagaaggucgagacccucgagaacgcgaaccggacccugcugcagcagcuccagaagcugcagacccuggugacgaacaagaucagccgccccuacaagauggccgccacccagaccgggaccugccucaugguggccgcccugugcuucguccuggugcucggcucccuggugcccugccugccggaguucagcuccggcagccagacggucaaggaggacccccuggcggccgacggcguguacaccgccucccagaugcccagccggagccuccuguucuacgacgacggggccggccugugggaggacggccgcuccacccuccugcccauggagccgcccgacgggugggagaucaaccccggcgggcccgcggagcagcggccgcgcgaccaccuccagcacgaccaccuggacagcacccacgagacgaccaaguaccuguccgaggccuggcccaaggacggcgggaacggcaccagccccgacuucucccacagcaaggagugguuccacgaccgggaccugggccccaacaccacgaucaagcucuccuga

SEQ ID NO: 8153 - RNA, 1560 nt, Artificial Sequence
  derived and/or modified sequence opt2 from CREB3L1__Homo_sapiens__CCDS53620.1
auggacgccguccucgagcccuuccccgccgaccgccucuuccccggcuccuccuuccucgaccucggcgaccucaacgaguccgacuuccucaacaacgcccacuuccccgagcaccucgaccacuucaccgagaacauggaggacuucuccaacgaccucuucuccuccuucuucgacgaccccguccucgacgagaaguccccccuccucgacauggagcucgacucccccacccccggcauccaggccgagcacuccuacucccucuccggcgacuccgccccccaguccccccucguccccaucaagauggaggacaccacccaggacgccgagcacggcgccugggcccucggccacaagcucugcuccaucauggucaagcaggagcagucccccgagcuccccgucgacccccucgccgcccccuccgccauggccgccgccgccgccauggccaccaccccccuccucggccucuccccccucucccgccuccccaucccccaccaggcccccggcgagaugacccagcuccccgucaucaaggccgagccccucgaggucaaccaguuccucaaggucacccccgaggaccucguccagaugccccccaccccccccuccucccacggcuccgacuccgacggcucccaguccccccgcucccucccccccuccucccccguccgccccauggcccgcuccuccaccgccaucuccaccuccccccuccucaccgccccccacaagcuccagggcaccuccggcccccuccuccucaccgaggaggagaagcgcacccucaucgccgagggcuaccccauccccaccaagcucccccucaccaaggccgaggagaaggcccucaagcgcguccgccgcaagaucaagaacaagaucuccgcccaggagucccgccgcaagaagaaggaguacgucgagugccucgagaagaaggucgagaccuucaccuccgagaacaacgagcucuggaagaaggucgagacccucgagaacgccaaccgcacccuccuccagcagcuccagaagcuccagacccucgucaccaacaagaucucccgccccuacaagauggccgccacccagaccggcaccugccucauggucgccgcccucugcuucguccucguccucggcucccucguccccugccuccccgaguucuccuccggcucccagaccgucaaggaggacccccucgccgccgacggcgucuacaccgccucccagaugcccucccgcucccuccucuucuacgacgacggcgccggccucugggaggacggccgcuccacccuccuccccauggagccccccgacggcugggagaucaaccccggcggccccgccgagcagcgcccccgcgaccaccuccagcacgaccaccucgacuccacccacgagaccaccaaguaccucuccgaggccuggcccaaggacggcggcaacggcaccucccccgacuucucccacuccaaggagugguuccacgaccgcgaccucggccccaacaccaccaucaagcucuccuga

SEQ ID NO: 8154 - RNA, 1560 nt, Artificial Sequence
  derived and/or modified sequence opt3 from CREB3L1__Homo_sapiens__CCDS53620.1
auggacgccgugcuggagcccuucccugcugauagacucuuuccaggcagcuccuuccuugaccugggggauuugaacgaaucugacuuuuuaaauaacgcacacuucccggagcaucuggaucacuuuaccgaaaauauggaggacuucucaaacgaucuauuuaguagcuucuuugacgaucccguccucgacgaaaaguccccucugcuugauauggagcuggacucuccaacacccggaauccaggccgagcauucguacucauugagcggugauagugcgccucaauccccacucguucccauuaaaauggaagacacuacgcaggacgcugagcacggcgccugggcacuggggcauaagcugugcucuauaauggugaaacaggaacagagcccugagcucccaguagauccguuagccgcucccuccgcaauggccgcugccgcggcaauggccaccacaccucugcuuggauugucaccacugaguaggcuacccaucccucaccaagcuccaggcgagaugacucagcuccccgugauuaaggccgaaccgcuggaggucaaucaguuccuuaaagugaccccugaagaccugguucagaugcccccaacaccucccagcucucacgguuccgauucagacgggagccaaaguccacggucuuugcccccuuccagcccagugcgcccgauggcacgaucgucuaccgcuaucuccacuucaccccuccugacagccccucauaaguuacagggaaccaguggcccacugcuccuuacggaggaagagaagcguacucugauugcggagggcuaucccaucccuaccaaauugccacuaacaaaggccgaagagaaagcacugaagagagucaggcggaaaauaaagaacaagaucagcgcucaggaaucccgcaggaaaaagaaagaguacguggaaugucucgagaagaaaguagagacuuuuaccucugaaaauaacgagcuguggaagaaaguugaaacacuugagaaugccaacagaacccuguugcagcaacuccagaagcugcagacguuagugacuaauaagauuagccggcccuauaaaauggcugccacacaaaccgggacuugccugauggucgcagcccuauguuucgugcucgugcugggaucacuugucccgugcuugccugaauuuaguuccgguagccagacaguuaaggaggauccacuggcugcggacggcguguacaccgcaucucagaugcccucacgcagucuccuguucuaugaugacggggccggacuuugggaggauggccgaagcacgcuguugccuauggaacccccagacgguugggagaucaacccugggggacccgcugaacagagaccaagggaucaccuccaacaugaccaccuggacuccacccacgagacaacuaaauacuuaucugaggccuggccgaaggauggcggcaaugggaccucgccugacuucagccauuccaaagaaugguuucacgaucgggaccugggacccaacacaacuauuaagcuaucauga

SEQ ID NO: 8155 - RNA, 1560 nt, Artificial Sequence
  derived and/or modified sequence opt4 from CREB3L1__Homo_sapiens__CCDS53620.1
auggacgccgugcuggagcccuuccccgccgacagacuguuccccggcagcagcuuccuggaccugggcgaccugaacgagagcgacuuccugaacaacgcccacuuccccgagcaccuggaccacuucaccgagaacauggaggacuucagcaacgaccuguucagcagcuucuucgacgaccccgugcuggacgagaagagcccccugcuggacauggagcuggacagccccacccccggcauccaggccgagcacagcuacagccugagcggcgacagcgccccccagagcccccuggugcccaucaagauggaggacaccacccaggacgccgagcacggcgccugggcccugggccacaagcugugcagcaucauggugaagcaggagcagagccccgagcugcccguggacccccuggccgcccccagcgccauggccgccgccgccgccauggccaccaccccccugcugggccugagcccccugagcagacugcccaucccccaccaggcccccggcgagaugacccagcugcccgugaucaaggccgagccccuggaggugaaccaguuccugaaggugacccccgaggaccuggugcagaugccccccaccccccccagcagccacggcagcgacagcgacggcagccagagccccagaagccugccccccagcagccccgugagacccauggccagaagcagcaccgccaucagcaccagcccccugcugaccgccccccacaagcugcagggcaccagcggcccccugcugcugaccgaggaggagaagagaacccugaucgccgagggcuaccccauccccaccaagcugccccugaccaaggccgaggagaaggcccugaagagagugagaagaaagaucaagaacaagaucagcgcccaggagagcagaagaaagaagaaggaguacguggagugccuggagaagaagguggagaccuucaccagcgagaacaacgagcuguggaagaagguggagacccuggagaacgccaacagaacccugcugcagcagcugcagaagcugcagacccuggugaccaacaagaucagcagacccuacaagauggccgccacccagaccggcaccugccugaugguggccgcccugugcuucgugcuggugcugggcagccuggugcccugccugcccgaguucagcagcggcagccagaccgugaaggaggacccccuggccgccgacggcguguacaccgccagccagaugcccagcagaagccugcuguucuacgacgacggcgccggccugugggaggacggcagaagcacccugcugcccauggagccccccgacggcugggagaucaaccccggcggccccgccgagcagagacccagagaccaccugcagcacgaccaccuggacagcacccacgagaccaccaaguaccugagcgaggccuggcccaaggacggcggcaacggcaccagccccgacuucagccacagcaaggagugguuccacgacagagaccugggccccaacaccaccaucaagcugagcuga

SEQ ID NO: 8156 - RNA, 1560 nt, Artificial Sequence
  derived and/or modified sequence opt5 from CREB3L1__Homo_sapiens__CCDS53620.1
auggacgccgugcuggagcccuucccugcugauagacucuuuccgggcagcuccuuccuggaccuuggggaucugaacgaaucugacuuucucaauaacgcccacuuccccgagcaucuggaucacuuuaccgaaaauauggaggacuucagcaacgaucuguuuuccucuuucuuugacgauccuguccuugacgaaaagagcccccuccuggauauggagcuggacuccccuacacccggaauccaggcggagcauucuuacagccucuccggcgauagcgcuccucaaucuccgcugguucccauuaaaauggaagacacgacccaggacgccgagcacggggccugggcucuuggacauaagcugugcuccaucauggugaaacaggaacagagcccugagcuccccguggauccucuggccgcucccucugccauggcggccgcugccgcuauggccacaaccccgcuucugggccucuccccucugagccggcugcccauuccucaccaagcgcccggggagaugacacagcuccccgucaucaaggccgaaccucuggaggugaaucaguuccuuaaaguuaccccggaagaccuggugcagaugcccccuacacccccuucuucccacggaagcgauuccgacggcucucaaagcccccgcucccucccgccuagcucucccgucagaccuauggcucgguccagcaccgccauuucuacgagcccccugcuuaccgcuccucauaagcugcagggcacauccgggccccuccugcugaccgaggaagagaagcgcacacucaucgccgagggauauccgaucccuaccaaacugccccuuacgaaggccgaagagaaagcucugaagagagugcggcgcaaaauuaagaacaagaucucugcgcaggaaagcagacggaaaaagaaagaguacguugaaugucucgagaagaaaguggagacauuuaccuccgaaaauaacgagcuguggaagaaagucgaaacacuugagaaugccaaccgcacccugcuccagcaacugcagaagcugcagacccucgugacaaauaagauuagcagacccuauaaaauggcugccacgcaaaccggcacaugccugaugguggccgcucuuuguuucguccugguucucgggucucuggugccuugccugccggaauuuuccagcggaucucagaccgugaaggaggauccccuugccgcggacggcgucuacacagcuucccagaugccuagccggucccuccuguucuaugaugacggggccggacugugggaggauggccgcucuacccuccugcccauggaaccucccgacggcugggagaucaacccugggggacccgccgaacagagaccgcgggaucaccuucaacaugaccaccuggacagcacgcacgagacaaccaaauaccucuccgaggcuuggccuaaggauggcgggaauggaaccucucccgacuucagccauuccaaagaaugguuucacgaucgcgaccugggcccuaacacaaccauuaagcugagcuga

SEQ ID NO: 8157 - protein, 461 aa, Artificial Sequence
  CREB3L3__Homo_sapiens__Q68CJ9
MNTDLAAGKMASAACSMDPIDSFELLDLLFDRQDGILRHVELGEGWGHVKDQQVLPNPDSDDFLSSILGSGDSLPSSPLWSPEGSDSGISEDLPSDPQDTPPRSGPATSPAGCHPAQPGKGPCLSYHPGNSCSTTTPGPVIQVPEASVTIDLEMWSPGGRICAEKPADPVDLSPRCNLTVKDLLLSGSSGDLQQHHLGASYLLRPGAGHCQELVLTEDEKKLLAKEGITLPTQLPLTKYEERVLKKIRRKIRNKQSAQESRKKKKEYIDGLETRMSACTAQNQELQRKVLHLEKQNLSLLEQLKKLQAIVVQSTSKSAQTGTCVAVLLLSFALIILPSISPFGPNKTESPGDFAPVRVFSRTLHNDAASRVAADAVPGSEAPGPRPEADTTREESPGSPGADWGFQDTANLTNSTEELDNATLVLRNATEGLGQVALLDWVAPGPSTGSGRAGLEAAGDEL

SEQ ID NO: 8158 - RNA, 1386 nt, Artificial Sequence
  CREB3L3__Homo_sapiens__CCDS12121.1
augaauacggauuuagcugcuggaaagauggcuucugcugccugcuccauggaccccaucgacagcuuugagcuccuggaucuccuguuugaccggcaggacggcauccugagacacguggagcugggcgagggcuggggucacgucaaggaccagcagguccugccaaaccccgacucugacgacuuccucagcuccauccugggcucuggagacucacugcccagcuccccacucuggucccccgaaggcagugauaguggcaucuccgaagaccuccccuccgacccccaggacaccccuccacgcagcggaccagccaccucccccgccggcugccauccugcccagccuggcaaggggcccugccucuccuaucauccuggcaacucuugcuccaccacaaccccagggccagugauccaaguaccugaagccucugugaccauagaccuggaaauguggagcccaggaggaaggaucugugcugagaagccggcugauccgguggaccuguccccacgaugcaaucucaccgugaaagaccuccuccuuucgggcagcaguggggaccugcaacagcaucaccugggggccuccuaccuccugcgaccuggggcugggcacugucaggagcuggugcucaccgaggaugagaagaagcugcuggcuaaagaaggcaucacccugcccacucagcugccccucacuaaguacgaggagcgagugcugaaaaaaauccgccggaaaauccggaacaagcagucggcgcaagaaagcaggaagaagaagaaggaauauaucgauggccuggagacucggaugucagcuugcacugcucagaaucaggaguuacagaggaaagucuugcaucucgagaagcaaaaccugucccucuuggagcaacugaagaaacuccaggccauuguggugcaguccaccagcaagucagcccagacaggcaccugugucgcaguccuguugcuguccuuugcccucaucauccuccccuccaucagcccuuuuggccccaacaaaaccgagagcccuggggacuuugcgccuguacgaguguucuccagaacuuugcacaacgaugcugccucccgcguggcugcugaugcugugccaggcuccgaggccccaggaccccgacccgaggcugacacaacccgagaagagucuccaggaagccccggggcagacuggggcuuccaggacaccgcgaaccugaccaauucgacggaggagcuggacaacgccacccugguccugaggaaugcaacagaggggcugggccaggucgcccugcuggacuggguggcgccugggccgagcacuggcucaggacgugcagggcuggaggcggcgggagacgagcuguga

SEQ ID NO: 8159 - RNA, 1386 nt, Artificial Sequence
  derived and/or modified sequence opt1 from CREB3L3__Homo_sapiens__CCDS12121.1
augaacaccgaccuggccgccggcaagauggcgagcgccgccugcuccauggaccccaucgacagcuucgagcuccuggaccuccuguucgaccgccaggacgggauccugcggcacguggagcugggcgagggguggggccacgucaaggaccagcagguccucccgaaccccgacuccgacgacuuccugagcuccauccuggggagcggcgacucccuccccagcagcccccugugguccccggagggcuccgacagcgggaucuccgaggaccugcccagcgacccccaggacacgcccccgcgcuccggccccgccaccagccccgccgggugccaccccgcgcagccgggcaaggggcccugccucuccuaccaccccggcaacagcugcuccaccaccacccccggcccggugauccaggugcccgaggccagcgugacgaucgaccuggagauguggagccccgggggccggaucugcgccgagaagcccgccgacccgguggaccugagcccccgcugcaaccucaccgucaaggaccugcugcucuccggguccagcggcgaccugcagcagcaccaccugggcgcguccuaccuccugcggcccggggccggccacugccaggagcuggugcucaccgaggacgagaagaagcugcuggccaaggaggggaucacccuccccacgcagcugccgcugaccaaguacgaggagcgcgugcucaagaagauccggcgcaagauccggaacaagcagagcgcccaggagucccgcaagaagaagaaggaguacaucgacggccuggagacccggaugagcgccugcaccgcgcagaaccaggagcugcagcgcaagguccuccaccuggagaagcagaaccugucccuccuggagcagcugaagaagcuccaggccaucguggugcagagcacguccaagagcgcccagaccgggaccugcgucgccgugcugcugcucuccuucgcccugaucauccugcccagcaucucccccuucggccccaacaagaccgagagcccgggcgacuucgcgcccgugcgggucuucucccgcacgcuccacaacgacgccgccagccggguggccgccgacgcggugcccggguccgaggccccgggcccccgccccgaggccgacaccacccgggaggagagccccgggagcccgggcgccgacuggggguuccaggacaccgccaaccugacgaacuccaccgaggagcuggacaacgcgacccucguccugcgcaacgccaccgagggccugggccagguggcccugcucgacuggguggcccccgggcccagcacgggcuccgggcgggcgggccuggaggccgccggggacgagcuguga

SEQ ID NO: 8160 - RNA, 1386 nt, Artificial Sequence
  derived and/or modified sequence opt2 from CREB3L3__Homo_sapiens__CCDS12121.1
augaacaccgaccucgccgccggcaagauggccuccgccgccugcuccauggaccccaucgacuccuucgagcuccucgaccuccucuucgaccgccaggacggcauccuccgccacgucgagcucggcgagggcuggggccacgucaaggaccagcagguccuccccaaccccgacuccgacgacuuccucuccuccauccucggcuccggcgacucccuccccuccuccccccucuggucccccgagggcuccgacuccggcaucuccgaggaccuccccuccgacccccaggacacccccccccgcuccggccccgccaccucccccgccggcugccaccccgcccagcccggcaagggccccugccucuccuaccaccccggcaacuccugcuccaccaccacccccggccccgucauccagguccccgaggccuccgucaccaucgaccucgagauguggucccccggcggccgcaucugcgccgagaagcccgccgaccccgucgaccucuccccccgcugcaaccucaccgucaaggaccuccuccucuccggcuccuccggcgaccuccagcagcaccaccucggcgccuccuaccuccuccgccccggcgccggccacugccaggagcucguccucaccgaggacgagaagaagcuccucgccaaggagggcaucacccuccccacccagcucccccucaccaaguacgaggagcgcguccucaagaagauccgccgcaagauccgcaacaagcaguccgcccaggagucccgcaagaagaagaaggaguacaucgacggccucgagacccgcauguccgccugcaccgcccagaaccaggagcuccagcgcaagguccuccaccucgagaagcagaaccucucccuccucgagcagcucaagaagcuccaggccaucgucguccaguccaccuccaaguccgcccagaccggcaccugcgucgccguccuccuccucuccuucgcccucaucauccuccccuccaucucccccuucggccccaacaagaccgagucccccggcgacuucgcccccguccgcgucuucucccgcacccuccacaacgacgccgccucccgcgucgccgccgacgccguccccggcuccgaggcccccggcccccgccccgaggccgacaccacccgcgaggagucccccggcucccccggcgccgacuggggcuuccaggacaccgccaaccucaccaacuccaccgaggagcucgacaacgccacccucguccuccgcaacgccaccgagggccucggccaggucgcccuccucgacugggucgcccccggccccuccaccggcuccggccgcgccggccucgaggccgccggcgacgagcucuga

SEQ ID NO: 8161 - RNA, 1386 nt, Artificial Sequence
  derived and/or modified sequence opt3 from CREB3L3__Homo_sapiens__CCDS12121.1
augaacaccgaccuggccgcuggcaagauggcaagcgccgcgugcuccauggaucccaucgacucuuucgagcuccuugaucuguuguuugacagacaggaugggauuuuaaggcacguggaacugggagaggguuggggccaugucaaagaccaacagguucuaccuaauccagauucagacgauuuccucaguagcauacugggguccggagacucucuuccgucgucaccccuguggagcccugaaggcagugauuccgguaucucugaggacuugccaagcgauccccaggacacaccuccacgguccgggcccgcuacuucaccagccggaugucacccugcacagccgggcaagggccccugccucaguuaccauccugggaacagcuguucuacgaccacaccaggacccgugauucaaguaccugaagccuccgugacuaucgaccuggagauguggucaccagguggccgcauuugcgcugagaaacccgcagauccggucgaccugagcccucgauguaaucucaccgugaaggauuuacugcuuagugggucuuccggagacuugcagcagcaccaucugggcgccagcuaucuacuccgucccggugcugggcacugccaggaacugguucuuacagaggaugagaaaaagcuguuggccaaggaaggaaucacccucccaacucaacugccuuuaacaaaauacgaggaaagagugcugaagaaaauaaggcggaagauccgcaacaaacagucggcgcaggagucuagaaagaagaaaaaggaauauauugacggccucgagaccaggauguccgcauguacggcccagaaucaagaacuucagcggaaaguccugcacuuggagaagcagaaccuaucacugcucgagcaacugaaaaagcugcaggcuaucgugguacagaguacuagcaaauccgcccagaccggcacaugcguugcagugcuuuugcucucuuuugcucugauuaucuuacccagcauaucaccauucgggcccaauaagacugaaaguccuggagauuuugccccaguccgcguguucucccgaacccugcauaacgacgcggccagcagaguggcagcugaugccgucccggguucugaggcucccggcccuaggccagaagccgacacaacccgggaggaaucacccgggaguccuggagcagauuggggcuuucaagacacggccaaucuaacuaacagcacagaggagcucgacaaugcuacccugguucuucguaacgcgacugaagguuugggccagguggcacugcucgauuggguagccccagggcccuccacaggaucuggccgcgcugggcuggaggccgcaggagacgaacuuuga

SEQ ID NO: 8162 - RNA, 1386 nt, Artificial Sequence
  derived and/or modified sequence opt4 from CREB3L3__Homo_sapiens__CCDS12121.1
augaacaccgaccuggccgccggcaagauggccagcgccgccugcagcauggaccccaucgacagcuucgagcugcuggaccugcuguucgacagacaggacggcauccugagacacguggagcugggcgagggcuggggccacgugaaggaccagcaggugcugcccaaccccgacagcgacgacuuccugagcagcauccugggcagcggcgacagccugcccagcagcccccuguggagccccgagggcagcgacagcggcaucagcgaggaccugcccagcgacccccaggacaccccccccagaagcggccccgccaccagccccgccggcugccaccccgcccagcccggcaagggccccugccugagcuaccaccccggcaacagcugcagcaccaccacccccggccccgugauccaggugcccgaggccagcgugaccaucgaccuggagauguggagccccggcggcagaaucugcgccgagaagcccgccgaccccguggaccugagccccagaugcaaccugaccgugaaggaccugcugcugagcggcagcagcggcgaccugcagcagcaccaccugggcgccagcuaccugcugagacccggcgccggccacugccaggagcuggugcugaccgaggacgagaagaagcugcuggccaaggagggcaucacccugcccacccagcugccccugaccaaguacgaggagagagugcugaagaagaucagaagaaagaucagaaacaagcagagcgcccaggagagcagaaagaagaagaaggaguacaucgacggccuggagaccagaaugagcgccugcaccgcccagaaccaggagcugcagagaaaggugcugcaccuggagaagcagaaccugagccugcuggagcagcugaagaagcugcaggccaucguggugcagagcaccagcaagagcgcccagaccggcaccugcguggccgugcugcugcugagcuucgcccugaucauccugcccagcaucagccccuucggccccaacaagaccgagagccccggcgacuucgcccccgugagaguguucagcagaacccugcacaacgacgccgccagcagaguggccgccgacgccgugcccggcagcgaggcccccggccccagacccgaggccgacaccaccagagaggagagccccggcagccccggcgccgacuggggcuuccaggacaccgccaaccugaccaacagcaccgaggagcuggacaacgccacccuggugcugagaaacgccaccgagggccugggccagguggcccugcuggacuggguggcccccggccccagcaccggcagcggcagagccggccuggaggccgccggcgacgagcuguga

SEQ ID NO: 8163 - RNA, 1386 nt, Artificial Sequence
  derived and/or modified sequence opt5 from CREB3L3__Homo_sapiens__CCDS12121.1
augaacaccgaccuggccgcuggcaagauggccagcgcggcuugcuccauggaucccaucgacucuuucgagcuccuggaucuucuguuugacagacaggaugggauucuccggcacguggaacugggagagggcugggggcaugucaaagaccaacagguucuuccuaauccggauagcgacgauuuccuguccucuauccucggaagcggcgacucccugcccucuagcccucuguggucccccgaagggagcgauucuggaauuuccgaggaccucccuagcgauccccaggacacaccuccgcgcucuggccccgccacguccccugccggcugucaccccgcucagccugggaagggacccugccugagcuaccauccgggcaacucuuguuccaccacaaccccugggcccgugauccaagugccugaagccagcgucacaauugaccuugagauguggucccccggaggcagaaucugcgcugagaaacccgccgauccuguggaccugucuccgcgguguaaucucaccguuaaggaucugcuucugagcggguccagcggagaccuccagcagcaccaucugggcgcgucuuaucugcuccgccccggcgccgggcacugccaggaacuggugcuuacagaggaugagaaaaagcugcucgcuaaggaaggaaucacccugccuacgcaacuuccccugaccaaauacgaggaaagaguccucaagaaaauucggcgcaagaucagaaacaaacaguccgcccaggagagccggaagaagaaaaaggaauauauugacggccuggagacacgcaugucugcuuguaccgcccagaaucaagaacugcagagaaaagugcuccaccuggagaagcagaaccuuagccugcucgagcaacugaaaaagcugcaggcgaucguugugcaguccacaucuaaaagcgcccagaccgggacgugcgucgcugugcuucuccuguccuuugcccugauuauccucccuagcauuucucccuucggaccgaauaagacagaauccccuggcgauuuugcucccgugcgggucuucagccgcacccugcauaacgacgccgccucuagaguugcugcggaugccgugccuggguccgaggcucccggaccucggcccgaagccgacacaacccgcgaggaaagcccgggcuccccuggcgccgauuggggguuucaagacaccgcuaaucuuacaaacucuacggaggagcuggacaaugccacccucgugcugagaaacgcgacagaaggacugggccaggucgcccuucucgauuggguggcucccgggcccagcaccggauccggccgggccgggcuggaggcugccggcgacgaacuguga

SEQ ID NO: 8164 - protein, 395 aa, Artificial Sequence
  CREB3L4__Homo_sapiens__Q8TEY5
MDLGIPDLLDAWLEPPEDIFSTGSVLELGLHCPPPEVPVTRLQEQGLQGWKSGGDRGCGLQESEPEDFLKLFIDPNEVYCSEASPGSDSGISEDPCHPDSPPAPRATSSPMLYEVVYEAGALERMQGETGPNVGLISIQLDQWSPAFMVPDSCMVSELPFDAHAHILPRAGTVAPVPCTTLLPCQTLFLTDEEKRLLGQEGVSLPSHLPLTKAEERVLKKVRRKIRNKQSAQDSRRRKKEYIDGLESRVAACSAQNQELQKKVQELERHNISLVAQLRQLQTLIAQTSNKAAQTSTCVLILLFSLALIILPSFSPFQSRPEAGSEDYQPHGVTSRNILTHKDVTENLETQVVESRLREPPGAKDANGSTRTLLEKMGGKPRPSGRIRSVLHADEM

SEQ ID NO: 8165 - RNA, 1188 nt, Artificial Sequence
  CREB3L4__Homo_sapiens__CCDS1056.1
auggaucucggaaucccugaccugcuggacgcguggcuggagcccccagaggauaucuucucgacaggauccguccuggagcugggacuccacugccccccuccagagguuccgguaacuaggcuacaggaacagggacugcaaggcuggaaguccgguggggaccguggcuguggccuucaagagagugagccugaagauuucuugaagcuuuucauugaucccaaugagguguacugcucagaagcaucuccuggcagugacaguggcaucucugaggaccccugccauccagacagucccccugcccccagggcaaccaguucuccuaugcucuaugagguugucuaugaggcaggggcccuggagaggaugcagggggaaacugggccaaauguaggccuuaucuccauccagcuagaucaguggagcccagcauuuauggugccugauuccugcauggucagugagcugcccuuugaugcucaugcccacauccugcccagagcaggcaccguagccccagugcccuguacaacccugcugcccugucaaacccuguuccugaccgaugaggagaagcgucugcuggggcaggaagggguuucccugcccucucaccugccccucaccaaggcagaggagaggguccucaagaaggucaggaggaaaauccguaacaagcagucagcucaggacagucggcggcggaagaaggaguacauugaugggcuggagagcaggguggcagccuguucugcacagaaccaagaauuacagaaaaaaguccaggagcuggagaggcacaacaucuccuugguagcucagcuccgccagcugcagacgcuaauugcucaaacuuccaacaaagcugcccagaccagcacuuguguuuugauucuucuuuuuucccuggcucucaucauccugcccagcuucaguccauuccagagucgaccagaagcugggucugaggauuaccagccucacggagugacuuccagaaauauccugacccacaaggacguaacagaaaaucuggagacccaagugguagaguccagacugagggagccaccuggagccaaggaugcaaauggcucaacaaggacacugcuugagaagaugggagggaagccaagacccagugggcgcauccgguccgugcugcaugcagaugagauguga

SEQ ID NO: 8166 - RNA, 1188 nt, Artificial Sequence
  derived and/or modified sequence opt1 from CREB3L4__Homo_sapiens__CCDS1056.1
auggaccugggcauccccgaccuccuggacgccuggcuggagccgcccgaggacaucuucagcaccggguccgugcucgagcugggccugcacugcccgcccccggagguccccgugacccgccuccaggagcaggggcugcagggcuggaaguccgggggcgaccggggcugcgggcugcaggagagcgagcccgaggacuuccucaagcuguucaucgaccccaacgagguguacugcagcgaggccuccccgggcagcgacuccgggaucagcgaggaccccugccaccccgacuccccgcccgcgccccgcgccacgagcucccccaugcuguacgaggucguguacgaggccggcgcccucgagcggaugcagggggagaccggccccaacgugggccugaucagcauccagcuggaccaguggucccccgccuucaugguccccgacagcugcaugguguccgagcuccccuucgacgcgcacgcccacauccugccccgcgccgggaccguggccccgguccccugcaccacgcugcuccccugccagacccuguuccugaccgacgaggagaagcggcuccugggccaggagggggugagccugcccucccaccucccgcugaccaaggcggaggagcgcgugcugaagaagguccggcgcaagauccggaacaagcagagcgcccaggacucccgccggcgcaagaaggaguacaucgacggccucgagagccggguggccgccugcagcgcccagaaccaggagcugcagaagaaggugcaggagcuggagcgccacaacaucucccucgucgcgcagcugcggcagcugcagacgcucaucgcccagaccagcaacaaggccgcccagaccuccacgugcgugcugauccuccuguucagccuggcccugaucauccuccccuccuucagccccuuccagucccgccccgaggcgggcagcgaggacuaccagccgcacggggugaccucccggaacauccugacccacaaggacgucaccgagaaccuggagacccaggugguggagagccgccuccgggagccgcccggcgccaaggacgccaacggguccacgcgcacccugcuggagaagaugggcgggaagccccggcccagcggccgcauccgcuccguccuccacgccgacgagauguga

SEQ ID NO: 8167 - RNA, 1188 nt, Artificial Sequence
  derived and/or modified sequence opt2 from CREB3L4__Homo_sapiens__CCDS1056.1
auggaccucggcauccccgaccuccucgacgccuggcucgagccccccgaggacaucuucuccaccggcuccguccucgagcucggccuccacugccccccccccgagguccccgucacccgccuccaggagcagggccuccagggcuggaaguccggcggcgaccgcggcugcggccuccaggaguccgagcccgaggacuuccucaagcucuucaucgaccccaacgaggucuacugcuccgaggccucccccggcuccgacuccggcaucuccgaggaccccugccaccccgacuccccccccgccccccgcgccaccuccucccccaugcucuacgaggucgucuacgaggccggcgcccucgagcgcaugcagggcgagaccggccccaacgucggccucaucuccauccagcucgaccaguggucccccgccuucaugguccccgacuccugcauggucuccgagcuccccuucgacgcccacgcccacauccucccccgcgccggcaccgucgcccccguccccugcaccacccuccuccccugccagacccucuuccucaccgacgaggagaagcgccuccucggccaggagggcgucucccuccccucccaccucccccucaccaaggccgaggagcgcguccucaagaagguccgccgcaagauccgcaacaagcaguccgcccaggacucccgccgccgcaagaaggaguacaucgacggccucgagucccgcgucgccgccugcuccgcccagaaccaggagcuccagaagaagguccaggagcucgagcgccacaacaucucccucgucgcccagcuccgccagcuccagacccucaucgcccagaccuccaacaaggccgcccagaccuccaccugcguccucauccuccucuucucccucgcccucaucauccuccccuccuucucccccuuccagucccgccccgaggccggcuccgaggacuaccagccccacggcgucaccucccgcaacauccucacccacaaggacgucaccgagaaccucgagacccaggucgucgagucccgccuccgcgagccccccggcgccaaggacgccaacggcuccacccgcacccuccucgagaagaugggcggcaagccccgccccuccggccgcauccgcuccguccuccacgccgacgagauguga

SEQ ID NO: 8168 - RNA, 1188 nt, Artificial Sequence
  derived and/or modified sequence opt3 from CREB3L4__Homo_sapiens__CCDS1056.1
auggaccugggcauccccgaucuccuugacgccuggcuggagccuccagaagauauuuucagcaccggguccguguuggaguuaggacugcacugcccgcccccugaagucccaguuacaagacuacaggagcaaggucuccagggcuggaagucugggggagacaggggcuguggucugcaggaaucagagcccgaggauuuucuuaaacuguucauagacccuaacgaaguguacugcagugaggcuagcccaggguccgauucuggaaucucggaagaccccugucauccugauucaccaccggcaccccgggccacuagcaguccuauguuguaugagguaguguacgaggcgggcgcucucgaacgcaugcagggcgagacggggccaaaugucggacugauuuccauccaacuggaccaguggucucccgccuuuauggugccugauagcugcaugguuuccgaacucccauucgacgcacacgcccauauuuuaccccgagcugguaccguggcaccggucccuuguacaacucugcuucccugccagaccuuguuucugacagaugaggaaaagcgucuacucggccaggagggggugucacugccaagucaccuuccucugaccaaagccgaggaaagaguauugaagaaaguuaggcggaagauccgcaacaagcaaagcgcucaggacucuagaaggcggaaaaaggaguauauagacggacucgaaucccgcguggccgcguguucagcacagaaucaggagcugcagaaaaagguccaagaauuagagcgacauaacaucagccugguggcccagcucagacaacuucagacucugauugcucagacaaguaauaaagccgcacagaccucuacgugcguguugauccuacuguucucccucgcucugauuauccuucccagcuuuucgccauuccaaucuaggcccgaggccggcuccgaagauuaccagccucacggugucacuucacggaacauacugacccacaaggacguuacagagaauuuggaaacucaggugguagagagucgucuccgcgaaccaccgggggcgaaggaugccaacggaagcaccagaacacuguuagagaaaaugggcggcaagcccaggccuuccgggcggauucgaucugugcugcaugcagacgagauguga

SEQ ID NO: 8169 - RNA, 1188 nt, Artificial Sequence
  derived and/or modified sequence opt4 from CREB3L4__Homo_sapiens__CCDS1056.1
auggaccugggcauccccgaccugcuggacgccuggcuggagccccccgaggacaucuucagcaccggcagcgugcuggagcugggccugcacugccccccccccgaggugcccgugaccagacugcaggagcagggccugcagggcuggaagagcggcggcgacagaggcugcggccugcaggagagcgagcccgaggacuuccugaagcuguucaucgaccccaacgagguguacugcagcgaggccagccccggcagcgacagcggcaucagcgaggaccccugccaccccgacagcccccccgcccccagagccaccagcagccccaugcuguacgaggugguguacgaggccggcgcccuggagagaaugcagggcgagaccggccccaacgugggccugaucagcauccagcuggaccaguggagccccgccuucauggugcccgacagcugcauggugagcgagcugcccuucgacgcccacgcccacauccugcccagagccggcaccguggcccccgugcccugcaccacccugcugcccugccagacccuguuccugaccgacgaggagaagagacugcugggccaggagggcgugagccugcccagccaccugccccugaccaaggccgaggagagagugcugaagaaggugagaagaaagaucagaaacaagcagagcgcccaggacagcagaagaagaaagaaggaguacaucgacggccuggagagcagaguggccgccugcagcgcccagaaccaggagcugcagaagaaggugcaggagcuggagagacacaacaucagccugguggcccagcugagacagcugcagacccugaucgcccagaccagcaacaaggccgcccagaccagcaccugcgugcugauccugcuguucagccuggcccugaucauccugcccagcuucagccccuuccagagcagacccgaggccggcagcgaggacuaccagccccacggcgugaccagcagaaacauccugacccacaaggacgugaccgagaaccuggagacccaggugguggagagcagacugagagagccccccggcgccaaggacgccaacggcagcaccagaacccugcuggagaagaugggcggcaagcccagacccagcggcagaaucagaagcgugcugcacgccgacgagauguga

SEQ ID NO: 8170 - RNA, 1188 nt, Artificial Sequence
  derived and/or modified sequence opt5 from CREB3L4__Homo_sapiens__CCDS1056.1
auggaccugggcauccccgaucuccuggacgccuggcuugagccuccggaagauauuuucagcaccggguccgugcuggagcucggacugcacugucccccucccgaagucccuguuacaagacuucaggagcaaggccugcagggguggaagucuggaggcgaccgggggugcggacuccaggaaagcgagcccgaggauuuucugaaacuguucaucgacccuaacgaaguguacugcuccgaggcuucuccgggcagcgauuccggcauuucugaagaccccugucauccugauagcccucccgcccccagagcgacguccagcccgaugcucuaugagguggucuacgaggcuggggcccuggaaagaaugcagggagagaccggcccuaauguggggcuuaucucuauucaacuggaccaguggucccccgccuuuaugguuccugauagcugcauggugucugaacuccccuucgacgcucacgcccauauccugccccgggcuggaacagucgccccugugccguguaccacacuucugcccugccagacccucuuucugacagaugaggaaaagcgccugcucggccaggaggggguuucccugccuagccaccuuccccugaccaaagcggaggaaagagugcucaagaaaguccggcgcaagaucagaaacaagcaaucugcccaggacucccggcgccgcaaaaaggaguauauugacggacuggaaagccggguggcugccuguuccgcucagaaucaggagcuucagaaaaaggugcaagaacuggagcgccauaacaucucucucgucgcccagcugagacaacugcagacgcucauugcgcagaccagcaauaaagccgcucagacauccacaugcguucugauccuucuguucagccucgcccugauuauccuuccuucuuuuucccccuuccaaagccggccggaggcuggcucugaagauuaccagccucacggcgugaccagccgcaacauucugacccacaaggacgugacggagaaucucgaaacacaggucguggaguccagacugcgggaacccccuggggccaaggaugccaacggaucuaccagaacacugcucgagaaaaugggcgggaagccccgcccuagcggacggaucagauccguucugcaugcugacgagauguga

SEQ ID NO: 8171 - protein, 508 aa, Artificial Sequence
  CREB5__Homo_sapiens__Q02930
MIYEESKMNLEQERPFVCSAPGCSQRFPTEDHLMIHRHKHEMTLKFPSIKTDNMLSDQTPTPTRFLKNCEEVGLFSELDCSLEHEFRKAQEEESSKRNISMHNAVGGAMTGPGTHQLSSARLPNHDTNVVIQQAMPSPQSSSVITQAPSTNRQIGPVPGSLSSLLHLHNRQRQPMPASMPGTLPNPTMPGSSAVLMPMERQMSVNSSIMGMQGPNLSNPCASPQVQPMHSEAKMRLKAALTHHPAAMSNGNMNTMGHMMEMMGSRQDQTPHHHMHSHPHQHQTLPPHHPYPHQHQHPAHHPHPQPHHQQNHPHHHSHSHLHAHPAHHQTSPHPPLHTGNQAQVSPATQQMQPTQTIQPPQPTGGRRRRVVDEDPDERRRKFLERNRAAATRCRQKRKVWVMSLEKKAEELTQTNMQLQNEVSMLKNEVAQLKQLLLTHKDCPITAMQKESQGYLSPESSPPASPVPACSQQQVIQHNTITTSSSVSEVVGSSTLSQLTTHRTDLNPIL

SEQ ID NO: 8172 - RNA, 1527 nt, Artificial Sequence
  CREB5__Homo_sapiens__CCDS5417.1
augauuuaugaggaauccaagaugaauuuggagcaggagaggccguuugucugcagugccccaggcugcucccagcgcuucccaacagaggaccaucugaugauucauaggcacaaacaugaaaugacuuugaaguuuccuucaauaaaaacagacaauauguuaucagaucaaacuccgaccccaacgagauuccugaagaacugcgaggaggugggccucuucagcgagcuggacugcucccuggagcacgaguucaggaaggcucaggaagaggagagcagcaagcggaauaucucgaugcauaaugcaguugguggggccaugacggggcccggaacucaccagcuuagcagcgcucggcugcccaaccaugacaccaacguugugauucagcaagccaugccgucgccucaguccagcucugucaucacucaggcaccuuccaccaaccgccagaucgggccugucccaggcucucuaucuucucugcuacaucuccacaacagacagagacagcccaugccagccuccaugccugggacccugcccaacccuacaaugccaggaucuuccgccgucuugaugccaauggagcgacaaaugucagugaacuccagcaucauggggaugcaagguccaaaucucagcaaccccugugcuucuccccagguccagccaaugcauucagaagccaaaaugagguugaaggcugcauugacucaccacccugcugccaugucaaaugggaacaugaacaccaugggacacaugauggagaugaugggcucccggcaggaccagacgccacaccaucacaugcacucgcacccgcaucagcaccagacacugccaccccaucacccuuacccacaccagcaccagcacccagcacaccauccucacccucaaccccaucaccagcagaaccauccacaucaccacucccauucccaccuucaugcacacccagcacaucaccagaccucgccacauccgccccugcacaccggcaaccaagcacagguuucaccagcaacacaacagaugcagccaacccagacaauacagccaccccagcccacaggggggcgccggcgaagggugguagacgaggauccggacgagaggcggcggaaauuucuggaacggaaccgggcagcugccacccgcugcagacagaagaggaaggucugggugaugucauuggaaaagaaagcagaagaacucacccagacaaacaugcagcuucagaaugaagugucuauguugaaaaaugagguggcccagcugaaacaguuguuguuaacacauaaagacugcccaauaacagccaugcagaaagaaucacaaggauaucuaaguccagagaguagcccuccugcuaguccugucccagcuugcucccagcaacaagucauccagcauaauaccaucacuacuuccucaucggucagcgaggugguaggaagcuccacccucagccagcucaccacucacagaacagaccugaauccgauucuuuaa

SEQ ID NO: 8173 - RNA, 1527 nt, Artificial Sequence
  derived and/or modified sequence opt1 from CREB5__Homo_sapiens__CCDS5417.1
augaucuacgaggagagcaagaugaaccuggagcaggagcgccccuucgugugcuccgccccgggcugcagccagcgguuccccaccgaggaccaccucaugauccaccgccacaagcacgagaugacccugaaguuccccuccaucaagacggacaacaugcugagcgaccagacccccaccccgacccgguuccucaagaacugcgaggaggucgggcuguucuccgagcuggacugcagccucgagcacgaguuccgcaaggcccaggaggaggaguccagcaagcggaacaucuccaugcacaacgcggugggcggggccaugacgggccccgggacccaccagcugagcuccgcccgccugcccaaccacgacaccaacguggucauccagcaggccaugcccagcccgcaguccagcuccgugaucacccaggcccccagcacgaaccggcagaucggccccgugcccggcucccucagcucccugcugcaccuccacaaccgccagcggcagccgaugcccgcgagcaugcccgggacccugcccaacccgaccaugcccggcagcuccgccguccugaugcccauggagcgccagaugagcgugaacuccagcaucauggggaugcagggccccaaccucuccaacccgugcgccagcccccaggugcagcccaugcacuccgaggccaagaugcggcugaaggcggcccugacccaccaccccgccgccaugagcaacgggaacaugaacacgaugggccacaugauggagaugaugggcucccgccaggaccagaccccgcaccaccacaugcacagccacccccaccagcaccagacccucccgccccaccaccccuacccccaccagcaccagcaccccgcccaccacccgcacccccagccccaccaccagcagaaccacccccaccaccacucccacagccaccuccacgcgcacccggcccaccaccagaccagcccccacccgccccugcacacggggaaccaggcccaggucucccccgccacccagcagaugcagcccacccagaccauccagccgccccagcccacgggcgggcggcgccggcgcgugguggacgaggaccccgacgagcggcgccggaaguuccuggagcgcaaccgggccgcggccacccgcugccgccagaagcggaaggucugggugaugucccuggagaagaaggccgaggagcugacccagaccaacaugcagcuccagaacgaggugagcaugcugaagaacgaggucgcccagcugaagcagcuccugcugacgcacaaggacugccccaucaccgccaugcagaaggagucccagggcuaccucagccccgaguccagcccgcccgcgagccccgugcccgccugcucccagcagcaggucauccagcacaacaccaucaccacgagcuccagcguguccgagguggugggcagcuccacccugagccagcugaccacccaccgcacggaccucaacccgauccuguga

SEQ ID NO: 8174 - RNA, 1527 nt, Artificial Sequence
  derived and/or modified sequence opt2 from CREB5__Homo_sapiens__CCDS5417.1
augaucuacgaggaguccaagaugaaccucgagcaggagcgccccuucgucugcuccgcccccggcugcucccagcgcuuccccaccgaggaccaccucaugauccaccgccacaagcacgagaugacccucaaguuccccuccaucaagaccgacaacaugcucuccgaccagacccccacccccacccgcuuccucaagaacugcgaggaggucggccucuucuccgagcucgacugcucccucgagcacgaguuccgcaaggcccaggaggaggaguccuccaagcgcaacaucuccaugcacaacgccgucggcggcgccaugaccggccccggcacccaccagcucuccuccgcccgccuccccaaccacgacaccaacgucgucauccagcaggccaugcccuccccccaguccuccuccgucaucacccaggcccccuccaccaaccgccagaucggccccguccccggcucccucuccucccuccuccaccuccacaaccgccagcgccagcccaugcccgccuccaugcccggcacccuccccaaccccaccaugcccggcuccuccgccguccucaugcccauggagcgccagauguccgucaacuccuccaucaugggcaugcagggccccaaccucuccaaccccugcgccuccccccagguccagcccaugcacuccgaggccaagaugcgccucaaggccgcccucacccaccaccccgccgccauguccaacggcaacaugaacaccaugggccacaugauggagaugaugggcucccgccaggaccagaccccccaccaccacaugcacucccacccccaccagcaccagacccuccccccccaccaccccuacccccaccagcaccagcaccccgcccaccacccccacccccagccccaccaccagcagaaccacccccaccaccacucccacucccaccuccacgcccaccccgcccaccaccagaccuccccccaccccccccuccacaccggcaaccaggcccaggucucccccgccacccagcagaugcagcccacccagaccauccagcccccccagcccaccggcggccgccgccgccgcgucgucgacgaggaccccgacgagcgccgccgcaaguuccucgagcgcaaccgcgccgccgccacccgcugccgccagaagcgcaaggucugggucaugucccucgagaagaaggccgaggagcucacccagaccaacaugcagcuccagaacgaggucuccaugcucaagaacgaggucgcccagcucaagcagcuccuccucacccacaaggacugccccaucaccgccaugcagaaggagucccagggcuaccucucccccgaguccuccccccccgccucccccguccccgccugcucccagcagcaggucauccagcacaacaccaucaccaccuccuccuccgucuccgaggucgucggcuccuccacccucucccagcucaccacccaccgcaccgaccucaaccccauccucuga

SEQ ID NO: 8175 - RNA, 1527 nt, Artificial Sequence
  derived and/or modified sequence opt3 from CREB5__Homo_sapiens__CCDS5417.1
augaucuacgaggaaagcaagaugaaccuggagcaggaaagacccuucgugugcuccgccccuggcuguucucaaagguuuccaaccgaggaccaccucaugauucaucggcacaaacaugaaaugacacuuaaguucccgucaauaaaaacugauaauaugcugagugaccagacgcccaccccuacacgcuuuuugaagaacugcgaggaggucggguuauucagcgaacuggauuguucccuagagcacgaauuucgaaaagcucaggaggaggaaucuucgaagcguaauaucucaaugcauaacgcaguuggaggugccaugacuggcccagggacccaccagcucagcagugcgagacugcccaaucacgacacaaacgugguaauucaacaggcuaugccuuccccacagucuagcuccgugaucacccaggcccccucaacuaauaggcaaauuggaccugucccaggcagucuuagcucucuguugcaucuccacaaccggcagcgccagccgaugcccgcauccaugccugguacacugccaaaucccaccaugccugggucaagcgccgugcugaugccaauggagagacagaugaguguuaacucuuccaucaugggaaugcaaggccccaaucucagcaacccgugcgcuucgccucaggugcagcccaugcauucugaagcaaagaugagguuaaaagccgcucugacgcaccacccagccgcgauguccaauggcaacaugaauacuauggggcauaugauggagaugaugggaucacggcaagaucagaccccucaccaucacaugcauagucacccccaccagcaucagacacuuccaccccaccauccuuauccacaccaacaccagcauccggcacaccauccccacccucagccacaucaccagcaaaaccacccccaucaccauagccacucccauuugcacgcccacccugcucaucaccagacuucuccacaucccccgcugcacaccgguaaccaggcccaggucagcccugcaacacaacagaugcagccaacccagacgauacaacccccucagcccacuggcgggcgccgaagaagggugguagacgaagauccagacgagcggcgucgcaaguuccuagagagaaauagggcugccgcgacacggugucgacagaaacgcaagguuugggugaugucacucgagaaaaaggccgaagaacugacccaaacuaacaugcagcuucagaaugaggucaguaugcugaagaacgaaguggcacaguugaaacaacuccuguuaacacacaaggauugcccuaucaccgcuaugcagaaagagucccagggauaccugagccccgagucuucaccaccggccaguccugugcccgcuuguagccagcaacaggucauucagcauaauacgaucaccacauccucuucgguuagcgaagugguaggcuccucaacucucagucagcuuaccacacacagaacugaccugaacccaauuuuguga

SEQ ID NO: 8176 - RNA, 1527 nt, Artificial Sequence
  derived and/or modified sequence opt4 from CREB5__Homo_sapiens__CCDS5417.1
augaucuacgaggagagcaagaugaaccuggagcaggagagacccuucgugugcagcgcccccggcugcagccagagauuccccaccgaggaccaccugaugauccacagacacaagcacgagaugacccugaaguuccccagcaucaagaccgacaacaugcugagcgaccagacccccacccccaccagauuccugaagaacugcgaggaggugggccuguucagcgagcuggacugcagccuggagcacgaguucagaaaggcccaggaggaggagagcagcaagagaaacaucagcaugcacaacgccgugggcggcgccaugaccggccccggcacccaccagcugagcagcgccagacugcccaaccacgacaccaacguggugauccagcaggccaugcccagcccccagagcagcagcgugaucacccaggcccccagcaccaacagacagaucggccccgugcccggcagccugagcagccugcugcaccugcacaacagacagagacagcccaugcccgccagcaugcccggcacccugcccaaccccaccaugcccggcagcagcgccgugcugaugcccauggagagacagaugagcgugaacagcagcaucaugggcaugcagggccccaaccugagcaaccccugcgccagcccccaggugcagcccaugcacagcgaggccaagaugagacugaaggccgcccugacccaccaccccgccgccaugagcaacggcaacaugaacaccaugggccacaugauggagaugaugggcagcagacaggaccagaccccccaccaccacaugcacagccacccccaccagcaccagacccugcccccccaccaccccuacccccaccagcaccagcaccccgcccaccacccccacccccagccccaccaccagcagaaccacccccaccaccacagccacagccaccugcacgcccaccccgcccaccaccagaccagcccccaccccccccugcacaccggcaaccaggcccaggugagccccgccacccagcagaugcagcccacccagaccauccagcccccccagcccaccggcggcagaagaagaagagugguggacgaggaccccgacgagagaagaagaaaguuccuggagagaaacagagccgccgccaccagaugcagacagaagagaaaggugugggugaugagccuggagaagaaggccgaggagcugacccagaccaacaugcagcugcagaacgaggugagcaugcugaagaacgagguggcccagcugaagcagcugcugcugacccacaaggacugccccaucaccgccaugcagaaggagagccagggcuaccugagccccgagagcagcccccccgccagccccgugcccgccugcagccagcagcaggugauccagcacaacaccaucaccaccagcagcagcgugagcgagguggugggcagcagcacccugagccagcugaccacccacagaaccgaccugaaccccauccuguga

SEQ ID NO: 8177 - RNA, 1527 nt, Artificial Sequence
  derived and/or modified sequence opt5 from CREB5__Homo_sapiens__CCDS5417.1
augaucuacgaggaaagcaagaugaaccuggagcaggaaagacccuucgugugcuccgccccuggcuguucucaacgguuuccgaccgaggaccaccucaugauucaucgccacaaacaugaaaugacacugaaguuccccagcaucaaaacggauaauaugcuuuccgaccagaccccuacacccaccagauuucugaagaacugcgaggaggucggacucuucucugaacuggauuguagccuugagcacgaauuucggaaagcucaggaggaggaauccucuaagcgcaauauuagcaugcauaacgccguugggggcgcgaugacagggccuggaacccaccagcuguccagcgcuagacuccccaaucacgacacaaacguggugauccaacaggccaugccuucuccgcaguccagcucugucauuacccaggcccccuccacgaaucggcaaaucggcccugugcccgggagccugucuucccugcuccaucugcacaaccgccagagacagccuaugcccgcuagcaugccgggaacccuuccuaaucccacaaugccuggcuccucugccguucugaugcccauggagcggcagaugagcgugaacuccagcaucaugggcaugcaagggcccaaucucucuaacccuugcgcuuccccgcagguccagcccaugcauagcgaagccaagaugcgccugaaagcggcccuuacccaccacccugcugccaugucuaauggaaacaugaauacaaugggccauaugauggagaugauggggagcagacaagaucagacgccccaccaucacaugcauucccacccucaccagcaucagacccugcccccgcaccauccuuauccccaccaacaccagcauccugcucaccauccccacccucagccccaucaccagcaaaaccacccgcaucaccauucucacagccaucuccacgcccacccugcgcaucaccagacaagcccccaucccccucugcacaccggaaaccaggcccagguguccccggcuacacaacagaugcagcccacccagaccauucaaccuccccagccuacaggcgggcggcgcagacggguuguggacgaagaucccgacgagcgcagacggaaguuccuggagagaaaucgcgccgcugccacgcgguguagacagaaacgcaaggucugggugaugucucucgagaaaaaggccgaagaacugacccaaacaaacaugcagcuucagaaugagguguccaugcugaagaacgaagucgcucagcucaaacaacugcuucugacccacaaggauugcccuaucacagcgaugcagaaagagagccagggauaccucucucccgaguccagcccgccugccucccccguuccugcuuguucucagcaacaggugauucagcauaauaccaucacgacaagcuccucugugagcgaagucgugggcuccagcacccugucucagcugaccacacaccggaccgaccucaaccccauucuguga

SEQ ID NO: 8178 - protein, 693 aa, Artificial Sequence
  CRTC2__Homo_sapiens__Q53ET0
MATSGANGPGSATASASNPRKFSEKIALQKQRQAEETAAFEEVMMDIGSTRLQAQKLRLAYTRSSHYGGSLPNVNQIGSGLAEFQSPLHSPLDSSRSTRHHGLVERVQRDPRRMVSPLRRYTRHIDSSPYSPAYLSPPPESSWRRTMAWGNFPAEKGQLFRLPSALNRTSSDSALHTSVMNPSPQDTYPGPTPPSILPSRRGGILDGEMDPKVPAIEENLLDDKHLLKPWDAKKLSSSSSRPRSCEVPGINIFPSPDQPANVPVLPPAMNTGGSLPDLTNLHFPPPLPTPLDPEETAYPSLSGGNSTSNLTHTMTHLGISRGMGLGPGYDAPGLHSPLSHPSLQSSLSNPNLQASLSSPQPQLQGSHSHPSLPASSLARHVLPTTSLGHPSLSAPALSSSSSSSSTSSPVLGAPSYPASTPGASPHHRRVPLSPLSLLAGPADARRSQQQLPKQFSPTMSPTLSSITQGVPLDTSKLSTDQRLPPYPYSSPSLVLPTQPHTPKSLQQPGLPSQSCSVQSSGGQPPGRQSHYGTPYPPGPSGHGQQSYHRPMSDFNLGNLEQFSMESPSASLVLDPPGFSEGPGFLGGEGPMGGPQDPHTFNHQNLTHCSRHGSGPNIILTGDSSPGFSKEIAAALAGVPGFEVSAAGLELGLGLEDELRMEPLGLEGLNMLSDPCALLPDPAVEESFRSDRLQ

SEQ ID NO: 8179 - RNA, 2082 nt, Artificial Sequence
  CRTC2__Homo_sapiens__CCDS30875.1
auggcgacgucgggggcgaacgggccugguucggccacggccucggcuuccaauccgcgcaaauuuagugagaagauugcgcugcagaagcagcgucaggccgaggagacggcggccuucgaggaggugaugauggacaucggcuccacccgguuacaggcccaaaaacugcgacuggcauacacaaggagcucucauuauggugggucucugcccaauguuaaccagauuggcucuggccuggccgaguuccagagcccccuccacucaccuuuggauucaucucggagcacucggcaccaugggcugguggaacgggugcagcgagauccucgaagaaugguguccccacuucgccgauacacccgccacauugacagcucucccuauaguccugccuacuuaucuccucccccagagucuagcuggcgaaggacgauggccuggggcaauuucccugcagagaaggggcaguuguuucgacuaccaucugcacuuaacaggacaagcucugacucugcccuucauacaagugugaugaaccccaguccccaggauaccuacccaggccccacaccucccagcauccugcccagccgacguggggguauucuggauggugaaauggaccccaaaguaccugcuauugaggagaacuugcuagaugacaagcauuugcugaagccaugggaugcuaagaagcuauccucauccucuucccgaccucgguccugugaagucccuggaauuaacaucuuuccaucuccugaccagccugccaaugugccuguccucccaccugccaugaacacggggggcucccuaccugaccucaccaaccugcacuuucccccaccacugcccaccccccuggacccugaagagacagccuacccuagccugagugggggcaacaguaccuccaauuugacccacaccaugacucaccugggcaucagcaggggcaugggccugggcccaggcuaugaugcaccaggacuucauucaccucucagccacccaucccugcaguccucccuaagcaaucccaaccuccaggcuucccugagcaguccucagccccagcuucagggcucccacagccaccccucucugccugccuccuccuuggcccgccauguacugcccaccaccucccugggccaccccucacucagugcuccggcucucuccuccuccucuuccuccuccuccacuucaucuccuguuuugggcgcccccucuuacccugcuucuaccccuggggccuccccccaccaccgccgugugccccucagcccccugaguuugcucgcgggcccagccgacgccagaaggucccaacagcagcugcccaaacaguuuucgccaacaaugucacccaccuugucuuccaucacucagggcgucccccuggauaccaguaaacuguccacugaccagcgguuacccccauacccauacagcuccccaagucugguucugccuacccagccccacaccccaaagucucuacagcagccagggcugcccucucagucuuguucagugcaguccucaggugggcagcccccaggcaggcagucucauuaugggacaccguacccaccugggcccagugggcaugggcaacagucuuaccaccggccaaugagugacuucaaccuggggaaucuggagcaguucagcauggagagcccaucagccagccuggugcuggaucccccuggcuuuucugaagggccuggauuuuuagggggugaggggccaauggguggcccccaggauccccacaccuucaaccaccagaacuugacccacuguucccgccauggcucagggccuaacaucauccucacaggggacuccucuccagguuucucuaaggagauugcagcagcccuggccggagugccuggcuuugaggugucagcagcuggauuggagcuagggcuugggcuagaagaugagcugcgcauggagccacugggccuggaagggcuaaacaugcugagugaccccugugcccugcugccugauccugcuguggaggagucauuccgcagugaccggcuccaauga

SEQ ID NO: 8180 - RNA, 2082 nt, Artificial Sequence
  derived and/or modified sequence opt1 from CRTC2__Homo_sapiens__CCDS30875.1
auggccaccagcggcgccaacgggcccggcuccgcgaccgccagcgccuccaacccgcgcaaguucagcgagaagaucgcccugcagaagcagcggcaggccgaggagacggcggccuucgaggaggugaugauggacaucggguccacccgccuccaggcccagaagcugcggcuggccuacacccgcagcucccacuacggcgggagccuccccaacgucaaccagaucggcuccggccuggcggaguuccagagcccccugcacagcccccucgacuccucccggagcacccgccaccacgggcugguggagcgggugcagcgcgacccgcggcgcauggucagcccccugcggcgcuacacgcggcacaucgacuccucccccuacagccccgccuaccucuccccgccgcccgagagcagcuggcgccggaccauggccuggggcaacuuccccgccgagaaggggcagcuguuccgccugcccuccgcccucaaccggaccagcuccgacagcgcgcugcacaccuccgugaugaaccccagcccccaggacacguaccccggcccgaccccgcccuccauccugcccagccgccgcgggggcauccucgacggcgagauggaccccaaggugcccgccaucgaggagaaccugcuggacgacaagcaccuccugaagcccugggacgccaagaagcuguccagcuccagcucccggccccggagcugcgaggucccggggaucaacaucuuccccucccccgaccagcccgccaacgugccggugcucccgcccgccaugaacaccggcgggagccugcccgaccugaccaaccuccacuucccgccgccccugcccacgccccuggaccccgaggagaccgcguaccccucccucagcggcggcaacuccaccagcaaccugacccacacgaugacccaccuggggaucagccgcggcauggggcucggccccggguacgacgcccccggccugcacagcccccugucccaccccucccuccagagcucccugagcaacccgaaccugcaggccucccucagcagcccccagccccagcugcagggcucccacucccaccccagccugccggccuccagccucgcccgccacguccugcccaccaccucccuggggcaccccagccucuccgcgcccgcccugagcagcuccagcuccagcuccagcacguccagcccggugcugggcgcccccuccuaccccgccagcacccccggggccuccccgcaccaccggcgcgugccccucagcccccugucccugcucgcgggcccggccgacgcccggcgcagccagcagcagcugcccaagcaguucucccccaccaugagccccacccuguccagcaucacgcagggggucccgcuggacaccuccaagcucagcaccgaccagcggcugccgcccuaccccuacagcucccccagccuggugcuccccacccagccccacacgcccaagucccugcagcagccgggccugcccagccaguccugcagcgugcaguccagcggcgggcagccgcccggccgccagucccacuacgggacccccuacccgcccggccccagcgggcacggccagcaguccuaccaccggcccaugagcgacuucaaccucggcaaccuggagcaguucuccauggagagccccuccgccagccugguccucgacccgcccggguucuccgagggccccggguuccugggcggcgaggggcccaugggcgggccccaggacccccacaccuucaaccaccagaaccugacccacugcagccgccacggcuccgggccgaacaucauccucacgggcgacagcagccccggcuucuccaaggagaucgcggccgcccuggccggggugcccggcuucgaggugagcgccgcggggcuggagcucggccuggggcuggaggacgagcuccggauggagccgcugggccuggagggccucaacaugcuguccgaccccugcgcccugcuccccgaccccgccgucgaggagagcuuccgcuccgaccggcugcaguga

SEQ ID NO: 8181 - RNA, 2082 nt, Artificial Sequence
  derived and/or modified sequence opt2 from CRTC2__Homo_sapiens__CCDS30875.1
auggccaccuccggcgccaacggccccggcuccgccaccgccuccgccuccaacccccgcaaguucuccgagaagaucgcccuccagaagcagcgccaggccgaggagaccgccgccuucgaggaggucaugauggacaucggcuccacccgccuccaggcccagaagcuccgccucgccuacacccgcuccucccacuacggcggcucccuccccaacgucaaccagaucggcuccggccucgccgaguuccaguccccccuccacuccccccucgacuccucccgcuccacccgccaccacggccucgucgagcgcguccagcgcgacccccgccgcauggucuccccccuccgccgcuacacccgccacaucgacuccucccccuacucccccgccuaccucucccccccccccgaguccuccuggcgccgcaccauggccuggggcaacuuccccgccgagaagggccagcucuuccgccuccccuccgcccucaaccgcaccuccuccgacuccgcccuccacaccuccgucaugaaccccuccccccaggacaccuaccccggccccaccccccccuccauccuccccucccgccgcggcggcauccucgacggcgagauggaccccaagguccccgccaucgaggagaaccuccucgacgacaagcaccuccucaagcccugggacgccaagaagcucuccuccuccuccucccgcccccgcuccugcgagguccccggcaucaacaucuuccccucccccgaccagcccgccaacguccccguccucccccccgccaugaacaccggcggcucccuccccgaccucaccaaccuccacuucccccccccccuccccaccccccucgaccccgaggagaccgccuaccccucccucuccggcggcaacuccaccuccaaccucacccacaccaugacccaccucggcaucucccgcggcaugggccucggccccggcuacgacgcccccggccuccacuccccccucucccaccccucccuccaguccucccucuccaaccccaaccuccaggccucccucuccuccccccagccccagcuccagggcucccacucccaccccucccuccccgccuccucccucgcccgccacguccuccccaccaccucccucggccaccccucccucuccgcccccgcccucuccuccuccuccuccuccuccuccaccuccucccccguccucggcgcccccuccuaccccgccuccacccccggcgccuccccccaccaccgccgcgucccccucuccccccucucccuccucgccggccccgccgacgcccgccgcucccagcagcagcuccccaagcaguucucccccaccaugucccccacccucuccuccaucacccagggcgucccccucgacaccuccaagcucuccaccgaccagcgccucccccccuaccccuacuccucccccucccucguccuccccacccagccccacacccccaagucccuccagcagcccggccuccccucccaguccugcuccguccaguccuccggcggccagccccccggccgccagucccacuacggcacccccuacccccccggccccuccggccacggccagcaguccuaccaccgccccauguccgacuucaaccucggcaaccucgagcaguucuccauggagucccccuccgccucccucguccucgacccccccggcuucuccgagggccccggcuuccucggcggcgagggccccaugggcggcccccaggacccccacaccuucaaccaccagaaccucacccacugcucccgccacggcuccggccccaacaucauccucaccggcgacuccucccccggcuucuccaaggagaucgccgccgcccucgccggcguccccggcuucgaggucuccgccgccggccucgagcucggccucggccucgaggacgagcuccgcauggagccccucggccucgagggccucaacaugcucuccgaccccugcgcccuccuccccgaccccgccgucgaggaguccuuccgcuccgaccgccuccaguga

SEQ ID NO: 8182 - RNA, 2082 nt, Artificial Sequence
  derived and/or modified sequence opt3 from CRTC2__Homo_sapiens__CCDS30875.1
auggccaccagcggcgcuaacgggcccggauccgcaacagccucugcgucaaauccuagaaaguucagugagaaaaucgcucugcagaagcaaaggcaggccgaagagacugcagccuuugaagaggugaugauggacauugguagcacgcggcuccaggcucagaaacuucgccuggcauacacccgauccucucacuauggcgggucguugccaaacgucaaucaaauaggaucaggcuuagccgaguuccagagcccgcugcauaguccccuagauuccucucguagcacaagacaccauggucucguugaaagggugcagcgggacccucgcagaaugguauccccacugaggcgguacacucgccacaucgauucaagucccuauagcccugcuuaccuuucuccacccccugaguccucauggcgaagaaccauggccugggggaacuuuccagcggaaaagggacagcuguucagguugccgagcgcacucaaucggacaaguucugacuccgcccugcauaccagcgugaugaaccccucgccucaagauacuuauccaggccccacaccuccaucuauucugcccucccgucgcggcgggauccucgacggagagauggauccgaaagucccugcuauugaagagaauuuacuggacgauaagcaccuuuugaagcccugggacgccaaaaagcugucaaguagcuccucuagaccaaggagcugcgaggugccugguaucaacauauuucccucaccagaucagcccgcaaauguuccugugcuaccaccggcuaugaacaccggcgggagucuccccgaccugacgaaucuucacuucccuccaccccugccuacuccauuggaucccgaagagaccgccuacccgucccucagcggaggcaacucuacaucaaaucugacucauaccaugacacacuuagguaucagucgggggaugggacugggcccuggcuaugacgcgccagggcuccauagcccccuuucccacccuucucugcagucgagcuuguccaaccccaaucuacaggccucacugaguucuccacaaccucagcuccagggaagccacucccaucccucacugccagcaagcucucuugcucgacacguccugccgaccacguccuugggucauccuagucucagcgcccccgcucugucuuccucaaguagcucguccucuacuagcucaccaguguuaggcgcccccaguuacccugcauccacaccaggggccucuccccaccaucgcagaguaccucugagcccgcuaucccuccuggcuggaccagcggacgcaaggcggucacaacagcagcuucccaaacaguuuagcccuaccaugaguccaacuuugucuuccauuacacaaggcguuccccuggauaccagcaagcucucgacggaccagcgccugccuccguaccccuauucaucuccaagucuugugcugccuacccagccccacacaccaaaauccuugcagcaaccuggucuccccagccagucuuguagcguccaguccucagggggccagccaccgggaagacaaagucacuacggcacuccuuaucccccagggcccagcggacauggucagcagucuuaccacaggccuauguccgauuucaaccugggcaacuuagaacaguuuucaauggagaguccaagcgccucccuggugcuagaucccccuggguucucugaaggaccgggcuuucucgguggggagggcccaaugggaggcccccaagacccucauaccuucaaucaccagaaccugacacacugcucgcgucaugggagcggacccaauaucauucuuacuggugacucauccccaggcuuuaguaaggagaucgcugccgcauuggccggggugccuggauucgaagucucugcugccggccuggagcucggucugggguuagaagaugagcugcggauggaaccccuuggcuuggagggacucaacaugcugagcgacccaugugcacuacugccugauccggcgguugaggaauccuuccgaucagacagacuccaguga

SEQ ID NO: 8183 - RNA, 2082 nt, Artificial Sequence
  derived and/or modified sequence opt4 from CRTC2__Homo_sapiens__CCDS30875.1
auggccaccagcggcgccaacggccccggcagcgccaccgccagcgccagcaaccccagaaaguucagcgagaagaucgcccugcagaagcagagacaggccgaggagaccgccgccuucgaggaggugaugauggacaucggcagcaccagacugcaggcccagaagcugagacuggccuacaccagaagcagccacuacggcggcagccugcccaacgugaaccagaucggcagcggccuggccgaguuccagagcccccugcacagcccccuggacagcagcagaagcaccagacaccacggccugguggagagagugcagagagaccccagaagaauggugagcccccugagaagauacaccagacacaucgacagcagccccuacagccccgccuaccugagccccccccccgagagcagcuggagaagaaccauggccuggggcaacuuccccgccgagaagggccagcuguucagacugcccagcgcccugaacagaaccagcagcgacagcgcccugcacaccagcgugaugaaccccagcccccaggacaccuaccccggccccaccccccccagcauccugcccagcagaagaggcggcauccuggacggcgagauggaccccaaggugcccgccaucgaggagaaccugcuggacgacaagcaccugcugaagcccugggacgccaagaagcugagcagcagcagcagcagacccagaagcugcgaggugcccggcaucaacaucuuccccagccccgaccagcccgccaacgugcccgugcugccccccgccaugaacaccggcggcagccugcccgaccugaccaaccugcacuucccccccccccugcccaccccccuggaccccgaggagaccgccuaccccagccugagcggcggcaacagcaccagcaaccugacccacaccaugacccaccugggcaucagcagaggcaugggccugggccccggcuacgacgcccccggccugcacagcccccugagccaccccagccugcagagcagccugagcaaccccaaccugcaggccagccugagcagcccccagccccagcugcagggcagccacagccaccccagccugcccgccagcagccuggccagacacgugcugcccaccaccagccugggccaccccagccugagcgcccccgcccugagcagcagcagcagcagcagcagcaccagcagccccgugcugggcgcccccagcuaccccgccagcacccccggcgccagcccccaccacagaagagugccccugagcccccugagccugcuggccggccccgccgacgccagaagaagccagcagcagcugcccaagcaguucagccccaccaugagccccacccugagcagcaucacccagggcgugccccuggacaccagcaagcugagcaccgaccagagacugccccccuaccccuacagcagccccagccuggugcugcccacccagccccacacccccaagagccugcagcagcccggccugcccagccagagcugcagcgugcagagcagcggcggccagccccccggcagacagagccacuacggcacccccuacccccccggccccagcggccacggccagcagagcuaccacagacccaugagcgacuucaaccugggcaaccuggagcaguucagcauggagagccccagcgccagccuggugcuggacccccccggcuucagcgagggccccggcuuccugggcggcgagggccccaugggcggcccccaggacccccacaccuucaaccaccagaaccugacccacugcagcagacacggcagcggccccaacaucauccugaccggcgacagcagccccggcuucagcaaggagaucgccgccgcccuggccggcgugcccggcuucgaggugagcgccgccggccuggagcugggccugggccuggaggacgagcugagaauggagccccugggccuggagggccugaacaugcugagcgaccccugcgcccugcugcccgaccccgccguggaggagagcuucagaagcgacagacugcaguga

SEQ ID NO: 8184 - RNA, 2082 nt, Artificial Sequence
  derived and/or modified sequence opt5 from CRTC2__Homo_sapiens__CCDS30875.1
auggccaccagcggcgcuaacgggcccggauccgccacagcgucugcuagcaauccuagaaaguucuccgagaaaaucgcccugcagaagcaacggcaggccgaagagacggcugccuuugaagaggugaugauggacauuggcucuacccgccuccaggcucagaaacugagacuugccuacacacggagcucccacuaugggggaucucugccgaacgucaaucaaaucggcagcgggcucgcggaguuccagagcccccugcauuccccucuugauucuucccgcagcaccagacaccauggacugguugaacgggugcagcgcgaccccagacggauggugucuccucuccgcagauacacacggcacauugauuccagccccuauucuccugccuaccuguccccgcccccugagagcuccuggcgcagaaccauggcuuggggcaacuuucccgccgaaaagggccagcuguuccggcucccuucugcucugaaucgcacaagcuccgacagcgcccuucauaccucugucaugaaccccuccccgcaagauacguauccugggcccaccccucccagcauccugcccucuagacggggaggcauucucgacggggagauggauccuaaagugccggcgaucgaagagaaucugcuugacgauaagcaucugcucaagcccugggacgccaaaaagcugagcuccucuagcuccagaccucgcagcugcgagguucccggaaucaacauuuuuccuucucccgaucagccggcuaaugugccuguccugcccccugccaugaacacaggcgggucccuccccgaccugaccaaucuucacuucccucccccgcugccuacaccccucgaucccgaagagaccgcuuacccuagccugucuggaggcaacuccacgagcaaucuuacacacaccaugacacaccugggcaucucccgggggaugggacucggcccgggguaugacgcccccggacugcauucuccucugagccaccccucccuccagucuagccuguccaacccuaaucuucaggccagccugucuagcccccaaccucagcuccagggcucccacucucaucccucccugccggcuagcucucuugcgagacacgugcugccuaccaccagccucgggcaucccucccugagcgccccugcucugucuuccagcuccucuagcuccucuacaagcucccccguucucggagccccgucuuacccugccagcacgcccggcgcuuccccucaccaucgccgggugccccugagcccccuuucucugcucgccggcccugcggacgcuagacgcucccaacagcagcugccgaaacaguuuagccccaccaugucuccuacacuguccagcauuacccaaggggucccccuugauacaucuaagcucuccaccgaccagcggcugccucccuacccuuauagcuccccgagccuggugcuccccacgcagccucacacacccaaaucucugcagcaaccuggacuucccagccaguccuguucugugcagagcuccggcgggcagccgccuggaagacaaucucacuacggcacccccuaucccccugggcccagcggccauggacagcaguccuaccaccgcccuaugucugauuucaaccugggcaaccucgaacaguuuagcauggaguccccgagcgccucucugguccuggaucccccuggguucuccgaaggacccggcuuucuugggggagagggcccuaugggcgggccccaagacccgcauaccuucaaucaccagaaccucacacacugcagccggcauggaucuggcccuaauaucauucugaccggggacuccagccccggauuuuccaaggagaucgccgcugcccuggcuggcguuccuggguucgaagugucugccgcgggacucgagcugggccuugggcuggaagaugagcucagaauggaaccccugggccuggagggacuuaacaugcucagcgacccuugugcccugcugcccgauccggcuguggaggaauccuuccgcagcgaccggcuccaguga

SEQ ID NO: 8185 - protein, 358 aa, Artificial Sequence
  DJB11__Homo_sapiens__Q9UBS4
MAPQNLSTFCLLLLYLIGAVIAGRDFYKILGVPRSASIKDIKKAYRKLALQLHPDRNPDDPQAQEKFQDLGAAYEVLSDSEKRKQYDTYGEEGLKDGHQSSHGDIFSHFFGDFGFMFGGTPRQQDRNIPRGSDIIVDLEVTLEEVYAGNFVEVVRNKPVARQAPGKRKCNCRQEMRTTQLGPGRFQMTQEVVCDECPNVKLVNEERTLEVEIEPGVRDGMEYPFIGEGEPHVDGEPGDLRFRIKVVKHPIFERRGDDLYTNVTISLVESLVGFEMDITHLDGHKVHISRDKITRPGAKLWKKGEGLPNFDNNNIKGSLIITFDVDFPKEQLTEEAREGIKQLLKQGSVQKVYNGLQGY

SEQ ID NO: 8186 - RNA, 1077 nt, Artificial Sequence
  DJB11__Homo_sapiens__AAF61711
auggcuccgcagaaccugagcaccuuuugccuguugcugcuauaccucaucggggcggugauugccggacgagauuucuauaagaucuugggggugccucgaagugccucuauaaaggauauuaaaaaggccuauaggaaacuagcccugcagcuucaucccgaccggaacccugaugauccacaagcccaggagaaauuccaggaucugggugcugcuuaugagguucugucagauagugagaaacggaaacaguacgauacuuauggugaagaaggauuaaaagauggucaucagagcucccauggagacauuuuuucacacuucuuuggggauuuugguuucauguuuggaggaaccccucgucagcaagacagaaauauuccaagaggaagugauauuauuguagaucuagaagucacuuuggaagaaguauaugcaggaaauuuuguggaaguaguuagaaacaaaccuguggcaaggcaggcuccuggcaaacggaagugcaauugucggcaagagaugcggaccacccagcugggcccugggcgcuuccaaaugacccaggagguggucugcgacgaaugcccuaaugucaaacuagugaaugaagaacgaacgcuggaaguagaaauagagccuggggugagagacggcauggaguaccccuuuauuggagaaggugagccucacguggauggggagccuggagauuuacgguuccgaaucaaaguugucaagcacccaauauuugaaaggagaggagaugauuuguacacaaaugugacaaucucauuaguugagucacugguuggcuuugagauggauauuacucacuuggauggucacaagguacauauuucccgggauaagaucaccaggccaggagcgaagcuauggaagaaaggggaagggcuccccaacuuugacaacaacaauaucaagggcucuuugauaaucacuuuugauguggauuuuccaaaagaacaguuaacagaggaagcgagagaagguaucaaacagcuacugaaacaagggucagugcagaagguauacaauggacugcaaggauauuga

SEQ ID NO: 8187 - RNA, 1077 nt, Artificial Sequence
  derived and/or modified sequence opt1 from DJB11__Homo_sapiens__AAF61711
auggcgccccagaaccugagcaccuucugccuccugcugcucuaccugaucggcgccgugaucgccgggcgcgacuucuacaagauccugggcgucccgcgguccgccagcaucaaggacaucaagaaggccuaccgcaagcucgcccugcagcugcaccccgaccggaaccccgacgacccccaggcccaggagaaguuccaggaccucggggcggccuacgaggugcuguccgacagcgagaagcgcaagcaguacgacaccuacggcgaggaggggcugaaggacggccaccaguccagccacggcgacaucuucucccacuucuucggggacuucggcuucauguucgggggcacgccgcggcagcaggaccgcaacaucccccgggggagcgacaucaucguggaccucgaggucacccuggaggagguguacgccggcaacuucguggaggucgugcgcaacaagcccguggcccggcaggcgcccggcaagcgcaagugcaacugccggcaggagaugcgcaccacccagcuggggccgggccgguuccagaugacgcaggaggucgugugcgacgagugccccaacgugaagcucgucaacgaggagcgcacccuggagguggagaucgagcccggggugcgggacggcauggaguaccccuucaucggcgagggggagccgcacgucgacggcgagcccggggaccugcgcuuccggaucaagguggugaagcaccccaucuucgagcgccggggcgacgaccucuacaccaacgucaccaucucccugguggagagccuggugggguucgagauggacaucacgcaccucgacggccacaagguccacaucucccgcgacaagaucacccggcccggcgccaagcuguggaagaagggggagggccugccgaacuucgacaacaacaacaucaaggggagccucaucaucaccuucgacguggacuuccccaaggagcagcugaccgaggaggcccgcgagggcaucaagcagcugcucaagcagggguccgugcagaaggucuacaacggccugcagggcuacuga

SEQ ID NO: 8188 - RNA, 1077 nt, Artificial Sequence
  derived and/or modified sequence opt2 from DJB11__Homo_sapiens__AAF61711
auggccccccagaaccucuccaccuucugccuccuccuccucuaccucaucggcgccgucaucgccggccgcgacuucuacaagauccucggcgucccccgcuccgccuccaucaaggacaucaagaaggccuaccgcaagcucgcccuccagcuccaccccgaccgcaaccccgacgacccccaggcccaggagaaguuccaggaccucggcgccgccuacgagguccucuccgacuccgagaagcgcaagcaguacgacaccuacggcgaggagggccucaaggacggccaccaguccucccacggcgacaucuucucccacuucuucggcgacuucggcuucauguucggcggcaccccccgccagcaggaccgcaacaucccccgcggcuccgacaucaucgucgaccucgaggucacccucgaggaggucuacgccggcaacuucgucgaggucguccgcaacaagcccgucgcccgccaggcccccggcaagcgcaagugcaacugccgccaggagaugcgcaccacccagcucggccccggccgcuuccagaugacccaggaggucgucugcgacgagugccccaacgucaagcucgucaacgaggagcgcacccucgaggucgagaucgagcccggcguccgcgacggcauggaguaccccuucaucggcgagggcgagccccacgucgacggcgagcccggcgaccuccgcuuccgcaucaaggucgucaagcaccccaucuucgagcgccgcggcgacgaccucuacaccaacgucaccaucucccucgucgagucccucgucggcuucgagauggacaucacccaccucgacggccacaagguccacaucucccgcgacaagaucacccgccccggcgccaagcucuggaagaagggcgagggccuccccaacuucgacaacaacaacaucaagggcucccucaucaucaccuucgacgucgacuuccccaaggagcagcucaccgaggaggcccgcgagggcaucaagcagcuccucaagcagggcuccguccagaaggucuacaacggccuccagggcuacuga

SEQ ID NO: 8189 - RNA, 1077 nt, Artificial Sequence
  derived and/or modified sequence opt3 from DJB11__Homo_sapiens__AAF61711
auggcuccccagaaccugagcaccuucugccuccuucuguuguacuuaaucggcgccgugauugcagggagagacuuuuauaagauacugggagucccuagguccgccucuaucaaagauauuaagaaagcguaccggaagcuagcucuccaacugcacccagaccgcaauccggaugacccccaggcccaggagaaauuccaggaucuuggugcagccuaugaaguucugucagacagugagaagcgaaagcaauacgauacauauggcgaagagggguugaaagacggacaucagagcucccacggcgauaucuuuucucauuucuuuggugacuucggguuuauguucggaggcacuccucgucagcaggauagaaacauuccaaggggcucggacaucauaguggaucucgaaguaacgcuggaggagguguacgcugggaauuuugucgaagugguucggaacaagcccguggcacgccaagccccuggaaaaagaaaguguaauugcaggcaggagaugcggaccacacagcuggguccaggccgcuuccagaugacucaagaagucgugugugacgagugccccaacguaaaacucguuaaugaggaacgaaccuuagagguggaaaucgagccuggggucagagacggaauggaauauccauuuauuggcgagggugagccgcacguggauggggaacccggagaccugagguuccggaucaagguggucaagcauccuauuuuugagcgucgcggcgaugaccuuuacacaaacguuaccaucucauugguggaaagccugguaggcuucgagauggauauaacucaccuagacgggcacaaagugcauauuaguagagauaagaucacaaggccaggagcuaaacucuggaagaaaggugaaggccugcccaauuucgacaacaauaacauuaaggggucccuuaucaucaccuuugaugucgacuucccuaaagagcagcugacggaggaagcccgggagggaauuaagcaguugcucaagcaaggcucugugcagaaaguuuacaauggucugcagggguauuga

SEQ ID NO: 8190 - RNA, 1077 nt, Artificial Sequence
  derived and/or modified sequence opt4 from DJB11__Homo_sapiens__AAF61711
auggccccccagaaccugagcaccuucugccugcugcugcuguaccugaucggcgccgugaucgccggcagagacuucuacaagauccugggcgugcccagaagcgccagcaucaaggacaucaagaaggccuacagaaagcuggcccugcagcugcaccccgacagaaaccccgacgacccccaggcccaggagaaguuccaggaccugggcgccgccuacgaggugcugagcgacagcgagaagagaaagcaguacgacaccuacggcgaggagggccugaaggacggccaccagagcagccacggcgacaucuucagccacuucuucggcgacuucggcuucauguucggcggcacccccagacagcaggacagaaacauccccagaggcagcgacaucaucguggaccuggaggugacccuggaggagguguacgccggcaacuucguggagguggugagaaacaagcccguggccagacaggcccccggcaagagaaagugcaacugcagacaggagaugagaaccacccagcugggccccggcagauuccagaugacccaggagguggugugcgacgagugccccaacgugaagcuggugaacgaggagagaacccuggagguggagaucgagcccggcgugagagacggcauggaguaccccuucaucggcgagggcgagccccacguggacggcgagcccggcgaccugagauucagaaucaagguggugaagcaccccaucuucgagagaagaggcgacgaccuguacaccaacgugaccaucagccugguggagagccuggugggcuucgagauggacaucacccaccuggacggccacaaggugcacaucagcagagacaagaucaccagacccggcgccaagcuguggaagaagggcgagggccugcccaacuucgacaacaacaacaucaagggcagccugaucaucaccuucgacguggacuuccccaaggagcagcugaccgaggaggccagagagggcaucaagcagcugcugaagcagggcagcgugcagaagguguacaacggccugcagggcuacuga

SEQ ID NO: 8191 - RNA, 1077 nt, Artificial Sequence
  derived and/or modified sequence opt5 from DJB11__Homo_sapiens__AAF61711
auggcuccccagaaccugagcaccuucugccuccugcuucuguaccucaucggcgccgugauugccgggagagacuuuuauaagauccugggagucccucgguccgcgucuauuaaagauaucaagaaggcuuaccgcaaacuugcccugcaacuccacccggacagaaaucccgaugacccucaggcccaggagaaauuccaggaucugggcgcugccuaugaaguucugagcgacuccgagaagcggaagcaauacgauacauauggggaagagggacucaaagacggccaucagucuagccacggggauaucuuuucccauuucuuuggagacuucggcuuuauguucggcgggacgccccgccagcaggauagaaacauuccucggggaucugacaucauuguggaucuggaagugacccuugaggaggucuacgcuggcaauuuuguggaaguugugcgcaacaagcccgucgccagacaagcgccugggaaacggaaguguaauugccgccaggagaugagaacaacccagcugggaccgggccgguuccagaugacacaagaagugguuugugacgagugccccaacgugaaacucgucaaugaggaacgcacccuggagguggaaaucgagccuggggugagagacggaauggaauaucccuuuauuggcgagggcgagccucacgucgauggggaacccggagaccuucgguuccgcaucaagguugugaagcauccgauuuuugagagacggggcgaugaccuguacacaaacgugaccaucagccucgucgaaucccuggugggguucgagauggauauuacgcaccuggacggacacaaaguucauaucagcagagauaagaucacccgcccuggcgccaaacucuggaagaaaggggaaggacugcccaauuucgacaacaauaacauuaagggcucucuuaucauuacauuugauguggacuucccuaaagagcagcugaccgaggaagcucgggagggcaucaagcagcuccugaagcaaggguccguccagaaaguguacaauggacuucagggcuauuga

SEQ ID NO: 8192 - protein, 316 aa, Artificial Sequence
  DJB13__Homo_sapiens__P59910
MGQDYYSVLGITRNSEDAQIKQAYRRLALKHHPLKSNEPSSAEIFRQIAEAYDVLSDPMKRGIYDKFGEEGLKGGIPLEFGSQTPWTTGYVFHGKPEKVFHEFFGGNNPFSEFFDAEGSEVDLNFGGLQGRGVKKQDPQVERDLYLSLEDLFFGCTKKIKISRRVLNEDGYSSTIKDKILTIDVKPGWRQGTRITFEKEGDQGPNIIPADIIFIVKEKLHPRFRRENDNLFFVNPIPLGKALTCCTVEVRTLDDRLLNIPINDIIHPKYFKKVPGEGMPLPEDPTKKGDLFIFFDIQFPTRLTPQKKQMLRQALLT

SEQ ID NO: 8193 - RNA, 951 nt, Artificial Sequence
  DJB13__Homo_sapiens__AAN15929
augggccaggauuauuacucugugcucgggaucacucgcaauucagaggaugcccagaucaagcaggcguaccgcagacucgcccuuaagcaccacccguugaagucaaaugagccgucuucagcagagauuuucaggcaaauagcagaggccuacgacgugcugagugaccccaugaagagaggcaucuacgacaaguuuggagaagagggccugaagggugggauuccuuuggaguuuggaucccagaccccauggacaacugguuacgucuuccacggcaaaccugaaaagguguuccacgaguucuuugguggaaacaaccccuucagugaguuuuuugaugcagaaggaagugagguagauuugaacuuuggggggcuccagggccgaggggucaagaagcaggacccccaagucgaacgggaucucuaccugucccuggaggacuuauucuuuggcugcaccaaaaaaauuaagaucuccagaagggugcugaacgaggauggguacuccuccaccaucaaggacaagauccugaccauugaugugaagcccgguuggaggcagggcacacgcaucaccuuugagaaggaaggggaccagggccccaacaucaucccagcagacaucauuuucaucguaaaggagaagcuacacccucgcuuccgcagggagaaugacaaccucuucuucgugaaccccaucccucuuggcaaggcucucaccugcugcacuguggaggugaggacccuagaugaccgucugcucaacauccccaucaaugacaucauccaccccaaauacuucaagaaggugccaggggaggggaugccauugccggaggaccccacuaagaaaggggaucucuucaucuucuucgacauccaguuccccacccgccucacaccccagaagaagcagaugcugcgccaggcauugcugacauga

SEQ ID NO: 8194 - RNA, 951 nt, Artificial Sequence
  derived and/or modified sequence opt1 from DJB13__Homo_sapiens__AAN15929
augggccaggacuacuacagcgugcuggggaucacccgcaacuccgaggacgcccagaucaagcaggccuaccggcgccucgcgcugaagcaccacccccucaagagcaacgagccguccagcgccgagaucuuccggcagaucgccgaggccuacgacguccuguccgaccccaugaagcgcggcaucuacgacaaguucggggaggagggccugaagggcgggaucccccuggaguucggcagccagacccccuggacgaccggguacguguuccacggcaagccggagaagguguuccacgaguucuucgggggcaacaaccccuucuccgaguucuucgacgccgaggggagcgaggucgaccucaacuucggcggccugcaggggcggggcgugaagaagcaggacccccagguggagcgcgaccuguaccucucccuggaggaccuguucuucgggugcaccaagaagaucaagaucagccggcgcguccucaacgaggacggcuacuccagcaccaucaaggacaagauccugacgaucgacgugaagcccggcuggcggcaggggacccgcaucaccuucgagaaggagggcgaccaggggccgaacaucauccccgcggacaucaucuucaucgugaaggagaagcugcacccccgguuccgccgggagaacgacaaccucuucuucgucaaccccaucccgcugggcaaggcccugaccugcugcacgguggaggugcgcacccucgacgaccggcugcugaacauccccaucaacgacaucauccaccccaaguacuucaagaagguccccggggagggcaugccgcuccccgaggaccccaccaagaagggcgaccuguucaucuucuucgacauccaguuccccacccgccugacgccgcagaagaagcagaugcuccggcaggcccugcugaccuga

SEQ ID NO: 8195 - RNA, 951 nt, Artificial Sequence
  derived and/or modified sequence opt2 from DJB13__Homo_sapiens__AAN15929
augggccaggacuacuacuccguccucggcaucacccgcaacuccgaggacgcccagaucaagcaggccuaccgccgccucgcccucaagcaccacccccucaaguccaacgagcccuccuccgccgagaucuuccgccagaucgccgaggccuacgacguccucuccgaccccaugaagcgcggcaucuacgacaaguucggcgaggagggccucaagggcggcaucccccucgaguucggcucccagacccccuggaccaccggcuacgucuuccacggcaagcccgagaaggucuuccacgaguucuucggcggcaacaaccccuucuccgaguucuucgacgccgagggcuccgaggucgaccucaacuucggcggccuccagggccgcggcgucaagaagcaggacccccaggucgagcgcgaccucuaccucucccucgaggaccucuucuucggcugcaccaagaagaucaagaucucccgccgcguccucaacgaggacggcuacuccuccaccaucaaggacaagauccucaccaucgacgucaagcccggcuggcgccagggcacccgcaucaccuucgagaaggagggcgaccagggccccaacaucauccccgccgacaucaucuucaucgucaaggagaagcuccacccccgcuuccgccgcgagaacgacaaccucuucuucgucaaccccaucccccucggcaaggcccucaccugcugcaccgucgagguccgcacccucgacgaccgccuccucaacauccccaucaacgacaucauccaccccaaguacuucaagaagguccccggcgagggcaugccccuccccgaggaccccaccaagaagggcgaccucuucaucuucuucgacauccaguuccccacccgccucaccccccagaagaagcagaugcuccgccaggcccuccucaccuga

SEQ ID NO: 8196 - RNA, 951 nt, Artificial Sequence
  derived and/or modified sequence opt3 from DJB13__Homo_sapiens__AAN15929
augggccaggacuacuauagcgugcuggggaucaccagaaacuccgaggaugcccaaauuaagcaggcuuacaggcggcucgcacuuaaacaccauccccugaagucuaaugaaccuucaagugccgagauauuccgccagaucgcggaggcuuaugacgucuugagcgauccaaugaaacgaggaauuuacgacaaguuuggugaagaaggcuuaaaagggggaaucccgcuggaguucggcucccagacacccuggacuacggguuauguuuuucacgggaagccugagaagguguuccaugaauuuuucggaggcaacaauccauuuucugaguucuuugaugccgaaggcucggagguagaccuaaacuucgggggacuccaaggucguggcgugaaaaagcaggauccccaggucgagagagaccuguaccuuucacuggaagauuuguuuuucgggugcaccaaaaagauuaaaaucagcaggcgggugcucaaugaggacggauauaguuccacaauaaaggauaagauccugacuauugacguuaaaccuggcuggcgccaggguaccagaaucacauuugaaaaggagggggaucaaggaccaaacauuauccccgcagacauaauuuucaucgugaaagaaaagcugcacccuagguuccggcgcgagaaugacaaccucuuuuucgucaauccaauuccguuaggcaaagcccugaccuguugcacuguggagguacgaacacuugaugacagauugcugaacauccccaucaaugauauuauacauccuaaguacuuuaaaaagguuccaggcgaagggaugccccuaccugaggacccaaccaagaaaggagaucucuucaucuuuuucgacauucaguuucccacgaggcugacuccgcagaagaaacagaugcuucggcaagcucuguugaccuga

SEQ ID NO: 8197 - RNA, 951 nt, Artificial Sequence
  derived and/or modified sequence opt4 from DJB13__Homo_sapiens__AAN15929
augggccaggacuacuacagcgugcugggcaucaccagaaacagcgaggacgcccagaucaagcaggccuacagaagacuggcccugaagcaccacccccugaagagcaacgagcccagcagcgccgagaucuucagacagaucgccgaggccuacgacgugcugagcgaccccaugaagagaggcaucuacgacaaguucggcgaggagggccugaagggcggcaucccccuggaguucggcagccagacccccuggaccaccggcuacguguuccacggcaagcccgagaagguguuccacgaguucuucggcggcaacaaccccuucagcgaguucuucgacgccgagggcagcgagguggaccugaacuucggcggccugcagggcagaggcgugaagaagcaggacccccagguggagagagaccuguaccugagccuggaggaccuguucuucggcugcaccaagaagaucaagaucagcagaagagugcugaacgaggacggcuacagcagcaccaucaaggacaagauccugaccaucgacgugaagcccggcuggagacagggcaccagaaucaccuucgagaaggagggcgaccagggccccaacaucauccccgccgacaucaucuucaucgugaaggagaagcugcaccccagauucagaagagagaacgacaaccuguucuucgugaaccccaucccccugggcaaggcccugaccugcugcaccguggaggugagaacccuggacgacagacugcugaacauccccaucaacgacaucauccaccccaaguacuucaagaaggugcccggcgagggcaugccccugcccgaggaccccaccaagaagggcgaccuguucaucuucuucgacauccaguuccccaccagacugaccccccagaagaagcagaugcugagacaggcccugcugaccuga

SEQ ID NO: 8198 - RNA, 951 nt, Artificial Sequence
  derived and/or modified sequence opt5 from DJB13__Homo_sapiens__AAN15929
augggccaggacuacuauagcgugcuggggaucaccagaaacuccgaggaugcccaaauuaagcaggcuuaccggcgccucgcccugaaacaccauccccuuaagucuaaugaaccuagcuccgcggagaucuucagacagauugcugaagccuaugacguccugucugauccgaugaaacggggaaucuacgacaaguuuggcgaggaagggcucaaaggaggcauuccccuggaguucgggagccagacaccuuggacgaccggauauguuuuucacggcaagcccgagaagguguuccaugaauuuuucggcgggaacaauccuuuuuccgaguucuuugaugccgaaggaucugagguggaccuuaacuucggcgggcugcaaggacgcggcgucaaaaagcaggauccccagguggagagagaccucuaccugagccuggaagaucucuuuuucgggugcaccaaaaagaucaaaaucucccggcgcguucugaaugaggacggauauagcucuacaauuaaggauaagauccuuacaauugacgugaaaccuggcuggagacagggcacccggaucacauuugaaaaggagggggaucaaggaccgaacauuauccccgcugacauuaucuucaucgucaaagaaaagcugcacccucgcuucagacgggagaaugacaaccucuuuuucgugaaucccauuccucugggcaaagcccuuaccuguugcacgguugaggugcgcacccuggaugacagacuccugaacauccccauuaaugauaucauucauccgaaguacuuuaaaaaggucccuggggaaggaaugccccugccugaggaccccacaaagaaaggcgaucucuucaucuuuuucgacauccaguuucccacccggcugacaccucagaagaaacagaugcuucgccaagcucugcucaccuga

SEQ ID NO: 8199 - protein, 379 aa, Artificial Sequence
  DJB14__Homo_sapiens__Q8TBM8
MEGNRDEAEKCVEIAREALNAGNREKAQRFLQKAEKLYPLPSARALLEIIMKNGSTAGNSPHCRKPSGSGDQSKPNCTKDSTSGSGEGGKGYTKDQVDGVLSINKCKNYYEVLGVTKDAGDEDLKKAYRKLALKFHPDKNHAPGATDAFKKIGNAYAVLSNPEKRKQYDLTGNEEQACNHQNNGRFNFHRGCEADITPEDLFNIFFGGGFPSGSVHSFSNGRAGYSQQHQHRHSGHEREEERGDGGFSVFIQLMPIIVLILVSLLSQLMVSNPPYSLYPRSGTGQTIKMQTENLGVVYYVNKDFKNEYKGMLLQKVEKSVEEDYVTNIRNNCWKERQQKTDMQYAAKVYRDDRLRRKADALSMDNCKELERLTSLYKGG

SEQ ID NO: 8200 - RNA, 1140 nt, Artificial Sequence
  DJB14__Homo_sapiens__AAH22248
auggaggggaacagggaugaggcugagaaaugugucgagaucgcccgggaggcccugaacgccggcaaccgcgagaaggcccagcgcuuccugcagaaggccgagaagcucuacccacugcccucggcccgcgcacuauuggaaauaauuaugaaaaauggaagcacggcuggaaauagcccucauugccgaaaaccaucagguaguggcgaucaaagcaagccuaauugcacaaaggacagcacaucugguaguggugaagguggaaaaggcuauaccaaagaccaaguagauggaguucucagcauaaacaaauguaaaaauuacuaugaaguacuuggaguuacgaaagaugcuggugaugaagauuugaaaaaagcuuauagaaagcuugcuuugaaguuucauccagacaaaaaccaugcaccuggagcaacagaugcuuuuaaaaagauuggaaaugcuuaugcuguuuuaaguaauccagaaaagcgaaaacaguaugaccucacgggcaaugaagaacaagcauguaaccaccaaaacaauggcagauuuaauuuccauagagguugugaagcugauauaacuccagaagacuuguuuaauauauuuuuuggggguggauuuccuucagguaguguacauucuuuuucaaauggaagagcugguuauagccaacaacaucagcaucgacauaguggacaugaaagagaagaggaaagaggagauggagguuuuucuguguuuauccagcugaugcccauaauuguauugauccucgugucauuauuaagccaguugauggucucuaauccuccuuauuccuuauaucccagaucuggaacugggcaaacuauuaaaaugcaaacagaaaacuuggguguuguuuauuaugucaacaaggacuucaaaaaugaauauaaaggaauguuauuacaaaagguagaaaagaguguggaggaagauuaugugacuaauauucgaaauaacugcuggaaagaaagacaacaaaaaacagauaugcaguaugcagcaaaaguauaccgugaugaucgacuccgaaggaaggcagaugccuugagcauggacaacuguaaagaauuagagcggcuuaccagucuuuauaaaggaggauga

SEQ ID NO: 8201 - RNA, 1140 nt, Artificial Sequence
  derived and/or modified sequence opt1 from DJB14__Homo_sapiens__AAH22248
auggagggcaaccgcgacgaggccgagaagugcguggagaucgcccgggaggcgcugaacgccgggaaccgcgagaaggcccagcgguuccuccagaaggccgagaagcuguacccccugccgagcgcccgcgcgcuccuggagaucaucaugaagaacggcuccaccgccgggaacagcccccacugccggaagcccuccggcagcggggaccaguccaagcccaacugcaccaaggacagcacguccggcagcggcgagggcgggaagggguacaccaaggaccaggucgacggcgugcuguccaucaacaagugcaagaacuacuacgaggugcucggggucaccaaggacgccggcgacgaggaccugaagaaggccuaccgcaagcuggcgcucaaguuccacccggacaagaaccacgcccccggcgccaccgacgccuucaagaagaucgggaacgccuacgcggugcugagcaaccccgagaagcggaagcaguacgaccugacgggcaacgaggagcaggccugcaaccaccagaacaacgggcgcuucaacuuccaccggggcugcgaggccgacaucacccccgaggaccucuucaacaucuucuucggcgggggcuucccguccgggagcgugcacuccuucagcaacggccgcgccggguacucccagcagcaccagcaccggcacagcggccacgagcgcgaggaggagcggggcgacgggggcuucuccgucuucauccagcugaugcccaucaucgugcugauccucgugagccugcugucccagcucauggucagcaacccgcccuacagccuguacccccgcuccgggaccggccagaccaucaagaugcagacggagaaccugggggugguguacuacgucaacaaggacuucaagaacgaguacaagggcaugcuccugcagaagguggagaaguccguggaggaggacuacgucaccaacauccggaacaacugcuggaaggagcgccagcagaagaccgacaugcaguacgccgcgaagguguaccgggacgaccgccugcggcgcaaggccgacgcccucagcauggacaacugcaaggagcuggagcggcugaccagccucuacaagggcggguga

SEQ ID NO: 8202 - RNA, 1140 nt, Artificial Sequence
  derived and/or modified sequence opt2 from DJB14__Homo_sapiens__AAH22248
auggagggcaaccgcgacgaggccgagaagugcgucgagaucgcccgcgaggcccucaacgccggcaaccgcgagaaggcccagcgcuuccuccagaaggccgagaagcucuacccccuccccuccgcccgcgcccuccucgagaucaucaugaagaacggcuccaccgccggcaacuccccccacugccgcaagcccuccggcuccggcgaccaguccaagcccaacugcaccaaggacuccaccuccggcuccggcgagggcggcaagggcuacaccaaggaccaggucgacggcguccucuccaucaacaagugcaagaacuacuacgagguccucggcgucaccaaggacgccggcgacgaggaccucaagaaggccuaccgcaagcucgcccucaaguuccaccccgacaagaaccacgcccccggcgccaccgacgccuucaagaagaucggcaacgccuacgccguccucuccaaccccgagaagcgcaagcaguacgaccucaccggcaacgaggagcaggccugcaaccaccagaacaacggccgcuucaacuuccaccgcggcugcgaggccgacaucacccccgaggaccucuucaacaucuucuucggcggcggcuuccccuccggcuccguccacuccuucuccaacggccgcgccggcuacucccagcagcaccagcaccgccacuccggccacgagcgcgaggaggagcgcggcgacggcggcuucuccgucuucauccagcucaugcccaucaucguccucauccucgucucccuccucucccagcucauggucuccaacccccccuacucccucuacccccgcuccggcaccggccagaccaucaagaugcagaccgagaaccucggcgucgucuacuacgucaacaaggacuucaagaacgaguacaagggcaugcuccuccagaaggucgagaaguccgucgaggaggacuacgucaccaacauccgcaacaacugcuggaaggagcgccagcagaagaccgacaugcaguacgccgccaaggucuaccgcgacgaccgccuccgccgcaaggccgacgcccucuccauggacaacugcaaggagcucgagcgccucaccucccucuacaagggcggcuga

SEQ ID NO: 8203 - RNA, 1140 nt, Artificial Sequence
  derived and/or modified sequence opt3 from DJB14__Homo_sapiens__AAH22248
auggagggcaacagagacgaagccgagaagugcguggaaaucgcuagggaggcacugaaugccgggaaccgggaaaaagcgcagcgcuuccuccaaaaggcugagaaacuuuacccccugccuagcgcccgagcauuguuagagauuauaaugaagaauggauccaccgccgguaacucuccacacugucguaaaccgucaggcaguggggaucagagcaagcccaauugcacaaaggacuccacuucuggaucgggcgaaggugggaaaggauauacgaaggaucaggucgacggcguucugucaaucaacaaauguaagaauuacuaugaggugcuaggcguaaccaaagaugcuggggacgaagaucucaagaaggcauacagaaaacuggcccuuaaguuucauccugacaaaaaccacgcuccaggagccacagaugcguucaagaaaauugguaaugcauaugccgugcugagcaaccccgagaagaggaaacaguacgacuugacuggcaaugaggaacaggcuugcaaccaucaaaauaacgggcgguuuaauuuccaccgcggaugugaggccgauaucaccccugaagaccucuuuaacauuuucuuuggcgguggguucccaaguggauccguccauucuuuuagcaacggcagagcaggcuauucccagcagcaccaacacaggcauucagggcacgagcgggaagaggagcgcggagaugguggcuucaguguguuuauccagcugaugcccauaaucguucugauucucgugagcuuacugucucagcuuauggucuccaauccuccauacucauuguacccgcgaagcgggacaggacagaccaucaagaugcaaacugaaaaccugggcgugguauauuacguuaauaaggacuucaaaaacgaguauaaggguaugcuacuccagaaaguggaaaagagugucgaggaagacuacgugacaaauauuagaaacaauugcuggaaagagaggcagcaaaagaccgauaugcaguaugcugccaagguguaccgggacgaucgucugcgcagaaaagcggacgcccuuucuauggauaacuguaaggagcuggaaagguugacgucccucuauaaagggggcuga

SEQ ID NO: 8204 - RNA, 1140 nt, Artificial Sequence
  derived and/or modified sequence opt4 from DJB14__Homo_sapiens__AAH22248
auggagggcaacagagacgaggccgagaagugcguggagaucgccagagaggcccugaacgccggcaacagagagaaggcccagagauuccugcagaaggccgagaagcuguacccccugcccagcgccagagcccugcuggagaucaucaugaagaacggcagcaccgccggcaacagcccccacugcagaaagcccagcggcagcggcgaccagagcaagcccaacugcaccaaggacagcaccagcggcagcggcgagggcggcaagggcuacaccaaggaccagguggacggcgugcugagcaucaacaagugcaagaacuacuacgaggugcugggcgugaccaaggacgccggcgacgaggaccugaagaaggccuacagaaagcuggcccugaaguuccaccccgacaagaaccacgcccccggcgccaccgacgccuucaagaagaucggcaacgccuacgccgugcugagcaaccccgagaagagaaagcaguacgaccugaccggcaacgaggagcaggccugcaaccaccagaacaacggcagauucaacuuccacagaggcugcgaggccgacaucacccccgaggaccuguucaacaucuucuucggcggcggcuuccccagcggcagcgugcacagcuucagcaacggcagagccggcuacagccagcagcaccagcacagacacagcggccacgagagagaggaggagagaggcgacggcggcuucagcguguucauccagcugaugcccaucaucgugcugauccuggugagccugcugagccagcugauggugagcaacccccccuacagccuguaccccagaagcggcaccggccagaccaucaagaugcagaccgagaaccugggcgugguguacuacgugaacaaggacuucaagaacgaguacaagggcaugcugcugcagaagguggagaagagcguggaggaggacuacgugaccaacaucagaaacaacugcuggaaggagagacagcagaagaccgacaugcaguacgccgccaagguguacagagacgacagacugagaagaaaggccgacgcccugagcauggacaacugcaaggagcuggagagacugaccagccuguacaagggcggcuga

SEQ ID NO: 8205 - RNA, 1140 nt, Artificial Sequence
  derived and/or modified sequence opt5 from DJB14__Homo_sapiens__AAH22248
auggagggcaacagagacgaagccgagaagugcguggaaaucgcucgggaggcccugaaugcggggaaccgcgaaaaagcucagagauuccuccaaaaggccgagaaacuguacccccuuccuagcgcccgggcucugcucgagauuaucaugaagaauggauccaccgccggcaacucuccgcacugucgcaaacccagcggguccggagaucagucuaagccuaauugcacaaaggacagcacguccggcucuggggaaggaggcaaaggcuauaccaaggaucaggucgacgggguucugagcauuaacaaauguaagaauuacuaugaggugcuuggagugacaaaagaugcuggcgacgaagaucugaagaaggccuacagaaaacucgcgcugaaguuucaucccgacaaaaaccacgccccuggggcuaccgaugccuucaagaaaaucggaaaugcuuaugccguccuguccaaccccgagaagcggaaacaguacgaccucacaggcaaugaggaacaagcgugcaaccaucagaauaacgggcgcuuuaauuuccacagaggaugugaggccgauauuaccccugaagaccuguuuaacaucuucuuuggcggcggguucccgagcggaucugugcauuccuuuagcaacggccgggcuggguauucucagcagcaccaacaccgccauuccggacacgagagagaagaggagcggggcgaugggggauucagcguuuuuauccagcuuaugcccauuaucgugcugauucucgucucucugcuuucccagcugauggugagcaauccucccuacucccucuacccucgcucuggcacaggccagaccaucaagaugcaaacggaaaaccuggggguuguguauuacgucaauaaggacuucaaaaacgaguauaagggaaugcugcuccagaaaguggaaaagagcguggaggaagacuacgucaccaauauuagaaacaauugcuggaaagagcggcagcaaaagacagauaugcaguaugccgcuaagguuuaccgcgacgauagacugcggagaaaagccgacgcccuuuccauggauaacuguaaggagcuggaacgccucaccagccuguauaaaggcggguga

SEQ ID NO: 8206 - protein, 793 aa, Artificial Sequence
  DJC10__Homo_sapiens__Q8IXB1
MGVWLNKDDYIRDLKRIILCFLIVYMAILVGTDQDFYSLLGVSKTASSREIRQAFKKLALKLHPDKNPNNPNAHGDFLKINRAYEVLKDEDLRKKYDKYGEKGLEDNQGGQYESWNYYRYDFGIYDDDPEIITLERREFDAAVNSGELWFVNFYSPGCSHCHDLAPTWRDFAKEVDGLLRIGAVNCGDDRMLCRMKGVNSYPSLFIFRSGMAPVKYHGDRSKESLVSFAMQHVRSTVTELWTGNFVNSIQTAFAAGIGWLITFCSKGGDCLTSQTRLRLSGMLDGLVNVGWMDCATQDNLCKSLDITTSTTAYFPPGATLNNKEKNSILFLNSLDAKEIYLEVIHNLPDFELLSANTLEDRLAHHRWLLFFHFGKNENSNDPELKKLKTLLKNDHIQVGRFDCSSAPDICSNLYVFQPSLAVFKGQGTKEYEIHHGKKILYDILAFAKESVNSHVTTLGPQNFPANDKEPWLVDFFAPWCPPCRALLPELRRASNLLYGQLKFGTLDCTVHEGLCNMYNIQAYPTTVVFNQSNIHEYEGHHSAEQILEFIEDLMNPSVVSLTPTTFNELVTQRKHNEVWMVDFYSPWCHPCQVLMPEWKRMARTLTGLINVGSIDCQQYHSFCAQENVQRYPEIRFFPPKSNKAYHYHSYNGWNRDAYSLRIWGLGFLPQVSTDLTPQTFSEKVLQGKNHWVIDFYAPWCGPCQNFAPEFELLARMIKGKVKAGKVDCQAYAQTCQKAGIRAYPTVKFYFYERAKRNFQEEQINTRDAKAIAALISEKLETLRNQGKRNKDEL

SEQ ID NO: 8207 - RNA, 2382 nt, Artificial Sequence
  DJC10__Homo_sapiens__BAB55263
augggagucugguuaaauaaagaugacuauaucagagacuugaaaaggaucauucucuguuuucugauaguguauauggccauuuuagugggcacagaucaggauuuuuacaguuuacuuggaguguccaaaacugcaagcaguagagaaauaagacaagcuuucaagaaauuggcauugaaguuacauccugauaaaaacccgaauaacccaaaugcacauggcgauuuuuuaaaaauaaauagagcauaugaaguacucaaagaugaagaucuacggaaaaaguaugacaaauauggagaaaagggacuugaggauaaucaagguggccaguaugaaagcuggaacuauuaucguuaugauuuugguauuuaugaugaugauccugaaaucauaacauuggaaagaagagaauuugaugcugcuguuaauucuggagaacugugguuuguaaauuuuuacuccccaggcuguucacacugccaugauuuagcucccacauggagagacuuugcuaaagaaguggauggguuacuucgaauuggagcuguuaacuguggugaugauagaaugcuuugccgaaugaaaggagucaacagcuaucccagccucuucauuuuucggucuggaauggccccagugaaauaucauggagacagaucaaaggagaguuuagugaguuuugcaaugcagcauguuagaaguacagugacagaacuuuggacaggaaauuuugucaacuccauacaaacugccuuugcugcugguauuggcuggcugaucacuuuuuguucaaaaggaggagauuguuugacuucacagacacgacucaggcuuaguggcauguuggauggucuuguuaauguaggauggauggacugugccacccaggauaaccuuuguaaaagcuuagauauuacaacaaguacuacugcuuauuuuccuccuggagccacuuuaaauaacaaagagaaaaacaguauuuuguuucucaacucauuggaugcuaaagaaauauauuuggaaguaauacauaaucuuccagauuuugaacuacuuucggcaaacacacuagaggaucguuuggcucaucaucgguggcuguuauuuuuucauuuuggaaaaaaugaaaauucaaaugauccugagcugaaaaaacuaaaaacucuacuuaaaaaugaucauauucaaguuggcagguuugacuguuccucugcaccagacaucuguaguaaucuguauguuuuucagccgucucuagcaguauuuaaaggacaaggaaccaaagaauaugaaauucaucauggaaagaagauucuauaugauauacuugccuuugccaaagaaagugugaauucucauguuaccacgcuuggaccucaaaauuuuccugccaaugacaaagaaccauggcuuguugauuucuuugcccccugguguccaccaugucgagcuuuacuaccagaguuacgaagagcaucaaaucuucuuuauggucagcuuaaguuugguacacuagauuguacaguucaugagggacucuguaacauguauaacauucaggcuuauccaacgacagugguauucaaccaguccaacauucaugaguaugaaggacaucacucugcugaacaaaucuuggaguucauagaggaucuuaugaauccuucaguggucucccuuacacccaccaccuucaacgaacuaguuacacaaagaaaacacaacgaagucuggaugguugauuucuauucuccguggugucauccuugccaagucuuaaugccagaauggaaaagaauggcccggacauuaacuggacugaucaacgugggcaguauagauugccaacaguaucauucuuuuugugcccaggaaaacguucaaagauacccugagauaagauuuuuucccccaaaaucaaauaaagcuuaucauuaucacaguuacaaugguuggaauagggaugcuuauucccugagaaucuggggucuaggauuuuuaccucaaguauccacagaucuaacaccucagacuuucagugaaaaaguucuacaagggaaaaaucauugggugauugauuucuaugcuccuugguguggaccuugccagaauuuugcuccagaauuugagcucuuggcuaggaugauuaaaggaaaagugaaagcuggaaaaguagacugucaggcuuaugcucagacaugccagaaagcugggaucagggccuauccaacuguuaaauuuuauuucuacgaaagagcaaagagaaauuuucaagaagagcagauaaauaccagagaugcaaaagcaaucgcugccuuaauaagugaaaaauuggaaacucuccgaaaucaaggcaagaggaauaaggaugaacuuuga

SEQ ID NO: 8208 - RNA, 2382 nt, Artificial Sequence
  derived and/or modified sequence opt1 from DJC10__Homo_sapiens__BAB55263
augggcguguggcugaacaaggacgacuacauccgcgaccucaagcggaucauccugugcuuccugaucgucuacauggccauccucguggggaccgaccaggacuucuacagccugcugggcguguccaagaccgccagcucccgcgagauccggcaggcguucaagaagcucgcccugaagcugcaccccgacaagaacccgaacaaccccaacgcccacggggacuuccucaagaucaaccgcgccuacgagguccugaaggacgaggaccugcggaagaaguacgacaaguacggcgagaaggggcucgaggacaaccagggcggccaguacgagagcuggaacuacuaccgcuacgacuucgggaucuacgacgacgaccccgagaucaucacgcuggagcggcgcgaguucgacgccgcggugaacuccggcgagcugugguucgugaacuucuacagccccgggugcucccacugccacgaccucgccccgaccuggcgggacuucgccaaggaggucgacggccugcugcgcaucggggccgugaacugcggcgacgaccggaugcucugccgcaugaagggcgugaacagcuaccccucccuguucaucuuccggagcgggauggcgcccgucaaguaccacggcgaccgcuccaaggagagccugguguccuucgccaugcagcacgugcggagcaccgucaccgagcucuggacggggaacuucgugaacuccauccagaccgccuucgccgccggcaucggcuggcugaucaccuucugcagcaagggcggggacugccugaccucccagacgcgccuccggcugagcgggaugcuggacggccucgugaacgucggguggauggacugcgcgacccaggacaaccugugcaagucccuggacaucaccaccagcacgaccgccuacuucccgccgggcgccacccucaacaacaaggagaagaacagcauccuguuccugaacucccucgacgccaaggagaucuaccuggaggugauccacaaccugcccgacuucgagcuccugagcgccaacacccuggaggaccgccucgcgcaccaccgguggcugcuguucuuccacuucggcaagaacgagaacuccaacgaccccgagcucaagaagcugaagacgcugcucaagaacgaccacauccagguggggcgcuucgacugcagcuccgcccccgacaucugcagcaaccuguacgucuuccagccgucccuggccguguucaagggccaggggaccaaggaguacgagauccaccacggcaagaagauccucuacgacauccuggccuucgccaaggagagcgugaacucccacgucaccacccuggggccccagaacuuccccgcgaacgacaaggagcccuggcugguggacuucuucgccccguggugcccgcccugccgggcccuccugcccgagcugcgccgcgccagcaaccuccuguacggccagcugaaguucggcacgcucgacugcaccgugcacgaggggcugugcaacauguacaacauccaggccuaccccaccaccgucguguucaaccaguccaacauccacgaguacgagggccaccacagcgcggagcagauccuggaguucaucgaggaccucaugaaccccuccgucgugagccugacgcccaccaccuucaacgagcuggugacccagcggaagcacaacgaggucuggaugguggacuucuacucccccuggugccacccgugccaggugcucaugcccgaguggaagcgcauggcccggacgcugaccgggcugaucaacgucggcagcaucgacugccagcaguaccacuccuucugcgcccaggagaacgugcagcgcuaccccgagauccgguucuucccgcccaagagcaacaaggccuaccacuaccacuccuacaacggguggaaccgcgacgcguacagccuccggaucuggggccugggcuuccugccccaggugagcaccgaccucacgccccagaccuucuccgagaagguccugcaggggaagaaccacugggugaucgacuucuacgcccccuggugcggccccugccagaacuucgcccccgaguucgagcugcucgcccgcaugaucaaggggaaggugaaggccggcaaggucgacugccaggcguacgcccagaccugccagaaggccggcauccgggccuaccccaccgugaaguucuacuucuacgagcgcgccaagcggaacuuccaggaggagcagaucaacacccgcgacgcgaaggccaucgccgcccugaucagcgagaagcuggagacgcuccggaaccaggggaagcgcaacaaggacgagcuguga

SEQ ID NO: 8209 - RNA, 2382 nt, Artificial Sequence
  derived and/or modified sequence opt2 from DJC10__Homo_sapiens__BAB55263
augggcgucuggcucaacaaggacgacuacauccgcgaccucaagcgcaucauccucugcuuccucaucgucuacauggccauccucgucggcaccgaccaggacuucuacucccuccucggcgucuccaagaccgccuccucccgcgagauccgccaggccuucaagaagcucgcccucaagcuccaccccgacaagaaccccaacaaccccaacgcccacggcgacuuccucaagaucaaccgcgccuacgagguccucaaggacgaggaccuccgcaagaaguacgacaaguacggcgagaagggccucgaggacaaccagggcggccaguacgaguccuggaacuacuaccgcuacgacuucggcaucuacgacgacgaccccgagaucaucacccucgagcgccgcgaguucgacgccgccgucaacuccggcgagcucugguucgucaacuucuacucccccggcugcucccacugccacgaccucgcccccaccuggcgcgacuucgccaaggaggucgacggccuccuccgcaucggcgccgucaacugcggcgacgaccgcaugcucugccgcaugaagggcgucaacuccuaccccucccucuucaucuuccgcuccggcauggcccccgucaaguaccacggcgaccgcuccaaggagucccucgucuccuucgccaugcagcacguccgcuccaccgucaccgagcucuggaccggcaacuucgucaacuccauccagaccgccuucgccgccggcaucggcuggcucaucaccuucugcuccaagggcggcgacugccucaccucccagacccgccuccgccucuccggcaugcucgacggccucgucaacgucggcuggauggacugcgccacccaggacaaccucugcaagucccucgacaucaccaccuccaccaccgccuacuucccccccggcgccacccucaacaacaaggagaagaacuccauccucuuccucaacucccucgacgccaaggagaucuaccucgaggucauccacaaccuccccgacuucgagcuccucuccgccaacacccucgaggaccgccucgcccaccaccgcuggcuccucuucuuccacuucggcaagaacgagaacuccaacgaccccgagcucaagaagcucaagacccuccucaagaacgaccacauccaggucggccgcuucgacugcuccuccgcccccgacaucugcuccaaccucuacgucuuccagcccucccucgccgucuucaagggccagggcaccaaggaguacgagauccaccacggcaagaagauccucuacgacauccucgccuucgccaaggaguccgucaacucccacgucaccacccucggcccccagaacuuccccgccaacgacaaggagcccuggcucgucgacuucuucgcccccuggugcccccccugccgcgcccuccuccccgagcuccgccgcgccuccaaccuccucuacggccagcucaaguucggcacccucgacugcaccguccacgagggccucugcaacauguacaacauccaggccuaccccaccaccgucgucuucaaccaguccaacauccacgaguacgagggccaccacuccgccgagcagauccucgaguucaucgaggaccucaugaaccccuccgucgucucccucacccccaccaccuucaacgagcucgucacccagcgcaagcacaacgaggucuggauggucgacuucuacucccccuggugccaccccugccagguccucaugcccgaguggaagcgcauggcccgcacccucaccggccucaucaacgucggcuccaucgacugccagcaguaccacuccuucugcgcccaggagaacguccagcgcuaccccgagauccgcuucuucccccccaaguccaacaaggccuaccacuaccacuccuacaacggcuggaaccgcgacgccuacucccuccgcaucuggggccucggcuuccucccccaggucuccaccgaccucaccccccagaccuucuccgagaagguccuccagggcaagaaccacugggucaucgacuucuacgcccccuggugcggccccugccagaacuucgcccccgaguucgagcuccucgcccgcaugaucaagggcaaggucaaggccggcaaggucgacugccaggccuacgcccagaccugccagaaggccggcauccgcgccuaccccaccgucaaguucuacuucuacgagcgcgccaagcgcaacuuccaggaggagcagaucaacacccgcgacgccaaggccaucgccgcccucaucuccgagaagcucgagacccuccgcaaccagggcaagcgcaacaaggacgagcucuga

SEQ ID NO: 8210 - RNA, 2382 nt, Artificial Sequence
  derived and/or modified sequence opt3 from DJC10__Homo_sapiens__BAB55263
augggcguguggcugaacaaggacgauuacaucagagaccucaaaaggauuauacuuugcuuccugaucgucuauauggccauuuugguugggaccgaucaggacuuuuacagcuuacugggaguguccaagacagcuucuucacgggagauccgccaagcauucaaaaagcuagcccucaaacugcaccccgauaagaauccuaacaauccaaacgcgcauggugacuuucuuaagauuaaucgagcuuaugaaguacugaaagaugaggacuugcguaagaaauacgauaaguauggcgaaaaagggcucgaggacaaccagggaggccaguacgaaaguuggaauuauuacagauacgauuucgguaucuaugacgaugacccggagauaaucacucuggagaggcgggaauuugacgccgcagugaacagcggggagcugugguucgucaauuuuuacucccccggauguucucacugccaugaucucgccccuacguggcgcgacuucgcuaaggaaguggauggcuuacugagaauuggcgcaguuaacuguggggacgauaggaugcuuugccggaugaagggagucaauucguauccaucauuguuuaucuuccgcagcgguauggcccccgugaaauaccacggcgaccgaaguaaggagucccuggugucuuuugcuaugcagcauguaagaagcaccguuacagagcuauggacugggaacuucgucaauuccauucaaaccgccuuugcggcaggaaucggcuggcucauaacauucuguucaaaagguggggauugccugaccagucagacuaggcuucggcugagcggaauguuggacggccucgugaacgugggcuggauggauugugccacacaggacaaucugugcaagucuuuagauauuaccacguccacuaccgcuuauuucccuccaggggccacacugaacaacaaagaaaagaacucaauccucuuucuuaauagccuggacgcaaaagagauuuacuuggaagugauccacaaucuacccgacuucgagcugcucagugcuaacacucuggaagaucgucuugcccaccaucgcuggcuguuguuuuuccacuuuggaaagaaugagaacucuaaugacccugagcucaagaaacugaagaccuuacugaaaaacgaucauauccaggucgguagauucgacuguuccagcgcgccagauauuugcucgaaucuauauguuuuucaaccgucucucgccguguucaagggccaggggacaaaagaauacgagauacaccacggaaagaagauccuguacgacauucuugcauuugcuaaagaauccguaaacucacaugugaccacguugggcccccagaauuucccugccaacgauaaggagccauggcuggucgacuuuuucgcucccugguguccuccaugcagggcccuccugcccgaacuucggcgagcaaguaaucuguuguauggucagcucaaauuugggacucuggauugcacagugcacgagggcuuauguaacauguacaauauccaagccuauccgaccacuguuguguucaaccagagcaacauacaugaguacgaaggacaccauuccgcugagcagauucuggaguucaucgaagaccuaaugaauccuucugucgugagccucacacccaccacguuuaacgaacugguaacccaacgcaagcacaaugagguuuggaugguggauuucuauucaccauggugccacccuugucagguccuuaugcccgaguggaaaagaauggcgaggacauugacuggccugaucaacguggggaguauugacugccagcaguaccauuccuuuugugcacaagaaaauguccagcgguauccagagauccgcuucuuucccccuaagagcaacaaggccuaccacuaccauucuuauaauggauggaacagagaugcuuacucacucaggauuuggggucugggcuucuuaccacaggugaguaccgaccugacaccgcagacuuuuagcgaaaaaguucuucaagggaagaaucacugggugauagacuucuaugcccccuggugcggaccuugucagaacuuugcaccagaguucgaguugcucgcccguaugaucaaaggcaagguaaaagcugguaaggucgauugccaggccuacgcacagaccugucaaaaggcggggauucgggcuuaucccacagugaaauuuuacuucuaugaacgagccaagagaaauuuucaggaggaacagaucaacaccagggacgcaaaagccaucgcugcccugauuuccgagaagcuagaaacucugcgcaaucagggcaaacggaacaaggaugagcucuga

SEQ ID NO: 8211 - RNA, 2382 nt, Artificial Sequence
  derived and/or modified sequence opt4 from DJC10__Homo_sapiens__BAB55263
augggcguguggcugaacaaggacgacuacaucagagaccugaagagaaucauccugugcuuccugaucguguacauggccauccuggugggcaccgaccaggacuucuacagccugcugggcgugagcaagaccgccagcagcagagagaucagacaggccuucaagaagcuggcccugaagcugcaccccgacaagaaccccaacaaccccaacgcccacggcgacuuccugaagaucaacagagccuacgaggugcugaaggacgaggaccugagaaagaaguacgacaaguacggcgagaagggccuggaggacaaccagggcggccaguacgagagcuggaacuacuacagauacgacuucggcaucuacgacgacgaccccgagaucaucacccuggagagaagagaguucgacgccgccgugaacagcggcgagcugugguucgugaacuucuacagccccggcugcagccacugccacgaccuggcccccaccuggagagacuucgccaaggagguggacggccugcugagaaucggcgccgugaacugcggcgacgacagaaugcugugcagaaugaagggcgugaacagcuaccccagccuguucaucuucagaagcggcauggcccccgugaaguaccacggcgacagaagcaaggagagccuggugagcuucgccaugcagcacgugagaagcaccgugaccgagcuguggaccggcaacuucgugaacagcauccagaccgccuucgccgccggcaucggcuggcugaucaccuucugcagcaagggcggcgacugccugaccagccagaccagacugagacugagcggcaugcuggacggccuggugaacgugggcuggauggacugcgccacccaggacaaccugugcaagagccuggacaucaccaccagcaccaccgccuacuucccccccggcgccacccugaacaacaaggagaagaacagcauccuguuccugaacagccuggacgccaaggagaucuaccuggaggugauccacaaccugcccgacuucgagcugcugagcgccaacacccuggaggacagacuggcccaccacagauggcugcuguucuuccacuucggcaagaacgagaacagcaacgaccccgagcugaagaagcugaagacccugcugaagaacgaccacauccaggugggcagauucgacugcagcagcgcccccgacaucugcagcaaccuguacguguuccagcccagccuggccguguucaagggccagggcaccaaggaguacgagauccaccacggcaagaagauccuguacgacauccuggccuucgccaaggagagcgugaacagccacgugaccacccugggcccccagaacuuccccgccaacgacaaggagcccuggcugguggacuucuucgcccccuggugcccccccugcagagcccugcugcccgagcugagaagagccagcaaccugcuguacggccagcugaaguucggcacccuggacugcaccgugcacgagggccugugcaacauguacaacauccaggccuaccccaccaccgugguguucaaccagagcaacauccacgaguacgagggccaccacagcgccgagcagauccuggaguucaucgaggaccugaugaaccccagcguggugagccugacccccaccaccuucaacgagcuggugacccagagaaagcacaacgagguguggaugguggacuucuacagccccuggugccaccccugccaggugcugaugcccgaguggaagagaauggccagaacccugaccggccugaucaacgugggcagcaucgacugccagcaguaccacagcuucugcgcccaggagaacgugcagagauaccccgagaucagauucuucccccccaagagcaacaaggccuaccacuaccacagcuacaacggcuggaacagagacgccuacagccugagaaucuggggccugggcuuccugccccaggugagcaccgaccugaccccccagaccuucagcgagaaggugcugcagggcaagaaccacugggugaucgacuucuacgcccccuggugcggccccugccagaacuucgcccccgaguucgagcugcuggccagaaugaucaagggcaaggugaaggccggcaagguggacugccaggccuacgcccagaccugccagaaggccggcaucagagccuaccccaccgugaaguucuacuucuacgagagagccaagagaaacuuccaggaggagcagaucaacaccagagacgccaaggccaucgccgcccugaucagcgagaagcuggagacccugagaaaccagggcaagagaaacaaggacgagcuguga

SEQ ID NO: 8212 - RNA, 2382 nt, Artificial Sequence
  derived and/or modified sequence opt5 from DJC10__Homo_sapiens__BAB55263
augggcguguggcugaacaaggacgauuacaucagagaccucaaacggauuauccugugcuuccuuauugucuauauggccauccugguugggaccgaucaggacuuuuacagccuccugggaguguccaagacagcuucuagccgcgagauuagacaagccuucaaaaagcuggcgcuuaaacuccaccccgauaagaauccuaacaauccgaacgcucauggcgacuuucugaagaucaaucgggccuaugaagugcugaaagaugaggaccuccgcaagaaauacgauaaguauggggaaaaaggacuggaggacaaccagggcgggcaguacgaauccuggaauuauuacagauacgauuucggaaucuaugacgaugaccccgagauuaucacgcuugagcggcgcgaauuugacgccgcugucaacucuggcgagcugugguucgugaauuuuuacagcccuggcuguucccacugccaugaucucgcccccaccuggagagacuucgcuaaggaaguugaugggcugcuucggauuggagccgugaacuguggcgacgaucgcaugcugugcagaaugaagggggucaauucuuauccuagccucuuuaucuuccgguccggaauggcgcccgugaaauaccacggcgaccgcagcaaggagucucugguuuccuuugccaugcagcaugugagaagcacagucaccgagcuguggacagggaacuucgucaauucuauucaaaccgcuuuugccgcuggaaucggcuggcucauuacauucuguuccaaaggcggggauugccugaccagccagacgcggcuucgccugucuggaaugcucgacggccuggugaacgugggguggauggauugugccacccaggacaaucuuugcaagucccuggauaucacaaccagcacaaccgcguauuucccuccgggagccacgcucaacaacaaagaaaagaacuccauccuguuucucaauucucuggacgcuaaagagauuuaccuggaaguuauccacaaucuucccgacuucgagcugcucagcgccaacacacuggaagauagacuugcucaccaucgguggcugcucuuuuuccacuuuggcaagaaugagaacuccaaugacccugagcugaagaaacugaagacccuccugaaaaacgaucauauucagguggggagauucgacuguagcucugcccccgauaucugcuccaaucuuuauguguuucaaccuagccuggccgucuucaagggacagggcacaaaagaauacgagauucaccacggcaagaagauccucuacgacauccuggcuuuugcgaaagaaucugugaacagccauguuaccacccuggggccccagaauuucccggccaacgauaaggagccuuggcuuguggacuuuuucgcucccugguguccucccugccgcgcccuccugcccgaacugcggagagccuccaaucuccuguauggacagcuuaaauuuggcacacuggauugcacgguccacgaggggcucuguaacauguacaauauucaggcuuauccuaccacagugguuuucaaccaaucuaacauccaugaguacgaaggacaccauagcgccgagcagauucuggaguucaucgaagaccugaugaauccguccguggucagccuuacccccacaaccuuuaacgaacucgugacgcaacgcaagcacaaugaggucuggaugguggauuucuauucuccuuggugccaccccugucagguucugaugccugaguggaaacggauggcgagaacacugaccggccucauuaacgugggguccaucgacugccagcaguaccauagcuuuugugcucaagaaaauguccagcgcuaucccgagauccgguucuuuccgccuaagucuaacaaggccuaccacuaccauuccuauaauggcuggaacagagaugccuacagccugcgcauuuggggacuuggcuuccugccccagguguccaccgaccucacaccucagaccuuuucugaaaaaguucugcaagggaagaaucacugggugaucgacuucuaugcucccuggugcggaccuugucagaacuuugcccccgaguucgagcugcuugcucggaugauuaaaggcaaggucaaagccgggaagguggauugccaggcguacgcccagacaugucaaaaggcuggaaucagagccuauccgacggugaaauuuuacuucuaugaacgcgcuaagcggaauuuucaggaggaacagauuaacaccagagacgccaaagcgaucgccgcucucauuagcgagaagcuggaaacacugcggaaucagggcaaacgcaacaaggaugagcucuga

SEQ ID NO: 8213 - protein, 198 aa, Artificial Sequence
  DJC12__Homo_sapiens__Q9UKB3
MDAILNYRSEDTEDYYTLLGCDELSSVEQILAEFKVRALECHPDKHPENPKAVETFQKLQKAKEILTNEESRARYDHWRRSQMSMPFQQWEALNDSVKTSMHWVVRGKKDLMLEESDKTHTTKMENEECNEQRERKKEELASTAEKTEQKEPKPLEKSVSPQNSDSSGFADVNGWHLRFRWSKDAPSELLRKFRNYEI

SEQ ID NO: 8214 - RNA, 597 nt, Artificial Sequence
  DJC12__Homo_sapiens__AAD52650
auggaugcaauacugaauuacaggucagaagauacugaagauuacuacacauuacugggaugugaugaacuaucuucgguugaacaaauccuggcagaauuuaaagucagagcucuggaaugucacccagacaagcauccugaaaaccccaaagcuguggagacuuuucagaaacugcagaaggcaaaggagauucugaccaaugaagagagucgagcccgcuaugaccacuggcgaaggagccagaugucgaugccauuccagcagugggaagcuuugaaugacucagugaagacgucaaugcacuggguugucagagguaaaaaagaccugaugcuggaagaaucugacaagacucauaccaccaagauggaaaaugaggaauguaaugagcaaagagaaagaaagaaagaggagcuggcuucaaccgcagagaaaacggagcagaaagaacccaagccccuagagaagucagucuccccgcaaaauucagauucuucagguuuugcagaugugaaugguuggcaccuucguuuccgcugguccaaggaugcucccucagaacuccugaggaaguucagaaacuaugaaauauga

SEQ ID NO: 8215 - RNA, 597 nt, Artificial Sequence
  derived and/or modified sequence opt1 from DJC12__Homo_sapiens__AAD52650
auggacgccauccugaacuaccgcagcgaggacaccgaggacuacuacacccuccugggcugcgacgagcuguccagcguggagcagauccucgccgaguucaagguccgggcgcuggagugccaccccgacaagcacccggagaaccccaaggccguggagacguuccagaagcugcagaaggccaaggagauccucaccaacgaggagucccgcgcccgguacgaccacuggcgccggagccagauguccaugcccuuccagcagugggaggcccugaacgacagcgugaagaccuccaugcacugggucgugcgcgggaagaaggaccugaugcucgaggagagcgacaagacccacacgaccaagauggagaacgaggagugcaacgagcagcgggagcgcaagaaggaggagcuggcguccaccgccgagaagaccgagcagaaggagcccaagccgcuggagaaguccgugagcccccagaacagcgacuccagcggcuucgccgacgucaacggguggcaccuccgguuccgcugguccaaggacgcccccagcgagcugcugcggaaguuccgcaacuacgagaucuga

SEQ ID NO: 8216 - RNA, 597 nt, Artificial Sequence
  derived and/or modified sequence opt2 from DJC12__Homo_sapiens__AAD52650
auggacgccauccucaacuaccgcuccgaggacaccgaggacuacuacacccuccucggcugcgacgagcucuccuccgucgagcagauccucgccgaguucaagguccgcgcccucgagugccaccccgacaagcaccccgagaaccccaaggccgucgagaccuuccagaagcuccagaaggccaaggagauccucaccaacgaggagucccgcgcccgcuacgaccacuggcgccgcucccagauguccaugcccuuccagcagugggaggcccucaacgacuccgucaagaccuccaugcacugggucguccgcggcaagaaggaccucaugcucgaggaguccgacaagacccacaccaccaagauggagaacgaggagugcaacgagcagcgcgagcgcaagaaggaggagcucgccuccaccgccgagaagaccgagcagaaggagcccaagccccucgagaaguccgucuccccccagaacuccgacuccuccggcuucgccgacgucaacggcuggcaccuccgcuuccgcugguccaaggacgcccccuccgagcuccuccgcaaguuccgcaacuacgagaucuga

SEQ ID NO: 8217 - RNA, 597 nt, Artificial Sequence
  derived and/or modified sequence opt3 from DJC12__Homo_sapiens__AAD52650
auggacgccauccugaacuacagaagcgaggauaccgaagacuauuacacacuccuuggcugcgaugagcuguccucuguggaacagauuuuggcugaguucaaggucagggcauuagaaugucaccccgacaaacauccugagaauccaaaggccguugagacuuuucaaaaacugcagaaggcgaaagaaauacuaacgaacgaggaaucacgggcucgcuaugaucacuggcgacguagucagaugagcaugccguuccagcaaugggaggcccucaaugacuccgugaagaccucuaugcauuggguagugagagggaagaaagaucugaugcuugaggaaucggacaagacacacacuaccaaaauggagaacgaagagugcaaugaacagagggagcggaagaaagaggaacuggcaucaacagccgagaagaccgaacagaaggagcccaaaccuuuggaaaagagcgucaguccacagaacuccgauucuagcggauuugcugacgugaaugguuggcaucuccgcuucagaugguccaaagaugcacccucagagcugcugaggaaguuucggaacuacgagaucuga

SEQ ID NO: 8218 - RNA, 597 nt, Artificial Sequence
  derived and/or modified sequence opt4 from DJC12__Homo_sapiens__AAD52650
auggacgccauccugaacuacagaagcgaggacaccgaggacuacuacacccugcugggcugcgacgagcugagcagcguggagcagauccuggccgaguucaaggugagagcccuggagugccaccccgacaagcaccccgagaaccccaaggccguggagaccuuccagaagcugcagaaggccaaggagauccugaccaacgaggagagcagagccagauacgaccacuggagaagaagccagaugagcaugcccuuccagcagugggaggcccugaacgacagcgugaagaccagcaugcacuggguggugagaggcaagaaggaccugaugcuggaggagagcgacaagacccacaccaccaagauggagaacgaggagugcaacgagcagagagagagaaagaaggaggagcuggccagcaccgccgagaagaccgagcagaaggagcccaagccccuggagaagagcgugagcccccagaacagcgacagcagcggcuucgccgacgugaacggcuggcaccugagauucagauggagcaaggacgcccccagcgagcugcugagaaaguucagaaacuacgagaucuga

SEQ ID NO: 8219 - RNA, 597 nt, Artificial Sequence
  derived and/or modified sequence opt5 from DJC12__Homo_sapiens__AAD52650
auggacgccauccugaacuacagaagcgaggauaccgaagacuauuacacacuccugggcugcgaugagcuuuccucuguggaacagauucuggcugaguucaagguccgggcccucgaaugucaccccgacaaacauccugagaauccgaaggcgguugagacguuucaaaaacugcagaaggcuaaagaaauccuuaccaacgaggaaagccgcgccagauaugaucacuggcggcgcucccagaugucuaugcccuuccagcaaugggaggcccugaaugacagcgugaagacauccaugcauuggguggucagagggaagaaagaucucaugcuggaggaaucugacaagacccacacaaccaaaauggagaacgaagagugcaaugaacagcgggagcgcaagaaagaggaacuggcuagcacagccgagaagaccgaacagaaggagccuaaaccccucgaaaaguccgugagcccucagaacucugauuccagcggauuugcugacguuaauggcuggcaucugagauuccgguggucuaaagaugcccccuccgagcuucugcgcaaguuuagaaacuacgagauuuga

SEQ ID NO: 8220 - protein, 702 aa, Artificial Sequence
  DJC14__Homo_sapiens__Q6Y2X3
MAQKHPGERGLYGAHHSGGASLRTLGPSVDPEIPSFSGLRDSAGTAPNGTRCLTEHSGPKHTQHPNPAHWLDPSHGPPGGPGPPRDAEDPDQSETSSEEESGVDQELSKENETGNQKDGNSFLSIPSACNCQGTPGIPEGPYSEGGNGSSSNFCHHCTSPALGEDELEEEYDDEESLKFPSDFSRVSSGKKPPSRRQRHRFPTKEDTREGGRRDPRSPGRHRLGRKRSQADKRKGLGLWGAEELCQLGQAGFWWLIELLVLVGEYVETCGHLIYACRQLKSSDLDLFRVWMGVWTGRLGGWAQVMFQFLSQGFYCGVGLFTRFLKLLGALLLLALALFLGFLQLGWRFLVGLGDRLGWRDKATWLFSWLDSPALQRCLTLLRDSRPWQRLVRIVQWGWLELPWVKQNINRQGNAPVASGRYCQPEEEVARLLTMAGVPEDELNPFHVLGVEATASDVELKKAYRQLAVMVHPDKNHHPRAEEAFKVLRAAWDIVSNAEKRKEYEMKRMAENELSRSVNEFLSKLQDDLKEAMNTMMCSRCQGKHRRFEMDREPKSARYCAECNRLHPAEEGDFWAESSMLGLKITYFALMDGKVYDITEWAGCQRVGISPDTHRVPYHISFGSRIPGTRGRQRATPDAPPADLQDFLSRIFQVPPGQMPNGNFFAAPQPAPGAAAASKPNSTVPKGEAKPKRRKKVRRPFQR

SEQ ID NO: 8221 - RNA, 2109 nt, Artificial Sequence
  DJC14__Homo_sapiens__AAI17147
auggcccagaagcaccccggagaaagaggguuguauggagcccaccacagugguggugccucccucaggacuuuaggacccuccguggacccugaaauaccuucauucucaggacucagggacucagcagggacugcuccuaaugguacccgcugccucacagagcacucugguccuaagcacacacagcacccaaacccagcccauugguuggacccaagccauggccccccaggggguccaggaccaccuagagaugcagaggacccugaucagagugagacgucuucagaagaagaaucaggaguggaccaggaacucucaaaagaaaacgagacugggaaccagaaggaugggaacucuuuucuuuccauuccaucugcuugcaacugccagggaacaccuggaauuccagaagggccuuacucugagggaggaaaugguucuucuagcaacuuuugccaccacuguaccucuccagcuuugggggaagaugaguuggaagaggaauaugaugaugaagaaucucucaaguuccccagugauuuuucgcguguguccagcggaaagaaacccccaucccggagacagcggcaccgcuuuccaacgaaggaggauacucgggaggguggacguagggaucccagguccccuggucgacaucggcugggucggaaacgaagucaggcagauaagcgcaaaggccugggauuguggggagccgaggaacuaugucaacuuggacaggcaggcuuuugguggcugauugaacugcugguauuggugggagaguacguagaaacuuguggccaucucaucuaugccugcaggcaacugaaaagcagugauuuggaccuuuuucgaguuuggaugggaguguggacagggcgguuagggggcugggcccaggucauguuucaguuucuaagccagggguuuuacuguggaguaggacuguuuacucguuuucuuaagcugcugggugcuuugcugcuccuggcucuggcccucuuuuugggcuuucuacaguugggauggcgguuucuggugggacuaggugaccgguuaggcuggagggauaaggcuaccuggcucuucucuuggcuggauucuccagccuugcagcguugcuugacucugcugagagauagcaggccauggcagcggcugguaagaauaguucaguggggcuggcuggaguugccuugggucaagcagaauauuaauaggcaggggaaugcaccuguagcuagugggcgcuacugccagccugaagaggaaguggcucgacucuugaccauggcugggguuccugaggaugagcuaaacccuuuccauguacuggggguugaggccacagcaucagauguugaacugaagaaggccuauagacagcuggcagugaugguucauccugacaaaaaucaucauccccgggcugaggaggccuucaagguuuugcgagcagcuugggacauugucagcaaugcugaaaagcgaaaggaguaugagaugaaacgaauggcagagaaugagcugagccggucaguaaaugaguuucuguccaagcugcaagaugaccucaaggaggcaaugaauacuaugauguguagccgaugccaaggaaagcauaggagguuugaaauggaccgggaaccuaagagugccagauacugugcugaguguaauaggcugcauccugcugaggaaggagacuuuugggcagagucaagcauguugggccucaagaucaccuacuuugcacugauggauggaaagguguaugacaucacagagugggcuggaugccagcguguagguaucuccccagauacccacagaguccccuaucacaucucauuugguucucggauuccaggcaccagagggcggcagagagccaccccagaugccccuccugcugaucuucaggauuucuugagucggaucuuucaaguacccccagggcagaugcccaaugggaacuucuuugcagcuccucagccugccccuggagccgcugcagccucuaagcccaacagcacaguacccaagggagaagccaaaccuaagcggcggaagaaagugaggaggcccuuccaacguuga

SEQ ID NO: 8222 - RNA, 2109 nt, Artificial Sequence
  derived and/or modified sequence opt1 from DJC14__Homo_sapiens__AAI17147
auggcccagaagcaccccggcgagcgcgggcuguacggcgcccaccacagcgggggcgcgucccuccggacccuggggccgagcguggaccccgagauccccuccuucagcggccugcgcgacuccgccggcaccgcccccaacgggacgcggugccucaccgagcacagcggcccgaagcacacccagcaccccaaccccgcccacuggcuggaccccucccacgggccgcccggcgggcccgggcccccgcgcgacgccgaggaccccgaccagagcgagaccuccagcgaggaggaguccggcgucgaccaggagcugagcaaggagaacgagacggggaaccagaaggacggcaacuccuuccucagcauccccuccgcgugcaacugccaggggacccccggcaucccggagggccccuacagcgagggcggcaacggguccagcuccaacuucugccaccacugcaccagccccgcccugggcgaggacgagcuggaggaggaguacgacgacgaggagagccucaaguuccccuccgacuucagccggguguccagcgggaagaagccgcccucccgccggcagcgccaccgguuccccaccaaggaggacacgcgcgagggcggccggcgcgacccccggagcccggggcgccaccggcugggccgcaagcggucccaggccgacaagcgcaaggggcugggccucuggggcgccgaggagcugugccagcuggggcaggcgggcuucugguggcucaucgagcugcuggugcucgucggggaguacguggagaccugcggccaccugaucuacgccugccggcagcucaagagcuccgaccuggaccuguuccgcguguggaugggggucuggaccggccggcucgggggcugggcccaggugauguuccaguuccugagccagggcuucuacugcggggugggccuguucacccgcuuccugaagcuccugggggcccugcuccugcuggcccucgcgcuguuccugggcuuccuccagcugggcuggcgcuuccuggucgggcucggcgaccggcugggguggcgcgacaaggccacguggcuguucuccuggcucgacagccccgcccugcagcggugccugacccuccugcgcgacucccggcccuggcagcgccuggugcggaucgugcaguggggcuggcucgagcugcccugggucaagcagaacaucaaccgccaggggaacgccccgguggccagcggccgguacugccagcccgaggaggagguggcgcgccugcugaccauggccggcguccccgaggacgagcucaacccguuccacgugcuggggguggaggccaccgccuccgacgucgagcugaagaaggccuaccggcagcucgcggugauggugcaccccgacaagaaccaccacccccgcgccgaggaggccuucaagguccugcgggccgccugggacaucgugagcaacgcggagaagcgcaaggaguacgagaugaagcggauggccgagaacgagcugucccgcagcgugaacgaguuccucuccaagcugcaggacgaccugaaggaggccaugaacacgaugaugugcagccggugccagggcaagcaccgccgguucgagauggaccgcgagcccaagagcgcccgcuacugcgcggagugcaaccggcuccacccggccgaggagggggacuucugggccgaguccagcaugcugggccugaagaucaccuacuucgcccucauggacgggaaggucuacgacaucaccgagugggccggcugccagcgcgugggcaucucccccgacacccaccggguccccuaccacaucagcuucgggucccgcauccccggcacgcgggggcgccagcgggcgaccccggacgccccgcccgccgaccugcaggacuuccugagccgcaucuuccaggugccgcccggccagaugcccaacgggaacuucuucgccgcgccccagcccgcccccggcgccgccgccgccuccaagcccaacagcaccgugcccaagggcgaggcgaagcccaagcggcgcaagaagguccggcgcccguuccagcgguga

SEQ ID NO: 8223 - RNA, 2109 nt, Artificial Sequence
  derived and/or modified sequence opt2 from DJC14__Homo_sapiens__AAI17147
auggcccagaagcaccccggcgagcgcggccucuacggcgcccaccacuccggcggcgccucccuccgcacccucggccccuccgucgaccccgagauccccuccuucuccggccuccgcgacuccgccggcaccgcccccaacggcacccgcugccucaccgagcacuccggccccaagcacacccagcaccccaaccccgcccacuggcucgaccccucccacggcccccccggcggccccggccccccccgcgacgccgaggaccccgaccaguccgagaccuccuccgaggaggaguccggcgucgaccaggagcucuccaaggagaacgagaccggcaaccagaaggacggcaacuccuuccucuccauccccuccgccugcaacugccagggcacccccggcauccccgagggccccuacuccgagggcggcaacggcuccuccuccaacuucugccaccacugcaccucccccgcccucggcgaggacgagcucgaggaggaguacgacgacgaggagucccucaaguuccccuccgacuucucccgcgucuccuccggcaagaagccccccucccgccgccagcgccaccgcuuccccaccaaggaggacacccgcgagggcggccgccgcgacccccgcucccccggccgccaccgccucggccgcaagcgcucccaggccgacaagcgcaagggccucggccucuggggcgccgaggagcucugccagcucggccaggccggcuucugguggcucaucgagcuccucguccucgucggcgaguacgucgagaccugcggccaccucaucuacgccugccgccagcucaaguccuccgaccucgaccucuuccgcgucuggaugggcgucuggaccggccgccucggcggcugggcccaggucauguuccaguuccucucccagggcuucuacugcggcgucggccucuucacccgcuuccucaagcuccucggcgcccuccuccuccucgcccucgcccucuuccucggcuuccuccagcucggcuggcgcuuccucgucggccucggcgaccgccucggcuggcgcgacaaggccaccuggcucuucuccuggcucgacucccccgcccuccagcgcugccucacccuccuccgcgacucccgccccuggcagcgccucguccgcaucguccaguggggcuggcucgagcuccccugggucaagcagaacaucaaccgccagggcaacgcccccgucgccuccggccgcuacugccagcccgaggaggaggucgcccgccuccucaccauggccggcguccccgaggacgagcucaaccccuuccacguccucggcgucgaggccaccgccuccgacgucgagcucaagaaggccuaccgccagcucgccgucaugguccaccccgacaagaaccaccacccccgcgccgaggaggccuucaagguccuccgcgccgccugggacaucgucuccaacgccgagaagcgcaaggaguacgagaugaagcgcauggccgagaacgagcucucccgcuccgucaacgaguuccucuccaagcuccaggacgaccucaaggaggccaugaacaccaugaugugcucccgcugccagggcaagcaccgccgcuucgagauggaccgcgagcccaaguccgcccgcuacugcgccgagugcaaccgccuccaccccgccgaggagggcgacuucugggccgaguccuccaugcucggccucaagaucaccuacuucgcccucauggacggcaaggucuacgacaucaccgagugggccggcugccagcgcgucggcaucucccccgacacccaccgcguccccuaccacaucuccuucggcucccgcauccccggcacccgcggccgccagcgcgccacccccgacgccccccccgccgaccuccaggacuuccucucccgcaucuuccaggucccccccggccagaugcccaacggcaacuucuucgccgccccccagcccgcccccggcgccgccgccgccuccaagcccaacuccaccguccccaagggcgaggccaagcccaagcgccgcaagaagguccgccgccccuuccagcgcuga

SEQ ID NO: 8224 - RNA, 2109 nt, Artificial Sequence
  derived and/or modified sequence opt3 from DJC14__Homo_sapiens__AAI17147
auggcccagaagcaccccggcgagagagggcuguacggagcucaucacagcgguggcgcaucccucaggacccuugggccuucuguggacccagaaaucccgucauucaguggacugcgggauagcgccggcacagcgcccaacgguacucgcugcuugacggagcauuccgggccuaaacacacccaacauccaaaucccgcucacugguuagacccuucucacggaccacccggcggcccugggccaccgcgagaugccgaagaccccgaucagucggagacaucaagcgaagaggagaguggagucgaccaggaacuguccaaggagaacgaaacugguaaucagaaagauggcaacucuuuucuaagcauuccuuccgcauguaauugccaagggaccccaggaauacccgagggcccuuauucagagggugggaacggaaguagcucuaauuucugucaucacugcacauccccagcccucggcgaagacgagcuggaagaggaauacgaugacgaggagucacuuaaguuucccagcgauuucagucguguuucuuccggcaaaaagccgccuagcagaaggcagcggcaucgcuuucccaccaaggaagacacuagagaagggggaaggcgggauccacgcucgccuggucgacacagacugggcaggaaacggucucaggcugacaagcguaaaggguugggacucuggggcgcagaggagcugugucagcugggucaagccggguucugguggcucaucgaauuacuggugcuuguaggcgaguauguggagacaugcggacacuugauuuacgcuugucgccagcugaaguccucagaccuagaucucuuuagagucuggaugggcguguggaccgggaggcugggagguugggcccagguuauguuccaguuucuuagucaaggcuucuauugcggggugggacuguuuacgcgguucuugaaacuccugggcgcguuacugcuccuugcacuggccuuguuucuagguuuccugcagcucggguggcgauuccuggucggccuuggagaccgccugggcuggagagauaaggcuacuugguuguuuagcuggcucgacucccccgcccugcagagguguuuaacccugcuacgggauucucgcccauggcaaagacucgugaggaucguacaguggggguggcuggaacuucccuggguuaagcagaacauuaaucgucagggaaacgcaccuguggcuagcggucgguacugccaaccagaggaagaggucgcccgauugcugacaauggcgggcgugccggaagacgagcucaaucccuuccaugugcugggggucgaggccacugcaucagauguugaacuuaaaaaggcuuauagacagcuggccgugaugguacacccugacaaaaaccaucacccaagggcugaggaagccuuuaagguguugcgcgcagccugggauaucgucaguaaugcugagaaacggaaggaguacgaaaugaaaagaauggcggagaacgaacucuccaggagcgugaaugaguuccugucuaaguuacaggacgaucugaaggaagcaaugaacaccaugauguguucacgcugccagggaaaacaucgacgguuugagauggaccgugagcccaagagugccagauacugcgcugaauguaacaggcuacacccugccgaggaaggcgacuucugggcagagagcuccaugcucggucugaaaauaacauauuuugcccuuauggaugggaagguuuacgacaucaccgaaugggcuggcugccaacgcgugggaauuucuccagauacgcaccggguccccuaucauaucucguucggcagcaggauuccggggacuagaggacgacagcgcgccacaccugacgcaccacccgcggauuugcaggacuuucugucccggaucuuccaggugccucccggccaaaugccaaaugguaacuuuuucgcugccccucagcccgcaccaggggccgcugccgcaucaaaaccgaauaguaccguaccuaagggagaggcuaagcccaaaagaaggaagaaaguucgucgcccauuucagcgguga

SEQ ID NO: 8225 - RNA, 2109 nt, Artificial Sequence
  derived and/or modified sequence opt4 from DJC14__Homo_sapiens__AAI17147
auggcccagaagcaccccggcgagagaggccuguacggcgcccaccacagcggcggcgccagccugagaacccugggccccagcguggaccccgagauccccagcuucagcggccugagagacagcgccggcaccgcccccaacggcaccagaugccugaccgagcacagcggccccaagcacacccagcaccccaaccccgcccacuggcuggaccccagccacggcccccccggcggccccggcccccccagagacgccgaggaccccgaccagagcgagaccagcagcgaggaggagagcggcguggaccaggagcugagcaaggagaacgagaccggcaaccagaaggacggcaacagcuuccugagcauccccagcgccugcaacugccagggcacccccggcauccccgagggccccuacagcgagggcggcaacggcagcagcagcaacuucugccaccacugcaccagccccgcccugggcgaggacgagcuggaggaggaguacgacgacgaggagagccugaaguuccccagcgacuucagcagagugagcagcggcaagaagccccccagcagaagacagagacacagauuccccaccaaggaggacaccagagagggcggcagaagagaccccagaagccccggcagacacagacugggcagaaagagaagccaggccgacaagagaaagggccugggccuguggggcgccgaggagcugugccagcugggccaggccggcuucugguggcugaucgagcugcuggugcuggugggcgaguacguggagaccugcggccaccugaucuacgccugcagacagcugaagagcagcgaccuggaccuguucagaguguggaugggcguguggaccggcagacugggcggcugggcccaggugauguuccaguuccugagccagggcuucuacugcggcgugggccuguucaccagauuccugaagcugcugggcgcccugcugcugcuggcccuggcccuguuccugggcuuccugcagcugggcuggagauuccuggugggccugggcgacagacugggcuggagagacaaggccaccuggcuguucagcuggcuggacagccccgcccugcagagaugccugacccugcugagagacagcagacccuggcagagacuggugagaaucgugcaguggggcuggcuggagcugcccugggugaagcagaacaucaacagacagggcaacgcccccguggccagcggcagauacugccagcccgaggaggagguggccagacugcugaccauggccggcgugcccgaggacgagcugaaccccuuccacgugcugggcguggaggccaccgccagcgacguggagcugaagaaggccuacagacagcuggccgugauggugcaccccgacaagaaccaccaccccagagccgaggaggccuucaaggugcugagagccgccugggacaucgugagcaacgccgagaagagaaaggaguacgagaugaagagaauggccgagaacgagcugagcagaagcgugaacgaguuccugagcaagcugcaggacgaccugaaggaggccaugaacaccaugaugugcagcagaugccagggcaagcacagaagauucgagauggacagagagcccaagagcgccagauacugcgccgagugcaacagacugcaccccgccgaggagggcgacuucugggccgagagcagcaugcugggccugaagaucaccuacuucgcccugauggacggcaagguguacgacaucaccgagugggccggcugccagagagugggcaucagccccgacacccacagagugcccuaccacaucagcuucggcagcagaauccccggcaccagaggcagacagagagccacccccgacgccccccccgccgaccugcaggacuuccugagcagaaucuuccaggugccccccggccagaugcccaacggcaacuucuucgccgccccccagcccgcccccggcgccgccgccgccagcaagcccaacagcaccgugcccaagggcgaggccaagcccaagagaagaaagaaggugagaagacccuuccagagauga

SEQ ID NO: 8226 - RNA, 2109 nt, Artificial Sequence
  derived and/or modified sequence opt5 from DJC14__Homo_sapiens__AAI17147
auggcccagaagcaccccggcgagagagggcuguacggagcucaucacagcggcggggccucccuccggacccugggaccuucuguggacccggaaauccccagcuucuccggccuucgcgauucugcggggacagcuccuaacggaacgagaugccugaccgagcauagcggccccaaacacacacaacauccuaaucccgcccacuggcucgacccuucccacggcccgcccgggggaccugggcccccucgggaugccgaagaccccgaucagucugagaccagcuccgaagaggagagcggggucgaccaggaacugucuaaggagaacgaaacaggaaaucagaaagauggcaacuccuuucuuagcauuccgucugcuuguaauugccaagggaccccuggaauccccgagggcccuuauuccgagggcgggaacggaucuagcuccaauuucugucaucacugcacaagccccgcccugggcgaagacgagcucgaagaggaauacgaugacgaggagucccugaaguuucccucugauuucagccgcguuuccagcgggaaaaagccuccgucuagacggcagcgccauagauuucccaccaaggaagacacgcgggagggaggccgcagagauccucggucccccgggcgccacagacugggacggaaacgcagccaggcugacaagagaaaaggccucggccuguggggcgccgaggaacuuugucagcugggacaagcgggcuucugguggcucauugaacugcuugugcuggugggggaguaugucgagaccugcggacaccucaucuacgccugucggcagcugaagucuagcgaccuggaucucuuuagaguguggaugggcguuuggacagggcgccugggcggaugggcucaggugauguuccaguuucuuucccaaggcuucuauugcggggucggacuguuuacccgguuccucaaacugcuuggcgcccugcuccugcuggcucucgcccuguuucuuggguuccugcagcucggauggagauuccuggugggccuuggggaccgccugggcuggcgggauaaggcgacauggcucuuuucuuggcuggacagcccugcccugcagagaugucucacccugcuucgcgauucccggcccuggcaaagacugguucgcauugugcaguggggauggcucgaacugccgugggucaagcagaacaucaaucggcagggcaacgcuccuguggccagcgggagauacugccaacccgaggaagagguggcucgccugcuuacgauggccggagucccugaagacgagcucaaucccuuccauguucugggcguggaggccacagcuucugauguggaacugaaaaaggcguaucggcagcucgccgucauggugcacccugacaaaaaccaucaccccagagcugaggaagccuuuaagguucugcgggccgcuugggauaucguguccaaugccgagaaacgcaaggaguacgaaaugaaaagaauggcggagaacgaacuuagccggucugucaaugaguuccuguccaagcuccaggacgaucugaaggaagcuaugaacaccaugauguguagcagaugccaggggaaacaucgccgguuugagauggacagagagccgaaguccgcccgcuacugcgccgaauguaacagacugcacccugcugaggaaggagacuucugggccgagucuagcaugcuuggccucaaaauuacauauuuugcucugauggaugggaagguguacgacaucaccgaaugggccggcugccaacggguuggaauuucccccgauacccaccgcgugcccuaucauaucucuuucggcagccggauuccugggacaagaggacgccagagagcgacgccggacgcucccccugccgaucugcaggacuuucucucccggaucuuccaggugcccccuggccaaaugcccaaugggaacuuuuucgccgcuccucagcccgccccgggagcggccgcugccagcaaaccuaauucuaccguccccaagggcgaggcuaagccuaaacgcagaaagaaaguccggcgccccuuucagagauga

SEQ ID NO: 8227 - protein, 150 aa, Artificial Sequence
  DJC15__Homo_sapiens__Q9Y5T4
MAARGVIAPVGESLRYAEYLQPSAKRPDADVDQQRLVRSLIAVGLGVAALAFAGRYAFRIWKPLEQVITETAKKISTPSFSSYYKGGFEQKMSRREAGLILGVSPSAGKAKIRTAHRRVMILNHPDKGGSPYVAAKINEAKDLLETTTKH

SEQ ID NO: 8228 - RNA, 453 nt, Artificial Sequence
  DJC15__Homo_sapiens__AAH95400
auggcugcccguggugucaucgcuccaguuggcgagaguuugcgcuacgcugaguacuugcagcccucggccaaacggccagacgccgacgucgaccagcagagacugguaagaaguuugauagcuguaggccuggguguugcagcucuugcauuugcaggucgcuacgcauuucggaucuggaaaccucuagaacaaguuaucacagaaacugcaaagaagauuucaacuccuagcuuuucauccuacuauaaaggaggauuugaacagaaaaugaguaggcgagaagcuggucuuauuuuagguguaagcccaucugcuggcaaggcuaagauuagaacagcucauaggagagucaugauuuugaaucacccagauaaagguggaucuccuuacguagcagccaaaauaaaugaagcaaaagacuugcuagaaacaaccaccaaacauuga

SEQ ID NO: 8229 - RNA, 453 nt, Artificial Sequence
  derived and/or modified sequence opt1 from DJC15__Homo_sapiens__AAH95400
auggccgcccgcggcgugaucgcgcccgucggggagagccugcgguacgccgaguaccuccagccguccgccaagcgccccgacgccgacguggaccagcagcggcuggugcgcagccugaucgccgucggccucgggguggcggcccuggccuucgccggccgguacgcguuccgcaucuggaagccccuggagcaggucaucaccgagaccgccaagaagaucuccacgcccagcuucuccagcuacuacaagggcggguucgagcagaagaugucccggcgcgaggccggccucauccugggggugagcccguccgccggcaaggccaagauccggaccgcgcaccgccgggugaugauccugaaccaccccgacaagggcgggagccccuacguggccgccaagaucaacgaggccaaggaccuccuggagaccaccacgaagcacuga

SEQ ID NO: 8230 - RNA, 453 nt, Artificial Sequence
  derived and/or modified sequence opt2 from DJC15__Homo_sapiens__AAH95400
auggccgcccgcggcgucaucgcccccgucggcgagucccuccgcuacgccgaguaccuccagcccuccgccaagcgccccgacgccgacgucgaccagcagcgccucguccgcucccucaucgccgucggccucggcgucgccgcccucgccuucgccggccgcuacgccuuccgcaucuggaagccccucgagcaggucaucaccgagaccgccaagaagaucuccacccccuccuucuccuccuacuacaagggcggcuucgagcagaagaugucccgccgcgaggccggccucauccucggcgucucccccuccgccggcaaggccaagauccgcaccgcccaccgccgcgucaugauccucaaccaccccgacaagggcggcucccccuacgucgccgccaagaucaacgaggccaaggaccuccucgagaccaccaccaagcacuga

SEQ ID NO: 8231 - RNA, 453 nt, Artificial Sequence
  derived and/or modified sequence opt3 from DJC15__Homo_sapiens__AAH95400
auggccgcuagaggcgugaucgcacccgucggggagagccugagguacgccgaauaucuccagccuuccgcgaagcggccagacgcugauguugaccaacagcgccuugugcgaucucugauugccguaggauuggguguggcagccuuagcuuucgcaggccguuacgccuuuagaauauggaaaccgcuggagcaggucaucaccgaaacagcuaagaaaauuucaacucccaguuucagcuccuauuacaaagggggauuugagcagaagaugucuaggcgggaagccggccuaauccucggugugucgccuucagcggggaaggcaaagauucgcacggcccacagaaggguuaugauccugaaccauccagauaaaggaggcagccccuauguggcugccaagauaaaugaggcaaaagaccuucuggagaccacaacuaagcacuga

SEQ ID NO: 8232 - RNA, 453 nt, Artificial Sequence
  derived and/or modified sequence opt4 from DJC15__Homo_sapiens__AAH95400
auggccgccagaggcgugaucgcccccgugggcgagagccugagauacgccgaguaccugcagcccagcgccaagagacccgacgccgacguggaccagcagagacuggugagaagccugaucgccgugggccugggcguggccgcccuggccuucgccggcagauacgccuucagaaucuggaagccccuggagcaggugaucaccgagaccgccaagaagaucagcacccccagcuucagcagcuacuacaagggcggcuucgagcagaagaugagcagaagagaggccggccugauccugggcgugagccccagcgccggcaaggccaagaucagaaccgcccacagaagagugaugauccugaaccaccccgacaagggcggcagccccuacguggccgccaagaucaacgaggccaaggaccugcuggagaccaccaccaagcacuga

SEQ ID NO: 8233 - RNA, 453 nt, Artificial Sequence
  derived and/or modified sequence opt5 from DJC15__Homo_sapiens__AAH95400
auggccgcuagaggcgugaucgcccccgucggggagagccugcgguacgcggaauaucuccagccuuccgcuaagcgcccggacgccgauguugaccaacagagacuggugcggucucuuauugccgugggacugggcgucgcugcccucgcuuucgccgggcgcuacgcguuuagaaucuggaaaccccuggaacaggugauuaccgagacagccaagaaaaucagcacgccuuccuucucuagcuauuacaagggaggcuuugagcagaaaaugucccggcgcgaagcugggcuuauucugggaguuucucccagcgccggcaaggcuaagaucagaaccgcccaccggcgcgugaugauccucaaccauccugauaaaggcgggucccccuaugucgcggccaagauuaaugaggcuaaagaccugcuggagacaaccacaaagcacuga

SEQ ID NO: 8234 - protein, 782 aa, Artificial Sequence
  DJC16__Homo_sapiens__Q9Y2G8
MEVRKLSISWQFLIVLVLILQILSALDFDPYRVLGVSRTASQADIKKAYKKLAREWHPDKNKDPGAEDKFIQISKAYEILSNEEKRSNYDQYGDAGENQGYQKQQQQREYRFRHFHENFYFDESFFHFPFNSERRDSIDEKYLLHFSHYVNEVVPDSFKKPYLIKITSDWCFSCIHIEPVWKEVIQELEELGVGIGVVHAGYERRLAHHLGAHSTPSILGIINGKISFFHNAVVRENLRQFVESLLPGNLVEKVTNKNYVRFLSGWQQENKPHVLLFDQTPIVPLLYKLTAFAYKDYLSFGYVYVGLRGTEEMTRRYNINIYAPTLLVFKEHINRPADVIQARGMKKQIIDDFITRNKYLLAARLTSQKLFHELCPVKRSHRQRKYCVVLLTAETTKLSKPFEAFLSFALANTQDTVRFVHVYSNRQQEFADTLLPDSEAFQGKSAVSILERRNTAGRVVYKTLEDPWIGSESDKFILLGYLDQLRKDPALLSSEAVLPDLTDELAPVFLLRWFYSASDYISDCWDSIFHNNWREMMPLLSLIFSALFILFGTVIVQAFSDSNDERESSPPEKEEAQEKTGKTEPSFTKENSSKIPKKGFVEVTELTDVTYTSNLVRLRPGHMNVVLILSNSTKTSLLQKFALEVYTFTGSSCLHFSFLSLDKHREWLEYLLEFAQDAAPIPNQYDKHFMERDYTGYVLALNGHKKYFCLFKPQKTVEEEEAIGSCSDVDSSLYLGESRGKPSCGLGSRPIKGKLSKLSLWMERLLEGSLQRFYIPSWPELD

SEQ ID NO: 8235 - RNA, 2349 nt, Artificial Sequence
  DJC16__Homo_sapiens__AAH47363
auggaagugagaaaguugagcauuuccuggcaguucuugauaguucugguucugauccugcaaauucugucugcguuggauuuugacccauacagaguccuaggggucagccgaacagccagucaggcugauauuaaaaaggcuuauaagaagcucgcccgggaauggcauccugacaaaaacaaagauccuggagcagaagacaaguucauucaaaucaguaaggcuuacgagauucuuucaaaugaagaaaagagaucaaauuaugaucaauauggagacgcuggagagaaccagggcuaccagaagcagcaacagcagcgagaguaucgcuuccgccauuuccaugaaaauuuuuauuuugaugaauccuuuuuucacuucccuuuuaauucugaacggcgggacucaauugacgaaaaguauuuauugcacuuuucacauuaugugaaugaagugguuccagauagcuucaagaaacccuaccucaucaagaucaccuccgauuggugcuuuagcugcauucauaucgagccuguguggaaagaagucauucaagaacuggaagaauuggguguaggaauuggcgugguccaugcuggguaugagagacgccuggcccaucaccuaggggcacacagcacgcccucuauccuaggaaucauuaacgggaaaaucuccuucuuccacaaugcaguuguccgugaaaaucugcgacaauuuguagaaagucuucuuccagggaacuugguggagaaaguuacaaauaaaaauuacgucagauuccucucuggcuggcagcaagagaauaagccucauguccuucuguuugaccaaacgcccauugugccacuguuauacaaguugacugccuuugcauacaaagauuauuuaucauuuggauauguauauguggguuugagagggacggaagagaugacaaggcgguacaacaucaauaucuacgccccuacccucuuggucuuuaaagaacauauaaacaggccugccgauguuauccaggcccgagguaugaagaagcaaaucauugacgacuucaucacccgaaacaaauaucuauuggcagccaggcucaccagccagaaguuguuccaugaacucugcccugugaaacggucgcaucgacagaggaaguacugugugguuuuauugacugcugagacuaccaaguugagcaaacccuuugaggcuuuccuguccuuugcccuggcaaacacucaagacacagugagauuugugcaugucuacagcaaucggcagcaggaguuugccgacaccuuacuaccagacagugaggcguuucaagggaaaucagcggugucuauuuuagaaaggcgcaacacagcaggaagggugguguauaaaacccuggaagacccuuggauugggagugagagugacaaauuuauccucuugggcuaucucgaccagcugcguaaagauccagcucuucuguccucugaagcagugcuuccugaccugaccgaugaacuugccccuguuuuucuccuucgaugguucuacucugcuucugacuacaucucagacugcugggauagcauuuuucacaacaacuggagggaaaugaugccccugcugucccugaucuucucugcccucuucauccucuucggcacugucaucguucaggcuuucagcgacucuaaugaugagcgagagucaagcccuccagaaaaagaggaagcccaagagaagacugggaaaacugagccaagcuucaccaaagaaaacagcagcaagauuccuaaaaaaggcuuuguggagguaacugaacucacagauguaacauacaccaguaacuugguacgucugaggccaggccacaugaaugugguccucauccugucgaauucuaccaagaccagccuacuacagaaauuugcuuuggaggucuacacauuuacugggagcagcugccuacacuucuccuuccugagucuagauaaacacagagaauggcuagaauacuuacuagaauuugcucaagaugcagcuccaaucccaaaccaauaugauaagcauuucauggagcgugacuacacugguuauguacuggcucugaauggccacaagaaauacuucugccucuucaagccccaaaagacagucgaagaggaggaagccauagggucgugcagugauguugacucuucccucuaccugggugaaucucgagggaaaccuuccuguggccuuggauccaggcccaucaaaggaaaguugagcaagcucucuuuauggauggaacgccugcuggagggcuccuuacagagguuuuauaucccaucauggccugaacuagacuga

SEQ ID NO: 8236 - RNA, 2349 nt, Artificial Sequence
  derived and/or modified sequence opt1 from DJC16__Homo_sapiens__AAH47363
auggaggugcgcaagcugagcaucuccuggcaguuccucaucguccuggugcugauccuccagauccugagcgcccuggacuucgaccccuaccgggugcucggcgucucccgcaccgccagccaggcggacaucaagaaggccuacaagaagcuggcccgggaguggcacccggacaagaacaaggaccccggggccgaggacaaguucauccagaucuccaaggccuacgagauccugagcaacgaggagaagcgcuccaacuacgaccaguacggcgacgcgggggagaaccagggcuaccagaagcagcagcagcagcgggaguaccgcuuccggcacuuccacgagaacuucuacuucgacgagagcuucuuccacuuccccuucaacuccgagcgccgggacagcaucgacgagaaguaccuccugcacuucucccacuacgugaacgaggugguccccgacagcuucaagaagccguaccugaucaagaucaccuccgacuggugcuucagcugcauccacaucgagcccguguggaaggaggugauccaggagcucgaggagcugggggucggcaucggcguggugcacgccggguacgagcgccggcuggcccaccaccucggcgcccacuccacgcccagcauccuggggaucaucaacggcaagaucuccuucuuccacaacgcggucgugcgcgagaaccugcggcaguucguggagagccuccugcccgggaaccuggucgagaaggugaccaacaagaacuacgugcgcuuccucuccggcuggcagcaggagaacaagccgcacguccugcuguucgaccagacccccaucgugccccuccuguacaagcugaccgccuucgccuacaaggacuaccucagcuucggcuacguguacgucgggcugcggggcacggaggagaugacccgccgguacaacaucaacaucuacgcccccacccugcucguguucaaggagcacaucaaccgcccggccgacgugauccaggcgcgggggaugaagaagcagaucaucgacgacuucaucacccgcaacaaguaccugcuggccgcccggcucacgagccagaagcuguuccacgagcugugccccgucaagcgcucccaccgccagcggaaguacugcgugguccuccugaccgccgagaccaccaagcugagcaagcccuucgaggccuuccucuccuucgcgcuggccaacacgcaggacaccgugcgcuucgugcacgucuacagcaaccggcagcaggaguucgccgacacccugcuccccgacuccgaggccuuccagggcaagagcgccguguccauccuggagcgccggaacaccgcgggccgcguggucuacaagacgcuggaggacccguggaucgggagcgaguccgacaaguucauccuccugggcuaccuggaccagcuccggaaggaccccgcccugcugagcuccgaggccgugcugcccgaccucaccgacgagcuggcccccguguuccugcuccgcugguucuacagcgccuccgacuacaucagcgacugcugggacuccaucuuccacaacaacuggcgggagaugaugccgcugcugagccucaucuucuccgcgcuguucauccuguucgggaccgucaucgugcaggccuucagcgacuccaacgacgagcgcgagagcagcccgcccgagaaggaggaggcccaggagaagaccggcaagacggagcccuccuucaccaaggagaacagcuccaagauccccaagaagggguucguggaggucaccgagcucaccgacgugacguacaccagcaaccuggugcggcugcgccccggccacaugaacgucgugcucauccuguccaacagcaccaagaccucccugcuccagaaguucgcccuggagguguacacguucaccggcagcuccugccugcacuucagcuuccucucccuggacaagcaccgggaguggcuggaguaccuccuggaguucgcgcaggacgccgcccccauccccaaccaguacgacaagcacuucauggagcgcgacuacaccggguacguccuggcccucaacggccacaagaaguacuucugccuguucaagccgcagaagaccguggaggaggaggaggccaucgggagcugcuccgacguggacagcucccuguaccucggcgagagccgggggaagcccuccugcggccugggcagccgccccaucaaggggaagcugagcaagcucucccuguggauggagcggcugcucgagggcagccugcagcgcuucuacaucccguccuggcccgagcuggacuga

SEQ ID NO: 8237 - RNA, 2349 nt, Artificial Sequence
  derived and/or modified sequence opt2 from DJC16__Homo_sapiens__AAH47363
auggagguccgcaagcucuccaucuccuggcaguuccucaucguccucguccucauccuccagauccucuccgcccucgacuucgaccccuaccgcguccucggcgucucccgcaccgccucccaggccgacaucaagaaggccuacaagaagcucgcccgcgaguggcaccccgacaagaacaaggaccccggcgccgaggacaaguucauccagaucuccaaggccuacgagauccucuccaacgaggagaagcgcuccaacuacgaccaguacggcgacgccggcgagaaccagggcuaccagaagcagcagcagcagcgcgaguaccgcuuccgccacuuccacgagaacuucuacuucgacgaguccuucuuccacuuccccuucaacuccgagcgccgcgacuccaucgacgagaaguaccuccuccacuucucccacuacgucaacgaggucguccccgacuccuucaagaagcccuaccucaucaagaucaccuccgacuggugcuucuccugcauccacaucgagcccgucuggaaggaggucauccaggagcucgaggagcucggcgucggcaucggcgucguccacgccggcuacgagcgccgccucgcccaccaccucggcgcccacuccacccccuccauccucggcaucaucaacggcaagaucuccuucuuccacaacgccgucguccgcgagaaccuccgccaguucgucgagucccuccuccccggcaaccucgucgagaaggucaccaacaagaacuacguccgcuuccucuccggcuggcagcaggagaacaagccccacguccuccucuucgaccagacccccaucgucccccuccucuacaagcucaccgccuucgccuacaaggacuaccucuccuucggcuacgucuacgucggccuccgcggcaccgaggagaugacccgccgcuacaacaucaacaucuacgcccccacccuccucgucuucaaggagcacaucaaccgccccgccgacgucauccaggcccgcggcaugaagaagcagaucaucgacgacuucaucacccgcaacaaguaccuccucgccgcccgccucaccucccagaagcucuuccacgagcucugccccgucaagcgcucccaccgccagcgcaaguacugcgucguccuccucaccgccgagaccaccaagcucuccaagcccuucgaggccuuccucuccuucgcccucgccaacacccaggacaccguccgcuucguccacgucuacuccaaccgccagcaggaguucgccgacacccuccuccccgacuccgaggccuuccagggcaaguccgccgucuccauccucgagcgccgcaacaccgccggccgcgucgucuacaagacccucgaggaccccuggaucggcuccgaguccgacaaguucauccuccucggcuaccucgaccagcuccgcaaggaccccgcccuccucuccuccgaggccguccuccccgaccucaccgacgagcucgcccccgucuuccuccuccgcugguucuacuccgccuccgacuacaucuccgacugcugggacuccaucuuccacaacaacuggcgcgagaugaugccccuccucucccucaucuucuccgcccucuucauccucuucggcaccgucaucguccaggccuucuccgacuccaacgacgagcgcgaguccuccccccccgagaaggaggaggcccaggagaagaccggcaagaccgagcccuccuucaccaaggagaacuccuccaagauccccaagaagggcuucgucgaggucaccgagcucaccgacgucaccuacaccuccaaccucguccgccuccgccccggccacaugaacgucguccucauccucuccaacuccaccaagaccucccuccuccagaaguucgcccucgaggucuacaccuucaccggcuccuccugccuccacuucuccuuccucucccucgacaagcaccgcgaguggcucgaguaccuccucgaguucgcccaggacgccgcccccauccccaaccaguacgacaagcacuucauggagcgcgacuacaccggcuacguccucgcccucaacggccacaagaaguacuucugccucuucaagccccagaagaccgucgaggaggaggaggccaucggcuccugcuccgacgucgacuccucccucuaccucggcgagucccgcggcaagcccuccugcggccucggcucccgccccaucaagggcaagcucuccaagcucucccucuggauggagcgccuccucgagggcucccuccagcgcuucuacauccccuccuggcccgagcucgacuga

SEQ ID NO: 8238 - RNA, 2349 nt, Artificial Sequence
  derived and/or modified sequence opt3 from DJC16__Homo_sapiens__AAH47363
auggaggugagaaagcugagcaucuccuggcaguuccucauuguccuuguucugauauugcaaaucuuaucugcccuggacuuugaucccuacagggugcuaggcguaucacggaccgcuagucaggcagacauuaaaaaggccuauaaaaagcucgcgcgcgaauggcacccugauaaaaacaaggacccaggggcugaggauaaguucauccagauuagcaaagccuacgaaauccuguccaaugaggaaaagcgaucuaacuaugaccaguacggagaugccggugagaaucaaggcuaucagaaacagcagcaacagcgugaguacagauuuaggcauuuccacgaaaacuuuuauuucgacgagucguuuuuccauuuuccguucaauucagaacggcgcgauagcauagacgagaaguaccuucugcacuuuagucauuacgugaacgaggucgugcccgauuccuucaaaaagccuuauuugaucaagauuacaucugacuggugcuuuagcuguauccacauugaaccaguuuggaaagaggugauccaggaacucgaggaacugggggucggaauaggcgugguacacgcagguuacgagagaaggcuggcucaucaccucggggcacauuccacucccucaauuuuaggaaucauuaauggcaagaucaguuucuuccacaacgccguugugcgggagaaucugcgccaguuugucgaaagccuuuugccuggcaaccugguggagaaagugacgaauaagaacuauguccgauuccuaucuggguggcaacaggaaaauaaaccacacguucuccuguuugaucagacccccaucgugccucuucuguacaaguugacagcuuucgccuauaaagacuaccucuccuuuggauauguauacgugggucugagaggcacugaggaaaugaccaggcgguacaacauuaauauauaugcgccaacauuacuggucuucaaggagcauaucaaccguccggcagacgugauucaagcccgcgggaugaagaaacagaucauagaugacuuuauuaccagaaacaaguaccuccuugcugccaggcugacuucacagaaauuguuccacgagcuaugccccguuaagcggagccaucgacagcgcaaauauugugugguccugcucacagcagaaaccacgaagcugaguaagccuuuugaggcuuuccuuucuuuugcccuggcgaauacucaagauaccgugagauucguacacguuuacuccaacaggcagcaggaauuugccgacacauugcucccagauagcgaggcauuccagggaaaaucggcugugucuauccuggaacggcgcaauacugccggcagagucguguauaagaccuuagaggaccccuggaucgguuccgagucagauaaauucauucugcuaggguaccucgaccaacugaggaaggauccugcucuuuugaguagcgaagccguccugccagaccucacagaugagcuggcacccguguuucuucugcguugguucuauuccgccucugacuacaucagcgacugcugggauucaauuuuucauaacaauuggcgggaaaugaugccguugcucagucugauauucuccgcuuuauuuauccuguucggaaccguuauugugcaggcguuuagcgacucuaacgaugagcgagagucaaguccucccgaaaaagaggaagcacaggagaagacgggcaagacugaaccauccuucacaaaagaaaauagcucuaagaucccuaaaaagggcuuuguagaggucaccgaacuaacugacgugacauacaccucgaaccucguuagacugaggcccgggcacaugaaugugguccuuaucuugagcaacuccacgaaaaccucacugcuccagaaguucgcccuggagguguauacauuuacuggaaguucuuguuuacacuucagcuuucugucccuugauaagcaucgcgaaugguuggaguaccuccuggaguucgcucaagacgccgcaccaauucccaaucaguaugauaaacacuucauggagcgggacuacaccgguuauguacuagcccugaacggccauaagaaauacuuuugccucuucaagccucagaaaacaguggaggaagaggaagcuauagggucauguagcgauguugacucuucccuguaucuuggagagaguagaggcaagccaagcugcgguuuggggucuaggccgaucaaaggcaagcuguccaaguuaucacucuggauggaacgccugcuugagggaagucugcagcgauuuuacauucccagcuggccugaguuggauuga

SEQ ID NO: 8239 - RNA, 2349 nt, Artificial Sequence
  derived and/or modified sequence opt4 from DJC16__Homo_sapiens__AAH47363
auggaggugagaaagcugagcaucagcuggcaguuccugaucgugcuggugcugauccugcagauccugagcgcccuggacuucgaccccuacagagugcugggcgugagcagaaccgccagccaggccgacaucaagaaggccuacaagaagcuggccagagaguggcaccccgacaagaacaaggaccccggcgccgaggacaaguucauccagaucagcaaggccuacgagauccugagcaacgaggagaagagaagcaacuacgaccaguacggcgacgccggcgagaaccagggcuaccagaagcagcagcagcagagagaguacagauucagacacuuccacgagaacuucuacuucgacgagagcuucuuccacuuccccuucaacagcgagagaagagacagcaucgacgagaaguaccugcugcacuucagccacuacgugaacgagguggugcccgacagcuucaagaagcccuaccugaucaagaucaccagcgacuggugcuucagcugcauccacaucgagcccguguggaaggaggugauccaggagcuggaggagcugggcgugggcaucggcguggugcacgccggcuacgagagaagacuggcccaccaccugggcgcccacagcacccccagcauccugggcaucaucaacggcaagaucagcuucuuccacaacgccguggugagagagaaccugagacaguucguggagagccugcugcccggcaaccugguggagaaggugaccaacaagaacuacgugagauuccugagcggcuggcagcaggagaacaagccccacgugcugcuguucgaccagacccccaucgugccccugcuguacaagcugaccgccuucgccuacaaggacuaccugagcuucggcuacguguacgugggccugagaggcaccgaggagaugaccagaagauacaacaucaacaucuacgcccccacccugcugguguucaaggagcacaucaacagacccgccgacgugauccaggccagaggcaugaagaagcagaucaucgacgacuucaucaccagaaacaaguaccugcuggccgccagacugaccagccagaagcuguuccacgagcugugccccgugaagagaagccacagacagagaaaguacugcguggugcugcugaccgccgagaccaccaagcugagcaagcccuucgaggccuuccugagcuucgcccuggccaacacccaggacaccgugagauucgugcacguguacagcaacagacagcaggaguucgccgacacccugcugcccgacagcgaggccuuccagggcaagagcgccgugagcauccuggagagaagaaacaccgccggcagagugguguacaagacccuggaggaccccuggaucggcagcgagagcgacaaguucauccugcugggcuaccuggaccagcugagaaaggaccccgcccugcugagcagcgaggccgugcugcccgaccugaccgacgagcuggcccccguguuccugcugagaugguucuacagcgccagcgacuacaucagcgacugcugggacagcaucuuccacaacaacuggagagagaugaugccccugcugagccugaucuucagcgcccuguucauccuguucggcaccgugaucgugcaggccuucagcgacagcaacgacgagagagagagcagcccccccgagaaggaggaggcccaggagaagaccggcaagaccgagcccagcuucaccaaggagaacagcagcaagauccccaagaagggcuucguggaggugaccgagcugaccgacgugaccuacaccagcaaccuggugagacugagacccggccacaugaacguggugcugauccugagcaacagcaccaagaccagccugcugcagaaguucgcccuggagguguacaccuucaccggcagcagcugccugcacuucagcuuccugagccuggacaagcacagagaguggcuggaguaccugcuggaguucgcccaggacgccgcccccauccccaaccaguacgacaagcacuucauggagagagacuacaccggcuacgugcuggcccugaacggccacaagaaguacuucugccuguucaagccccagaagaccguggaggaggaggaggccaucggcagcugcagcgacguggacagcagccuguaccugggcgagagcagaggcaagcccagcugcggccugggcagcagacccaucaagggcaagcugagcaagcugagccuguggauggagagacugcuggagggcagccugcagagauucuacauccccagcuggcccgagcuggacuga

SEQ ID NO: 8240 - RNA, 2349 nt, Artificial Sequence
  derived and/or modified sequence opt5 from DJC16__Homo_sapiens__AAH47363
auggaggugagaaagcugagcaucuccuggcaguuccucauuguccugguucuuauccugcaaauucucucugcccuggacuuugaucccuaccgggugcuuggcgugagccgcaccgcuucccaggccgacaucaaaaaggcguauaaaaagcuggcuagagaauggcacccugauaaaaacaaggacccgggggccgaggauaaguucauucagaucucuaaagccuacgaaauccucagcaaugaggaaaagcgguccaacuaugaccaguacggagaugcuggcgagaaucaaggguaucagaaacagcagcaacagcgcgaguacagauuucggcauuuccacgaaaacuuuuauuucgacgagucuuucuuccauuuucccuucaauagcgaacgcagagauuccauugacgagaaguaccugcugcacuuuagccauuacgucaacgaggugguuccugauucuuucaaaaagcccuaucucaucaagauuacauccgacuggugcuuuagcuguauccacauugaaccuguguggaaagaggucauccaggaacuggaggaacuuggagugggcauugggguugugcacgccggauacgagcggcgccuggcucaucaccucggcgcccauucuacgcccuccauccugggcaucauuaaugggaagaucagcuucuuccacaacgcggucgugagagagaaucuucggcaguuuguggaaucucugcucccuggaaaccuggucgagaaaguuaccaauaagaacuaugugcgcuuccuguccggcuggcaacaggaaaauaaaccgcacgugcuccuguuugaucagacacccauugucccucuucuguacaagcucaccgccuucgcuuauaaagacuaccugagcuuuggguauguguacguuggacuuagaggcacagaggaaaugacccggcgcuacaacaucaauauuuaugcccccacacugcucguguucaaggagcauaucaacagaccugcugacgucauccaagcccgggggaugaagaaacagauuaucgaugacuuuauuaccagaaacaaguaccugcuggcggcccgccucacgucccagaaacuguuccacgagcuuugccccgugaagcggucucauagacagcgcaaauauuguguugugcugcucaccgcugaaacaaccaagcugagcaagccguuugaggccuuccuuuccuuugcucuggccaauacacaagauaccguccgguucgugcacgucuacagcaacagacagcaggaauuugccgacacgcuccugccugauucugaggcuuuccagggaaaauccgcggugagcauccuggaacgccggaauacagccggcagaguuguguauaagacccucgaggaccccuggauuggcucugagagcgauaaauucauccugcuuggguaccuggaccaacuccgcaaggauccugcucugcuguccucugaagccguccuucccgaccucacagaugagcuggcccccguguuucugcuccggugguucuauagcgcuuccgacuacaucagcgacugcugggauucuauuuuucauaacaauuggagagaaaugaugccucugcuuucccugaucuucagcgcccucuuuauucuguucggaaccguuaucgugcaggcguuuucugacuccaacgaugagcgcgagagcuccccgcccgaaaaagaggaagcucaggagaagaccggcaagacagaaccuucuuucacgaaagagaauagcuccaagauucccaaaaagggguuugucgaggugaccgaacugacagacgugaccuacacaucuaaccuuguucggcucagaccuggacacaugaaugucgugcugauccugagcaacuccaccaaaacgagccuccugcagaaguucgcccuugagguguauacauuuaccgggucuuccugucugcacuucagcuuucucucucuggauaagcaucgggaauggcuggaguaccuucucgaauuugcccaagacgcugcccccauuccgaaucaguaugauaaacacuucauggagcgcgacuacaccggcuauguccuggcucugaacggacauaagaaauacuuuugccucuucaagccucagaaaacaguggaggaagaggaagccaucggcuccuguagcgauguugacucuagccuguaucuuggcgaguccagagggaagcccagcugcggacugggcucucggccuaucaaagggaagcucuccaagcugagccuguggauggaaagacuucucgagggaucccugcagcgcuuuuacauucccucuuggccugagcuggauuga

SEQ ID NO: 8241 - protein, 304 aa, Artificial Sequence
  DJC17__Homo_sapiens__Q9NVM6
MAVTKELLQMDLYALLGIEEKAADKEVKKAYRQKALSCHPDKNPDNPRAAELFHQLSQALEVLTDAAARAAYDKVRKAKKQAAERTQKLDEKRKKVKLDLEARERQAQAQESEEEEESRSTRTLEQEIERLREEGSRQLEEQQRLIREQIRQERDQRLRGKAENTEGQGTPKLKLKWKCKKEDESKGGYSKDVLLRLLQKYGEVLNLVLSSKKPGTAVVEFATVKAAELAVQNEVGLVDNPLKISWLEGQPQDAVGRSHSGLSKGSVLSERDYESLVMMRMRQAAERQQLIARMQQEDQEGPPT

SEQ ID NO: 8242 - RNA, 915 nt, Artificial Sequence
  DJC17__Homo_sapiens__AAH00048
auggcagugaccaaggagcucuuacagauggaccuguacgcgcugcuaggcauugaggagaaggcagcggacaaagagguaaagaaggcguauaggcagaaggcccucuccugccacccagacaaaaauccagauaaucccagagcagcugaacucuuccaccagcuuucucaggccuuggaggugcugaccgaugcugcagccagggcugcauaugacaaggucaggaaagccaagaagcaagcagcagagaggacccagaaacuugaugagaaaaggaagaaagugaagcuugaccuggaggcccgggagcggcaggcccaggcccaggagagugaggaggaagaggagagccggagcaccaggacacuagagcaagagaucgaacgccugagagaagaggguucccggcagcuggaggaacagcagaggcucauccgggagcagauacgccaggagcgugaccagagguugagaggaaaggcagaaaauacugaaggccaaggaacccccaaacuaaagcuaaaauggaagugcaagaaggaggaugagucaaaagguggcuacuccaaagacguccuccuacggcuuuugcagaaguauggugagguucucaaccuggugcuuuccaguaagaagccaggcacugcugugguggaguuugcaaccgucaaggcagcggagcuggcuguccagaaugaaguuggccugguggauaacccucugaagauuuccugguuggagggacagccccaggaugccgugggccgcagccacucaggacugucaaagggcucagugcugucagagagggacuacgagagccucgucaugaugcgcaugcgccaggcggccgagcggcaacagcugaucgcacggaugcagcaggaagaccaggaggggccgccuacguag

SEQ ID NO: 8243 - RNA, 915 nt, Artificial Sequence
  derived and/or modified sequence opt1 from DJC17__Homo_sapiens__AAH00048
auggccgugaccaaggagcugcuccagauggaccuguacgcccugcucggcaucgaggagaaggcggccgacaaggaggucaagaaggccuaccgccagaaggcccugagcugccaccccgacaagaaccccgacaacccccgggccgcggagcuguuccaccagcucucccaggcccuggaggugcugaccgacgccgccgcgcgcgccgccuacgacaaggugcggaaggccaagaagcaggccgcggagcgcacgcagaagcucgacgagaagcggaagaaggucaagcuggaccuggaggcccgcgagcggcaggcccaggcccaggagagcgaggaggaggaggagucccgcagcacccggacccucgagcaggagaucgagcgccugcgggaggaggggucccgccagcuggaggagcagcagcggcucauccgcgagcagauccggcaggagcgcgaccagcggcugcgcggcaaggccgagaacaccgaggggcagggcacgcccaagcugaagcucaaguggaagugcaagaaggaggacgagagcaagggcggguacuccaaggacgugcugcugcggcuccugcagaaguacggcgaggugcugaaccucguccugagcuccaagaagcccgggaccgcggugguggaguucgccaccgucaaggccgccgagcuggccgugcagaacgaggugggccucgucgacaacccgcugaagaucagcuggcuggaggggcagccccaggacgcggugggccgcucccacagcgggcucuccaagggcagcgugcuguccgagcgggacuacgagagccuggucaugaugcgcaugcgccaggccgccgagcggcagcagcucaucgcccgcaugcagcaggaggaccaggagggcccgcccaccuga

SEQ ID NO: 8244 - RNA, 915 nt, Artificial Sequence
  derived and/or modified sequence opt2 from DJC17__Homo_sapiens__AAH00048
auggccgucaccaaggagcuccuccagauggaccucuacgcccuccucggcaucgaggagaaggccgccgacaaggaggucaagaaggccuaccgccagaaggcccucuccugccaccccgacaagaaccccgacaacccccgcgccgccgagcucuuccaccagcucucccaggcccucgagguccucaccgacgccgccgcccgcgccgccuacgacaagguccgcaaggccaagaagcaggccgccgagcgcacccagaagcucgacgagaagcgcaagaaggucaagcucgaccucgaggcccgcgagcgccaggcccaggcccaggaguccgaggaggaggaggagucccgcuccacccgcacccucgagcaggagaucgagcgccuccgcgaggagggcucccgccagcucgaggagcagcagcgccucauccgcgagcagauccgccaggagcgcgaccagcgccuccgcggcaaggccgagaacaccgagggccagggcacccccaagcucaagcucaaguggaagugcaagaaggaggacgaguccaagggcggcuacuccaaggacguccuccuccgccuccuccagaaguacggcgagguccucaaccucguccucuccuccaagaagcccggcaccgccgucgucgaguucgccaccgucaaggccgccgagcucgccguccagaacgaggucggccucgucgacaacccccucaagaucuccuggcucgagggccagccccaggacgccgucggccgcucccacuccggccucuccaagggcuccguccucuccgagcgcgacuacgagucccucgucaugaugcgcaugcgccaggccgccgagcgccagcagcucaucgcccgcaugcagcaggaggaccaggagggcccccccaccuga

SEQ ID NO: 8245 - RNA, 915 nt, Artificial Sequence
  derived and/or modified sequence opt3 from DJC17__Homo_sapiens__AAH00048
auggccgugaccaaggagcugcuccagauggaccuuuacgcucuguugggcaucgaagagaaagcagccgauaaggaagucaaaaaggcguauagacaaaaggcuuuaagcugccaccccgacaagaacccugauaauccaagggccgcagagcuguuccaucagcuaucccaggcccucgaaguucugacagacgcugcagcccgggcugccuacgauaaggugcgcaaagcgaagaaacaggcagccgagcgaacucaaaaacuugacgagaaacguaagaagguaaaacuggauuuggaagcuagagagaggcaggcccaggcacaggaaucugaggaggaagaggaaucacggaguacgcgcacccucgagcaagaaauugagagacugagggaggaagggagccggcagcuggaggaacagcagcgccucauacgagagcaaaucagacaggaaagggaccagcgguuacguggaaaggcugagaacacagagggucaaggcacuccgaaacugaaacuuaaauggaaguguaaaaaggaagaugaguccaaagggggauauucuaaggacguguugcugcgccuacuccagaaguacggcgaaguccugaaucuugugcugucgucaaagaagcccgguaccgccguuguggaguuugcgacagucaaagccgcagaauuggcugugcagaacgagguagggcucguugauaauccucugaagauuagcugguuagagggacagccacaagacgccgugggcagaagucacuccggccugucuaaggggagcguccucuccgaaagggauuaugagucacuugugaugaugcggaugcgacaggcugccgaacgccagcagcugaucgcaagaaugcaacaggaggaccaggagggacccccuaccuga

SEQ ID NO: 8246 - RNA, 915 nt, Artificial Sequence
  derived and/or modified sequence opt4 from DJC17__Homo_sapiens__AAH00048
auggccgugaccaaggagcugcugcagauggaccuguacgcccugcugggcaucgaggagaaggccgccgacaaggaggugaagaaggccuacagacagaaggcccugagcugccaccccgacaagaaccccgacaaccccagagccgccgagcuguuccaccagcugagccaggcccuggaggugcugaccgacgccgccgccagagccgccuacgacaaggugagaaaggccaagaagcaggccgccgagagaacccagaagcuggacgagaagagaaagaaggugaagcuggaccuggaggccagagagagacaggcccaggcccaggagagcgaggaggaggaggagagcagaagcaccagaacccuggagcaggagaucgagagacugagagaggagggcagcagacagcuggaggagcagcagagacugaucagagagcagaucagacaggagagagaccagagacugagaggcaaggccgagaacaccgagggccagggcacccccaagcugaagcugaaguggaagugcaagaaggaggacgagagcaagggcggcuacagcaaggacgugcugcugagacugcugcagaaguacggcgaggugcugaaccuggugcugagcagcaagaagcccggcaccgccgugguggaguucgccaccgugaaggccgccgagcuggccgugcagaacgaggugggccugguggacaacccccugaagaucagcuggcuggagggccagccccaggacgccgugggcagaagccacagcggccugagcaagggcagcgugcugagcgagagagacuacgagagccuggugaugaugagaaugagacaggccgccgagagacagcagcugaucgccagaaugcagcaggaggaccaggagggcccccccaccuga

SEQ ID NO: 8247 - RNA, 915 nt, Artificial Sequence
  derived and/or modified sequence opt5 from DJC17__Homo_sapiens__AAH00048
auggccgugaccaaggagcugcuccagauggaccuguacgcccuucugggcaucgaagagaaagcugcggauaaggaagucaaaaaggcuuauagacaaaaagcccucagcugccaccccgacaagaacccugauaauccgcgggccgcugagcuguuccaucagcuuucccaggcccuggaaguucucacagacgcugccgcgcgcgccgcuuacgauaaggugagaaaagccaagaaacaggcugccgagcggacgcaaaagcuggacgagaaacgcaagaaggugaaacuggaucucgaagcgagagagcggcaggcccaggcucaggaaucugaggaggaagaggaaagccgcuccaccagaacacuggagcaagaaauugagcggcuucgcgaggaagggucuagacagcuggaggaacagcagcggcucauccgcgagcaaauuagacaggaacgggaccagcgccugagaggaaaggccgagaacaccgagggccaagggacacccaaacuuaagcugaaauggaaguguaaaaaggaagaugagagcaagggaggcuauuccaaagacguccuccugcggcugcuccagaaguacggggaagugcugaaucuuguucugucuagcaaaaagccuggaaccgcuguggucgaguuugccacagugaaagccgcugaacucgcgguucagaacgaggugggccuggucgauaauccccuuaagaucuccuggcuggagggccagccucaagacgccguggggagaagccacucuggacucuccaagggcagcgugcugucugaacgcgauuaugagucccuggucaugaugcggaugagacaggcugccgaacgccagcagcucauugcccggaugcaacaggaggaccaggaggggcccccuaccuga

SEQ ID NO: 8248 - protein, 358 aa, Artificial Sequence
  DJC18__Homo_sapiens__Q9H819
MAATLGSGERWTEAYIDAVRRNKYPEDTPPESHDPCGCCNCMKAQKEKKSENEWTQTRQGEGNSTYSEEQLLGVQRIKKCRNYYEILGVSRDASDEELKKAYRKLALKFHPDKNCAPGATDAFKAIGNAFAVLSNPDKRLRYDEYGDEQVTFTAPRARPYNYYRDFEADITPEELFNVFFGGHFPTGNIHMFSNVTDDTYYYRRRHRHERTQTQKEEEEEKPQTTYSAFIQLLPVLVIVIISVITQLLATNPPYSLFYKSTLGYTISRETQNLQVPYFVDKNFDKAYRGASLHDLEKTIEKDYIDYIQTSCWKEKQQKSELTNLAGLYRDERLKQKAESLKLENCEKLSKLIGLRRGG

SEQ ID NO: 8249 - RNA, 1077 nt, Artificial Sequence
  DJC18__Homo_sapiens__AAH30162
auggcggcgacucugggcagcggggagcgcuggacggaagcuuacauugacgcaguuagaagaaacaaauacccagaagacacaccuccugagagucaugaccccuguggcugcuguaacugcaugaaggcacaaaaggaaaagaagucugagaaugaguggacucagacccggcagggugaggggaacuccacguacagugaggaacagcugcuugggguacaaaggaucaagaaaugcagaaauuacuaugaaauucugggaguuucucgagaugcuagugacgaagagcuuaagaaagcuuacagaaaacucgcccugaaauuucacccugacaagaacugugcuccuggagcaacagaugcuuucaaagcaauaggaaaugcauuugcaguccugagcaauccugauaagagacuucgcuaugaugaauacggagaugaacaggugacuuucacugccccucgagccagaccuuauaauuauuacagggauuuugaagcugacaucacuccagaagagcuguucaacgucuucuuuggaggacauuuuccuacaggaaauauucauauguuuucaaaugugacagaugacacuuacuauuaccgucgacggcaccgacaugagaggacacagacucagaaggaggaggaagaagagaaaccucagacuacauauucugcauuuauucagcuacuuccaguucuugugauugugauuauaucugucauuacucagcugcuggcuacuaaucccccauauagucuguucuauaaaucgaccuugggcuacaccauuucuagagaaacucagaaccugcaggugccuuacuuuguggauaaaaacuuugacaaggccuacagaggagcuucucugcaugacuuggagaaaacaauagagaaggauuacauugauuauauccagacuaguuguuggaaggagaaacaacaaaagucagagcugacaaauuuggcaggauuauacagagaugaacgauugaaacagaaagcagagucgcugaaacuugaaaacugugagaaacuuuccaaacucauuggccuacgcagagguggcuga

SEQ ID NO: 8250 - RNA, 1077 nt, Artificial Sequence
  derived and/or modified sequence opt1 from DJC18__Homo_sapiens__AAH30162
auggccgccacccugggcagcggggagcgcuggaccgaggcguacaucgacgccgugcggcgcaacaaguaccccgaggacacgccgcccgagucccacgaccccugcggcugcugcaacugcaugaaggcccagaaggagaagaaguccgagaacgaguggacccagacccggcagggggagggcaacagcaccuacagcgaggagcagcuccuggggguccagcgcaucaagaagugccggaacuacuacgagauccugggcgugucccgcgacgccagcgacgaggagcucaagaaggccuaccggaagcuggcgcugaaguuccaccccgacaagaacugcgccccgggcgccacggacgccuucaaggcgaucgggaacgccuucgccgugcucuccaaccccgacaagcgccugcgguacgacgaguacggcgacgagcaggucaccuucaccgcgccccgcgcccggcccuacaacuacuaccgcgacuucgaggccgacaucaccccggaggagcuguucaacguguucuucgggggccacuuccccacggggaacauccacauguucagcaacgugaccgacgacaccuacuacuaccggcgccggcaccgccacgagcggacccagacgcagaaggaggaggaggaggagaagccccagaccaccuacuccgccuucauccagcuccugcccguccuggugaucgugaucaucagcgucaucacccagcuccuggccacgaacccgcccuacucccuguucuacaagagcacccucggcuacaccaucucccgcgagacccagaaccuccaggugcccuacuucguggacaagaacuucgacaaggccuaccggggcgccagccugcacgaccuggagaagacgaucgagaaggacuacaucgacuacauccagaccuccugcuggaaggagaagcagcagaaguccgagcugaccaaccuggcggggcucuaccgcgacgagcggcugaagcagaaggccgagagccugaagcucgagaacugcgagaagcugagcaagcugaucggccuccgccgcgggggcuga

SEQ ID NO: 8251 - RNA, 1077 nt, Artificial Sequence
  derived and/or modified sequence opt2 from DJC18__Homo_sapiens__AAH30162
auggccgccacccucggcuccggcgagcgcuggaccgaggccuacaucgacgccguccgccgcaacaaguaccccgaggacaccccccccgagucccacgaccccugcggcugcugcaacugcaugaaggcccagaaggagaagaaguccgagaacgaguggacccagacccgccagggcgagggcaacuccaccuacuccgaggagcagcuccucggcguccagcgcaucaagaagugccgcaacuacuacgagauccucggcgucucccgcgacgccuccgacgaggagcucaagaaggccuaccgcaagcucgcccucaaguuccaccccgacaagaacugcgcccccggcgccaccgacgccuucaaggccaucggcaacgccuucgccguccucuccaaccccgacaagcgccuccgcuacgacgaguacggcgacgagcaggucaccuucaccgccccccgcgcccgccccuacaacuacuaccgcgacuucgaggccgacaucacccccgaggagcucuucaacgucuucuucggcggccacuuccccaccggcaacauccacauguucuccaacgucaccgacgacaccuacuacuaccgccgccgccaccgccacgagcgcacccagacccagaaggaggaggaggaggagaagccccagaccaccuacuccgccuucauccagcuccuccccguccucgucaucgucaucaucuccgucaucacccagcuccucgccaccaacccccccuacucccucuucuacaaguccacccucggcuacaccaucucccgcgagacccagaaccuccagguccccuacuucgucgacaagaacuucgacaaggccuaccgcggcgccucccuccacgaccucgagaagaccaucgagaaggacuacaucgacuacauccagaccuccugcuggaaggagaagcagcagaaguccgagcucaccaaccucgccggccucuaccgcgacgagcgccucaagcagaaggccgagucccucaagcucgagaacugcgagaagcucuccaagcucaucggccuccgccgcggcggcuga

SEQ ID NO: 8252 - RNA, 1077 nt, Artificial Sequence
  derived and/or modified sequence opt3 from DJC18__Homo_sapiens__AAH30162
auggccgcuacccugggcagcggggagagauggacagaagcauacaucgacgccgugaggcggaacaaguaucccgaggauacuccuccagaaucccacgacccgugcggauguugcaauuguaugaaagcgcagaaggagaaaaagucugaaaacgaguggacgcaaacccgccagggugagggcaauucaacauacagugaggaacagcuccuugggguccagcgaauuaaaaagugccguaacuauuacgaaauacugggaguuagcagagaugcuuccgacgaggaguugaagaaagccuauaggaaguuagcacugaaauuccaucccgauaagaauugugccccuggcgcuacugacgcauuuaaagccaucgguaacgcuuucgccgugcuaucuaauccagauaagcggcuccgcuacgacgaauauggggaugagcaaguaaccuuuacagcgcccagagcaaggccuuacaacuacuaucgggacuucgaagccgauauuaccccagaggaacuguuuaauguguucuuuggaggccacuuccccacuggcaacauccauauguuuucgaaugucacagacgauaccuacuauuaccgccgaagacacaggcaugagcggacgcagacucagaaggaggaagaggaagagaaaccucagaccacauauucagcuuucauucaacuucugccaguguugguuaucgugauaaucagcgucauuacucagcuccuggccaccaacccgcccuacagucuguuuuauaaguccacacucggguacaccaucucucgugaaacgcagaauuuacaggugccuuacuucguagacaaaaacuuugacaaggcauaucgcggagcuagccugcacgaucuugagaaaacuauugagaaggacuacaucgauuauauacaaacauccugcuggaaagaaaagcagcagaagucagaguugaccaaucuggccggucuauacagagacgaaaggcucaaacaaaaggcggagagucugaaacuugaaaacugugagaagcugagcaaauugauuggccuccggcgagggggauga

SEQ ID NO: 8253 - RNA, 1077 nt, Artificial Sequence
  derived and/or modified sequence opt4 from DJC18__Homo_sapiens__AAH30162
auggccgccacccugggcagcggcgagagauggaccgaggccuacaucgacgccgugagaagaaacaaguaccccgaggacaccccccccgagagccacgaccccugcggcugcugcaacugcaugaaggcccagaaggagaagaagagcgagaacgaguggacccagaccagacagggcgagggcaacagcaccuacagcgaggagcagcugcugggcgugcagagaaucaagaagugcagaaacuacuacgagauccugggcgugagcagagacgccagcgacgaggagcugaagaaggccuacagaaagcuggcccugaaguuccaccccgacaagaacugcgcccccggcgccaccgacgccuucaaggccaucggcaacgccuucgccgugcugagcaaccccgacaagagacugagauacgacgaguacggcgacgagcaggugaccuucaccgcccccagagccagacccuacaacuacuacagagacuucgaggccgacaucacccccgaggagcuguucaacguguucuucggcggccacuuccccaccggcaacauccacauguucagcaacgugaccgacgacaccuacuacuacagaagaagacacagacacgagagaacccagacccagaaggaggaggaggaggagaagccccagaccaccuacagcgccuucauccagcugcugcccgugcuggugaucgugaucaucagcgugaucacccagcugcuggccaccaacccccccuacagccuguucuacaagagcacccugggcuacaccaucagcagagagacccagaaccugcaggugcccuacuucguggacaagaacuucgacaaggccuacagaggcgccagccugcacgaccuggagaagaccaucgagaaggacuacaucgacuacauccagaccagcugcuggaaggagaagcagcagaagagcgagcugaccaaccuggccggccuguacagagacgagagacugaagcagaaggccgagagccugaagcuggagaacugcgagaagcugagcaagcugaucggccugagaagaggcggcuga

SEQ ID NO: 8254 - RNA, 1077 nt, Artificial Sequence
  derived and/or modified sequence opt5 from DJC18__Homo_sapiens__AAH30162
auggccgcuacccugggcagcggggagagauggacagaagccuacaucgacgcggugcggcgcaacaaguaucccgaggauacgccuccggaaucccacgaccccugcggauguugcaauuguaugaaagcucagaaggagaaaaagucugaaaacgaguggacccaaacaagacagggcgaggggaauagcaccuacuccgaggaacagcuccugggaguccagcggauuaaaaagugccgcaacuauuacgaaauccuuggcguuucuagagaugccagcgacgaggagcugaagaaagccuaucggaagcucgcucugaaauuccauccugauaagaauugugcccccggggcuacagacgccuuuaaagcgauuggaaacgccuucgcugugcuuuccaauccugauaagcgccugagauacgacgaauauggcgaugagcaagugaccuuuacagcuccccgggcccgcccuuacaacuacuauagagacuucgaagccgauaucaccccggaggaacucuuuaaugucuucuuuggcgggcacuuccccacgggaaacauucauauguuuucuaaugugaccgacgauacauacuauuaccggcgcagacaccggcaugagcgcacccagacacagaaggaggaagaggaagagaaaccucagaccacguauagcgcguucauccaacugcugcccguucucgugaucgucauuaucuccgugauuacacagcugcuugccaccaacccucccuacagccuguuuuauaagucuacacucggcuacaccaucuccagagaaacccagaaucugcagguuccguacuucguggacaaaaacuuugacaaggcuuauagaggggccagccuucacgaucuggagaaaacaauugagaaggacuacaucgauuauauucaaacgucuugcuggaaagaaaagcagcagaaguccgagcucaccaaucuggcuggacuguaccgggacgaacgccucaaacaaaaggccgagagccugaaacuugaaaacugugagaagcugucuaaacucaucggccugcggagagggggauga

SEQ ID NO: 8255 - protein, 341 aa, Artificial Sequence
  DJC22__Homo_sapiens__Q8N4W6
MAKGLLVTYALWAVGGPAGLHHLYLGRDSHALLWMLTLGGGGLGWLWEFWKLPSFVAQANRAQGQRQSPRGVTPPLSPIRFAAQVIVGIYFGLVALISLSSMVNFYIVALPLAVGLGVLLVAAVGNQTSDFKNTLGSAFLTSPIFYGRPIAILPISVAASITAQRHRRYKALVASEPLSVRLYRLGLAYLAFTGPLAYSALCNTAATLSYVAETFGSFLNWFSFFPLLGRLMEFVLLLPYRIWRLLMGETGFNSSCFQEWAKLYEFVHSFQDEKRQLAYQVLGLSEGATNEEIHRSYQELVKVWHPDHNLDQTEEAQRHFLEIQAAYEVLSQPRKPWGSRR

SEQ ID NO: 8256 - RNA, 1026 nt, Artificial Sequence
  DJC22__Homo_sapiens__AAH33236
auggccaaggggcuccuggugaccuaugcccucugggcuguggggggcccugcugggcuccaccaccuguaccugggaagggacagccacgcccugcucuggaugcugacccuggggggaggugggcugggcuggcucugggaguucuggaagcucccaagcuuuguagcucaggccaacagagcccagggacagaggcagagccccagaggggugacacccccucugagucccauucgcuuugcugcccaggugauaguuggcaucuauuuuggccuuguggcacugauuagccuuucuuccauggucaacuucuauauuguggcccucccacuggcaguuggcuuaggggucuugcugguggcugcuguuggcaaccagaccucagacuuuaagaacacucuggggucagcauuucucacuucaccuaucuucuauggccgccccauagccauacugcccauuagcguggccgccagcauuacagcucagaggcaucgccgcuacaaagcuuugguggcaucagagccgcucagugugcggcucuaucgucugggcuuggcuuaccuugcuuucacaggcccacuggcauacagugcccucugcaacacagcugccacccucagcuauguggcagaaaccuuuggcuccuucuugaauugguucagcuucuucccccuucuuggccgccucauggaguuuguccuccuucugccuuaccggaucuggaggcuacugaugggggagacuggcuucaacagcagcugcuuucaggagugggcgaagcucuaugaguuuguucacaguuuucaggaugagaagcgucagcuggcuuaccagguuuugggccucucagaaggggcaacaaaugaagaaauacaucggaguuaccaggagcuagugaaggucuggcacccagaccacaaccuggaccagacagaggaggcacagaggcacuuccuggagauccaggcugcguaugaaguccugagucaacccaggaagcccuggggaucccggagguga

SEQ ID NO: 8257 - RNA, 1026 nt, Artificial Sequence
  derived and/or modified sequence opt1 from DJC22__Homo_sapiens__AAH33236
auggccaagggccugcucgugaccuacgcccugugggcggucgggggccccgccgggcugcaccaccucuaccugggccgcgacagccacgcccugcucuggaugcugacccucgggggcggcgggcugggcuggcugugggaguucuggaagcugccguccuucguggcccaggccaaccgggcgcaggggcagcgccagagcccccggggcgugacgccgccccucucccccauccgcuucgccgcccaggucaucguggggaucuacuucggccugguggcccugaucagccucuccagcauggucaacuucuacaucguggcgcugccccuggccgugggccucgggguccugcugguggccgccgugggcaaccagaccuccgacuucaagaacacccucgggagcgccuuccugaccucccccaucuucuacggccggcccaucgcgauccugccgaucagcgucgccgccuccaucacggcccagcgccaccggcgcuacaaggcccucguggcgagcgagccccuguccgugcggcuguaccgccucggccuggccuaccuggccuucaccgggccccucgccuacagcgcccugugcaacaccgcggccacccuguccuacgucgccgagacguucggcagcuuccucaacugguucuccuucuucccccugcuggggcggcucauggaguucgugcugcugcucccguaccgcaucuggcggcugcugaugggcgagaccggguucaacagcuccugcuuccaggagugggccaagcucuacgaguucgugcacagcuuccaggacgagaagcgccagcuggccuaccagguccugggccucagcgagggcgcgaccaacgaggagauccaccgguccuaccaggagcuggugaagguguggcaccccgaccacaaccuggaccagaccgaggaggcccagcgccacuuccucgagauccaggccgccuacgagguccugagccagccccggaagcccugggggucccgccgguga

SEQ ID NO: 8258 - RNA, 1026 nt, Artificial Sequence
  derived and/or modified sequence opt2 from DJC22__Homo_sapiens__AAH33236
auggccaagggccuccucgucaccuacgcccucugggccgucggcggccccgccggccuccaccaccucuaccucggccgcgacucccacgcccuccucuggaugcucacccucggcggcggcggccucggcuggcucugggaguucuggaagcuccccuccuucgucgcccaggccaaccgcgcccagggccagcgccaguccccccgcggcgucacccccccccucucccccauccgcuucgccgcccaggucaucgucggcaucuacuucggccucgucgcccucaucucccucuccuccauggucaacuucuacaucgucgcccucccccucgccgucggccucggcguccuccucgucgccgccgucggcaaccagaccuccgacuucaagaacacccucggcuccgccuuccucaccucccccaucuucuacggccgccccaucgccauccuccccaucuccgucgccgccuccaucaccgcccagcgccaccgccgcuacaaggcccucgucgccuccgagccccucuccguccgccucuaccgccucggccucgccuaccucgccuucaccggcccccucgccuacuccgcccucugcaacaccgccgccacccucuccuacgucgccgagaccuucggcuccuuccucaacugguucuccuucuucccccuccucggccgccucauggaguucguccuccuccuccccuaccgcaucuggcgccuccucaugggcgagaccggcuucaacuccuccugcuuccaggagugggccaagcucuacgaguucguccacuccuuccaggacgagaagcgccagcucgccuaccagguccucggccucuccgagggcgccaccaacgaggagauccaccgcuccuaccaggagcucgucaaggucuggcaccccgaccacaaccucgaccagaccgaggaggcccagcgccacuuccucgagauccaggccgccuacgagguccucucccagccccgcaagcccuggggcucccgccgcuga

SEQ ID NO: 8259 - RNA, 1026 nt, Artificial Sequence
  derived and/or modified sequence opt3 from DJC22__Homo_sapiens__AAH33236
auggccaagggccugcucgugaccuacgcucuuugggcagucgggggacccgccggucugcaccauuuguauuuaggcagagacagccacgcgcugcuauggaugcucacacuugggggaggcggucugggguggcugugggaguucuggaaauugccuuccuuuguugcucaggccaacagggcacaaggacagcggcagucuccacgcggcgugacuccgccccucucaccuauccgauucgccgcucagguaauugugggcauauacuuugggcuggucgcacugaucagucucagcuccauggugaauuucuauauuguugccuuaccacuggcugugggacuuggugucuugcugguggccgcgguaggcaaccaaacgucugauuuuaagaauacccuagggucggcauuccucacaucacccaucuuuuacggacguccuauugccauccugccaauaagcguugcugccaguaucacugcacagagacauaggcgguauaaagcucuuguggccuccgaaccccugucuguccgcuuguacagacucggccuggcguauuuagccuucaccgguccucuggcauacagcgcucucugcaacacagccgcuacccuuuccuacguggccgagacuuuugggucauuccugaauugguuuaguuucuuuccauugcuaggaaggcugauggaguucgugcuccugcuuccguaucggauuuggcgccuguugaugggcgaaacaggcuucaacagcucuuguuuucaggaaugggcaaagcucuacgaguucguccacuccuuucaggacgagaaacgacaacuggccuaucagguuuuagggcugucagaaggagcuaccaaugaggaaauccauagaagcuaccaggagcuagugaagguauggcaccccgaucacaaccucgaccagacggaggaagcgcaaaggcauuuccuggagauucaggcagccuaugaagugcuuagucagccucggaagccaugggguucucgucgcuga

SEQ ID NO: 8260 - RNA, 1026 nt, Artificial Sequence
  derived and/or modified sequence opt4 from DJC22__Homo_sapiens__AAH33236
auggccaagggccugcuggugaccuacgcccugugggccgugggcggccccgccggccugcaccaccuguaccugggcagagacagccacgcccugcuguggaugcugacccugggcggcggcggccugggcuggcugugggaguucuggaagcugcccagcuucguggcccaggccaacagagcccagggccagagacagagccccagaggcgugacccccccccugagccccaucagauucgccgcccaggugaucgugggcaucuacuucggccugguggcccugaucagccugagcagcauggugaacuucuacaucguggcccugccccuggccgugggccugggcgugcugcugguggccgccgugggcaaccagaccagcgacuucaagaacacccugggcagcgccuuccugaccagccccaucuucuacggcagacccaucgccauccugcccaucagcguggccgccagcaucaccgcccagagacacagaagauacaaggcccugguggccagcgagccccugagcgugagacuguacagacugggccuggccuaccuggccuucaccggcccccuggccuacagcgcccugugcaacaccgccgccacccugagcuacguggccgagaccuucggcagcuuccugaacugguucagcuucuucccccugcugggcagacugauggaguucgugcugcugcugcccuacagaaucuggagacugcugaugggcgagaccggcuucaacagcagcugcuuccaggagugggccaagcuguacgaguucgugcacagcuuccaggacgagaagagacagcuggccuaccaggugcugggccugagcgagggcgccaccaacgaggagauccacagaagcuaccaggagcuggugaagguguggcaccccgaccacaaccuggaccagaccgaggaggcccagagacacuuccuggagauccaggccgccuacgaggugcugagccagcccagaaagcccuggggcagcagaagauga

SEQ ID NO: 8261 - RNA, 1026 nt, Artificial Sequence
  derived and/or modified sequence opt5 from DJC22__Homo_sapiens__AAH33236
auggccaagggccugcucgugaccuacgcucugugggccgucgggggacccgcgggccuucaccaucuguaucucgggagagacagccacgcucugcuuuggaugcugacacucggaggcgggggacugggcuggcugugggaguucuggaaacucccuuccuuuguugcccaggccaaccgggcucaaggccagcgccagucuccgagaggggugacgcccccucugagccccauccgguucgccgcucaggugauugucggaaucuacuuuggccuuguggcccugauuucccucucuagcaugguuaauuucuauaucguggcgcugccucuugccgucgggcugggagugcuccugguugcugccgugggcaaccaaaccuccgauuuuaagaauacacuggggucugcuuuccucaccagccccauuuucuacggacgcccuaucgccauccugccgauuuccgucgcggccagcaucacagcucagagacaucggcgcuauaaagcccuuguggcuucugaaccccuguccgugagacucuaccggcugggccuugccuaucuggccuucaccggcccucucgcuuacagcgcgcugugcaacacagccgcuacccugucuuacgucgccgagacguuuggguccuuccucaauugguuuagcuucuuuccccugcuuggacgccugauggaauuuguucuccugcuuccuuauagaauuuggcggcugcucaugggcgagaccggguucaacucuuccuguuuucaggaaugggccaagcuguacgaguucgugcacagcuuucaggacgagaaacgccaacuggcuuaucaggugcucggacuguccgaaggcgccacaaaugaggaaauccauagaucuuaccaggagcuugucaagguguggcaccccgaucacaaccuggaccagaccgaggaagcgcaacggcauuuccucgagauucaggcugccuaugaaguucugagccagccgcgcaagccuuggggguccagacgguga

SEQ ID NO: 8262 - protein, 148 aa, Artificial Sequence
  DJC24__Homo_sapiens__Q6P3W2
MAVEQMPKKDWYSILGADPSANISDLKQKYQKLILMYHPDKQSTDVPAGTVEECVQKFIEIDQAWKILGNEETKREYDLQRCEDDLRNVGPVDAQVYLEEMSWNEGDHSFYLSCRCGGKYSVSKDEAEEVSLISCDTCSLIIELLHYN

SEQ ID NO: 8263 - RNA, 447 nt, Artificial Sequence
  DJC24__Homo_sapiens__AAH63804
auggcgguugagcagaugccaaaaaaggauugguacagcauccugggagcagacccaucugcaaauauaucagaccuaaaacaaaaauaucaaaaacucauauuaauguaucauccagauaaacaaaguacagauguaccagcaggaacaguggaggaauguguacagaaguucaucgaaauugaucaagcauggaaaauucuaggaaaugaagagacaaaaagagaguaugaccugcagcggugugaagaugaucuaagaaauguaggaccaguagaugcucaaguauaucuugaagaaaugucuuggaaugaaggugaucacucuuuuuaucugaguugcagaugugguggaaaauacaguguuuccaaggaugaagcggaagaaguuagccugauuucuugugauacauguucacuaauuauagaacuccuucauuauaacuaa

SEQ ID NO: 8264 - RNA, 447 nt, Artificial Sequence
  derived and/or modified sequence opt1 from DJC24__Homo_sapiens__AAH63804
auggccguggagcagaugcccaagaaggacugguacagcauccugggcgccgacccguccgcgaacaucagcgaccucaagcagaaguaccagaagcugauccugauguaccaccccgacaagcaguccaccgacguccccgccgggaccguggaggagugcgugcagaaguucaucgagaucgaccaggccuggaagauccucggcaacgaggagaccaagcgcgaguacgaccugcagcggugcgaggacgaccugcgcaacgucgggcccguggacgcccagguguaccucgaggagaugagcuggaacgagggcgaccacuccuucuaccugagcugccggugcgggggcaaguacuccgucagcaaggacgaggccgaggaggugucccugaucagcugcgacacgugcucccucaucaucgagcugcugcacuacaacuga

SEQ ID NO: 8265 - RNA, 447 nt, Artificial Sequence
  derived and/or modified sequence opt2 from DJC24__Homo_sapiens__AAH63804
auggccgucgagcagaugcccaagaaggacugguacuccauccucggcgccgaccccuccgccaacaucuccgaccucaagcagaaguaccagaagcucauccucauguaccaccccgacaagcaguccaccgacguccccgccggcaccgucgaggagugcguccagaaguucaucgagaucgaccaggccuggaagauccucggcaacgaggagaccaagcgcgaguacgaccuccagcgcugcgaggacgaccuccgcaacgucggccccgucgacgcccaggucuaccucgaggagauguccuggaacgagggcgaccacuccuucuaccucuccugccgcugcggcggcaaguacuccgucuccaaggacgaggccgaggaggucucccucaucuccugcgacaccugcucccucaucaucgagcuccuccacuacaacuga

SEQ ID NO: 8266 - RNA, 447 nt, Artificial Sequence
  derived and/or modified sequence opt3 from DJC24__Homo_sapiens__AAH63804
auggccguggagcagaugcccaagaaagacugguacagcauccugggcgcugauccuuccgcaaacauuucugaccucaagcaaaaauaucagaaacuuauacugauguaccacccagauaagcagucaaccgacgucccggccgggacaguugaagagugcgugcagaaguucaucgaaauugaucaagcguggaagaucuugggaaaugaggaaacuaaaagagaguaugacuuacagaggugugaggaugaccugcggaacguaggucccguggaugcucaggucuaccuagaagagaugaguuggaaugaaggcgaccauagcuuuuaucucuccugccgcugugggggaaaguacucugugucgaaagaugaggccgaggaaguuucacugauuagcugcgacacguguagucuuaucauagagcuguugcacuauaacuga

SEQ ID NO: 8267 - RNA, 447 nt, Artificial Sequence
  derived and/or modified sequence opt4 from DJC24__Homo_sapiens__AAH63804
auggccguggagcagaugcccaagaaggacugguacagcauccugggcgccgaccccagcgccaacaucagcgaccugaagcagaaguaccagaagcugauccugauguaccaccccgacaagcagagcaccgacgugcccgccggcaccguggaggagugcgugcagaaguucaucgagaucgaccaggccuggaagauccugggcaacgaggagaccaagagagaguacgaccugcagagaugcgaggacgaccugagaaacgugggccccguggacgcccagguguaccuggaggagaugagcuggaacgagggcgaccacagcuucuaccugagcugcagaugcggcggcaaguacagcgugagcaaggacgaggccgaggaggugagccugaucagcugcgacaccugcagccugaucaucgagcugcugcacuacaacuga

SEQ ID NO: 8268 - RNA, 447 nt, Artificial Sequence
  derived and/or modified sequence opt5 from DJC24__Homo_sapiens__AAH63804
auggccguggagcagaugcccaagaaagacugguacagcauccugggcgcugauccuuccgccaacauuucugaccucaagcaaaaauaucagaagcugauccuuauguaccacccggauaaacagagcaccgacguccccgcggggacaguugaagagugcgugcagaaguucauugaaaucgaucaggcuuggaagauucugggaaaugaggaaacgaaaagagaguaugaccuccaacggugugaggaugaccugcgcaacgugggcccugucgaugcccagguguaccuugaagagauguccuggaaugaaggggaccauucuuuuuaucugagcugcagauguggaggcaaguacuccguuucuaaagaugaggccgaggaagugagccucaucuccugcgacaccuguagccugaucauugagcugcuccacuauaacuga

SEQ ID NO: 8269 - protein, 360 aa, Artificial Sequence
  DJC25__Homo_sapiens__Q9H1X3
MGAPLLSPGWGAGAAGRRWWMLLAPLLPALLLVRPAGALVEGLYCGTRDCYEVLGVSRSAGKAEIARAYRQLARRYHPDRYRPQPGDEGPGRTPQSAEEAFLLVATAYETLKDEETRKDYDYMLDHPEEYYSHYYHYYSRRLAPKVDVRVVILVSVCAISVFQFFSWWNSYNKAISYLATVPKYRIQATEIAKQQGLLKKAKEKGKNKKSKEEIRDEEENIIKNIIKSKIDIKGGYQKPQICDLLLFQIILAPFHLCSYIVWYCRWIYNFNIKGKEYGEEERLYIIRKSMKMSKSQFDSLEDHQKETFLKRELWIKENYEVYKQEQEEELKKKLANDPRWKRYRRWMKNEGPGRLTFVDD

SEQ ID NO: 8270 - RNA, 1083 nt, Artificial Sequence
  DJC25__Homo_sapiens__AAH48318
augggggcgccgcugcucucucccggcuggggagccggggcugccggccggcgcugguggaugcugcuggcgccccugcugccggcgcugcugcuggugcggcccgcgggggcccugguggaggggcucuacugcggcacgcgggacugcuacgaggugcugggcgugagccgcucggcgggcaaggcggagaucgcgcgggccuaccgccagcuggcccggcgcuaccacccugaccgcuaccggccccagcccggagacgagggccccgggcggacgccgcagagcgccgaggaggcuuuccugcugguggcaaccgccuacgagacacucaaggaugaagaaacacgaaaagauuaugauuacaugcuggaucauccagaagaguacuacagccauuacuaccacuacuauagcaggcgcuuggccccuaagguggauguuagaguagugauuuuggucagcgugugugcuauuucgguguuucaguuuuucagcugguggaauagcuacaauaaggcaaucagcuaccuagccacagugcccaaguaccguauccaagcuacagagauugccaagcagcagggacugcucaaaaaagccaaagaaaaaggcaaaaacaaaaaguccaaagaagaaauucgugacgaggaggagaacaucauaaagaacauuauaaaaaguaaaauagauauaaaggggggcuaucagaaaccccaaaucugugaucuucuccuguuucaaauuaucuuagcuccuuuucaccuaugcucauauauaguuugguauugucgguggaucuauaauuuuaacaucaaaggcaaagaauauggagaggaagagagauuauacauuauacguaaaucuaugaagaugucaaagucucaauuugauagucuagaagaucaucagaaagaaacuuuucuuaaacgagagcucuggaucaaggagaauuaugaggucuacaagcaagaacaagaggaagaauuaaagaaaaaguuggcaaaugaccccagauggaagagauacaggagauggaugaagaaugaagggccugggcgguuaacauuugucgaugacuga

SEQ ID NO: 8271 - RNA, 1083 nt, Artificial Sequence
  derived and/or modified sequence opt1 from DJC25__Homo_sapiens__AAH48318
augggcgcgccccugcucagcccgggguggggcgccggggccgccggccgccggugguggaugcugcuggcgccccuccugcccgcccugcuccuggugcgccccgccggggcccuggucgagggccucuacugcggcacccgggacugcuacgaggugcugggggugucccgcagcgccggcaaggccgagaucgcccgggcguaccgccagcuggcccggcgcuaccacccggaccgguaccgcccccagcccggggacgagggccccgggcggaccccgcaguccgccgaggaggccuuccuccuggucgccacggcguacgagacccugaaggacgaggagacccgcaaggacuacgacuacaugcucgaccaccccgaggaguacuacagccacuacuaccacuacuacucccggcgccuggcccccaagguggacgugcgggucgugauccuggugagcgucugcgccaucuccguguuccaguucuucagcugguggaacuccuacaacaaggccaucagcuaccucgccaccgugcccaaguaccgcauccaggcgacggagaucgccaagcagcagggccugcugaagaaggccaaggagaagggcaagaacaagaaguccaaggaggagauccgggacgaggaggagaacaucaucaagaacaucaucaagagcaagaucgacaucaagggcggguaccagaagccgcagaucugcgaccuccugcuguuccagaucauccucgcccccuuccaccugugcuccuacaucgucugguacugccgcuggaucuacaacuucaacaucaaggggaaggaguacggcgaggaggagcggcuguacaucauccgcaagagcaugaagauguccaagagccaguucgacucccucgaggaccaccagaaggagaccuuccugaagcgggagcuguggaucaaggagaacuacgagguguacaagcaggagcaggaggaggagcucaagaagaagcuggccaacgacccccgcuggaagcgcuaccggcgcuggaugaagaacgagggccccgggcggcugaccuucguggacgacuga

SEQ ID NO: 8272 - RNA, 1083 nt, Artificial Sequence
  derived and/or modified sequence opt2 from DJC25__Homo_sapiens__AAH48318
augggcgccccccuccucucccccggcuggggcgccggcgccgccggccgccgcugguggaugcuccucgccccccuccuccccgcccuccuccucguccgccccgccggcgcccucgucgagggccucuacugcggcacccgcgacugcuacgagguccucggcgucucccgcuccgccggcaaggccgagaucgcccgcgccuaccgccagcucgcccgccgcuaccaccccgaccgcuaccgcccccagcccggcgacgagggccccggccgcaccccccaguccgccgaggaggccuuccuccucgucgccaccgccuacgagacccucaaggacgaggagacccgcaaggacuacgacuacaugcucgaccaccccgaggaguacuacucccacuacuaccacuacuacucccgccgccucgcccccaaggucgacguccgcgucgucauccucgucuccgucugcgccaucuccgucuuccaguucuucuccugguggaacuccuacaacaaggccaucuccuaccucgccaccguccccaaguaccgcauccaggccaccgagaucgccaagcagcagggccuccucaagaaggccaaggagaagggcaagaacaagaaguccaaggaggagauccgcgacgaggaggagaacaucaucaagaacaucaucaaguccaagaucgacaucaagggcggcuaccagaagccccagaucugcgaccuccuccucuuccagaucauccucgcccccuuccaccucugcuccuacaucgucugguacugccgcuggaucuacaacuucaacaucaagggcaaggaguacggcgaggaggagcgccucuacaucauccgcaaguccaugaagauguccaagucccaguucgacucccucgaggaccaccagaaggagaccuuccucaagcgcgagcucuggaucaaggagaacuacgaggucuacaagcaggagcaggaggaggagcucaagaagaagcucgccaacgacccccgcuggaagcgcuaccgccgcuggaugaagaacgagggccccggccgccucaccuucgucgacgacuga

SEQ ID NO: 8273 - RNA, 1083 nt, Artificial Sequence
  derived and/or modified sequence opt3 from DJC25__Homo_sapiens__AAH48318
augggcgcuccccugcucagcccuggguggggagccggugcagccggcagaaggugguggaugcuucuggcgccauuguuaccggcucugcuacucgugcggcccgccggggcacuggucgagggacuuuacugcggcacccgcgacuguuaugaaguucugggugugucccgaucugccgggaaggcugagaucgcacgugccuacagacaguuggcuaggcgguaucacccugaucgcuacagaccacaacccggagacgaaggcccuggcaggacaccacagucagccgaggaagcguuccuccugguagcaacugccuaugagacgcugaaagaugaggaaacccggaaggacuacgauuauaugcucgaccaucccgaggaauacuacagucacuauuaccauuauuacagccgccgauuagcuccuaaaguggaugucagagugguuauucugguguccgucugcgccauaucuguguuucaguucuuuucgugguggaacucauauaauaaggcaaucagcuaccuugcuacaguaccaaaauauaggauucaggccacugagaucgcgaagcaacagggguugcugaagaaagccaaggagaaaggaaagaacaaaaagaguaaggaagagauucgggacgaagaggaaaauaucaucaaaaacauaauuaaguccaaaaucgauauuaaggguggcuaccagaaaccgcagaucugugaccuacuccuguuccaaauaauucuugcacccuuucaccugugcucuuacaucguuugguauugucguuggauuuacaauuucaacaucaaggggaaagaguauggagaggaagaacgcuuguacaucauuagaaagagcaugaagauguccaaaucacaguuugauagucucgaagaccaucagaaggagaccuuccugaaaagggaauuauggauaaaggagaauuaugagguguacaaacaggaacaagaggaggagcugaagaagaaacucgcuaacgauccucgguggaagcgauaucgcagauggaugaaaaaugaaggcccagguaggcuuacauuugucgacgacuga

SEQ ID NO: 8274 - RNA, 1083 nt, Artificial Sequence
  derived and/or modified sequence opt4 from DJC25__Homo_sapiens__AAH48318
augggcgccccccugcugagccccggcuggggcgccggcgccgccggcagaagaugguggaugcugcuggccccccugcugcccgcccugcugcuggugagacccgccggcgcccugguggagggccuguacugcggcaccagagacugcuacgaggugcugggcgugagcagaagcgccggcaaggccgagaucgccagagccuacagacagcuggccagaagauaccaccccgacagauacagaccccagcccggcgacgagggccccggcagaaccccccagagcgccgaggaggccuuccugcugguggccaccgccuacgagacccugaaggacgaggagaccagaaaggacuacgacuacaugcuggaccaccccgaggaguacuacagccacuacuaccacuacuacagcagaagacuggcccccaagguggacgugagaguggugauccuggugagcgugugcgccaucagcguguuccaguucuucagcugguggaacagcuacaacaaggccaucagcuaccuggccaccgugcccaaguacagaauccaggccaccgagaucgccaagcagcagggccugcugaagaaggccaaggagaagggcaagaacaagaagagcaaggaggagaucagagacgaggaggagaacaucaucaagaacaucaucaagagcaagaucgacaucaagggcggcuaccagaagccccagaucugcgaccugcugcuguuccagaucauccuggcccccuuccaccugugcagcuacaucgugugguacugcagauggaucuacaacuucaacaucaagggcaaggaguacggcgaggaggagagacuguacaucaucagaaagagcaugaagaugagcaagagccaguucgacagccuggaggaccaccagaaggagaccuuccugaagagagagcuguggaucaaggagaacuacgagguguacaagcaggagcaggaggaggagcugaagaagaagcuggccaacgaccccagauggaagagauacagaagauggaugaagaacgagggccccggcagacugaccuucguggacgacuga

SEQ ID NO: 8275 - RNA, 1083 nt, Artificial Sequence
  derived and/or modified sequence opt5 from DJC25__Homo_sapiens__AAH48318
augggcgcuccccugcucagcccuggguggggagccggcgccgcggggagacggugguggaugcugcuugcuccgcugcuccccgcccugcuucuggugcgcccugccggagcucucgucgagggccuguacugcgggaccagagacuguuaugaaguucugggagugucccggucugccggcaaggcugagaucgcccgcgcguacagacagcucgcccggcgcuaucaccccgauagauaccggccucaacccggcgacgaagggccuggacgcacaccgcagagcgcugaggaagccuuccugcuuguggcuacggccuaugagacccugaaagaugaggaaacaagaaaggacuacgauuauaugcucgaccaucccgaggaauacuacucccacuauuaccauuauuacucucggcgccuggcgccuaaagucgaugugagaguugugauucuugucagcgugugcgccaucuccguuuuucaguucuuuucuugguggaacagcuauaauaaggcuauuuccuaccuggccaccgugcccaaauaucggauccaggcuacagagauugccaagcaacagggccuccugaagaaagccaaggagaaagggaagaacaaaaagagcaaggaagagauccgcgacgaagaggaaaauaucauuaaaaacaucauuaagucuaaaaucgauauuaagggaggcuaccagaaaccucagaucugugaccugcuccuguuccaaauuauccuugcucccuuucaccugugcuccuacaucgucugguauuguagauggauuuacaauuucaacaucaaggggaaagaguauggagaggaagaacggcucuacauuaucagaaagagcaugaagaugucuaaaucccaguuugauagccuggaagaccaucagaaggagaccuuccuuaaacgcgaacuguggauuaaggagaauuaugagguguacaaacaggaacaagaggaggagcucaagaagaaacuggcgaacgauccgcgguggaagagauaucgccgguggaugaaaaaugaaggcccuggcagacugacauuuguggacgacuga

SEQ ID NO: 8276 - protein, 273 aa, Artificial Sequence
  DJC27__Homo_sapiens__Q9NZQ0
MEANMPKRKEPGRSLRIKVISMGNAEVGKSCIIKRYCEKRFVSKYLATIGIDYGVTKVHVRDREIKVNIFDMAGHPFFYEVRNEFYKDTQGVILVYDVGQKDSFDALDAWLAEMKQELGPHGNMENIIFVVCANKIDCTKHRCVDESEGRLWAESKGFLYFETSAQTGEGINEMFQTFYISIVDLCENGGKRPTTNSSASFTKEQADAIRRIRNSKDSWDMLGVKPGASRDEVNKAYRKLAVLLHPDKCVAPGSEDAFKAVVNARTALLKNIK

SEQ ID NO: 8277 - RNA, 822 nt, Artificial Sequence
  DJC27__Homo_sapiens__AAF44347
auggaggccaacaugccgaagcggaaggagcccggcaggucucuccgcaucaaagucaucuccaugggcaacgccgaaguggggaaaagcuguauuauaaagcgauacugugagaaaagauucgugucuaaauaccuggcaacaauuggaauugacuauggagucacaaagguacacgucagagacagagaaaucaaaguuaacaucuuugauauggcuggacaucccuucuucuaugagguucgaaaugaguuuuacaaggacacacagggugugauacuggucuaugauguugggcagaaagacuccuuugacgcccuugaugcguggcuggcagaaaugaagcaagagcuuggaccucauggaaacauggaaaauauuauauuuguaguuugugccaacaagauugauuguaccaaacaucgcuguguagaugaaagugaaggacgucuuugggcugaaagcaaaggguuccuguacuuugaaacuucagcacaaacuggagaaggcauuaaugagauguuccagaccuuuuauauauccauaguugauuuaugugaaaauggcgggaaacgcccuaccaccaauagcagugcuaguuucaccaaagaacaagcagaugccauucgcagaauucgaaauaguaaagacaguugggacaugcugggagucaaaccuggggccucaagggaugaagucaauaaagcguaucggaaacuugcugugcuucuucacccugacaaauguguagcaccuggcagugaagaugccuucaaagcaguugugaaugcucggacagcccuccugaaaaacaucaaguag

SEQ ID NO: 8278 - RNA, 822 nt, Artificial Sequence
  derived and/or modified sequence opt1 from DJC27__Homo_sapiens__AAF44347
auggaggccaacaugcccaagcgcaaggagccgggccggagccugcgcaucaaggugaucuccauggggaacgccgaggucggcaagagcugcaucaucaagcgguacugcgagaagcgcuucguguccaaguaccucgcgaccaucgggaucgacuacggcgugaccaagguccacgugcgggaccgcgagaucaaggugaacaucuucgacauggccgggcaccccuucuucuacgagguccggaacgaguucuacaaggacacgcagggcgugauccugguguacgacgucggccagaaggacagcuucgacgcccuggacgccuggcucgccgagaugaagcaggagcuggggccccacggcaacauggagaacaucaucuucguggugugcgcgaacaagaucgacugcaccaagcaccgcugcgucgacgaguccgaggggcggcugugggccgagagcaagggcuuccucuacuucgagaccuccgcccagaccggggagggcaucaacgagauguuccagacguucuacaucagcaucguggaccugugcgagaacggcgggaagcgccccaccaccaacuccagcgccuccuucaccaaggagcaggcggacgccauccggcgcauccggaacagcaaggacuccugggacaugcugggcgugaagccgggggccagccgcgacgaggucaacaaggccuaccggaagcucgccgugcugcugcaccccgacaagugcguggcgcccggcuccgaggacgccuucaaggccgucgugaacgcccgcacggcccuccugaagaacaucaaguga

SEQ ID NO: 8279 - RNA, 822 nt, Artificial Sequence
  derived and/or modified sequence opt2 from DJC27__Homo_sapiens__AAF44347
auggaggccaacaugcccaagcgcaaggagcccggccgcucccuccgcaucaaggucaucuccaugggcaacgccgaggucggcaaguccugcaucaucaagcgcuacugcgagaagcgcuucgucuccaaguaccucgccaccaucggcaucgacuacggcgucaccaagguccacguccgcgaccgcgagaucaaggucaacaucuucgacauggccggccaccccuucuucuacgagguccgcaacgaguucuacaaggacacccagggcgucauccucgucuacgacgucggccagaaggacuccuucgacgcccucgacgccuggcucgccgagaugaagcaggagcucggcccccacggcaacauggagaacaucaucuucgucgucugcgccaacaagaucgacugcaccaagcaccgcugcgucgacgaguccgagggccgccucugggccgaguccaagggcuuccucuacuucgagaccuccgcccagaccggcgagggcaucaacgagauguuccagaccuucuacaucuccaucgucgaccucugcgagaacggcggcaagcgccccaccaccaacuccuccgccuccuucaccaaggagcaggccgacgccauccgccgcauccgcaacuccaaggacuccugggacaugcucggcgucaagcccggcgccucccgcgacgaggucaacaaggccuaccgcaagcucgccguccuccuccaccccgacaagugcgucgcccccggcuccgaggacgccuucaaggccgucgucaacgcccgcaccgcccuccucaagaacaucaaguga

SEQ ID NO: 8280 - RNA, 822 nt, Artificial Sequence
  derived and/or modified sequence opt3 from DJC27__Homo_sapiens__AAF44347
auggaggccaacaugcccaagagaaaagaaccuggcaggagccugcggaucaaggugauuuccauggggaaugcugaggucggaaaaucuugcauaaucaagcgcuacugugaaaaacgauucguuucaaaguaucucgcaaccauugguaucgacuacggcgugacaaagguacacgugcgugauagagagauuaaagucaacaucuuugacauggccgggcauccauucuuuuaugaagugaggaaugaguucuacaaggauacucagggaguuauacuuguguaugacgucggccaaaaagauaguuuugacgcgcuggaugcuugguuggccgagaugaagcaggaauuagguccgcacgggaacauggagaauaucauuuucgugguaugcgcaaacaaaaucgacuguacgaagcaucggugcguugaugaaagcgagggacgccugugggccgaguccaagggcuuucuauacuucgaaaccucugcucagacaggcgaggggauuaaugaaauguuucagacuuucuauaucucgauaguggaccucugugagaacggagguaaaagacccaccacaaauucaagcgcaaguuuuaccaaggaacaagccgaugcuauuaggcggauccgcaacuccaaagacucuugggauaugcugggcgucaagccuggggccagccgagacgaggugaauaaagcguacagaaaacuugcagugcuguugcacccagacaagugcgucgcccccggauccgaggaugcuuucaaggccguugugaacgcaaggacugcucuccugaagaauauuaaauga

SEQ ID NO: 8281 - RNA, 822 nt, Artificial Sequence
  derived and/or modified sequence opt4 from DJC27__Homo_sapiens__AAF44347
auggaggccaacaugcccaagagaaaggagcccggcagaagccugagaaucaaggugaucagcaugggcaacgccgaggugggcaagagcugcaucaucaagagauacugcgagaagagauucgugagcaaguaccuggccaccaucggcaucgacuacggcgugaccaaggugcacgugagagacagagagaucaaggugaacaucuucgacauggccggccaccccuucuucuacgaggugagaaacgaguucuacaaggacacccagggcgugauccugguguacgacgugggccagaaggacagcuucgacgcccuggacgccuggcuggccgagaugaagcaggagcugggcccccacggcaacauggagaacaucaucuucguggugugcgccaacaagaucgacugcaccaagcacagaugcguggacgagagcgagggcagacugugggccgagagcaagggcuuccuguacuucgagaccagcgcccagaccggcgagggcaucaacgagauguuccagaccuucuacaucagcaucguggaccugugcgagaacggcggcaagagacccaccaccaacagcagcgccagcuucaccaaggagcaggccgacgccaucagaagaaucagaaacagcaaggacagcugggacaugcugggcgugaagcccggcgccagcagagacgaggugaacaaggccuacagaaagcuggccgugcugcugcaccccgacaagugcguggcccccggcagcgaggacgccuucaaggccguggugaacgccagaaccgcccugcugaagaacaucaaguga

SEQ ID NO: 8282 - RNA, 822 nt, Artificial Sequence
  derived and/or modified sequence opt5 from DJC27__Homo_sapiens__AAF44347
auggaggccaacaugcccaagagaaaagaaccuggccggagccugcgcaucaaggugauuuccauggggaaugcugaggucggaaaaucuugcaucauuaagagauacugugaaaaacgguucguuagcaaguaucucgccaccaucggcauugacuacggggugacaaaggugcacguccgcgauagagagaucaaagugaacaucuuugacauggcgggacauccguucuuuuaugaaguucggaaugaguucuacaaggauacgcagggcgugauucuggucuaugacguggggcaaaaagauuccuuugacgcucuugaugccuggcuggccgagaugaagcaggaacucggaccccacggcaacauggagaauaucauuuucguugugugcgcuaacaaaaucgacuguaccaagcaucgcugcgucgaugaaucugagggcagacugugggccgagagcaagggguuucuuuacuucgaaacauccgcucagaccggagagggcauuaaugaaauguuucagacauucuauaucucuauuguggaccugugugagaacgggggaaaacggccuaccacaaauagcuccgccagcuuuaccaaggaacaagcggaugccauccgcagaauccggaacucuaaagacuccugggauaugcucggcgugaagcccggggcuagccgcgacgaggucaauaaagccuacagaaagcuggcuguucugcuccacccugacaaaugcguggcccccggaucugaggaugcguucaaggccguggucaacgcucggacggcccugcuuaagaauauuaaauga

SEQ ID NO: 8283 - protein, 388 aa, Artificial Sequence
  DJC28__Homo_sapiens__Q9NX36
MNTMYVMMAQILRSHLIKATVIPNRVKMLPYFGIIRNRMMSTHKSKKKIREYYRLLNVEEGCSADEVRESFHKLAKQYHPDSGSNTADSATFIRIEKAYRKVLSHVIEQTNASQSKGEEEEDVEKFKYKTPQHRHYLSFEGIGFGTPTQREKHYRQFRADRAAEQVMEYQKQKLQSQYFPDSVIVKNIRQSKQQKITQAIERLVEDLIQESMAKGDFDNLSGKGKPLKKFSDCSYIDPMTHNLNRILIDNGYQPEWILKQKEISDTIEQLREAILVSRKKLGNPMTPTEKKQWNHVCEQFQENIRKLNKRINDFNLIVPILTRQKVHFDAQKEIVRAQKIYETLIKTKEVTDRNPNNLDQGEGEKTPEIKKGFLNWMNLWKFIKIRSF

SEQ ID NO: 8284 - RNA, 1167 nt, Artificial Sequence
  DJC28__Homo_sapiens__AAL59618
augaauacaauguaugugaugauggcucagaucuuaagaucucaccugauaaaggcuacagugauuccuaaucgagugaaaaugcuuccauauuuugguaucauuagaaauagaaugaugucaacccauaaauccaaaaagaagaucagagaauauuauagacugcugaacguggaggaaggaugcucugcagaugaagucagggaaucuuuucauaagcuugccaagcaauaucauccugacaguggcucuaauacugcugauucugcaacauuuauaaggauugaaaaagcuuauagaaaggugcucucccaugugauagaacaaacaaaugccagucagaguaaaggugaagaagaagaagauguagaaaaauucaaauauaaaacaccccaacaccgacauuauuuaaguuuugaagguauugguuuugggacuccaacucaacgagagaagcauuauaggcaauuuagggcagaccgugcugcugaacaagugauggaauaucaaaagcagaaacuacaaagccaguauuuuccugauaguguaauuguuaaaaauauaagacagagcaaacagcaaaagauaacgcaagcuauagaacguuuaguggaggaccucauucaagaauccauggcaaaaggagacuuugacaaucucagugggaaaggaaaaccucugaaaaaguuuucugacuguucuuacauugaucccaugacucacaaccugaaccgaauacugaucgauaauggauaccaaccagaauggauccuuaagcaaaaggaaauaagcgauacuauugagcaacucagagaggcaauuuuagugucuaggaaaaaacuugggaauccaaugacaccaacugaaaagaaacaguggaaccauguuugugagcaguuucaagaaaacaucagaaaauuaaacaagcgaauuaaugauuuuaauuuaauuguucccauccugaccaggcaaaaaguccauuuugaugcucagaaagaaauugucagagcccagaaaauauacgagacccuuauaaaaacaaaagaagucacagauagaaacccaaauaaccuugaucaaggagaaggagagaaaacaccugaaaucaagaaagguuuuuuaaacuggaugaaucuguggaaauuuauuaaaauacgaucauuuuga

SEQ ID NO: 8285 - RNA, 1167 nt, Artificial Sequence
  derived and/or modified sequence opt1 from DJC28__Homo_sapiens__AAL59618
augaacaccauguacgugaugauggcccagauccugcgcagccaccucaucaaggccaccgucauccccaaccgggugaagaugcugccguacuucggcaucauccgcaaccggaugauguccacgcacaagagcaagaagaagauccgcgaguacuaccggcugcucaacguggaggaggggugcuccgcggacgagguccgcgagagcuuccacaagcuggccaagcaguaccaccccgacuccggcagcaacaccgccgacuccgccaccuucauccggaucgagaaggccuaccgcaaggugcugagccacgugaucgagcagaccaacgcgucccagagcaagggggaggaggaggaggacgucgagaaguucaaguacaagacgccccagcaccggcacuaccucuccuucgagggcaucggguucggcacccccacccagcgcgagaagcacuaccggcaguuccgcgccgaccgggccgccgagcaggucauggaguaccagaagcagaagcugcagagccaguacuucccggacuccgugaucgugaagaacauccgccagagcaagcagcagaagaucacccaggcgaucgagcggcugguggaggaccucauccaggaguccauggccaagggcgacuucgacaaccugagcgggaagggcaagccccugaagaaguucuccgacugcagcuacaucgaccccaugacgcacaaccucaaccgcauccugaucgacaacggguaccagcccgaguggauccugaagcagaaggagaucuccgacaccaucgagcagcuccgggaggccauccuggugagccgcaagaagcugggcaacccgaugacccccaccgagaagaagcaguggaaccacgucugcgagcaguuccaggagaacauccggaagcucaacaagcgcaucaacgacuucaaccugaucgugcccauccugacgcggcagaaggugcacuucgacgcccagaaggagaucguccgcgcccagaagaucuacgagacccucaucaagaccaaggaggugaccgaccgcaaccccaacaaccuggaccagggggagggcgagaagacgccggagaucaagaagggcuuccugaacuggaugaaccucuggaaguucaucaagauccggagcuucuga

SEQ ID NO: 8286 - RNA, 1167 nt, Artificial Sequence
  derived and/or modified sequence opt2 from DJC28__Homo_sapiens__AAL59618
augaacaccauguacgucaugauggcccagauccuccgcucccaccucaucaaggccaccgucauccccaaccgcgucaagaugcuccccuacuucggcaucauccgcaaccgcaugauguccacccacaaguccaagaagaagauccgcgaguacuaccgccuccucaacgucgaggagggcugcuccgccgacgagguccgcgaguccuuccacaagcucgccaagcaguaccaccccgacuccggcuccaacaccgccgacuccgccaccuucauccgcaucgagaaggccuaccgcaagguccucucccacgucaucgagcagaccaacgccucccaguccaagggcgaggaggaggaggacgucgagaaguucaaguacaagaccccccagcaccgccacuaccucuccuucgagggcaucggcuucggcacccccacccagcgcgagaagcacuaccgccaguuccgcgccgaccgcgccgccgagcaggucauggaguaccagaagcagaagcuccagucccaguacuuccccgacuccgucaucgucaagaacauccgccaguccaagcagcagaagaucacccaggccaucgagcgccucgucgaggaccucauccaggaguccauggccaagggcgacuucgacaaccucuccggcaagggcaagccccucaagaaguucuccgacugcuccuacaucgaccccaugacccacaaccucaaccgcauccucaucgacaacggcuaccagcccgaguggauccucaagcagaaggagaucuccgacaccaucgagcagcuccgcgaggccauccucgucucccgcaagaagcucggcaaccccaugacccccaccgagaagaagcaguggaaccacgucugcgagcaguuccaggagaacauccgcaagcucaacaagcgcaucaacgacuucaaccucaucguccccauccucacccgccagaagguccacuucgacgcccagaaggagaucguccgcgcccagaagaucuacgagacccucaucaagaccaaggaggucaccgaccgcaaccccaacaaccucgaccagggcgagggcgagaagacccccgagaucaagaagggcuuccucaacuggaugaaccucuggaaguucaucaagauccgcuccuucuga

SEQ ID NO: 8287 - RNA, 1167 nt, Artificial Sequence
  derived and/or modified sequence opt3 from DJC28__Homo_sapiens__AAL59618
augaacaccauguacgugaugauggcccagauccugagaagccaccucauuaaggcuacagucauacccaauaggguuaaaaugcuuccuuauuucggcaucauucggaaccgcaugauguccacucauaagucuaaaaagaaaauccgagaguacuaucgucuguugaauguggaagaggggugcucagcagacgaaguaagagagaguuuucacaaguuagccaagcaauaccauccagauagcggauccaacacggcggacucugcuaccuucauuaggaucgaaaaagccuaucggaaggugcugucgcacgucauagagcagacaaaugcaucacagagcaaaggugaggaagaggaagauguggagaaguuuaaauacaagacuccgcagcaucgccacuaucuaaguuucgagggcaucggguuuggaacccccacacaaagagaaaagcacuacaggcaguuccgggccgaccgcgcugcagagcagguuauggaauaccagaaacaaaagcuccagucccaguauuuuccugauucugugauugucaaaaacauccgacagagcaagcaacagaaaauuacccaggccaucgagagacugguggaagaccuuauacaagaguccauggcuaagggcgauuucgacaaucugucagguaaagggaagccauugaagaaauuuagugauuguagcuacauugaccccaugacucauaaccucaauaggauccugauugauaacggauaucagccugaguggauccugaagcagaaagaaaucucugacacaauugagcagcuccgggaagccauauuaguaucccguaagaaacugggcaauccaaugacccccacggagaagaagcaauggaaccacguuugcgaacaguuccaggagaauauccgcaaacuuaacaagagaauuaaugauuuuaacuugaucgugccuauacugacuaggcagaaaguccauuucgacgcgcaaaaggagauugugcgggcacagaaaaucuacgaaacccuaaucaagacaaaggaggugacugaccgaaacccaaauaaccucgaucagggcgaaggggagaaaaccccggaaauuaagaaaggauuucugaauuggaugaaccuuuggaaguucaucaaaauucgcucauucuga

SEQ ID NO: 8288 - RNA, 1167 nt, Artificial Sequence
  derived and/or modified sequence opt4 from DJC28__Homo_sapiens__AAL59618
augaacaccauguacgugaugauggcccagauccugagaagccaccugaucaaggccaccgugauccccaacagagugaagaugcugcccuacuucggcaucaucagaaacagaaugaugagcacccacaagagcaagaagaagaucagagaguacuacagacugcugaacguggaggagggcugcagcgccgacgaggugagagagagcuuccacaagcuggccaagcaguaccaccccgacagcggcagcaacaccgccgacagcgccaccuucaucagaaucgagaaggccuacagaaaggugcugagccacgugaucgagcagaccaacgccagccagagcaagggcgaggaggaggaggacguggagaaguucaaguacaagaccccccagcacagacacuaccugagcuucgagggcaucggcuucggcacccccacccagagagagaagcacuacagacaguucagagccgacagagccgccgagcaggugauggaguaccagaagcagaagcugcagagccaguacuuccccgacagcgugaucgugaagaacaucagacagagcaagcagcagaagaucacccaggccaucgagagacugguggaggaccugauccaggagagcauggccaagggcgacuucgacaaccugagcggcaagggcaagccccugaagaaguucagcgacugcagcuacaucgaccccaugacccacaaccugaacagaauccugaucgacaacggcuaccagcccgaguggauccugaagcagaaggagaucagcgacaccaucgagcagcugagagaggccauccuggugagcagaaagaagcugggcaaccccaugacccccaccgagaagaagcaguggaaccacgugugcgagcaguuccaggagaacaucagaaagcugaacaagagaaucaacgacuucaaccugaucgugcccauccugaccagacagaaggugcacuucgacgcccagaaggagaucgugagagcccagaagaucuacgagacccugaucaagaccaaggaggugaccgacagaaaccccaacaaccuggaccagggcgagggcgagaagacccccgagaucaagaagggcuuccugaacuggaugaaccuguggaaguucaucaagaucagaagcuucuga

SEQ ID NO: 8289 - RNA, 1167 nt, Artificial Sequence
  derived and/or modified sequence opt5 from DJC28__Homo_sapiens__AAL59618
augaacaccauguacgugaugauggcccagauccugagaagccaccucauuaaggcuacagucauccccaaucggguuaaaaugcugccuuauuucggcauuauccgcaacagaaugauguccacgcauaagucuaaaaagaaaauucgggaguacuaucgccuucugaauguggaagaggggugcagcgccgacgaagugagagaguccuuucacaagcucgcgaagcaauaccauccggauucuggaagcaacaccgcugacuccgccacauucauccggaucgaaaaagccuaucgcaagguccugucucacgugauugagcagaccaaugcuagccaguccaaaggcgaggaagaggaagauguugagaaguuuaaauacaagacaccccagcauagacacuaucuuagcuucgaggggaucggauuuggcaccccuacacaacgggaaaagcacuaccgccaguucagagccgaccgggcugccgaacaggugauggaguaccagaaacaaaagcugcagucucaguauuuucccgauuccgucauugugaaaaacauccgccagagcaagcaacagaaaauuacccaggcgaucgagagacucguugaagaccugauucaagagucuauggccaagggggauuucgacaaucuguccggaaaaggcaagccucucaagaaauuuagcgauuguucuuacaucgaccccaugacgcauaaccugaaucggauccuuauugauaacggcuaucagccugaguggauccugaagcagaaagaaauuuccgacaccaucgagcagcuccgcgaagcuauucuggugagcagaaagaaacuugggaauccgaugacacccaccgagaagaagcaauggaaccacgucugcgaacaguuccaggagaauauccggaaacugaacaagagaaucaaugauuuuaaccucauugugccuauccugacacgccagaaagugcauuucgacgcccaaaaggagauuguccgggcucagaaaaucuacgaaacccugauuaagacgaaggagguuacagacagaaaccccaauaaccucgaucagggagaaggcgagaaaaccccugaaaucaagaaaggguuucugaauuggaugaaccuuuggaaguucaucaaaauucgcuccuucuga

SEQ ID NO: 8290 - protein, 226 aa, Artificial Sequence
  DJC30__Homo_sapiens__Q96LL9
MAAMRWRWWQRLLPWRLLQARGFPQNSAPSLGLGARTYSQGDCSYSRTALYDLLGVPSTATQAQIKAAYYRQCFLYHPDRNSGSAEAAERFTRISQAYVVLGSATLRRKYDRGLLSDEDLRGPGVRPSRTPAPDPGSPRTPPPTSRTHDGSRASPGANRTMFNFDAFYQAHYGEQLERERRLRARREALRKRQEYRSMKGLRWEDTRDTAAIFLIFSIFIIIGFYI

SEQ ID NO: 8291 - RNA, 681 nt, Artificial Sequence
  DJC30__Homo_sapiens__AAM62307
auggcagccaugcgcuggcgaugguggcagcggcuguuaccuuggagguugcugcaggcccguggcuuuccacaaaauucugcacccagccugggccuaggagcgaggacuuauucccagggcgacugcucguauucgcgcacggcgcuguaugaucugcucggcguccccuccacagccacgcaggcccaaaucaaggcggcuuacuaccgucagugcuuucucuaccacccggaccgcaacuccgggagcgcggaggccgccgagcgcuucacgcgcaucucccaggccuacguggugcugggcagugccacccuccgucgcaaguaugaucgcggccuacucagcgacgaggaccugcgcggaccuggcguccggcccuccaggacgcccgcacccgaccccggcucgccgcguaccccgccgcccaccucucggacccacgacgguucucgggccucccccggcgccaaccgcacgauguucaacuuugacgccuucuaccaggcccacuacggggaacaacuggagcgggaacggcgccugagggcccggcgggaggcccuucgcaaacggcaggaguaucgguccaugaaaggccuccgcugggaggauacccgagacacggcugccauuuuccucaucuuuucaaucuucaucaucaucggcuuuuauauuuaa

SEQ ID NO: 8292 - RNA, 681 nt, Artificial Sequence
  derived and/or modified sequence opt1 from DJC30__Homo_sapiens__AAM62307
auggccgccaugcgcuggcggugguggcagcgccugcuccccuggcggcugcugcaggcgcgcggcuucccccagaacagcgcccccucccucgggcugggcgcccggaccuacagccagggggacugcuccuacagccgcaccgcccuguacgaccuccugggcgugcccuccacggccacccaggcgcagaucaaggccgccuacuaccggcagugcuuccuguaccaccccgaccgcaacagcggguccgccgaggcggccgagcgguucacccgcaucagccaggccuacgucgugcucggcuccgccacccugcggcgcaaguacgaccggggccugcucagcgacgaggaccugcgcgggccgggcgugcggcccucccgcacgcccgcccccgacccggggagcccccggaccccgccgcccaccucccgcacccacgacggcagccgggcgucccccggggccaaccgcacgauguucaacuucgacgccuucuaccaggcccacuacggcgagcagcuggagcgggagcgccgccuccgggcccgccgggaggcgcugcgcaagcggcaggaguaccgcagcaugaagggccugcggugggaggacacccgcgacaccgccgccaucuuccucaucuucuccaucuucaucaucaucggguucuacaucuga

SEQ ID NO: 8293 - RNA, 681 nt, Artificial Sequence
  derived and/or modified sequence opt2 from DJC30__Homo_sapiens__AAM62307
auggccgccaugcgcuggcgcugguggcagcgccuccuccccuggcgccuccuccaggcccgcggcuucccccagaacuccgcccccucccucggccucggcgcccgcaccuacucccagggcgacugcuccuacucccgcaccgcccucuacgaccuccucggcguccccuccaccgccacccaggcccagaucaaggccgccuacuaccgccagugcuuccucuaccaccccgaccgcaacuccggcuccgccgaggccgccgagcgcuucacccgcaucucccaggccuacgucguccucggcuccgccacccuccgccgcaaguacgaccgcggccuccucuccgacgaggaccuccgcggccccggcguccgccccucccgcacccccgcccccgaccccggcuccccccgcacccccccccccaccucccgcacccacgacggcucccgcgccucccccggcgccaaccgcaccauguucaacuucgacgccuucuaccaggcccacuacggcgagcagcucgagcgcgagcgccgccuccgcgcccgccgcgaggcccuccgcaagcgccaggaguaccgcuccaugaagggccuccgcugggaggacacccgcgacaccgccgccaucuuccucaucuucuccaucuucaucaucaucggcuucuacaucuga

SEQ ID NO: 8294 - RNA, 681 nt, Artificial Sequence
  derived and/or modified sequence opt3 from DJC30__Homo_sapiens__AAM62307
auggccgcuaugagauggaggugguggcagcggcugcuccccuggcgccuucugcaagcacgaggcuucccucagaacagcgccccauccuugggguuaggagcgcguaccuacucucagggugacugcucauauaguagaacagcucuguacgaucuacucggcgugccgagcacugccacgcaggcacaaaucaaggccgcuuauuacaggcaguguuuucuguaucaccccgaccgcaauuccgggucugcagaggccgcugaacgguucaccagaauuucgcaggccuacgucguucuuggaucagcgacacugaggcggaaauaugaucgcggcuugcucagcgacgaggaucugcgagguccuggggugagaccaaguaggacucccgcaccugacccaggaucuccccggaccccuccaccgacaucccguacccaugauggcagccgcgccucccccggcgcuaacagaacuauguuuaauuucgacgccuuuuaccaggcacacuacggggaacaacuggagagggaacggcgacuccgcgcuagaagggaggccuuacggaagcgccaggaguauagaucaaugaaaggacugaggugggaagauacacgugacaccgcggccauauuccuuaucuuuaguauuuucaucauuaucgguuuuuacauauga

SEQ ID NO: 8295 - RNA, 681 nt, Artificial Sequence
  derived and/or modified sequence opt4 from DJC30__Homo_sapiens__AAM62307
auggccgccaugagauggagaugguggcagagacugcugcccuggagacugcugcaggccagaggcuucccccagaacagcgcccccagccugggccugggcgccagaaccuacagccagggcgacugcagcuacagcagaaccgcccuguacgaccugcugggcgugcccagcaccgccacccaggcccagaucaaggccgccuacuacagacagugcuuccuguaccaccccgacagaaacagcggcagcgccgaggccgccgagagauucaccagaaucagccaggccuacguggugcugggcagcgccacccugagaagaaaguacgacagaggccugcugagcgacgaggaccugagaggccccggcgugagacccagcagaacccccgcccccgaccccggcagccccagaacccccccccccaccagcagaacccacgacggcagcagagccagccccggcgccaacagaaccauguucaacuucgacgccuucuaccaggcccacuacggcgagcagcuggagagagagagaagacugagagccagaagagaggcccugagaaagagacaggaguacagaagcaugaagggccugagaugggaggacaccagagacaccgccgccaucuuccugaucuucagcaucuucaucaucaucggcuucuacaucuga

SEQ ID NO: 8296 - RNA, 681 nt, Artificial Sequence
  derived and/or modified sequence opt5 from DJC30__Homo_sapiens__AAM62307
auggccgcuaugagauggcggugguggcagcgccugcuccccuggagacugcuucaagcccggggcuucccucagaacagcgcgccgucccuggggcucggagcucgcaccuacucucagggcgacugcagcuauuccagaacagcccuguacgaucuucugggggugcccucuacggccacccaggcucaaaucaaggccgcuuauuaccggcaguguuuucucuaucacccugaccgcaauagcggauccgccgaggcggccgaaagauucacacggauuucucaggcuuacgucguucugggcagcgccacccugcgcagaaaauaugaucgggggcuccuguccgacgaggaucuucgcggacccggcgugagaccuagccggacacccgcuccugacccgggcucuccccgcaccccucccccuacauccagaacccaugaugggagccgggccucucccggagcgaacagaacgauguuuaauuucgacgccuuuuaccaggcucacuacggcgaacaacuggagcgcgaacggagacuccgcgcccggagagaggcucugcgcaagcggcaggaguauagauccaugaaagggcuucgcugggaagauacccgggacacagccgccaucuuccugauuuuuagcaucuucauuaucaucggauuuuacauuuga

SEQ ID NO: 8297 - protein, 409 aa, Artificial Sequence
  DNAJB12__Homo_sapiens__NP_001002762.2
MSSLRARLPATRRRVAQPFARPASPSLVPRSGSAMESNKDEAERCISIALKAIQSNQPDRALRFLEKAQRLYPTPRVRALIESLNQKPQTAGDQPPPTDTTHATHRKAGGTDAPSANGEAGGESTKGYTAEQVAAVKRVKQCKDYYEILGVSRGASDEDLKKAYRRLALKFHPDKNHAPGATEAFKAIGTAYAVLSNPEKRKQYDQFGDDKSQAARHGHGHGDFHRGFEADISPEDLFNMFFGGGFPSSNVHVYSNGRMRYTYQQRQDRRDNQGDGGLGVFVQLMPILILILVSALSQLMVSSPPYSLSPRPSVGHIHRRVTDHLGVVYYVGDTFSEEYTGSSLKTVERNVEDDYIANLRNNCWKEKQQKEGLLYRARYFGDTDMYHRAQKMGTPSCSRLSEVQASLHG

SEQ ID NO: 8298 - RNA, 1230 nt, Artificial Sequence
  DNAJB12__Homo_sapiens__NM_001002762.2
augucaucacuccgcgcccggcugcccgcgacgcgccggcggguggcgcagcccuucgcucgcccggccucccccucccugguuccgcguucugguuccgccauggaauccaacaaggaugaagcugagcgcuguaucagcaucgcccucaaggccauccagagcaaccagcccgaccgggcgcuccgcuuccuggagaaggcacagcggcuguauccgacgccgcgaguucgcgcccugauugagucccucaaccagaaaccacagacugccggugaccaacccccacccacagacacaacccaugccacccacaggaaagcaggugggaccgaugcccccucggccaacggugaagcuggaggagagagcaccaaaggcuacacugcagaacagguugcagcugugaaaagggucaagcaauguaaagauuacuaugagauccugggggugagcagaggggccucggaugaggaccugaagaaggccuaccgcagacuggcccucaaauuccacccagacaagaaccacgcaccuggugccacugaagccuucaaagccauuggcacagcauaugcgguacucagcaacccggagaagaggaagcaguaugaccaguucggcgaugacaagagccaggcggcccggcacggccaugggcauggggauuuccaccguggcuuugaggccgacaucuccccugaagaccucuucaacauguucuuuggcggcggcuucccuucuaguaacguccacgucuacagcaacggccgcaugcgcuauaccuaccagcaaaggcaggaccgcagggacaaccagggugauggcgggcuagggguguuugugcagcugaugccuauccucauccugauucucgugucagcucucagccagcucauggucuccaguccacccuacagucugaguccaagaccguccgugggccacauccacaggcgagucacugaccaccugggugucgucuacuaugugggagacacuuucuccgaagaguacacaggcuccagccucaaaacagucgagcggaauguggaagaugauuauaucgccaaccuccggaacaacugcuggaaggagaagcagcagaaggaaggcuugcuguaccgggcacgcuacuuuggcgacacagauauguaccacagagcacagaagaugggcacccccagcugcagccgacugucagaggugcaggccucccugcauggauag

SEQ ID NO: 8299 - RNA, 1230 nt, Artificial Sequence
  derived and/or modified sequence opt1 from DNAJB12__Homo_sapiens__NM_001002762.2
augagcucccugcgcgcccggcuccccgccacccgccggcgcguggcgcagccguucgcccggcccgccagccccucccuggucccccgcagcggcuccgccauggagagcaacaaggacgaggccgagcggugcaucuccaucgcgcugaaggccauccagagcaaccagccggaccgcgcccuccgguuccuggagaaggcccagcgccuguaccccacgccccgggugcgcgcgcucaucgagucccugaaccagaagccccagaccgccggggaccagccgccgcccaccgacaccacccacgccacgcaccggaaggccggcgggaccgacgcccccagcgcgaacggcgaggccgggggcgaguccaccaagggcuacaccgccgagcaggucgccgccgugaagcgcgugaagcagugcaaggacuacuacgagauccugggggugagccggggcgcguccgacgaggaccucaagaaggccuaccgccggcuggcccugaaguuccaccccgacaagaaccacgcccccggggccacggaggcguucaaggccaucggcaccgccuacgccguccucagcaaccccgagaagcgcaagcaguacgaccaguucggggacgacaagucccaggccgcgcggcacggccacggccacggggacuuccaccgcggcuucgaggccgacaucagccccgaggaccuguucaacauguucuucgggggcggcuucccguccagcaacgugcacguguacuccaacgggcggaugcgcuacaccuaccagcagcgccaggaccggcgcgacaaccagggcgacgggggccugggggucuucgugcagcucaugcccauccugauccugauccucgugagcgcccugagccagcugauggucuccagcccgcccuacucccucagcccccggcccuccgugggccacauccaccgccgggugaccgaccaccugggcgucguguacuacgugggggacacguucagcgaggaguacaccggcuccagccugaagaccgucgagcgcaacguggaggacgacuacaucgccaaccuccggaacaacugcuggaaggagaagcagcagaaggaggggcugcuguaccgcgcgcgguacuucggcgacaccgacauguaccaccgcgcccagaagauggggacgcccuccugcagccggcucuccgaggugcaggccagccugcacggcuga

SEQ ID NO: 8300 - RNA, 1230 nt, Artificial Sequence
  derived and/or modified sequence opt2 from DNAJB12__Homo_sapiens__NM_001002762.2
auguccucccuccgcgcccgccuccccgccacccgccgccgcgucgcccagcccuucgcccgccccgccucccccucccucgucccccgcuccggcuccgccauggaguccaacaaggacgaggccgagcgcugcaucuccaucgcccucaaggccauccaguccaaccagcccgaccgcgcccuccgcuuccucgagaaggcccagcgccucuaccccaccccccgcguccgcgcccucaucgagucccucaaccagaagccccagaccgccggcgaccagcccccccccaccgacaccacccacgccacccaccgcaaggccggcggcaccgacgcccccuccgccaacggcgaggccggcggcgaguccaccaagggcuacaccgccgagcaggucgccgccgucaagcgcgucaagcagugcaaggacuacuacgagauccucggcgucucccgcggcgccuccgacgaggaccucaagaaggccuaccgccgccucgcccucaaguuccaccccgacaagaaccacgcccccggcgccaccgaggccuucaaggccaucggcaccgccuacgccguccucuccaaccccgagaagcgcaagcaguacgaccaguucggcgacgacaagucccaggccgcccgccacggccacggccacggcgacuuccaccgcggcuucgaggccgacaucucccccgaggaccucuucaacauguucuucggcggcggcuuccccuccuccaacguccacgucuacuccaacggccgcaugcgcuacaccuaccagcagcgccaggaccgccgcgacaaccagggcgacggcggccucggcgucuucguccagcucaugcccauccucauccucauccucgucuccgcccucucccagcucauggucuccuccccccccuacucccucuccccccgccccuccgucggccacauccaccgccgcgucaccgaccaccucggcgucgucuacuacgucggcgacaccuucuccgaggaguacaccggcuccucccucaagaccgucgagcgcaacgucgaggacgacuacaucgccaaccuccgcaacaacugcuggaaggagaagcagcagaaggagggccuccucuaccgcgcccgcuacuucggcgacaccgacauguaccaccgcgcccagaagaugggcacccccuccugcucccgccucuccgagguccaggccucccuccacggcuga

SEQ ID NO: 8301 - RNA, 1230 nt, Artificial Sequence
  derived and/or modified sequence opt3 from DNAJB12__Homo_sapiens__NM_001002762.2
augagcucccugagagccaggcuccccgcuacccggcgccgaguggcacagccuuucgcccguccagcgucuccgucacuuguccccagaaguggcagcgcuauggaguccaacaaggacgaagccgagaggugcaucucuauugcacugaaagccauacaaucgaaucagccugaucgggcuuugcgcuuuuuagaaaaggcacagagacuguacccaacacccaggguucgggcccuaaucgagucacucaaccagaaaccucaaacugcuggggaccagccacccccuacggauaccacacacgccacucaucgcaaggcgggagguaccgacgcaccaagcgccaauggcgaagcugggggagagaguacaaaaggcuauaccgccgagcaaguggcagcuguaaagcgagugaagcaguguaaagauuacuaugaaauucugggugucuccagaggggccucugacgaggaucuuaagaaagcguacaggcggcuggccuugaaguuccacccggacaaaaaccaugcacccggagcuacugaagccuuuaaggcuaucggcacagccuaugcagugcucagcaauccugagaagcguaaacaauacgaucaguucggcgacgauaagucccaggccgcucgccacgggcauggacacggugacuuucacagaggcuucgaggcggauauuucaccagaagaccuguuuaacauguucuuugggggaggcuuccccaguagcaauguucauguguauucuaacgguaggaugcgguacaccuaccagcaacgacaggaccgcagagauaaucagggggacggaggccugggcgucuuugugcaacucaugccuaucuuaauacugauccuuguauccgcauugucacagcugaugguuagcaguccacccuauucucuauccccgaggccuagcguggggcacauucaucggcgcgucacggaucaccucggagugguguacuaugucggugacacuuucucggaggaauacaccgggucuucccugaaaacaguugagagaaacguggaagaugacuauaucgccaaucuuaggaacaauugcuggaaggagaaacagcagaaggagggccuguuguaccgugcucgguauuuuggagauacugacauguaccaccgagcccagaaaaugggcacccccucauguaguagacucagcgaaguacaggcaucccugcaugguuga

SEQ ID NO: 8302 - RNA, 1230 nt, Artificial Sequence
  derived and/or modified sequence opt4 from DNAJB12__Homo_sapiens__NM_001002762.2
augagcagccugagagccagacugcccgccaccagaagaagaguggcccagcccuucgccagacccgccagccccagccuggugcccagaagcggcagcgccauggagagcaacaaggacgaggccgagagaugcaucagcaucgcccugaaggccauccagagcaaccagcccgacagagcccugagauuccuggagaaggcccagagacuguaccccacccccagagugagagcccugaucgagagccugaaccagaagccccagaccgccggcgaccagcccccccccaccgacaccacccacgccacccacagaaaggccggcggcaccgacgcccccagcgccaacggcgaggccggcggcgagagcaccaagggcuacaccgccgagcagguggccgccgugaagagagugaagcagugcaaggacuacuacgagauccugggcgugagcagaggcgccagcgacgaggaccugaagaaggccuacagaagacuggcccugaaguuccaccccgacaagaaccacgcccccggcgccaccgaggccuucaaggccaucggcaccgccuacgccgugcugagcaaccccgagaagagaaagcaguacgaccaguucggcgacgacaagagccaggccgccagacacggccacggccacggcgacuuccacagaggcuucgaggccgacaucagccccgaggaccuguucaacauguucuucggcggcggcuuccccagcagcaacgugcacguguacagcaacggcagaaugagauacaccuaccagcagagacaggacagaagagacaaccagggcgacggcggccugggcguguucgugcagcugaugcccauccugauccugauccuggugagcgcccugagccagcugauggugagcagcccccccuacagccugagccccagacccagcgugggccacauccacagaagagugaccgaccaccugggcgugguguacuacgugggcgacaccuucagcgaggaguacaccggcagcagccugaagaccguggagagaaacguggaggacgacuacaucgccaaccugagaaacaacugcuggaaggagaagcagcagaaggagggccugcuguacagagccagauacuucggcgacaccgacauguaccacagagcccagaagaugggcacccccagcugcagcagacugagcgaggugcaggccagccugcacggcuga

SEQ ID NO: 8303 - RNA, 1230 nt, Artificial Sequence
  derived and/or modified sequence opt5 from DNAJB12__Homo_sapiens__NM_001002762.2
augagcucccugagagcccggcuccccgcuacccgcagacggguggcccagccuuucgcgcgcccggcuucucccagccuggucccuagauccggcucugccauggagagcaacaaggacgaagccgagcggugcaucuccauugcucuuaaagccauccaaucuaaucagcccgaucgcgcucugagauuucucgaaaaggcccagcggcuguacccuacaccccgcguuagagcgcuuauugagagccugaaccagaaaccucaaacggccggggaccagccgcccccuaccgauacaacccacgcuacacaucggaaggccggaggcaccgacgcucccuccgccaauggggaagcgggaggcgagagcacaaaaggguauaccgccgagcaaguggcugccgugaagcgcgucaagcaguguaaagauuacuaugaaauccucggagugucuagaggcgcuuccgacgaggaucugaagaaagccuaccggcgccuggcccucaaguuccacccugacaaaaaccaugcucccggcgcgacggaagccuuuaaggcuauugggaccgccuaugccguucugagcaauccggagaagagaaaacaauacgaucaguucggagacgauaagucucaggcugcccggcacggccaugggcacggagacuuucacagaggcuucgaggcggauaucuccccugaagaccuuuuuaacauguucuuugggggaggcuuccccagcucuaaugugcaugucuauuccaacggccgcaugcgguacacauaccagcaaagacaggaccgccgggauaaucagggggacggaggccuggggguguuuguucaacucaugccuauccugauucuuauccuggugagcgcucucucccagcugauggucucuagcccucccuauucccugagccccagaccgucugugggacacauucaucgccgggugaccgaucaccucggcgucguuuacuaugugggggacacauucuccgaggaauacaccggaagcucucugaaaacgguggagagaaacgucgaagaugacuauaucgccaaucuucgcaacaauugcuggaaggagaaacagcagaaggagggccugcucuaccgggccagauauuuuggcgauacagacauguaccaccgcgcucagaaaauggggacccccagcuguucccggcugucugaagugcaggccagccuucauggauga

SEQ ID NO: 8304 - protein, 559 aa, Artificial Sequence
  DNAJC11__Homo_sapiens__Q9NVH1
MATALSEEELDNEDYYSLLNVRREASSEELKAAYRRLCMLYHPDKHRDPELKSQAERLFNLVHQAYEVLSDPQTRAIYDIYGKRGLEMEGWEVVERRRTPAEIREEFERLQREREERRLQQRTNPKGTISVGVDATDLFDRYDEEYEDVSGSSFPQIEINKMHISQSIEAPLTATDTAILSGSLSTQNGNGGGSINFALRRVTSAKGWGELEFGAGDLQGPLFGLKLFRNLTPRCFVTTNCALQFSSRGIRPGLTTVLARNLDKNTVGYLQWRWGIQSAMNTSIVRDTKTSHFTVALQLGIPHSFALISYQHKFQDDDQTRVKGSLKAGFFGTVVEYGAERKISRHSVLGAAVSVGVPQGVSLKVKLNRASQTYFFPIHLTDQLLPSAMFYATVGPLVVYFAMHRLIIKPYLRAQKEKELEKQRESAATDVLQKKQEAESAVRLMQESVRRIIEAEESRMGLIIVNAWYGKFVNDKSRKSEKVKVIDVTVPLQCLVKDSKLILTEASKAGLPGFYDPCVGEEKNLKVLYQFRGVLHQVMVLDSEALRIPKQSHRIDTDG

SEQ ID NO: 8305 - RNA, 1680 nt, Artificial Sequence
  DNAJC11__Homo_sapiens__CCDS87.1
auggcgacggccuugagcgaggaggagcuggacaaugaagacuauuacucguugcugaacgugcgcagggaggccucuucugaagagcugaaagcugccuaccggaggcucuguaugcucuaccauccagacaagcacagagacccagagcucaagucacaggcggaacgacuguuuaaccuuguucaccaggcuuaugaagugcuuagugacccccaaaccagggccaucuaugauauauaugggaagagaggacuggaaauggaaggaugggagguuguggaaaggaggagaaccccugcugaaauucgagaggaguuugagcggcugcagagagagagagaagagaggagauugcagcagcgaaccaaucccaagggaacgaucagcguuggaguagaugccaccgaccuuuuugaucgcuaugaugaggaguaugaagauguguccggcaguagcuuuccgcagauugaaauuaauaaaaugcacauaucccaguccauugaggcacccuugacagcgacagacacagccauccucucuggaagccucucaacccagaauggaaauggaggagguuccauuaacuuugcgcucagacgaguaacuucggcaaagggauggggagaguuggaauuuggagcuggagaccuacaggggccuuuguucggucucaagcuguuccguaaucucacaccaagaugcuuugugacaacaaacugugcucugcaguuuucaucccguggaauccgacccggccugaccacuguccuagcucggaaccuagacaagaacaccgugggcuaccugcaguggcgaugggguauccagucagccaugaacacuagcaucguccgagacacuaaaaccagccacuucacuguggcccugcagcugggaaucccucacuccuuugcacugaucagcuaucagcacaaauuccaagaugacgaucagacucgugugaaaggaucccucaaagcaggcuucuuugggacggugguggaguacggagcugagaggaagaucuccaggcacagcguuuugggugcagcugucagcguuggaguuccacaggguguuucucucaaagucaagcucaacagggccagucagacauacuucuucccuauucacuugacggaccagcuucugcccagcgccauguucuaugccaccguggggccucuaguggucuacuuugccaugcaccgucugaucaucaaaccauaccucagggcucagaaagagaaggaauuggagaagcagagggaaagcgccgccaccgaugugcugcagaagaagcaagaggcggaguccgcuguccggcugaugcaggaaucuguccgaaggauaauugaggcagaagaguccagaaugggccucaucaucgucaaugccugguacgggaaguuugucaaugacaagagcaggaagagcgagaaggugaaggugauugacgugacugugccccugcagugccuggugaaggacucgaagcucauccucacggaggccuccaaggcugggcugccuggcuuuuaugacccgugugugggggaagagaagaaccugaaagugcucuaucaguuccggggcguccugcaucaggugauggugcuggacagugaggcccuccggauaccaaagcagucccacaggaucgauacagauggauaa

SEQ ID NO: 8306 - RNA, 1680 nt, Artificial Sequence
  derived and/or modified sequence opt1 from DNAJC11__Homo_sapiens__CCDS87.1
auggccaccgcccugagcgaggaggagcucgacaacgaggacuacuacucccugcugaacgugcgccgggaggcgagcuccgaggagcucaaggccgccuaccgccggcugugcaugcuguaccaccccgacaagcaccgcgacccggagcucaagagccaggccgagcggcuguucaaccugguccaccaggccuacgaggugcucuccgacccccagacccgcgcgaucuacgacaucuacggcaagcgggggcuggagauggagggcugggagguggucgagcgccggcgcacgcccgccgagauccgggaggaguucgagcgccugcagcgggagcgcgaggagcggcgccuccagcagcggaccaaccccaaggggaccaucagcgugggcguggacgccaccgaccuguucgaccgcuacgacgaggaguacgaggacgucuccgggagcuccuucccgcagaucgagaucaacaagaugcacaucagccaguccaucgaggcgccccugacggccaccgacaccgccauccucagcggcucccugagcacccagaacggcaacgggggcggguccaucaacuucgcccugcggcgcgugacgagcgccaagggcuggggcgagcucgaguucggggccggcgaccugcaggggccccuguucggccucaagcuguuccggaaccugacgccccgcugcuucgugaccaccaacugcgcgcuccaguucuccagccgcgggauccggccgggccugaccaccguccuggcccgcaaccucgacaagaacaccgugggcuaccugcaguggcggugggggauccaguccgccaugaacaccagcaucgugcgcgacacgaagaccagccacuucaccgucgcccugcagcucggcaucccccacuccuucgcccugaucagcuaccagcacaaguuccaggacgacgaccagacccgggugaaggggucccugaaggcgggcuucuucgggacgguggucgaguacggcgccgagcgcaagaucagccggcacuccgugcucggcgccgccgugagcgucggggugccccagggcgugucccugaaggucaagcugaaccgcgccagccagaccuacuucuuccccauccaccucaccgaccagcugcugccguccgcgauguucuacgccaccguggggccccucguggucuacuucgccaugcaccggcugaucaucaagcccuaccugcgcgcccagaaggagaaggagcucgagaagcagcgggagagcgccgcgacggacgugcugcagaagaagcaggaggccgaguccgccguccgccugaugcaggagagcgugcggcgcaucaucgaggccgaggagucccggaugggccucaucaucgugaacgcgugguacgggaaguucgucaacgacaagagccgcaaguccgagaaggugaaggugaucgacgucaccgugccccugcagugccuggugaaggacagcaagcucauccugaccgaggccuccaaggccggccugccgggcuucuacgaccccugcgucggggaggagaagaaccugaaggugcucuaccaguuccggggcgugcugcaccaggucauggugcuggacagcgaggcccuccgcauccccaagcagucccaccggaucgacaccgacggguga

SEQ ID NO: 8307 - RNA, 1680 nt, Artificial Sequence
  derived and/or modified sequence opt2 from DNAJC11__Homo_sapiens__CCDS87.1
auggccaccgcccucuccgaggaggagcucgacaacgaggacuacuacucccuccucaacguccgccgcgaggccuccuccgaggagcucaaggccgccuaccgccgccucugcaugcucuaccaccccgacaagcaccgcgaccccgagcucaagucccaggccgagcgccucuucaaccucguccaccaggccuacgagguccucuccgacccccagacccgcgccaucuacgacaucuacggcaagcgcggccucgagauggagggcugggaggucgucgagcgccgccgcacccccgccgagauccgcgaggaguucgagcgccuccagcgcgagcgcgaggagcgccgccuccagcagcgcaccaaccccaagggcaccaucuccgucggcgucgacgccaccgaccucuucgaccgcuacgacgaggaguacgaggacgucuccggcuccuccuucccccagaucgagaucaacaagaugcacaucucccaguccaucgaggccccccucaccgccaccgacaccgccauccucuccggcucccucuccacccagaacggcaacggcggcggcuccaucaacuucgcccuccgccgcgucaccuccgccaagggcuggggcgagcucgaguucggcgccggcgaccuccagggcccccucuucggccucaagcucuuccgcaaccucaccccccgcugcuucgucaccaccaacugcgcccuccaguucuccucccgcggcauccgccccggccucaccaccguccucgcccgcaaccucgacaagaacaccgucggcuaccuccaguggcgcuggggcauccaguccgccaugaacaccuccaucguccgcgacaccaagaccucccacuucaccgucgcccuccagcucggcaucccccacuccuucgcccucaucuccuaccagcacaaguuccaggacgacgaccagacccgcgucaagggcucccucaaggccggcuucuucggcaccgucgucgaguacggcgccgagcgcaagaucucccgccacuccguccucggcgccgccgucuccgucggcgucccccagggcgucucccucaaggucaagcucaaccgcgccucccagaccuacuucuuccccauccaccucaccgaccagcuccuccccuccgccauguucuacgccaccgucggcccccucgucgucuacuucgccaugcaccgccucaucaucaagcccuaccuccgcgcccagaaggagaaggagcucgagaagcagcgcgaguccgccgccaccgacguccuccagaagaagcaggaggccgaguccgccguccgccucaugcaggaguccguccgccgcaucaucgaggccgaggagucccgcaugggccucaucaucgucaacgccugguacggcaaguucgucaacgacaagucccgcaaguccgagaaggucaaggucaucgacgucaccgucccccuccagugccucgucaaggacuccaagcucauccucaccgaggccuccaaggccggccuccccggcuucuacgaccccugcgucggcgaggagaagaaccucaagguccucuaccaguuccgcggcguccuccaccaggucaugguccucgacuccgaggcccuccgcauccccaagcagucccaccgcaucgacaccgacggcuga

SEQ ID NO: 8308 - RNA, 1680 nt, Artificial Sequence
  derived and/or modified sequence opt3 from DNAJC11__Homo_sapiens__CCDS87.1
auggccaccgcucugagcgaggaggaacucgacaacgaagauuacuauucccuucugaaugugagaagggaggcaucuucagaagaguugaaggccgcguaccggcgcuuaugcaugcuguaucaccccgacaaacaucgagauccugagcuaaagagucaggcugaacgucucuucaaccugguccaccaagccuacgagguucuuagcgacccacagacaagagcaaucuaugauauuuacggcaaaagggggcuggaaauggagggaugggaggugguagaacggcgcagaacuccggccgagauaagggaagaguuugaacgguugcagcgcgagcgagaggaaagaaggcuccagcaacggacgaaucccaaggguaccaucuccgugggcgucgacgcuacagaucuguucgaccguuaugaugaggaauacgaggacgugucugggucgucauuuccucagauugaaaucaacaaaaugcauauuagccagaguaucgaggcaccacugacugccaccgauacagcuauacucuccggaucuuuaagcacccagaauggcaacggugggggauccaucaauuucgcccugcgcagaguuacuucagcgaagggcuggggcgagcuugaauuuggggcaggagacuugcaagguccccuguucggccuaaagcucuuuaggaaccugacaccucgguguuucgugaccacgaauugcgcccuucaguuuaguagccgagggauucgcccaggacugacuaccgucuuggcuagaaaccucgauaaaaauacagugggcuaccugcaguggaggugggguauccagucugccaugaacacuuccauuguacgggacaccaagacaucacacuucaccguugcauuacaacuggggaucccccauagcuuugcucucauaaguuaucagcacaaauuccaggacgaugaccaaacgcgcgugaagggaucucuuaaagccggcuuuuucggcacugucguggaguacggggcggaaagaaagauuuccaggcacagcgugcugggagccgcagucucgguuggugugccucagggcguaucuuugaaggugaaacuaaaucgugcuucccagacauauuucuuuccaauccaucugaccgaucagcuccugccgucagccauguucuacgcuacugucgggccccuugugguuuauuuugccaugcaccggcugauuaucaagccuuacuugcgagcacaaaaagagaaggaacucgagaaacagagagagagugccgcuacagacgugcugcagaagaaacaggaagcggagagcgcagucagguuaaugcaagaauccgugcgccggaucauugaggccgaggaaucuagaaugggacugauaaucguaaacgcuugguauggcaaguucguuaaugauaagagcaggaaaucagagaaggugaaagucauugacgugaccgucccacuacagugucucgugaaggauaguaaacugauccuuacggaagccuccaaggcagguuugcccggguuuuacgacccuugcguuggcgaggaaaagaaccugaaagugcucuaccaguuccgcggaguacugcaucaggucauggugcuugauagcgaggcccugcgaauaccaaagcaaucucaccggauugacaccgauggcuga

SEQ ID NO: 8309 - RNA, 1680 nt, Artificial Sequence
  derived and/or modified sequence opt4 from DNAJC11__Homo_sapiens__CCDS87.1
auggccaccgcccugagcgaggaggagcuggacaacgaggacuacuacagccugcugaacgugagaagagaggccagcagcgaggagcugaaggccgccuacagaagacugugcaugcuguaccaccccgacaagcacagagaccccgagcugaagagccaggccgagagacuguucaaccuggugcaccaggccuacgaggugcugagcgacccccagaccagagccaucuacgacaucuacggcaagagaggccuggagauggagggcugggaggugguggagagaagaagaacccccgccgagaucagagaggaguucgagagacugcagagagagagagaggagagaagacugcagcagagaaccaaccccaagggcaccaucagcgugggcguggacgccaccgaccuguucgacagauacgacgaggaguacgaggacgugagcggcagcagcuucccccagaucgagaucaacaagaugcacaucagccagagcaucgaggccccccugaccgccaccgacaccgccauccugagcggcagccugagcacccagaacggcaacggcggcggcagcaucaacuucgcccugagaagagugaccagcgccaagggcuggggcgagcuggaguucggcgccggcgaccugcagggcccccuguucggccugaagcuguucagaaaccugacccccagaugcuucgugaccaccaacugcgcccugcaguucagcagcagaggcaucagacccggccugaccaccgugcuggccagaaaccuggacaagaacaccgugggcuaccugcaguggagauggggcauccagagcgccaugaacaccagcaucgugagagacaccaagaccagccacuucaccguggcccugcagcugggcaucccccacagcuucgcccugaucagcuaccagcacaaguuccaggacgacgaccagaccagagugaagggcagccugaaggccggcuucuucggcaccgugguggaguacggcgccgagagaaagaucagcagacacagcgugcugggcgccgccgugagcgugggcgugccccagggcgugagccugaaggugaagcugaacagagccagccagaccuacuucuuccccauccaccugaccgaccagcugcugcccagcgccauguucuacgccaccgugggcccccuggugguguacuucgccaugcacagacugaucaucaagcccuaccugagagcccagaaggagaaggagcuggagaagcagagagagagcgccgccaccgacgugcugcagaagaagcaggaggccgagagcgccgugagacugaugcaggagagcgugagaagaaucaucgaggccgaggagagcagaaugggccugaucaucgugaacgccugguacggcaaguucgugaacgacaagagcagaaagagcgagaaggugaaggugaucgacgugaccgugccccugcagugccuggugaaggacagcaagcugauccugaccgaggccagcaaggccggccugcccggcuucuacgaccccugcgugggcgaggagaagaaccugaaggugcuguaccaguucagaggcgugcugcaccaggugauggugcuggacagcgaggcccugagaauccccaagcagagccacagaaucgacaccgacggcuga

SEQ ID NO: 8310 - RNA, 1680 nt, Artificial Sequence
  derived and/or modified sequence opt5 from DNAJC11__Homo_sapiens__CCDS87.1
auggccaccgcucugagcgaggaagaacucgacaacgaagauuacuauucccugcuuaaugugagacgggaggccucuagcgaggagcugaaggcggcuuaccgcagacucugcaugcuguaucaccccgacaaacaucgggauccugagcuuaagucccaggccgaacgccuguucaaccucguccaccaagccuacgagguucugucugacccgcagacaagagcuaucuaugauauuuacggcaaacgggggcuggaaauggagggaugggaggugguggaacgcagacggacgcccgccgagauccgcgaagaguuugaaagacuccagcgggagcgcgaggaaagacggcugcagcaacgcaccaauccuaagggcacaauuagcgucgggguggacgcuaccgaucuuuucgacagauaugaugaggaauacgaggacguuuccggaucuagcuuuccccagaucgaaauuaacaaaaugcauaucucccagagcaucgaggccccucugacagcgaccgauacagccauucucucuggcucccugagcacccagaaugggaacggaggcggcucuaucaauuucgcccuucggagagugacguccgcuaagggguggggagagcuggaauuuggcgcuggggaccuccaaggaccccuguucggccugaagcucuuucgcaaccugaccccucgguguuucgucacaaccaauugcgcccuucaguuuagcucuagagggauucgcccgggacugacaaccgugcucgcgcggaaccuggauaaaaauacgguuggcuaccuucaguggagauggggcauccaguccgccaugaacacaagcauugugcgcgacaccaagacaucccacuucaccgucgcucugcaacucgggaucccccauucuuuugcccugauuagcuaucagcacaaauuccaggacgaugaccaaacccgggugaagggaucccugaaagcuggcuuuuucgggacaguggucgaguacggagccgaaagaaagaucagccgccacucuguucucggcgccgcuguguccgugggggucccucagggagugagccugaagguuaaacuuaaucgggcgucucagacguauuucuuucccauccaucugaccgaucagcuccugccuagcgccauguucuacgcuacagugggcccccuugucguguauuuugccaugcacagacugauuaucaagccguaccuccgcgcccaaaaagagaaggaacuggagaaacagcgggaguccgcugccaccgacguucugcagaagaaacaggaagcggagucugcugugagacucaugcaagaaagcguccggcgcauuaucgaggccgaggaauccagaaugggccugauuaucgugaacgccugguaugggaaguucgucaaugauaagagccggaaaucugagaaggugaaaguuaucgacgugacagucccucuucagugucuggugaaggauuccaaacucauucugaccgaagcuagcaaggccggacugcccggcuuuuacgacccuugcguuggggaggaaaagaaccuuaaagugcucuaccaguucagaggaguccugcaucaggugauggugcuggauucugaggcucuccgcauccccaagcaaucccaccggauugacacggauggcuga

SEQ ID NO: 8311 - protein, 531 aa, Artificial Sequence
  DNAJC21__Homo_sapiens__Q5F1R6
MKCHYEALGVRRDASEEELKKAYRKLALKWHPDKNLDNAAEAAEQFKLIQAAYDVLSDPQERAWYDNHREALLKGGFDGEYQDDSLDLLRYFTVTCYSGYGDDEKGFYTVYRNVFEMIAKEELESVLEEEVDDFPTFGDSQSDYDTVVHPFYAYWQSFCTQKNFAWKEEYDTRQASNRWEKRAMEKENKKIRDKARKEKNELVRQLVAFIRKRDKRVQAHRKLVEEQNAEKARKAEEMRRQQKLKQAKLVEQYREQSWMTMANLEKELQEMEARYEKEFGDGSDENEMEEHELKDEEDGKDSDEAEDAELYDDLYCPACDKSFKTEKAMKNHEKSKKHREMVALLKQQLEEEEENFSRPQIDENPLDDNSEEEMEDAPKQKLSKKQKKKKQKPAQNYDDNFNVNGPGEGVKVDPEDTNLNQDSAKELEDSPQENVSVTEIIKPCDDPKSEAKSVPKPKGKKTKDMKKPVRVPAEPQTMSVLISCTTCHSEFPSRNKLFDHLKATGHARAPSSSSLNSATSSQSKKEKRKNR

SEQ ID NO: 8312 - RNA, 1596 nt, Artificial Sequence
  DNAJC21__Homo_sapiens__CCDS34144.1
augaagugucacuaugaggcgcugggggugcggcgcgacgccagcgaggaggagcucaagaaggccuaucggaagcuggcccugaaauggcacccggauaaaaaucuggauaaugccgcagaagcagcugaacaauuuaaauuaauccaagcagcauaugauguguugagugacccucaggaaagagcaugguaugauaaucauagagaggcccuacuuaaagguggguuugauggcgaauaucaagaugacagcuuagauuugcuacgcuauuucaccguuaccuguuauucugguuauggagaugaugaaaagggauuuuacacgguguaucguaauguuuuugaaaugauugccaaggaagaacuagaaucuguguuagaggaagagguugaugauuucccaacuuuuggagacucccagagugacuaugauacgguaguccauccuuucuacgcuuauuggcagaguuucugcacucaaaagaauuuugcauggaaggaagaauaugauacacgacaggcuucaaaccgcugggaaaaacgagccauggaaaaagaaaacaaaaagauucgggacaaagcaaggaaagagaagaaugagcuuguccgucagcugguagcuuucauucguaaaagagauaaaagagugcaggcgcaucgaaaacuuguggaagaacagaaugcagagaaggcgaggaaagccgaagagaugaggcggcagcagaagcuaaagcaggccaaacugguggagcaguacagagaacagagcuggaugacuauggccaauuuggagaaagagcuccaggagauggaggcacgguacgagaaggaguuuggagauggaucggaugaaaaugaaauggaagaacaugaacucaaagaugaggaggaugguaaagacagugaugaggccgaggacgcugagcucuaugaugaccuuuacugcccagcaugugacaaaucguucaagacagaaaaggccaugaagaaucacgagaagucaaagaagcaucgggaaaugguggccuugcuaaaacaacagcuggaggaggaagaagaaaauuuuucaagaccucaaauugaugaaaauccauuagaugacaauucugaggaagaaauggaagaugcaccaaaacaaaagcuuucuaaaaaacagaagaaaaagaaacagaaaccagcacagaauuaugaugacaauuucaauguaaauggaccuggagaaggaguaaagguugauccagaagauacuaacuuaaaucaagacagugccaaagaauuggaagauaguccccaggaaaaugucagugucacagagaucauuaaaccaugugaugauccaaaaagugaagcuaaaaguguuccuaaacccaaaggaaagaaaaccaaagauaugaaaaaaccugucagaguaccugcugaaccacaaacaaugaguguucuuaucagcuguacaaccugccauagugaauuuccaucucggaauaaacuuuuugaccaucuaaaggccacaggucaugcaagagcaccuucaucaucgucuuuaaacagcgcaacaaguagucaaagcaagaaagagaaacguaaaaacagauag

SEQ ID NO: 8313 - RNA, 1596 nt, Artificial Sequence
  derived and/or modified sequence opt1 from DNAJC21__Homo_sapiens__CCDS34144.1
augaagugccacuacgaggcccugggcgugcgccgggacgccagcgaggaggagcucaagaaggcguaccgcaagcuggcccugaaguggcaccccgacaagaaccucgacaacgccgccgaggccgcggagcaguucaagcugauccaggccgccuacgacguccuguccgacccgcaggagcgggccugguacgacaaccaccgcgaggcgcuccugaagggcggguucgacggggaguaccaggacgacagccuggaccuccugcgguacuucaccgugaccugcuacuccggcuacggggacgacgagaagggcuucuacacgguguaccgcaacgucuucgagaugaucgccaaggaggagcuggagagcgugcucgaggaggagguggacgacuuccccaccuucggcgacucccagagcgacuacgacaccgucgugcaccccuucuacgccuacuggcaguccuucugcacccagaagaacuucgccuggaaggaggaguacgacacgcggcaggccagcaaccgcugggagaagcgggcgauggagaaggagaacaagaagauccgcgacaaggcccggaaggagaagaacgagcuggugcgccagcuggucgccuucauccggaagcgcgacaagcgggugcaggcccaccgcaagcucguggaggagcagaacgccgagaaggcgcggaaggccgaggagaugcgccggcagcagaagcugaagcaggccaagcuggucgagcaguaccgcgagcaguccuggaugaccauggccaaccucgagaaggagcugcaggagauggaggcccgguacgagaaggaguucggggacggcagcgacgagaacgagauggaggagcacgagcugaaggacgaggaggacgggaaggacuccgacgaggcggaggacgccgagcucuacgacgaccuguacugccccgccugcgacaagagcuucaagaccgagaaggccaugaagaaccacgagaaguccaagaagcaccgcgagaugguggcccugcucaagcagcagcuggaggaggaggaggagaacuucagccgcccgcagaucgacgagaacccccuggacgacaacuccgaggaggagauggaggacgcgcccaagcagaagcucagcaagaagcagaagaagaagaagcagaagcccgcccagaacuacgacgacaacuucaacgugaacggcccgggggagggcgucaagguggaccccgaggacaccaaccugaaccaggacuccgccaaggagcuggaggacagcccccaggagaacguguccgucacggagaucaucaagcccugcgacgaccccaagagcgaggccaagagcgugccgaagcccaagggcaagaagaccaaggacaugaagaagcccgugcgggucccggcggagccccagaccauguccgugcucaucagcugcaccacgugccacuccgaguuccccagccgcaacaagcuguucgaccaccugaaggccaccgggcacgcccgggcccccuccagcuccagccucaacuccgccaccagcucccagagcaagaaggagaagcgcaagaaccgguga

SEQ ID NO: 8314 - RNA, 1596 nt, Artificial Sequence
  derived and/or modified sequence opt2 from DNAJC21__Homo_sapiens__CCDS34144.1
augaagugccacuacgaggcccucggcguccgccgcgacgccuccgaggaggagcucaagaaggccuaccgcaagcucgcccucaaguggcaccccgacaagaaccucgacaacgccgccgaggccgccgagcaguucaagcucauccaggccgccuacgacguccucuccgacccccaggagcgcgccugguacgacaaccaccgcgaggcccuccucaagggcggcuucgacggcgaguaccaggacgacucccucgaccuccuccgcuacuucaccgucaccugcuacuccggcuacggcgacgacgagaagggcuucuacaccgucuaccgcaacgucuucgagaugaucgccaaggaggagcucgaguccguccucgaggaggaggucgacgacuuccccaccuucggcgacucccaguccgacuacgacaccgucguccaccccuucuacgccuacuggcaguccuucugcacccagaagaacuucgccuggaaggaggaguacgacacccgccaggccuccaaccgcugggagaagcgcgccauggagaaggagaacaagaagauccgcgacaaggcccgcaaggagaagaacgagcucguccgccagcucgucgccuucauccgcaagcgcgacaagcgcguccaggcccaccgcaagcucgucgaggagcagaacgccgagaaggcccgcaaggccgaggagaugcgccgccagcagaagcucaagcaggccaagcucgucgagcaguaccgcgagcaguccuggaugaccauggccaaccucgagaaggagcuccaggagauggaggcccgcuacgagaaggaguucggcgacggcuccgacgagaacgagauggaggagcacgagcucaaggacgaggaggacggcaaggacuccgacgaggccgaggacgccgagcucuacgacgaccucuacugccccgccugcgacaaguccuucaagaccgagaaggccaugaagaaccacgagaaguccaagaagcaccgcgagauggucgcccuccucaagcagcagcucgaggaggaggaggagaacuucucccgcccccagaucgacgagaacccccucgacgacaacuccgaggaggagauggaggacgcccccaagcagaagcucuccaagaagcagaagaagaagaagcagaagcccgcccagaacuacgacgacaacuucaacgucaacggccccggcgagggcgucaaggucgaccccgaggacaccaaccucaaccaggacuccgccaaggagcucgaggacuccccccaggagaacgucuccgucaccgagaucaucaagcccugcgacgaccccaaguccgaggccaaguccguccccaagcccaagggcaagaagaccaaggacaugaagaagcccguccgcguccccgccgagccccagaccauguccguccucaucuccugcaccaccugccacuccgaguuccccucccgcaacaagcucuucgaccaccucaaggccaccggccacgcccgcgcccccuccuccuccucccucaacuccgccaccuccucccaguccaagaaggagaagcgcaagaaccgcuga

SEQ ID NO: 8315 - RNA, 1596 nt, Artificial Sequence
  derived and/or modified sequence opt3 from DNAJC21__Homo_sapiens__CCDS34144.1
augaagugccacuacgaggcccugggcgugagaagggacgcuagcgaagaggaacucaaaaaggcauaucggaaacuugcccugaaguggcaucccgauaaaaacuuggacaaugcggcugaggccgcagaacaguucaaguuaauccaagccgcuuacgauguccuguccgacccucaggagcgcgcaugguaugauaaccaccgagaggcccuacucaaagggggauuugacggugaauaccaggaugacucucuggaucuucugcguuauuucaccguuacauguuacucaggcuauggggacgaugagaagggauuuuacacuguguacagaaauguauucgaaaugauugcuaaggaggaguuggaaagugugcucgaggaagaggucgacgauuuuccaacguucggcgacagccaguccgacuaugauaccgugguucauccguuuuacgccuauuggcaaucuuucugcacacagaaaaacuuugcguggaaggaagaguacgacacuaggcaggcaucgaaucggugggagaaacgcgccauggaaaaggagaacaagaaaauaagagauaaggcuaggaaagaaaagaaugagcuggugcggcagcuggucgccuucauccgcaaacgagacaagagagugcaagcacacaggaaacucguagaagaacagaacgcugagaaggcccggaaggcggaagagaugcgucgccagcagaaauuaaagcaagccaaacugguugaacaguauagagagcagucauggaugaccauggcaaaucuugaaaaggaguugcaagagauggaagcuagguacgagaaagaauuuggugaugggagcgacgagaacgagauggaggagcaugaacugaaggaugaggaagacggaaaggauagugacgaggccgaggaugcugaacuauaugacgaccucuacugucccgccugcgauaaauccuucaagacagagaaagcaaugaagaaucacgaaaaaucuaagaagcaccgggagaugguggcccugcuuaaacagcagcuggaagaggaggaagagaacuuuagccgaccucagauugacgaaaauccauuggaugacaacuccgaggaagagauggaggaugcucccaagcaaaaacucucaaagaaacagaagaagaaaaagcagaaaccugcgcagaauuacgacgauaacuucaacgucaauggcccaggcgaaggggugaagguggaccccgaggauaccaaccugaaucaagacagugcaaaagaauuagaggauagcccucaggagaacgucucuguuacugaaaucauuaagccaugugacgauccgaaauccgaggccaagucagugcccaagccuaaaggaaagaaaacaaaggacaugaaaaagccaguacgcgugcccgcugaaccucagaccaugagcguccugaucaguugcacgacuugucauucugaguucccauccagaaauaagcucuuugaccaccuuaaagccaccggucaugcaagggcccccagcucgucuucccugaacucagcuacaaguagccaguccaagaaagaaaagcggaaaaaucgcuga

SEQ ID NO: 8316 - RNA, 1596 nt, Artificial Sequence
  derived and/or modified sequence opt4 from DNAJC21__Homo_sapiens__CCDS34144.1
augaagugccacuacgaggcccugggcgugagaagagacgccagcgaggaggagcugaagaaggccuacagaaagcuggcccugaaguggcaccccgacaagaaccuggacaacgccgccgaggccgccgagcaguucaagcugauccaggccgccuacgacgugcugagcgacccccaggagagagccugguacgacaaccacagagaggcccugcugaagggcggcuucgacggcgaguaccaggacgacagccuggaccugcugagauacuucaccgugaccugcuacagcggcuacggcgacgacgagaagggcuucuacaccguguacagaaacguguucgagaugaucgccaaggaggagcuggagagcgugcuggaggaggagguggacgacuuccccaccuucggcgacagccagagcgacuacgacaccguggugcaccccuucuacgccuacuggcagagcuucugcacccagaagaacuucgccuggaaggaggaguacgacaccagacaggccagcaacagaugggagaagagagccauggagaaggagaacaagaagaucagagacaaggccagaaaggagaagaacgagcuggugagacagcugguggccuucaucagaaagagagacaagagagugcaggcccacagaaagcugguggaggagcagaacgccgagaaggccagaaaggccgaggagaugagaagacagcagaagcugaagcaggccaagcugguggagcaguacagagagcagagcuggaugaccauggccaaccuggagaaggagcugcaggagauggaggccagauacgagaaggaguucggcgacggcagcgacgagaacgagauggaggagcacgagcugaaggacgaggaggacggcaaggacagcgacgaggccgaggacgccgagcuguacgacgaccuguacugccccgccugcgacaagagcuucaagaccgagaaggccaugaagaaccacgagaagagcaagaagcacagagagaugguggcccugcugaagcagcagcuggaggaggaggaggagaacuucagcagaccccagaucgacgagaacccccuggacgacaacagcgaggaggagauggaggacgcccccaagcagaagcugagcaagaagcagaagaagaagaagcagaagcccgcccagaacuacgacgacaacuucaacgugaacggccccggcgagggcgugaagguggaccccgaggacaccaaccugaaccaggacagcgccaaggagcuggaggacagcccccaggagaacgugagcgugaccgagaucaucaagcccugcgacgaccccaagagcgaggccaagagcgugcccaagcccaagggcaagaagaccaaggacaugaagaagcccgugagagugcccgccgagccccagaccaugagcgugcugaucagcugcaccaccugccacagcgaguuccccagcagaaacaagcuguucgaccaccugaaggccaccggccacgccagagcccccagcagcagcagccugaacagcgccaccagcagccagagcaagaaggagaagagaaagaacagauga

SEQ ID NO: 8317 - RNA, 1596 nt, Artificial Sequence
  derived and/or modified sequence opt5 from DNAJC21__Homo_sapiens__CCDS34144.1
augaagugccacuacgaggcccugggcgugagacgggacgcuagcgaagaggaacucaaaaaggccuaucgcaaacuggcgcuuaaguggcaucccgauaaaaaccuggacaaugcugccgaggccgcugaacaguucaagcucauccaagccgcuuacgauguccuguccgacccucaggagagagccugguaugauaaccaccgggaggcgcuucugaaagggggauuugacggcgaauaccaggaugacucucucgaucugcugcgcuauuucaccguuacauguuacagcggguauggagacgaugagaagggcuuuuacacgguguacagaaauguguucgaaaugauugccaaggaggagcucgaauccguccuggaggaagagguggacgauuuuccgaccuucggggacucucagagcgacuaugauacaguugugcaucccuuuuacgcuuauuggcaauccuucugcacccagaaaaacuuugccuggaaggaagaguacgacacacggcaggcuucuaaucgcugggagaaaagagccauggaaaaggagaacaagaaaauccgggauaaggcgcgcaaagaaaagaaugagcuugucagacagcugguggccuucauucggaaacgcgacaagagaguucaagcucaccggaaacucguggaagaacagaacgccgagaaggcucgcaaggccgaagagaugagacggcagcagaaacugaagcaagccaaacuugucgaacaguauagagagcagagcuggaugaccauggcuaaucuggaaaaggagcuccaagagauggaagcgcgcuacgagaaagaauuuggagauggcuccgacgagaacgagauggaggagcaugaacugaaggaugaggaagacggcaaggauagcgacgaggccgaggaugcugaacuguaugacgaccucuacuguccugccugcgauaaaucuuucaagacagagaaagccaugaagaaucacgaaaaauccaagaagcaccgggagaugguggcucugcuuaaacagcagcuggaagaggaggaagagaacuuuagcagaccccagaucgacgaaaauccucucgaugacaacucugaggaagagauggaggaugcccccaagcaaaaacuguccaagaaacagaagaagaaaaagcagaaaccugcgcagaauuacgacgauaacuucaacgugaaugggccgggagaaggcgucaagguugaccccgaggauaccaaccuuaaucaagacagcgcuaaagaacuggaggauucuccucaggagaacguguccgugacggaaauuaucaagcccugugacgauccuaaaagcgaggccaaguccguccccaagccgaaagggaagaaaaccaaggacaugaaaaagccugugcgcguucccgccgaaccucagacaaugucugugcucaucagcugcaccacaugucauuccgaguuccccagccggaauaagcuguuugaccaccugaaagcuaccggacaugccagagcucccucuuccagcucucucaacagcgccacguccucucagagcaagaaagaaaagcgcaaaaaucgguga

SEQ ID NO: 8318 - protein, 397 aa, Artificial Sequence
  DNJA1__Homo_sapiens__P31689
MVKETTYYDVLGVKPNATQEELKKAYRKLALKYHPDKNPNEGEKFKQISQAYEVLSDAKKRELYDKGGEQAIKEGGAGGGFGSPMDIFDMFFGGGGRMQRERRGKNVVHQLSVTLEDLYNGATRKLALQKNVICDKCEGRGGKKGAVECCPNCRGTGMQIRIHQIGPGMVQQIQSVCMECQGHGERISPKDRCKSCNGRKIVREKKILEVHIDKGMKDGQKITFHGEGDQEPGLEPGDIIIVLDQKDHAVFTRRGEDLFMCMDIQLVEALCGFQKPISTLDNRTIVITSHPGQIVKHGDIKCVLNEGMPIYRRPYEKGRLIIEFKVNFPENGFLSPDKLSLLEKLLPERKEVEETDEMDQVELVDFDPNQERRRHYNGEAYEDDEHHPRGGVQCQTS

SEQ ID NO: 8319 - RNA, 1194 nt, Artificial Sequence
  DNJA1__Homo_sapiens__AAC37517
auggugaaagaaacaacuuacuacgauguuuugggggucaaacccaaugcuacucaggaagaauugaaaaaggcuuauaggaaacuggccuugaaguaccauccugauaagaacccaaaugaaggagagaaguuuaaacagauuucucaagcuuacgaaguucucucugaugcaaagaaaagggaauuauaugacaaaggaggagaacaggcaauuaaagaggguggagcagguggcgguuuuggcucccccauggacaucuuugauauguuuuuuggaggaggaggaaggaugcagagagaaaggagagguaaaaauguuguacaucagcucucaguaacccuagaagacuuauauaauggugcaacaagaaaacuggcucugcaaaagaaugugauuugugacaaaugugaagguagaggagguaagaaaggagcaguagagugcugucccaauugccgagguacuggaaugcaaauaagaauucaucagauaggaccuggaaugguucagcaaauucagucugugugcauggagugccagggccauggggagcggaucaguccuaaagauagauguaaaagcugcaacggaaggaagauaguucgagagaagaaaauuuuagaaguucauauugacaaaggcaugaaagauggccagaagauaacauuccauggugaaggagaccaagaaccaggacuggagccaggcgauauuaucauuguguuagaucagaaggaccaugcuguuuuuacucgacgaggagaagaccuuuucauguguauggacauacagcucguugaagcacuguguggcuuccagaagccaauaucuacucuugacaaccgaaccaucgucaucaccucucauccaggucagauugucaagcauggagauaucaaguguguacuaaaugaaggcaugccaauuuaucguagaccauaugaaaagggucgccuaaucaucgaauuuaagguaaacuuuccugagaauggcuuucucucuccugauaaacugucuuugcuggaaaaacuccuacccgagaggaaggaaguggaagagacugaugagauggaccaaguagaacugguggacuuugauccaaaucaggaaagacggcgccacuacaauggagaagcauaugaggaugaugaacaucaucccagaggugguguucagugucagaccucuuaa

SEQ ID NO: 8320 - RNA, 1194 nt, Artificial Sequence
  derived and/or modified sequence opt1 from DNJA1__Homo_sapiens__AAC37517
auggugaaggagaccaccuacuacgacguccugggcgugaagcccaacgccacgcaggaggagcucaagaaggccuaccggaagcuggcgcugaaguaccacccggacaagaaccccaacgagggggagaaguucaagcagaucagccaggccuacgaggugcucuccgacgccaagaagcgggagcuguacgacaagggcggggagcaggccaucaaggagggcggggccggcggcggguucggcagccccauggacaucuucgacauguucuucgggggcgggggccgcaugcagcgggagcgccggggcaagaacgucgugcaccagcuguccgugacccucgaggaccuguacaacggggcgacccgcaagcuggcccuccagaagaacgucaucugcgacaagugcgagggccgcgggggcaagaagggcgccguggagugcugccccaacugccgggggaccggcaugcagauccggauccaccagaucgggccgggcauggugcagcagauccagagcgucugcauggagugccaggggcacggcgagcgcaucucccccaaggaccggugcaagagcugcaacggccgcaagaucgugcgggagaagaagauccuggaggugcacaucgacaaggggaugaaggacggccagaagaucacguuccacggggagggcgaccaggagcccgggcuggagcccggcgacaucaucaucguccucgaccagaaggaccacgccguguucacccgccggggcgaggaccuguucaugugcauggacauccagcugguggaggcgcucugcggguuccagaagccgaucuccacccuggacaaccgcaccaucgucaucacgagccaccccggccagaucgugaagcacggggacaucaagugcgugcugaacgagggcaugcccaucuaccggcgccccuacgagaaggggcggcucaucaucgaguucaaggucaacuucccggagaacggcuuccugucccccgacaagcugagccuccuggagaagcugcuccccgagcgcaaggagguggaggagaccgacgagauggaccagguggagcuggucgacuucgaccccaaccaggagcggcgccgccacuacaacggcgaggccuacgaggacgacgagcaccacccgcgcgggggcgugcagugccagaccuccuga

SEQ ID NO: 8321 - RNA, 1194 nt, Artificial Sequence
  derived and/or modified sequence opt2 from DNJA1__Homo_sapiens__AAC37517
auggucaaggagaccaccuacuacgacguccucggcgucaagcccaacgccacccaggaggagcucaagaaggccuaccgcaagcucgcccucaaguaccaccccgacaagaaccccaacgagggcgagaaguucaagcagaucucccaggccuacgagguccucuccgacgccaagaagcgcgagcucuacgacaagggcggcgagcaggccaucaaggagggcggcgccggcggcggcuucggcucccccauggacaucuucgacauguucuucggcggcggcggccgcaugcagcgcgagcgccgcggcaagaacgucguccaccagcucuccgucacccucgaggaccucuacaacggcgccacccgcaagcucgcccuccagaagaacgucaucugcgacaagugcgagggccgcggcggcaagaagggcgccgucgagugcugccccaacugccgcggcaccggcaugcagauccgcauccaccagaucggccccggcaugguccagcagauccaguccgucugcauggagugccagggccacggcgagcgcaucucccccaaggaccgcugcaaguccugcaacggccgcaagaucguccgcgagaagaagauccucgagguccacaucgacaagggcaugaaggacggccagaagaucaccuuccacggcgagggcgaccaggagcccggccucgagcccggcgacaucaucaucguccucgaccagaaggaccacgccgucuucacccgccgcggcgaggaccucuucaugugcauggacauccagcucgucgaggcccucugcggcuuccagaagcccaucuccacccucgacaaccgcaccaucgucaucaccucccaccccggccagaucgucaagcacggcgacaucaagugcguccucaacgagggcaugcccaucuaccgccgccccuacgagaagggccgccucaucaucgaguucaaggucaacuuccccgagaacggcuuccucucccccgacaagcucucccuccucgagaagcuccuccccgagcgcaaggaggucgaggagaccgacgagauggaccaggucgagcucgucgacuucgaccccaaccaggagcgccgccgccacuacaacggcgaggccuacgaggacgacgagcaccacccccgcggcggcguccagugccagaccuccuga

SEQ ID NO: 8322 - RNA, 1194 nt, Artificial Sequence
  derived and/or modified sequence opt3 from DNJA1__Homo_sapiens__AAC37517
auggugaaggagaccacauacuaugacguccugggcguuaaacccaacgccacucaggaggaacucaagaaggcuuacagaaaacuugcacugaaauaucacccugauaagaauccaaacgaaggggagaaguucaaacaaaucagccaggccuacgaaguguuguccgacgcgaagaaaagggaguuauaugauaagggaggugagcaggcuauuaaagaaggcggggccggaggcgguuuugggucuccgauggacauauucgauauguuuuucggaggcggcgggcggaugcagcgcgagcgacguggaaagaauguagugcaucaacugucagucacgcuagaagaccucuacaacggugcaaccagaaagcuggcccuucagaaaaaugugaucugcgauaagugugagggcaggggagggaaaaagggcgcuguugagugcugucccaacugccgggguacagggaugcagauucgcauccaccagauuggaccuggcauggugcaacagauccagagugucuguauggaaugccagggccauggggagagaauaagcccaaaagacagguguaaguccugcaauggacggaaaaucgugcgcgaaaagaagauucuggagguacacaucgauaaagguaugaaggacggccagaaaauuacuuuucauggggaaggagaucaagagcccggcuuggagccuggugacaucauaauuguucucgaucagaaggaccacgcaguguucacccgaagaggggaagaccuguuuauguguauggauauccaacuggucgaggcccucugcggcuuccagaaaccaauuucuacauuagacaacaggaccaucgugaucacuucgcaccccggacagauugugaagcauggcgauauaaaguguguccugaaugaagggaugccuaucuaucggcguccauacgagaaaggacgccuuauuaucgaauuuaagguuaacuucccggagaauggcuuuuugucacccgacaaacugagccuacucgagaagcugcuuccugaaagaaaagagguggaagagacagaugaaauggaccagguagagcugguggauuucgacccaaaccaagagaggcggcgacacuacaauggugaggcuuaugaagaugacgaacaucacccccgcgggggaguccagugccagaccaguuga

SEQ ID NO: 8323 - RNA, 1194 nt, Artificial Sequence
  derived and/or modified sequence opt4 from DNJA1__Homo_sapiens__AAC37517
auggugaaggagaccaccuacuacgacgugcugggcgugaagcccaacgccacccaggaggagcugaagaaggccuacagaaagcuggcccugaaguaccaccccgacaagaaccccaacgagggcgagaaguucaagcagaucagccaggccuacgaggugcugagcgacgccaagaagagagagcuguacgacaagggcggcgagcaggccaucaaggagggcggcgccggcggcggcuucggcagccccauggacaucuucgacauguucuucggcggcggcggcagaaugcagagagagagaagaggcaagaacguggugcaccagcugagcgugacccuggaggaccuguacaacggcgccaccagaaagcuggcccugcagaagaacgugaucugcgacaagugcgagggcagaggcggcaagaagggcgccguggagugcugccccaacugcagaggcaccggcaugcagaucagaauccaccagaucggccccggcauggugcagcagauccagagcgugugcauggagugccagggccacggcgagagaaucagccccaaggacagaugcaagagcugcaacggcagaaagaucgugagagagaagaagauccuggaggugcacaucgacaagggcaugaaggacggccagaagaucaccuuccacggcgagggcgaccaggagcccggccuggagcccggcgacaucaucaucgugcuggaccagaaggaccacgccguguucaccagaagaggcgaggaccuguucaugugcauggacauccagcugguggaggcccugugcggcuuccagaagcccaucagcacccuggacaacagaaccaucgugaucaccagccaccccggccagaucgugaagcacggcgacaucaagugcgugcugaacgagggcaugcccaucuacagaagacccuacgagaagggcagacugaucaucgaguucaaggugaacuuccccgagaacggcuuccugagccccgacaagcugagccugcuggagaagcugcugcccgagagaaaggagguggaggagaccgacgagauggaccagguggagcugguggacuucgaccccaaccaggagagaagaagacacuacaacggcgaggccuacgaggacgacgagcaccaccccagaggcggcgugcagugccagaccagcuga

SEQ ID NO: 8324 - RNA, 1194 nt, Artificial Sequence
  derived and/or modified sequence opt5 from DNJA1__Homo_sapiens__AAC37517
auggugaaggagaccacauacuaugacguccugggcguuaaacccaacgccacgcaggaggaacucaagaaggcuuacagaaaacuggcccuuaaauaucacccugauaagaauccgaacgaaggggagaaguucaaacaaaucagccaggcguacgaagugcuguccgacgcuaagaaacgggagcucuaugauaagggaggcgagcaggccauuaaagaagggggagccggcgggggauuuggcucucccauggacaucuucgauauguuuuucggcgggggaggccgcaugcagagagagcggcgcgggaagaaugugguccaucaacugagcgugacccuugaagaccuguacaacggagcuacaagaaagcucgcccugcagaaaaauguuauuugcgauaagugugagggcagagggggcaaaaagggagcuguggagugcuguccuaacugccgcggcaccgggaugcagauccggauucaccagaucggacccggcaugguccaacagauccaguccguguguauggaaugccaggggcauggagagcggauuucuccuaaagaccgcuguaagagcugcaauggcagaaaaaucguucgggaaaagaagauucuggaggugcacaucgauaaagggaugaaggacggacagaaaauuacauuucauggcgaaggcgaucaagagcccgggcucgagccuggagacaucauuaucguccuggaucagaaggaccacgccguguucacccgcagaggcgaagaccuuuuuauguguauggauauccaacugguggaggcgcucugcggguuccagaaaccgauuuccacacuggacaaccggaccaucgucauuacgucucaccccggacagaucguuaagcauggcgauauuaagugugugcuuaaugaagggaugccuaucuaucgcagacccuacgagaaaggccggcugaucauugaauuuaaggugaacuucccugagaauggauuucucagccccgacaaacugucccugcucgagaagcugcuuccggaaagaaaagaggucgaagagaccgaugaaauggaccagguggagcugguugauuucgacccuaaccaagagcgccggagacacuacaauggcgaagccuaugaggaugacgaacaucacccccgcgggggagugcagugccagacaagcuga

SEQ ID NO: 8325 - protein, 412 aa, Artificial Sequence
  DNJA2__Homo_sapiens__O60884
MANVADTKLYDILGVPPGASENELKKAYRKLAKEYHPDKNPNAGDKFKEISFAYEVLSNPEKRELYDRYGEQGLREGSGGGGGMDDIFSHIFGGGLFGFMGNQSRSRNGRRRGEDMMHPLKVSLEDLYNGKTTKLQLSKNVLCSACSGQGGKSGAVQKCSACRGRGVRIMIRQLAPGMVQQMQSVCSDCNGEGEVINEKDRCKKCEGKKVIKEVKILEVHVDKGMKHGQRITFTGEADQAPGVEPGDIVLLLQEKEHEVFQRDGNDLHMTYKIGLVEALCGFQFTFKHLDGRQIVVKYPPGKVIEPGCVRVVRGEGMPQYRNPFEKGDLYIKFDVQFPENNWINPDKLSELEDLLPSRPEVPNIIGETEEVELQEFDSTRGSGGGQRREAYNDSSDEESSSHHGPGVQCAHQ

SEQ ID NO: 8326 - RNA, 1239 nt, Artificial Sequence
  DNJA2__Homo_sapiens__AAH13044
auggcuaacguggcugacacgaagcuguacgacauccugggcgucccgcccggcgccagcgagaacgagcugaagaaggcauacagaaaguuagccaaggaauaucauccugauaagaauccaaaugcaggagacaaauuuaaagaaauaaguuuugcauaugaaguacuaucaaauccugagaagcgugaguuauaugacagauacggagagcaaggucuucgggaaggcagcggcggaggugguggcauggaugauauuuucucucacauuuuuggugggggauuguucggcuucaugggcaaucagaguagaagucgaaauggcagaagaagaggagaggacaugaugcauccacucaaaguaucuuuagaagaucuguauaauggcaagacaaccaaacuacaacuuagcaagaaugugcucuguagugcaugcaguggccaaggcggaaagucuggagcuguccaaaaguguagugcuugucgaggucgaggugugcgcaucaugaucagacagcuggcuccagggaugguacaacagaugcagucugugugcucugauuguaauggagaaggagagguaauuaaugaaaaagaccgcuguaaaaaaugugaagggaagaaggugauuaaagaagucaagauucuugaaguccacguagacaaaggcaugaaacauggacagagaauuacauucacuggggaagcagaccaggccccaggaguggaacccggagacauuguucuuuugcuacaggagaaagaacaugagguauuucagagagaugggaaugauuugcacaugacauauaaaauaggacuuguugaagcucuauguggauuucaguucacauuuaagcaccuugauggacgucagauuguggugaaauaccccccuggcaaaguaauugaaccaggguguguucguguaguucgaggugaagggaugccgcaguaucguaaucccuuugaaaaaggugaucuuuacauaaaguuugaugugcaguuuccugaaaacaacuggaucaacccagacaagcuuucugaacuagaagaucuucugccaucuagaccggaaguuccuaacauaauuggagaaacagaggagguagagcuucaggaauuugauagcacucgaggcucaggagguggucagaggcgugaagccuauaaugauagcucugaugaagaaagcagcagccaucauggaccuggagugcagugugcccaucaguaa

SEQ ID NO: 8327 - RNA, 1239 nt, Artificial Sequence
  derived and/or modified sequence opt1 from DNJA2__Homo_sapiens__AAH13044
auggccaacguggccgacaccaagcuguacgacauccucggcgugcccccgggggcgagcgagaacgagcugaagaaggccuaccgcaagcuggccaaggaguaccaccccgacaagaaccccaacgccggcgacaaguucaaggagaucuccuucgccuacgagguccucagcaaccccgagaagcgggagcuguacgaccgcuacggggagcagggccugcgggagggguccggcggcgggggcgggauggacgacaucuucagccacaucuucggcgggggccucuucggcuucauggggaaccagucccgcagccggaacggccgccggcgcggggaggacaugaugcacccgcugaaggugucccuggaggaccucuacaacggcaagaccacgaagcugcagcugagcaagaacguccucugcuccgcgugcagcggccagggcgggaaguccggggccgugcagaagugcagcgccugccggggccgcggggugcggaucaugauccgccagcuggcccccggcaugguccagcagaugcaguccgugugcagcgacugcaacggcgagggggaggugaucaacgagaaggaccggugcaagaagugcgagggcaagaaggucaucaaggaggugaagauccuggaggugcacgucgacaaggggaugaagcacggccagcgcaucaccuucaccggggaggcggaccaggcccccggcguggagcccggcgacaucgugcuccugcugcaggagaaggagcacgaggucuuccagcgggacgggaacgaccuccacaugaccuacaagaucggccugguggaggcccugugcggguuccaguucacguucaagcaccucgacggccgccagaucguggucaaguacccgcccgggaaggugaucgagcccggcugcgugcgggucgugcgcggcgaggggaugccccaguaccggaacccguucgagaagggcgaccuguacaucaaguucgacgugcaguuccccgagaacaacuggaucaaccccgacaagcuguccgagcucgaggaccugcugcccagccgcccggagguccccaacaucaucggggagaccgaggagguggagcuccaggaguucgacuccacccggggcagcggcgggggccagcgccgcgaggccuacaacgacuccagcgacgaggagagcuccagccaccacgggcccggcguccagugcgcccaccaguga

SEQ ID NO: 8328 - RNA, 1239 nt, Artificial Sequence
  derived and/or modified sequence opt2 from DNJA2__Homo_sapiens__AAH13044
auggccaacgucgccgacaccaagcucuacgacauccucggcgucccccccggcgccuccgagaacgagcucaagaaggccuaccgcaagcucgccaaggaguaccaccccgacaagaaccccaacgccggcgacaaguucaaggagaucuccuucgccuacgagguccucuccaaccccgagaagcgcgagcucuacgaccgcuacggcgagcagggccuccgcgagggcuccggcggcggcggcggcauggacgacaucuucucccacaucuucggcggcggccucuucggcuucaugggcaaccagucccgcucccgcaacggccgccgccgcggcgaggacaugaugcacccccucaaggucucccucgaggaccucuacaacggcaagaccaccaagcuccagcucuccaagaacguccucugcuccgccugcuccggccagggcggcaaguccggcgccguccagaagugcuccgccugccgcggccgcggcguccgcaucaugauccgccagcucgcccccggcaugguccagcagaugcaguccgucugcuccgacugcaacggcgagggcgaggucaucaacgagaaggaccgcugcaagaagugcgagggcaagaaggucaucaaggaggucaagauccucgagguccacgucgacaagggcaugaagcacggccagcgcaucaccuucaccggcgaggccgaccaggcccccggcgucgagcccggcgacaucguccuccuccuccaggagaaggagcacgaggucuuccagcgcgacggcaacgaccuccacaugaccuacaagaucggccucgucgaggcccucugcggcuuccaguucaccuucaagcaccucgacggccgccagaucgucgucaaguacccccccggcaaggucaucgagcccggcugcguccgcgucguccgcggcgagggcaugccccaguaccgcaaccccuucgagaagggcgaccucuacaucaaguucgacguccaguuccccgagaacaacuggaucaaccccgacaagcucuccgagcucgaggaccuccuccccucccgccccgagguccccaacaucaucggcgagaccgaggaggucgagcuccaggaguucgacuccacccgcggcuccggcggcggccagcgccgcgaggccuacaacgacuccuccgacgaggaguccuccucccaccacggccccggcguccagugcgcccaccaguga

SEQ ID NO: 8329 - RNA, 1239 nt, Artificial Sequence
  derived and/or modified sequence opt3 from DNJA2__Homo_sapiens__AAH13044
auggccaacguggcugacaccaagcuguacgauauccucggcguucccccuggggcaagcgagaaugaacuuaaaaaggccuauagaaaacuggcgaaggaguaccacccagacaaaaacccgaaugcuggagauaaguucaaggaaauuuccuuugccuaugaggucuugucuaaccccgagaaaagggaauuauacgaccgguauggugagcagggccugcgcgaagggucaggaggcggugggggaauggaugacauauucagucauaucuuuggcggcgggcuauucggauuuauggguaaucaaagccgaucccguaacggcagaaggcgcggggaggauaugaugcacccucucaaggugucucuggaagaccuuuacaauggaaaaacaacuaagcugcaguugucgaaaaacguacucugcucagcauguagcggccagggugggaagaguggagccgugcagaagugcuccgcuugucggggcagaggcgucaggauuaugauccggcaacuggcaccagggauggugcagcagaugcagucuguuugcagcgauuguaauggagagggugaggugauuaacgaaaaagaccgcugcaagaaaugugagggcaagaaagucaucaaggaagugaaaauacuggagguacauguugauaaggggaugaagcacggacaacgaaucacguucaccggcgaagccgaccaggcucccgguguggagccuggggauauuguccucuuacugcaggagaaagaacaugagguguuucagagagacggcaaugaccuucacaugacauauaagaucggauugguggaagcccugugcggcuuccaauuuacuuucaaacaccuagaugggaggcagauugucguuaaguacccacccggaaaagugaucgagccugguuguguacgggugguccguggcgaagggaugccacaguaccgcaacccguuugagaagggagaccucuauauaaaguucgaugugcaauuucccgagaauaacuggauuaauccugacaaacuguccgaacuugaggaucuguugccaucaagacccgaaguuccuaacaucauuggcgagaccgaagagguggagcuccaggaguucgacaguacaagggguagcgggggcggacagcggcgagaagcguacaacgauucuuccgacgaagagucaagcagucaucacggcccagggguccagugcgcacaucaauga

SEQ ID NO: 8330 - RNA, 1239 nt, Artificial Sequence
  derived and/or modified sequence opt4 from DNJA2__Homo_sapiens__AAH13044
auggccaacguggccgacaccaagcuguacgacauccugggcgugccccccggcgccagcgagaacgagcugaagaaggccuacagaaagcuggccaaggaguaccaccccgacaagaaccccaacgccggcgacaaguucaaggagaucagcuucgccuacgaggugcugagcaaccccgagaagagagagcuguacgacagauacggcgagcagggccugagagagggcagcggcggcggcggcggcauggacgacaucuucagccacaucuucggcggcggccuguucggcuucaugggcaaccagagcagaagcagaaacggcagaagaagaggcgaggacaugaugcacccccugaaggugagccuggaggaccuguacaacggcaagaccaccaagcugcagcugagcaagaacgugcugugcagcgccugcagcggccagggcggcaagagcggcgccgugcagaagugcagcgccugcagaggcagaggcgugagaaucaugaucagacagcuggcccccggcauggugcagcagaugcagagcgugugcagcgacugcaacggcgagggcgaggugaucaacgagaaggacagaugcaagaagugcgagggcaagaaggugaucaaggaggugaagauccuggaggugcacguggacaagggcaugaagcacggccagagaaucaccuucaccggcgaggccgaccaggcccccggcguggagcccggcgacaucgugcugcugcugcaggagaaggagcacgagguguuccagagagacggcaacgaccugcacaugaccuacaagaucggccugguggaggcccugugcggcuuccaguucaccuucaagcaccuggacggcagacagaucguggugaaguacccccccggcaaggugaucgagcccggcugcgugagaguggugagaggcgagggcaugccccaguacagaaaccccuucgagaagggcgaccuguacaucaaguucgacgugcaguuccccgagaacaacuggaucaaccccgacaagcugagcgagcuggaggaccugcugcccagcagacccgaggugcccaacaucaucggcgagaccgaggagguggagcugcaggaguucgacagcaccagaggcagcggcggcggccagagaagagaggccuacaacgacagcagcgacgaggagagcagcagccaccacggccccggcgugcagugcgcccaccaguga

SEQ ID NO: 8331 - RNA, 1239 nt, Artificial Sequence
  derived and/or modified sequence opt5 from DNJA2__Homo_sapiens__AAH13044
auggccaacguggcugacaccaagcuguacgauauccucggcguucccccuggggccagcgagaaugaacugaaaaaggcguauagaaaacuugcuaaggaguaccacccggacaaaaaccccaaugccggagauaaguucaaggaaauuuccuuugccuaugagguccugucuaacccugaaaaacgggagcucuacgaccgcuauggcgagcaggggcugagagaaggaagcggcgggggaggcggcauggaugacaucuucucccauauuuuugggggaggccuuuucggguuuaugggaaaucaaucucggagccgcaacggcagacggcgcggggaggauaugaugcacccccugaaggugucccucgaagaccuguacaauggaaaaacaacgaagcugcagcucucuaaaaacgugcugugcagcgcuuguuccggccagggcggaaagagcggggccguccagaagugcucugcuuguagaggccgcggggugcggaucaugauuagacaacuugccccuggaaugguucagcagaugcaguccgugugcagcgauuguaauggcgagggggaggucaucaacgaaaaagaccggugcaagaaaugugagggaaagaaagugaucaaggaaguuaaaauucuggaggugcaugucgauaagggcaugaagcacggccaacgcaucaccuucacaggggaagcggaccaggcccccggaguggagccuggcgauauugugcuccugcuucaggagaaagaacaugaggucuuucagagagacgggaaugaccugcacaugaccuauaagaucggacucguugaagcucugugcggcuuccaauuuacauucaaacaccuggaugggcggcagauuguggugaaguacccgcccggcaaagucaucgagccuggaugugugcgcguugugagaggcgaagggaugccccaguaccggaacccuuuugagaagggagaccucuauauuaaguucgauguccaauuucccgagaauaacuggaucaauccggacaaacugucugaacuugaggaucugcucccuuccagacccgaagugccuaacaucauuggcgagaccgaagagguugagcugcaggaguucgacagcacacgcgggucuggaggcgggcagcggagagaagccuacaacgauuccagcgacgaagaguccucuagccaucacggccccggagugcagugcgcucaucaauga

SEQ ID NO: 8332 - protein, 480 aa, Artificial Sequence
  DNJA3__Homo_sapiens__Q96EY1
MAARCSTRWLLVVVGTPRLPAISGRGARPPREGVVGAWLSRKLSVPAFASSLTSCGPRALLTLRPGVSLTGTKHNPFICTASFHTSAPLAKEDYYQILGVPRNASQKEIKKAYYQLAKKYHPDTNKDDPKAKEKFSQLAEAYEVLSDEVKRKQYDAYGSAGFDPGASGSQHSYWKGGPTVDPEELFRKIFGEFSSSSFGDFQTVFDQPQEYFMELTFNQAAKGVNKEFTVNIMDTCERCNGKGNEPGTKVQHCHYCGGSGMETINTGPFVMRSTCRRCGGRGSIIISPCVVCRGAGQAKQKKRVMIPVPAGVEDGQTVRMPVGKREIFITFRVQKSPVFRRDGADIHSDLFISIAQALLGGTARAQGLYETINVTIPPGTQTDQKIRMGGKGIPRINSYGYGDHYIHIKIRVPKRLTSRQQSLILSYAEDETDVEGTVNGVTLTSSGGSTMDSSAGSKARREAGEDEEGFLSKLKKMFTS

SEQ ID NO: 8333 - RNA, 1443 nt, Artificial Sequence
  DNJA3__Homo_sapiens__AAC29066
auggcugcgcggugcuccacacgcugguugcuggugguuguggggaccccgcggcugccggcuauaucggguagaggggcccggccgcccagggagggcguggugggggcauggcugagccgcaagcugagcguccccgccuuugcgucuucccugaccucuugcggcccccgagcgcugcugacauugagaccuggugucagccuuacaggaacaaaacauaacccuuucauuuguacugccuccuuccacacgagugccccuuuggccaaagaagauuauuaucagauauuaggagugccucgaaaugccagccagaaagagaucaagaaagccuauuaucagcuugccaagaaguaucacccugacacaaauaaggaugaucccaaagccaaggagaaguucucccagcuggcagaagccuaugagguuuugagugaugaggugaagaggaagcaguacgaugccuacggcucugcaggcuucgauccuggggccagcggcucccagcauagcuacuggaagggaggccccacuguggaccccgaggagcuguucaggaagaucuuuggcgaguucucauccucuucauuuggagauuuccagaccguguuugaucagccucaggaauacuucauggaguugacauucaaucaagcugcaaagggggucaacaaggaguucaccgugaacaucauggacacgugugagcgcugcaacggcaaggggaacgagcccggcaccaaggugcagcauugccacuacuguggcggcuccggcauggaaaccaucaacacaggcccuuuugugaugcguuccacguguaggagaugugguggccgcggcuccaucaucauaucgcccuguguggucugcaggggagcaggacaagccaagcagaaaaagcgagugaugaucccugugccugcaggagucgaggauggccagaccgugaggaugccugugggaaaaagggaaauuuucauuacguucagggugcagaaaagcccuguguuccggagggacggcgcagacauccacuccgaccucuuuauuucuauagcucaggcucuucuugggggaacagccagagcccagggccuguacgagacgaucaacgugacgauccccccugggacucagacagaccagaagauucggaugggugggaaaggcaucccccggauuaacagcuacggcuacggagaccacuacauccacaucaagauacgaguuccaaagaggcuaacgagccggcagcagagccugauccugagcuacgccgaggacgagacagauguggaggggacggugaacggcgucacccucaccagcucugguggcagcaccauggauagcuccgcaggaagcaaggcuaggcgugaggcuggggaggacgaggagggauuccuuuccaaacuuaagaaaauguuuaccucauga

SEQ ID NO: 8334 - RNA, 1443 nt, Artificial Sequence
  derived and/or modified sequence opt1 from DNJA3__Homo_sapiens__AAC29066
auggccgcccgcugcagcacccgguggcugcucguggucgugggcacgccccgccugccggcgaucuccgggcggggcgcccgcccgccccgggaggggguggucggcgccuggcugagccgcaagcucuccgugcccgccuucgccagcucccugaccagcugcgggccccgggcgcugcucacccugcgccccggcgugucccugaccggcaccaagcacaaccccuucaucugcacggccagcuuccacaccuccgcgccccucgccaaggaggacuacuaccagauccugggggucccgcggaacgccagccagaaggagaucaagaaggccuacuaccagcuggccaagaaguaccaccccgacaccaacaaggacgaccccaaggccaaggagaaguucucccagcucgccgaggcguacgaggugcugagcgacgaggugaagcgcaagcaguacgacgccuacggcuccgccggguucgaccccggcgccagcgggucccagcacagcuacuggaagggcggcccgaccgucgaccccgaggagcuguuccggaagaucuucggggaguucuccagcuccagcuucggcgacuuccagacgguguucgaccagccccaggaguacuucauggagcucaccuucaaccaggccgcgaagggggugaacaaggaguucaccgucaacaucauggacacgugcgagcgcugcaacggcaagggcaacgagcccgggaccaaggugcagcacugccacuacugcggcgggagcggcauggagaccaucaacaccgggccguucgugaugcgguccacgugccgccggugcggcggccgcgggagcaucaucaucucccccugcgucgugugccggggcgccgggcaggccaagcagaagaagcgcgugaugauccccguccccgccggcguggaggacgggcagaccgugcggaugccggucggcaagcgcgagaucuucaucaccuuccgggugcagaagucccccguguuccgccgcgacggcgccgacauccacagcgaccuguucaucagcaucgcgcaggcccugcucgggggcaccgcccgggcccaggggcuguacgagaccaucaacgucacgaucccgcccggcacccagaccgaccagaagauccgcaugggcgggaagggcaucccccggaucaacuccuacggguacggcgaccacuacauccacaucaagauccgcgugcccaagcggcugaccagccgccagcagucccucauccugagcuacgccgaggacgagacggacgucgaggggaccgugaacggcgugacccugaccuccagcggcggguccacgauggacagcuccgcgggcagcaaggcccggcgcgaggccggggaggacgaggagggcuuccucuccaagcugaagaagauguucaccagcuga

SEQ ID NO: 8335 - RNA, 1443 nt, Artificial Sequence
  derived and/or modified sequence opt2 from DNJA3__Homo_sapiens__AAC29066
auggccgcccgcugcuccacccgcuggcuccucgucgucgucggcaccccccgccuccccgccaucuccggccgcggcgcccgccccccccgcgagggcgucgucggcgccuggcucucccgcaagcucuccguccccgccuucgccuccucccucaccuccugcggcccccgcgcccuccucacccuccgccccggcgucucccucaccggcaccaagcacaaccccuucaucugcaccgccuccuuccacaccuccgccccccucgccaaggaggacuacuaccagauccucggcgucccccgcaacgccucccagaaggagaucaagaaggccuacuaccagcucgccaagaaguaccaccccgacaccaacaaggacgaccccaaggccaaggagaaguucucccagcucgccgaggccuacgagguccucuccgacgaggucaagcgcaagcaguacgacgccuacggcuccgccggcuucgaccccggcgccuccggcucccagcacuccuacuggaagggcggccccaccgucgaccccgaggagcucuuccgcaagaucuucggcgaguucuccuccuccuccuucggcgacuuccagaccgucuucgaccagccccaggaguacuucauggagcucaccuucaaccaggccgccaagggcgucaacaaggaguucaccgucaacaucauggacaccugcgagcgcugcaacggcaagggcaacgagcccggcaccaagguccagcacugccacuacugcggcggcuccggcauggagaccaucaacaccggccccuucgucaugcgcuccaccugccgccgcugcggcggccgcggcuccaucaucaucucccccugcgucgucugccgcggcgccggccaggccaagcagaagaagcgcgucaugauccccguccccgccggcgucgaggacggccagaccguccgcaugcccgucggcaagcgcgagaucuucaucaccuuccgcguccagaagucccccgucuuccgccgcgacggcgccgacauccacuccgaccucuucaucuccaucgcccaggcccuccucggcggcaccgcccgcgcccagggccucuacgagaccaucaacgucaccaucccccccggcacccagaccgaccagaagauccgcaugggcggcaagggcaucccccgcaucaacuccuacggcuacggcgaccacuacauccacaucaagauccgcguccccaagcgccucaccucccgccagcagucccucauccucuccuacgccgaggacgagaccgacgucgagggcaccgucaacggcgucacccucaccuccuccggcggcuccaccauggacuccuccgccggcuccaaggcccgccgcgaggccggcgaggacgaggagggcuuccucuccaagcucaagaagauguucaccuccuga

SEQ ID NO: 8336 - RNA, 1443 nt, Artificial Sequence
  derived and/or modified sequence opt3 from DNJA3__Homo_sapiens__AAC29066
auggccgcuagaugcagcaccagguggcugcucguggucguuggcacaccccggcuuccugcaaucuccgggcgcggagcccgaccaccgcgugagggugugguaggcgcguggcugucuagaaaguugucagugcccgcuuucgccaguagcuuaacuuccugugggccuagggcacugcuaacgcuccggccaggagucucucugaccggcacaaaacacaaccccuuuauuugcacugccucguuccauaccucagcuccucuugcaaaggaagacuacuaucagauacugggugugccacgcaaugccagccaaaaagagaucaagaaggcuuacuaucaguuggccaagaaguaccaccccgauacaaacaaagacgauccuaaggcgaaagaaaaguuuagucagcucgcagaggccuaugaaguucuguccgacgaggugaaaagaaagcaguacgaugcuuaugggucugccggauucgacccaggcgcaagcggcucccaacauucauacuggaaagggggaccgaccgucgaucccgaggaacuguuuaggaaaauuuucggugaguuuaguucuagcuccuucggcgacuuucagacuguguucgaucagccucaggaauacuuuauggagcucacauucaaucaagcugccaaggggguaaacaaagaguuuaccguuaauaucauggacacgugugaacggugcaacggaaagggcaaugagccagguacuaaagugcagcacugucauuauugcgggggaucaggcauggaaaccauuaacacaggccccuucgucaugcgcagcacuugucgaagaugcgggggaagggguaguaucauaaucucuccuuguguggugugccggggcgcggggcaggccaagcagaaaaagcgugucaugauuccaguucccgcaggaguggaggauggccaaaccguacgcaugccgguggguaagagagaaaucuucauuacauuuaggguccagaaauccccuguguuccggcgagacggggcugauauccacagcgacuuauuuauaucgauugcccaggcucugcuuggcggaaccgcccgcgcacaaggcuuguacgagacgaucaauguuacuauucccccagggacacagaccgaccagaagaucagaaugggagguaaaggcaucccuaggauuaacucuuauggguacggagaucacuauauacauaucaagauucgggugcccaaacgccugacuuccagacagcaaucacuaauccucaguuacgccgaggacgaaacagaugucgagggcaccgugaaugguguaacgcugaccagcuccgggggcucuacaauggacagcucagcuggaaguaaggcgaggcgugaagcaggcgaggaugaagagggguuccuuuccaagcugaaaaagauguuuacuagcuga

SEQ ID NO: 8337 - RNA, 1443 nt, Artificial Sequence
  derived and/or modified sequence opt4 from DNJA3__Homo_sapiens__AAC29066
auggccgccagaugcagcaccagauggcugcuggugguggugggcacccccagacugcccgccaucagcggcagaggcgccagaccccccagagagggcguggugggcgccuggcugagcagaaagcugagcgugcccgccuucgccagcagccugaccagcugcggccccagagcccugcugacccugagacccggcgugagccugaccggcaccaagcacaaccccuucaucugcaccgccagcuuccacaccagcgccccccuggccaaggaggacuacuaccagauccugggcgugcccagaaacgccagccagaaggagaucaagaaggccuacuaccagcuggccaagaaguaccaccccgacaccaacaaggacgaccccaaggccaaggagaaguucagccagcuggccgaggccuacgaggugcugagcgacgaggugaagagaaagcaguacgacgccuacggcagcgccggcuucgaccccggcgccagcggcagccagcacagcuacuggaagggcggccccaccguggaccccgaggagcuguucagaaagaucuucggcgaguucagcagcagcagcuucggcgacuuccagaccguguucgaccagccccaggaguacuucauggagcugaccuucaaccaggccgccaagggcgugaacaaggaguucaccgugaacaucauggacaccugcgagagaugcaacggcaagggcaacgagcccggcaccaaggugcagcacugccacuacugcggcggcagcggcauggagaccaucaacaccggccccuucgugaugagaagcaccugcagaagaugcggcggcagaggcagcaucaucaucagccccugcguggugugcagaggcgccggccaggccaagcagaagaagagagugaugauccccgugcccgccggcguggaggacggccagaccgugagaaugcccgugggcaagagagagaucuucaucaccuucagagugcagaagagccccguguucagaagagacggcgccgacauccacagcgaccuguucaucagcaucgcccaggcccugcugggcggcaccgccagagcccagggccuguacgagaccaucaacgugaccaucccccccggcacccagaccgaccagaagaucagaaugggcggcaagggcauccccagaaucaacagcuacggcuacggcgaccacuacauccacaucaagaucagagugcccaagagacugaccagcagacagcagagccugauccugagcuacgccgaggacgagaccgacguggagggcaccgugaacggcgugacccugaccagcagcggcggcagcaccauggacagcagcgccggcagcaaggccagaagagaggccggcgaggacgaggagggcuuccugagcaagcugaagaagauguucaccagcuga

SEQ ID NO: 8338 - RNA, 1443 nt, Artificial Sequence
  derived and/or modified sequence opt5 from DNJA3__Homo_sapiens__AAC29066
auggccgcuagaugcagcacccgguggcugcucguggucguuggcacaccccgccugccugccaucuccgggagaggagcgcggccgccccgcgagggcguggugggggcuuggcuuucuagaaagcugagcgucccugccuucgccuccucucucacgagcuguggaccccgggcucugcuuacccugcgcccuggcgugucccucacagggaccaaacacaaccccuuuauuugcacagccucuuuccauaccagcgcuccucuggccaaggaagacuacuaucagauccugggaguuccgagaaaugcgucccaaaaagagauuaagaaagccuacuaucagcucgcuaagaaguaccaccccgauacaaacaaagacgauccuaaggccaaagaaaaguuuagccagcuggcugaggccuaugaagugcuuucugacgaggucaaacggaagcaguacgaugcguauggcuccgccggcuucgaccccggggcuagcggaucucaacauuccuacuggaagggcgggccuaccguggaucccgaggaacuguuucgcaaaaucuucggagaguuuucuagcuccagcuucggcgacuuucagacgguuuucgaucagccgcaggaauacuuuauggagcucaccuucaaucaagccgcuaagggggugaacaaagaguuuacagucaauauuauggacaccugugaaagaugcaacggaaagggcaaugagccuggcacaaaagugcagcacugucauuauugcgggggauccggcauggaaaccaucaacacggggcccuucgugaugcggucuacaugucgcagaugcggaggccgggggagcaucauuaucuccccuugugucguuugccgcggagccggccaggccaagcagaaaaagagagugaugauucccgugcccgcuggcgucgaggaugggcaaaccgugcggaugccuguuggaaagagagaaaucuucauuacauuucgcgugcagaaaagcccggucuuccggagagacggcgcggauauccacucugaccuguuuauuuccaucgcccaggcucugcuugggggaaccgcccgcgcccaaggccucuacgagaccaucaaugugacaauucccccugggacgcagaccgaccagaagauccggaugggcggaaaaggcauucccagaaucaacagcuauggguacggagaucacuauauucauaucaagauccgcguuccuaaacggcugacaucuagacagcaaagccugauucucuccuacgcugaggacgaaaccgauguggagggcacagucaauggggugacccugacgucuagcggaggcuccacaauggacagcucugccggguccaaggcgcgccgggaagcuggcgaggaugaagagggauuccuuagcaagcugaaaaagauguuuaccucuuga

SEQ ID NO: 8339 - protein, 397 aa, Artificial Sequence
  DNJA4__Homo_sapiens__Q8WW22
MVKETQYYDILGVKPSASPEEIKKAYRKLALKYHPDKNPDEGEKFKLISQAYEVLSDPKKRDVYDQGGEQAIKEGGSGSPSFSSPMDIFDMFFGGGGRMARERRGKNVVHQLSVTLEDLYNGVTKKLALQKNVICEKCEGVGGKKGSVEKCPLCKGRGMQIHIQQIGPGMVQQIQTVCIECKGQGERINPKDRCESCSGAKVIREKKIIEVHVEKGMKDGQKILFHGEGDQEPELEPGDVIIVLDQKDHSVFQRRGHDLIMKMKIQLSEALCGFKKTIKTLDNRILVITSKAGEVIKHGDLRCVRDEGMPIYKAPLEKGILIIQFLVIFPEKHWLSLEKLPQLEALLPPRQKVRITDDMDQVELKEFCPNEQNWRQHREAYEEDEDGPQAGVQCQTA

SEQ ID NO: 8340 - RNA, 1194 nt, Artificial Sequence
  DNJA4__Homo_sapiens__AAH21720
auggugaaggagacccaguacuaugacauccugggcgugaagcccagcgcguccccggaggagaucaagaaggccuaucggaagcuggcgcucaaguaccacccggacaagaacccggaugagggcgagaaguuuaaacucauaucccaggcauaugaagugcuuucagauccaaagaaaagggauguuuaugaccaaggcggagagcaggcaauuaaagaaggaggcucaggcagccccagcuucucuucacccauggacaucuuugacauguucuuugguggugguggacggauggcuagagagagaagaggcaagaauguuguacaccaguuaucuguaacucuugaagauuuauauaauggagucacgaagaaauuggcccuccagaaaaauguaauuugugagaaaugugaagguguuggugggaagaagggaucgguggagaagugcccgcugugcaaggggcgggggaugcagauccacauccagcagaucgggccgggcaugguacagcagauccagaccgugugcaucgagugcaagggccagggugagcgcaucaaccccaaggaccgcugcgagagcugcagcggggccaaggugauccgugagaagaagauuaucgagguacauguugaaaaagguaugaaagaugggcaaaagauacuauuucauggagaaggagaucaggagccugagcuggagccuggugaugucauaauugugcuugaucagaaggaucauagugucuuucagagacgaggccaugacuugaucaugaaaaugaaaauucagcuuucugaagcucuuuguggcuucaagaagacgauaaaaacauuggacaaucgaauucuuguuauuacauccaaagcaggugaggugauaaagcacggggaccugagaugcgugcgcgaugaaggaaugcccaucuacaaagcaccccuggaaaaagggauucugaucauacaguuuuuaguaaucuuuccugaaaaacacuggcuuucucuggaaaagcuuccucagcuggaagcuuuacucccuccucgacagaaagugaggauuacagaugacauggaucagguggagcugaaggaguuuugucccaaugagcagaacuggcgucagcacagggaggccuacgaggaggacgaagacgggccccaggcuggagugcagugccagacggcauga

SEQ ID NO: 8341 - RNA, 1194 nt, Artificial Sequence
  derived and/or modified sequence opt1 from DNJA4__Homo_sapiens__AAH21720
auggugaaggagacccaguacuacgacauccugggcgucaagcccagcgccuccccggaggagaucaagaaggccuaccgcaagcucgcgcugaaguaccaccccgacaagaaccccgacgagggggagaaguucaagcugaucagccaggccuacgaggugcucuccgaccccaagaagcgggacguguacgaccagggcggggagcaggccaucaaggagggcgggagcggcuccccgagcuucuccagccccauggacaucuucgacauguucuucggcgggggcgggcgcauggcccgggagcgccggggcaagaacgucgugcaccagcuguccgugacccuggaggaccucuacaacggggucacgaagaagcuggcccugcagaagaacgugaucugcgagaagugcgagggcgugggcgggaagaagggcagcgucgagaagugcccccucugcaaggggcgcggcaugcagauccacauccagcagaucggccccgggauggugcagcagauccagaccgugugcaucgagugcaagggccagggggagcggaucaacccgaaggaccgcugcgaguccugcagcggcgcgaaggucauccgggagaagaagaucaucgaggugcacguggagaaggggaugaaggacggccagaagauccuguuccacggcgagggggaccaggagcccgagcuggagcccggcgacgucaucaucgugcucgaccagaaggaccacuccguguuccagcgccgggggcacgaccugaucaugaagaugaagauccagcugagcgaggcccucugcggcuucaagaagaccaucaagacccuggacaaccgcauccuggucaucacguccaaggccggggaggugaucaagcacggcgaccuccggugcgugcgcgacgagggcaugcccaucuacaaggccccgcuggagaaggggauccugaucauccaguuccucgucaucuuccccgagaagcacuggcugagccuggagaagcucccccagcuggaggcgcugcugcccccgcggcagaaggugcgcaucaccgacgacauggaccagguggagcucaaggaguucugccccaacgagcagaacuggcggcagcaccgcgaggccuacgaggaggacgaggacggcccccaggccgggguccagugccagaccgccuga

SEQ ID NO: 8342 - RNA, 1194 nt, Artificial Sequence
  derived and/or modified sequence opt2 from DNJA4__Homo_sapiens__AAH21720
auggucaaggagacccaguacuacgacauccucggcgucaagcccuccgccucccccgaggagaucaagaaggccuaccgcaagcucgcccucaaguaccaccccgacaagaaccccgacgagggcgagaaguucaagcucaucucccaggccuacgagguccucuccgaccccaagaagcgcgacgucuacgaccagggcggcgagcaggccaucaaggagggcggcuccggcucccccuccuucuccucccccauggacaucuucgacauguucuucggcggcggcggccgcauggcccgcgagcgccgcggcaagaacgucguccaccagcucuccgucacccucgaggaccucuacaacggcgucaccaagaagcucgcccuccagaagaacgucaucugcgagaagugcgagggcgucggcggcaagaagggcuccgucgagaagugcccccucugcaagggccgcggcaugcagauccacauccagcagaucggccccggcaugguccagcagauccagaccgucugcaucgagugcaagggccagggcgagcgcaucaaccccaaggaccgcugcgaguccugcuccggcgccaaggucauccgcgagaagaagaucaucgagguccacgucgagaagggcaugaaggacggccagaagauccucuuccacggcgagggcgaccaggagcccgagcucgagcccggcgacgucaucaucguccucgaccagaaggaccacuccgucuuccagcgccgcggccacgaccucaucaugaagaugaagauccagcucuccgaggcccucugcggcuucaagaagaccaucaagacccucgacaaccgcauccucgucaucaccuccaaggccggcgaggucaucaagcacggcgaccuccgcugcguccgcgacgagggcaugcccaucuacaaggccccccucgagaagggcauccucaucauccaguuccucgucaucuuccccgagaagcacuggcucucccucgagaagcucccccagcucgaggcccuccuccccccccgccagaagguccgcaucaccgacgacauggaccaggucgagcucaaggaguucugccccaacgagcagaacuggcgccagcaccgcgaggccuacgaggaggacgaggacggcccccaggccggcguccagugccagaccgccuga

SEQ ID NO: 8343 - RNA, 1194 nt, Artificial Sequence
  derived and/or modified sequence opt3 from DNJA4__Homo_sapiens__AAH21720
auggugaaggagacccaguacuaugacauccugggcgucaaacccagcgccuccccugaagagauuaagaaggcuuacagaaaacucgcacuuaaauaucacccagauaagaacccggacgaaggggagaaguucaaacugauaucucaagccuacgaaguuuugucagaucccaagaaaagggacguguaugaucagggaggugagcaggcgaucaaggagggcgggaguggaagcccuuccuuuucuucgccaauggacauuuucgauauguuuuucggcggugggggacggauggcucgcgaacgacguggcaaaaauguagugcaucaguuaucagucacacuggaggaccuauacaacggcgugacuaagaagcucgcccugcagaaaaauguuaucugcgaaaagugugagggggugggagguaaaaagggcagcgucgagaaaugcccccuuuguaaggggagaggaaugcaaauucacauccagcagauaggcccugguauggugcaacagauccagacgguaugcauugaauguaaagggcagggagagaggaucaacccaaaggaucggugcgaaaguuguuccggcgcaaagguuauucgcgagaaaaagaucauagaagugcaugucgagaaaggcaugaaggacgggcagaaaauucuguuucacggagagggugaucaagaacccgaguuggaaccuggcgacgugaucauugugcucgaucagaaggaccauucugucuuccaaagaagggggcacgaccugaucaugaagaugaaaauccagcugagcgaggcccucugcggauuuaagaaaaccauuaagacauuagauaaucggauacugguuaucacuuccaaagcuggcgaagugauuaagcacggugaccuucgcuguguacgagaugaggggaugccaaucuauaaggcaccguuggagaaaggcauacugauuauccaguuccuagugaucuuucccgaaaagcauuggcucucacuggagaaacuuccucagcuggaagccuugcucccacccagacaaaaggucaggauuaccgacgauauggaccagguggagcugaaagaguucugcccuaacgaacagaauuggcggcagcaccgugaggcuuacgaagaggaugaagacggaccacaagccggcguucagugucagacagcguga

SEQ ID NO: 8344 - RNA, 1194 nt, Artificial Sequence
  derived and/or modified sequence opt4 from DNJA4__Homo_sapiens__AAH21720
auggugaaggagacccaguacuacgacauccugggcgugaagcccagcgccagccccgaggagaucaagaaggccuacagaaagcuggcccugaaguaccaccccgacaagaaccccgacgagggcgagaaguucaagcugaucagccaggccuacgaggugcugagcgaccccaagaagagagacguguacgaccagggcggcgagcaggccaucaaggagggcggcagcggcagccccagcuucagcagccccauggacaucuucgacauguucuucggcggcggcggcagaauggccagagagagaagaggcaagaacguggugcaccagcugagcgugacccuggaggaccuguacaacggcgugaccaagaagcuggcccugcagaagaacgugaucugcgagaagugcgagggcgugggcggcaagaagggcagcguggagaagugcccccugugcaagggcagaggcaugcagauccacauccagcagaucggccccggcauggugcagcagauccagaccgugugcaucgagugcaagggccagggcgagagaaucaaccccaaggacagaugcgagagcugcagcggcgccaaggugaucagagagaagaagaucaucgaggugcacguggagaagggcaugaaggacggccagaagauccuguuccacggcgagggcgaccaggagcccgagcuggagcccggcgacgugaucaucgugcuggaccagaaggaccacagcguguuccagagaagaggccacgaccugaucaugaagaugaagauccagcugagcgaggcccugugcggcuucaagaagaccaucaagacccuggacaacagaauccuggugaucaccagcaaggccggcgaggugaucaagcacggcgaccugagaugcgugagagacgagggcaugcccaucuacaaggccccccuggagaagggcauccugaucauccaguuccuggugaucuuccccgagaagcacuggcugagccuggagaagcugccccagcuggaggcccugcugccccccagacagaaggugagaaucaccgacgacauggaccagguggagcugaaggaguucugccccaacgagcagaacuggagacagcacagagaggccuacgaggaggacgaggacggcccccaggccggcgugcagugccagaccgccuga

SEQ ID NO: 8345 - RNA, 1194 nt, Artificial Sequence
  derived and/or modified sequence opt5 from DNJA4__Homo_sapiens__AAH21720
auggugaaggagacccaguacuaugacauccugggcgucaaacccagcgccuccccugaagagauuaagaaggcuuacagaaaacucgcccugaaauaucacccggauaagaaccccgacgaaggggagaaguucaaacuuaucucucaagcguacgaaguucugagcgauccuaagaaacgggacguguaugaucagggaggcgagcaggcuauuaaggaagggggauccggcucucccagcuuuuccucuccuauggacaucuucgauauguuuuucgggggaggcggccgcauggccagagaacggcgcgggaaaaaugugguccaucagcucagcgugacacuggaggaccuuuacaacggaguuacgaagaagcuggcccuccagaaaaaugugauuugcgaaaagugugagggcgucgggggcaaaaagggauccguggagaaaugcccccuguguaaggggagaggaaugcaaauccacauccagcagauuggcccuggcaugguucaacagauccagaccgugugcauugaauguaaagggcagggagagcggaucaacccgaaggaucgcugcgaaagcuguucuggcgcuaaggucauuagagagaaaaagaucauugaagugcauguggagaaagggaugaaggacggacagaaaauccuguuucacggcgagggggaucaagaacccgagcucgaaccuggagacgucaucauuguucuggaucagaaggaccauuccguguuccaacggcgcggccacgaccuuaucaugaagaugaaaauucagcugagcgaggcccucugcggcuuuaagaaaacaaucaagacccuggauaaucggauucuugugaucacaucuaaagcuggggaagucaucaagcacggagaccugagaugugugcgcgaugagggcaugcccauuuauaaggccccucucgagaaagggauccugauuauccaguuccugguuauuuuucccgaaaagcauuggcucucccuggagaaacuuccgcagcuggaagcgcuccugccucccagacaaaaggugcggaucaccgacgauauggaccaggucgagcuuaaagaguucugcccuaacgagcagaauuggcgccagcacagagaggccuacgaagaggaugaagacggaccccaagcuggcgugcagugucagacagccuga

SEQ ID NO: 8346 - protein, 340 aa, Artificial Sequence
  DNJB1__Homo_sapiens__P25685
MGKDYYQTLGLARGASDEEIKRAYRRQALRYHPDKNKEPGAEEKFKEIAEAYDVLSDPRKREIFDRYGEEGLKGSGPSGGSGGGANGTSFSYTFHGDPHAMFAEFFGGRNPFDTFFGQRNGEEGMDIDDPFSGFPMGMGGFTNVNFGRSRSAQEPARKKQDPPVTHDLRVSLEEIYSGCTKKMKISHKRLNPDGKSIRNEDKILTIEVKKGWKEGTKITFPKEGDQTSNNIPADIVFVLKDKPHNIFKRDGSDVIYPARISLREALCGCTVNVPTLDGRTIPVVFKDVIRPGMRRKVPGEGLPLPKTPEKRGDLIIEFEVIFPERIPQTSRTVLEQVLPI

SEQ ID NO: 8347 - RNA, 1023 nt, Artificial Sequence
  DNJB1__Homo_sapiens__AAH02352
auggguaaagacuacuaccagacguugggccuggcccgcggcgcgucggacgaggagaucaagcgggccuaccgccgccaggcgcugcgcuaccacccggacaagaacaaggagcccggcgccgaggagaaguucaaggagaucgcugaggccuacgacgugcucagcgacccgcgcaagcgcgagaucuucgaccgcuacggggaggaaggccuaaaggggaguggccccaguggcgguagcggcgguggugccaaugguaccucuuucagcuacacauuccauggagacccucaugccauguuugcugaguucuucgguggcagaaaucccuuugacaccuuuuuugggcagcggaacggggaggaaggcauggacauugaugacccauucucuggcuucccuaugggcauggguggcuucaccaacgugaacuuuggccgcucccgcucugcccaagagcccgcccgaaagaagcaagaucccccagucacccacgaccuucgagucucccuugaagagaucuacagcggcuguaccaagaagaugaaaaucucccacaagcggcuaaaccccgacggaaagagcauucgaaacgaagacaaaauauugaccaucgaagugaagaagggguggaaagaaggaaccaaaaucacuuuccccaaggaaggagaccagaccuccaacaacauuccagcugauaucgucuuuguuuuaaaggacaagccccacaauaucuuuaagagagauggcucugaugucauuuauccugccaggaucagccuccgggaggcucuguguggcugcacagugaacguccccacucuggacggcaggacgauacccgucguauucaaagauguuaucaggccuggcaugcggcgaaaaguuccuggagaaggccucccccuccccaaaacacccgagaaacguggggaccucauuauugaguuugaagugaucuuccccgaaaggauuccccagacaucaagaaccguacuugagcagguucuuccaauauag

SEQ ID NO: 8348 - RNA, 1023 nt, Artificial Sequence
  derived and/or modified sequence opt1 from DNJB1__Homo_sapiens__AAH02352
augggcaaggacuacuaccagacccuggggcucgcccgcggcgccagcgacgaggagaucaagcgggcguaccgccggcaggcccugcgcuaccaccccgacaagaacaaggagccgggggccgaggagaaguucaaggagaucgccgaggccuacgacgugcuguccgacccccggaagcgcgagaucuucgaccgguacggcgaggaggggcucaagggcagcggccccuccgggggcagcgggggcggggcgaacggcaccuccuucagcuacacguuccacggcgacccccacgccauguucgccgaguucuucgggggccgcaacccguucgacaccuucuucgggcagcggaacggcgaggagggcauggacaucgacgaccccuucuccggguuccccaugggcaugggcggguucaccaacgucaacuucgggcgcagccgguccgcccaggagcccgcgcgcaagaagcaggacccgcccgugacccacgaccugcgggugagccuggaggagaucuacuccggcugcacgaagaagaugaagaucagccacaagcgccucaaccccgacggcaaguccauccggaacgaggacaagauccugaccaucgaggucaagaagggguggaaggagggcaccaagaucaccuuccccaaggagggggaccagacgagcaacaacaucccggccgacaucguguucgugcugaaggacaagccccacaacaucuucaagcgcgacggcuccgacgucaucuaccccgcccggaucagccuccgcgaggcccugugcgggugcaccgugaacgugcccacccuggacggccggaccaucccggucguguucaaggacgugauccgccccggcaugcggcgcaagguccccggggagggccucccccugccgaagacgcccgagaagcgcggggaccugaucaucgaguucgaggugaucuuccccgagcggaucccccagaccucccgcaccgugcucgagcagguccugccgaucuga

SEQ ID NO: 8349 - RNA, 1023 nt, Artificial Sequence
  derived and/or modified sequence opt2 from DNJB1__Homo_sapiens__AAH02352
augggcaaggacuacuaccagacccucggccucgcccgcggcgccuccgacgaggagaucaagcgcgccuaccgccgccaggcccuccgcuaccaccccgacaagaacaaggagcccggcgccgaggagaaguucaaggagaucgccgaggccuacgacguccucuccgacccccgcaagcgcgagaucuucgaccgcuacggcgaggagggccucaagggcuccggccccuccggcggcuccggcggcggcgccaacggcaccuccuucuccuacaccuuccacggcgacccccacgccauguucgccgaguucuucggcggccgcaaccccuucgacaccuucuucggccagcgcaacggcgaggagggcauggacaucgacgaccccuucuccggcuuccccaugggcaugggcggcuucaccaacgucaacuucggccgcucccgcuccgcccaggagcccgcccgcaagaagcaggacccccccgucacccacgaccuccgcgucucccucgaggagaucuacuccggcugcaccaagaagaugaagaucucccacaagcgccucaaccccgacggcaaguccauccgcaacgaggacaagauccucaccaucgaggucaagaagggcuggaaggagggcaccaagaucaccuuccccaaggagggcgaccagaccuccaacaacauccccgccgacaucgucuucguccucaaggacaagccccacaacaucuucaagcgcgacggcuccgacgucaucuaccccgcccgcaucucccuccgcgaggcccucugcggcugcaccgucaacguccccacccucgacggccgcaccauccccgucgucuucaaggacgucauccgccccggcaugcgccgcaagguccccggcgagggccucccccuccccaagacccccgagaagcgcggcgaccucaucaucgaguucgaggucaucuuccccgagcgcaucccccagaccucccgcaccguccucgagcagguccuccccaucuga

SEQ ID NO: 8350 - RNA, 1023 nt, Artificial Sequence
  derived and/or modified sequence opt3 from DNJB1__Homo_sapiens__AAH02352
augggcaaggacuacuaucagacccuggggcucgccagaggagcuagcgaugaggagaucaaaagggcauaccggcgccaagcccuucgauaucaccccgacaagaacaaagagccuggugcggaagagaaguucaaagaaauugcugaggccuacgaugugcuguccgacccacguaagagagagauauuugauagguauggcgaagagggguugaagggaucuggcccgucaggugggaguggaggcggcgcaaaugggacuagcuucuccuacacauuucauggagacccccacgccauguucgcugaauuuuucgguggccggaacccuuuugauacguucuuugggcagcgcaauggagaggagggcauggacaucgaugacccauucucugguuuucccauggggaugggaggcuucaccaacgucaauuuuggcagaucgaggucagcacaggaaccugcccggaaaaagcaggauccacccguuacacaugacuuacgcgugagccuggaggaaauuuauagugggugcacuaaaaagaugaaaaucucccacaagcgacuaaacccugauggaaagucuauuagaaaugaggacaaaauccucaccauagaaguaaagaaagguuggaaggagggcacaaaaaucaccuucccaaaggagggggaccaaacuagcaacaauauuccggcugauaucguguucguccugaaagacaagccccauaacauuuuuaagagggauggauccgacgugaucuacccugcccggauaucacuucgugaagcgcuguguggcugcacaguuaaugugccaaccuuggauggucgcacgauucccgucguguucaaagacguaaucagaccugggaugaggcggaagguuccaggcgagggacucccccugccgaaaacuccugaaaagcgaggcgaucugauuaucgaguuugaagugaucuuccccgagcgcauuccacagaccaguagaacaguccucgaacagguguuaccuauauga

SEQ ID NO: 8351 - RNA, 1023 nt, Artificial Sequence
  derived and/or modified sequence opt4 from DNJB1__Homo_sapiens__AAH02352
augggcaaggacuacuaccagacccugggccuggccagaggcgccagcgacgaggagaucaagagagccuacagaagacaggcccugagauaccaccccgacaagaacaaggagcccggcgccgaggagaaguucaaggagaucgccgaggccuacgacgugcugagcgaccccagaaagagagagaucuucgacagauacggcgaggagggccugaagggcagcggccccagcggcggcagcggcggcggcgccaacggcaccagcuucagcuacaccuuccacggcgacccccacgccauguucgccgaguucuucggcggcagaaaccccuucgacaccuucuucggccagagaaacggcgaggagggcauggacaucgacgaccccuucagcggcuuccccaugggcaugggcggcuucaccaacgugaacuucggcagaagcagaagcgcccaggagcccgccagaaagaagcaggacccccccgugacccacgaccugagagugagccuggaggagaucuacagcggcugcaccaagaagaugaagaucagccacaagagacugaaccccgacggcaagagcaucagaaacgaggacaagauccugaccaucgaggugaagaagggcuggaaggagggcaccaagaucaccuuccccaaggagggcgaccagaccagcaacaacauccccgccgacaucguguucgugcugaaggacaagccccacaacaucuucaagagagacggcagcgacgugaucuaccccgccagaaucagccugagagaggcccugugcggcugcaccgugaacgugcccacccuggacggcagaaccauccccgugguguucaaggacgugaucagacccggcaugagaagaaaggugcccggcgagggccugccccugcccaagacccccgagaagagaggcgaccugaucaucgaguucgaggugaucuuccccgagagaaucccccagaccagcagaaccgugcuggagcaggugcugcccaucuga

SEQ ID NO: 8352 - RNA, 1023 nt, Artificial Sequence
  derived and/or modified sequence opt5 from DNJB1__Homo_sapiens__AAH02352
augggcaaggacuacuaucagacccuggggcucgccagaggagcuagcgaugaggaaaucaaacgggccuaccgcagacaagcgcugcgguaucaccccgacaagaacaaagagccuggcgcugaagagaaguucaaagaaauugccgaggccuacgaugugcuuuccgacccgcgcaagagagagaucuuugaucgguauggggaagagggacugaagggcucugggcccagcggaggcuccggcgggggagcuaauggcacaucuuucagcuacacguuucauggggacccucacgccauguucgcugaauuuuucggaggccgcaaccccuuugauaccuucuuugggcagagaaauggagaggagggcauggacauugaugacccuuucuccggcuuucccauggggaugggaggcuucacaaacgucaauuuugggcggucucgcagcgcccaggaaccugcgcggaaaaagcaggauccgcccguuacccaugaccucagagugucccuggaggaaaucuauagcggaugcaccaaaaagaugaaaauuucucacaagcgccuuaacccugauggcaaguccaucagaaaugaggacaaaauccugacaauugaagugaagaaaggguggaaggagggaacaaaaaucaccuuccccaaggagggcgaccaaacgagcaacaauauuccugccgauaucgucuucgugcucaaagacaagccccauaacauuuuuaagcgggauggcucugacguuaucuacccggcucgcauuucccugagagaagcccugugugggugcaccgugaaugucccuacacucgauggacggaccauccccgugguuuucaaagacgugaucagaccuggcaugcgccggaagguccccggggagggacugccccuuccuaaaacaccggaaaagagaggcgaucugauuaucgaguuugaagugauuuuccccgagcgcaucccucagaccagccggacggugcucgagcagguccugcccauuuga

SEQ ID NO: 8353 - protein, 324 aa, Artificial Sequence
  DNJB2__Homo_sapiens__P25686
MASYYEILDVPRSASADDIKKAYRRKALQWHPDKNPDNKEFAEKKFKEVAEAYEVLSDKHKREIYDRYGREGLTGTGTGPSRAEAGSGGPGFTFTFRSPEEVFREFFGSGDPFAELFDDLGPFSELQNRGSRHSGPFFTFSSSFPGHSDFSSSSFSFSPGAGAFRSVSTSTTFVQGRRITTRRIMENGQERVEVEEDGQLKSVTINGVPDDLALGLELSRREQQPSVTSRSGGTQVQQTPASCPLDSDLSEDEDLQLAMAYSLSEMEAAGKKPAGGREAQHRRQGRPKAQHQDPGLGGTQEGARGEATKRSPSPEEKASRCLIL

SEQ ID NO: 8354 - RNA, 975 nt, Artificial Sequence
  DNJB2__Homo_sapiens__AAH11609
auggcauccuacuacgagauccuagacgugccgcgaagugcguccgcugaugacaucaagaaggcguaucggcgcaaggcucuccaguggcacccagacaaaaacccagauaauaaagaguuugcugagaagaaauuuaaggagguggccgaggcauaugaagugcugucugacaagcacaagcgggagauuuacgaccgcuauggccgggaagggcugacagggacaggaacuggcccaucucgggcagaagcuggcaguggugggccuggcuucaccuucaccuuccgcagccccgaggaggucuuccgggaauucuuugggaguggagacccuuuugcagagcucuuugaugaccugggccccuucucagagcuucagaaccgggguucccgacacucaggccccuucuuuaccuucucuuccuccuucccugggcacuccgauuucuccuccucaucuuucuccuucaguccuggggcuggugcuuuucgcucuguuucuacaucuaccaccuuuguccaaggacgccgcaucaccacacgcagaaucauggagaacgggcaggagcggguggaaguggaggaggaugggcagcugaagucagucacaaucaauggugucccagaugaccuggcacugggcuuggagcugagccgucgcgagcagcagccgucagucacuuccaggucugggggcacucagguccagcagaccccugccucaugccccuuggacagcgaccucucugaggaugaggaccugcagcuggccauggccuacagccugucagagauggaggcagcugggaagaaacccgcaggugggcgggaggcacagcaccgacggcaggggcggcccaaggcccagcaccaagauccaggcuugggggggacccaggagggugcgaggggugaagcaaccaaacgcaguccauccccagaggagaaggccucucgcugccucauccucuga

SEQ ID NO: 8355 - RNA, 975 nt, Artificial Sequence
  derived and/or modified sequence opt1 from DNJB2__Homo_sapiens__AAH11609
auggccagcuacuacgagauccuggacgugccccgcuccgccagcgcggacgacaucaagaaggccuaccggcgcaaggcccuccaguggcacccggacaagaaccccgacaacaaggaguucgccgagaagaaguucaaggaggucgccgaggcguacgaggugcuguccgacaagcacaagcgggagaucuacgaccgcuacggccgggaggggcugaccggcaccgggacgggccccagccgcgccgaggccggguccggcggccccggguucaccuucaccuuccggagcccggaggagguguuccgcgaguucuucggcuccggggaccccuucgccgagcuguucgacgaccugggccccuucagcgagcugcagaaccgggggucccgccacagcggccccuucuucaccuucuccagcuccuucccgggccacagcgacuucuccagcuccagcuucuccuucagccccggggcgggcgccuuccggagcgucuccacgagcaccaccuucgugcaggggcgccggaucaccacgcgccggaucauggagaacggccaggagcgcguggaggucgaggaggacggccagcucaaguccgugaccaucaacggggugcccgacgaccuggcccugggccucgagcugagccggcgcgagcagcagcccuccgucaccagccgguccgggggcacccaggugcagcagacgccggccagcugcccccuggacuccgaccucagcgaggacgaggaccugcagcuggccauggcguacucccucagcgagauggaggccgccgggaagaagcccgccggcggccgcgaggcccagcaccggcgccaggggcgccccaaggcgcagcaccaggacccgggccucgggggcacccaggagggggcccggggcgaggccaccaagcgcucccccagccccgaggagaaggccucccggugccugauccucuga

SEQ ID NO: 8356 - RNA, 975 nt, Artificial Sequence
  derived and/or modified sequence opt2 from DNJB2__Homo_sapiens__AAH11609
auggccuccuacuacgagauccucgacgucccccgcuccgccuccgccgacgacaucaagaaggccuaccgccgcaaggcccuccaguggcaccccgacaagaaccccgacaacaaggaguucgccgagaagaaguucaaggaggucgccgaggccuacgagguccucuccgacaagcacaagcgcgagaucuacgaccgcuacggccgcgagggccucaccggcaccggcaccggccccucccgcgccgaggccggcuccggcggccccggcuucaccuucaccuuccgcucccccgaggaggucuuccgcgaguucuucggcuccggcgaccccuucgccgagcucuucgacgaccucggccccuucuccgagcuccagaaccgcggcucccgccacuccggccccuucuucaccuucuccuccuccuuccccggccacuccgacuucuccuccuccuccuucuccuucucccccggcgccggcgccuuccgcuccgucuccaccuccaccaccuucguccagggccgccgcaucaccacccgccgcaucauggagaacggccaggagcgcgucgaggucgaggaggacggccagcucaaguccgucaccaucaacggcguccccgacgaccucgcccucggccucgagcucucccgccgcgagcagcagcccuccgucaccucccgcuccggcggcacccagguccagcagacccccgccuccugcccccucgacuccgaccucuccgaggacgaggaccuccagcucgccauggccuacucccucuccgagauggaggccgccggcaagaagcccgccggcggccgcgaggcccagcaccgccgccagggccgccccaaggcccagcaccaggaccccggccucggcggcacccaggagggcgcccgcggcgaggccaccaagcgcucccccucccccgaggagaaggccucccgcugccucauccucuga

SEQ ID NO: 8357 - RNA, 975 nt, Artificial Sequence
  derived and/or modified sequence opt3 from DNJB2__Homo_sapiens__AAH11609
auggccagcuacuaugagauccuggacgugcccagauccgcuucugcagaugacauuaagaaagccuacaggcggaaggcgcuccaguggcacccugauaaaaacccagacaauaaggaauuugcugagaaaaaguuuaaggaagucgccgaggcauaugaaguucuuucagauaaacauaagcgcgagauauacgaccgauauggccgugaggggcugaccggaacagguacuggcccgaguagagccgaagcugggagcggaggccccgguuucacguuuaccuucagguccccugaggaaguguuucgggaguucuuugggucuggagauccauucgcagaguuguuugacgauuuaggccccuucucggaacugcaaaaccgcggcucaagacacagcgggccuuucuucacauuuaguuccucuuucccaggacauagcgacuucuccucaaguagcuuuucuuucucccccggugccggcgcuuuuaggucaguaagcacgaguaccacauucgugcaggggcggcgcaucaccacucgaagaauuauggagaauggacaggaaagggucgagguggaagaggauggccagcuaaaaucuguuacaaucaacggugugccugacgaucucgcccuggggcuugagcugucccggcgugaacaacagccaagcgucaccucgcgcucuggaggcacucaggugcagcaaacuccggcguccugccccuuggacucagaccucagugaggaugaagaccugcagcuggcaauggccuacagccucuccgagauggaagcugccggcaagaaaccugcagggggaagagaggcucagcacaggcggcagggucgaccaaaggcccaacaucaggaucccggcuuagggggaacccaggagggcgcgcgcggugaagccacaaagagaucuccuagcccagaggaaaaagcaucaaggugucugauucuuuga

SEQ ID NO: 8358 - RNA, 975 nt, Artificial Sequence
  derived and/or modified sequence opt4 from DNJB2__Homo_sapiens__AAH11609
auggccagcuacuacgagauccuggacgugcccagaagcgccagcgccgacgacaucaagaaggccuacagaagaaaggcccugcaguggcaccccgacaagaaccccgacaacaaggaguucgccgagaagaaguucaaggagguggccgaggccuacgaggugcugagcgacaagcacaagagagagaucuacgacagauacggcagagagggccugaccggcaccggcaccggccccagcagagccgaggccggcagcggcggccccggcuucaccuucaccuucagaagccccgaggagguguucagagaguucuucggcagcggcgaccccuucgccgagcuguucgacgaccugggccccuucagcgagcugcagaacagaggcagcagacacagcggccccuucuucaccuucagcagcagcuuccccggccacagcgacuucagcagcagcagcuucagcuucagccccggcgccggcgccuucagaagcgugagcaccagcaccaccuucgugcagggcagaagaaucaccaccagaagaaucauggagaacggccaggagagaguggagguggaggaggacggccagcugaagagcgugaccaucaacggcgugcccgacgaccuggcccugggccuggagcugagcagaagagagcagcagcccagcgugaccagcagaagcggcggcacccaggugcagcagacccccgccagcugcccccuggacagcgaccugagcgaggacgaggaccugcagcuggccauggccuacagccugagcgagauggaggccgccggcaagaagcccgccggcggcagagaggcccagcacagaagacagggcagacccaaggcccagcaccaggaccccggccugggcggcacccaggagggcgccagaggcgaggccaccaagagaagccccagccccgaggagaaggccagcagaugccugauccuguga

SEQ ID NO: 8359 - RNA, 975 nt, Artificial Sequence
  derived and/or modified sequence opt5 from DNJB2__Homo_sapiens__AAH11609
auggccagcuacuaugagauccuggacgugcccagauccgcuucugccgaugacauuaagaaagcguaccggcgcaaggcucuccaguggcacccugauaaaaacccggacaauaaggaauuugccgagaaaaaguuuaaggaagucgccgaggcuuaugaaguucugagcgauaaacauaagagagagaucuacgaccgguauggccgcgaggggcuuaccggaacaggcacggggcccuccagagccgaagcuggaucuggcgggccuggauucaccuuuacauuccggagccccgaggaaguguuucgcgaguucuuuggcuccggcgauccuuucgccgagcuguuugacgaucucgggcccuucucugaacugcaaaacagaggaagccggcacuccggcccuuucuucaccuuuucuucuuccuucccggggcauagcgacuucucuuccagcucuuuuuccuucagccccggagcgggcgccuuucgcuccgugucuacaagcaccacauucguccaggggagacggauuaccacgcgcagaaucauggagaauggacaggaacggguggagguugaagaggauggccagcuuaaauccgugaccauuaacggcgucccugacgaucuggcucucgggcuggagcugagccgcagagaacaacagcccucugugacaucccggagcggaggcacccagguucagcaaaccccugccucuugcccccucgacagcgaccuguccgaggaugaagaccuucagcuggcuauggccuacucucucagcgagauggaagcggccgggaagaaaccggcuggaggcagagaggcccagcaccgccggcaggggagaccuaaggcucaacaucaggaucccggacugggcggcacacaggagggggcccgcggagaagccacgaagcgguccccuagccccgaggaaaaagcuagcagaugucuuauccuguga

SEQ ID NO: 8360 - protein, 145 aa, Artificial Sequence
  DNJB3__Homo_sapiens__Q8WWF6
MVDYYEVLDVPRQASSEAIKKAYRKLALKWHPDKNPENKEEAERRFKQVAEAYEVLSDAKKRDIYDRYGEAGAEGGCTGGRPFEDPFEYVFSFRDPADVFREFFGGQDPFSFDLLGNPLENILGGSEELLGKQKQSVCTPFLCLQ

SEQ ID NO: 8361 - RNA, 438 nt, Artificial Sequence
  DNJB3__Homo_sapiens__AAH17590
augguggacuacuacgaggugcuggacgugccccggcaggccucauccgaggccaucaagaaggcguaccgcaagcuggcgcucaaguggcaccccgacaaaaacccugagaacaaggaggaagcggagaggagauucaagcagguggccgaggccuacgagguguugucggacgccaagaaacgcgauaucuaugaccgcuauggcgaggcgggcgcggagggcggcugcacaggcggcaggcccuucgaggaccccuucgaguacgucuucagcuuccgcgacccagccgacgucuucagggaguucuucggcggccaggacccauucuccuuugaccucuugggaaacccgcuggagaauauuuugggggggucagaggaacugcuggggaagcagaagcagagcgucugcaccccuuuucucugccuucaguga

SEQ ID NO: 8362 - RNA, 438 nt, Artificial Sequence
  derived and/or modified sequence opt1 from DNJB3__Homo_sapiens__AAH17590
augguggacuacuacgagguccuggacgugccccgccaggccagcuccgaggccaucaagaaggcguaccggaagcucgcccugaaguggcacccggacaagaaccccgagaacaaggaggaggccgagcgccgguucaagcaggucgccgaggccuacgaggugcugagcgacgcgaagaagcgcgacaucuacgaccgguacggcgaggccggggccgagggcgggugcaccggcgggcgccccuucgaggaccccuucgaguacguguucuccuuccgggacccggccgacguguuccgcgaguucuucggcggccaggaccccuucagcuucgaccuccuggggaacccccuggagaacauccucggcggguccgaggagcugcugggcaagcagaagcagagcgucugcacccccuuccucugccugcaguga

SEQ ID NO: 8363 - RNA, 438 nt, Artificial Sequence
  derived and/or modified sequence opt2 from DNJB3__Homo_sapiens__AAH17590
auggucgacuacuacgagguccucgacgucccccgccaggccuccuccgaggccaucaagaaggccuaccgcaagcucgcccucaaguggcaccccgacaagaaccccgagaacaaggaggaggccgagcgccgcuucaagcaggucgccgaggccuacgagguccucuccgacgccaagaagcgcgacaucuacgaccgcuacggcgaggccggcgccgagggcggcugcaccggcggccgccccuucgaggaccccuucgaguacgucuucuccuuccgcgaccccgccgacgucuuccgcgaguucuucggcggccaggaccccuucuccuucgaccuccucggcaacccccucgagaacauccucggcggcuccgaggagcuccucggcaagcagaagcaguccgucugcacccccuuccucugccuccaguga

SEQ ID NO: 8364 - RNA, 438 nt, Artificial Sequence
  derived and/or modified sequence opt3 from DNJB3__Homo_sapiens__AAH17590
augguggacuacuaugagguccuggauguucccagacaggccagcuccgaagcuaucaagaaagcauacaggaagcucgcccuuaaauggcacccugacaagaacccagagaauaaagaagaggcggaacggcgcuucaagcaaguggcugaggccuaugagguacugucugaugcaaagaaacgagacauuuacgaucguuauggcgaagccggggcugagggagguugcaccggcgggagaccguuugaagaccccuucgaguacguguuuucauucagggauccugcagacgucuuucgggaguucuuuggaggccaggauccauucaguuuugacuuguuagguaacccccuggaaaauauacuagggggaagcgaggaacuccugggcaagcagaaacaguccguguguacaccuuuccuuugccugcaauga

SEQ ID NO: 8365 - RNA, 438 nt, Artificial Sequence
  derived and/or modified sequence opt4 from DNJB3__Homo_sapiens__AAH17590
augguggacuacuacgaggugcuggacgugcccagacaggccagcagcgaggccaucaagaaggccuacagaaagcuggcccugaaguggcaccccgacaagaaccccgagaacaaggaggaggccgagagaagauucaagcagguggccgaggccuacgaggugcugagcgacgccaagaagagagacaucuacgacagauacggcgaggccggcgccgagggcggcugcaccggcggcagacccuucgaggaccccuucgaguacguguucagcuucagagaccccgccgacguguucagagaguucuucggcggccaggaccccuucagcuucgaccugcugggcaacccccuggagaacauccugggcggcagcgaggagcugcugggcaagcagaagcagagcgugugcacccccuuccugugccugcaguga

SEQ ID NO: 8366 - RNA, 438 nt, Artificial Sequence
  derived and/or modified sequence opt5 from DNJB3__Homo_sapiens__AAH17590
augguggacuacuaugagguccuggauguucccagacaggccagcuccgaagcuaucaagaaagccuaccggaagcucgcgcugaaauggcacccugacaagaacccggagaauaaagaagaggcugaacgcagauucaagcaaguggccgaggccuaugaggugcuuucugaugcuaagaaacgggacauuuacgaucgcuauggcgaagccggggcugagggaggcugcaccgggggaagacccuuugaagacccuuucgaguacgucuuuagcuuccgggaucccgccgacguguuucgcgaguucuuuggcgggcaggauccuuucuccuuugaccugcucggaaacccccuggaaaauauccuuggcggcucugaggaacugcucgggaagcagaaacagagcguuuguacaccuuuccugugccugcaauga

SEQ ID NO: 8367 - protein, 337 aa, Artificial Sequence
  DNJB4__Homo_sapiens__Q9UDY4
MGKDYYCILGIEKGASDEDIKKAYRKQALKFHPDKNKSPQAEEKFKEVAEAYEVLSDPKKREIYDQFGEEGLKGGAGGTDGQGGTFRYTFHGDPHATFAAFFGGSNPFEIFFGRRMGGGRDSEEMEIDGDPFSAFGFSMNGYPRDRNSVGPSRLKQDPPVIHELRVSLEEIYSGCTKRMKISRKRLNADGRSYRSEDKILTIEIKKGWKEGTKITFPREGDETPNSIPADIVFIIKDKDHPKFKRDGSNIIYTAKISLREALCGCSINVPTLDGRNIPMSVNDIVKPGMRRRIIGYGLPFPKNPDQRGDLLIEFEVSFPDTISSSSKEVLRKHLPAS

SEQ ID NO: 8368 - RNA, 1014 nt, Artificial Sequence
  DNJB4__Homo_sapiens__AAC14483
auggggaaagacuauuauugcauuuugggaauugagaaaggagcuucagaugaagauauuaaaaaggcuuaccgaaaacaagcccucaaauuucauccggacaagaacaaaucuccucaggcagaggaaaaauuuaaagaggucgcagaagcuuaugaaguauugagugauccuaaaaagagagaaauauaugaucaguuuggggaggaaggguugaaaggaggagcaggagguacugauggacaaggagguaccuuccgguacaccuuucauggcgauccucaugcuacauuugcugcauuuuucggaggguccaaccccuuugaaauuuucuuuggaagacgaauggguggugguagagauucugaagaaauggaaauagauggugauccuuuuagugccuuugguuucagcaugaauggauauccaagagacaggaauucuguggggccaucccgccucaaacaagauccuccaguuauucaugaacuuagaguaucacuugaagagauauauagugguuguaccaaacggaugaagauuucucgaaaaaggcuaaacgcugauggaaggaguuacagaucugaggacaaaauucuuaccauugagauuaaaaaaggguggaaagaaggcaccaaaauuacuuuuccaagagaaggagaugaaacaccaaauaguauuccagcagacauuguuuuuaucauuaaagacaaagaucauccaaaauuuaaaagggauggaucaaauauaauuuauacugcuaaaauuaguuuacgagaggcauuguguggcugcucaauuaauguaccaacacuggauggaagaaacauaccuaugucaguaaaugauauugugaaacccggaaugaggagaagaauuauuggauaugggcugccauuuccaaaaaauccugaccaacguggugaccuucuaauagaauuugagguguccuucccagauacuauaucuucuucauccaaagaaguacuuaggaaacaucuuccugccucauag

SEQ ID NO: 8369 - RNA, 1014 nt, Artificial Sequence
  derived and/or modified sequence opt1 from DNJB4__Homo_sapiens__AAC14483
augggcaaggacuacuacugcauccuggggaucgagaagggcgccagcgacgaggacaucaagaaggccuaccgcaagcaggcgcucaaguuccaccccgacaagaacaaguccccgcaggccgaggagaaguucaaggagguggccgaggccuacgagguccugagcgaccccaagaagcgggagaucuacgaccaguucggggaggagggccugaagggcggggccggcgggaccgacggccagggcgggaccuuccgcuacacguuccacggggacccccacgcgaccuucgccgccuucuucggcggcuccaaccccuucgagaucuucuucgggcggcgcaugggcgggggccgggacagcgaggagauggagaucgacggcgacccguucuccgccuucggguucagcaugaacggcuacccccgcgaccggaacuccguggggcccagccgccucaagcaggacccgcccgugauccacgagcugcgggucucccuggaggagaucuacagcggcugcaccaagcgcaugaagaucucccggaagcgccucaacgcggacgggcggagcuaccgcuccgaggacaagauccugaccaucgagaucaagaagggcuggaaggagggcacgaagaucaccuucccccgggagggggacgagacccccaacagcauccccgccgacaucguguucaucaucaaggacaaggaccacccgaaguucaagcgcgacggcuccaacaucaucuacaccgccaagaucagccugcgggaggcccucugcgggugcuccaucaacgugcccacgcuggacggccgcaacauccccaugagcgucaacgacaucgugaagcccgggaugcggcgccggaucaucggcuacggccugccguuccccaagaaccccgaccagcgcggggaccuccugaucgaguucgagguguccuuccccgacaccaucagcagcuccagcaaggagguccugcgcaagcaccucccggccuccuga

SEQ ID NO: 8370 - RNA, 1014 nt, Artificial Sequence
  derived and/or modified sequence opt2 from DNJB4__Homo_sapiens__AAC14483
augggcaaggacuacuacugcauccucggcaucgagaagggcgccuccgacgaggacaucaagaaggccuaccgcaagcaggcccucaaguuccaccccgacaagaacaaguccccccaggccgaggagaaguucaaggaggucgccgaggccuacgagguccucuccgaccccaagaagcgcgagaucuacgaccaguucggcgaggagggccucaagggcggcgccggcggcaccgacggccagggcggcaccuuccgcuacaccuuccacggcgacccccacgccaccuucgccgccuucuucggcggcuccaaccccuucgagaucuucuucggccgccgcaugggcggcggccgcgacuccgaggagauggagaucgacggcgaccccuucuccgccuucggcuucuccaugaacggcuacccccgcgaccgcaacuccgucggccccucccgccucaagcaggacccccccgucauccacgagcuccgcgucucccucgaggagaucuacuccggcugcaccaagcgcaugaagaucucccgcaagcgccucaacgccgacggccgcuccuaccgcuccgaggacaagauccucaccaucgagaucaagaagggcuggaaggagggcaccaagaucaccuucccccgcgagggcgacgagacccccaacuccauccccgccgacaucgucuucaucaucaaggacaaggaccaccccaaguucaagcgcgacggcuccaacaucaucuacaccgccaagaucucccuccgcgaggcccucugcggcugcuccaucaacguccccacccucgacggccgcaacauccccauguccgucaacgacaucgucaagcccggcaugcgccgccgcaucaucggcuacggccuccccuuccccaagaaccccgaccagcgcggcgaccuccucaucgaguucgaggucuccuuccccgacaccaucuccuccuccuccaaggagguccuccgcaagcaccuccccgccuccuga

SEQ ID NO: 8371 - RNA, 1014 nt, Artificial Sequence
  derived and/or modified sequence opt3 from DNJB4__Homo_sapiens__AAC14483
augggcaaggacuacuauugcauccuggggauugagaaaggagccagcgaugaagacauaaagaaggcuuacagaaaacaggcacucaaauuccaccccgauaagaacaaguccccucaagccgaggaaaaauuuaaggagguggcggaggcuuaugaaguccuuucugacccgaaaaagagggagaucuacgaucaguucggugaagagggccugaaagggggagccggcgguaccgacgggcagggaggcacauuucgguauacuuuccauggcgauccacacgcaacguuugccgcuuucuuugggggaucaaaucccuucgaaaucuuuuucggucgccgaaugggcgggggacgugacagugaggagauggaaauugauggcgacccuuuuagcgcauucgguuuuuccaugaacggguacccaagagauaggaacucuguuggacccucgcgguugaagcaggacccuccagugauucaugaguuacgcguaucacuggaagagaucuauagcggcuguaccaagagaaugaaaauaaguaggaagcggcuaaaugccgauggccgcuccuaccgaucugaagacaaaauccucacaauugagaucaagaaaggguggaaggagggaacuaaaauuaccuuccccagagaaggugacgagacaccuaauagcaucccagcugauauaguguucauuaucaaggacaaggaucacccgaaauuuaagagggacggcuccaacauuaucuacaccgccaaaaucucacugcgggaagcgcuuugcggguguaguauuaauguccccacucuggauggacguaacauaccuaugagcgugaaugacaucguuaagccaggcaugcgcagaaggauuaucgguuauggguugcccuucccuaaaaacccagaucaacggggcgaccuccugauagaguuugaagugucuuuccccgauacaauuuccucaagcaguaaggagguccugcgaaagcaucucccggcaucuuga

SEQ ID NO: 8372 - RNA, 1014 nt, Artificial Sequence
  derived and/or modified sequence opt4 from DNJB4__Homo_sapiens__AAC14483
augggcaaggacuacuacugcauccugggcaucgagaagggcgccagcgacgaggacaucaagaaggccuacagaaagcaggcccugaaguuccaccccgacaagaacaagagcccccaggccgaggagaaguucaaggagguggccgaggccuacgaggugcugagcgaccccaagaagagagagaucuacgaccaguucggcgaggagggccugaagggcggcgccggcggcaccgacggccagggcggcaccuucagauacaccuuccacggcgacccccacgccaccuucgccgccuucuucggcggcagcaaccccuucgagaucuucuucggcagaagaaugggcggcggcagagacagcgaggagauggagaucgacggcgaccccuucagcgccuucggcuucagcaugaacggcuaccccagagacagaaacagcgugggccccagcagacugaagcaggacccccccgugauccacgagcugagagugagccuggaggagaucuacagcggcugcaccaagagaaugaagaucagcagaaagagacugaacgccgacggcagaagcuacagaagcgaggacaagauccugaccaucgagaucaagaagggcuggaaggagggcaccaagaucaccuuccccagagagggcgacgagacccccaacagcauccccgccgacaucguguucaucaucaaggacaaggaccaccccaaguucaagagagacggcagcaacaucaucuacaccgccaagaucagccugagagaggcccugugcggcugcagcaucaacgugcccacccuggacggcagaaacauccccaugagcgugaacgacaucgugaagcccggcaugagaagaagaaucaucggcuacggccugcccuuccccaagaaccccgaccagagaggcgaccugcugaucgaguucgaggugagcuuccccgacaccaucagcagcagcagcaaggaggugcugagaaagcaccugcccgccagcuga

SEQ ID NO: 8373 - RNA, 1014 nt, Artificial Sequence
  derived and/or modified sequence opt5 from DNJB4__Homo_sapiens__AAC14483
augggcaaggacuacuauugcauccuggggauugagaaaggagccagcgaugaagacaucaagaaggcuuacagaaaacaggcccucaaauuccaccccgauaagaacaaguccccucaagcggaggaaaaauuuaaggagguggcugaagccuaugagguccugucugacccgaaaaagcgggagauuuacgaucaguucggcgaagaggggcuuaaaggaggcgccgggggaaccgacggccagggcgggacauuucgcuauacguuccauggagauccccacgcuaccuuugccgcuuucuuuggcgggagcaauccuuucgaaaucuuuuucggaagacggaugggcgggggacgcgacuccgaggagauggaaauugauggcgaccccuuuucugccuucggcuuuagcaugaacggguacccuagagaucgcaauuccguuggacccucucggcugaagcaggacccuccggugauccaugagcucagagugagccuggaagagaucuauuccggcuguacaaagcggaugaaaauuagccgcaagagacuuaacgcggaugggcggucuuaccgcuccgaagacaaaauccugaccauugagaucaagaaaggauggaaggagggcacaaaaauuaccuuccccagagaaggggacgagacaccuaauagcauccccgccgauauugucuucaucaucaaggacaaggaucacccuaaauuuaagcgggacggaucuaacauuaucuacaccgcuaaaauuucccuccgcgaagcccugugcggcuguagcaucaaugugcccacgcuggauggcagaaacauuccgaugucuguuaaugacaucgugaagccugggaugcggagacgcaucauuggauauggccuccccuucccuaaaaaccccgaucaaagaggggaccugcuuaucgaguuugaagucuccuuccccgauaccauuagcuccucuagcaaggaggugcugcggaagcaucucccugcuuccuga

SEQ ID NO: 8374 - protein, 348 aa, Artificial Sequence
  DNJB5__Homo_sapiens__O75953
MGKDYYKILGIPSGANEDEIKKAYRKMALKYHPDKNKEPNAEEKFKEIAEAYDVLSDPKKRGLYDQYGEEGLKTGGGTSGGSSGSFHYTFHGDPHATFASFFGGSNPFDIFFASSRSTRPFSGFDPDDMDVDEDEDPFGAFGRFGFNGLSRGPRRAPEPLYPRRKVQDPPVVHELRVSLEEIYHGSTKRMKITRRRLNPDGRTVRTEDKILHIVIKRGWKEGTKITFPKEGDATPDNIPADIVFVLKDKPHAHFRRDGTNVLYSALISLKEALCGCTVNIPTIDGRVIPLPCNDVIKPGTVKRLRGEGLPFPKVPTQRGDLIVEFKVRFPDRLTPQTRQILKQHLPCS

SEQ ID NO: 8375 - RNA, 1047 nt, Artificial Sequence
  DNJB5__Homo_sapiens__AAC35860
augggaaaagauuauuacaagauucuugggaucccaucgggggccaacgaggaugagaucaagaaagccuaccggaagauggccuugaaguaccacccagacaagaauaaagaacccaacgcugaggagaaguuuaaggagauugcagaggccuaugaugugcuaagugaccccaagaaacggggccuguaugaccaguauggggaggaaggccugaagaccggcgguggcacaucagguggcuccaguggcuccuuucacuacaccuuucauggggacccccaugccaccuuugccuccuucuuugguggcuccaaccccuucgauaucuucuuugccagcagccgcuccacucggcccuucaguggcuuugacccagaugacauggauguggaugaagaugaggacccauuuggcgcuuucggccguuuuggcuucaaugggcugaguagggguccaaggcgagccccagaaccacuguacccucggcgcaaggugcaggaccccccaguggugcacgagcugcgggugucccuggaggagaucuaccauggcuccaccaagcgcaugaagaucacaaggcgucgccucaacccugaugggcgaacugugcgcaccgaggacaagauccugcacauagucaucaagcguggcuggaaggaaggcaccaagaucaccuuccccaaagaaggcgacgccacaccugacaacaucccugcugacaucgucuuugugcucaaagacaagccccaugcacacuuccgccgagauggcaccaacgugcucuacagugcccugaucagccucaaggaggcgcuguguggcugcacugugaacauucccacuaucgacggccgagugaucccuuugcccugcaaugaugucaucaagccaggcaccgugaagagacuccguggggagggccuucccuuccccaaagugccaacucagcgaggagaccucauuguugaguucaaaguucgcuucccagacagauuaacaccacagacaagacagauccuuaagcagcaccuacccuguuccuag

SEQ ID NO: 8376 - RNA, 1047 nt, Artificial Sequence
  derived and/or modified sequence opt1 from DNJB5__Homo_sapiens__AAC35860
augggcaaggacuacuacaagauccuggggauccccagcggcgccaacgaggacgagaucaagaaggccuaccgcaagauggcgcucaaguaccacccggacaagaacaaggagcccaacgccgaggagaaguucaaggagaucgccgaggccuacgacgugcuguccgaccccaagaagcgggggcuguacgaccaguacggcgaggaggggcucaagaccggcggcgggaccagcggcggguccagcggcuccuuccacuacacguuccacggggacccccacgccaccuucgcgagcuucuucggcggcuccaacccguucgacaucuucuucgccagcucccgcagcacccggcccuucuccggguucgaccccgacgacauggacgucgacgaggacgaggaccccuucggcgccuucgggcgcuucggcuucaacggccugagccgggggccgcgccgggcccccgagccccuguacccccgccggaaggugcaggacccgcccgugguccacgagcuccgcgugucccuggaggagaucuaccacggcagcaccaagcggaugaagaucacgcgccggcgccugaaccccgacgggcggaccgugcgcaccgaggacaagauccuccacaucgucaucaagcggggcuggaaggaggggaccaagaucacguuccccaaggagggcgacgcgaccccggacaacauccccgccgacaucguguucgugcugaaggacaagccccacgcccacuuccgccgggacggcaccaacguccuguacuccgcccucaucagccugaaggaggcccugugcgggugcaccgugaacauccccacgaucgacggccgcgugaucccgcuccccugcaacgacgucaucaagcccgggaccgugaagcggcugcgcggcgaggggcugcccuucccgaaggugcccacccagcgcggcgaccucaucgucgaguucaaggugcgguuccccgaccgccugacgccccagacccggcagauccugaagcagcaccucccgugcuccuga

SEQ ID NO: 8377 - RNA, 1047 nt, Artificial Sequence
  derived and/or modified sequence opt2 from DNJB5__Homo_sapiens__AAC35860
augggcaaggacuacuacaagauccucggcauccccuccggcgccaacgaggacgagaucaagaaggccuaccgcaagauggcccucaaguaccaccccgacaagaacaaggagcccaacgccgaggagaaguucaaggagaucgccgaggccuacgacguccucuccgaccccaagaagcgcggccucuacgaccaguacggcgaggagggccucaagaccggcggcggcaccuccggcggcuccuccggcuccuuccacuacaccuuccacggcgacccccacgccaccuucgccuccuucuucggcggcuccaaccccuucgacaucuucuucgccuccucccgcuccacccgccccuucuccggcuucgaccccgacgacauggacgucgacgaggacgaggaccccuucggcgccuucggccgcuucggcuucaacggccucucccgcggcccccgccgcgcccccgagccccucuacccccgccgcaagguccaggacccccccgucguccacgagcuccgcgucucccucgaggagaucuaccacggcuccaccaagcgcaugaagaucacccgccgccgccucaaccccgacggccgcaccguccgcaccgaggacaagauccuccacaucgucaucaagcgcggcuggaaggagggcaccaagaucaccuuccccaaggagggcgacgccacccccgacaacauccccgccgacaucgucuucguccucaaggacaagccccacgcccacuuccgccgcgacggcaccaacguccucuacuccgcccucaucucccucaaggaggcccucugcggcugcaccgucaacauccccaccaucgacggccgcgucaucccccuccccugcaacgacgucaucaagcccggcaccgucaagcgccuccgcggcgagggccuccccuuccccaagguccccacccagcgcggcgaccucaucgucgaguucaagguccgcuuccccgaccgccucaccccccagacccgccagauccucaagcagcaccuccccugcuccuga

SEQ ID NO: 8378 - RNA, 1047 nt, Artificial Sequence
  derived and/or modified sequence opt3 from DNJB5__Homo_sapiens__AAC35860
augggcaaggacuacuauaaaauccuggggauucccagcggagccaacgaggaugaaauaaagaaggcuuacagaaaaauggcacucaaauaucacccugacaagaauaaggagccaaacgccgaagagaaauucaaggaaaucgcggaggcuuacgaugugcuuuccgacccgaaaaagaggggucuguaugaucaguacggcgaggaaggguugaaaaccggaggcgguacaucugggggaucaaguggcagcuuucauuauacuuuccacggcgacccccaugccacguuugcauccuucuuugggggaucuaauccuuucgauauuuucuucgccucgucacggagcacccgcccauuuagugguuucgaccccgaugacauggaugucgacgaggaugaagacccuuuuggcgcuuucgggcgauuuggauucaacggcuuaucccgugguccaagaagggcacccgagccucuguacccacggcgcaagguucaagacccgcccgugguacacgagcuaagagugucucucgaagagaucuaccaugggagcacaaagaggaugaaaauuacucggcgccgacugaauccugauggaagaaccgucaggacagaagacaagauccuucacauagugaucaaacggggcuggaaggagggcaccaaaauuacuuucccaaaggaaggggaugccacacccgacaacaucccugcugauauuguuuuugugcugaaagacaagccacacgcccauuuccgucgcgauggaaccaaugucuuguauuccgcgcucaucucacugaaggaggcacugugcgguuguacggugaacauacccacuauugacggcagaguaaucccgcucccuugcaaugauguuauuaaacccgggaccgugaagagguuacggggagagggccugccauuuccuaaaguccccacacagcgaggugaccuuaucguggaauuuaaggugcgcuuuccagauagauugacuccccagaccaggcagauccugaaacaacaccuaccuuguaguuga

SEQ ID NO: 8379 - RNA, 1047 nt, Artificial Sequence
  derived and/or modified sequence opt4 from DNJB5__Homo_sapiens__AAC35860
augggcaaggacuacuacaagauccugggcauccccagcggcgccaacgaggacgagaucaagaaggccuacagaaagauggcccugaaguaccaccccgacaagaacaaggagcccaacgccgaggagaaguucaaggagaucgccgaggccuacgacgugcugagcgaccccaagaagagaggccuguacgaccaguacggcgaggagggccugaagaccggcggcggcaccagcggcggcagcagcggcagcuuccacuacaccuuccacggcgacccccacgccaccuucgccagcuucuucggcggcagcaaccccuucgacaucuucuucgccagcagcagaagcaccagacccuucagcggcuucgaccccgacgacauggacguggacgaggacgaggaccccuucggcgccuucggcagauucggcuucaacggccugagcagaggccccagaagagcccccgagccccuguaccccagaagaaaggugcaggacccccccguggugcacgagcugagagugagccuggaggagaucuaccacggcagcaccaagagaaugaagaucaccagaagaagacugaaccccgacggcagaaccgugagaaccgaggacaagauccugcacaucgugaucaagagaggcuggaaggagggcaccaagaucaccuuccccaaggagggcgacgccacccccgacaacauccccgccgacaucguguucgugcugaaggacaagccccacgcccacuucagaagagacggcaccaacgugcuguacagcgcccugaucagccugaaggaggcccugugcggcugcaccgugaacauccccaccaucgacggcagagugaucccccugcccugcaacgacgugaucaagcccggcaccgugaagagacugagaggcgagggccugcccuuccccaaggugcccacccagagaggcgaccugaucguggaguucaaggugagauuccccgacagacugaccccccagaccagacagauccugaagcagcaccugcccugcagcuga

SEQ ID NO: 8380 - RNA, 1047 nt, Artificial Sequence
  derived and/or modified sequence opt5 from DNJB5__Homo_sapiens__AAC35860
augggcaaggacuacuauaaaauccuggggauucccagcggagccaacgaagaugaaaucaagaaggcuuacagaaaaauggcccucaaauaucacccugacaagaauaaggagccgaacgcggaagagaaauucaaggaaauugcugaggccuacgaugugcuguccgaccccaaaaagcggggccuuuaugaucaguacggggaggaaggacugaaaaccggcgggggaacaucuggcggcagcuccgggucuuuucacuauacguuccacggagacccucaugccaccuuugcuagcuucuuuggcggguccaaucccuucgauaucuuuuucgccucuagccgcuccacaagaccuuuuagcggauucgaccccgaugacauggaugucgacgaggaugaagacccuuuuggcgcuuucgggcgguuuggauucaacggccucucucgcggcccgagacgggcccccgagccucuguacccccgcagaaagguucaagacccucccguggugcacgagcuucgggucucccuggaagagauuuaccaugggagcaccaagcgcaugaaaaucacaagacggcgccucaauccggauggaagaaccgugcggacagaagacaagauccugcacauuguuaucaaacgcggcuggaaggaggggaccaaaauuacguucccuaaggaaggagaugcgacccccgacaacaucccugccgauauuguguuuguccugaaagacaagccccacgcucauuucagacgggauggcacaaaugugcucuauucugcccugaucucccuuaaggaggcucugugcggguguaccguuaacauucccacaaucgacggaagagugaucccucucccgugcaaugaugucauuaaacccggcaccgugaagcgccugcggggcgaggggcuuccuuuucccaaagugccuacgcagagaggagaccugaucgucgaguucaagguucgcuuucccgaucggcucacaccgcagaccagacagauucugaaacaacaucugccuuguagcuga

SEQ ID NO: 8381 - protein, 326 aa, Artificial Sequence
  DNJB6__Homo_sapiens__O75190
MVDYYEVLGVQRHASPEDIKKAYRKLALKWHPDKNPENKEEAERKFKQVAEAYEVLSDAKKRDIYDKYGKEGLNGGGGGGSHFDSPFEFGFTFRNPDDVFREFFGGRDPFSFDFFEDPFEDFFGNRRGPRGSRSRGTGSFFSAFSGFPSFGSGFSSFDTGFTSFGSLGHGGLTSFSSTSFGGSGMGNFKSISTSTKMVNGRKITTKRIVENGQERVEVEEDGQLKSLTINGVADDDALAEERMRRGQNALPAQPAGLRPPKPPRPASLLRHAPHCLSEEEGEQDRPRAPGPWDPLASAAGLKEGGKRKKQKQREESKKKKSTKGNH

SEQ ID NO: 8382 - RNA, 981 nt, Artificial Sequence
  DNJB6__Homo_sapiens__AAH02446
augguggauuacuaugaaguucuaggcgugcagagacaugccucacccgaggauauuaaaaaggcauaucggaaacuggcacugaaguggcauccagauaaaaauccugagaauaaagaagaagcagagagaaaauucaagcaaguagcggaggcauaugaagugcugucggaugcuaagaaacgggacaucuaugacaaauauggcaaagaaggauuaaaugguggaggaggagguggaagucauuuugacaguccauuugaauuuggcuucacauuccguaacccagaugaugucuucagggaauuuuuugguggaagggacccauuuucauuugacuucuuugaagacccuuuugaggacuucuuugggaaucgaagggguccccgaggaagcagaagccgagggacggggucguuuuucucugcguucaguggauuuccgucuuuuggaaguggauuuucuucuuuugauacaggauuuacuucauuugggucacuaggucacgggggccucacuucauucucuuccacgucauuuggugguaguggcaugggcaacuucaaaucgauaucaacuucaacuaaaaugguuaauggcagaaaaaucacuacaaagagaauugucgagaacggucaagaaagaguagaaguugaagaagauggccaguuaaaguccuuaacaauaaaugguguggccgacgacgaugcccucgcugaggagcgcaugcggagaggccagaacgcccugccagcccagccugccggccuccgcccgccgaagccgccccggccugccucgcugcugagacacgcgccucacugucucucugaggaggagggcgagcaggaccgaccucgggcacccgggcccugggacccccucgcguccgcagcaggauugaaagaagguggcaagaggaagaagcagaagcagagagaggagucgaagaagaagaagucgaccaaaggcaaucacuag

SEQ ID NO: 8383 - RNA, 981 nt, Artificial Sequence
  derived and/or modified sequence opt1 from DNJB6__Homo_sapiens__AAH02446
augguggacuacuacgagguccugggcgugcagcgccacgccagccccgaggacaucaagaaggccuaccggaagcucgcgcugaaguggcacccggacaagaaccccgagaacaaggaggaggccgagcgcaaguucaagcaggucgccgaggccuacgaggugcugagcgacgccaagaagcgggacaucuacgacaaguacgggaaggagggccucaacgggggcgggggcggcgggagccacuucgacucccccuucgaguucggcuucaccuuccgcaaccccgacgacguguuccgggaguucuucgggggccgcgacccguucagcuucgacuucuucgaggaccccuucgaggacuucuucgggaaccggcgcggcccccggggcucccgcagccgggggaccggcuccuucuucagcgcguucuccggguuccccagcuucggcuccggcuucagcuccuucgacacgggguucaccagcuucggcucccuggggcacggcgggcugaccagcuucuccagcaccuccuucggcggcagcgggaugggcaacuucaagagcaucuccacgagcaccaagauggugaacgggcgcaagaucaccaccaagcggaucgucgagaacggccaggagcgcguggagguggaggaggacgggcagcucaagucccugacgaucaacggcgucgccgacgacgacgcccuggccgaggagcggaugcgccggggccagaacgcgcucccggcccagcccgccgggcugcgcccgcccaagccgccccggcccgccagccugcuccgccacgcgccccacugccuguccgaggaggagggcgagcaggaccggccccgcgcccccgggcccugggacccccuggccagcgccgccggccucaaggagggcgggaagcgcaagaagcagaagcagcgggaggaguccaagaagaagaaguccaccaagggcaaccacuga

SEQ ID NO: 8384 - RNA, 981 nt, Artificial Sequence
  derived and/or modified sequence opt2 from DNJB6__Homo_sapiens__AAH02446
auggucgacuacuacgagguccucggcguccagcgccacgccucccccgaggacaucaagaaggccuaccgcaagcucgcccucaaguggcaccccgacaagaaccccgagaacaaggaggaggccgagcgcaaguucaagcaggucgccgaggccuacgagguccucuccgacgccaagaagcgcgacaucuacgacaaguacggcaaggagggccucaacggcggcggcggcggcggcucccacuucgacucccccuucgaguucggcuucaccuuccgcaaccccgacgacgucuuccgcgaguucuucggcggccgcgaccccuucuccuucgacuucuucgaggaccccuucgaggacuucuucggcaaccgccgcggcccccgcggcucccgcucccgcggcaccggcuccuucuucuccgccuucuccggcuuccccuccuucggcuccggcuucuccuccuucgacaccggcuucaccuccuucggcucccucggccacggcggccucaccuccuucuccuccaccuccuucggcggcuccggcaugggcaacuucaaguccaucuccaccuccaccaagauggucaacggccgcaagaucaccaccaagcgcaucgucgagaacggccaggagcgcgucgaggucgaggaggacggccagcucaagucccucaccaucaacggcgucgccgacgacgacgcccucgccgaggagcgcaugcgccgcggccagaacgcccuccccgcccagcccgccggccuccgcccccccaagcccccccgccccgccucccuccuccgccacgccccccacugccucuccgaggaggagggcgagcaggaccgcccccgcgcccccggccccugggacccccucgccuccgccgccggccucaaggagggcggcaagcgcaagaagcagaagcagcgcgaggaguccaagaagaagaaguccaccaagggcaaccacuga

SEQ ID NO: 8385 - RNA, 981 nt, Artificial Sequence
  derived and/or modified sequence opt3 from DNJB6__Homo_sapiens__AAH02446
augguggacuacuaugagguccugggcguucagagacacgccagccccgaagauaucaagaaggcuuacaggaaacucgcacuuaaauggcauccugacaagaacccagagaauaaagaagaggccgaacggaaguucaagcaaguggcggaggcuuaugagguacuguccgaugccaaaaagcgcgacauuuacgauaaauaugggaaggaaggauugaacgguggcgggggaggcgguucucacuuugacucaccguucgaguuuggguucaccuuucgaaaucccgaugacguguuccgugaauuuuucggaggcagagauccuuuuaguuucgacuuuuucgaggauccauuugaggacuucuucggcaacaggcgggggccccgcggaagcagauccagggguacaggcucguuuuucucugcauuuucaggguucccuagcuuuggaaguggcuucuccucuuuugauacugguuucacgagcuuuggguccuuaggacauggcggccugaccucauucaguagcacaucuuuugggggauccgguaugggcaauuucaaaucaauaagcaccaguacuaagauggucaacgggcggaagaucacaaccaaacgcauuguggaaaauggacaggagcgaguugaaguggaggaagacggccagcuaaagucucucacuaucaacggugucgccgacgaugacgcucuggcagaggagagaaugaggcgggggcagaaugcccuuccagcucaacccgccggccugcguccuccaaaaccgccccgcccugcguccuugcucagacacgcaccacauugccugagcgaagaggaaggagagcaggauaggccccgggccccuggcccaugggacccccuggcuucggccgcagggcucaaggaaggagguaaacgaaagaaacagaagcagcgcgaggagucuaagaaaaagaaauccacaaagggcaaccacuga

SEQ ID NO: 8386 - RNA, 981 nt, Artificial Sequence
  derived and/or modified sequence opt4 from DNJB6__Homo_sapiens__AAH02446
augguggacuacuacgaggugcugggcgugcagagacacgccagccccgaggacaucaagaaggccuacagaaagcuggcccugaaguggcaccccgacaagaaccccgagaacaaggaggaggccgagagaaaguucaagcagguggccgaggccuacgaggugcugagcgacgccaagaagagagacaucuacgacaaguacggcaaggagggccugaacggcggcggcggcggcggcagccacuucgacagccccuucgaguucggcuucaccuucagaaaccccgacgacguguucagagaguucuucggcggcagagaccccuucagcuucgacuucuucgaggaccccuucgaggacuucuucggcaacagaagaggccccagaggcagcagaagcagaggcaccggcagcuucuucagcgccuucagcggcuuccccagcuucggcagcggcuucagcagcuucgacaccggcuucaccagcuucggcagccugggccacggcggccugaccagcuucagcagcaccagcuucggcggcagcggcaugggcaacuucaagagcaucagcaccagcaccaagauggugaacggcagaaagaucaccaccaagagaaucguggagaacggccaggagagaguggagguggaggaggacggccagcugaagagccugaccaucaacggcguggccgacgacgacgcccuggccgaggagagaaugagaagaggccagaacgcccugcccgcccagcccgccggccugagaccccccaagccccccagacccgccagccugcugagacacgccccccacugccugagcgaggaggagggcgagcaggacagacccagagcccccggccccugggacccccuggccagcgccgccggccugaaggagggcggcaagagaaagaagcagaagcagagagaggagagcaagaagaagaagagcaccaagggcaaccacuga

SEQ ID NO: 8387 - RNA, 981 nt, Artificial Sequence
  derived and/or modified sequence opt5 from DNJB6__Homo_sapiens__AAH02446
augguggacuacuaugagguccugggcguucagagacacgccagccccgaagauaucaagaaggcuuaccggaaacucgcccugaaauggcauccugacaagaacccggagaauaaagaagaggcggaacgcaaguucaagcaaguggcugaggccuaugaggugcuuuccgaugccaaaaagagagacauuuacgauaaauaugggaaggaaggacugaacggcgggggaggcgggggaucucacuuugacagccccuucgaguuuggcuucaccuuucggaauccugaugacgucuuccgcgaauuuuucggcgggagagaucccuuuuccuucgacuuuuucgaggauccuuuugaggacuucuucggaaaccggcgcggccccagagggucucggagccgcggaacaggcuccuuuuucucugcuuuuagcggguucccuuccuuuggaagcggcuucucuuccuuugauacgggcuucaccagcuuugggucucucggacauggcgggcugacauccuucagcucuaccuccuuuggaggcagcgggaugggaaauuucaaauccaucucuacaagcaccaagauggugaacggcagaaagauuacaaccaaacggaucguugaaaauggccaggagcgcguggaagucgaggaagacgggcagcuuaagucccugacgauuaacggaguggccgacgaugacgcucucgccgaggagagaaugcggcgcggccagaaugcgcugccggcccaacccgcugggcugagaccucccaaaccuccccggccggccagccuccugagacacgcuccucauugccuuucugaagaggaaggagagcaggaucgcccccgggccccuggccccugggacccccuggcguccgccgcugggcucaaggaaggcggaaaaagaaagaaacagaagcagcgcgaggagagcaagaaaaagaaaucuaccaagggcaaccacuga

SEQ ID NO: 8388 - protein, 309 aa, Artificial Sequence
  DNJB7__Homo_sapiens__Q7Z6W7
MVDYYEVLGLQRYASPEDIKKAYHKVALKWHPDKNPENKEEAERKFKEVAEAYEVLSNDEKRDIYDKYGTEGLNGGGSHFDDECEYGFTFHKPDDVFKEIFHERDPFSFHFFEDSLEDLLNRPGSSYGNRNRDAGYFFSTASEYPIFEKFSSYDTGYTSQGSLGHEGLTSFSSLAFDNSGMDNYISVTTSDKIVNGRNINTKKIIESDQEREAEDNGELTFFLVNSVANEEGFAKECSWRTQSFNNYSPNSHSSKHVSQYTFVDNDEGGISWVTSNRDPPIFSAGVKEGGKRKKKKRKEVQKKSTKRNC

SEQ ID NO: 8389 - RNA, 930 nt, Artificial Sequence
  DNJB7__Homo_sapiens__AAI12136
augguggauuacuaugaaguucuaggacugcaaagauaugcuucaccugaggacauuaaaaaagcuuaucauaaaguggcacuuaaauggcacccugauaaaaauccagaaaauaaagaagaagcagagagaaaauucaaagaaguagcugaggcauacgagguauuaucaaaugaugagaaacgggacauuuaugauaaauauggcacagaaggauuaaacggagguggaagucauuuugaugaugaaugugaguacggcuucacauuccauaagccagaugauguuuuuaaagaaauuuuucaugaaagggauccauuuucuuuucacuucuuugaagacucgcuugaggaccuguuaaaucguccaggaagcuccuauggaaacagaaacagagaugcaggauacuuuuucuccacugccagugaauauccaauuuuugagaaauuuucuucauaugauacaggauauacaucacaggguucauuggggcaugaaggccuuacuucuuucucuucccuggcuuuugauaauagugggauggacaacuacauaucuguuacaacuucagacaaaaucguuaauggcagaaauauuaauacaaagaaaauuauugaaagugaucaagaaagagaagcugaagauaauggagaguugacauuuuuucuuguaaauaguguggccaaugaagagggcuuugcaaaagaaugcagcuggagaacacagucauucaacaacuauucaccaaauucucacagcuccaaacauguaucucaauauacuuucguggacaaugaugagggagguauaucuuggguuaccagcaacagagaucccccuauuuucucagcaggagucaaagagggugguaagaggaaaaaaaagaagcguaaagaggugcaaaagaagucuaccaaaaggaauuguuaa

SEQ ID NO: 8390 - RNA, 930 nt, Artificial Sequence
  derived and/or modified sequence opt1 from DNJB7__Homo_sapiens__AAI12136
augguggacuacuacgagguccugggccuccagcgcuacgccagccccgaggacaucaagaaggccuaccacaagguggcgcugaaguggcacccggacaagaaccccgagaacaaggaggaggccgagcggaaguucaaggagguggccgaggccuacgagguccugagcaacgacgagaagcgcgacaucuacgacaaguacgggaccgagggccucaacgggggcgggagccacuucgacgacgagugcgaguacggcuucaccuuccacaagcccgacgacguguucaaggagaucuuccacgagcgggaccccuucuccuuccacuucuucgaggacagccuggaggaccugcucaaccgcccgggcuccagcuacgggaaccggaaccgcgacgccggcuacuucuucuccacggcgagcgaguaccccaucuucgagaaguucuccagcuacgacaccggguacaccucccagggcagccuggggcacgagggccugaccuccuucagcucccucgccuucgacaacagcggcauggacaacuacaucuccgugacgaccagcgacaagaucgucaacgggcggaacaucaacaccaagaagaucaucgaguccgaccaggagcgcgaggccgaggacaacggcgagcugaccuucuuccuggugaacagcguggccaacgaggagggguucgcgaaggagugcagcuggcggacgcaguccuucaacaacuacagccccaacucccacagcuccaagcacgucagccaguacaccuucguggacaacgacgagggcggcaucuccugggugaccagcaaccgcgacccgcccaucuucuccgccggggucaaggagggcgggaagcggaagaagaagaagcgcaaggaggugcagaagaaguccaccaagcggaacugcuga

SEQ ID NO: 8391 - RNA, 930 nt, Artificial Sequence
  derived and/or modified sequence opt2 from DNJB7__Homo_sapiens__AAI12136
auggucgacuacuacgagguccucggccuccagcgcuacgccucccccgaggacaucaagaaggccuaccacaaggucgcccucaaguggcaccccgacaagaaccccgagaacaaggaggaggccgagcgcaaguucaaggaggucgccgaggccuacgagguccucuccaacgacgagaagcgcgacaucuacgacaaguacggcaccgagggccucaacggcggcggcucccacuucgacgacgagugcgaguacggcuucaccuuccacaagcccgacgacgucuucaaggagaucuuccacgagcgcgaccccuucuccuuccacuucuucgaggacucccucgaggaccuccucaaccgccccggcuccuccuacggcaaccgcaaccgcgacgccggcuacuucuucuccaccgccuccgaguaccccaucuucgagaaguucuccuccuacgacaccggcuacaccucccagggcucccucggccacgagggccucaccuccuucuccucccucgccuucgacaacuccggcauggacaacuacaucuccgucaccaccuccgacaagaucgucaacggccgcaacaucaacaccaagaagaucaucgaguccgaccaggagcgcgaggccgaggacaacggcgagcucaccuucuuccucgucaacuccgucgccaacgaggagggcuucgccaaggagugcuccuggcgcacccaguccuucaacaacuacucccccaacucccacuccuccaagcacgucucccaguacaccuucgucgacaacgacgagggcggcaucuccugggucaccuccaaccgcgacccccccaucuucuccgccggcgucaaggagggcggcaagcgcaagaagaagaagcgcaaggagguccagaagaaguccaccaagcgcaacugcuga

SEQ ID NO: 8392 - RNA, 930 nt, Artificial Sequence
  derived and/or modified sequence opt3 from DNJB7__Homo_sapiens__AAI12136
augguggacuacuaugagguccugggccuccagagauacgccagccccgaagauaucaagaaggcuuaucacaaaguugcacuuaaauggcauccugacaagaacccagagaauaaagaagaggccgaaaggaaguucaaggagguggcggaggcuuacgaaguacuguccaacgaugagaaacgggacauuuaugauaaguacgggaccgaaggauugaaugguggcgggucucacuuugacgaugagugcgaguauggauucacauuucauaaaccggacgauguguucaaggaaauauuucacgagcgcgaccccuucucauuucauuucuuugaagauaguuuagaggaccugcuaaaccgaccuggcagcuccuacgguaaucguaacagagaugccggguacuucuuuucuacugcaucggaauauccaaucuucgagaaauuuucaagcuacgacacgggauauaccagucaaggcucccucggccacgaggggcugacaucuuucagcucccuugccuucgacaauucaggaauggauaacuacauuagugucacuaccagcgacaagaucgugaaugguaggaacauuaauacaaagaaaaucauagaaucugaucaggagcgggaagcugaggacaacggcgaacugaccuuuuucuugguuaauuccguggcaaacgaggagggguuugccaaggaauguucauggcgcacucagagcuucaauaacuauagucccaacucucacuccagcaaacaugucucgcaguacacauuuguggauaaugacgagggaggcaucucuuggguaaccuccaacagagauccuccaauuuucucagcugguguuaaggaagggggaaaaaggaagaaaaagaagcggaaagaggugcaaaagaaaaguacgaagcgcaauugcuga

SEQ ID NO: 8393 - RNA, 930 nt, Artificial Sequence
  derived and/or modified sequence opt4 from DNJB7__Homo_sapiens__AAI12136
augguggacuacuacgaggugcugggccugcagagauacgccagccccgaggacaucaagaaggccuaccacaagguggcccugaaguggcaccccgacaagaaccccgagaacaaggaggaggccgagagaaaguucaaggagguggccgaggccuacgaggugcugagcaacgacgagaagagagacaucuacgacaaguacggcaccgagggccugaacggcggcggcagccacuucgacgacgagugcgaguacggcuucaccuuccacaagcccgacgacguguucaaggagaucuuccacgagagagaccccuucagcuuccacuucuucgaggacagccuggaggaccugcugaacagacccggcagcagcuacggcaacagaaacagagacgccggcuacuucuucagcaccgccagcgaguaccccaucuucgagaaguucagcagcuacgacaccggcuacaccagccagggcagccugggccacgagggccugaccagcuucagcagccuggccuucgacaacagcggcauggacaacuacaucagcgugaccaccagcgacaagaucgugaacggcagaaacaucaacaccaagaagaucaucgagagcgaccaggagagagaggccgaggacaacggcgagcugaccuucuuccuggugaacagcguggccaacgaggagggcuucgccaaggagugcagcuggagaacccagagcuucaacaacuacagccccaacagccacagcagcaagcacgugagccaguacaccuucguggacaacgacgagggcggcaucagcugggugaccagcaacagagacccccccaucuucagcgccggcgugaaggagggcggcaagagaaagaagaagaagagaaaggaggugcagaagaagagcaccaagagaaacugcuga

SEQ ID NO: 8394 - RNA, 930 nt, Artificial Sequence
  derived and/or modified sequence opt5 from DNJB7__Homo_sapiens__AAI12136
augguggacuacuaugagguccugggccuccagagauacgccagccccgaagauaucaagaaggcuuaucacaaaguugcccugaaauggcauccugacaagaacccggagaauaaagaagaggcggaacggaaguucaaggagguggcugaggccuacgaagugcuuuccaacgaugagaaacgcgacauuuaugauaaguacgggaccgaaggacugaauggcgggggaucucacuuugacgaugagugcgaguauggcuucacauuucauaaacccgacgaugucuucaaggaaaucuuucacgagagagacccuuucagcuuucauuucuuugaagauucccucgaggaccugcuuaaccggcccgggucuagcuacggaaaucgcaacagagaugccggcuacuucuuuuccacggcuucugaauauccuauuuucgagaaauuuagcuccuacgacaccggcuauacaagccaagggucucugggacacgagggccucaccuccuucagcucucuggccuucgacaauuccgggauggauaacuacaucagcgugacaaccucugacaagauuguuaauggacggaacaucaauacaaagaaaaucauugaauccgaucaggagcgcgaagcugaggacaacggcgaacugaccuuuuuccucgugaauagcgucgccaacgaggagggguuugcgaaggaauguuccuggagaacgcagucuuucaauaacuauagccccaacucccacagcucuaaacaugugucccaguacaccuuuguugauaaugacgagggaggcaucagcugggugacaucuaaccgggauccuccgauuuucagcgccggcgucaaggaagggggaaaacgcaagaaaaagaagagaaaagaggugcaaaagaaauccaccaagcggaauugcuga

SEQ ID NO: 8395 - protein, 232 aa, Artificial Sequence
  DNJB8__Homo_sapiens__Q8NHS0
MANYYEVLGVQASASPEDIKKAYRKLALRWHPDKNPDNKEEAEKKFKLVSEAYEVLSDSKKRSLYDRAGCDSWRAGGGASTPYHSPFDTGYTFRNPEDIFREFFGGLDPFSFEFWDSPFNSDRGGRGHGLRGAFSAGFGEFPAFMEAFSSFNMLGCSGGSHTTFSSTSFGGSSSGSSGFKSVMSSTEMINGHKVTTKRIVENGQERVEVEEDGQLKSVTVNGKEQLKWMDSK

SEQ ID NO: 8396 - RNA, 699 nt, Artificial Sequence
  DNJB8__Homo_sapiens__AAH29521
auggcuaacuacuacgaagugcugggcgugcaggccagcgcuuccccggaggacaucaagaaagccuaccgcaagcuggcccuucguuggcaccccgacaagaacccugacaauaaggaggaggcggagaagaaguucaagcuggugucugaggccuaugagguucugucugacuccaagaaacgcucccuguaugaccgugcuggcugugacagcuggcgggcugguggcggggccagcacgcccuaccacagccccuucgacaccggcuacaccuuccguaacccugaggacaucuuccgggaguuuuucgguggccuggacccuuucuccuuugaguucugggacagcccauucaauagugaccgugguggccggggccauggccugaggggggccuucucggcaggcuuuggagaauuuccggccuucauggaggccuucucauccuucaacaugcugggcugcagcgggggcagccacaccaccuucucauccaccuccuucgggggcuccaguucuggcagcucgggguucaagucggugaugucguccaccgagaugaucaauggccacaaggucaccaccaagcgcaucguggagaacgggcaggagcgcguggagguggaggaagacgggcagcucaagucggugacugugaacggcaaggagcagcucaaauggauggacagcaaguag

SEQ ID NO: 8397 - RNA, 699 nt, Artificial Sequence
  derived and/or modified sequence opt1 from DNJB8__Homo_sapiens__AAH29521
auggccaacuacuacgaggugcugggcguccaggccagcgcgucccccgaggacaucaagaaggccuaccgcaagcucgcccugcgguggcacccggacaagaaccccgacaacaaggaggaggccgagaagaaguucaagcuggugagcgaggccuacgaggugcucuccgacagcaagaagcgcucccuguacgaccgggcggggugcgacagcuggcgcgccggcgggggcgccuccacccccuaccacagccccuucgacaccggguacacguuccggaacccggaggacaucuuccgcgaguucuucggcggccuggaccccuucuccuucgaguucugggacagccccuucaacuccgaccgcgggggccgggggcacggccuccgcggggccuucagcgcgggcuucggcgaguuccccgccuucauggaggccuucuccagcuucaacaugcuggggugcuccggcgggagccacaccaccuucuccagcaccuccuucggcggcagcagcuccgggagcuccggcuucaagagcgucauguccagcacggagaugaucaacgggcacaaggugaccaccaagcggaucguggagaacggccaggagcgggucgagguggaggaggacgggcagcugaaguccgugaccgucaacggcaaggagcagcucaaguggauggacagcaaguga

SEQ ID NO: 8398 - RNA, 699 nt, Artificial Sequence
  derived and/or modified sequence opt2 from DNJB8__Homo_sapiens__AAH29521
auggccaacuacuacgagguccucggcguccaggccuccgccucccccgaggacaucaagaaggccuaccgcaagcucgcccuccgcuggcaccccgacaagaaccccgacaacaaggaggaggccgagaagaaguucaagcucgucuccgaggccuacgagguccucuccgacuccaagaagcgcucccucuacgaccgcgccggcugcgacuccuggcgcgccggcggcggcgccuccacccccuaccacucccccuucgacaccggcuacaccuuccgcaaccccgaggacaucuuccgcgaguucuucggcggccucgaccccuucuccuucgaguucugggacucccccuucaacuccgaccgcggcggccgcggccacggccuccgcggcgccuucuccgccggcuucggcgaguuccccgccuucauggaggccuucuccuccuucaacaugcucggcugcuccggcggcucccacaccaccuucuccuccaccuccuucggcggcuccuccuccggcuccuccggcuucaaguccgucauguccuccaccgagaugaucaacggccacaaggucaccaccaagcgcaucgucgagaacggccaggagcgcgucgaggucgaggaggacggccagcucaaguccgucaccgucaacggcaaggagcagcucaaguggauggacuccaaguga

SEQ ID NO: 8399 - RNA, 699 nt, Artificial Sequence
  derived and/or modified sequence opt3 from DNJB8__Homo_sapiens__AAH29521
auggccaacuacuaugaggugcugggcguccaggcuagcgcaucccccgaagacaucaagaaagccuacagaaagcucgcgcuuagguggcacccugauaaaaauccagacaacaaggaggaagcugagaaaaaguucaagcugguuucugaagccuaugagguguugucagauaguaaaaagcggagcuuauacgaccgcgcagggugcgauuccuggcgagccggagguggcgcuucuaccccguaucauucgcccuuugacacaggguacacuuuccguaauccugaggauauuuuuagagaauuuuucggaggccuggacccauucucauuugaguucugggauagccccuuuaacagugacaggggugggcggggacacggccuacgcggcgcauucuccgccggguuuggagaguucccugcuuuuauggaagccuucucuagcuucaauaugcucgguuguuccggcgggucacauacgaccuuuaguagcacaucuuucggaggcuccucaagcgguaguucuggguuuaaauccguaaugagcucgacugagaugauaaacggacacaaggugaccacaaaaagaaucgucgaaaauggccaagagaggguggaaguugaggaagauggccagcugaagucugugaccgucaacgggaaggagcagcuuaaauggauggacuccaaguga

SEQ ID NO: 8400 - RNA, 699 nt, Artificial Sequence
  derived and/or modified sequence opt4 from DNJB8__Homo_sapiens__AAH29521
auggccaacuacuacgaggugcugggcgugcaggccagcgccagccccgaggacaucaagaaggccuacagaaagcuggcccugagauggcaccccgacaagaaccccgacaacaaggaggaggccgagaagaaguucaagcuggugagcgaggccuacgaggugcugagcgacagcaagaagagaagccuguacgacagagccggcugcgacagcuggagagccggcggcggcgccagcacccccuaccacagccccuucgacaccggcuacaccuucagaaaccccgaggacaucuucagagaguucuucggcggccuggaccccuucagcuucgaguucugggacagccccuucaacagcgacagaggcggcagaggccacggccugagaggcgccuucagcgccggcuucggcgaguuccccgccuucauggaggccuucagcagcuucaacaugcugggcugcagcggcggcagccacaccaccuucagcagcaccagcuucggcggcagcagcagcggcagcagcggcuucaagagcgugaugagcagcaccgagaugaucaacggccacaaggugaccaccaagagaaucguggagaacggccaggagagaguggagguggaggaggacggccagcugaagagcgugaccgugaacggcaaggagcagcugaaguggauggacagcaaguga

SEQ ID NO: 8401 - RNA, 699 nt, Artificial Sequence
  derived and/or modified sequence opt5 from DNJB8__Homo_sapiens__AAH29521
auggccaacuacuaugaggugcugggcguccaggcuagcgccucccccgaagacaucaagaaagcguacagaaagcucgcucugcgguggcacccugauaaaaauccggacaacaaggaggaagccgagaaaaaguucaaacuuguuucugaagccuaugaggugcugagcgauuccaagaagcgcucucucuacgacagagcugggugcgauagcuggcgggccggaggcggggcuuccacccccuaucauucuccuuuugacacaggauacacguuccgcaaucccgaggauauuuuuagagaauuuuucggcgggcuggacccuuucagcuuugaguucugggauucccccuuuaacagcgaccggggaggccgcggccacgggcuuagaggagccuucucugcgggcuuuggggaauuuccugccuucauggaggcuuucuccagcuucaauaugcugggauguucuggcgggucccauaccacauuuagcucuaccuccuucggaggcagcuccucuggcagcuccggguuuaaaagcgugaugucuuccacagagaugaucaacggacacaaggucaccacaaaacggauuguggaaaauggccaagagcgcguugaaguggaggaagaugggcagcucaagagcgucaccgugaacggaaaggagcagcugaaauggauggacucuaaguga

SEQ ID NO: 8402 - protein, 223 aa, Artificial Sequence
  DNJB9__Homo_sapiens__Q9UBS3
MATPQSIFIFAICILMITELILASKSYYDILGVPKSASERQIKKAFHKLAMKYHPDKNKSPDAEAKFREIAEAYETLSDANRRKEYDTLGHSAFTSGKGQRGSGSSFEQSFNFNFDDLFKDFGFFGQNQNTGSKKRFENHFQTRQDGGSSRQRHHFQEFSFGGGLFDDMFEDMEKMFSFSGFDSTNQHTVQTENRFHGSSKHCRTVTQRRGNMVTTYTDCSGQ

SEQ ID NO: 8403 - RNA, 672 nt, Artificial Sequence
  DNJB9__Homo_sapiens__AAD39845
auggcuacuccccagucaauuuucaucuuugcaaucugcauuuuaaugauaacagaauuaauucuggccucaaaaagcuacuaugauaucuuaggugugccaaaaucggcaucagagcgccaaaucaagaaggccuuucacaaguuggccaugaaguaccacccugacaaaaauaagagcccggaugcugaagcaaaauucagagagauugcagaagcauaugaaacacucucagaugcuaauagacgaaaagaguaugauacacuuggacacagugcuuuuacuagugguaaaggacaaagagguaguggaaguucuuuugagcagucauuuaacuucaauuuugaugacuuauuuaaagacuuuggcuuuuuuggucaaaaccaaaacacuggauccaagaagcguuuugaaaaucauuuccagacacgccaggauggugguuccaguagacaaaggcaucauuuccaagaauuuucuuuuggagguggauuauuugaugacauguuugaagauauggagaaaauguuuucuuuuagugguuuugacucuaccaaucagcauacaguacagacugaaaauagauuucauggaucuagcaagcacugcaggacugucacucaacgaagaggaaauaugguuacuacauacacugacuguucaggacaguag

SEQ ID NO: 8404 - RNA, 672 nt, Artificial Sequence
  derived and/or modified sequence opt1 from DNJB9__Homo_sapiens__AAD39845
auggccacgccccagagcaucuucaucuucgccaucugcauccugaugaucaccgagcucauccuggcguccaagagcuacuacgacauccugggcgugccgaaguccgccagcgagcgccagaucaagaaggccuuccacaagcucgccaugaaguaccaccccgacaagaacaagucccccgacgccgaggcgaaguuccgggagaucgccgaggccuacgagacccugagcgacgccaaccgccggaaggaguacgacacccuggggcacuccgcguucaccagcggcaaggggcagcgcggcuccgggagcuccuucgagcagagcuucaacuucaacuucgacgaccucuucaaggacuucggcuucuucggccagaaccagaacaccggguccaagaagcgguucgagaaccacuuccagacgcgccaggacggcgggagcucccggcagcgccaccacuuccaggaguucagcuucggcgggggccuguucgacgacauguucgaggacauggagaagauguucuccuucagcggcuucgacuccaccaaccagcacaccguccagaccgagaaccgguuccacgggagcagcaagcacugccgcacggugacccagcggcgcggcaacauggugaccaccuacacggacugcuccgggcaguga

SEQ ID NO: 8405 - RNA, 672 nt, Artificial Sequence
  derived and/or modified sequence opt2 from DNJB9__Homo_sapiens__AAD39845
auggccaccccccaguccaucuucaucuucgccaucugcauccucaugaucaccgagcucauccucgccuccaaguccuacuacgacauccucggcguccccaaguccgccuccgagcgccagaucaagaaggccuuccacaagcucgccaugaaguaccaccccgacaagaacaagucccccgacgccgaggccaaguuccgcgagaucgccgaggccuacgagacccucuccgacgccaaccgccgcaaggaguacgacacccucggccacuccgccuucaccuccggcaagggccagcgcggcuccggcuccuccuucgagcaguccuucaacuucaacuucgacgaccucuucaaggacuucggcuucuucggccagaaccagaacaccggcuccaagaagcgcuucgagaaccacuuccagacccgccaggacggcggcuccucccgccagcgccaccacuuccaggaguucuccuucggcggcggccucuucgacgacauguucgaggacauggagaagauguucuccuucuccggcuucgacuccaccaaccagcacaccguccagaccgagaaccgcuuccacggcuccuccaagcacugccgcaccgucacccagcgccgcggcaacauggucaccaccuacaccgacugcuccggccaguga

SEQ ID NO: 8406 - RNA, 672 nt, Artificial Sequence
  derived and/or modified sequence opt3 from DNJB9__Homo_sapiens__AAD39845
auggccacaccccagagcaucuucauuuuugcuauaugcauccugaugauuaccgagcucauccuugcauccaagucuuacuaugacauucugggcgugccuaaaucagccagugaaagacaaaucaagaaagcguuccacaaguuggcuaugaaauaccauccagauaagaacaagagcccggacgccgaggcaaaauuuagggaaauagccgaggcuuaugaaacuuuauccgaugcaaaucggcgcaaggaguacgacacgcuggggcacucugccuucaccucgggaaaaggucagcgaggcucagggagcaguuuugagcaguccuucaacuuuaauuucgaugaccuauuuaaggauuucggauuuuucggccagaaccaaaauacagguucuaaaaagcguuuugaaaaccauuuccagacuagacaggacgggggaagcuccaggcagcggcaccauuuccaagaguuuucauucggcggcgggcucuuugaugacauguucgaagauauggagaagauguuuaguuucagcggauuugacucuaccaaucagcacacaguccagaccgagaaccgcuuccacgguuccucaaaacauuguagaacuguuacacagaggcggggcaauauggugaccacguauacugauugcagcgggcaauga

SEQ ID NO: 8407 - RNA, 672 nt, Artificial Sequence
  derived and/or modified sequence opt4 from DNJB9__Homo_sapiens__AAD39845
auggccaccccccagagcaucuucaucuucgccaucugcauccugaugaucaccgagcugauccuggccagcaagagcuacuacgacauccugggcgugcccaagagcgccagcgagagacagaucaagaaggccuuccacaagcuggccaugaaguaccaccccgacaagaacaagagccccgacgccgaggccaaguucagagagaucgccgaggccuacgagacccugagcgacgccaacagaagaaaggaguacgacacccugggccacagcgccuucaccagcggcaagggccagagaggcagcggcagcagcuucgagcagagcuucaacuucaacuucgacgaccuguucaaggacuucggcuucuucggccagaaccagaacaccggcagcaagaagagauucgagaaccacuuccagaccagacaggacggcggcagcagcagacagagacaccacuuccaggaguucagcuucggcggcggccuguucgacgacauguucgaggacauggagaagauguucagcuucagcggcuucgacagcaccaaccagcacaccgugcagaccgagaacagauuccacggcagcagcaagcacugcagaaccgugacccagagaagaggcaacauggugaccaccuacaccgacugcagcggccaguga

SEQ ID NO: 8408 - RNA, 672 nt, Artificial Sequence
  derived and/or modified sequence opt5 from DNJB9__Homo_sapiens__AAD39845
auggccacaccccagagcaucuucauuuuugcuaucugcauucugaugaucaccgagcucauucuggccuccaagucuuacuaugacauccuuggcgugccuaaaagcgcguccgaaagacaaaucaagaaggcuuuccacaaacuggccaugaaauaccauccggauaagaacaagucucccgacgccgaggcuaaauuucgggaaauugccgaggcuuaugaaacgcucagcgaugccaaucgcagaaaggaguacgacacccuggggcacuccgcguucacaucuggaaaaggccagcgggggagcggauccagcuuugagcagucuuucaacuuuaauuucgaugaccuuuuuaaggauuucggcuuuuucgggcagaaccaaaauaccggauccaaaaagcgcuuugaaaaccauuuccagacaagacaggacggcggcagcucucggcagcgccaccauuuccaagaguuuuccuucgggggaggccuguuugaugacauguucgaagauauggagaagauguuuagcuucucuggguuugacuccaccaaucagcacacaguccagaccgagaacagauuccacggaagcuccaaacauugucggacgguuacccagcgcagaggcaauauggugacaaccuauacagauugcucugggcaauga

SEQ ID NO: 8409 - protein, 554 aa, Artificial Sequence
  DNJC1__Homo_sapiens__Q96KC8
MTAPCSQPAQLPGRRQLGLVPFPPPPPRTPLLWLLLLLLAAVAPARGWESGDLELFDLVEEVQLNFYQFLGVQQDASSADIRKAYRKLSLTLHPDKNKDENAETQFRQLVAIYEVLKDDERRQRYDDILINGLPDWRQPVFYYRRVRKMSNAELALLLFIILTVGHYAVVWSIYLEKQLDELLSRKKREKKKKTGSKSVDVSKLGASEKNERLLMKPQWHDLLPCKLGIWFCLTLKALPHLIQDAGQFYAKYKETRLKEKEDALTRTELETLQKQKKVKKPKPEFPVYTPLETTYIQSYDHGTSIEEIEEQMDDWLENRNRTQKKQAPEWTEEDLSQLTRSMVKFPGGTPGRWEKIAHELGRSVTDVTTKAKQLKDSVTCSPGMVRLSELKSTVQNSRPIKTATTLPDDMITQREDAEGVAAEEEQEGDSGEQETGATDARPRRRKPARLLEATAKPEPEEKSRAKRQKDFDIAEQNESSDEESLRKERARSAEEPWTQNQQKLLELALQQYPRGSSDRWDKIARCVPSKSKEDCIARYKLLVELVQKKKQAKS

SEQ ID NO: 8410 - RNA, 1665 nt, Artificial Sequence
  DNJC1__Homo_sapiens__AAI10895
augacggcuccuugcucccagccggcgcagcuuccuggacgccgccagcucgggcuggugccguucccgccgccgccgccgcggacgccgcugcuguggcugcugcugcugcugcuggccgccguggcgccggcgcgcggcugggagagcggagaccuggaguuguuugacuuaguggaggaggugcagcucaacuucuaccaguuccucggggugcagcaggaugcaucaucugcagacaucagaaaagcauaucguaagcuuucacuaacuuuacauccagacaagaauaaagaugaaaaugcagaaacucaguuuagacaauugguggccauuuaugaaguuuuaaaggaugaugaacgaaggcagagguaugaugauauucugaucaauggacuuccagauuggcgacagccuguauucuacuacaggcgggugagaaaaaugagcaaugcugagcuggcauuacucuuguucauuauucucacagugggucauuaugcugugguuuggucaaucuaccuggaaaaacaacuggaugaacuacuaaguagaaaaaagagagaaaagaaaaaaaagacuggcagcaagaguguggauguaucaaaacucggugcuucagaaaaaaaugaaagauugcugaugaaaccacaguggcaugauuugcuuccaugcaaacuggggauuugguuuugccuuacacuaaaagcauuaccucaccucauccaggaugcugggcaguuuuaugcuaaauauaaagaaacaagauugaaggaaaaggaagaugcacugacuagaacugaacuugaaacacuucaaaaacagaagaaaguuaaaaaaccaaaaccugaauuuccuguauacacaccuuuagaaacuacauauauucagucuuaugaucauggaacuuccauagaagaaauugaggaacaaauggaugauugguuggaaaacaggaaccgaacacagaaaaaacaggcaccugaauggacagaagaggaccucagccaacugacaagaaguaugguuaaguucccaggagggacuccaggucgaugggaaaagauugcccacgaauugggucgaucugugacagaugugacaaccaaagccaagcaacugaaggauucagugaccugcuccccaggaaugguuagacucuccgaacucaaaucgacaguucagaauuccaggcccaucaaaacggccaccaccuugcccgaugacaugaucacccagcgagaggacgcagaggggguggcagcggaggaggagcaggagggagacuccggugagcaggagaccggggccacugaugcccggccucggaggcggaagccagccaggcugcuggaggcuacagcgaagccggagccagaggagaaguccagagccaagcggcagaaggacuuugacauagcagaacaaaacgaguccagcgacgaggagagccugagaaaagagagagcucggucugcagaggagccguggacucaaaaucaacagaaacuucuggaacuggcguugcagcaguacccaaggggauccucugaccgcugggacaaaauagccagaugugucccguccaagagcaaggaagacuguaucgcuagguacaaguugcugguugaacugguccaaaagaaaaaacaagcuaaaagcuga

SEQ ID NO: 8411 - RNA, 1665 nt, Artificial Sequence
  derived and/or modified sequence opt1 from DNJC1__Homo_sapiens__AAI10895
augaccgcccccugcagccagccggcccagcugcccggccgccggcagcucgggcuggugcccuucccgcccccgccgccccgcacgccccugcucuggcugcugcuccugcugcucgcggccgucgcccccgcccggggcugggaguccggggaccuggagcuguucgaccucguggaggaggugcagcugaacuucuaccaguuccugggcguccagcaggacgccagcuccgcggacauccgcaaggccuaccggaagcucagccugacccugcaccccgacaagaacaaggacgagaacgccgagacccaguuccgccagcucguggccaucuacgaggugcugaaggacgacgagcggcgccagcgguacgacgacauccugaucaacgggcuccccgacuggcgccagcccgucuucuacuaccggcgcgugcggaagauguccaacgcggagcuggcccugcuccuguucaucauccugaccgugggccacuacgccgucguguggagcaucuaccucgagaagcagcuggacgagcugcucucccgcaagaagcgggagaagaagaagaagaccggcagcaaguccguggacgucagcaagcugggggccuccgagaagaacgagcgccugcucaugaagccccaguggcacgaccugcugcccugcaagcucggcaucugguucugccugacgcugaaggcccucccccaccugauccaggacgcggggcaguucuacgccaaguacaaggagacccggcugaaggagaaggaggacgcccucacccgcaccgagcuggagacgcugcagaagcagaagaaggugaagaagccgaagcccgaguuccccguguacacgccccucgagaccaccuacauccagagcuacgaccacggcaccuccaucgaggagaucgaggagcagauggacgacuggcuggagaaccggaaccgcacccagaagaagcaggccccggaguggaccgaggaggaccugagccagcucacccgguccauggucaaguuccccgggggcacgcccggccgcugggagaagaucgcccacgagcuggggcgcagcgugaccgacgugaccaccaaggcgaagcagcugaaggacuccgucacgugcagccccggcauggugcggcuguccgagcucaagagcaccgugcagaacagccgcccgaucaagaccgccaccacgcugcccgacgacaugaucacccagcgggaggacgccgagggggucgccgccgaggaggagcaggagggcgacuccggcgagcaggagaccggggcgaccgacgcccgcccccggcgccggaagcccgcccgccugcucgaggccacggccaagccggagcccgaggagaagucccgggcgaagcgccagaaggacuucgacaucgccgagcagaacgagagcagcgacgaggagucccugcggaaggagcgcgcccggagcgccgaggagcccuggacccagaaccagcagaagcugcucgagcuggcgcugcagcaguacccgcgcggcuccagcgaccggugggacaagaucgcccgcugcgugcccuccaagagcaaggaggacugcaucgcccgguacaagcuccugguggagcugguccagaagaagaagcaggccaaguccuga

SEQ ID NO: 8412 - RNA, 1665 nt, Artificial Sequence
  derived and/or modified sequence opt2 from DNJC1__Homo_sapiens__AAI10895
augaccgcccccugcucccagcccgcccagcuccccggccgccgccagcucggccucguccccuucccccccccccccccccgcaccccccuccucuggcuccuccuccuccuccucgccgccgucgcccccgcccgcggcugggaguccggcgaccucgagcucuucgaccucgucgaggagguccagcucaacuucuaccaguuccucggcguccagcaggacgccuccuccgccgacauccgcaaggccuaccgcaagcucucccucacccuccaccccgacaagaacaaggacgagaacgccgagacccaguuccgccagcucgucgccaucuacgagguccucaaggacgacgagcgccgccagcgcuacgacgacauccucaucaacggccuccccgacuggcgccagcccgucuucuacuaccgccgcguccgcaagauguccaacgccgagcucgcccuccuccucuucaucauccucaccgucggccacuacgccgucgucugguccaucuaccucgagaagcagcucgacgagcuccucucccgcaagaagcgcgagaagaagaagaagaccggcuccaaguccgucgacgucuccaagcucggcgccuccgagaagaacgagcgccuccucaugaagccccaguggcacgaccuccuccccugcaagcucggcaucugguucugccucacccucaaggcccucccccaccucauccaggacgccggccaguucuacgccaaguacaaggagacccgccucaaggagaaggaggacgcccucacccgcaccgagcucgagacccuccagaagcagaagaaggucaagaagcccaagcccgaguuccccgucuacaccccccucgagaccaccuacauccaguccuacgaccacggcaccuccaucgaggagaucgaggagcagauggacgacuggcucgagaaccgcaaccgcacccagaagaagcaggcccccgaguggaccgaggaggaccucucccagcucacccgcuccauggucaaguuccccggcggcacccccggccgcugggagaagaucgcccacgagcucggccgcuccgucaccgacgucaccaccaaggccaagcagcucaaggacuccgucaccugcucccccggcaugguccgccucuccgagcucaaguccaccguccagaacucccgccccaucaagaccgccaccacccuccccgacgacaugaucacccagcgcgaggacgccgagggcgucgccgccgaggaggagcaggagggcgacuccggcgagcaggagaccggcgccaccgacgcccgcccccgccgccgcaagcccgcccgccuccucgaggccaccgccaagcccgagcccgaggagaagucccgcgccaagcgccagaaggacuucgacaucgccgagcagaacgaguccuccgacgaggagucccuccgcaaggagcgcgcccgcuccgccgaggagcccuggacccagaaccagcagaagcuccucgagcucgcccuccagcaguacccccgcggcuccuccgaccgcugggacaagaucgcccgcugcguccccuccaaguccaaggaggacugcaucgcccgcuacaagcuccucgucgagcucguccagaagaagaagcaggccaaguccuga

SEQ ID NO: 8413 - RNA, 1665 nt, Artificial Sequence
  derived and/or modified sequence opt3 from DNJC1__Homo_sapiens__AAI10895
augaccgcccccugcagccagccugcucaacugccaggcagaaggcagcucgggcuugugccguuucccccuccacccccucggacaccacuguugugguuacugcuacuccugcuugcagccgucgcgcccgcucgcggaugggaguccggugaccuggaauuguucgaucucguugaggaagugcagcugaacuucuaccaguuucugggcguacaacaggacgccucuucagcagauauccgaaaggccuaucguaaacucaguuuaacucugcacccugacaagaauaaagaugagaacgcugaaacgcaguucagacagcuuguggcaauuuacgaggucuugaaggacgaugagaggcggcaacgcuaugacgauauacugaucaaugggcuaccagacuggagacagccgguguuuuacuauaggcggguucgcaaaaugagcaacgccgaacucgcucugcuucuguucauuaucuugaccgugggacauuacgccgucgugugguccauuuaucucgagaagcagcuggaugaauuacugucucgaaagaaaagagagaagaaaaagaaaacaggcucgaagucaguagacguuagcaagcucggugcgagugagaaaaaugaaaggcuucugaugaagccccaguggcacgauuugcuaccuuguaaacuggggaucugguuuugccucacucugaaggcacuuccacaucugauacaagacgccggacaguucuacgcuaaauacaaggagacccgguugaaagaaaaggaggacgcccucacacguaccgaacuggagacuuuacagaagcagaaaaaggugaaaaagcccaaaccugaguuuccagucuauacaccccuggaaaccacguacauccaauccuaugaucacggcacuucuauugaggaaaucgaggaacagauggacgauuggcuagagaaccgcaauagaacccagaagaagcaagcaccggaguggacagaagaggaccucagccagcugacuagguccauggugaaauucccuggcgggacccccggacggugggaaaagauugcucaugagcuuggucgaucagugacagaugucaccacgaaagccaagcaguugaaagacaguguuacuuguagcccaggcauggugcgccugucugaacucaaguccacaguacagaacucaagaccuaucaagaccgcgacuacacugcccgaugacaugauaacccaaagggaggaugccgaggggguggcagcugaagaggaacaggagggagacagcggcgagcaggaaacgggugccaccgaugcucggccacgcagaaggaaacccgcccgucuucuggaggcaacagccaagccugaaccagaggagaaaagucgggcuaagcgacagaaagacuuugacauugcggaacaaaaugagucuuccgaugaagagagcuugagaaaggaaagggcacgcucggccgaggaaccguggacucagaaccagcagaagcuccuggaguuagcucugcaacaguacccccgggggucuuccgacagaugggauaaaaucgccaggugcgucccuucaaagaguaaagaggacuguauugcacgcuauaagcuacucguggaacugguucagaaaaagaaacaagccaagagcuga

SEQ ID NO: 8414 - RNA, 1665 nt, Artificial Sequence
  derived and/or modified sequence opt4 from DNJC1__Homo_sapiens__AAI10895
augaccgcccccugcagccagcccgcccagcugcccggcagaagacagcugggccuggugcccuuccccccccccccccccagaaccccccugcuguggcugcugcugcugcugcuggccgccguggcccccgccagaggcugggagagcggcgaccuggagcuguucgaccugguggaggaggugcagcugaacuucuaccaguuccugggcgugcagcaggacgccagcagcgccgacaucagaaaggccuacagaaagcugagccugacccugcaccccgacaagaacaaggacgagaacgccgagacccaguucagacagcugguggccaucuacgaggugcugaaggacgacgagagaagacagagauacgacgacauccugaucaacggccugcccgacuggagacagcccguguucuacuacagaagagugagaaagaugagcaacgccgagcuggcccugcugcuguucaucauccugaccgugggccacuacgccgugguguggagcaucuaccuggagaagcagcuggacgagcugcugagcagaaagaagagagagaagaagaagaagaccggcagcaagagcguggacgugagcaagcugggcgccagcgagaagaacgagagacugcugaugaagccccaguggcacgaccugcugcccugcaagcugggcaucugguucugccugacccugaaggcccugccccaccugauccaggacgccggccaguucuacgccaaguacaaggagaccagacugaaggagaaggaggacgcccugaccagaaccgagcuggagacccugcagaagcagaagaaggugaagaagcccaagcccgaguuccccguguacaccccccuggagaccaccuacauccagagcuacgaccacggcaccagcaucgaggagaucgaggagcagauggacgacuggcuggagaacagaaacagaacccagaagaagcaggcccccgaguggaccgaggaggaccugagccagcugaccagaagcauggugaaguuccccggcggcacccccggcagaugggagaagaucgcccacgagcugggcagaagcgugaccgacgugaccaccaaggccaagcagcugaaggacagcgugaccugcagccccggcauggugagacugagcgagcugaagagcaccgugcagaacagcagacccaucaagaccgccaccacccugcccgacgacaugaucacccagagagaggacgccgagggcguggccgccgaggaggagcaggagggcgacagcggcgagcaggagaccggcgccaccgacgccagacccagaagaagaaagcccgccagacugcuggaggccaccgccaagcccgagcccgaggagaagagcagagccaagagacagaaggacuucgacaucgccgagcagaacgagagcagcgacgaggagagccugagaaaggagagagccagaagcgccgaggagcccuggacccagaaccagcagaagcugcuggagcuggcccugcagcaguaccccagaggcagcagcgacagaugggacaagaucgccagaugcgugcccagcaagagcaaggaggacugcaucgccagauacaagcugcugguggagcuggugcagaagaagaagcaggccaagagcuga

SEQ ID NO: 8415 - RNA, 1665 nt, Artificial Sequence
  derived and/or modified sequence opt5 from DNJC1__Homo_sapiens__AAI10895
augaccgcccccugcagccagccugcucaacugccgggcagacggcagcucgggcuggugcccuucccucccccucccccucgcacaccgcuucuguggcuccugcuucugcuccuggccgcggucgcucccgccagaggaugggaguccggcgaccuggaacucuuugaucugguugaggaagugcagcuuaacuucuaccaguuucugggggugcaacaggacgccucuagcgcugauauccggaaggccuaucgcaaacucucccugacgcuucacccugacaagaauaaagaugagaacgcugaaacccaguucagacagcuggucgccauuuacgaggugcucaaggacgaugagcggcgccaaagauaugacgauauccugauuaauggacugcccgacuggcggcagccuguguuuuacuaucgcagaguucggaaaaugucuaacgcggaacucgcccugcuucuguucaucauucucacagucggccauuacgcugugguuuggagcaucuaucuggagaagcagcuugaugaacugcucucccgcaagaaaagagagaagaaaaagaaaaccgggucuaagagcguggacgucuccaagcugggagccagcgagaaaaaugaacggcugcucaugaagccccaguggcacgaucugcuuccguguaaacugggcaucugguuuugccucacacugaaggcccuuccucaucugauucaagacgcuggccaguucuacgcgaaauacaaggagacccgccucaaagaaaaggaggacgcccugacaagaaccgaacuggagacgcuccagaagcaaaagaaggugaaaaagcccaaaccugaguuucccguguauacaccccuggaaaccaccuacauccagucuuaugaucacgggacauccauugaggaaaucgaggaacagauggacgauuggcuugagaaccggaauagaacccagaagaagcaagcuccugaguggacggaagaggaccugagccagcucacacgcucuauggucaaauucccgggaggcacccccgggcggugggaaaagauugcccaugagcugggaagauccguuacagaugugaccaccaaagcuaagcagcugaaagacagcgugacauguucuccuggcaugguccgccuuuccgaacucaagagcacggugcagaacucccggcccaucaagaccgccacaacccugccugaugacaugauuacacaaagagaggaugccgaggggguugcugcggaagaggaacaggagggagacucuggcgagcaggaaaccggcgccacggaugcucgcccccggagacgcaaaccggcccggcugcucgaggccacagcuaagccugaacccgaggagaaaagcagagccaagcgccagaaagacuuugacaucgcggaacaaaaugaguccagcgaugaagagucucugcggaaggaaagagcucgguccgccgaggaaccuuggacccagaaccagcagaaacuucuggagcucgcccugcaacaguacccccgcgggagcucugacagaugggauaaaaucgcucggugcgugccuagcaaguccaaagaggacuguauugccagauauaagcugcuugucgaacucgugcagaaaaagaaacaagcuaagucuuga

SEQ ID NO: 8416 - protein, 621 aa, Artificial Sequence
  DNJC2__Homo_sapiens__Q99543
MLLLPSAADGRGTAITHALTSASTLCQVEPVGRWFEAFVKRRNRNASASFQELEDKKELSEESEDEELQLEEFPMLKTLDPKDWKNQDHYAVLGLGHVRYKATQRQIKAAHKAMVLKHHPDKRKAAGEPIKEGDNDYFTCITKAYEMLSDPVKRRAFNSVDPTFDNSVPSKSEAKDNFFEVFTPVFERNSRWSNKKNVPKLGDMNSSFEDVDIFYSFWYNFDSWREFSYLDEEEKEKAECRDERRWIEKQNRATRAQRKKEEMNRIRTLVDNAYSCDPRIKKFKEEEKAKKEAEKKAKAEAKRKEQEAKEKQRQAELEAARLAKEKEEEEVRQQALLAKKEKDIQKKAIKKERQKLRNSCKTWNHFSDNEAERVKMMEEVEKLCDRLELASLQCLNETLTSCTKEVGKAALEKQIEEINEQIRKEKEEAEARMRQASKNTEKSTGGGGNGSKNWSEDDLQLLIKAVNLFPAGTNSRWEVIANYMNIHSSSGVKRTAKDVIGKAKSLQKLDPHQKDDINKKAFDKFKKEHGVVPQADNATPSERFEGPYTDFTPWTTEEQKLLEQALKTYPVNTPERWEKIAEAVPGRTKKDCMKRYKELVEMVKAKKAAQEQVLNASRAKK

SEQ ID NO: 8417 - RNA, 1866 nt, Artificial Sequence
  DNJC2__Homo_sapiens__CCDS43628.1
augcugcuucugccaagcgccgcggacggccggggcaccgccaucacccacgcucugaccucugccucuacacucugucaaguugaaccugugggaagaugguuugaagcuuuuguuaagaggagaaacagaaaugcuucugccucuuuucaggaacuggaggauaagaaagaguuauccgaggaaucagaagaugaagaauugcaguuggaagaguuucccaugcugaaaacacuugaucccaaagacuggaagaaccaagaucauuaugcaguucuuggacuuggccaugugagauacaaggcuacacagagacagaucaaagcagcucauaaagcaaugguuuuaaaacaucacccagacaaacggaaagcagcuggugaaccaauaaaagaaggagauaaugacuacuucacuugcauaacuaaagcuuaugaaauguuaucugauccagugaaaagacgagcauuuaacaguguagauccuacuuuugauaacucaguuccuucuaaaagugaagcaaaggauaauuucuucgaaguguuuaccccaguguuugaaaggaauuccagauggucaaauaaaaaaaauguuccuaaacuuggugauaugaauucaucauuugaagauguagauauauuuuauucuuucugguauaauuuugauucuuggagagaauuuucuuauuuagaugaagaagaaaaagaaaaagcagaaugucgugaugagaggagauggauugaaaagcagaacagagcaacaagagcacaaagaaaaaaagaagaaaugaacagaauaagaacauuaguugacaaugcauacagcugugauccaaggauaaaaaaguucaaggaagaagaaaaagccaagaaagaagcagaaaagaaagcaaaagcagaagcuaaacggaaggagcaagaagcuaaagaaaaacaaagacaagcugaauuagaagcugcucgguuagcuaaggagaaagaagaggaggaagucagacagcaagcauugcuggcaaagaaggaaaaagauauccagaaaaaagccauuaagaaggaaaggcaaaaacuucgaaacucaugcaagaccuggaaucauuuuucugauaaugaggcagagcggguuaaaaugauggaagaaguggaaaaacuuugugaucggcuugaacuggcaagcuuacagugcuugaaugaaacacucacaucaugcacaaaagaaguaggaaaggcugcuuuggaaaaacagauagaagaaauaaaugagcaaaucagaaaagagaaagaggaagcugaggcucguaugcgacaagcaucuaagaacacagagaaaucaacugguggagguggaaauggaaguaaaaauuggucagaagaugaucuacaauuacuaauuaaagcugugaaucuguucccugcuggaacaaauucaagaugggaaguuauugcuaauuacaugaacauacauucuuccucuggagucaaaagaacugccaaagauguuauuggcaaagcaaagagucuccaaaaacuugacccucaucaaaaagaugacauaaauaaaaaggcauuugauaaguucaaaaaagaacauggagugguaccucaagcagacaacgcaacgccuucagaacgauuugaagguccauauacagacuucaccccuuggacaacagaagaacagaagcuuuuggaacaagcuuugaaaacauacccaguaaauacaccugaaagaugggaaaaaauagcagaagcggugccuggcaggacaaagaaggacugcaugaaacgauacaaggaacuugucgagaugguaaaagcaaagaaagcugcucaagaacaagugcugaaugcaaguagagccaagaaauga

SEQ ID NO: 8418 - RNA, 1866 nt, Artificial Sequence
  derived and/or modified sequence opt1 from DNJC2__Homo_sapiens__CCDS43628.1
augcugcuccugcccagcgccgccgacggccgcgggaccgcgaucacccacgcccugacguccgccagcacccucugccagguggagccggugggccggugguucgaggccuucgugaagcgccggaaccgcaacgccuccgcgagcuuccaggagcuggaggacaagaaggagcuguccgaggagagcgaggacgaggagcuccagcuggaggaguuccccaugcugaagacccucgaccccaaggacuggaagaaccaggaccacuacgccgugcuggggcugggccacguccgguacaaggccacccagcgccagaucaaggccgcgcacaaggccauggugcucaagcaccaccccgacaagcggaaggccgccggggagccgaucaaggagggcgacaacgacuacuucacgugcaucaccaaggccuacgagaugcuguccgaccccgugaagcgccgggcguucaacagcgucgaccccaccuucgacaacuccgugcccagcaaguccgaggccaaggacaacuucuucgagguguucaccccggucuucgagcgcaacagccggugguccaacaagaagaacgugcccaagcugggcgacaugaacagcuccuucgaggacguggacaucuucuacagcuucugguacaacuucgacuccuggcgcgaguucagcuaccucgacgaggaggagaaggagaaggccgagugccgggacgagcgccgguggaucgagaagcagaaccgcgccacgcgggcccagcgcaagaaggaggagaugaaccggauccgcacccuggucgacaacgcguacuccugcgacccccggaucaagaaguucaaggaggaggagaaggccaagaaggaggccgagaagaaggccaaggccgaggcgaagcgcaaggagcaggaggccaaggagaagcagcgccaggccgagcuggaggccgcccggcucgcgaaggagaaggaggaggaggaggugcgccagcaggcccugcuggccaagaaggagaaggacauccagaagaaggccaucaagaaggagcggcagaagcuccgcaacagcugcaagaccuggaaccacuucagcgacaacgaggcggagcgggugaagaugauggaggaggucgagaagcugugcgaccgccuggagcucgccucccugcagugccugaacgagacccucacgagcugcaccaaggagguggggaaggccgcccuggagaagcagaucgaggagaucaacgagcagauccggaaggagaaggaggaggccgaggcgcgcaugcggcaggccuccaagaacaccgagaaguccaccggcgggggcgggaacggcagcaagaacuggagcgaggacgaccugcagcuccugaucaaggccgugaaccuguuccccgccggcacgaacucccgcugggaggucaucgccaacuacaugaacauccacagcuccagcggggugaagcggaccgcgaaggacgugaucggcaaggccaagucccuccagaagcuggacccgcaccagaaggacgacaucaacaagaaggccuucgacaaguucaagaaggagcacggggucgugccccaggccgacaacgccacccccagcgagcgcuucgagggccccuacaccgacuucacgccguggaccaccgaggagcagaagcugcucgagcaggcgcugaagaccuaccccgugaacacgcccgagcggugggagaagaucgccgaggccguccccggccgcaccaagaaggacugcaugaagcgguacaaggagcugguggagauggucaaggccaagaaggcggcccaggagcagguccucaacgccucccgcgccaagaaguga

SEQ ID NO: 8419 - RNA, 1866 nt, Artificial Sequence
  derived and/or modified sequence opt2 from DNJC2__Homo_sapiens__CCDS43628.1
augcuccuccuccccuccgccgccgacggccgcggcaccgccaucacccacgcccucaccuccgccuccacccucugccaggucgagcccgucggccgcugguucgaggccuucgucaagcgccgcaaccgcaacgccuccgccuccuuccaggagcucgaggacaagaaggagcucuccgaggaguccgaggacgaggagcuccagcucgaggaguuccccaugcucaagacccucgaccccaaggacuggaagaaccaggaccacuacgccguccucggccucggccacguccgcuacaaggccacccagcgccagaucaaggccgcccacaaggccaugguccucaagcaccaccccgacaagcgcaaggccgccggcgagcccaucaaggagggcgacaacgacuacuucaccugcaucaccaaggccuacgagaugcucuccgaccccgucaagcgccgcgccuucaacuccgucgaccccaccuucgacaacuccguccccuccaaguccgaggccaaggacaacuucuucgaggucuucacccccgucuucgagcgcaacucccgcugguccaacaagaagaacguccccaagcucggcgacaugaacuccuccuucgaggacgucgacaucuucuacuccuucugguacaacuucgacuccuggcgcgaguucuccuaccucgacgaggaggagaaggagaaggccgagugccgcgacgagcgccgcuggaucgagaagcagaaccgcgccacccgcgcccagcgcaagaaggaggagaugaaccgcauccgcacccucgucgacaacgccuacuccugcgacccccgcaucaagaaguucaaggaggaggagaaggccaagaaggaggccgagaagaaggccaaggccgaggccaagcgcaaggagcaggaggccaaggagaagcagcgccaggccgagcucgaggccgcccgccucgccaaggagaaggaggaggaggagguccgccagcaggcccuccucgccaagaaggagaaggacauccagaagaaggccaucaagaaggagcgccagaagcuccgcaacuccugcaagaccuggaaccacuucuccgacaacgaggccgagcgcgucaagaugauggaggaggucgagaagcucugcgaccgccucgagcucgccucccuccagugccucaacgagacccucaccuccugcaccaaggaggucggcaaggccgcccucgagaagcagaucgaggagaucaacgagcagauccgcaaggagaaggaggaggccgaggcccgcaugcgccaggccuccaagaacaccgagaaguccaccggcggcggcggcaacggcuccaagaacugguccgaggacgaccuccagcuccucaucaaggccgucaaccucuuccccgccggcaccaacucccgcugggaggucaucgccaacuacaugaacauccacuccuccuccggcgucaagcgcaccgccaaggacgucaucggcaaggccaagucccuccagaagcucgacccccaccagaaggacgacaucaacaagaaggccuucgacaaguucaagaaggagcacggcgucgucccccaggccgacaacgccacccccuccgagcgcuucgagggccccuacaccgacuucacccccuggaccaccgaggagcagaagcuccucgagcaggcccucaagaccuaccccgucaacacccccgagcgcugggagaagaucgccgaggccguccccggccgcaccaagaaggacugcaugaagcgcuacaaggagcucgucgagauggucaaggccaagaaggccgcccaggagcagguccucaacgccucccgcgccaagaaguga

SEQ ID NO: 8420 - RNA, 1866 nt, Artificial Sequence
  derived and/or modified sequence opt3 from DNJC2__Homo_sapiens__CCDS43628.1
augcugcuccuucccagcgccgcugacggcagagggaccgcaaucacacacgcccugacuuccgcgucuacguugugccagguggagccugucggaaggugguucgaagcauuuguuaagcggcgcaaccgaaaugccucagcaaguuuccaagaguuagaagauaaaaaggagcugagcgaagaguccgaggacgaggagcuacagcucgaagaguuuccaaugcugaaaacccuugauccgaaggacuggaaaaaccaggaucauuacgccgugcuggguuugggccacguacguuauaaggcuacacagagacaaauuaaggcagcccauaaagcuauggugcucaagcaccaucccgacaaaaggaaggccgcgggggagccuauaaaagaaggagauaaugacuacuucacuuguaucaccaaggcauaugagaugcugucugauccagucaagcggcgcgccuuuaacucgguggaccccacauucgauaauucaguuccuagcaaaagugaagcuaaggacaacuuuuucgagguguuuaccccagucuucgaaagaaauuccagguggucuaacaaaaagaaugugcccaaacugggcgauaugaacagcuccuuugaggacguagacauuuucuacucauuuugguauaauuucgauaguuggcgggaguucagcuaccucgacgaagaggaaaaggagaaagccgaaugccgcgaugagcgaagauggaucgagaagcagaacagggcaacucgggcucagcguaagaaagaagagaugaaucgcauuagaacauuaguugacaacgccuauucuugugauccuaggaucaagaaauuuaaggaagaggaaaaagcgaagaaggaggccgagaaaaaggcaaaagcugaagccaagcggaaagagcaggaagcuaaggagaagcaacgacaggccgagcuggaagcagcccgccuugcuaaagagaaggaagaggaagaggugagacagcaggcguugcuggcuaaaaaggagaaagacauacaaaagaaggccaucaaaaaggaaaggcagaaacuacggaauaguugcaagaccuggaaccacuucucagauaacgaggcugaacgcgucaaaaugauggaggaaguggagaagcucugugacagacuggagcuugccagccugcagugcuugaaugaaacgcucacuuccuguaccaaagagguggguaaggcagcccuggaaaagcaaauugaggaaaucaacgagcagauuaggaaagagaaggaagaggcugaagcccguaugcggcaggcaucuaaaaauacagagaaguccacugggggaggcggcaacgggagcaaaaauuggucggaggaugacuuacagcugcucaucaaggcggucaaccuuuuuccagcuggaaccaauucucgaugggaaguuauagccaacuacaugaauauucacuccucaaguggugugaagagaacagcaaaagauguaaucggcaaggccaaaagccugcaaaaguuggacccgcaucagaaagacgauauuaacaagaaggcuuucgacaaauuuaagaaagagcacgggguggucccccaggccgauaaugcaaccccuuccgaaagguucgagggaccauacacggacuuuacucccuggacaaccgaggaacagaagcuacuggagcaagcucucaaaacuuauccugugaacacaccagaacgcugggagaagaucgccgaagcgguucccggccggaccaagaaagauugcaugaagagauacaaagagcugguggaaauggucaaggccaaaaaggcugcacaggaacaggugcuuaaugccucuagggcuaaaaaguga

SEQ ID NO: 8421 - RNA, 1866 nt, Artificial Sequence
  derived and/or modified sequence opt4 from DNJC2__Homo_sapiens__CCDS43628.1
augcugcugcugcccagcgccgccgacggcagaggcaccgccaucacccacgcccugaccagcgccagcacccugugccagguggagcccgugggcagaugguucgaggccuucgugaagagaagaaacagaaacgccagcgccagcuuccaggagcuggaggacaagaaggagcugagcgaggagagcgaggacgaggagcugcagcuggaggaguuccccaugcugaagacccuggaccccaaggacuggaagaaccaggaccacuacgccgugcugggccugggccacgugagauacaaggccacccagagacagaucaaggccgcccacaaggccauggugcugaagcaccaccccgacaagagaaaggccgccggcgagcccaucaaggagggcgacaacgacuacuucaccugcaucaccaaggccuacgagaugcugagcgaccccgugaagagaagagccuucaacagcguggaccccaccuucgacaacagcgugcccagcaagagcgaggccaaggacaacuucuucgagguguucacccccguguucgagagaaacagcagauggagcaacaagaagaacgugcccaagcugggcgacaugaacagcagcuucgaggacguggacaucuucuacagcuucugguacaacuucgacagcuggagagaguucagcuaccuggacgaggaggagaaggagaaggccgagugcagagacgagagaagauggaucgagaagcagaacagagccaccagagcccagagaaagaaggaggagaugaacagaaucagaacccugguggacaacgccuacagcugcgaccccagaaucaagaaguucaaggaggaggagaaggccaagaaggaggccgagaagaaggccaaggccgaggccaagagaaaggagcaggaggccaaggagaagcagagacaggccgagcuggaggccgccagacuggccaaggagaaggaggaggaggaggugagacagcaggcccugcuggccaagaaggagaaggacauccagaagaaggccaucaagaaggagagacagaagcugagaaacagcugcaagaccuggaaccacuucagcgacaacgaggccgagagagugaagaugauggaggagguggagaagcugugcgacagacuggagcuggccagccugcagugccugaacgagacccugaccagcugcaccaaggaggugggcaaggccgcccuggagaagcagaucgaggagaucaacgagcagaucagaaaggagaaggaggaggccgaggccagaaugagacaggccagcaagaacaccgagaagagcaccggcggcggcggcaacggcagcaagaacuggagcgaggacgaccugcagcugcugaucaaggccgugaaccuguuccccgccggcaccaacagcagaugggaggugaucgccaacuacaugaacauccacagcagcagcggcgugaagagaaccgccaaggacgugaucggcaaggccaagagccugcagaagcuggacccccaccagaaggacgacaucaacaagaaggccuucgacaaguucaagaaggagcacggcguggugccccaggccgacaacgccacccccagcgagagauucgagggccccuacaccgacuucacccccuggaccaccgaggagcagaagcugcuggagcaggcccugaagaccuaccccgugaacacccccgagagaugggagaagaucgccgaggccgugcccggcagaaccaagaaggacugcaugaagagauacaaggagcugguggagauggugaaggccaagaaggccgcccaggagcaggugcugaacgccagcagagccaagaaguga

SEQ ID NO: 8422 - RNA, 1866 nt, Artificial Sequence
  derived and/or modified sequence opt5 from DNJC2__Homo_sapiens__CCDS43628.1
augcugcuccugcccagcgccgcugacggcagagggaccgccaucacacacgcgcuuacguccgcuucuacccugugccagguggagccugucggacggugguucgaagccuuuguuaagcgcagaaaccggaaugccagcgcuuccuuccaagagcucgaagauaaaaaggagcugucugaagagagcgaggacgaagaacuucagcuggaagaguuuccgaugcucaaaacacuggaucccaaggacuggaaaaaccaggaucauuacgccgugcugggccucgggcacgugcgcuauaaggcuacccagagacaaauuaaggccgcgcauaaagccaugguccugaagcaccauccugacaaacggaaggcugccggagagcccaucaaagaaggcgauaaugacuacuucacauguauuaccaaggcuuaugagaugcuuuccgauccugugaagcgcagagccuuuaacucuguugaccccacauucgauaauagcgugccuuccaaaagcgaagcgaaggacaacuuuuucgaggucuuuaccccgguguucgaacggaauagccgcugguccaacaaaaagaauguucccaaacugggggauaugaacagcucuuuugaggacguggacaucuucuacuccuuuugguauaauuucgauagcuggagagaguucucuuaccucgacgaagaggaaaaggagaaagccgaaugccgggaugagcgcagauggauugagaagcagaaccgggcuacgcgcgcccagagaaagaaagaagagaugaaucggaucagaacccuggucgacaacgcuuauuccugugauccucgcaucaagaaauuuaaggaagaggaaaaagccaagaaggaggccgagaaaaaggcuaaagcggaagccaagcggaaagagcaggaagcuaaggagaagcaaagacaggccgagcuugaagccgcucgccuggccaaagagaaggaagaggaagaggugcggcagcaggcgcuccuggcuaaaaaggagaaagacauucaaaagaaggccaucaaaaaggaaagacagaaacugcgcaauagcugcaagacauggaaccacuucuccgauaacgaggccgaacgggugaaaaugauggaggaagucgagaagcucugugacagacuggagcuugcuucucugcagugccucaaugaaacccugacaagcuguaccaaagagguuggaaaggccgcucuugaaaagcaaauugaggaaaucaacgagcagauucgcaaagagaaggaagaggccgaagcgcggaugagacaggccuccaaaaauacggagaagucuacaggcggcgggggaaacggcucuaaaaauugguccgaggaugaccugcagcuccugaucaaggcugugaaccuguuucccgccgggaccaauagccgcugggaagugauugcuaacuacaugaauauccacucuagcuccggagucaagcggacagccaaagaugugaucggcaaggcgaaaucucuccaaaagcuggacccucaucagaaagacgauauuaacaagaaggccuucgacaaauuuaagaaagagcacgggguugugccccaggcugauaaugccaccccgagcgaaagauucgagggaccuuacaccgacuuuacacccuggacgaccgaggagcagaaacuucuggagcaagcucucaagacauauccugucaacacccccgaacggugggagaagaucgccgaagccgugcccggccgcacaaagaaagauugcaugaagagauacaaagagcugguugaaauggugaaggcuaaaaaggcggcccaggagcagguccuuaaugcuucccgggccaaaaaguga

SEQ ID NO: 8423 - protein, 504 aa, Artificial Sequence
  DNJC3__Homo_sapiens__Q13217
MVAPGSVTSRLGSVFPFLLVLVDLQYEGAECGVNADVEKHLELGKKLLAAGQLADALSQFHAAVDGDPDNYIAYYRRATVFLAMGKSKAALPDLTKVIQLKMDFTAARLQRGHLLLKQGKLDEAEDDFKKVLKSNPSENEEKEAQSQLIKSDEMQRLRSQALNAFGSGDYTAAIAFLDKILEVCVWDAELRELRAECFIKEGEPRKAISDLKAASKLKNDNTEAFYKISTLYYQLGDHELSLSEVRECLKLDQDHKRCFAHYKQVKKLNKLIESAEELIRDGRYTDATSKYESVMKTEPSIAEYTVRSKERICHCFSKDEKPVEAIRVCSEVLQMEPDNVNALKDRAEAYLIEEMYDEAIQDYETAQEHNENDQQIREGLEKAQRLLKQSQKRDYYKILGVKRNAKKQEIIKAYRKLALQWHPDNFQNEEEKKKAEKKFIDIAAAKEVLSDPEMRKKFDDGEDPLDAESQQGGGGNPFHRSWNSWQGFNPFSSGGPFRFKFHFN

SEQ ID NO: 8424 - RNA, 1515 nt, Artificial Sequence
  DNJC3__Homo_sapiens__AAC50502
augguggcccccggcuccgugaccagccggcugggcucgguauuccccuuccugcuaguccugguggaucugcaguacgaaggugcugaauguggaguaaaugcagauguugagaaacaucuugaauugggcaagaaauuacuugcagcuggacagcuagcugaugcuuuaucucaguuucaugcugccguagauggugacccugauaacuauauugcuuauuaucggagggcuacugucuuuuuagcuaugggcaaaucaaaagcugcacuuccugauuuaacuaaagugauucaauugaagauggacuucacugcagcaagauuacagagaggucacuuauuacucaaacaaggaaaacuugaugaagcagaagaugauuuuaaaaaagugcucaaaucuaauccaagugaaaaugaagaaaaggaagcacagucucaacuuauaaaaucugaugaaaugcagcguuugcguucacaagcacuuaacgcuuuuggaaguggagauuauacugcugcuauagccuuccuugauaagauuuuagagguuuguguuugggaugcagaacuacgggaacuucgagcugaauguuuuauaaaagaaggagaaccuaggaaagcuauaagugacuuaaaagcugcgucaaaguugaagaaugauaauacugaagcguuuuauaaaauaagcacacuguacuaccaacuaggagaccacgaacugucccucagugaaguucgggaaugucuuaaacuugaccaggaucauaaaagguguuuugcacacuauaaacaaguaaagaaacuuaauaagcugauugagucagcugaagagcucaucagagauggcagauacacagaugcuaccagcaaauaugaaucugucaugaaaacagagccaagcauugcugaauauacaguucguucaaaggagaggauuugccacugcuuuucuaaggacgagaagccuguugaagcuauuaggguuuguucugaaguuuuacagauggaaccugacaaugugaaugcccugaaagaucgagcugaggccuauuugauagaggaaauguaugaugaagcuauucaggauuaugaaacugcucaggaacacaaugaaaaugaucagcagauucgagaaggucuagagaaagcacaaagauuauugaaacagucgcagaaacgagauuauuauaaaaucuugggaguaaaaagaaaugccaaaaagcaagaaauuauuaaagcauaccgaaaauuagcacugcaguggcacccagauaacuuccagaaugaagaagaaaagaaaaaagcugagaaaaaguucauugauauagcagcugcuaaagaaguccucucugauccagaaaugagaaagaaguuugacgacggagaagauccuuuggaugcagagagccagcaaggaggcggcggcaacccuuuccacagaagcuggaacucauggcaaggguucaaucccuucagcucaggcggaccauuuagauuuaaauuccacuucaauuaa

SEQ ID NO: 8425 - RNA, 1515 nt, Artificial Sequence
  derived and/or modified sequence opt1 from DNJC3__Homo_sapiens__AAC50502
augguggcccccggcagcgucaccucccgccuggggagcguguucccguuccuccuggugcuggucgaccuccaguacgagggcgccgagugcggggugaacgcggacguggagaagcaccuggagcugggcaagaagcuccuggccgccgggcagcuggccgacgcccucucccaguuccacgcggccgucgacggcgaccccgacaacuacaucgccuacuaccggcgcgccaccguguuccuggcgaugggcaagagcaaggccgcccugcccgaccucacgaaggugauccagcugaagauggacuucaccgccgcccggcugcagcgcgggcaccuccugcugaagcagggcaagcucgacgaggcggaggacgacuucaagaagguccugaaguccaaccccagcgagaacgaggagaaggaggcccagucccagcugaucaagagcgacgagaugcagcggcuccgcucccaggcccugaacgccuucgggagcggcgacuacaccgccgcgaucgccuuccuggacaagauccucgaggugugcgugugggacgccgagcugcgggagcugcgcgccgagugcuucaucaaggagggggagccgcggaaggccaucuccgaccucaaggcggccagcaagcugaagaacgacaacaccgaggccuucuacaagaucuccacgcuguacuaccagcucggcgaccacgagcugagccuguccgagguccgcgagugccucaagcuggaccaggaccacaagcggugcuucgcccacuacaagcaggucaagaagcugaacaagcucaucgagagcgccgaggagcugauccgcgacggccgguacaccgacgcgaccuccaaguacgagagcgugaugaagaccgagcccuccaucgccgaguacacggugcgcagcaaggagcggaucugccacugcuucagcaaggacgagaagcccguggaggccauccgcgugugcuccgagguccugcagauggagcccgacaacgugaacgcccucaaggaccgggcggaggccuaccugaucgaggagauguacgacgaggccauccaggacuacgagaccgcccaggagcacaacgagaacgaccagcagauccgcgaggggcuggagaaggcccagcggcuccugaagcagagccagaagcgcgacuacuacaagauccugggcgugaagcggaacgcgaagaagcaggagaucaucaaggccuaccgcaagcucgcccugcaguggcacccggacaacuuccagaacgaggaggagaagaagaaggccgagaagaaguucaucgacaucgccgcggccaaggagguccuguccgaccccgagaugcgcaagaaguucgacgacggggaggacccccucgacgccgagagccagcagggcggcgggggcaaccccuuccaccgguccuggaacagcuggcagggguucaacccguucuccagcggcgggcccuuccgcuucaaguuccacuucaacuga

SEQ ID NO: 8426 - RNA, 1515 nt, Artificial Sequence
  derived and/or modified sequence opt2 from DNJC3__Homo_sapiens__AAC50502
auggucgcccccggcuccgucaccucccgccucggcuccgucuuccccuuccuccucguccucgucgaccuccaguacgagggcgccgagugcggcgucaacgccgacgucgagaagcaccucgagcucggcaagaagcuccucgccgccggccagcucgccgacgcccucucccaguuccacgccgccgucgacggcgaccccgacaacuacaucgccuacuaccgccgcgccaccgucuuccucgccaugggcaaguccaaggccgcccuccccgaccucaccaaggucauccagcucaagauggacuucaccgccgcccgccuccagcgcggccaccuccuccucaagcagggcaagcucgacgaggccgaggacgacuucaagaagguccucaaguccaaccccuccgagaacgaggagaaggaggcccagucccagcucaucaaguccgacgagaugcagcgccuccgcucccaggcccucaacgccuucggcuccggcgacuacaccgccgccaucgccuuccucgacaagauccucgaggucugcgucugggacgccgagcuccgcgagcuccgcgccgagugcuucaucaaggagggcgagccccgcaaggccaucuccgaccucaaggccgccuccaagcucaagaacgacaacaccgaggccuucuacaagaucuccacccucuacuaccagcucggcgaccacgagcucucccucuccgagguccgcgagugccucaagcucgaccaggaccacaagcgcugcuucgcccacuacaagcaggucaagaagcucaacaagcucaucgaguccgccgaggagcucauccgcgacggccgcuacaccgacgccaccuccaaguacgaguccgucaugaagaccgagcccuccaucgccgaguacaccguccgcuccaaggagcgcaucugccacugcuucuccaaggacgagaagcccgucgaggccauccgcgucugcuccgagguccuccagauggagcccgacaacgucaacgcccucaaggaccgcgccgaggccuaccucaucgaggagauguacgacgaggccauccaggacuacgagaccgcccaggagcacaacgagaacgaccagcagauccgcgagggccucgagaaggcccagcgccuccucaagcagucccagaagcgcgacuacuacaagauccucggcgucaagcgcaacgccaagaagcaggagaucaucaaggccuaccgcaagcucgcccuccaguggcaccccgacaacuuccagaacgaggaggagaagaagaaggccgagaagaaguucaucgacaucgccgccgccaaggagguccucuccgaccccgagaugcgcaagaaguucgacgacggcgaggacccccucgacgccgagucccagcagggcggcggcggcaaccccuuccaccgcuccuggaacuccuggcagggcuucaaccccuucuccuccggcggccccuuccgcuucaaguuccacuucaacuga

SEQ ID NO: 8427 - RNA, 1515 nt, Artificial Sequence
  derived and/or modified sequence opt3 from DNJC3__Homo_sapiens__AAC50502
augguggcccccggcagcgucaccuccagacuggggucuguuuucccuuuucuccuugugcugguagacuugcaguacgagggagcugaaugcggugugaacgcagaugucgagaagcacuuagaacugggcaaaaagcuacucgccgcggggcaacuggcugacgcccuuucacaguuccaugcagccguggauggagacccagauaauuauaucgcuuacuauaggcgggcaacaguuuuucuggccaugggcaaaaguaaggcugccuugccggaccucacuaaagugauucagcugaagauggauuucacggcggcacgccugcagcgaggucaccucuuacugaagcaagggaaacuugacgaggccgaagaugacuuuaagaaaguccucaagagcaaccccuccgagaaugaggaaaaagaggcucagucucagcugauaaagucggaugaaaugcagcgucuaagaucacaagcccucaacgcauucggaagcggcgacuacaccgcugccaucgcguuucuggauaagauucuugagguguguguaugggacgccgagcugagggaauugcgggcagagugcuucaucaaagaaggcgagccucgcaaggcuauuagugaccucaaagccgcuuccaagcugaaaaaugauaacacagaagccuuuuauaagaucucuacuuuauacuaucagcugggggaccaugagcucagccuuuccgagguuagagaaugucugaaauuggaucaggaccacaagaggugcuucgcacauuacaaacaggugaaaaagcuaaauaaacugauagagucagccgaagaguugauccgggauggacgcuacaccgacgcuacaaguaaguaugaaagcgucaugaaaaccgagccaucuauugcggaguacacugugcgauccaaggaaagaaucugucacugcuuuucaaaggaugagaaacccguggaagcaauuagggucuguagcgagguucugcaaauggaaccugacaacgugaaugcccuuaaggaucgggcugaggccuaucugaucgaggaaauguacgacgaggcaauacaggauuaugaaacagcccaggagcacaacgagaaugaccaacagauucgugaagguuuggagaaagcucagcgccuccugaagcagagucaaaagagagacuacuauaagaucuuaggcguaaagaggaacgccaaaaagcaggaaauuaucaaagcauaccggaagcuggcgcuacaguggcauccagauaauuuccagaacgaggaagagaaaaagaaggcugagaaaaaguuuaucgacauugccgcagccaaagaagugcucucugaucccgagaugcgaaagaaauucgacgauggggaagacccucuggaugcugagucccaacagggaggcggugggaauccauuccaccgcagcuggaacucguggcagggauuuaacccguucucuuccggcggccccuuuagauucaaguuucauuucaauuga

SEQ ID NO: 8428 - RNA, 1515 nt, Artificial Sequence
  derived and/or modified sequence opt4 from DNJC3__Homo_sapiens__AAC50502
augguggcccccggcagcgugaccagcagacugggcagcguguuccccuuccugcuggugcugguggaccugcaguacgagggcgccgagugcggcgugaacgccgacguggagaagcaccuggagcugggcaagaagcugcuggccgccggccagcuggccgacgcccugagccaguuccacgccgccguggacggcgaccccgacaacuacaucgccuacuacagaagagccaccguguuccuggccaugggcaagagcaaggccgcccugcccgaccugaccaaggugauccagcugaagauggacuucaccgccgccagacugcagagaggccaccugcugcugaagcagggcaagcuggacgaggccgaggacgacuucaagaaggugcugaagagcaaccccagcgagaacgaggagaaggaggcccagagccagcugaucaagagcgacgagaugcagagacugagaagccaggcccugaacgccuucggcagcggcgacuacaccgccgccaucgccuuccuggacaagauccuggaggugugcgugugggacgccgagcugagagagcugagagccgagugcuucaucaaggagggcgagcccagaaaggccaucagcgaccugaaggccgccagcaagcugaagaacgacaacaccgaggccuucuacaagaucagcacccuguacuaccagcugggcgaccacgagcugagccugagcgaggugagagagugccugaagcuggaccaggaccacaagagaugcuucgcccacuacaagcaggugaagaagcugaacaagcugaucgagagcgccgaggagcugaucagagacggcagauacaccgacgccaccagcaaguacgagagcgugaugaagaccgagcccagcaucgccgaguacaccgugagaagcaaggagagaaucugccacugcuucagcaaggacgagaagcccguggaggccaucagagugugcagcgaggugcugcagauggagcccgacaacgugaacgcccugaaggacagagccgaggccuaccugaucgaggagauguacgacgaggccauccaggacuacgagaccgcccaggagcacaacgagaacgaccagcagaucagagagggccuggagaaggcccagagacugcugaagcagagccagaagagagacuacuacaagauccugggcgugaagagaaacgccaagaagcaggagaucaucaaggccuacagaaagcuggcccugcaguggcaccccgacaacuuccagaacgaggaggagaagaagaaggccgagaagaaguucaucgacaucgccgccgccaaggaggugcugagcgaccccgagaugagaaagaaguucgacgacggcgaggacccccuggacgccgagagccagcagggcggcggcggcaaccccuuccacagaagcuggaacagcuggcagggcuucaaccccuucagcagcggcggccccuucagauucaaguuccacuucaacuga

SEQ ID NO: 8429 - RNA, 1515 nt, Artificial Sequence
  derived and/or modified sequence opt5 from DNJC3__Homo_sapiens__AAC50502
augguggcccccggcagcgucaccuccagacuggggucuguuuucccuuuucuccuggugcuuguggaccugcaguacgagggagcugaaugcggcgucaacgccgauguggagaagcaccucgaacuggggaaaaagcugcuugcggcuggacaacucgccgacgcccugagccaguuccaugcugccguugauggcgacccggauaauuauaucgcuuacuaucggcgcgccacaguguuucuggcgauggggaaauccaaggccgcucuccccgaccugacgaaagucauucagcuuaagauggauuucaccgccgcuagacugcagcggggacaccuccugcuuaagcaaggcaaacuggacgaggccgaagaugacuuuaagaaagugcucaagucuaacccuagcgagaaugaggaaaaagaggcgcagucccagcugaucaagucugaugaaaugcagcgccugagaagccaagcccucaacgcuuucggcuccggggacuacacagccgcuauugccuuucuggauaagauccuugagguuugugugugggacgccgagcugcgggaacuccgcgcugagugcuucauuaaagaaggagagcccagaaaggcgaucagcgaccugaaagccgcuucuaaacuuaaaaaugauaacaccgaagccuuuuauaagaucuccacacuguacuaucagcucggcgaccaugagcugagccugucugagguccgggaaugucucaaacuggaucaggaccacaagcgcugcuucgcccauuacaaacaggugaagaaacuuaauaagcugauugaguccgcugaggaacucaucagagaugggcgguacaccgacgccacaagcaaguaugaaucugugaugaaaaccgagccuuccauugcggaguacacgguccgcagcaaggaaagaaucugucacugcuuuuccaaggaugagaaacccguugaagcuauucggguguguucugaggugcugcaaauggaaccugacaacgucaaugcccuuaaggaucgcgccgaggcuuaucugaucgaggaaauguacgacgaggccauucaggauuaugaaaccgcucaggagcacaacgagaaugaccaacagaucagagaaggacucgagaaagcccagcggcugcugaagcagagccaaaagagagacuacuauaagauccucggcgugaagcgcaacgcgaaaaagcaggaaauuaucaaagccuaccggaagcuggcccuucaguggcauccggauaauuuccagaacgaggaagagaaaaagaaggcugagaaaaaguuuauugacaucgcugccgcgaaagaaguucuguccgaucccgagaugagaaagaaauucgacgauggggaagacccucucgaugccgagagccaacagggaggcggcgggaaucccuuccaccgcucuuggaacuccuggcagggauuuaacccuuucagcucuggcgggcccuuucgguucaaguuucauuucaauuga

SEQ ID NO: 8430 - protein, 241 aa, Artificial Sequence
  DNJC4__Homo_sapiens__Q9NNZ3
MPPLLPLRLCRLWPRNPPSRLLGAAAGQRSRPSTYYELLGVHPGASTEEVKRAFFSKSKELHPDRDPGNPSLHSRFVELSEAYRVLSREQSRRSYDDQLRSGSPPKSPRTTVHDKSAHQTHSSWTPPNAQYWSQFHSVRPQGPQLRQQQHKQNKQVLGYCLLLMLAGMGLHYIAFRKVKQMHLNFMDEKDRIITAFYNEARARARANRGILQQERQRLGQRQPPPSEPTQGPEIVPRGAGP

SEQ ID NO: 8431 - RNA, 726 nt, Artificial Sequence
  DNJC4__Homo_sapiens__AAF97845
augccgcccuuacugccccugcgccugugccggcuguggccccgcaacccucccucccggcuccucggagcggccgccgggcagcgguccagacccaguacuuauuaugaacuguugggggugcauccuggugccagcacugaggaaguuaaacgagcuuucuucuccaaguccaaagagcugcacccagaccgggacccugggaacccaagccugcacagccgcuuuguggagcugagcgaggcauaccgugugcucagccgugagcagagccgccgcagcuaugaugaccagcuccgcucagguagucccccaaagucuccacgaaccacaguccaugacaagucugcccaccaaacacacagcuccuggacaccccccaacgcacaguacuggucccaguuucacagcgugaggccacaggggccccaguugaggcagcagcaacacaaacaaaacaaacaagugcugggguacugccuccuccucaugcuggcgggcaugggccugcacuacauugccuucaggaaggugaagcagaugcaccuuaacuucauggaugaaaaggaucggaucaucacagccuucuacaacgaagcccgggcacgggccagggccaacagaggcauccuucagcaggagcgacaacggcuagggcagcggcagccgccaccauccgagccaacccaaggccccgagaucgugccccggggcgccggccccuga

SEQ ID NO: 8432 - RNA, 726 nt, Artificial Sequence
  derived and/or modified sequence opt1 from DNJC4__Homo_sapiens__AAF97845
augcccccgcugcucccccugcgccugugccggcucuggccccgcaacccgcccagccggcugcugggcgccgccgcggggcagcgcucccggcccagcaccuacuacgagcuccugggcgugcaccccggggccuccaccgaggaggucaagcgcgccuucuucagcaaguccaaggagcugcaccccgaccgggacccgggcaaccccagccuccacucccgcuucguggagcugagcgaggccuaccgggugcugucccgcgagcagagccggcgcuccuacgacgaccagcuccggagcggguccccgcccaagagcccccgcacgaccguccacgacaaguccgcccaccagacccacagcuccuggaccccgcccaacgcgcaguacuggagccaguuccacuccgugcggccccagggcccccagcugcgccagcagcagcacaagcagaacaagcagguccugggcuacugccuccugcugaugcucgccgggaugggccugcacuacaucgccuuccggaaggugaagcagaugcaccugaacuucauggacgagaaggaccgcaucaucacggccuucuacaacgaggcgcgggcccgcgcccgggccaaccgcgggauccuccagcaggagcgccagcggcugggccagcgccagcccccgcccagcgagcccacccaggggcccgagaucgugccccggggcgccggccccuga

SEQ ID NO: 8433 - RNA, 726 nt, Artificial Sequence
  derived and/or modified sequence opt2 from DNJC4__Homo_sapiens__AAF97845
augcccccccuccucccccuccgccucugccgccucuggccccgcaacccccccucccgccuccucggcgccgccgccggccagcgcucccgccccuccaccuacuacgagcuccucggcguccaccccggcgccuccaccgaggaggucaagcgcgccuucuucuccaaguccaaggagcuccaccccgaccgcgaccccggcaaccccucccuccacucccgcuucgucgagcucuccgaggccuaccgcguccucucccgcgagcagucccgccgcuccuacgacgaccagcuccgcuccggcuccccccccaaguccccccgcaccaccguccacgacaaguccgcccaccagacccacuccuccuggaccccccccaacgcccaguacuggucccaguuccacuccguccgcccccagggcccccagcuccgccagcagcagcacaagcagaacaagcagguccucggcuacugccuccuccucaugcucgccggcaugggccuccacuacaucgccuuccgcaaggucaagcagaugcaccucaacuucauggacgagaaggaccgcaucaucaccgccuucuacaacgaggcccgcgcccgcgcccgcgccaaccgcggcauccuccagcaggagcgccagcgccucggccagcgccagcccccccccuccgagcccacccagggccccgagaucgucccccgcggcgccggccccuga

SEQ ID NO: 8434 - RNA, 726 nt, Artificial Sequence
  derived and/or modified sequence opt3 from DNJC4__Homo_sapiens__AAF97845
augcccccucugcucccacuuaggcugugcagguuguggccgcggaaucccccuagccgcuuacugggcgccgcugcagggcagcgaucccguccaucuaccuacuaugagcuacucggagugcaccccggugccucaacagaagaggucaagagagcguucuuuaguaaaagcaaggaacugcauccugacagggauccaggcaaccccucccuucacucucgguucguugagcugucggaggcuuaccgcguguugucaagagaacaaagcaggcggaguuaugacgaucagcuccgcuccgggucuccuccaaaaagcccgcgaacuacgguacaugacaaguccgcccaccagacccauucaaguuggacacccccuaacgcacaguacuggagccaauuucacucugugagaccacagggaccccagcugaggcagcaacagcacaaacagaauaagcagguccugggcuauugucucuuacugaugcuugccgguaugggguugcauuacaucgcuuuccggaaggugaaacaaaugcaccugaacuuuauggaugagaaggaccguauuauaacugcauucuauaaugaagcccgcgcuagagccagggcgaaccggggaauccuacagcaggagcgacaacgccucggccagagacagccuccacccuccgaaccgacccagggcccugagauuguucccagaggggcaggaccauga

SEQ ID NO: 8435 - RNA, 726 nt, Artificial Sequence
  derived and/or modified sequence opt4 from DNJC4__Homo_sapiens__AAF97845
augcccccccugcugccccugagacugugcagacuguggcccagaaacccccccagcagacugcugggcgccgccgccggccagagaagcagacccagcaccuacuacgagcugcugggcgugcaccccggcgccagcaccgaggaggugaagagagccuucuucagcaagagcaaggagcugcaccccgacagagaccccggcaaccccagccugcacagcagauucguggagcugagcgaggccuacagagugcugagcagagagcagagcagaagaagcuacgacgaccagcugagaagcggcagcccccccaagagccccagaaccaccgugcacgacaagagcgcccaccagacccacagcagcuggaccccccccaacgcccaguacuggagccaguuccacagcgugagaccccagggcccccagcugagacagcagcagcacaagcagaacaagcaggugcugggcuacugccugcugcugaugcuggccggcaugggccugcacuacaucgccuucagaaaggugaagcagaugcaccugaacuucauggacgagaaggacagaaucaucaccgccuucuacaacgaggccagagccagagccagagccaacagaggcauccugcagcaggagagacagagacugggccagagacagcccccccccagcgagcccacccagggccccgagaucgugcccagaggcgccggccccuga

SEQ ID NO: 8436 - RNA, 726 nt, Artificial Sequence
  derived and/or modified sequence opt5 from DNJC4__Homo_sapiens__AAF97845
augcccccucugcucccgcugagacuuugccggcuguggccccgcaacccucccagcagacuccugggcgccgcugccgggcagcggucccgcccuucuaccuacuaugagcuucugggagugcaccccggcgcgagcacagaagaggucaagagagcuuucuuuuccaaaucuaaggaacuccauccugaccgggauccggggaaucccagccugcacucccgcuucguugagcugucugaagccuacagagugcucagccgggagcaaucccgcagaagcuaugacgaucagcugcggucuggauccccucccaaaagcccucgcacgaccgugcaugacaagucugcccaccagacacauuccagcuggacacccccgaacgcucaguacuggucucaauuucacuccgucagaccucagggcccccagcuucggcagcaacagcacaaacagaauaaacaggugcugggguauugucuccugcuuaugcuggccggaaugggccuccauuacaucgcuuuccgcaagguuaagcaaaugcaccugaacuuuauggaugagaaggacagaauuaucaccgccuucuauaaugaagcgcgggccagagcucgcgccaaccggggcauucugcagcaggagagacaacgccucgggcagcggcagccuccucccagcgaacccacccagggaccggagaucgugcccagaggcgcugggccuuga

SEQ ID NO: 8437 - protein, 198 aa, Artificial Sequence
  DNJC5__Homo_sapiens__Q9H3Z4
MADQRQRSLSTSGESLYHVLGLDKNATSDDIKKSYRKLALKYHPDKNPDNPEAADKFKEINNAHAILTDATKRNIYDKYGSLGLYVAEQFGEENVNTYFVLSSWWAKALFVFCGLLTCCYCCCCLCCCFNCCCGKCKPKAPEGEETEFYVSPEDLEAQLQSDEREATDTPIVIQPASATETTQLTADSHPSYHTDGFN

SEQ ID NO: 8438 - RNA, 597 nt, Artificial Sequence
  DNJC5__Homo_sapiens__AAH53642
auggcagaccagagacagcgcucacugucuaccucuggggagucauuguaccacguccuuggguuggacaagaacgcaaccucagaugacauuaaaaaguccuaucggaagcuugccuugaaauaucaccccgacaagaaccccgacaacccggaggccgcggacaaguuuaaggagaucaacaacgcgcacgccauccucacggacgccacaaaaaggaacaucuacgacaaguacggcucgcugggucucuacguggccgagcaguuuggggaagagaacgugaacaccuacuucgugcuguccagcuggugggccaaggcccuguuugucuucugcggccuccucacgugcugcuacugcugcugcugucugugcugcugcuucaacugcugcugcgggaaguguaagcccaaggcgccugaaggcgaggagacggaguucuacgugucccccgaggaucuggaggcacagcugcagucugacgagagggaggccacagacacgccgaucgucauacagccggcauccgccaccgagaccacccagcucacagccgacucccaccccagcuaccacacugacggguucaacuaa

SEQ ID NO: 8439 - RNA, 597 nt, Artificial Sequence
  derived and/or modified sequence opt1 from DNJC5__Homo_sapiens__AAH53642
auggccgaccagcgccagcggagccuguccaccagcggcgagucccucuaccacgugcuggggcuggacaagaacgccaccagcgacgacaucaagaaguccuaccgcaagcucgcgcugaaguaccaccccgacaagaacccggacaaccccgaggccgccgacaaguucaaggagaucaacaacgcccacgccauccugacggacgcgaccaagcggaacaucuacgacaaguacggcagccucgggcuguacgucgccgagcaguucggcgaggagaacgugaacaccuacuucgugcuguccagcuggugggccaaggcccucuucgucuucugcgggcugcugaccugcugcuacugcugcugcugccucugcugcugcuucaacugcugcugcggcaagugcaagcccaaggcgcccgagggcgaggagacggaguucuacguguccccggaggaccuggaggcccagcugcagagcgacgagcgcgaggccaccgacacccccaucgugauccagcccgccuccgccaccgagacgacccagcucaccgcggacagccaccccuccuaccacaccgacggguucaacuga

SEQ ID NO: 8440 - RNA, 597 nt, Artificial Sequence
  derived and/or modified sequence opt2 from DNJC5__Homo_sapiens__AAH53642
auggccgaccagcgccagcgcucccucuccaccuccggcgagucccucuaccacguccucggccucgacaagaacgccaccuccgacgacaucaagaaguccuaccgcaagcucgcccucaaguaccaccccgacaagaaccccgacaaccccgaggccgccgacaaguucaaggagaucaacaacgcccacgccauccucaccgacgccaccaagcgcaacaucuacgacaaguacggcucccucggccucuacgucgccgagcaguucggcgaggagaacgucaacaccuacuucguccucuccuccuggugggccaaggcccucuucgucuucugcggccuccucaccugcugcuacugcugcugcugccucugcugcugcuucaacugcugcugcggcaagugcaagcccaaggcccccgagggcgaggagaccgaguucuacgucucccccgaggaccucgaggcccagcuccaguccgacgagcgcgaggccaccgacacccccaucgucauccagcccgccuccgccaccgagaccacccagcucaccgccgacucccaccccuccuaccacaccgacggcuucaacuga

SEQ ID NO: 8441 - RNA, 597 nt, Artificial Sequence
  derived and/or modified sequence opt3 from DNJC5__Homo_sapiens__AAH53642
auggccgaccagagacaaaggagccuguccaccucuggcgagucacucuaccacgugcuugggcuggauaagaacgcuacaagugacgauaucaaaaagagcuaucggaaauuggcauuaaaguaccaucccgacaaaaauccugauaacccagaagccgcggacaaguucaaggagauuaauaacgcucacgccauacugacugaugcaacgaaacgcaauaucuaugacaaguacggaucccuaggucucuaugucgccgaacaguuuggcgaggaaaacguuaauaccuacuucgugcugucuucguggugggcuaaagcacuuuuuguauucugcgggcuguugacauguugcuauuguugcuguugccucuguugcuguuuuaacugcuguugcggaaagugcaaaccgaaggcccccgagggcgaggaaacugaguucuacgugucaccugaagaucuggaggcucagcugcagagcgacgagcgagaagccaccgauacaccaauugucauccaacccgcgagugcaaccgagacuacacagcucaccgccgacucccauccuucuuaccacacggaugguuuuaauuga

SEQ ID NO: 8442 - RNA, 597 nt, Artificial Sequence
  derived and/or modified sequence opt4 from DNJC5__Homo_sapiens__AAH53642
auggccgaccagagacagagaagccugagcaccagcggcgagagccuguaccacgugcugggccuggacaagaacgccaccagcgacgacaucaagaagagcuacagaaagcuggcccugaaguaccaccccgacaagaaccccgacaaccccgaggccgccgacaaguucaaggagaucaacaacgcccacgccauccugaccgacgccaccaagagaaacaucuacgacaaguacggcagccugggccuguacguggccgagcaguucggcgaggagaacgugaacaccuacuucgugcugagcagcuggugggccaaggcccuguucguguucugcggccugcugaccugcugcuacugcugcugcugccugugcugcugcuucaacugcugcugcggcaagugcaagcccaaggcccccgagggcgaggagaccgaguucuacgugagccccgaggaccuggaggcccagcugcagagcgacgagagagaggccaccgacacccccaucgugauccagcccgccagcgccaccgagaccacccagcugaccgccgacagccaccccagcuaccacaccgacggcuucaacuga

SEQ ID NO: 8443 - RNA, 597 nt, Artificial Sequence
  derived and/or modified sequence opt5 from DNJC5__Homo_sapiens__AAH53642
auggccgaccagagacaacggagccuguccaccucuggcgagagccucuaccacgugcuggggcuugauaagaacgcuacauccgacgauaucaaaaagucuuaucgcaaacuggcccucaaguaccaucccgacaaaaauccugauaacccggaagcggcugacaaguucaaggagauuaauaacgcccacgccauccugacggaugcuaccaaaagaaauauuuaugacaaguacggaagccuuggccuguaugucgccgaacaguuuggggaggaaaacguuaauacauacuucgugcucuccucuuggugggcuaaagcccuguuuguguucugcggacugcucaccuguugcuauuguugcuguugccuguguugcuguuuuaacugcuguugcggcaagugcaaacccaaggcgccugagggggaggaaacagaguucuacgucagccccgaagaucuugaggcccagcugcaguccgacgagcgggaagcuaccgauacaccuaucgugauucaacccgccagcgcuaccgagacgacccagcucacagccgacucucauccuuccuaccacaccgauggauuuaauuga

SEQ ID NO: 8444 - protein, 494 aa, Artificial Sequence
  DNJC7__Homo_sapiens__Q99615
MAAAAECDVVMAATEPELLDDQEAKREAETFKEQGNAYYAKKDYNEAYNYYTKAIDMCPKNASYYGNRAATLMMLGRFREALGDAQQSVRLDDSFVRGHLREGKCHLSLGNAMAACRSFQRALELDHKNAQAQQEFKNANAVMEYEKIAETDFEKRDFRKVVFCMDRALEFAPACHRFKILKAECLAMLGRYPEAQSVASDILRMDSTNADALYVRGLCLYYEDCIEKAVQFFVQALRMAPDHEKACIACRNAKALKAKKEDGNKAFKEGNYKLAYELYTEALGIDPNNIKTNAKLYCNRGTVNSKLRKLDDAIEDCTNAVKLDDTYIKAYLRRAQCYMDTEQYEEAVRDYEKVYQTEKTKEHKQLLKNAQLELKKSKRKDYYKILGVDKNASEDEIKKAYRKRALMHHPDRHSGASAEVQKEEEKKFKEVGEAFTILSDPKKKTRYDSGQDLDEEGMNMGDFDPNNIFKAFFGGPGGFSFEASGPGNFFFQFG

SEQ ID NO: 8445 - RNA, 1485 nt, Artificial Sequence
  DNJC7__Homo_sapiens__AAH11837
auggcggcugccgcggagugcgaugugguaauggcggcgaccgagccggagcugcucgacgaccaagaggcgaagagggaagcagagacuuucaaggaacaaggaaaugcauacuaugccaagaaagauuacaaugaagcuuauaauuauuauacaaaagccauagauauguguccuaaaaaugcuagcuauuaugguaaucgagcagccaccuugaugaugcuuggaagguuccgggaagcucuuggagaugcacaacagucagugagguuggaugacaguuuuguccggggacaucuacgagagggcaagugccaccucucucuggggaaugccauggcagcaugucgcagcuuccagagagcccuagaacuggaucauaaaaaugcucaggcacaacaagaguucaagaaugcuaaugcagucauggaauaugagaaaauagcagaaacagauuuugagaagcgagauuuucggaagguuguuuucugcauggaccgugcccuagaauuugccccugccugccaucgcuucaaaauccucaaggcagaauguuuagcaaugcugggucguuauccagaagcacagucuguggcuagugacauucuacgaauggauuccaccaaugcagaugcucuguauguacgaggucuuugccuuuauuacgaagauuguauugagaaggcaguucaguuuuucguacaggcucucaggauggcuccugaccacgagaaggccugcauugccugcagaaaugccaaagcacucaaagcaaagaaagaagaugggaauaaagcauuuaaggaaggaaauuacaaacuagcauaugaacuguacacagaagcccuggggauagaccccaacaauauaaaaacaaaugcuaaacucuacuguaaucgggguacgguuaauuccaagcuuaggaaacuagaugaugcaauagaagacugcacaaaugcagugaagcuugaugacacuuacauaaaagccuacuugagaagagcucaguguuacauggacacagaacaguaugaagaagcaguacgagacuaugaaaaaguauaccagacagagaaaacaaaagaacacaaacagcuccuaaaaaaugcgcagcuggaacugaagaagaguaagaggaaagauuacuacaagauucuaggaguggacaagaaugccucugaggacgagaucaagaaagcuuaucggaaacgggccuugaugcaccauccagaucggcauaguggagccagugcugagguucagaaggaggaggagaagaaguucaaggaaguuggagaggccuuuacuauccucucugaucccaagaaaaagacucgcuaugacaguggacaggaccuagaugaggagggcaugaauaugggugauuuugauccaaacaauaucuucaaggcauucuuuggcgguccuggcggcuucagcuuugaagcaucugguccagggaauuucuuuuuucaauuuggcuaa

SEQ ID NO: 8446 - RNA, 1485 nt, Artificial Sequence
  derived and/or modified sequence opt1 from DNJC7__Homo_sapiens__AAH11837
auggccgccgcggccgagugcgacguggucauggccgccaccgagcccgagcugcucgacgaccaggaggccaagcgcgaggcggagaccuucaaggagcagggcaacgccuacuacgccaagaaggacuacaacgaggccuacaacuacuacacgaaggcgaucgacaugugcccgaagaacgccagcuacuacgggaaccgggccgccacccugaugaugcugggccgcuuccgggaggcccucggggacgcgcagcaguccgugcgccuggacgacagcuucgugcggggccaccuccgcgaggggaagugccaccugucccugggcaacgccauggccgccugccggagcuuccagcgcgcccuggagcucgaccacaagaacgcgcaggcccagcaggaguucaagaacgccaacgccgucauggaguacgagaagaucgccgagaccgacuucgagaagcgggacuuccgcaaggugguguucugcauggaccgggcgcuggaguucgcccccgccugccaccgcuucaagauccugaaggccgagugccucgccaugcugggccgguaccccgaggcgcaguccgucgccagcgacauccugcgcauggacuccaccaacgccgacgcccucuacgugcgggggcugugccuguacuacgaggacugcaucgagaaggcggugcaguucuucguccaggcccuccgcauggcccccgaccacgagaaggccugcaucgccugccggaacgcgaaggcccugaaggccaagaaggaggacggcaacaaggccuucaaggaggggaacuacaagcuggccuacgagcucuacacggaggcgcugggcaucgacccgaacaacaucaagaccaacgccaagcuguacugcaaccgcgggaccgugaacagcaagcuccggaagcuggacgacgccaucgaggacugcaccaacgccgugaagcuggacgacacguacaucaaggccuaccuccgccgggcgcagugcuacauggacaccgagcaguacgaggaggccguccgcgacuacgagaagguguaccagaccgagaagaccaaggagcacaagcagcugcugaagaacgcccagcucgagcugaagaaguccaagcgcaaggacuacuacaagauccugggcguggacaagaacgccagcgaggacgagaucaagaaggcguaccggaagcgcgcccucaugcaccaccccgaccggcacuccggcgccagcgccgagguccagaaggaggaggagaagaaguucaaggaggugggggaggccuucacgauccuguccgaccccaagaagaagacccgcuacgacagcggccaggaccuggacgaggaggggaugaacaugggcgacuucgaccccaacaacaucuucaaggcguucuucggcgggccgggcggguucuccuucgaggccagcggccccgggaacuucuucuuccaguucggcuga

SEQ ID NO: 8447 - RNA, 1485 nt, Artificial Sequence
  derived and/or modified sequence opt2 from DNJC7__Homo_sapiens__AAH11837
auggccgccgccgccgagugcgacgucgucauggccgccaccgagcccgagcuccucgacgaccaggaggccaagcgcgaggccgagaccuucaaggagcagggcaacgccuacuacgccaagaaggacuacaacgaggccuacaacuacuacaccaaggccaucgacaugugccccaagaacgccuccuacuacggcaaccgcgccgccacccucaugaugcucggccgcuuccgcgaggcccucggcgacgcccagcaguccguccgccucgacgacuccuucguccgcggccaccuccgcgagggcaagugccaccucucccucggcaacgccauggccgccugccgcuccuuccagcgcgcccucgagcucgaccacaagaacgcccaggcccagcaggaguucaagaacgccaacgccgucauggaguacgagaagaucgccgagaccgacuucgagaagcgcgacuuccgcaaggucgucuucugcauggaccgcgcccucgaguucgcccccgccugccaccgcuucaagauccucaaggccgagugccucgccaugcucggccgcuaccccgaggcccaguccgucgccuccgacauccuccgcauggacuccaccaacgccgacgcccucuacguccgcggccucugccucuacuacgaggacugcaucgagaaggccguccaguucuucguccaggcccuccgcauggcccccgaccacgagaaggccugcaucgccugccgcaacgccaaggcccucaaggccaagaaggaggacggcaacaaggccuucaaggagggcaacuacaagcucgccuacgagcucuacaccgaggcccucggcaucgaccccaacaacaucaagaccaacgccaagcucuacugcaaccgcggcaccgucaacuccaagcuccgcaagcucgacgacgccaucgaggacugcaccaacgccgucaagcucgacgacaccuacaucaaggccuaccuccgccgcgcccagugcuacauggacaccgagcaguacgaggaggccguccgcgacuacgagaaggucuaccagaccgagaagaccaaggagcacaagcagcuccucaagaacgcccagcucgagcucaagaaguccaagcgcaaggacuacuacaagauccucggcgucgacaagaacgccuccgaggacgagaucaagaaggccuaccgcaagcgcgcccucaugcaccaccccgaccgccacuccggcgccuccgccgagguccagaaggaggaggagaagaaguucaaggaggucggcgaggccuucaccauccucuccgaccccaagaagaagacccgcuacgacuccggccaggaccucgacgaggagggcaugaacaugggcgacuucgaccccaacaacaucuucaaggccuucuucggcggccccggcggcuucuccuucgaggccuccggccccggcaacuucuucuuccaguucggcuga

SEQ ID NO: 8448 - RNA, 1485 nt, Artificial Sequence
  derived and/or modified sequence opt3 from DNJC7__Homo_sapiens__AAH11837
auggccgcugcagccgagugcgacguggucauggcggcuaccgaacccgagcugcucgaugaccaggaagccaagagagaggcagaaacauucaaagagcaaggcaacgccuacuaugcuaagaaagauuacaaugaggcauauaacuacuauacuaaggccaucgacauguguccuaaaaaugcuagcuacuaugggaacagggccgcgacgcuuaugaugcugggacgguuucgcgaagcauugggugaugcccagcaguccguucgauuagacgauucuuucgugcguggccaccugagagaggggaagugccaucuaucacucggaaaugcuauggccgcauguaggaguuuucagcgggcucuggaacuugaccacaagaacgcccaagcgcagcaggaguucaaaaaugccaacgcaguaauggaguacgaaaagauugcugagaccgauuuugaaaaacgcgacuucagaaagguggucuuuugcauggauagggcccuggaguucgcuccagccugucaucgguuuaaaauauugaaggcagaaugccucgccaugcugggccgcuacccggaggcucagagcguggcguccgacauccugcgaauggauucuacaaaugcagacgcccucuauguuagagguuuaugucuguacuaugaggacugcauugaaaaggcugugcaauucuuuguccaggcccuuaggauggcacccgaucacgagaaagccuguaucgcuugccggaacgccaaggcauugaaagcgaagaaagaagacgggaauaaggcuuucaaagagggaaacuacaagcuggccuaugaacuauacacugaggcacucggcauugauccuaauaacaucaagaccaaugccaaacuguauuguaaccguggcacagugaacucgaaacuucgcaaacuggacgaugcuauagaggacugcaccaaugccguaaaguuggaugacacuuacaucaaagcauaccucagaagggcucagugcuauauggauacagaacaguacgaggaagccguucgggacuaugagaagguguaccaaaccgaaaagacgaaagagcauaagcagcuguuaaagaacgcgcagcuggagcucaagaaaucaaagcgaaaggauuauuacaaaauucuuggggucgacaagaaugccagcgaagacgagaucaaaaaggcuuaucgcaaaagagcacugaugcaccacccagauaggcauaguggagccuccgcugaagugcaaaaggaggaggaaaagaaauuuaaggaggugggugaagccuucacuauuuugucugaccccaaaaagaaaacccgguacgauagcggccaggaccuagaugaggaagggaugaacaugggagacuucgauccuaauaacaucuuuaaggcauucuuuggcgguccagggggauucuccuuugaggcgucaggccccggcaauuucuuuuuccaguuuggguga

SEQ ID NO: 8449 - RNA, 1485 nt, Artificial Sequence
  derived and/or modified sequence opt4 from DNJC7__Homo_sapiens__AAH11837
auggccgccgccgccgagugcgacguggugauggccgccaccgagcccgagcugcuggacgaccaggaggccaagagagaggccgagaccuucaaggagcagggcaacgccuacuacgccaagaaggacuacaacgaggccuacaacuacuacaccaaggccaucgacaugugccccaagaacgccagcuacuacggcaacagagccgccacccugaugaugcugggcagauucagagaggcccugggcgacgcccagcagagcgugagacuggacgacagcuucgugagaggccaccugagagagggcaagugccaccugagccugggcaacgccauggccgccugcagaagcuuccagagagcccuggagcuggaccacaagaacgcccaggcccagcaggaguucaagaacgccaacgccgugauggaguacgagaagaucgccgagaccgacuucgagaagagagacuucagaaaggugguguucugcauggacagagcccuggaguucgcccccgccugccacagauucaagauccugaaggccgagugccuggccaugcugggcagauaccccgaggcccagagcguggccagcgacauccugagaauggacagcaccaacgccgacgcccuguacgugagaggccugugccuguacuacgaggacugcaucgagaaggccgugcaguucuucgugcaggcccugagaauggcccccgaccacgagaaggccugcaucgccugcagaaacgccaaggcccugaaggccaagaaggaggacggcaacaaggccuucaaggagggcaacuacaagcuggccuacgagcuguacaccgaggcccugggcaucgaccccaacaacaucaagaccaacgccaagcuguacugcaacagaggcaccgugaacagcaagcugagaaagcuggacgacgccaucgaggacugcaccaacgccgugaagcuggacgacaccuacaucaaggccuaccugagaagagcccagugcuacauggacaccgagcaguacgaggaggccgugagagacuacgagaagguguaccagaccgagaagaccaaggagcacaagcagcugcugaagaacgcccagcuggagcugaagaagagcaagagaaaggacuacuacaagauccugggcguggacaagaacgccagcgaggacgagaucaagaaggccuacagaaagagagcccugaugcaccaccccgacagacacagcggcgccagcgccgaggugcagaaggaggaggagaagaaguucaaggaggugggcgaggccuucaccauccugagcgaccccaagaagaagaccagauacgacagcggccaggaccuggacgaggagggcaugaacaugggcgacuucgaccccaacaacaucuucaaggccuucuucggcggccccggcggcuucagcuucgaggccagcggccccggcaacuucuucuuccaguucggcuga

SEQ ID NO: 8450 - RNA, 1485 nt, Artificial Sequence
  derived and/or modified sequence opt5 from DNJC7__Homo_sapiens__AAH11837
auggccgcugccgcggagugcgacguggucauggcugccaccgaacccgagcugcucgaugaccaggaagccaagagagaggcugaaacauucaaagagcaaggcaacgccuacuaugcuaagaaagauuacaaugaggccuauaacuacuauacgaaggcgaucgacauguguccuaaaaaugccagcuacuaugggaaccgggcugccacccugaugaugcuuggacgcuuuagagaagcucugggcgaugcccagcaguccguucggcucgacgauucuuucgugcgcgggcaccugagagagggaaagugccaucuuagccugggcaaugcgauggccgcuugucgguccuuucagcgcgcccucgaacuggaccacaagaacgcucaagcccagcaggaguucaaaaaugccaacgcugugauggaguacgaaaagauugcggagacagauuuugaaaagagagacuuccggaaggucguguuuugcauggaucgcgcccuggaguucgcuccggccugucauagauuuaaaauccucaaggccgaaugccuggcuaugcuugggcgguaccccgaggcccagucuguugcgagcgacauucugcgcauggauuccaccaaugcugacgcccucuaugugagaggacugugucuuuacuaugaggacugcaucgaaaaggccguccaauucuuugugcaggcucugcggauggccccugaucacgagaaggcuuguauugccugccgcaacgcgaaagcccucaaagcuaagaaagaagacggcaauaaggccuucaaagagggcaacuacaagcuggcuuaugaacuguacacagaggcccucgggaucgaucccaauaacaucaagaccaaugcgaaacuguauuguaacagaggaacaguuaacucuaaacuucggaaacuggacgaugccauugaggacugcaccaaugcugugaagcucgaugacacguacaucaaagccuaccugagacgcgcucagugcuauauggauaccgaacaguacgaggaagccguccgggacuaugagaagguguaccaaacagaaaagaccaaagagcauaagcagcuucugaaaaacgcccagcucgagcugaagaaaagcaagagaaaggauuauuacaaaauucugggcguggacaagaaugcuuccgaagacgagaucaaaaaggcguaucgcaaacgggcccucaugcaccacccugauagacauagcggggcuucugccgaaguccaaaaggaggaggaaaagaaauuuaaggagguuggagaagccuucacaauucuguccgaccccaaaaagaaaacccgcuacgauagcggccaggaccuugaugaggaagggaugaacaugggagacuucgauccuaauaacaucuuuaaggcuuucuuuggcggccccgggggauucucuuuugaggccuccggcccggggaauuucuuuuuccaguuuggauga

SEQ ID NO: 8451 - protein, 253 aa, Artificial Sequence
  DNJC8__Homo_sapiens__O75937
MAASGESGTSGGGGSTEEAFMTFYSEVKQIEKRDSVLTSKNQIERLTRPGSSYFNLNPFEVLQIDPEVTDEEIKKRFRQLSILVHPDKNQDDADRAQKAFEAVDKAYKLLLDQEQKKRALDVIQAGKEYVEHTVKERKKQLKKEGKPTIVEEDDPELFKQAVYKQTMKLFAELEIKRKEREAKEMHERKRQREEEIEAQEKAKREREWQKNFEESRDGRVDSWRNFQANTKGKKEKKNRTFLRPPKVKMEQRE

SEQ ID NO: 8452 - RNA, 762 nt, Artificial Sequence
  DNJC8__Homo_sapiens__AAH33159
auggcggcuucaggagagagcgggacuucaggcggcggaggcagcaccgaggaagcauuuaugaccuucuacagugaggugaaacaaauagagaagagagacucgguucuaacuucgaaaaaucagauugaaagacugacccguccugguuccucuuacuucaauuugaacccauuugagguucuucagauagauccugaaguuacagaugaagaaauaaaaaagagguuucggcaguuauccaucuuggugcauccugacaaaaaucaagaugaugcugacagagcacaaaaggcuuuugaagcuguggacaaagcuuacaaguugcuacuggaucaggagcaaaagaagagggcccuggauguaauucaggcaggaaaagaauacguggaacacacugugaaagagcgaaaaaaacaauuaaagaaggaaggaaaaccuacaauuguagaggaggaugauccugagcuguucaaacaagcuguauauaaacagacaaugaaacucuuugcagagcuggaaauuaaaaggaaagagagagaagccaaagaaaugcaugaaaggaaacgacaaagggaagaagagauugaagcucaagaaaaagccaaacgggaaagagaguggcagaaaaacuuugaggaaagucgagauggucguguggacagcuggcgaaacuuccaagccaauacgaaggggaagaaagagaagaaaaaucggaccuuccugagaccaccgaaaguaaaaauggagcaacgugaguga

SEQ ID NO: 8453 - RNA, 762 nt, Artificial Sequence
  derived and/or modified sequence opt1 from DNJC8__Homo_sapiens__AAH33159
auggccgccagcggcgaguccgggaccagcggcgggggcggguccaccgaggaggcguucaugacguucuacagcgaggugaagcagaucgagaagcgcgacuccguccugaccagcaagaaccagaucgagcggcucacccgccccggcuccagcuacuucaaccugaaccccuucgaggugcugcagaucgaccccgaggugaccgacgaggagaucaagaagcgguuccgccagcucuccauccugguccaccccgacaagaaccaggacgacgccgaccgggcccagaaggccuucgaggccguggacaaggcguacaagcugcuccuggaccaggagcagaagaagcgcgcccuggacgugauccaggccggcaaggaguacgucgagcacacggugaaggagcggaagaagcagcucaagaaggaggggaagcccaccaucguggaggaggacgacccggagcuguucaagcaggccgucuacaagcagaccaugaagcuguucgcggagcucgagaucaagcgcaaggagcgggaggccaaggagaugcacgagcgcaagcggcagcgcgaggaggagaucgaggcccaggagaaggccaagcgggagcgcgaguggcagaagaacuucgaggagagccgggacggccgcguggacuccuggcggaacuuccaggccaacaccaaggggaagaaggagaagaagaaccgcacguuccugcggccgcccaaggugaagauggagcagcgcgaguga

SEQ ID NO: 8454 - RNA, 762 nt, Artificial Sequence
  derived and/or modified sequence opt2 from DNJC8__Homo_sapiens__AAH33159
auggccgccuccggcgaguccggcaccuccggcggcggcggcuccaccgaggaggccuucaugaccuucuacuccgaggucaagcagaucgagaagcgcgacuccguccucaccuccaagaaccagaucgagcgccucacccgccccggcuccuccuacuucaaccucaaccccuucgagguccuccagaucgaccccgaggucaccgacgaggagaucaagaagcgcuuccgccagcucuccauccucguccaccccgacaagaaccaggacgacgccgaccgcgcccagaaggccuucgaggccgucgacaaggccuacaagcuccuccucgaccaggagcagaagaagcgcgcccucgacgucauccaggccggcaaggaguacgucgagcacaccgucaaggagcgcaagaagcagcucaagaaggagggcaagcccaccaucgucgaggaggacgaccccgagcucuucaagcaggccgucuacaagcagaccaugaagcucuucgccgagcucgagaucaagcgcaaggagcgcgaggccaaggagaugcacgagcgcaagcgccagcgcgaggaggagaucgaggcccaggagaaggccaagcgcgagcgcgaguggcagaagaacuucgaggagucccgcgacggccgcgucgacuccuggcgcaacuuccaggccaacaccaagggcaagaaggagaagaagaaccgcaccuuccuccgcccccccaaggucaagauggagcagcgcgaguga

SEQ ID NO: 8455 - RNA, 762 nt, Artificial Sequence
  derived and/or modified sequence opt3 from DNJC8__Homo_sapiens__AAH33159
auggccgcuagcggcgaguccgggaccucuggagguggcgggucaacagaagaggcauucaugacuuuuuacagugaagugaagcagaucgagaaaagagacagcguccugacguccaagaaccaaauugaaaggcucacccggcccggaucuucguauuucaaucuuaacccuuuugagguucugcagauagauccagaggugacagacgaagagaucaaaaagcgcuuccgacaguugucaauuuuaguacacccggauaaaaaucaggacgaugccgaccgugcgcaaaaggcuuuugaagccguggauaaggcauacaaacugcuacucgaccaggagcagaagaaaagagcccuggaugucauccaggcuggcaaggaguauguggaacauacuguuaaagagaggaagaagcaacuuaaaaaggaagguaaacccaccauuguggaggaagacgauccugagcuguucaagcaggcagucuacaaacagacaaugaaguuguuugccgagcucgaaaucaaacggaaggagcgcgaagcuaaggagaugcacgaaagaaaaaggcagcgggaggaggaaauagaggcccaagaaaaggcgaaacgcgagcgagaauggcagaagaacuucgaggagagcagagacgggaggguggauaguuggcggaauuuucaggcaaacaccaaaggaaagaaggagaaaaagaaucguacuuuccugcgcccacccaaaguaaagauggaacaaagagaauga

SEQ ID NO: 8456 - RNA, 762 nt, Artificial Sequence
  derived and/or modified sequence opt4 from DNJC8__Homo_sapiens__AAH33159
auggccgccagcggcgagagcggcaccagcggcggcggcggcagcaccgaggaggccuucaugaccuucuacagcgaggugaagcagaucgagaagagagacagcgugcugaccagcaagaaccagaucgagagacugaccagacccggcagcagcuacuucaaccugaaccccuucgaggugcugcagaucgaccccgaggugaccgacgaggagaucaagaagagauucagacagcugagcauccuggugcaccccgacaagaaccaggacgacgccgacagagcccagaaggccuucgaggccguggacaaggccuacaagcugcugcuggaccaggagcagaagaagagagcccuggacgugauccaggccggcaaggaguacguggagcacaccgugaaggagagaaagaagcagcugaagaaggagggcaagcccaccaucguggaggaggacgaccccgagcuguucaagcaggccguguacaagcagaccaugaagcuguucgccgagcuggagaucaagagaaaggagagagaggccaaggagaugcacgagagaaagagacagagagaggaggagaucgaggcccaggagaaggccaagagagagagagaguggcagaagaacuucgaggagagcagagacggcagaguggacagcuggagaaacuuccaggccaacaccaagggcaagaaggagaagaagaacagaaccuuccugagaccccccaaggugaagauggagcagagagaguga

SEQ ID NO: 8457 - RNA, 762 nt, Artificial Sequence
  derived and/or modified sequence opt5 from DNJC8__Homo_sapiens__AAH33159
auggccgcuagcggcgaguccgggaccucuggaggcgggggaagcacagaagaggccuucaugacguuuuacuccgaagugaagcagaucgagaaaagagacucuguccugaccagcaagaaccaaauugaacggcucacacgccccggcuccucuuauuucaaucugaacccuuuugagguucuucagaucgauccggaggugaccgacgaagagauuaaaaagagauuccggcagcugagcauccucgugcaccccgauaaaaaucaggacgaugcggaccgcgcucaaaaggccuuugaagccgucgauaaggcuuacaaacugcuucuggaccaggagcagaagaaaagagcccucgaugugauucaggcugggaaggaguauguugaacauacagugaaagagcggaagaagcaacugaaaaaggaaggaaaaccuaccaucgucgaggaagacgaucccgagcuguucaagcaggccguguacaaacagacaaugaagcucuuugcggagcuggaaaucaaacgcaaggagagagaagccaaggagaugcacgaacggaaacgccagagagaggaggaaauugaggcucaagaaaaggccaaacgggagcgcgaauggcagaagaacuucgaggaguccagagacggccggguugauagcuggcgcaauuuucaggcuaacaccaaaggcaagaaggagaaaaagaauagaacguuccuucggccucccaaagugaagauggaacaaagagaauga

SEQ ID NO: 8458 - protein, 260 aa, Artificial Sequence
  DNJC9__Homo_sapiens__Q8WXX5
MGLLDLCEEVFGTADLYRVLGVRREASDGEVRRGYHKVSLQVHPDRVGEGDKEDATRRFQILGKVYSVLSDREQRAVYDEQGTVDEDSPVLTQDRDWEAYWRLLFKKISLEDIQAFEKTYKGSEEELADIKQAYLDFKGDMDQIMESVLCVQYTEEPRIRNIIQQAIDAGEVPSYNAFVKESKQKMNARKRRAQEEAKEAEMSRKELGLDEGVDSLKAAIQSRQKDRQKEMDNFLAQMEAKYCKSSKGGGKKSALKKEKK

SEQ ID NO: 8459 - RNA, 783 nt, Artificial Sequence
  DNJC9__Homo_sapiens__AAI36508
auggggcugcuggaccuuugcgaggaaguguucggcaccgccgaccuuuaccgggugcugggcgugcgacgcgaggccuccgacggcgagguccgacgaggcuaccacaaggugucccugcagguacacccggaccgggugggugagggcgacaaggaggacgccacccgccgcuuccagauccugggaaaagucuauuccguucucagugacagagaacagagagcaguguacgaugagcagggaacaguggacgaggacucuccugugcucacccaagaccgagacugggaggcguauuggcggcuacucuuuaaaaagauaucuuuagaggacauucaagcuuuugaaaagacauacaaagguucggaagaagagcuggcugauauuaagcaggccuaucuggacuucaagggugacauggaucagaucauggagucugugcuuugcgugcaguacacagaggaacccaggauaaggaauaucauucagcaagcuauugacgccggagaggucccauccuauaaugccuuugucaaagaaucgaaacaaaagaugaaugcaaggaaaaggagggcucaggaagaggccaaagaagcagaaaugagcagaaaggaguuggggcuugaugaaggcguggauagccugaaggcagccauucagagcagacaaaaggaucggcaaaaggaaauggacaauuuucuggcucagauggaagcaaaguacugcaaaucuuccaaaggaggagggaaaaaaucugcucucaagaaagaaaagaaauaa

SEQ ID NO: 8460 - RNA, 783 nt, Artificial Sequence
  derived and/or modified sequence opt1 from DNJC9__Homo_sapiens__AAI36508
augggccugcucgaccugugcgaggagguguucgggaccgccgaccuguaccgcguccucggcgugcggcgcgaggccagcgacggggaggugcggcgcggcuaccacaaggucucccuccaggugcaccccgaccgggugggggagggcgacaaggaggacgcgacccgccgguuccagauccugggcaaggucuacagcgugcucuccgaccgcgagcagcgggccguguacgacgagcaggggacggucgacgaggacagcccggugcugacccaggaccgcgacugggaggccuacuggcggcugcuguucaagaagaucucccuggaggacauccaggccuucgagaagaccuacaagggcagcgaggaggagcuggccgacaucaagcaggcguaccucgacuucaagggggacauggaccagaucauggaguccgugcugugcguccaguacaccgaggagccccgcauccggaacaucauccagcaggccaucgacgccggcgaggugcccagcuacaacgccuucgugaaggaguccaagcagaagaugaacgcgcgcaagcggcgcgcccaggaggaggccaaggaggccgagaugagccggaaggagcuggggcucgacgagggcgucgacucccugaaggccgcgauccagagccgccagaaggaccggcagaaggagauggacaacuuccuggcccagauggaggccaaguacugcaaguccagcaagggcgggggcaagaaguccgcccucaagaaggagaagaaguga

SEQ ID NO: 8461 - RNA, 783 nt, Artificial Sequence
  derived and/or modified sequence opt2 from DNJC9__Homo_sapiens__AAI36508
augggccuccucgaccucugcgaggaggucuucggcaccgccgaccucuaccgcguccucggcguccgccgcgaggccuccgacggcgagguccgccgcggcuaccacaaggucucccuccagguccaccccgaccgcgucggcgagggcgacaaggaggacgccacccgccgcuuccagauccucggcaaggucuacuccguccucuccgaccgcgagcagcgcgccgucuacgacgagcagggcaccgucgacgaggacucccccguccucacccaggaccgcgacugggaggccuacuggcgccuccucuucaagaagaucucccucgaggacauccaggccuucgagaagaccuacaagggcuccgaggaggagcucgccgacaucaagcaggccuaccucgacuucaagggcgacauggaccagaucauggaguccguccucugcguccaguacaccgaggagccccgcauccgcaacaucauccagcaggccaucgacgccggcgagguccccuccuacaacgccuucgucaaggaguccaagcagaagaugaacgcccgcaagcgccgcgcccaggaggaggccaaggaggccgagaugucccgcaaggagcucggccucgacgagggcgucgacucccucaaggccgccauccagucccgccagaaggaccgccagaaggagauggacaacuuccucgcccagauggaggccaaguacugcaaguccuccaagggcggcggcaagaaguccgcccucaagaaggagaagaaguga

SEQ ID NO: 8462 - RNA, 783 nt, Artificial Sequence
  derived and/or modified sequence opt3 from DNJC9__Homo_sapiens__AAI36508
augggccugcucgaccuuugcgaggaaguguucgggaccgccgaucuguacagagucuugggaguuaggcgggaggcuagcgacggugaagugcgccgaggcuaucacaagguauccuuacaggugcaucccgaucgugucggggagggagacaaagaagaugcaacaagaagguuucaaauccugggcaagguguacucuguucuaucagaccgggagcagcgcgccguguaugaugagcaggguacugucgacgaagauaguccugugcucacgcaggacagagauugggaggcguacuggaggcugcuuuucaaaaagauuagccuggaagacauacaggcuuuugagaaaaccuauaagggguccgaggaagaguuggccgauaucaagcaagcauaccucgacuucaaaggagacauggaucagauuauggaaucuguacuguguguucaguauacagaggaaccacggauccgcaacauuauccaacaggccauagacgcuggcgaggugccgucguacaaugcauuugucaaggagucaaaacagaagaugaacgcccgaaaaagaagggcucaggaagaggccaaggaagcggagaugagccggaaggaacugggccucgaugaggggguggacaguuuaaaagcagccauccaaucccgucagaaggaucgccagaaagagauggacaauuuccuggcucaaauggaagccaaguacugcaaaucuagcaagggagguggcaaaaaguccgcacuuaagaaagagaagaaauga

SEQ ID NO: 8463 - RNA, 783 nt, Artificial Sequence
  derived and/or modified sequence opt4 from DNJC9__Homo_sapiens__AAI36508
augggccugcuggaccugugcgaggagguguucggcaccgccgaccuguacagagugcugggcgugagaagagaggccagcgacggcgaggugagaagaggcuaccacaaggugagccugcaggugcaccccgacagagugggcgagggcgacaaggaggacgccaccagaagauuccagauccugggcaagguguacagcgugcugagcgacagagagcagagagccguguacgacgagcagggcaccguggacgaggacagccccgugcugacccaggacagagacugggaggccuacuggagacugcuguucaagaagaucagccuggaggacauccaggccuucgagaagaccuacaagggcagcgaggaggagcuggccgacaucaagcaggccuaccuggacuucaagggcgacauggaccagaucauggagagcgugcugugcgugcaguacaccgaggagcccagaaucagaaacaucauccagcaggccaucgacgccggcgaggugcccagcuacaacgccuucgugaaggagagcaagcagaagaugaacgccagaaagagaagagcccaggaggaggccaaggaggccgagaugagcagaaaggagcugggccuggacgagggcguggacagccugaaggccgccauccagagcagacagaaggacagacagaaggagauggacaacuuccuggcccagauggaggccaaguacugcaagagcagcaagggcggcggcaagaagagcgcccugaagaaggagaagaaguga

SEQ ID NO: 8464 - RNA, 783 nt, Artificial Sequence
  derived and/or modified sequence opt5 from DNJC9__Homo_sapiens__AAI36508
augggccugcucgaccugugcgaggaaguguucgggaccgccgaucuuuacagaguccugggaguucggcgcgaggcuagcgacggcgaagugagacggggguaucacaaggugucccuccagguccaucccgaucgcgugggagagggcgacaaagaagaugccacaagacgguuucaaauccuggggaagguuuacucugugcuuagcgaccgcgagcagagagcggucuaugaugagcagggaacgguggacgaagauuccccuguucugacccaggaccgggauugggaggcuuacuggcgccuccuguucaaaaagauuucucuggaagacauccaagccuuugagaaaacauauaagggcagcgaggaggaacucgccgauauuaagcaggcuuaccuggacuucaaaggcgacauggaucagaucauggaauccgugcuuuguguccaguauaccgaggaaccgcggauuagaaacaucauccaacaggccauugacgcuggggaggugcccucuuacaaugccuuugugaaggagagcaaacagaagaugaacgcgcgcaaaagacgggcccaggaagaggcuaaggaagccgagaugucccgcaaggaacugggacucgaugagggcgucgacagccugaaagcugccauccaaucuagacagaaggaucggcagaaagagauggacaauuuccuugcgcaaauggaagccaaguacugcaaauccagcaaagggggaggcaagaagucugcucugaagaaagagaagaaauga

SEQ ID NO: 8465 - protein, 428 aa, Artificial Sequence
  Elk-1__Homo_sapiens__P19419
MDPSVTLWQFLLQLLREQGNGHIISWTSRDGGEFKLVDAEEVARLWGLRKNKTNMNYDKLSRALRYYYDKNIIRKVSGQKFVYKFVSYPEVAGCSTEDCPPQPEVSVTSTMPNVAPAAIHAAPGDTVSGKPGTPKGAGMAGPGGLARSSRNEYMRSGLYSTFTIQSLQPQPPPHPRPAVVLPSAAPAGAAAPPSGSRSTSPSPLEACLEAEEAGLPLQVILTPPEAPNLKSEELNVEPGLGRALPPEVKVEGPKEELEVAGERGFVPETTKAEPEVPPQEGVPARLPAVVMDTAGQAGGHAASSPEISQPQKGRKPRDLELPLSPSLLGGPGPERTPGSGSGSGLQAPGPALTPSLLPTHTLTPVLLTPSSLPPSIHFWSTLSPIAPRSPAKLSFQFPSSGSAQVHIPSISVDGLSTPVVLSPGPQKP

SEQ ID NO: 8466 - RNA, 1287 nt, Artificial Sequence
  Elk-1__Homo_sapiens__AAH56150
auggacccaucugugacgcuguggcaguuucugcugcagcugcugagagagcaaggcaauggccacaucaucuccuggacuucacgggaugguggugaauucaagcugguggaugcagaggagguggcccggcugugggggcuacgcaagaacaagaccaacaugaauuacgacaagcucagccgggccuugcgguacuacuaugacaagaacaucauccgcaaggugagcggccagaaguucgucuacaaguuuguguccuacccugaggucgcagggugcuccacugaggacugcccgccccagccagaggugucuguuaccuccaccaugccaaauguggccccugcugcuauacaugccgccccaggggacacugucucuggaaagccaggcacacccaagggugcaggaauggcaggcccaggcgguuuggcacgcagcagccggaacgaguacaugcgcucgggccucuauuccaccuucaccauccagucucugcagccgcagccacccccucauccucggccugcuguggugcuccccagugcagcuccugcaggggcagcagcgccccccucggggagcaggagcaccaguccaagccccuuggaggccugucuggaggcugaagaggccggcuugccucugcaggucauccugaccccgcccgaggccccaaaccugaaaucggaagagcuuaauguggagccggguuugggccgggcuuugcccccagaagugaaaguagaagggcccaaggaagaguuggaaguugcgggggagagaggguuugugccagaaaccaccaaggccgagccagaagucccuccacaggagggcgugccagcccggcugcccgcgguuguuauggacaccgcagggcaggcgggcggccaugcggcuuccagcccugagaucucccagccgcagaagggccggaagccccgggaccuagagcuuccacucagcccgagccugcuaggugggccgggacccgaacggaccccaggaucgggaaguggcuccggccuccaggcuccggggccggcgcugaccccaucccugcuuccuacgcauacauugaccccggugcugcugacacccagcucgcugccuccuagcauucacuucuggagcacccugagucccauugcgccccguagcccggccaagcucuccuuccaguuuccauccaguggcagcgcccaggugcacaucccuucuaucagcguggauggccucucgacccccguggugcucuccccagggccccagaagccauga

SEQ ID NO: 8467 - RNA, 1287 nt, Artificial Sequence
  derived and/or modified sequence opt1 from Elk-1__Homo_sapiens__AAH56150
auggaccccagcgugacccuguggcaguuccuccugcagcugcuccgcgagcagggcaacgggcacaucaucuccuggaccagccgggacggcggggaguucaagcuggucgacgccgaggagguggcccgccuguggggccuccggaagaacaagacgaacaugaacuacgacaagcugucccgcgcgcugcgguacuacuacgacaagaacaucauccgcaaggugagcgggcagaaguucgucuacaaguucguguccuacccggagguggccggcugcagcaccgaggacugcccgccccagcccgaggucuccgugaccagcaccaugcccaacguggcccccgccgccauccacgcggcccccggcgacacggucuccgggaagcccggcaccccgaagggggccggcauggccgggcccggcggccucgcgcggagcucccgcaacgaguacaugcggagcgggcuguacuccaccuucaccauccagagccugcagccccagcccccgccccacccccgccccgccguggugcucccguccgccgcccccgccggcgcggccgccccgcccagcgggucccggagcacgucccccagcccccuggaggccugccuggaggccgaggaggcgggccucccccugcaggucauccugacgcccccggaggcccccaaccucaagagcgaggagcugaacguggagcccggccuggggcgcgcccugcccccggaggugaaggucgagggccccaaggaggagcuggagguggccggggagcggggcuucgugcccgagaccaccaaggccgagccggaggucccgccccaggagggggugcccgcgcgccugcccgccguggucauggacaccgccggccaggccggcgggcacgccgcguccagccccgagaucucccagccccagaagggccggaagccccgcgaccucgagcugccgcugagccccucccuccucgggggccccgggcccgagcggaccccgggcagcggcuccgggagcggccugcaggcccccgggcccgcccucacccccucccugcugccgacccacacgcucacccccgugcugcugacccccagcucccugcccccgagcauccacuucugguccacccucagccccaucgcgccccgcucccccgccaagcugagcuuccaguucccguccagcggcuccgcccaggugcacauccccagcaucagcgucgacgggcucuccacgcccgugguccugagcccgggcccccagaagcccuga

SEQ ID NO: 8468 - RNA, 1287 nt, Artificial Sequence
  derived and/or modified sequence opt2 from Elk-1__Homo_sapiens__AAH56150
auggaccccuccgucacccucuggcaguuccuccuccagcuccuccgcgagcagggcaacggccacaucaucuccuggaccucccgcgacggcggcgaguucaagcucgucgacgccgaggaggucgcccgccucuggggccuccgcaagaacaagaccaacaugaacuacgacaagcucucccgcgcccuccgcuacuacuacgacaagaacaucauccgcaaggucuccggccagaaguucgucuacaaguucgucuccuaccccgaggucgccggcugcuccaccgaggacugccccccccagcccgaggucuccgucaccuccaccaugcccaacgucgcccccgccgccauccacgccgcccccggcgacaccgucuccggcaagcccggcacccccaagggcgccggcauggccggccccggcggccucgcccgcuccucccgcaacgaguacaugcgcuccggccucuacuccaccuucaccauccagucccuccagccccagccccccccccacccccgccccgccgucguccuccccuccgccgcccccgccggcgccgccgccccccccuccggcucccgcuccaccucccccuccccccucgaggccugccucgaggccgaggaggccggccucccccuccaggucauccucaccccccccgaggcccccaaccucaaguccgaggagcucaacgucgagcccggccucggccgcgcccucccccccgaggucaaggucgagggccccaaggaggagcucgaggucgccggcgagcgcggcuucguccccgagaccaccaaggccgagcccgagguccccccccaggagggcguccccgcccgccuccccgccgucgucauggacaccgccggccaggccggcggccacgccgccuccucccccgagaucucccagccccagaagggccgcaagccccgcgaccucgagcucccccucucccccucccuccucggcggccccggccccgagcgcacccccggcuccggcuccggcuccggccuccaggcccccggccccgcccucacccccucccuccuccccacccacacccucacccccguccuccucacccccuccucccucccccccuccauccacuucugguccacccucucccccaucgccccccgcucccccgccaagcucuccuuccaguuccccuccuccggcuccgcccagguccacauccccuccaucuccgucgacggccucuccacccccgucguccucucccccggcccccagaagcccuga

SEQ ID NO: 8469 - RNA, 1287 nt, Artificial Sequence
  derived and/or modified sequence opt3 from Elk-1__Homo_sapiens__AAH56150
auggaccccagcgugacccuguggcaguuccuccuucaacuguugagagagcagggcaacgggcacaucauuuccuggacaucuagggauggaggugaauuuaaguuagucgacgccgaggaaguugcucggcuguggggccuacgcaaaaauaagacuaacaugaauuacgauaaacucucacgagcacugcguuauuacuaugacaagaacauaaucagaaaagugagugggcagaaguucguauacaaguuugugagcuauccugaggucgccggaugcuccacggaagauuguccaccgcagcccgaggugucuguuaccucgacaaugccuaauguggcgccagcugccauucaugcagcccccggcgacacugucucagguaaaccugggaccccaaagggagcuggcauggcaggccccgggggacuugccaggagcagucggaacgaguacaugcgcuccggucuguauucuacauucaccauccagagcuugcaaccucagccaccgccccacccuagaccagcugugguacuccccuccgccgcgccugcaggcgccgcugccccacccucagggaguaggagcacuucuccguccccucuggaagcaugccuggaggcugaagaggccggacuccccuuacagguuauucugacaccaccugaggcgcccaaucuuaaaucagaagaguugaacguggaaccaggccugggucgggcccuacccccugaggucaagguggaagggccaaaagaggagcucgaaguggcaggagagcgcggcuuugucccggaaaccacgaaggcugagcccgaaguuccuccacaagagggcgugcccgcccgacugccugcuguagugauggauacugccgggcaggcaggaggucaugccgcuagcaguccagagaucucucagccccagaagggcagaaaaccgagggaccuugaacugccuuuguccccaagccucuuagggggacccggcccugagcggacccccgguucggggucuggcuccggacugcaagcgccaggcccugcacugacacccucacuccuuccaacucacacccugacaccggucuugcuaaccccuaguagccugcccccauccauacauuucuggucuacgcucagccccaucgccccucguucaccagcuaagcugaguuuucaguuccccuccagcgggucugcccaggugcacauuccuucaaucaguguugauggacuuagcacuccggugguccuguccccagguccccaaaaaccuuga

SEQ ID NO: 8470 - RNA, 1287 nt, Artificial Sequence
  derived and/or modified sequence opt4 from Elk-1__Homo_sapiens__AAH56150
auggaccccagcgugacccuguggcaguuccugcugcagcugcugagagagcagggcaacggccacaucaucagcuggaccagcagagacggcggcgaguucaagcugguggacgccgaggagguggccagacuguggggccugagaaagaacaagaccaacaugaacuacgacaagcugagcagagcccugagauacuacuacgacaagaacaucaucagaaaggugagcggccagaaguucguguacaaguucgugagcuaccccgagguggccggcugcagcaccgaggacugccccccccagcccgaggugagcgugaccagcaccaugcccaacguggcccccgccgccauccacgccgcccccggcgacaccgugagcggcaagcccggcacccccaagggcgccggcauggccggccccggcggccuggccagaagcagcagaaacgaguacaugagaagcggccuguacagcaccuucaccauccagagccugcagccccagccccccccccaccccagacccgccguggugcugcccagcgccgcccccgccggcgccgccgccccccccagcggcagcagaagcaccagccccagcccccuggaggccugccuggaggccgaggaggccggccugccccugcaggugauccugaccccccccgaggcccccaaccugaagagcgaggagcugaacguggagcccggccugggcagagcccugccccccgaggugaagguggagggccccaaggaggagcuggagguggccggcgagagaggcuucgugcccgagaccaccaaggccgagcccgaggugcccccccaggagggcgugcccgccagacugcccgccguggugauggacaccgccggccaggccggcggccacgccgccagcagccccgagaucagccagccccagaagggcagaaagcccagagaccuggagcugccccugagccccagccugcugggcggccccggccccgagagaacccccggcagcggcagcggcagcggccugcaggcccccggccccgcccugacccccagccugcugcccacccacacccugacccccgugcugcugacccccagcagccugccccccagcauccacuucuggagcacccugagccccaucgcccccagaagccccgccaagcugagcuuccaguuccccagcagcggcagcgcccaggugcacauccccagcaucagcguggacggccugagcacccccguggugcugagccccggcccccagaagcccuga

SEQ ID NO: 8471 - RNA, 1287 nt, Artificial Sequence
  derived and/or modified sequence opt5 from Elk-1__Homo_sapiens__AAH56150
auggaccccagcgugacccuguggcaguuccuccugcaacuucugagagagcagggcaacgggcacaucauuuccuggacaucucgggauggaggcgaauuuaagcucgucgacgccgaggaaguugcucgccugugggggcuucggaaaaauaagacgaacaugaauuacgauaaacugagcagagcccuccgcuauuacuaugacaagaacaucauuagaaaaguguccggacagaaguucguguacaaguuugucucuuauccugagguggcgggcugcagcaccgaagauuguccgccccagccugagguuuccgugacaucuaccaugcccaaugucgcuccugccgccauccaugcugcccccggggacacagugagcggaaaaccuggcaccccgaagggcgcugggauggccggacccggcgggcuggcgcgguccagccgcaacgaguacaugagaucuggacuguauuccacauucaccauucaaagccuccagccucagcccccuccccacccgcggccugccguugugcugcccucugcugccccugcuggcgccgcggccccucccuccgggagccgcucuacgucccccagcccgcuugaggcuugccuggaggccgaagaggcuggacucccccugcaggucauccuuaccccucccgaggccccuaaucugaaauccgaagaacucaacguggaacccggccugggcagagcccugccgccugaggugaaggucgaagggcccaaagaggagcucgaaguugcuggagagcggggcuuugugccugaaacaaccaaggcggagcccgaagugccuccccaagagggggucccggcccgccugccugcugugguuauggauacagccggacaggccggcgggcaugcugccucuagccccgagaucucccagccccagaagggaagaaaaccucgggaccuugaacugccgcucagccccucucugcuuggcggcccugggcccgagcgcaccccuggauccggcagcgggucuggacugcaagcgcccggcccugcucucacgcccagccugcugccgacacacacccucacaccugugcugcuuacccccuccucucugccucccagcauucauuucugguccacccucagcccgaucgccccuagaucucccgccaagcuguccuuucaguucccuagcucuggguccgcucagguccacauucccagcaucuccguggauggccuuucuacacccguugugcugagcccuggaccgcaaaaacccuga

SEQ ID NO: 8472 - protein, 121 aa, Artificial Sequence
  Elk-1__Homo_sapiens__Q8N9S0
MDTAGQAGGHAASSPEISQPQKGRKPRDLELPLSPSLLGGPGPERTPSLLPTHTLTPVLLTPSSLPPSIHFWSTLSPIAPRSPAKLSFQFPSSGSAQVHIPSISVDGLSTPVVLSPGPQKP

SEQ ID NO: 8473 - RNA, 366 nt, Artificial Sequence
  Elk-1__Homo_sapiens__BAC04259
auggacaccgcagggcaggcgggcggccaugcggcuuccagcccugagaucucccagccgcagaagggccggaagccccgggaccuagagcuuccacucagcccgagccugcuaggugggccgggacccgaacggaccccaucccugcuuccuacgcauacauugaccccggugcugcugacacccagcucgcugccuccuagcauucacuucuggagcacccugagucccauugcgccccguagcccggccaagcucuccuuccaguuuccauccaguggcagcgcccaggugcacaucccuucuaucagcguggauggccucucgacccccguggugcucuccccagggccccagaagccauga

SEQ ID NO: 8474 - RNA, 366 nt, Artificial Sequence
  derived and/or modified sequence opt1 from Elk-1__Homo_sapiens__BAC04259
auggacaccgccggccaggccgggggccacgccgccagcucccccgagaucagccagccgcagaaggggcgcaagccccgggaccuggagcucccccugucccccagccugcucggcgggccgggccccgagcgcacccccucccugcugcccacgcacacccucaccccggugcugcugacccccagcucccucccgcccagcauccacuucugguccacgcugagccccaucgcgccccggucccccgccaagcugagcuuccaguuccccuccagcggcuccgcccagguccacaucccgagcaucuccguggacgggcucagcacccccgugguccugucccccggcccccagaagccguga

SEQ ID NO: 8475 - RNA, 366 nt, Artificial Sequence
  derived and/or modified sequence opt2 from Elk-1__Homo_sapiens__BAC04259
auggacaccgccggccaggccggcggccacgccgccuccucccccgagaucucccagccccagaagggccgcaagccccgcgaccucgagcucccccucucccccucccuccucggcggccccggccccgagcgcacccccucccuccuccccacccacacccucacccccguccuccucacccccuccucccucccccccuccauccacuucugguccacccucucccccaucgccccccgcucccccgccaagcucuccuuccaguuccccuccuccggcuccgcccagguccacauccccuccaucuccgucgacggccucuccacccccgucguccucucccccggcccccagaagcccuga

SEQ ID NO: 8476 - RNA, 366 nt, Artificial Sequence
  derived and/or modified sequence opt3 from Elk-1__Homo_sapiens__BAC04259
auggacaccgccggccaggcugggggacacgcagccagcucccccgagaucucucaaccucagaaggguagaaaaccaagggaucuggaacucccgcuuucacccagucuguugggcgggccuggaccagagcggacacccagcuuacugccuacucauacgcuaaccccagugcuccugacacccuccucucuuccuccaucgauucacuucuggucaacucugagcccgauagcgccccgcaguccugcuaaguuguccuuucaguucccaucuagcggcuccgcccagguccauauccccucaauuaguguugacggucucagcaccccugugguacugucuccagggccccaaaaaccguga

SEQ ID NO: 8477 - RNA, 366 nt, Artificial Sequence
  derived and/or modified sequence opt4 from Elk-1__Homo_sapiens__BAC04259
auggacaccgccggccaggccggcggccacgccgccagcagccccgagaucagccagccccagaagggcagaaagcccagagaccuggagcugccccugagccccagccugcugggcggccccggccccgagagaacccccagccugcugcccacccacacccugacccccgugcugcugacccccagcagccugccccccagcauccacuucuggagcacccugagccccaucgcccccagaagccccgccaagcugagcuuccaguuccccagcagcggcagcgcccaggugcacauccccagcaucagcguggacggccugagcacccccguggugcugagccccggcccccagaagcccuga

SEQ ID NO: 8478 - RNA, 366 nt, Artificial Sequence
  derived and/or modified sequence opt5 from Elk-1__Homo_sapiens__BAC04259
auggacaccgccggccaggcugggggacacgccgcgagcucccccgagaucucucaaccucagaagggcagaaaaccgcgggaucuggaacucccccugagcccuucccuucucgggggacccggcccugagcgcacacccucucugcugccuacgcauacccuuacaccggugcugcucacccccagcucccugccucccucuauucacuucuggagcacacuguccccuaucgcucccagaagcccggccaagcucucuuuucaguucccuuccagcgggucugcccagguccauauucccuccaucagcguugacggacugucuaccccuguggugcuuucccccggcccccaaaaaccuuga

SEQ ID NO: 8479 - protein, 379 aa, Artificial Sequence
  ERK1__Homo_sapiens__P27361
MAAAAAQGGGGGEPRRTEGVGPGVPGEVEMVKGQPFDVGPRYTQLQYIGEGAYGMVSSAYDHVRKTRVAIKKISPFEHQTYCQRTLREIQILLRFRHENVIGIRDILRASTLEAMRDVYIVQDLMETDLYKLLKSQQLSNDHICYFLYQILRGLKYIHSANVLHRDLKPSNLLINTTCDLKICDFGLARIADPEHDHTGFLTEYVATRWYRAPEIMLNSKGYTKSIDIWSVGCILAEMLSNRPIFPGKHYLDQLNHILGILGSPSQEDLNCIINMKARNYLQSLPSKTKVAWAKLFPKSDSKALDLLDRMLTFNPNKRITVEEALAHPYLEQYYDPTDEPVAEEPFTFAMELDDLPKERLKELIFQETARFQPGVLEAP

SEQ ID NO: 8480 - RNA, 1140 nt, Artificial Sequence
  ERK1__Homo_sapiens__AAH13992
auggcggcggcggcggcucaggggggcgggggcggggagccccguagaaccgagggggucggcccgggggucccgggggagguggagauggugaaggggcagccguucgacgugggcccgcgcuacacgcaguugcaguacaucggcgagggcgcguacggcauggucagcucggccuaugaccacgugcgcaagacucgcguggccaucaagaagaucagccccuucgaacaucagaccuacugccagcgcacgcuccgggagauccagauccugcugcgcuuccgccaugagaaugucaucggcauccgagacauucugcgggcguccacccuggaagccaugagagaugucuacauugugcaggaccugauggagacugaccuguacaaguugcugaaaagccagcagcugagcaaugaccauaucugcuacuuccucuaccagauccugcggggccucaaguacauccacuccgccaacgugcuccaccgagaucuaaagcccuccaaccugcucaucaacaccaccugcgaccuuaagauuugugauuucggccuggcccggauugccgauccugagcaugaccacaccggcuuccugacggaguauguggcuacgcgcugguaccgggccccagagaucaugcugaacuccaagggcuauaccaaguccaucgacaucuggucugugggcugcauucuggcugagaugcucucuaaccggcccaucuucccuggcaagcacuaccuggaucagcucaaccacauucugggcauccugggcuccccaucccaggaggaccugaauuguaucaucaacaugaaggcccgaaacuaccuacagucucugcccuccaagaccaagguggcuugggccaagcuuuuccccaagucagacuccaaagcccuugaccugcuggaccggauguuaaccuuuaaccccaauaaacggaucacaguggaggaagcgcuggcucaccccuaccuggagcaguacuaugacccgacggaugagccaguggccgaggagcccuucaccuucgccauggagcuggaugaccuaccuaaggagcggcugaaggagcucaucuuccaggagacagcacgcuuccagcccggagugcuggaggcccccuag

SEQ ID NO: 8481 - RNA, 1140 nt, Artificial Sequence
  derived and/or modified sequence opt1 from ERK1__Homo_sapiens__AAH13992
auggccgccgcggccgcccagggcgggggcgggggcgagccccgccggaccgagggggugggcccgggcguccccggggagguggagauggugaagggccagcccuucgacgucgggccccgcuacacccagcugcaguacaucggcgagggggccuacggcauggugagcuccgccuacgaccacgugcggaagacgcgcgucgcgaucaagaagaucagcccguucgagcaccagaccuacugccagcggacccuccgcgagauccagauccugcugcgguuccgccacgagaacgugaucggcauccgggacauccuccgcgccuccacccuggaggccaugcgggacguguacaucguccaggaccugauggagacggaccucuacaagcugcucaagagccagcagcucuccaacgaccacaucugcuacuuccuguaccagauccugcgcgggcucaaguacauccacagcgccaacgugcugcaccgggaccugaagcccuccaaccuccugaucaacacgaccugcgaccugaagaucugcgacuucggccucgcgcgcaucgccgaccccgagcacgaccacaccggguuccugaccgaguacguggccacccggugguaccgcgcccccgagaucaugcugaacagcaagggcuacaccaaguccaucgacaucuggagcgucggcugcauccucgccgagaugcuguccaaccggccgaucuuccccgggaagcacuaccuggaccagcucaaccacauccugggcauccuggggagccccucccaggaggaccucaacugcaucaucaacaugaaggcgcgcaacuaccugcagagccugcccuccaagaccaagguggccugggccaagcuguuccccaagagcgacuccaaggcccuggaccugcucgaccggaugcugacguucaacccgaacaagcgcaucaccguggaggaggcccuggcgcaccccuaccucgagcaguacuacgaccccaccgacgagccggucgccgaggagcccuucaccuucgccauggagcuggacgaccugcccaaggagcggcucaaggagcugaucuuccaggagacggcccgcuuccagcccggcgugcuggaggccccguga

SEQ ID NO: 8482 - RNA, 1140 nt, Artificial Sequence
  derived and/or modified sequence opt2 from ERK1__Homo_sapiens__AAH13992
auggccgccgccgccgcccagggcggcggcggcggcgagccccgccgcaccgagggcgucggccccggcguccccggcgaggucgagauggucaagggccagcccuucgacgucggcccccgcuacacccagcuccaguacaucggcgagggcgccuacggcauggucuccuccgccuacgaccacguccgcaagacccgcgucgccaucaagaagaucucccccuucgagcaccagaccuacugccagcgcacccuccgcgagauccagauccuccuccgcuuccgccacgagaacgucaucggcauccgcgacauccuccgcgccuccacccucgaggccaugcgcgacgucuacaucguccaggaccucauggagaccgaccucuacaagcuccucaagucccagcagcucuccaacgaccacaucugcuacuuccucuaccagauccuccgcggccucaaguacauccacuccgccaacguccuccaccgcgaccucaagcccuccaaccuccucaucaacaccaccugcgaccucaagaucugcgacuucggccucgcccgcaucgccgaccccgagcacgaccacaccggcuuccucaccgaguacgucgccacccgcugguaccgcgcccccgagaucaugcucaacuccaagggcuacaccaaguccaucgacaucugguccgucggcugcauccucgccgagaugcucuccaaccgccccaucuuccccggcaagcacuaccucgaccagcucaaccacauccucggcauccucggcucccccucccaggaggaccucaacugcaucaucaacaugaaggcccgcaacuaccuccagucccuccccuccaagaccaaggucgccugggccaagcucuuccccaaguccgacuccaaggcccucgaccuccucgaccgcaugcucaccuucaaccccaacaagcgcaucaccgucgaggaggcccucgcccaccccuaccucgagcaguacuacgaccccaccgacgagcccgucgccgaggagcccuucaccuucgccauggagcucgacgaccuccccaaggagcgccucaaggagcucaucuuccaggagaccgcccgcuuccagcccggcguccucgaggcccccuga

SEQ ID NO: 8483 - RNA, 1140 nt, Artificial Sequence
  derived and/or modified sequence opt3 from ERK1__Homo_sapiens__AAH13992
auggccgcugcagccgcgcagggcgggggagguggcgagcccagaaggaccgaaggggugggaccuggcgucccaggugagguugaaauggugaaggggcaaccguucgacguaggaccccgguacacacagcugcaguauaucggcgagggcgcuuacgggauggugagcuccgccuaugaucacguccgcaaaacucgaguggcaauuaagaaaauaucuccuuuugaacaucagacguacugccaacguacccucagagagauccagauucuucugagguuccggcacgagaacguuaucgguauucgcgacaucuugagagccucaacauuagaagcuaugagggauguguauauaguccaggaccugauggagacugaucuauacaagcuccugaaaagucagcaacuuagcaaugaccauaucuguuauuuucuguaccagauuuugcggggacucaaguacauccacuccgcaaacgugcugcaucgcgaucugaagccaucuaaucucuuaauuaacaccacaugcgaccugaaaaucugugauuucggccuugcccgaauagcugaccccgaacacgaucacaccggguuuuugacugaguauguagccacaagaugguacagggcgccugagauuauguuaaauucgaagggauauaccaaaucaaucgacauuuggagcguuggcugcauccuagcagaaaugcucaguaaccggccaaucuuccccgguaagcauuaccuggaucagcuuaaucacauucuggggauauugggauccccuucucaggaggaccucaacuguaucauuaauaugaaagcccguaacuaucugcaaagccugccauccaagacgaagguggcuugggccaaacuguuuccgaagucagacaguaaagcacucgaucuucuggaccgcauguugacuuucaaucccaacaagagaaucaccgucgaagaggcucuagcccauccuuaccuggaacaguauuacgauccaacagacgagcccguggcggaggaaccuuuuacuuucgccauggagcucgaugaccugccaaaagaaaggcuuaaggagcugauauuucaggaaaccgcacgguuccaacccggcguguuggaggcuccguga

SEQ ID NO: 8484 - RNA, 1140 nt, Artificial Sequence
  derived and/or modified sequence opt4 from ERK1__Homo_sapiens__AAH13992
auggccgccgccgccgcccagggcggcggcggcggcgagcccagaagaaccgagggcgugggccccggcgugcccggcgagguggagauggugaagggccagcccuucgacgugggccccagauacacccagcugcaguacaucggcgagggcgccuacggcauggugagcagcgccuacgaccacgugagaaagaccagaguggccaucaagaagaucagccccuucgagcaccagaccuacugccagagaacccugagagagauccagauccugcugagauucagacacgagaacgugaucggcaucagagacauccugagagccagcacccuggaggccaugagagacguguacaucgugcaggaccugauggagaccgaccuguacaagcugcugaagagccagcagcugagcaacgaccacaucugcuacuuccuguaccagauccugagaggccugaaguacauccacagcgccaacgugcugcacagagaccugaagcccagcaaccugcugaucaacaccaccugcgaccugaagaucugcgacuucggccuggccagaaucgccgaccccgagcacgaccacaccggcuuccugaccgaguacguggccaccagaugguacagagcccccgagaucaugcugaacagcaagggcuacaccaagagcaucgacaucuggagcgugggcugcauccuggccgagaugcugagcaacagacccaucuuccccggcaagcacuaccuggaccagcugaaccacauccugggcauccugggcagccccagccaggaggaccugaacugcaucaucaacaugaaggccagaaacuaccugcagagccugcccagcaagaccaagguggccugggccaagcuguuccccaagagcgacagcaaggcccuggaccugcuggacagaaugcugaccuucaaccccaacaagagaaucaccguggaggaggcccuggcccaccccuaccuggagcaguacuacgaccccaccgacgagcccguggccgaggagcccuucaccuucgccauggagcuggacgaccugcccaaggagagacugaaggagcugaucuuccaggagaccgccagauuccagcccggcgugcuggaggcccccuga

SEQ ID NO: 8485 - RNA, 1140 nt, Artificial Sequence
  derived and/or modified sequence opt5 from ERK1__Homo_sapiens__AAH13992
auggccgcugccgcggcucagggcgggggaggcggggagcccagacggaccgaaggagugggcccuggggucccgggagagguugaaauggugaagggccaacccuucgacgugggcccucgcuacacacagcugcaguauaucggggagggagccuacggcauggucagcuccgccuaugaucacgugagaaaaacgcggguugcuauuaagaaaaucucucccuuugaacaucagaccuacugccaacgcacacucagagagauucagauccugcuucgguuccgccacgagaacgugauugggaucagagacauccugcgggccagcacccucgaagcuaugcgcgaugucuauauugugcaggaccugauggagacagaucuuuacaagcugcucaaaucccagcaacugucuaaugaccauaucuguuauuuucuguaccagauucucagaggacugaaguacauccacagcgccaacguucuucaucgggaucugaagccuuccaaucuccugauuaacaccacaugcgaccuuaaaaucugugauuucggccuggcgcgcauugccgaccccgaacacgaucacaccggguuucucacggaguauguggcuaccagaugguaccgggccccugagaucaugcucaauucuaagggauauacaaaaagcaucgacauuugguccgucggcugcauccuggcugaaaugcugagcaaccgcccgauuuuccccggcaagcauuaccuggaucagcuuaaucacauccuggggauucucggaucuccuucccaggaggaccugaacuguaucaucaauaugaaagccagaaacuaucuucaaagccugcccucuaagaccaagguggcgugggccaaacucuuuccuaaguccgacagcaaagcucuggaucugcucgaccggaugcugacauucaaucccaacaagagaauuaccguggaagaggcccuugcucauccguaccuggaacaguauuacgauccuacggacgagcccgucgccgaggaaccuuuuacauucgccauggagcucgaugaccugcccaaagaacgccuuaaggagcugaucuuucaggaaaccgcucgguuccaacccggcguucucgaggcgccuuga

SEQ ID NO: 8486 - protein, 360 aa, Artificial Sequence [sequence omitted]

SEQ ID NO: 8487 - RNA, 1083 nt, Artificial Sequence
  ERK2__Homo_sapiens__AAA58459
auggcggcggcggcggcggcgggcgcgggcccggagaugguccgcgggcagguguucgacguggggccgcgcuacaccaaccucucguacaucggcgagggcgccuacggcauggugugcucugcuuaugauaaugucaacaaaguucgaguagcuaucaagaaaaucagccccuuugagcaccagaccuacugccagagaacccugagggagauaaaaaucuuacugcgcuucagacaugagaacaucauuggaaucaaugacauuauucgagcaccaaccaucgagcaaaugaaagauguauauauaguacaggaccucauggaaacagaucuuuacaagcucuugaagacacaacaccucagcaaugaccauaucugcuauuuucucuaccagauccucagaggguuaaaauauauccauucagcuaacguucugcaccgugaccucaagccuuccaaccugcugcucaacaccaccugugaucucaagaucugugacuuuggccuggcccguguugcagauccagaccaugaucacacaggguuccugacagaauauguggccacacguugguacagggcuccagaaauuauguugaauuccaagggcuacaccaaguccauugauauuuggucuguaggcugcauucuggcagaaaugcuuuccaacaggcccaucuuuccagggaagcauuaucuugaccagcugaaucacauuuuggguauucuuggauccccaucacaagaagaccugaauuguauaauaaauuuaaaagcuaggaacuauuugcuuucucuuccacacaaaaauaaggugccauggaacaggcuguucccaaaugcugacuccaaagcucuggacuuauuggacaaaauguugacauucaacccacacaagaggauugaaguagaacaggcucuggcccacccauaucuggagcaguauuacgacccgagugacgagcccaucgccgaagcaccauucaaguucgacauggaauuggaugacuugccuaaggaaaagcuaaaagaacuaauuuuugaagagacugcuagauuccagccaggauacagaucuuaa

SEQ ID NO: 8488 - RNA, 1083 nt, Artificial Sequence
  derived and/or modified sequence opt1 from ERK2__Homo_sapiens__AAA58459
auggccgccgcggccgccgccggcgccgggcccgagauggugcgcggccaggucuucgacguggggccgcgguacaccaaccugagcuacaucggcgagggggcguacggcauggugugcuccgccuacgacaacgucaacaaggugcgcguggccaucaagaagaucagccccuucgagcaccagaccuacugccagcggacgcuccgcgagaucaagauccugcugcgguuccgccacgagaacaucaucggcaucaacgacaucauccgggcccccaccaucgagcagaugaaggacgucuacaucgugcaggaccucauggagaccgaccuguacaagcugcucaagacccagcaccuguccaacgaccacaucugcuacuuccuguaccagauccuccgcgggcugaaguacauccacagcgcgaacgugcugcaccgggaccucaagcccuccaaccugcugcucaacacgaccugcgaccugaagaucugcgacuucggccuggcccgcgucgccgacccggaccacgaccacaccggguuccucaccgaguacguggccacgcggugguaccgcgcccccgagaucaugcugaacagcaagggcuacaccaaguccaucgacaucuggagcguggggugcauccuggcggagaugcucuccaaccggcccaucuuccccggcaagcacuaccuggaccagcugaaccacauccucggcauccuggggagcccgucccaggaggaccugaacugcaucaucaaccucaaggcccgcaacuaccugcugagccucccccacaagaacaagguccccuggaaccggcuguuccccaacgccgacuccaaggcccuggaccuccuggacaagaugcugaccuucaacccgcacaagcgcaucgagguggagcaggcccucgcgcaccccuaccuggagcaguacuacgaccccagcgacgagcccaucgccgaggccccguucaaguucgacauggagcuggacgaccuccccaaggagaagcugaaggagcugaucuucgaggagaccgcccgguuccagcccggcuaccgcuccuga

SEQ ID NO: 8489 - RNA, 1083 nt, Artificial Sequence
  derived and/or modified sequence opt2 from ERK2__Homo_sapiens__AAA58459
auggccgccgccgccgccgccggcgccggccccgagaugguccgcggccaggucuucgacgucggcccccgcuacaccaaccucuccuacaucggcgagggcgccuacggcauggucugcuccgccuacgacaacgucaacaagguccgcgucgccaucaagaagaucucccccuucgagcaccagaccuacugccagcgcacccuccgcgagaucaagauccuccuccgcuuccgccacgagaacaucaucggcaucaacgacaucauccgcgcccccaccaucgagcagaugaaggacgucuacaucguccaggaccucauggagaccgaccucuacaagcuccucaagacccagcaccucuccaacgaccacaucugcuacuuccucuaccagauccuccgcggccucaaguacauccacuccgccaacguccuccaccgcgaccucaagcccuccaaccuccuccucaacaccaccugcgaccucaagaucugcgacuucggccucgcccgcgucgccgaccccgaccacgaccacaccggcuuccucaccgaguacgucgccacccgcugguaccgcgcccccgagaucaugcucaacuccaagggcuacaccaaguccaucgacaucugguccgucggcugcauccucgccgagaugcucuccaaccgccccaucuuccccggcaagcacuaccucgaccagcucaaccacauccucggcauccucggcucccccucccaggaggaccucaacugcaucaucaaccucaaggcccgcaacuaccuccucucccucccccacaagaacaagguccccuggaaccgccucuuccccaacgccgacuccaaggcccucgaccuccucgacaagaugcucaccuucaacccccacaagcgcaucgaggucgagcaggcccucgcccaccccuaccucgagcaguacuacgaccccuccgacgagcccaucgccgaggcccccuucaaguucgacauggagcucgacgaccuccccaaggagaagcucaaggagcucaucuucgaggagaccgcccgcuuccagcccggcuaccgcuccuga

SEQ ID NO: 8490 - RNA, 1083 nt, Artificial Sequence
  derived and/or modified sequence opt3 from ERK2__Homo_sapiens__AAA58459
auggccgcugcagccgcggcuggcgccgggcccgagauggugagaggacaggucuucgacguugguccuagguacaccaaccugagcuauaucggcgaaggggcauacggaauggugugcuccgccuaugauaauguaaacaaggugcgggucgcuauuaaaaagauaucuccauuugagcaccaaacauacugucagcgcacucuccgagaaaucaaaauucuucugcguuucagacaugagaauaucauuggcaucaacgacauaaucagggcaccgacgauugaacagaugaaggauguguauaucguucaggacuugauggagaccgauuuauacaaacugcuaaagacacaacaccucucaaaugaccauauuugcuauuuucuguaccagauccuucggggucugaaguacauacacagugccaacguguugcaucgcgaucucaaacccagcaaucugcugcucaacacuaccugugacuuaaagauuugcgauuucgggcuggcuagagucgccgacccugaucacgaccacacaggauuucuuaccgaguauguggcgacuaggugguaccgggcaccagaaaucauguugaacuccaaaggcuauacaaagucuauugauaucuggucgguaggcuguauccuggccgagaugcuaucaaaucgccccauuuucccugggaaacauuaccucgaccagcugaaucacauacuuggaauccuggguagcccaagucaggaagacuugaacugcauuaucaaucucaaggcucgaaacuaucuguuaucccugccccauaagaauaaaguuccuuggaacagacucuuuccaaacgccgauucuaaggcacuugaccuguuggauaaaaugcuaaccuucaauccgcacaagaggauagagguggagcaagcucuggcccaccccuaccucgaacaguauuacgacccuagcgaugagccaauugcggaagcccccuuuaaauucgacauggagcuggaugaccuuccuaaggaaaaacugaaggaguugaucuuugaggaaacggcacgguuccagccaggcuaccguuccuga

SEQ ID NO: 8491 - RNA, 1083 nt, Artificial Sequence
  derived and/or modified sequence opt4 from ERK2__Homo_sapiens__AAA58459
auggccgccgccgccgccgccggcgccggccccgagauggugagaggccagguguucgacgugggccccagauacaccaaccugagcuacaucggcgagggcgccuacggcauggugugcagcgccuacgacaacgugaacaaggugagaguggccaucaagaagaucagccccuucgagcaccagaccuacugccagagaacccugagagagaucaagauccugcugagauucagacacgagaacaucaucggcaucaacgacaucaucagagcccccaccaucgagcagaugaaggacguguacaucgugcaggaccugauggagaccgaccuguacaagcugcugaagacccagcaccugagcaacgaccacaucugcuacuuccuguaccagauccugagaggccugaaguacauccacagcgccaacgugcugcacagagaccugaagcccagcaaccugcugcugaacaccaccugcgaccugaagaucugcgacuucggccuggccagaguggccgaccccgaccacgaccacaccggcuuccugaccgaguacguggccaccagaugguacagagcccccgagaucaugcugaacagcaagggcuacaccaagagcaucgacaucuggagcgugggcugcauccuggccgagaugcugagcaacagacccaucuuccccggcaagcacuaccuggaccagcugaaccacauccugggcauccugggcagccccagccaggaggaccugaacugcaucaucaaccugaaggccagaaacuaccugcugagccugccccacaagaacaaggugcccuggaacagacuguuccccaacgccgacagcaaggcccuggaccugcuggacaagaugcugaccuucaacccccacaagagaaucgagguggagcaggcccuggcccaccccuaccuggagcaguacuacgaccccagcgacgagcccaucgccgaggcccccuucaaguucgacauggagcuggacgaccugcccaaggagaagcugaaggagcugaucuucgaggagaccgccagauuccagcccggcuacagaagcuga

SEQ ID NO: 8492 - RNA, 1083 nt, Artificial Sequence
  derived and/or modified sequence opt5 from ERK2__Homo_sapiens__AAA58459
auggccgcugccgcggcugccggcgccgggcccgagauggugagaggacaggucuucgacguuggcccucgguacaccaaccugagcuauaucggggaaggagcuuacggcauggugugcuccgccuaugauaaugugaacaagguccgcguggcuauuaaaaagaucucuccguuugagcaccaaacauacugucagagaacgcuccgggaaauuaaaauccugcuucgcuucagacaugagaauauuaucgggaucaacgacauuauccgggcccccaccauugaacagaugaaggauguuuauaucgugcaggaccugauggagacagaucucuacaaacugcuuaagacccaacaccugagcaaugaccauauuugcuauuuucucuaccagauccugcgcggacugaaguacauucacuccgcgaacguccuccauagagaucugaaaccuucuaaucuucugcucaacacaaccugugaccugaagaucugcgauuucggccuugcccggguggcugaccccgaucacgaccacacaggcuuucugaccgaguauguugccacgcgcugguacagagcuccugaaaucaugcucaauagcaaaggguauaccaaguccauugauaucuggucugugggauguauucuggccgagaugcugagcaaccggcccaucuucccuggcaaacauuaccucgaccagcugaaucacauucuugggauccugggauccccgagccaggaagaccucaacugcaucauuaaucugaaggcgcgcaacuaucuucugucucucccccauaagaauaaagucccuuggaacagacuguuucccaacgccgauuccaaggcucuggaccuccuggauaaaaugcuuacauucaauccucacaagcggaucgagguggagcaagcccuggcucaccccuaccucgaacaguauuacgacccgagcgaugagccuauugccgaagcccccuuuaaauucgacauggagcuggaugaccuuccuaaggaaaaacugaaggagcucaucuuugaggaaaccgcucgcuuccagcccggcuacagaucuuga

SEQ ID NO: 8493 - protein, 22 aa, Artificial Sequence
  Fibrinogen__Homo_sapiens__A0A024R8B4
MGGAAQLEDRPRDKPQTNQPRC

SEQ ID NO: 8494 - RNA, 69 nt, Artificial Sequence
  Fibrinogen__Homo_sapiens__EAW87951
augggcggcgcugcccaacuugaggaccggccgcgcgacaagccgcagacaaaucagccccguugcuga

SEQ ID NO: 8495 - RNA, 69 nt, Artificial Sequence
  derived and/or modified sequence opt1 from Fibrinogen__Homo_sapiens__EAW87951
augggcggggccgcccagcuggaggaccgcccccgggacaagccgcagaccaaccagccccgcugcuga

SEQ ID NO: 8496 - RNA, 69 nt, Artificial Sequence
  derived and/or modified sequence opt2 from Fibrinogen__Homo_sapiens__EAW87951
augggcggcgccgcccagcucgaggaccgcccccgcgacaagccccagaccaaccagccccgcugcuga

SEQ ID NO: 8497 - RNA, 69 nt, Artificial Sequence
  derived and/or modified sequence opt3 from Fibrinogen__Homo_sapiens__EAW87951
augggcggggccgcucagcuggaggacagacccagggauaagccucaaaccaaccagccacggugcuga

SEQ ID NO: 8498 - RNA, 69 nt, Artificial Sequence
  derived and/or modified sequence opt4 from Fibrinogen__Homo_sapiens__EAW87951
augggcggcgccgcccagcuggaggacagacccagagacaagccccagaccaaccagcccagaugcuga

SEQ ID NO: 8499 - RNA, 69 nt, Artificial Sequence
  derived and/or modified sequence opt5 from Fibrinogen__Homo_sapiens__EAW87951
augggcggggccgcucagcuggaggacagaccccgggauaagccucaaaccaaccagccgcgcugcuga

SEQ ID NO: 8500 - protein, 439 aa, Artificial Sequence
  Fibrinogen__Homo_sapiens__A4D1B8
MKLANWYWLSSAVLATYGFLVVANNETEEIKDERAKDVCPVRLESRGKCEEAGECPYQVSLPPLTIQLPKQFSRIEEVFKEVQNLKEIVNSLKKSCQDCKLQADDNGDPGRNGLLLPSTGAPGEVGDNRVRELESEVNKLSSELKNAKEEINVLHGRLEKLNLVNMNNIENYVDSKVANLTFVVNSLDGKCSKCPSQEQIQSRPVQHLIYKDCSDYYAIGKRSSETYRVTPDPKNSSFEVYCDMETMGGGWTVLQARLDGSTNFTRTWQDYKAGFGNLRREFWLGNDKIHLLTKSKEMILRIDLEDFNGVELYALYDQFYVANEFLKYRLHVGNYNGTAGDALRFNKHYNHDLKFFTTPDKDNDRYPSGNCGLYYSSGWWFDACLSANLNGKYYHQKYRGVRNGIFWGTWPGVSEAHPGGYKSSFKEAKMMIRPKHFKP

SEQ ID NO: 8501 - RNA, 1320 nt, Artificial Sequence
  Fibrinogen__Homo_sapiens__BAG35554
augaagcuggcuaacugguacuggcugagcucagcuguucuugccacuuacgguuuuuugguuguggcaaacaaugaaacagaggaaauuaaagaugaaagagcaaaggaugucugcccagugagacuagaaagcagagggaaaugcgaagaggcaggggagugccccuaccagguaagccugccccccuugacuauucagcucccgaagcaauucagcaggaucgaggagguguucaaagaaguccaaaaccucaaggaaaucguaaauagucuaaagaaaucuugccaagacugcaagcugcaggcugaugacaacggagacccaggcagaaacggacuguuguuacccaguacaggagccccgggagagguuggugauaacagaguuagagaauuagagagugagguuaacaagcuguccucugagcuaaagaaugccaaagaggagaucaauguacuucauggucgccuggagaagcugaaucuuguaaauaugaacaacauagaaaauuauguugacagcaaaguggcaaaucuaacauuuguugucaauaguuuggauggcaaauguucaaagugucccagccaagaacaaauacagucacguccaguucaacaucuaauauauaaagauugcucugacuacuacgcaauaggcaaaagaagcagugagaccuacagaguuacaccugaucccaaaaauaguagcuuugaaguuuacugugacauggagaccauggggggaggcuggacagugcugcaggcacgccucgaugggagcaccaacuucaccagaacauggcaagacuacaaagcaggcuuuggaaaccucagaagggaauuuuggcuggggaacgauaaaauucaucuucugaccaagaguaaggaaaugauucugagaauagaucuugaagacuuuaauggugucgaacuauaugccuuguaugaucaguuuuauguggcuaaugaguuucucaaauaucguuuacacguugguaacuauaauggcacagcuggagaugcauuacguuucaacaaacauuacaaccacgaucugaaguuuuucaccacuccagauaaagacaaugaucgauauccuucugggaacugugggcuguacuacaguucaggcuggugguuugaugcaugucuuucugcaaacuuaaauggcaaauauuaucaccaaaaauacagagguguccguaaugggauuuucugggguaccuggccugguguaagugaggcacacccugguggcuacaaguccuccuucaaagaggcuaagaugaugaucagacccaagcacuuuaagccauaa

SEQ ID NO: 8502 - RNA, 1320 nt, Artificial Sequence
  derived and/or modified sequence opt1 from Fibrinogen__Homo_sapiens__BAG35554
augaagcuggccaacugguacuggcucagcuccgccgugcuggcgaccuacggcuuccuggucguggccaacaacgagaccgaggagaucaaggacgagcgcgccaaggacgugugccccguccggcucgagagccgcgggaagugcgaggaggccggcgagugcccguaccaggugucccugccgccccugacgauccagcuccccaagcaguucagccggaucgaggagguguucaaggagguccagaaccugaaggagaucgugaacucccugaagaaguccugccaggacugcaagcuccaggccgacgacaacggggaccccggccgcaacgggcugcugcuccccagcaccggcgcgcccggcgaggugggggacaaccggguccgcgagcuggagagcgaggugaacaagcuguccagcgagcucaagaacgccaaggaggagaucaacgugcugcacggccggcuggagaagcucaaccuggucaacaugaacaacaucgagaacuacguggacuccaagguggccaaccugaccuucgucgugaacagccucgacgggaagugcuccaagugccccagccaggagcagauccagucccgcccggugcagcaccugaucuacaaggacugcagcgacuacuacgccaucggcaagcgguccagcgagaccuaccgcgucacgcccgaccccaagaacuccagcuucgagguguacugcgacauggagaccaugggcgggggcuggaccgugcugcaggcgcggcucgacgggagcaccaacuucacgcgcaccuggcaggacuacaaggccggcuucgggaaccugcggcgcgaguucuggcugggcaacgacaagauccaccuccugaccaaguccaaggagaugauccugcggaucgaccucgaggacuucaacggcgucgagcuguacgcccuguacgaccaguucuacguggccaacgaguuccucaaguaccgccugcacguggggaacuacaacggcaccgccggggacgcgcugcgguucaacaagcacuacaaccacgaccucaaguucuucacgacccccgacaaggacaacgaccgcuacccgagcggcaacugcgggcuguacuacuccagcggcuggugguucgacgccugccuguccgccaaccucaacggcaaguacuaccaccagaaguaccgcgggguccggaacggcaucuucugggggaccuggcccggcgugagcgaggcccaccccgggggcuacaaguccagcuucaaggaggccaagaugaugauccggcccaagcacuucaagccguga

SEQ ID NO: 8503 - RNA, 1320 nt, Artificial Sequence
  derived and/or modified sequence opt2 from Fibrinogen__Homo_sapiens__BAG35554
augaagcucgccaacugguacuggcucuccuccgccguccucgccaccuacggcuuccucgucgucgccaacaacgagaccgaggagaucaaggacgagcgcgccaaggacgucugccccguccgccucgagucccgcggcaagugcgaggaggccggcgagugccccuaccaggucucccuccccccccucaccauccagcuccccaagcaguucucccgcaucgaggaggucuucaaggagguccagaaccucaaggagaucgucaacucccucaagaaguccugccaggacugcaagcuccaggccgacgacaacggcgaccccggccgcaacggccuccuccuccccuccaccggcgcccccggcgaggucggcgacaaccgcguccgcgagcucgaguccgaggucaacaagcucuccuccgagcucaagaacgccaaggaggagaucaacguccuccacggccgccucgagaagcucaaccucgucaacaugaacaacaucgagaacuacgucgacuccaaggucgccaaccucaccuucgucgucaacucccucgacggcaagugcuccaagugccccucccaggagcagauccagucccgccccguccagcaccucaucuacaaggacugcuccgacuacuacgccaucggcaagcgcuccuccgagaccuaccgcgucacccccgaccccaagaacuccuccuucgaggucuacugcgacauggagaccaugggcggcggcuggaccguccuccaggcccgccucgacggcuccaccaacuucacccgcaccuggcaggacuacaaggccggcuucggcaaccuccgccgcgaguucuggcucggcaacgacaagauccaccuccucaccaaguccaaggagaugauccuccgcaucgaccucgaggacuucaacggcgucgagcucuacgcccucuacgaccaguucuacgucgccaacgaguuccucaaguaccgccuccacgucggcaacuacaacggcaccgccggcgacgcccuccgcuucaacaagcacuacaaccacgaccucaaguucuucaccacccccgacaaggacaacgaccgcuaccccuccggcaacugcggccucuacuacuccuccggcuggugguucgacgccugccucuccgccaaccucaacggcaaguacuaccaccagaaguaccgcggcguccgcaacggcaucuucuggggcaccuggcccggcgucuccgaggcccaccccggcggcuacaaguccuccuucaaggaggccaagaugaugauccgccccaagcacuucaagcccuga

SEQ ID NO: 8504 - RNA, 1320 nt, Artificial Sequence
  derived and/or modified sequence opt3 from Fibrinogen__Homo_sapiens__BAG35554
augaagcuggccaacugguacuggcucagcuccgcugugcuugcaaccuauggcuuccuggucguugccaauaacgagacagaagagaucaaagacgaaagagcgaaggaugugugccccguaagguuggagucucgggggaaaugugaagaggcuggagagugcccuuaccaggugucauuaccaccgcugacuauucaacuacccaagcaguuuagucgcauagaagaggucuucaaagaagugcagaaucucaaggagaucguuaacagccugaagaaauccugucaggacugcaaacuucaagccgaugacaauggugauccuggccgaaacgggcuguugcucccaucuacgggagcacccggcgaggugggugacaaucgugucagagaacuggagucggaagugaacaagcugucaagcgagcucaagaaugccaaagaagagauuaacguauuacacgggaggcuggagaaacuuaauuugguuaacaugaauaacaucgaaaauuauguggauaguaaggucgcuaaccugaccuuuguggugaacucccuagacggaaaguguucuaagugcccuagccaggagcagauucagucccggccaguccaacaucucaucuacaaagauuguucagacuauuacgcaauaggcaagcgcaguagcgaaacauauagaguuacucccgauccuaaaaauucuuccuucgagguguacugcgacauggaaaccaugggcgggggauggacaguacugcaggccaggcuugaugguucaaccaacuuuacucggacauggcaggacuacaaggcuggcuucgggaaucugcgccgagaguuuugguugggaaacgacaaaauccaccuccugaccaagagcaaggagaugauuuuaagaaucgaucuggaagacuucaauggcguggagcucuaugcccuuuacgaucaguuuuaugucgcgaacgaguuccugaaauacagguugcauguggguaauuauaacgggacggcaggagacgcccuacgguuuaauaagcacuacaaccaugaucugaaauucuuuacuaccccagacaaggauaaugaccguuauccgaguggcaacuguggccucuacuacucuuccggguggugguucgaugcuugccugagcgccaaucuuaacggaaaauauuaccaccaaaaguaucgcgguguuagaaauggcauuuucugggggacauggcccggagugucggaagcacacccuggcgguuacaagucuuccuuuaaagaagcuaagaugaugaucaggccaaaacauuucaagcccuga

SEQ ID NO: 8505 - RNA, 1320 nt, Artificial Sequence
  derived and/or modified sequence opt4 from Fibrinogen__Homo_sapiens__BAG35554
augaagcuggccaacugguacuggcugagcagcgccgugcuggccaccuacggcuuccuggugguggccaacaacgagaccgaggagaucaaggacgagagagccaaggacgugugccccgugagacuggagagcagaggcaagugcgaggaggccggcgagugccccuaccaggugagccugcccccccugaccauccagcugcccaagcaguucagcagaaucgaggagguguucaaggaggugcagaaccugaaggagaucgugaacagccugaagaagagcugccaggacugcaagcugcaggccgacgacaacggcgaccccggcagaaacggccugcugcugcccagcaccggcgcccccggcgaggugggcgacaacagagugagagagcuggagagcgaggugaacaagcugagcagcgagcugaagaacgccaaggaggagaucaacgugcugcacggcagacuggagaagcugaaccuggugaacaugaacaacaucgagaacuacguggacagcaagguggccaaccugaccuucguggugaacagccuggacggcaagugcagcaagugccccagccaggagcagauccagagcagacccgugcagcaccugaucuacaaggacugcagcgacuacuacgccaucggcaagagaagcagcgagaccuacagagugacccccgaccccaagaacagcagcuucgagguguacugcgacauggagaccaugggcggcggcuggaccgugcugcaggccagacuggacggcagcaccaacuucaccagaaccuggcaggacuacaaggccggcuucggcaaccugagaagagaguucuggcugggcaacgacaagauccaccugcugaccaagagcaaggagaugauccugagaaucgaccuggaggacuucaacggcguggagcuguacgcccuguacgaccaguucuacguggccaacgaguuccugaaguacagacugcacgugggcaacuacaacggcaccgccggcgacgcccugagauucaacaagcacuacaaccacgaccugaaguucuucaccacccccgacaaggacaacgacagauaccccagcggcaacugcggccuguacuacagcagcggcuggugguucgacgccugccugagcgccaaccugaacggcaaguacuaccaccagaaguacagaggcgugagaaacggcaucuucuggggcaccuggcccggcgugagcgaggcccaccccggcggcuacaagagcagcuucaaggaggccaagaugaugaucagacccaagcacuucaagcccuga

SEQ ID NO: 8506 - RNA, 1320 nt, Artificial Sequence
  derived and/or modified sequence opt5 from Fibrinogen__Homo_sapiens__BAG35554
augaagcuggccaacugguacuggcucagcuccgcugugcuggccaccuauggcuuccuugucguugcgaauaacgagacagaagagaucaaagacgaaagagcuaaggaugugugccccgugcggcuggagucucgcgggaaaugugaagaggccggagagugcccuuaccaggucagccucccgccccugacgauucaacuuccuaagcaguuuuccagaaucgaagagguguucaaagaaguucagaaucugaaggagauugugaacucucucaagaaaagcugucaggacugcaagcugcaagccgaugacaauggcgaucccgggcggaacggacugcuccugccuuccaccggcgcucccggggaggucggagacaaucgcgugagagaacuugagucugaaguuaacaaacugagcuccgagcucaagaaugccaaagaagagaucaacgugcugcacggccggcuugagaagcugaaucucgucaacaugaauaacauugaaaauuauguggauagcaagguggcuaaccugacauuugucguuaacucucuggacggcaaauguuccaagugcccuagccaggagcagauccagucucgcccggugcaacaucucaucuacaaagauuguuccgacuauuacgccauugggaagagaagcucugaaaccuaucgggugacacccgauccuaaaaauuccagcuucgaggucuacugcgacauggaaaccaugggaggcggguggacagugcugcaggcgcgccuugauggauccaccaacuuuacgagaaccuggcaggacuacaaggccggcuucgggaaucugcggcgcgaguuuuggcucggaaacgacaaaauccaucugcuuacaaagucuaaggagaugauucugagaaucgaucucgaagacuucaauggcguugagcuguaugcucuguacgaucaguuuuauguggccaacgaguuccucaaauaccggcugcacgucggcaauuauaacgggaccgcuggagacgcccuucgcuuuaauaagcacuacaaccaugaucugaaauucuuuacaacccccgacaaggauaaugacagauauccuagcggcaacugugggcucuacuacuccagcggauggugguucgaugcgugccugucugccaaucuuaacggcaaauauuaccaccaaaaguauagaggggugcggaauggaauuuucuggggcacguggcccggcguuuccgaagcucacccugggggauacaagagcucuuuuaaagaagccaagaugaugauccgcccgaaacauuucaagcccuga

SEQ ID NO: 8507 - protein, 461 aa, Artificial Sequence [sequence omitted]

SEQ ID NO: 8508 - RNA, 1386 nt, Artificial Sequence
  Fibrinogen__Homo_sapiens__BAF85178
auggucaacgaccgguggaagaccaugggcggcgcugcccaacuugaggaccggccgcgcgacaagccgcagcggccgagcugcggcuacgugcugugcaccgugcugcuggcccuggcugugcugcuggcuguagcugucaccggugccgugcucuuccugaaccacgcccacgcgccgggcacggcgcccccaccugucgucagcacuggggcugccggcgccaacagcgcccuggucacuguggaaagggcggacagcucgcaccucagcauccucauugacccgcgcugccccgaccucaccgacagcuucgcacgccuggagagcgcccaggccucggugcugcaggcgcugacagagcaccaggcccagccacggcuggugggcgaccaggagcaggagcugcuggacacgcuggccgaccagcugccccggcugcuggcccgagccucagagcugcagacggagugcauggggcugcggaaggggcauggcacgcugggccagggccucagcgcccugcagagugagcagggccgccucauccagcuucucucugagagccagggccacauggcucaccuggugaacuccgucagcgacauccuggaugcccugcagagggaccgggggcugggccggccccgcaacaaggccgaccuucagagagcgccugcccggggaacccggccccggggcugugccacuggcucccggccccgagacugucuggacguccuccuaagcggacagcaggacgauggcgucuacucugucuuucccacccacuacccggccggcuuccagguguacugugacaugcgcacggacggcggcggcuggacgguguuucagcgccgggaggacggcuccgugaacuucuuccggggcugggacgcguaccgagacggcuuuggcaggcucaccggggagcacuggcuagggcucaagaggauccacgcccugaccacacaggcugccuacgagcugcacguggaccuggaggacuuugagaauggcacggccuaugcccgcuacgggagcuucggcgugggcuuguucuccguggacccugaggaagacggguacccgcucaccguggcugacuauuccggcacugcaggcgacucccuccugaagcacagcggcaugagguucaccaccaaggaccgugacagcgaccauucagagaacaacugugccgccuucuaccgcggugccuggugguaccgcaacugccacacguccaaccucaaugggcaguaccugcgcggugcgcacgccuccuaugccgacggcguggagugguccuccuggaccggcuggcaguacucacucaaguucucugagaugaagauccggccgguccgggaggaccgcuag

SEQ ID NO: 8509 - RNA, 1386 nt, Artificial Sequence
  derived and/or modified sequence opt1 from Fibrinogen__Homo_sapiens__BAF85178
auggugaacgaccgcuggaagaccaugggcggggccgcccagcuggaggaccggccccgcgacaagccgcagcggcccagcugcggcuacguccucugcaccgugcugcuggcgcucgccgugcugcuggccgucgccgugacgggggccguccucuuccugaaccacgcgcacgcccccggcaccgcgcccccgcccgugguguccaccggggccgccggcgccaacagcgcccuggugaccgucgagcgcgccgacuccagccaccucuccauccugaucgacccccggugccccgaccugacggacagcuucgcccgccucgaguccgcgcaggccagcgugcugcaggcccugaccgagcaccaggcccagccgcggcucgugggcgaccaggagcaggagcugcuggacacccucgccgaccagcugccccgccugcucgcgcgggccuccgagcugcagaccgagugcauggggcugcgcaagggccacgggacgcucggccaggggcugagcgcccugcaguccgagcagggccggcucauccagcugcugagcgagucccagggccacauggcccaccucgucaacagcguguccgacauccuggacgcccugcagcgcgaccgggggcucggccgcccccggaacaaggcggaccugcagcgcgcccccgcccgggggacccgcccgcggggcugcgccaccggcagccgcccccgggacugccuggacgugcuccuguccgggcagcaggacgacggcgucuacagcguguuccccacccacuaccccgccggguuccagguguacugcgacaugcgcacggacggcgggggcuggaccgucuuccagcgccgggaggacggcuccgugaacuucuuccgcgggugggacgcguaccgggacggcuucgggcgccugaccggcgagcacuggcucgggcugaagcggauccacgcccugaccacgcaggccgccuacgagcuccacguggaccuggaggacuucgagaacggcaccgcguacgcccgcuacggcagcuucggggucggccuguucagcguggacccggaggaggacggguacccccucaccguggccgacuacuccggcaccgccggggacagccugcugaagcacuccggcaugcgguucacgaccaaggaccgcgacagcgaccacuccgagaacaacugcgccgcguucuaccggggcgccuggugguaccgcaacugccacaccagcaaccucaacgggcaguaccugcggggcgcccacgccuccuacgccgacggggucgaguggagcuccuggaccggcuggcaguacagccugaaguucuccgagaugaagauccgccccgugcgggaggaccgcuga

SEQ ID NO: 8510 - RNA, 1386 nt, Artificial Sequence
  derived and/or modified sequence opt2 from Fibrinogen__Homo_sapiens__BAF85178
auggucaacgaccgcuggaagaccaugggcggcgccgcccagcucgaggaccgcccccgcgacaagccccagcgccccuccugcggcuacguccucugcaccguccuccucgcccucgccguccuccucgccgucgccgucaccggcgccguccucuuccucaaccacgcccacgcccccggcaccgcccccccccccgucgucuccaccggcgccgccggcgccaacuccgcccucgucaccgucgagcgcgccgacuccucccaccucuccauccucaucgacccccgcugccccgaccucaccgacuccuucgcccgccucgaguccgcccaggccuccguccuccaggcccucaccgagcaccaggcccagccccgccucgucggcgaccaggagcaggagcuccucgacacccucgccgaccagcucccccgccuccucgcccgcgccuccgagcuccagaccgagugcaugggccuccgcaagggccacggcacccucggccagggccucuccgcccuccaguccgagcagggccgccucauccagcuccucuccgagucccagggccacauggcccaccucgucaacuccgucuccgacauccucgacgcccuccagcgcgaccgcggccucggccgcccccgcaacaaggccgaccuccagcgcgcccccgcccgcggcacccgcccccgcggcugcgccaccggcucccgcccccgcgacugccucgacguccuccucuccggccagcaggacgacggcgucuacuccgucuuccccacccacuaccccgccggcuuccaggucuacugcgacaugcgcaccgacggcggcggcuggaccgucuuccagcgccgcgaggacggcuccgucaacuucuuccgcggcugggacgccuaccgcgacggcuucggccgccucaccggcgagcacuggcucggccucaagcgcauccacgcccucaccacccaggccgccuacgagcuccacgucgaccucgaggacuucgagaacggcaccgccuacgcccgcuacggcuccuucggcgucggccucuucuccgucgaccccgaggaggacggcuacccccucaccgucgccgacuacuccggcaccgccggcgacucccuccucaagcacuccggcaugcgcuucaccaccaaggaccgcgacuccgaccacuccgagaacaacugcgccgccuucuaccgcggcgccuggugguaccgcaacugccacaccuccaaccucaacggccaguaccuccgcggcgcccacgccuccuacgccgacggcgucgagugguccuccuggaccggcuggcaguacucccucaaguucuccgagaugaagauccgccccguccgcgaggaccgcuga

SEQ ID NO: 8511 - RNA, 1386 nt, Artificial Sequence
  derived and/or modified sequence opt3 from Fibrinogen__Homo_sapiens__BAF85178
auggugaacgacagauggaagaccaugggcggggccgcucagcuggaggauaggccccgggacaaaccucaacgcccaagcugcggauacguccucuguacaguucuucuggcauuggccguguuacuggcgguagcugugacuggugccguccuauuccucaaucacgcacaugccccgggcacggcucccccuccagugguuuccaccggggcagccggagcuaacucugcccuggugacagucgaacgagcggauucaagucaccuuagcauccugauugacccccguugcccugauuugacugacuccuuugcaagacucgagucugcccaggcuucggugcugcaggcccugaccgaacaucaggcacaaccaaggcucguaggcgaucaggagcaggaauuacuggacacacuugcugaucaguugccccggcugcuagcccgcgcgucagagcuccaaaccgaguguaugggucugagaaaggggcacggaacucuuggccagggccugagcgccuugcagagugaacaggggaggcucauacaacuguuauccgagucucagggacauauggcacaccugguuaauagcguguccgacauccucgaugcccuucagcgggaccgcggucugggccgaccuagaaacaaagcugauuugcaaagggcuccagcccgggggacacguccgcgcggaugcgcaaccggcucaagacccagggacugucuagacguccugcucaguggucagcaggaugacgggguguauagcguguucccuacgcacuacccagccggauuucaggucuauugcgauaugcggacugacggcggcggguggaccguuuuccaacgacgcgaagauggaucugugaacuuuuucagagguugggacgcuuacagggauggcuuugggcggcugacaggagagcauuggcuuggccugaagcgcauucacgcguugacuacccaggcagccuaugagcuccauguagaccuggaagauuucgagaaugguacagcuuacgccagauauggguccuuuggcgugggauuauucucagucgaccccgaagaggauggcuacccucugaccguggcagacuacagcgggacggccggagacagucuacucaaacacucugguaugagguuuacuacaaaggaucgugacuccgaucacagcgaaaauaacugugcugccuucuaucggggcgcauggugguaccgaaauugccauaccucgaaccugaaugggcaguaucuuagaggagcgcacgcuucuuacgccgacggcguugagugguccucauggacugguuggcaguauaguuugaaguuuagcgagaugaaaaucaggccagugcgcgaagaucgguga

SEQ ID NO: 8512 - RNA, 1386 nt, Artificial Sequence
  derived and/or modified sequence opt4 from Fibrinogen__Homo_sapiens__BAF85178
auggugaacgacagauggaagaccaugggcggcgccgcccagcuggaggacagacccagagacaagccccagagacccagcugcggcuacgugcugugcaccgugcugcuggcccuggccgugcugcuggccguggccgugaccggcgccgugcuguuccugaaccacgcccacgcccccggcaccgcccccccccccguggugagcaccggcgccgccggcgccaacagcgcccuggugaccguggagagagccgacagcagccaccugagcauccugaucgaccccagaugccccgaccugaccgacagcuucgccagacuggagagcgcccaggccagcgugcugcaggcccugaccgagcaccaggcccagcccagacuggugggcgaccaggagcaggagcugcuggacacccuggccgaccagcugcccagacugcuggccagagccagcgagcugcagaccgagugcaugggccugagaaagggccacggcacccugggccagggccugagcgcccugcagagcgagcagggcagacugauccagcugcugagcgagagccagggccacauggcccaccuggugaacagcgugagcgacauccuggacgcccugcagagagacagaggccugggcagacccagaaacaaggccgaccugcagagagcccccgccagaggcaccagacccagaggcugcgccaccggcagcagacccagagacugccuggacgugcugcugagcggccagcaggacgacggcguguacagcguguuccccacccacuaccccgccggcuuccagguguacugcgacaugagaaccgacggcggcggcuggaccguguuccagagaagagaggacggcagcgugaacuucuucagaggcugggacgccuacagagacggcuucggcagacugaccggcgagcacuggcugggccugaagagaauccacgcccugaccacccaggccgccuacgagcugcacguggaccuggaggacuucgagaacggcaccgccuacgccagauacggcagcuucggcgugggccuguucagcguggaccccgaggaggacggcuacccccugaccguggccgacuacagcggcaccgccggcgacagccugcugaagcacagcggcaugagauucaccaccaaggacagagacagcgaccacagcgagaacaacugcgccgccuucuacagaggcgccuggugguacagaaacugccacaccagcaaccugaacggccaguaccugagaggcgcccacgccagcuacgccgacggcguggaguggagcagcuggaccggcuggcaguacagccugaaguucagcgagaugaagaucagacccgugagagaggacagauga

SEQ ID NO: 8513 - RNA, 1386 nt, Artificial Sequence
  derived and/or modified sequence opt5 from Fibrinogen__Homo_sapiens__BAF85178
auggugaacgacagauggaagaccaugggcggggccgcucagcuggaggaucggccccgcgacaaaccucaaagaccgagcugcggauacguccucuguacaguucugcuugcccuggcggugcuccuggcuguggccgucacgggcgccgugcuuuuccugaaucacgcucaugcccccgggaccgcuccucccccuguuguguccacaggagccgcgggcgccaacucugcucucgucaccguggaacgggccgauagcucccaccugucuauccugauugacccccgcugcccugaucucacagacagcuuugcuagacuggaguccgcccaggcgucuguucuucaggcccugaccgaacaucaggcucaaccgcggcucgugggggaucaggagcaggaacugcuugacacacuggccgaucagcucccccgccugcuggcuagagccagcgagcuccaaaccgaguguaugggacugcggaagggccacggcacgcuugggcagggacuguccgcccuccagagcgaacagggccgccugauccaacuucugucugagucccaggggcauauggcucaccucgucaauagcgugucugacauucuggaugcgcugcagagagaccggggacucggccgcccuagaaacaaagccgaucugcaacgggcucccgcccgcgggaccagaccucggggaugcgccacaggcuccagaccccgcgacugucuugacgugcugcucagcggccagcaggaugacggggucuauucuguuuucccgacccacuacccugcuggauuucagguguauugcgauaugcggacagacggcgggggauggaccguguuccaaagacgcgaagauggcuccgucaacuuuuuccgggggugggacgccuacagagauggauuuggccgccugacgggcgagcauuggcuugggcugaagcggauccacgcgcucacaacccaggcugccuaugagcugcauguggaccuggaagauuucgagaauggaacagccuacgcuagauauggcagcuuugggguuggacucuucuccguggaccccgaagaggauggcuacccucugaccgucgccgacuacucugggaccgcuggcgacagccuucugaaacacuccggaaugcgcuuuacaacgaaggaucgggacagcgaucacucugaaaauaacugugccgcguucuauagaggcgccuggugguaccgcaauugccauaccuccaaccucaaugggcaguaucugcggggagcucacgccagcuacgcugacggcguggaguggucuagcuggacaggguggcaguauucccugaaguuuucugagaugaaaauuagacccguucgggaagaucgcuga

SEQ ID NO: 8514 - protein, 179 aa, Artificial Sequence [sequence omitted]

SEQ ID NO: 8515 - RNA, 540 nt, Artificial Sequence
  Fibrinogen__Homo_sapiens__BAG62044
auggucaacgaccgguggaagaccaugggcggcgcugcccaacuugaggaccggccgcgcgacaagccgcaggcgaggaaacugaggcucagagagcggccgagcugcggcuacgugcugugcaccgugcugcuggcccuggcugugcugcuggcuguagcugucaccggugccgugcucuuccugaaccacgcccacgcgccgggcacggcgcccccaccugucgucagcacuggggcugccagcgccaacagcgcccuggucacuguggaaagggcggacagcucgcaccucagcauccucauugacccgcgcugccccgaccucaccgacagcuucgcacgccuggagagcgcccaggccucggugcugcaggcgcugacagagcaccaggcccagccacggcuggugggcgaccaggagcaggagcugcuggacacgcuggccgaccagcugccccggcugcuggcccgagccucagagcugcagacggagugcauggggcugcggaaggggcauggcacgcuggaaaggcgguaa

SEQ ID NO: 8516 - RNA, 540 nt, Artificial Sequence
  derived and/or modified sequence opt1 from Fibrinogen__Homo_sapiens__BAG62044
auggugaacgaccgcuggaagaccaugggcggggccgcccagcuggaggaccggccccgcgacaagccgcaggcgcggaagcuccgccugcgggagcgccccagcugcggcuacguccugugcaccgugcuccuggcccuggccgugcuccuggccgucgccgugacgggggcggugcuguuccucaaccacgcccacgcccccggcaccgcgcccccgcccgucguguccaccggggccgccagcgccaacuccgcccuggugaccgucgagcgggccgacagcucccaccugagcauccucaucgacccccgcugccccgaccugacggacuccuucgcgcggcuggagagcgcccaggccuccgugcuccaggcccugaccgagcaccaggcccagccgcgccuggugggcgaccaggagcaggagcuccuggacacccuggcggaccagcucccccggcugcuggcccgcgccagcgagcuccagaccgagugcaugggccugcggaaggggcacggcacgcuggagcgccgguga

SEQ ID NO: 8517 - RNA, 540 nt, Artificial Sequence
  derived and/or modified sequence opt2 from Fibrinogen__Homo_sapiens__BAG62044
auggucaacgaccgcuggaagaccaugggcggcgccgcccagcucgaggaccgcccccgcgacaagccccaggcccgcaagcuccgccuccgcgagcgccccuccugcggcuacguccucugcaccguccuccucgcccucgccguccuccucgccgucgccgucaccggcgccguccucuuccucaaccacgcccacgcccccggcaccgcccccccccccgucgucuccaccggcgccgccuccgccaacuccgcccucgucaccgucgagcgcgccgacuccucccaccucuccauccucaucgacccccgcugccccgaccucaccgacuccuucgcccgccucgaguccgcccaggccuccguccuccaggcccucaccgagcaccaggcccagccccgccucgucggcgaccaggagcaggagcuccucgacacccucgccgaccagcucccccgccuccucgcccgcgccuccgagcuccagaccgagugcaugggccuccgcaagggccacggcacccucgagcgccgcuga

SEQ ID NO: 8518 - RNA, 540 nt, Artificial Sequence
  derived and/or modified sequence opt3 from Fibrinogen__Homo_sapiens__BAG62044
auggugaacgacagauggaagaccaugggcggggccgcucagcuggaggauaggccccgggacaaaccucaagcacgcaagcuccgacuucgugaaagaccaagcugcggauacguccuguguacaguuuuguuagcccuggcggugcuacucgcuguagccgugacuggugcaguccuguuccuuaaucacgcccaugcuccgggcacggcacccccuccagugguuuccaccggggccgcuucugccaacucagcgcuggugacagucgagagggcagauaguagccacuuguccauccucauugacccccggugcccugaucugacugacucuuuugcccgccuggaaucggcucaggccucagugcuccaggcauuaaccgagcaucaggcucaaccaagacugguaggagaucaggaacaggagcuuuuggacacacuggccgaucagcuacccaggcuccuggcgcgggccagcgagcuucaaaccgaauguaugggccugcgcaaaggucacgggacuuuggagcgaagauga

SEQ ID NO: 8519 - RNA, 540 nt, Artificial Sequence
  derived and/or modified sequence opt4 from Fibrinogen__Homo_sapiens__BAG62044
auggugaacgacagauggaagaccaugggcggcgccgcccagcuggaggacagacccagagacaagccccaggccagaaagcugagacugagagagagacccagcugcggcuacgugcugugcaccgugcugcuggcccuggccgugcugcuggccguggccgugaccggcgccgugcuguuccugaaccacgcccacgcccccggcaccgcccccccccccguggugagcaccggcgccgccagcgccaacagcgcccuggugaccguggagagagccgacagcagccaccugagcauccugaucgaccccagaugccccgaccugaccgacagcuucgccagacuggagagcgcccaggccagcgugcugcaggcccugaccgagcaccaggcccagcccagacuggugggcgaccaggagcaggagcugcuggacacccuggccgaccagcugcccagacugcuggccagagccagcgagcugcagaccgagugcaugggccugagaaagggccacggcacccuggagagaagauga

SEQ ID NO: 8520 - RNA, 540 nt, Artificial Sequence
  derived and/or modified sequence opt5 from Fibrinogen__Homo_sapiens__BAG62044
auggugaacgacagauggaagaccaugggcggggccgcucagcuggaggaucggccccgcgacaaaccucaagccagaaagcuccggcugcgcgaaagaccgagcugcggauacguccuuuguacaguucugcucgcgcuggcugugcuucuggccguggccgucacgggcgcuguucucuuccugaaucacgcccaugcucccgggaccgccccucccccugugguguccacaggagcggccucugcuaacagcgcccuggucaccguggagcgggcugauuccucucaccucagcauccugauugacccccgcugcccugaucuuacagacuccuuugccagacuggaaucugcgcaggccagcguucuccaggcucugaccgagcaucaggcccaaccgcggcuugugggcgaucaggaacaggagcugcucgacacacuggcugaucagcugccccgccuccuggccagagccuccgagcuucaaaccgaauguauggggcugcggaaaggacacggcacgcucgagcgcagauga

SEQ ID NO: 8521 - protein, 474 aa, Artificial Sequence
  Fibrinogen__Homo_sapiens__B4E1D3
MKRMVSWSFHKLKTMKHLLLLLLCVFLVKSQGVNDNEEGFFSARGHRPLDKKREEARPAKAAATQKKVERKAPDAGGCLHADPDLGVLCPTGCQLQEALLQQERPIRNSVDELNNNVEAVSQTSSSSFQYMYLLKDLWQKRQKQVKDNENVVNEYSSELEKHQLYIDETVNSNIPTNLRVLRSILENLRSKIQKLESDVSAQMEYCRTPCTVSCNIPVVSGKECEEIIRKGGETSEMYLIQPDSSVKPYRVYCDMNTENGGWTVIQNRQDGSVDFGRKWDPYKQGFGNVATNTDGKNYCGLPGEYWLGNDKISQLTRMGPTELLIEMEDWKGDKVKAHYGGFTVQNEANKYQISVNKYRGTAGNALMDGASQLMGENRTMTIHNGMFFSTYDRDNDGWLTSDPRKQCSKEDGGGWWYNRCHAANPNGRYYWGGQYTWDMAKHGTDDGVVWMNWKGSWYSMRKMSMKIRPFFPQQ

SEQ ID NO: 8522 - RNA, 1425 nt, Artificial Sequence
  Fibrinogen__Homo_sapiens__BAG64745
augaaaaggaugguuucuuggagcuuccacaaacuuaaaaccaugaaacaucuauuauugcuacuauuguguguuuuucuaguuaagucccaaggugucaacgacaaugaggaggguuucuucagugcccguggucaucgaccccuugacaagaagagagaagaggcucguccagccaaagcagcugccacucaaaagaaaguagaaagaaaagccccugaugcuggaggcugucuucacgcugacccagaccuggggguguuguguccuacaggaugucaguugcaagaggcuuugcuacaacaggaaaggccaaucagaaauaguguugaugaguuaaauaacaauguggaagcuguuucccagaccuccucuucuuccuuucaguacauguauuugcugaaagaccuguggcaaaagaggcagaagcaaguaaaagauaaugaaaauguagucaaugaguacuccucagaacuggaaaagcaccaauuauauauagaugagacugugaauagcaauaucccaacuaaccuucgugugcuucguucaauccuggaaaaccugagaagcaaaauacaaaaguuagaaucugaugucucagcucaaauggaauauugucgcaccccaugcacugucaguugcaauauuccuguggugucuggcaaagaaugugaggaaauuaucaggaaaggaggugaaacaucugaaauguaucucauucaaccugacaguucugucaaaccguauagaguauacugugacaugaauacagaaaauggaggauggacagugauucagaaccgucaagacgguaguguugacuuuggcaggaaaugggauccauauaaacagggauuuggaaauguugcaaccaacacagaugggaagaauuacuguggccuaccaggugaauauuggcuuggaaaugauaaaauuagccagcuuaccaggaugggacccacagaacuuuugauagaaauggaggacuggaaaggagacaaaguaaaggcucacuauggaggauucacuguacagaaugaagccaacaaauaccagaucucagugaacaaauacagaggaacagccgguaaugcccucauggauggagcaucucagcugaugggagaaaacaggaccaugaccauucacaacggcauguucuucagcacguaugacagagacaaugacggcugguuaacaucagaucccagaaaacaguguucuaaagaagacggugguggauggugguauaauagaugucaugcagccaauccaaacggcagauacuacugggguggacaguacaccugggacauggcaaagcauggcacagaugaugguguaguauggaugaauuggaaggggucaugguacucaaugaggaagaugaguaugaagaucaggcccuucuucccacagcaauag

SEQ ID NO: 8523 - RNA, 1425 nt, Artificial Sequence
  derived and/or modified sequence opt1 from Fibrinogen__Homo_sapiens__BAG64745
augaagcgcauggugagcugguccuuccacaagcugaagaccaugaagcaccuccugcugcuccugcugugcgucuuccucgucaagagccagggcgugaacgacaacgaggagggguucuucuccgcccggggccaccgcccccuggacaagaagcgggaggaggcccgcccggcgaaggccgccgccacccagaagaagguggagcggaaggcccccgacgccgggggcugccugcacgcggaccccgaccucggggugcugugccccacgggcugccagcugcaggaggcccuccugcagcaggagcgcccgauccggaacagcguggacgagcugaacaacaacgucgaggccgugucccagaccagcuccagcuccuuccaguacauguaccuccugaaggaccuguggcagaagcgccagaagcaggucaaggacaacgagaacguggugaacgaguacagcuccgagcucgagaagcaccagcuguacaucgacgagaccgugaacagcaacauccccaccaaccugcggguccuccgcuccauccuggagaaccugcggagcaagauccagaagcucgaguccgacgugagcgcgcagauggaguacugccgcacgcccugcaccguguccugcaacauccccgucgugagcggcaaggagugcgaggagaucauccggaagggcggggagaccuccgagauguaccugauccagccggacagcagcgugaagcccuaccgcgucuacugcgacaugaacaccgagaacgggggcuggacggugauccagaaccggcaggacggguccguggacuucggccgcaagugggaccccuacaagcagggcuucgggaacgucgccaccaacaccgacggcaagaacuacugcgggcugcccggcgaguacuggcucggcaacgacaagaucagccagcugacccggauggggccgacggagcugcucaucgagauggaggacuggaagggcgacaaggugaaggcccacuacgggggcuucaccgugcagaacgaggccaacaaguaccagaucuccgucaacaaguaccgcgggaccgccggcaacgcgcugauggacggcgccagccagcugaugggggagaaccggaccaugacgauccacaacggcauguucuucuccaccuacgaccgcgacaacgacggguggcucaccagcgacccccggaagcagugcuccaaggaggacggcgggggcuggugguacaaccgcugccacgccgccaaccccaacggccgcuacuacuggggcgggcaguacaccugggacauggccaagcacgggacggacgacggcguggucuggaugaacuggaaggggagcugguacuccaugcggaagaugagcaugaagauccgccccuucuucccgcagcaguga

SEQ ID NO: 8524 - RNA, 1425 nt, Artificial Sequence
  derived and/or modified sequence opt2 from Fibrinogen__Homo_sapiens__BAG64745
augaagcgcauggucuccugguccuuccacaagcucaagaccaugaagcaccuccuccuccuccuccucugcgucuuccucgucaagucccagggcgucaacgacaacgaggagggcuucuucuccgcccgcggccaccgcccccucgacaagaagcgcgaggaggcccgccccgccaaggccgccgccacccagaagaaggucgagcgcaaggcccccgacgccggcggcugccuccacgccgaccccgaccucggcguccucugccccaccggcugccagcuccaggaggcccuccuccagcaggagcgccccauccgcaacuccgucgacgagcucaacaacaacgucgaggccgucucccagaccuccuccuccuccuuccaguacauguaccuccucaaggaccucuggcagaagcgccagaagcaggucaaggacaacgagaacgucgucaacgaguacuccuccgagcucgagaagcaccagcucuacaucgacgagaccgucaacuccaacauccccaccaaccuccgcguccuccgcuccauccucgagaaccuccgcuccaagauccagaagcucgaguccgacgucuccgcccagauggaguacugccgcacccccugcaccgucuccugcaacauccccgucgucuccggcaaggagugcgaggagaucauccgcaagggcggcgagaccuccgagauguaccucauccagcccgacuccuccgucaagcccuaccgcgucuacugcgacaugaacaccgagaacggcggcuggaccgucauccagaaccgccaggacggcuccgucgacuucggccgcaagugggaccccuacaagcagggcuucggcaacgucgccaccaacaccgacggcaagaacuacugcggccuccccggcgaguacuggcucggcaacgacaagaucucccagcucacccgcaugggccccaccgagcuccucaucgagauggaggacuggaagggcgacaaggucaaggcccacuacggcggcuucaccguccagaacgaggccaacaaguaccagaucuccgucaacaaguaccgcggcaccgccggcaacgcccucauggacggcgccucccagcucaugggcgagaaccgcaccaugaccauccacaacggcauguucuucuccaccuacgaccgcgacaacgacggcuggcucaccuccgacccccgcaagcagugcuccaaggaggacggcggcggcuggugguacaaccgcugccacgccgccaaccccaacggccgcuacuacuggggcggccaguacaccugggacauggccaagcacggcaccgacgacggcgucgucuggaugaacuggaagggcuccugguacuccaugcgcaagauguccaugaagauccgccccuucuucccccagcaguga

SEQ ID NO: 8525 - RNA, 1425 nt, Artificial Sequence
  derived and/or modified sequence opt3 from Fibrinogen__Homo_sapiens__BAG64745
augaagagaauggugagcugguccuuccacaaacugaagaccaugaaacaucuccuucuguuguuacugugcgucuuucuaguuaagucucagggcgugaacgacaaugaggaaggguucuuuucagccaggggacaccggccccucgauaaaaagcgcgaggaagcucgaccugcaaaggccgcggcuacacaaaagaagguagagcguaaagccccagacgccgguggcugucugcaugcagauccggaccuuggggugcugugccccacuggaugucaguugcaggaagcucuccugcagcaagagagaccuaucaggaacagugucgaugagcugaauaacaauguggaagcaguuagccagacguccucuucgucauuccaguacauguaucucuuaaaggaccuguggcagaaacggcaaaaacaggugaaggauaacgagaaugucgugaacgaauacagcagugagcuugagaaacaccaguuguauauugacgaaaccguaaauuccaacauaccaacaaaucugcgcguucuaagaucuauccucgagaaccugaggagcaagauucagaaacuugaauccgaugugucagcccaaauggaguacugccggacucccuguaccgucaguugcaauaucccuguggugagcggcaaggaaugugaggagauuauccgcaaagguggggaaacaucugagauguaucugauacagccagacuccucagucaagcccuaccgaguuuauugcgauaugaacaccgaaaauggaggcuggacugugauccagaacagacaagacggcagcguagauuuugggaggaaaugggacccuuacaagcagggauucgguaacguggcuacaaauaccgacggcaagaacuacuguggguugccaggagaguauuggcucggcaaugauaaaauuagucagcugacgcggauggguccgacugaauuacugaucgagauggaggacuggaagggggauaaagucaaggcccauuacggaggcuuuaccgugcagaacgaagcgaauaaauaucaaauuucuguuaacaaguaccguggcacagcagggaaugcccucauggacggagcuucccagcuuaugggugagaaccgcacuaugaccauccacaauggcauguucuuuagcacauaugauagagacaacgauggguggcugaccucggaccccaggaagcagugcucuaaagaagauggaggcgguuggugguacaaucggugucacgccgcaaacccuaaugggcgauauuacuggggcggacaguacacgugggacauggcuaagcauggcacugaugacgggguggucuggaugaacuggaaaggauccugguauucaaugcgcaagaugaguaugaaaauaagaccauucuuuccccaacaguga

SEQ ID NO: 8526 - RNA, 1425 nt, Artificial Sequence
  derived and/or modified sequence opt4 from Fibrinogen__Homo_sapiens__BAG64745
augaagagaauggugagcuggagcuuccacaagcugaagaccaugaagcaccugcugcugcugcugcugugcguguuccuggugaagagccagggcgugaacgacaacgaggagggcuucuucagcgccagaggccacagaccccuggacaagaagagagaggaggccagacccgccaaggccgccgccacccagaagaagguggagagaaaggcccccgacgccggcggcugccugcacgccgaccccgaccugggcgugcugugccccaccggcugccagcugcaggaggcccugcugcagcaggagagacccaucagaaacagcguggacgagcugaacaacaacguggaggccgugagccagaccagcagcagcagcuuccaguacauguaccugcugaaggaccuguggcagaagagacagaagcaggugaaggacaacgagaacguggugaacgaguacagcagcgagcuggagaagcaccagcuguacaucgacgagaccgugaacagcaacauccccaccaaccugagagugcugagaagcauccuggagaaccugagaagcaagauccagaagcuggagagcgacgugagcgcccagauggaguacugcagaacccccugcaccgugagcugcaacauccccguggugagcggcaaggagugcgaggagaucaucagaaagggcggcgagaccagcgagauguaccugauccagcccgacagcagcgugaagcccuacagaguguacugcgacaugaacaccgagaacggcggcuggaccgugauccagaacagacaggacggcagcguggacuucggcagaaagugggaccccuacaagcagggcuucggcaacguggccaccaacaccgacggcaagaacuacugcggccugcccggcgaguacuggcugggcaacgacaagaucagccagcugaccagaaugggccccaccgagcugcugaucgagauggaggacuggaagggcgacaaggugaaggcccacuacggcggcuucaccgugcagaacgaggccaacaaguaccagaucagcgugaacaaguacagaggcaccgccggcaacgcccugauggacggcgccagccagcugaugggcgagaacagaaccaugaccauccacaacggcauguucuucagcaccuacgacagagacaacgacggcuggcugaccagcgaccccagaaagcagugcagcaaggaggacggcggcggcuggugguacaacagaugccacgccgccaaccccaacggcagauacuacuggggcggccaguacaccugggacauggccaagcacggcaccgacgacggcgugguguggaugaacuggaagggcagcugguacagcaugagaaagaugagcaugaagaucagacccuucuucccccagcaguga

SEQ ID NO: 8527 - RNA, 1425 nt, Artificial Sequence
  derived and/or modified sequence opt5 from Fibrinogen__Homo_sapiens__BAG64745
augaagagaauggugagcugguccuuccacaaacugaagaccaugaaacaucuccugcuucugcuccugugcgucuuucuuguuaagucucagggcgugaacgacaaugaggaaggguucuuuagcgcccggggacaccgcccccuggauaaaaagagagaggaagcucggccugccaaggcggcugccacacagaaaaagguggagcgcaaagccccggacgcuggcgggugucuccaugccgaucccgaccugggaguccugugcccuacgggcugucaacuccaggaagcucugcuucagcaagagagacccauccggaacuccguggaugagcugaauaacaauguugaagccgugucucagaccagcuccucuagcuuccaguacauguaucuccugaaggaccuuuggcagaaacgccaaaagcaggucaaggauaacgagaaugugguuaacgaauacuccagcgagcuggagaaacaccagcucuauauugacgaaacagucaauucuaacaucccuaccaaucugagagugcugcgguccauucucgagaaccugcgcagcaagauccagaaacuugaaucugauguguccgcgcaaauggaguacugcagaacacccuguaccgugagcugcaauauuccugucguuucugggaaggaaugugaggagaucauccggaaaggaggcgaaacauccgagauguaucugauucagccggacagcuccgugaagcccuaccgcguguauugcgauaugaacaccgaaaauggcggguggacggucauccagaacagacaagacggaucuguggauuuuggccggaaaugggacccuuacaagcagggguucggaaacguugccaccaauacagacggcaagaacuacugugggcuccccggagaguauuggcugggcaaugauaaaauuagccagcuuacccgcaugggcccuacagaacugcucaucgagauggaggacuggaagggggauaaagugaaggcucauuacggaggcuuuaccguccagaacgaagccaauaaauaucaaauuuccgugaacaaguacagagggacggcuggaaaugcccugauggacggcgcgagccagcugaugggggagaaccggacaaugaccauccacaauggaauguucuuuucuacauaugauagagacaacgauggcuggcucaccuccgacccccgcaagcagugcagcaaagaagauggcgggggauggugguacaaucggugucacgccgcuaacccgaauggcagauauuacuggggagggcaguacaccugggacauggccaagcauggcacagaugacgggguuguguggaugaacuggaaaggcucuugguauagcaugcgcaagauguccaugaaaauucggccuuucuuuccccaacaguga

SEQ ID NO: 8528 - protein, 344 aa, Artificial Sequence
  Fibrinogen__Homo_sapiens__D3DP13
MYLLKDLWQKRQKQVKDNENVVNEYSSELEKHQLYIDETVNSNIPTNLRVLRSILENLRSKIQKLESDVSAQMEYCRTPCTVSCNIPVVSGKECEEIIRKGGETSEMYLIQPDSSVKPYRVYCDMNTENGGWTVIQNRQDGSVDFGRKWDPYKQGFGNVATNTDGKNYCGLPGEYWLGNDKISQLTRMGPTELLIEMEDWKGDKVKAHYGGFTVQNEANKYQISVNKYRGTAGNALMDGASQLMGENRTMTIHNGMFFSTYDRDNDGWLTSDPRKQCSKEDGGGWWYNRCHAANPNGRYYWGGQYTWDMAKHGTDDGVVWMNWKGSWYSMRKMSMKIRPFFPQQ

SEQ ID NO: 8529 - RNA, 1035 nt, Artificial Sequence
  Fibrinogen__Homo_sapiens__EAX04934
auguauuugcugaaagaccuguggcaaaagaggcagaagcaaguaaaagauaaugaaaauguagucaaugaguacuccucagaacuggaaaagcaccaauuauauauagaugagacugugaauagcaauaucccaacuaaccuucgugugcuucguucaauccuggaaaaccugagaagcaaaauacaaaaguuagaaucugaugucucagcucaaauggaauauugucgcaccccaugcacugucaguugcaauauuccuguggugucuggcaaagaaugugaggaaauuaucaggaaaggaggugaaacaucugaaauguaucucauucaaccugacaguucugucaaaccguauagaguauacugugacaugaauacagaaaauggaggauggacagugauucagaaccgucaagacgguaguguugacuuuggcaggaaaugggauccauauaaacagggauuuggaaauguugcaaccaacacagaugggaagaauuacuguggccuaccaggugaauauuggcuuggaaaugauaaaauuagccagcuuaccaggaugggacccacagaacuuuugauagaaauggaggacuggaaaggagacaaaguaaaggcucacuauggaggauucacuguacagaaugaagccaacaaauaccagaucucagugaacaaauacagaggaacagccgguaaugcccucauggauggagcaucucagcugaugggagaaaacaggaccaugaccauucacaacggcauguucuucagcacguaugacagagacaaugacggcugguuaacaucagaucccagaaaacaguguucuaaagaagacggugguggauggugguauaauagaugucaugcagccaauccaaacggcagauacuacugggguggacaguacaccugggacauggcaaagcauggcacagaugaugguguaguauggaugaauuggaaggggucaugguacucaaugaggaagaugaguaugaagaucaggcccuucuucccacagcaauag

SEQ ID NO: 8530 - RNA, 1035 nt, Artificial Sequence
  derived and/or modified sequence opt1 from Fibrinogen__Homo_sapiens__EAX04934
auguaccugcucaaggaccuguggcagaagcgccagaagcaggucaaggacaacgagaacguggugaacgaguacagcuccgagcuggagaagcaccagcucuacaucgacgagaccgugaacagcaacauccccaccaaccugcggguccugcgcuccauccucgagaaccugcggagcaagauccagaagcuggaguccgacgugagcgcccagauggaguacugccgcacgccgugcaccguguccugcaacauccccgucgugagcggcaaggagugcgaggagaucauccggaagggcggggagaccuccgagauguaccucauccagcccgacagcuccgugaagcccuaccgcgucuacugcgacaugaacaccgagaacgggggcuggacggugauccagaaccggcaggacgggagcguggacuucggccgcaagugggacccguacaagcagggcuucgggaacgucgccaccaacaccgacggcaagaacuacugcgggcugcccggcgaguacuggcuggggaacgacaagaucucccagcucacccggaugggccccacggagcugcugaucgagauggaggacuggaagggcgacaaggugaaggcgcacuacgggggcuucaccgugcagaacgaggccaacaaguaccagaucagcgucaacaaguaccgcgggaccgccggcaacgcccucauggacggcgccucccagcugaugggggagaaccggaccaugacgauccacaacggcauguucuucagcaccuacgaccgcgacaacgacggguggcugaccuccgacccccggaagcagugcagcaaggaggacggcgggggcuggugguacaaccgcugccacgcggccaacccgaacggccgguacuacuggggcgggcaguacaccugggacauggccaagcacgggacggacgacggcgugguguggaugaacuggaagggguccugguacagcaugcgcaagaugagcaugaagauccggcccuucuucccccagcaguga

SEQ ID NO: 8531 - RNA, 1035 nt, Artificial Sequence
  derived and/or modified sequence opt2 from Fibrinogen__Homo_sapiens__EAX04934
auguaccuccucaaggaccucuggcagaagcgccagaagcaggucaaggacaacgagaacgucgucaacgaguacuccuccgagcucgagaagcaccagcucuacaucgacgagaccgucaacuccaacauccccaccaaccuccgcguccuccgcuccauccucgagaaccuccgcuccaagauccagaagcucgaguccgacgucuccgcccagauggaguacugccgcacccccugcaccgucuccugcaacauccccgucgucuccggcaaggagugcgaggagaucauccgcaagggcggcgagaccuccgagauguaccucauccagcccgacuccuccgucaagcccuaccgcgucuacugcgacaugaacaccgagaacggcggcuggaccgucauccagaaccgccaggacggcuccgucgacuucggccgcaagugggaccccuacaagcagggcuucggcaacgucgccaccaacaccgacggcaagaacuacugcggccuccccggcgaguacuggcucggcaacgacaagaucucccagcucacccgcaugggccccaccgagcuccucaucgagauggaggacuggaagggcgacaaggucaaggcccacuacggcggcuucaccguccagaacgaggccaacaaguaccagaucuccgucaacaaguaccgcggcaccgccggcaacgcccucauggacggcgccucccagcucaugggcgagaaccgcaccaugaccauccacaacggcauguucuucuccaccuacgaccgcgacaacgacggcuggcucaccuccgacccccgcaagcagugcuccaaggaggacggcggcggcuggugguacaaccgcugccacgccgccaaccccaacggccgcuacuacuggggcggccaguacaccugggacauggccaagcacggcaccgacgacggcgucgucuggaugaacuggaagggcuccugguacuccaugcgcaagauguccaugaagauccgccccuucuucccccagcaguga

SEQ ID NO: 8532 - RNA, 1035 nt, Artificial Sequence
  derived and/or modified sequence opt3 from Fibrinogen__Homo_sapiens__EAX04934
auguaccugcucaaggaccuuuggcagaaaagacaaaaacaggugaaggauaacgagaaugucguuaacgaauauagcuccgagcuggaaaagcaccaguuguacaucgacgagaccguaaauucuaacauucccacaaauuuaagggugcugcggucaauacuagaaaaccuccgcaguaaaauccagaagcuggagagcgauguguccgcccaaauggaguauugccgaacuccuuguacggucucuugcaauauuccagugguuucgggcaaggaaugugaggaaaucauucguaaagggggagagaccucagagauguaccuuauccagccggacagcagugugaagcccuauagagucuacugcgauaugaacacagaaaaugguggcuggacugugauacagaacaggcaggacggguccguagauuucggacggaaaugggacccuuauaagcaaggcuuugguaauguugcuaccaacacagaugggaaaaauuacuguggacugccaggcgaguacugguugggcaacgacaagaucucucagcucacccgcauggggcccacugaacugcugauugagauggaagauuggaagggagacaaagugaaggcacauuaugguggcuucacaguccagaaugaggccaacaaauaccagaucagcgugaacaaguauagagggaccgcgggaaaugcucucauggauggcgccucccaauuaaugggugagaacaggacgaugacuauucacaaugggauguuuuucucaaccuacgaccgggacaacgauggauggcugacaagugacccucgcaaacagugcagcaaggaagauggcggcggguggugguauaaucgaugucaugcagccaacccaaauggaagauacuauugggguggccaguacacuugggacauggcuaaacacgggaccgaugacggaguggucuggaugaacuggaagggcucuugguacuccaugaggaagaugucaaugaaaauccggcccuuuuucccucaacaguga

SEQ ID NO: 8533 - RNA, 1035 nt, Artificial Sequence
  derived and/or modified sequence opt4 from Fibrinogen__Homo_sapiens__EAX04934
auguaccugcugaaggaccuguggcagaagagacagaagcaggugaaggacaacgagaacguggugaacgaguacagcagcgagcuggagaagcaccagcuguacaucgacgagaccgugaacagcaacauccccaccaaccugagagugcugagaagcauccuggagaaccugagaagcaagauccagaagcuggagagcgacgugagcgcccagauggaguacugcagaacccccugcaccgugagcugcaacauccccguggugagcggcaaggagugcgaggagaucaucagaaagggcggcgagaccagcgagauguaccugauccagcccgacagcagcgugaagcccuacagaguguacugcgacaugaacaccgagaacggcggcuggaccgugauccagaacagacaggacggcagcguggacuucggcagaaagugggaccccuacaagcagggcuucggcaacguggccaccaacaccgacggcaagaacuacugcggccugcccggcgaguacuggcugggcaacgacaagaucagccagcugaccagaaugggccccaccgagcugcugaucgagauggaggacuggaagggcgacaaggugaaggcccacuacggcggcuucaccgugcagaacgaggccaacaaguaccagaucagcgugaacaaguacagaggcaccgccggcaacgcccugauggacggcgccagccagcugaugggcgagaacagaaccaugaccauccacaacggcauguucuucagcaccuacgacagagacaacgacggcuggcugaccagcgaccccagaaagcagugcagcaaggaggacggcggcggcuggugguacaacagaugccacgccgccaaccccaacggcagauacuacuggggcggccaguacaccugggacauggccaagcacggcaccgacgacggcgugguguggaugaacuggaagggcagcugguacagcaugagaaagaugagcaugaagaucagacccuucuucccccagcaguga

SEQ ID NO: 8534 - RNA, 1035 nt, Artificial Sequence
  derived and/or modified sequence opt5 from Fibrinogen__Homo_sapiens__EAX04934
auguaccugcucaaggaccuguggcagaaaagacaaaaacaggugaaggauaacgagaaugucguuaacgaauauagcuccgagcuugaaaagcaccagcuguacaucgacgagaccgucaauucuaacauucccacaaaucuccgggugcugcgcagcauccuugaaaaccugagauccaaaauucagaagcucgagucugaugugagcgcccaaauggaguauugccggacgccuuguaccguguccugcaauaucccgguugugucuggcaaggaaugugaggaaauuauccgcaaagggggagagacaagcgagauguaccugauccagcccgacuccagcgucaagccuuauagaguguacugcgauaugaacaccgaaaauggcggguggacaguuauucagaaccggcaggacggaucuguggauuucggccgcaaaugggaccccuauaagcaaggguuuggaaaugucgcuaccaacacagauggcaaaaauuacuguggccugccuggggaguacuggcucggaaacgacaagaucucccagcugaccagaaugggccccacggaacuucugauugagauggaagauuggaagggggacaaagugaaggcccauuauggaggcuucaccgugcagaaugaggcgaacaaauaccagaucagcgucaacaaguaucgggggacagcuggaaaugcccucauggauggcgccucucaacugaugggcgagaaccgcaccaugacaauucacaaugggauguuuuucuccaccuacgacagagacaacgauggauggcuuacgagcgacccucggaaacagugcucuaaggaagauggcgggggauggugguauaaucgcugucaugcugccaacccgaauggcagauacuauuggggagggcaguacacaugggacauggcuaaacacggcaccgaugacggcguuguguggaugaacuggaagggguccugguacagcaugcggaagauguccaugaaaauccgccccuuuuucccucaacaguga

SEQ ID NO: 8535 - protein, 334 aa, Artificial Sequence
  Fibrinogen__Homo_sapiens__D3DP16
MIDAATLKSRKMLEEIMKYEASILTHDSSIRYLQEIYNSNNQKIVNLKEKVAQLEAQCQEPCKDTVQIHDITGKDCQDIANKGAKQSGLYFIKPLKANQQFLVYCEIDGSGNGWTVFQKRLDGSVDFKKNWIQYKEGFGHLSPTGTTEFWLGNEKIHLISTQSAIPYALRVELEDWNGRTSTADYAMFKVGPEADKYRLTYAYFAGGDAGDAFDGFDFGDDPSDKFFTSHNGMQFSTWDNDNDKFEGNCAEQDGSGWWMNKCHAGHLNGVYYQGGTYSKASTPNGYDNGIIWATWKTRWYSMKKTTMKIIPFNRLTIGEGQQHHLGGAKQAGDV

SEQ ID NO: 8536 - RNA, 1005 nt, Artificial Sequence
  Fibrinogen__Homo_sapiens__EAX04905
augauagacgcugcuacuuugaaguccaggaaaauguuagaagaaauuaugaaauaugaagcaucgauuuuaacacaugacucaaguauucgauauuugcaggaaauauauaauucaaauaaucaaaagauuguuaaccugaaagagaagguagcccagcuugaagcacagugccaggaaccuugcaaagacacggugcaaauccaugauaucacugggaaagauugucaagacauugccaauaagggagcuaaacagagcgggcuuuacuuuauuaaaccucugaaagcuaaccagcaauucuuagucuacugugaaaucgaugggucuggaaauggauggacuguguuucagaagagacuugauggcaguguagauuucaagaaaaacuggauucaauauaaagaaggauuuggacaucugucuccuacuggcacaacagaauuuuggcugggaaaugagaagauucauuugauaagcacacagucugccaucccauaugcauuaagaguggaacuggaagacuggaauggcagaaccaguacugcagacuaugccauguucaaggugggaccugaagcugacaaguaccgccuaacauaugccuacuucgcugguggggaugcuggagaugccuuugauggcuuugauuuuggcgaugauccuagugacaaguuuuucacaucccauaauggcaugcaguucaguaccugggacaaugacaaugauaaguuugaaggcaacugugcugaacaggauggaucugguugguggaugaacaagugucacgcuggccaucucaauggaguuuauuaccaagguggcacuuacucaaaagcaucuacuccuaaugguuaugauaauggcauuauuugggccacuuggaaaacccggugguauuccaugaagaaaaccacuaugaagauaaucccauucaacagacucacaauuggagaaggacagcaacaccaccuggggggagccaaacaggcuggagacguuuaa

SEQ ID NO: 8537 - RNA, 1005 nt, Artificial Sequence
  derived and/or modified sequence opt1 from Fibrinogen__Homo_sapiens__EAX04905
augaucgacgccgccacccucaagagccgcaagaugcuggaggagaucaugaaguacgaggcguccauccugacccacgacagcuccauccgguaccugcaggagaucuacaacagcaacaaccagaagaucgugaaccucaaggagaaggucgcccagcuggaggcccagugccaggagcccugcaaggacacggugcagauccacgacaucaccggcaaggacugccaggacaucgccaacaagggggccaagcaguccggccuguacuucaucaagccgcucaaggcgaaccagcaguuccugguguacugcgagaucgacgggagcggcaacggguggaccgucuuccagaagcgccuggacggcuccguggacuucaagaagaacuggauccaguacaaggagggcuucgggcaccucagccccaccggcacgaccgaguucuggcuggggaacgagaagauccaccugaucuccacccagagcgccauccccuacgcccuccggguggagcuggaggacuggaacggccgcaccuccacggccgacuacgcgauguucaaggucgggcccgaggccgacaaguaccggcugaccuacgccuacuucgccggcggcgacgccggggacgcguucgacggcuucgacuucggggacgacccgagcgacaaguucuucaccucccacaacggcaugcaguucagcaccugggacaacgacaacgacaaguucgagggcaacugcgccgagcaggacggguccggcugguggaugaacaagugccacgccgggcaccucaacggcguguacuaccagggcgggacguacagcaaggccuccacccccaacggcuacgacaacgggaucaucugggccaccuggaagacccgcugguacagcaugaagaagacgaccaugaagaucauccccuucaaccggcugaccaucggcgaggggcagcagcaccaccugggcggggcgaagcaggccggcgacguguga

SEQ ID NO: 8538 - RNA, 1005 nt, Artificial Sequence
  derived and/or modified sequence opt2 from Fibrinogen__Homo_sapiens__EAX04905
augaucgacgccgccacccucaagucccgcaagaugcucgaggagaucaugaaguacgaggccuccauccucacccacgacuccuccauccgcuaccuccaggagaucuacaacuccaacaaccagaagaucgucaaccucaaggagaaggucgcccagcucgaggcccagugccaggagcccugcaaggacaccguccagauccacgacaucaccggcaaggacugccaggacaucgccaacaagggcgccaagcaguccggccucuacuucaucaagccccucaaggccaaccagcaguuccucgucuacugcgagaucgacggcuccggcaacggcuggaccgucuuccagaagcgccucgacggcuccgucgacuucaagaagaacuggauccaguacaaggagggcuucggccaccucucccccaccggcaccaccgaguucuggcucggcaacgagaagauccaccucaucuccacccaguccgccauccccuacgcccuccgcgucgagcucgaggacuggaacggccgcaccuccaccgccgacuacgccauguucaaggucggccccgaggccgacaaguaccgccucaccuacgccuacuucgccggcggcgacgccggcgacgccuucgacggcuucgacuucggcgacgaccccuccgacaaguucuucaccucccacaacggcaugcaguucuccaccugggacaacgacaacgacaaguucgagggcaacugcgccgagcaggacggcuccggcugguggaugaacaagugccacgccggccaccucaacggcgucuacuaccagggcggcaccuacuccaaggccuccacccccaacggcuacgacaacggcaucaucugggccaccuggaagacccgcugguacuccaugaagaagaccaccaugaagaucauccccuucaaccgccucaccaucggcgagggccagcagcaccaccucggcggcgccaagcaggccggcgacgucuga

SEQ ID NO: 8539 - RNA, 1005 nt, Artificial Sequence
  derived and/or modified sequence opt3 from Fibrinogen__Homo_sapiens__EAX04905
augaucgacgccgcuacccugaaaagcagaaaaaugcucgaggaaauuaugaaguacgaggcauccauacuuacacacgauucuucaaucagguaucugcaggaaauuuacaacaguaauaaccaaaagaucgugaauuugaaggagaaagucgcccaguuagaagcgcagugccaggagcccuguaaggacacuguucaaauucaugauaucacgggcaaggacugccaggauauagcuaacaaaggggccaagcagagcggacuguauuucaucaaaccucuaaaggcaaaucagcaauuucucguguacugugagauugacgguuccggcaacggguggaccguauuccagaaacggcuggauggaucuguggacuuuaagaagaauuggauccaguauaaagaaggcuucggucaccuuucgccaacagggacuaccgaguuuuggcugggaaacgaaaagauucauuugaucucaacacagagcgccauaccguacgcucuccgcgucgagcuggaggauuggaauggccgaaccaguacugcagacuaugccauguucaaagugggccccgaagcugauaaguaccgucugacauacgccuauuuugcagggggagacgcgggugaugccuucgacggcuuugacuucggggaugacccuuccgauaaauuuuucaccucucacaacggaaugcaauuuagcacgugggacaaugauaacgacaaguucgagggcaauugcgcugaacaggaugguuccgggugguggaugaacaaaugucaugccggacaccucaauggcguuuacuaucagggcgggacuuacucaaaggcaaguaccccaaacggauaugacaacgguauuaucugggcuacauggaagacuagaugguacagcaugaaaaagaccacaaugaaaauuauccccuucaauagguuaaccaucggcgaggggcaacagcaccaucugggaggcgccaagcaggcgggugauguguga

SEQ ID NO: 8540 - RNA, 1005 nt, Artificial Sequence
  derived and/or modified sequence opt4 from Fibrinogen__Homo_sapiens__EAX04905
augaucgacgccgccacccugaagagcagaaagaugcuggaggagaucaugaaguacgaggccagcauccugacccacgacagcagcaucagauaccugcaggagaucuacaacagcaacaaccagaagaucgugaaccugaaggagaagguggcccagcuggaggcccagugccaggagcccugcaaggacaccgugcagauccacgacaucaccggcaaggacugccaggacaucgccaacaagggcgccaagcagagcggccuguacuucaucaagccccugaaggccaaccagcaguuccugguguacugcgagaucgacggcagcggcaacggcuggaccguguuccagaagagacuggacggcagcguggacuucaagaagaacuggauccaguacaaggagggcuucggccaccugagccccaccggcaccaccgaguucuggcugggcaacgagaagauccaccugaucagcacccagagcgccauccccuacgcccugagaguggagcuggaggacuggaacggcagaaccagcaccgccgacuacgccauguucaaggugggccccgaggccgacaaguacagacugaccuacgccuacuucgccggcggcgacgccggcgacgccuucgacggcuucgacuucggcgacgaccccagcgacaaguucuucaccagccacaacggcaugcaguucagcaccugggacaacgacaacgacaaguucgagggcaacugcgccgagcaggacggcagcggcugguggaugaacaagugccacgccggccaccugaacggcguguacuaccagggcggcaccuacagcaaggccagcacccccaacggcuacgacaacggcaucaucugggccaccuggaagaccagaugguacagcaugaagaagaccaccaugaagaucauccccuucaacagacugaccaucggcgagggccagcagcaccaccugggcggcgccaagcaggccggcgacguguga

SEQ ID NO: 8541 - RNA, 1005 nt, Artificial Sequence
  derived and/or modified sequence opt5 from Fibrinogen__Homo_sapiens__EAX04905
augaucgacgccgcuacccucaagagcagaaaaaugcuggaggaaauuaugaaguacgaggccuccauccugacacacgauucuagcauucgguaucuucaggaaaucuacaacuccaauaaccagaaaauugugaaucugaaggagaaagucgcgcagcucgaagcucagugccaggagcccuguaaggacacgguucaaauccaugauaucaccggcaaggacugccaggauauugccaacaaaggggccaagcagucuggacuguauuucaucaaaccucuuaaggcuaaucagcaauuucugguguacugugagauugacggcagcgggaacggauggacaguguuccagaaacgccucgauggcuccgucgacuuuaagaagaauuggauccaguauaaagaaggguucggacaccugucuccgaccggcacaaccgaguuuuggcugggcaacgaaaagauucaucucaucagcacacaguccgccauucccuacgcucugagaguggagcuugaggauuggaaugggcggaccagcacggccgacuaugcgauguucaaaguuggaccugaagccgauaaguaccgccugaccuacgcuuauuuugccggcggggacgcuggagaugccuucgacggcuuugacuucggggaugaccccucugauaaauuuuucacaucccacaacggaaugcaauuuagcaccugggacaaugauaacgacaaguucgagggcaauugcgcggaacaggauggcucugggugguggaugaacaaaugucaugccggacaccucaauggcguguacuaucaagggggaacauacuccaaggcuagcaccccuaacggcuaugacaacgggaucaucugggccacguggaagacaagaugguacucuaugaaaaagaccacaaugaaaauuauccccuucaaucggcugaccauuggagagggccaacagcaccaucuuggcggggcuaagcaggccggagaugucuga

SEQ ID NO: 8542 - protein, 253 aa, Artificial Sequence
  Fibrinogen__Homo_sapiens__D3DSP9
MAKVFSFILVTTALIMGREISADCSEIFNDGYKLSGFYKIKPLQSPAEFSVYCDMSDGGGWTVIQRRSDGSENFNRGWKDYENGFGNFVQKHGEYWLGNKNLHFLTTQEDYTLKIDLADFEKNSRYAQYKNFKVGDEKNFYELNIGEYSGTAGDSLAGNFHPEVQWWASHQRMKFSTWDRDHDNYEGNCAEEDQSGWWFNRCHSANLNGVYYSGPYTAKTDNGIVWYTWHGWWYSLKSVVMKIRPNDFIPNVI

SEQ ID NO: 8543 - RNA, 762 nt, Artificial Sequence
  Fibrinogen__Homo_sapiens__EAW63802
auggcaaagguguucaguuucauccuuguuaccaccgcucugauaaugggcagggaaauuucggcagauuguucagagauuuucaaugauggguauaagcucaguggauuuuacaaaaucaaaccucuccagagcccagcagaauuuucuguuuauugugacauguccgauggaggaggauggacuguaauucagagacgaucugauggcagugaaaacuuuaacagaggauggaaagacuaugaaaauggcuuuggaaauuuuguccaaaaacauggugaauauuggcugggcaauaaaaaucuucacuucuugaccacucaagaagacuacacuuuaaaaaucgaccuugcagauuuugaaaaaaauagccguuaugcacaauauaagaauuucaaaguuggagaugaaaagaauuucuacgaguugaauauuggggaauauucuggaacagcuggagauucccuugcggggaauuuucauccugaggugcaguggugggcuagucaccaaagaaugaaauucagcacgugggacagagaucaugacaacuaugaagggaacugcgcagaagaagaucagucuggcuggugguuuaacaggugucacucugcaaaccugaaugguguauacuacagcggccccuacacggcuaaaacagacaaugggauugucugguacaccuggcauggguggugguauucucugaaaucugugguuaugaaaauuaggccaaaugauuuuauuccaaauguaauuuaa

SEQ ID NO: 8544 - RNA, 762 nt, Artificial Sequence
  derived and/or modified sequence opt1 from Fibrinogen__Homo_sapiens__EAW63802
auggccaagguguucagcuucauccuggucaccaccgcccugaucaugggccgcgagaucuccgcggacugcagcgagaucuucaacgacggguacaagcuguccggcuucuacaagaucaagccccugcagagcccggccgaguucuccguguacugcgacaugagcgacgggggcggguggacggugauccagcggcgcuccgacggcagcgagaacuucaaccggggcuggaaggacuacgagaacggguucggcaacuucguccagaagcacggggaguacuggcucggcaacaagaaccugcacuuccugaccacccaggaggacuacacccucaagaucgaccuggccgacuucgagaagaacucccgcuacgcccaguacaagaacuucaaggugggggacgagaagaacuucuacgagcugaacaucggcgaguacagcggcacggccggggacucccucgcgggcaacuuccaccccgaggugcaguggugggccagccaccagcggaugaaguucuccaccugggaccgcgaccacgacaacuacgaggggaacugcgccgaggaggaccagagcggcuggugguucaaccggugccacuccgccaaccugaacggcgucuacuacagcgggcccuacaccgcgaagaccgacaacggcaucgugugguacacguggcacggguggugguacucccucaagagcguggucaugaagauccgccccaacgacuucaucccgaacgugaucuga

SEQ ID NO: 8545 - RNA, 762 nt, Artificial Sequence
  derived and/or modified sequence opt2 from Fibrinogen__Homo_sapiens__EAW63802
auggccaaggucuucuccuucauccucgucaccaccgcccucaucaugggccgcgagaucuccgccgacugcuccgagaucuucaacgacggcuacaagcucuccggcuucuacaagaucaagccccuccagucccccgccgaguucuccgucuacugcgacauguccgacggcggcggcuggaccgucauccagcgccgcuccgacggcuccgagaacuucaaccgcggcuggaaggacuacgagaacggcuucggcaacuucguccagaagcacggcgaguacuggcucggcaacaagaaccuccacuuccucaccacccaggaggacuacacccucaagaucgaccucgccgacuucgagaagaacucccgcuacgcccaguacaagaacuucaaggucggcgacgagaagaacuucuacgagcucaacaucggcgaguacuccggcaccgccggcgacucccucgccggcaacuuccaccccgagguccaguggugggccucccaccagcgcaugaaguucuccaccugggaccgcgaccacgacaacuacgagggcaacugcgccgaggaggaccaguccggcuggugguucaaccgcugccacuccgccaaccucaacggcgucuacuacuccggccccuacaccgccaagaccgacaacggcaucgucugguacaccuggcacggcuggugguacucccucaaguccgucgucaugaagauccgccccaacgacuucauccccaacgucaucuga

SEQ ID NO: 8546 - RNA, 762 nt, Artificial Sequence
  derived and/or modified sequence opt3 from Fibrinogen__Homo_sapiens__EAW63802
auggccaagguguucagcuuuauccuggucaccacagcucucauuaugggcagagagauauccgcagacugcucugaaaucuucaacgauggguacaaacuuucaggauuuuauaagauuaaaccccugcagaguccugccgaguucagcguuuacugugacauguccgaugguggcggguggacugugauccaaaggcggucugacggaucggaaaauuuuaaccgcggcuggaaggauuaugagaaugguuucgggaacuuuguacagaaacacggagaauacugguugggcaauaagaacuuacauuuccugacgacccaggaggacuauacacuaaagauugaucucgcggacuuugagaaaaauucacgauacgcucaguauaagaacuucaaagugggcgaugaaaagaauuuuuacgagcugaacaucggggaauacagcggaacugccggugacagucuugcaggcaauuuccacccagagguccaauggugggccucccaucagcguaugaaauuuucuaccugggauagagaccacgauaacuaugaggggaauugcgcugaagaggaccagagcggauggugguucaacaggugucauuccgcaaaucugaacggcguguacuauucagguccguacacagccaagaccgacaacgggauaguuugguauacuuggcacggauggugguacaguuugaaaagcguggucaugaagauccggcccaaugauuucauuccuaacgugaucuga

SEQ ID NO: 8547 - RNA, 762 nt, Artificial Sequence
  derived and/or modified sequence opt4 from Fibrinogen__Homo_sapiens__EAW63802
auggccaagguguucagcuucauccuggugaccaccgcccugaucaugggcagagagaucagcgccgacugcagcgagaucuucaacgacggcuacaagcugagcggcuucuacaagaucaagccccugcagagccccgccgaguucagcguguacugcgacaugagcgacggcggcggcuggaccgugauccagagaagaagcgacggcagcgagaacuucaacagaggcuggaaggacuacgagaacggcuucggcaacuucgugcagaagcacggcgaguacuggcugggcaacaagaaccugcacuuccugaccacccaggaggacuacacccugaagaucgaccuggccgacuucgagaagaacagcagauacgcccaguacaagaacuucaaggugggcgacgagaagaacuucuacgagcugaacaucggcgaguacagcggcaccgccggcgacagccuggccggcaacuuccaccccgaggugcaguggugggccagccaccagagaaugaaguucagcaccugggacagagaccacgacaacuacgagggcaacugcgccgaggaggaccagagcggcuggugguucaacagaugccacagcgccaaccugaacggcguguacuacagcggccccuacaccgccaagaccgacaacggcaucgugugguacaccuggcacggcuggugguacagccugaagagcguggugaugaagaucagacccaacgacuucauccccaacgugaucuga

SEQ ID NO: 8548 - RNA, 762 nt, Artificial Sequence
  derived and/or modified sequence opt5 from Fibrinogen__Homo_sapiens__EAW63802
auggccaagguguucagcuuuauccuggucaccacagcucucauuaugggcagagagaucuccgccgacugcucugaaauuuucaacgauggguacaaacugagcggauuuuauaagaucaaaccccuucaguccccugcggaguucucuguuuacugugacaugagcgauggcgggggauggacggugauucaacggcgcuccgacggcucugaaaauuuuaacagaggguggaaggauuaugagaauggauucggcaacuuugugcagaaacacggcgaauacuggcuggggaauaagaaccuccauuuccugaccacacaggaggacuauacccuuaagaucgaucuggcugacuuugagaaaaauagccgguacgcccaguauaagaacuucaaagucggagaugaaaagaauuuuuacgagcucaacaucggcgaauacuccgggacagccggagacagccuggcuggcaauuuccacccggaggugcaauggugggccucucaucagcgcaugaaauuuuccaccugggauagagaccacgauaacuaugaggggaauugcgcugaagaggaccagagcggauggugguucaaccggugucauucugccaaucugaacggcguuuacuauuccggccccuacacagcgaagaccgacaacgggauugugugguauacguggcacggauggugguacagccucaagucugucgugaugaaaauccgcccuaaugauuucauucccaacguuaucuga

SEQ ID NO: 8549 - protein, 866 aa, Artificial Sequence
  Fibrinogen__Homo_sapiens__P02671
MFSMRIVCLVLSVVGTAWTADSGEGDFLAEGGGVRGPRVVERHQSACKDSDWPFCSDEDWNYKCPSGCRMKGLIDEVNQDFTNRINKLKNSLFEYQKNNKDSHSLTTNIMEILRGDFSSANNRDNTYNRVSEDLRSRIEVLKRKVIEKVQHIQLLQKNVRAQLVDMKRLEVDIDIKIRSCRGSCSRALAREVDLKDYEDQQKQLEQVIAKDLLPSRDRQHLPLIKMKPVPDLVPGNFKSQLQKVPPEWKALTDMPQMRMELERPGGNEITRGGSTSYGTGSETESPRNPSSAGSWNSGSSGPGSTGNRNPGSSGTGGTATWKPGSSGPGSTGSWNSGSSGTGSTGNQNPGSPRPGSTGTWNPGSSERGSAGHWTSESSVSGSTGQWHSESGSFRPDSPGSGNARPNNPDWGTFEEVSGNVSPGTRREYHTEKLVTSKGDKELRTGKEKVTSGSTTTTRRSCSKTVTKTVIGPDGHKEVTKEVVTSEDGSDCPEAMDLGTLSGIGTLDGFRHRHPDEAAFFDTASTGKTFPGFFSPMLGEFVSETESRGSESGIFTNTKESSSHHPGIAEFPSRGKSSSYSKQFTSSTSYNRGDSTFESKSYKMADEAGSEADHEGTHSTKRGHAKSRPVRDCDDVLQTHPSGTQSGIFNIKLPGSSKIFSVYCDQETSLGGWLLIQQRMDGSLNFNRTWQDYKRGFGSLNDEGEGEFWLGNDYLHLLTQRGSVLRVELEDWAGNEAYAEYHFRVGSEAEGYALQVSSYEGTAGDALIEGSVEEGAEYTSHNNMQFSTFDRDADQWEENCAEVYGGGWWYNNCQAANLNGIYYPGGSYDPRNNSPYEIENGVVWVSFRGADYSLRAVRMKIRPLVTQ

SEQ ID NO: 8550 - RNA, 2601 nt, Artificial Sequence
  Fibrinogen__Homo_sapiens__AAA17056
auguuuuccaugaggaucgucugccuaguucuaaguguggugggcacagcauggacugcagauaguggugaaggugacuuucuagcugaaggaggaggcgugcguggcccaaggguuguggaaagacaucaaucugccugcaaagauucagacuggcccuucugcucugaugaagacuggaacuacaaaugcccuucuggcugcaggaugaaaggguugauugaugaagucaaucaagauuuuacaaacagaauaaauaagcucaaaaauucacuauuugaauaucagaagaacaauaaggauucucauucguugaccacuaauauaauggaaauuuugagaggcgauuuuuccucagccaauaaccgugauaauaccuacaaccgagugucagaggaucugagaagcagaauugaaguccugaagcgcaaagucauagaaaaaguacagcauauccagcuucugcagaaaaauguuagagcucaguugguugauaugaaacgacuggagguggacauugauauuaagauccgaucuugucgagggucaugcaguagggcuuuagcucgugaaguagaucugaaggacuaugaagaucagcagaagcaacuugaacaggucauugccaaagacuuacuucccucuagagauaggcaacacuuaccacugauaaaaaugaaaccaguuccagacuugguucccggaaauuuuaagagccagcuucagaagguacccccagaguggaaggcauuaacagacaugccgcagaugagaauggaguuagagagaccugguggaaaugagauuacucgaggaggcuccaccucuuauggaaccggaucagagacggaaagccccaggaacccuagcagugcuggaagcuggaacucugggagcucuggaccuggaaguacuggaaaccgaaacccugggagcucugggacuggagggacugcaaccuggaaaccugggagcucuggaccuggaaguacuggaagcuggaacucugggagcucuggaacuggaaguacuggaaaccaaaacccugggagcccuagaccugguaguaccggaaccuggaauccuggcagcucugaacgcggaagugcugggcacuggaccucugagagcucuguaucugguaguacuggacaauggcacucugaaucuggaaguuuuaggccagauagcccaggcucugggaacgcgaggccuaacaacccagacuggggcacauuugaagaggugucaggaaauguaaguccagggacaaggagagaguaccacacagaaaaacuggucacuucuaaaggagauaaagagcucaggacugguaaagagaaggucaccucugguagcacaaccaccacgcgucguucaugcucuaaaaccguuacuaagacuguuauugguccugauggucacaaagaaguuaccaaagaaguggugaccuccgaagaugguucugacugucccgaggcaauggauuuaggcacauugucuggcauagguacucuggauggguuccgccauaggcacccugaugaagcugccuucuucgacacugccucaacuggaaaaacauucccagguuucuucucaccuauguuaggagaguuugucagugagacugagucuaggggcucagaaucuggcaucuucacaaauacaaaggaauccaguucucaucacccugggauagcugaauucccuucccgugguaaaucuucaaguuacagcaaacaauuuacuaguagcacgaguuacaacagaggagacuccacauuugaaagcaagagcuauaaaauggcagaugaggccggaagugaagccgaucaugaaggaacacauagcaccaagagaggccaugcuaaaucucgcccugucagagacugugaugauguccuccaaacacauccuucagguacccaaaguggcauuuucaauaucaagcuaccgggauccaguaagauuuuuucuguuuauugcgaucaagagaccaguuugggaggauggcuuuugauccagcaaagaauggauggaucacugaauuuuaaccggaccuggcaagacuacaagagagguuucggcagccugaaugacgagggggaaggagaauucuggcuaggcaaugacuaccuccacuuacuaacccaaaggggcucuguucuuaggguugaauuagaggacugggcugggaaugaagcuuaugcagaauaucacuuccggguaggcucugaggcugaaggcuaugcccuccaagucuccuccuaugaaggcacugcgggugaugcucugauugaggguuccguagaggaaggggcagaguacaccucucacaacaacaugcaguucagcaccuuugacagggaugcagaccagugggaagagaacugugcagaagucuaugggggaggcuggugguauaauaacugccaagcagccaaucucaauggaaucuacuacccugggggcuccuaugacccaaggaauaacaguccuuaugagauugagaauggaguggucuggguuuccuuuagaggggcagauuauucccucagggcuguucgcaugaaaauuaggccccuugugacccaauag

SEQ ID NO: 8551 - RNA, 2601 nt, Artificial Sequence
  derived and/or modified sequence opt1 from Fibrinogen__Homo_sapiens__AAA17056
auguucagcaugcgcaucgugugccugguccucuccguggugggcaccgccuggaccgccgacagcggggagggcgacuuccuggcggagggcggcgggguccgggggccccgcgugguggagcggcaccaguccgccugcaaggacagcgacuggccguucugcuccgacgaggacuggaacuacaagugccccagcggcugccgcaugaaggggcugaucgacgaggucaaccaggacuucacgaaccggaucaacaagcucaagaacucccuguucgaguaccagaagaacaacaaggacagccacucccugaccaccaacaucauggagauccuccgcggcgacuucagcuccgccaacaaccgggacaacaccuacaaccgcgugagcgaggaccugcggucccgcaucgaggugcugaagcggaaggucaucgagaaggugcagcacauccagcuccugcagaagaacgugcgcgcccagcuggucgacaugaagcggcucgagguggacaucgacaucaagauccgcagcugccggggguccugcagccgcgcccuggcgcgggagguggaccugaaggacuacgaggaccagcagaagcagcucgagcaggucaucgccaaggaccugcugcccucccgcgaccggcagcaccucccccugaucaagaugaagccggugcccgaccuggugcccggcaacuucaagagccagcuccagaaggugcccccggaguggaaggcccugacggacaugccccagaugcgcauggagcuggagcggcccgggggcaacgagaucacccgcggcggguccaccagcuacggcaccgggagcgagacggagagcccccgcaacccguccuccgccggcagcuggaacuccggcagcuccgggcccggcagcaccgggaaccggaaccccggcuccagcgggaccggcggcaccgcgacguggaagcccggguccagcggcccgggguccaccggcagcuggaacuccgggagcuccggcaccggcagcaccgggaaccagaaccccggcagcccccgccccggguccacgggcaccuggaacccggggagcuccgagcggggcagcgccggccacuggaccuccgagagcuccgucagcggguccaccggccaguggcacagcgaguccgggagcuuccgccccgacucccccggcagcggcaacgcccggcccaacaacccggacugggggacguucgaggagguguccggcaacgucagccccgggacccgccgggaguaccacaccgagaagcucgugaccuccaagggcgacaaggagcugcgcacggggaaggagaaggugaccagcggcuccaccaccacgacccggcgcagcugcagcaagaccgucaccaagacggugaucggccccgacgggcacaaggaggucaccaaggagguggugaccuccgaggacggcagcgacugccccgaggccauggaccuggggacccucuccggcaucgggacgcuggacggcuuccggcaccgccacccggacgaggccgcguucuucgacaccgccagcaccggcaagaccuuccccggguucuucucccccaugcugggcgaguucgucagcgagaccgagucccgggggagcgaguccggcaucuucacgaacaccaaggagagcuccagccaccacccggggaucgccgaguuccccucccgcggcaagagcuccagcuacuccaagcaguucaccagcuccaccagcuacaaccggggcgacagcacguucgaguccaagagcuacaagauggccgacgaggccggguccgaggcggaccacgagggcacccacagcaccaagcgcgggcacgccaagucccggcccgugcgcgacugcgacgacgugcuccagacccaccccagcggcacgcaguccgggaucuucaacaucaagcugccgggcagcuccaagaucuucagcgucuacugcgaccaggagaccucccugggcggguggcuccugauccagcagcggauggacggcagccugaacuucaaccgcaccuggcaggacuacaagcgcggguucggcucccucaacgacgagggcgagggggaguucuggcugggcaacgacuaccugcaccuccugacccagcgggggagcgugcugcgcguggagcucgaggacugggccggcaacgaggccuacgccgaguaccacuuccgggucggguccgaggcggagggcuacgcccuccaggugagcuccuacgagggcacggccggggacgcccugaucgagggcagcguggaggagggggccgaguacaccucccacaacaacaugcaguucagcaccuucgaccgcgacgcggaccagugggaggagaacugcgccgaggucuacggcgggggcuggugguacaacaacugccaggccgccaaccugaacggcaucuacuaccccgggggcagcuacgacccccggaacaacucccccuacgagaucgagaacgggguggugugggucagcuuccgcggcgcggacuacucccugcgggccgugcgcaugaagauccggccgcuggugacccaguga

SEQ ID NO: 8552 - RNA, 2601 nt, Artificial Sequence
  derived and/or modified sequence opt2 from Fibrinogen__Homo_sapiens__AAA17056
auguucuccaugcgcaucgucugccucguccucuccgucgucggcaccgccuggaccgccgacuccggcgagggcgacuuccucgccgagggcggcggcguccgcggcccccgcgucgucgagcgccaccaguccgccugcaaggacuccgacuggcccuucugcuccgacgaggacuggaacuacaagugccccuccggcugccgcaugaagggccucaucgacgaggucaaccaggacuucaccaaccgcaucaacaagcucaagaacucccucuucgaguaccagaagaacaacaaggacucccacucccucaccaccaacaucauggagauccuccgcggcgacuucuccuccgccaacaaccgcgacaacaccuacaaccgcgucuccgaggaccuccgcucccgcaucgagguccucaagcgcaaggucaucgagaagguccagcacauccagcuccuccagaagaacguccgcgcccagcucgucgacaugaagcgccucgaggucgacaucgacaucaagauccgcuccugccgcggcuccugcucccgcgcccucgcccgcgaggucgaccucaaggacuacgaggaccagcagaagcagcucgagcaggucaucgccaaggaccuccuccccucccgcgaccgccagcaccucccccucaucaagaugaagcccguccccgaccucguccccggcaacuucaagucccagcuccagaaggucccccccgaguggaaggcccucaccgacaugccccagaugcgcauggagcucgagcgccccggcggcaacgagaucacccgcggcggcuccaccuccuacggcaccggcuccgagaccgaguccccccgcaaccccuccuccgccggcuccuggaacuccggcuccuccggccccggcuccaccggcaaccgcaaccccggcuccuccggcaccggcggcaccgccaccuggaagcccggcuccuccggccccggcuccaccggcuccuggaacuccggcuccuccggcaccggcuccaccggcaaccagaaccccggcuccccccgccccggcuccaccggcaccuggaaccccggcuccuccgagcgcggcuccgccggccacuggaccuccgaguccuccgucuccggcuccaccggccaguggcacuccgaguccggcuccuuccgccccgacucccccggcuccggcaacgcccgccccaacaaccccgacuggggcaccuucgaggaggucuccggcaacgucucccccggcacccgccgcgaguaccacaccgagaagcucgucaccuccaagggcgacaaggagcuccgcaccggcaaggagaaggucaccuccggcuccaccaccaccacccgccgcuccugcuccaagaccgucaccaagaccgucaucggccccgacggccacaaggaggucaccaaggaggucgucaccuccgaggacggcuccgacugccccgaggccauggaccucggcacccucuccggcaucggcacccucgacggcuuccgccaccgccaccccgacgaggccgccuucuucgacaccgccuccaccggcaagaccuuccccggcuucuucucccccaugcucggcgaguucgucuccgagaccgagucccgcggcuccgaguccggcaucuucaccaacaccaaggaguccuccucccaccaccccggcaucgccgaguuccccucccgcggcaaguccuccuccuacuccaagcaguucaccuccuccaccuccuacaaccgcggcgacuccaccuucgaguccaaguccuacaagauggccgacgaggccggcuccgaggccgaccacgagggcacccacuccaccaagcgcggccacgccaagucccgccccguccgcgacugcgacgacguccuccagacccaccccuccggcacccaguccggcaucuucaacaucaagcuccccggcuccuccaagaucuucuccgucuacugcgaccaggagaccucccucggcggcuggcuccucauccagcagcgcauggacggcucccucaacuucaaccgcaccuggcaggacuacaagcgcggcuucggcucccucaacgacgagggcgagggcgaguucuggcucggcaacgacuaccuccaccuccucacccagcgcggcuccguccuccgcgucgagcucgaggacugggccggcaacgaggccuacgccgaguaccacuuccgcgucggcuccgaggccgagggcuacgcccuccaggucuccuccuacgagggcaccgccggcgacgcccucaucgagggcuccgucgaggagggcgccgaguacaccucccacaacaacaugcaguucuccaccuucgaccgcgacgccgaccagugggaggagaacugcgccgaggucuacggcggcggcuggugguacaacaacugccaggccgccaaccucaacggcaucuacuaccccggcggcuccuacgacccccgcaacaacucccccuacgagaucgagaacggcgucgucugggucuccuuccgcggcgccgacuacucccuccgcgccguccgcaugaagauccgcccccucgucacccaguga

SEQ ID NO: 8553 - RNA, 2601 nt, Artificial Sequence
  derived and/or modified sequence opt3 from Fibrinogen__Homo_sapiens__AAA17056
auguucagcaugagaaucgugugccugguccucuccguugugggcaccgccuggacagcugacucuggggagggagauuuucuugcagaagguggcgggguaaggggaccccggguggucgagcgccaccagucagccuguaaggacagugauuggccuuucugcagcgacgaagauuggaacuacaaauguccauccggcugccgaaugaagggucugauugacgaggugaaucaagauuuuacuaaccguauaaauaaauugaagaacucuuuauucgaauaucagaaaaauaacaaggacucgcauucacugacgaccaauaucauggagauucuaagaggggauuuuagcagugcgaacaauagggacaacacauacaaucggguuuccgaggaucuccgcucuagaaucgaagugcugaagaggaaagucauugagaaggugcagcacauccagcuucugcaaaagaacguacgggcucaguugguugacaugaagcgccucgaaguggauauagacaucaaaauucgaagcuguagaggauccugcucaagggcccuggcacgggaggucgaccugaaggauuaugaggaccagcagaagcaacucgaacaggugaucgccaaagauuuacugccgagucgugaccgccagcaucuucccuugauuaagaugaaaccugugccagaucugguccccggcaauuucaagagccagcuacaaaaaguuccuccagaguggaaggcucucacugacaugccccagaugagaauggaacuggagaggccuggcgggaacgaaaucacccggggagguucuacauccuacggcaccgggucagagacugagagcccacgaaauccgaguucugcaggauccuggaacagcggcucgucuggucccggguccacaggaaaccgcaauccuggcucaaguggcaccgggggaacggccacuuggaaaccagguagcuccggccccgggucuaccggaagcuggaacucaggcaguuccgguacagggagcacuggcaaucagaacccuggaucuccaagacccggcucaaccgggacauggaauccgggaaguagcgaaagggguuccgcuggccacuggaccucugagucgagcguguccgggucaacgggacaauggcauagugaaucuggcagcuuucggccugauucccccgguucagggaacgcccgcccaaauaacccugacuggggcacuuucgaggaaguaagcggaaaugugucucccggcacaagaagggaguaucacaccgagaaacuugucacuuccaagggggauaaagaacugcguacaggaaaggagaaagugaccagugguagcacgaccacaacucggcgaucuuguuccaagaccguuacaaaaacugugauaggcccagacgggcacaaggaagucaccaaggaggugguaacaucagaagauggaagugacugccccgaggcgauggacuugggcacccucagcgguauugggacucuggauggcuuuagacauaggcacccugacgaggcagccuucuuugauacggcuucgacaggaaaaaccuucccaggcuuuuucuccccgauguuaggggaguucguuucugaaacugaaagccgcggaucagagaguggcaucuuuaccaacacaaaggaguccucuagccaucaccccgguauugccgaguucccuucccgggggaaaucaagcaguuacucuaagcaguuuaccuccagcacuucguauaauagaggagacucaacauucgaaucuaaaaguuacaagauggcagaugaagcuggcuccgaggccgaccacgaagguacgcauagcaccaagaggggccacgcgaaaucucgcccagugcgagauugugacgauguccugcagacucaucccagcgggacacaguccggaaucuuuaacaucaagcucccuggcucaaguaaaauuuucagcguguacugcgaccaagagaccucucuugggggauggcuguugauacagcagcggauggauggcucccuaaauuuuaaccguacauggcaggacuauaagagagguuucgggucacugaaugaugagggagaaggcgaguuuuggcucgguaacgacuaccugcaccuucugacucaaaggggcagugucuugcgcguggaacucgaggacugggccgggaacgaagcauaugcugaguaccauuuccggguuggaagcgaggccgaaggcuaugcuuuacagguguccucuuacgaggggaccgccggagaugcacugaucgaaggcucgguagaggaaggugccgaguauacgagccacaauaacaugcaguuuucaaccuucgacagagaugcugaccagugggaggaaaauugugcggaggucuacgggggaggcuggugguacaacaauugccaagcagccaaccugaaugguauuuauuacccaggcggguccuaugaucccaggaacaauaguccguacgaaaucgagaacggagugguuugggugucuuuucgaggcgcugacuauagccuacgcgccguccggaugaaaauaagaccucucgugacacaguga

SEQ ID NO: 8554 - RNA, 2601 nt, Artificial Sequence
  derived and/or modified sequence opt4 from Fibrinogen__Homo_sapiens__AAA17056
auguucagcaugagaaucgugugccuggugcugagcguggugggcaccgccuggaccgccgacagcggcgagggcgacuuccuggccgagggcggcggcgugagaggccccagagugguggagagacaccagagcgccugcaaggacagcgacuggcccuucugcagcgacgaggacuggaacuacaagugccccagcggcugcagaaugaagggccugaucgacgaggugaaccaggacuucaccaacagaaucaacaagcugaagaacagccuguucgaguaccagaagaacaacaaggacagccacagccugaccaccaacaucauggagauccugagaggcgacuucagcagcgccaacaacagagacaacaccuacaacagagugagcgaggaccugagaagcagaaucgaggugcugaagagaaaggugaucgagaaggugcagcacauccagcugcugcagaagaacgugagagcccagcugguggacaugaagagacuggagguggacaucgacaucaagaucagaagcugcagaggcagcugcagcagagcccuggccagagagguggaccugaaggacuacgaggaccagcagaagcagcuggagcaggugaucgccaaggaccugcugcccagcagagacagacagcaccugccccugaucaagaugaagcccgugcccgaccuggugcccggcaacuucaagagccagcugcagaaggugccccccgaguggaaggcccugaccgacaugccccagaugagaauggagcuggagagacccggcggcaacgagaucaccagaggcggcagcaccagcuacggcaccggcagcgagaccgagagccccagaaaccccagcagcgccggcagcuggaacagcggcagcagcggccccggcagcaccggcaacagaaaccccggcagcagcggcaccggcggcaccgccaccuggaagcccggcagcagcggccccggcagcaccggcagcuggaacagcggcagcagcggcaccggcagcaccggcaaccagaaccccggcagccccagacccggcagcaccggcaccuggaaccccggcagcagcgagagaggcagcgccggccacuggaccagcgagagcagcgugagcggcagcaccggccaguggcacagcgagagcggcagcuucagacccgacagccccggcagcggcaacgccagacccaacaaccccgacuggggcaccuucgaggaggugagcggcaacgugagccccggcaccagaagagaguaccacaccgagaagcuggugaccagcaagggcgacaaggagcugagaaccggcaaggagaaggugaccagcggcagcaccaccaccaccagaagaagcugcagcaagaccgugaccaagaccgugaucggccccgacggccacaaggaggugaccaaggagguggugaccagcgaggacggcagcgacugccccgaggccauggaccugggcacccugagcggcaucggcacccuggacggcuucagacacagacaccccgacgaggccgccuucuucgacaccgccagcaccggcaagaccuuccccggcuucuucagccccaugcugggcgaguucgugagcgagaccgagagcagaggcagcgagagcggcaucuucaccaacaccaaggagagcagcagccaccaccccggcaucgccgaguuccccagcagaggcaagagcagcagcuacagcaagcaguucaccagcagcaccagcuacaacagaggcgacagcaccuucgagagcaagagcuacaagauggccgacgaggccggcagcgaggccgaccacgagggcacccacagcaccaagagaggccacgccaagagcagacccgugagagacugcgacgacgugcugcagacccaccccagcggcacccagagcggcaucuucaacaucaagcugcccggcagcagcaagaucuucagcguguacugcgaccaggagaccagccugggcggcuggcugcugauccagcagagaauggacggcagccugaacuucaacagaaccuggcaggacuacaagagaggcuucggcagccugaacgacgagggcgagggcgaguucuggcugggcaacgacuaccugcaccugcugacccagagaggcagcgugcugagaguggagcuggaggacugggccggcaacgaggccuacgccgaguaccacuucagagugggcagcgaggccgagggcuacgcccugcaggugagcagcuacgagggcaccgccggcgacgcccugaucgagggcagcguggaggagggcgccgaguacaccagccacaacaacaugcaguucagcaccuucgacagagacgccgaccagugggaggagaacugcgccgagguguacggcggcggcuggugguacaacaacugccaggccgccaaccugaacggcaucuacuaccccggcggcagcuacgaccccagaaacaacagccccuacgagaucgagaacggcguggugugggugagcuucagaggcgccgacuacagccugagagccgugagaaugaagaucagaccccuggugacccaguga

SEQ ID NO: 8555 - RNA, 2601 nt, Artificial Sequence
  derived and/or modified sequence opt5 from Fibrinogen__Homo_sapiens__AAA17056
auguucagcaugagaaucgugugccugguccucuccguugugggcaccgccuggacagcugacucuggggagggagauuuucuggccgaaggcgggggagugcggggcccccgcgucguggagagacaccagagcgcguguaaggacuccgauuggccuuucugcucugacgaagauuggaacuacaaauguccgagcgggugccggaugaagggacuuauugacgagguuaaucaagauuuuacgaaccgcaucaauaaacugaagaacucccucuucgaauaucagaaaaauaacaaggacucucauagccugaccacaaauauuauggagauccuuagaggcgauuuuuccagcgcuaacaaucgggacaacaccuacaaucgcgugucugaggaucugagaucccggauugaaguccucaagcgcaaagugaucgagaagguucagcacauccagcugcugcaaaagaacgugagagcccagcucgucgacaugaagcggcuggaaguggauauugacaucaaaauucgcagcuguagaggcucuugcucccgggcccuugcucgcgagguggaccugaaggauuaugaggaccagcagaagcaacucgaacaggucaucgccaaagaucugcuucccagcagagaccggcagcaucugccucucauuaagaugaaacccguuccugaucuggugcccgggaauuucaagucucagcugcaaaaagugccuccggaguggaaggcucucacagacaugccccagaugagaauggaacuggagcgcccuggaggcaacgaaaucaccagagggggauccacaagcuacggcaccggguccgagacggagucuccccggaauccuagcuccgccggaagcuggaacucuggcuccagcggccccgggucuaccggaaaccgcaauccgggcagcuccgggacaggaggcaccgcgacauggaaaccugggucuagcggacccggcuccaccggcagcuggaacucuggguccagcggaacgggcucuacagggaaucagaacccuggaagcccccggcccggcuccaccgggacauggaauccuggcuccucugaaagaggaagcgccggccacuggaccuccgagucuagcgucuccgggagcaccggacaauggcauucugaauccggcagcuuucgcccggauucucccggguccggaaacgcucggccuaauaaccccgacuggggcacauucgaggaagugagcgggaauguuucuccuggcacgagacgcgaguaucacaccgagaaacuugugacaagcaagggagauaaagaacugcggaccggcaaggagaaagucacauccgggagcaccacgacaaccagacgcucuuguuccaagaccgugacaaaaaccguuauuggacccgacggccacaaggaagugacaaaggaggucgugacgagcgaagauggguccgacugcccggaggccauggaccucggaacccugucuggcaucgggacacuugauggcuuucggcauagacacccugacgaggcugccuucuuugauaccgcgagcacaggaaaaaccuuccccggcuuuuucuccccuaugcugggggaguucgucucugaaacggaaagccggggauccgagucuggcaucuuuaccaacacaaaggagagcuccagccaucaccccgggauugccgaguucccuucucgcggaaaauccagcucuuacuccaagcaguuuaccagcucuacauccuauaauagaggcgacagcaccuucgaauccaaaagcuacaagauggcugaugaagccgggucugaggcugaccacgaaggcacgcauagcacaaagcggggacacgccaaauccagacccgugcgcgauugugacgauguucuccagacccauccgucuggcacacagagcgggaucuuuaacauuaagcugccuggauccucuaaaaucuucagcguguacugcgaccaagagaccucccugggcggguggcuccugauucagcagcggauggauggaucucuuaauuuuaacagaaccuggcaggacuauaagcgcggcuucggcagccugaaugaugagggggaaggagaguuuuggcucggcaacgacuaccugcaccuucugacacaaagaggguccguccuccggguggaacuggaggacugggccggaaacgaggcuuaugcggaauaccauuuccgcguuggcagcgaggccgaaggguaugcucuccaggugucuuccuacgagggaacggccggcgaugcccugaucgaaggcagcgucgaggaaggggcugaguauaccucucacaauaacaugcaguuuuccacauucgacagagaugccgaccagugggaggaaaauugugcggagguguacggaggcggguggugguacaacaauugccaagcugccaaccugaauggaaucuauuaccccggcgggagcuaugauccccggaacaauuccccuuacgaaauugagaacggagugguuugggucucuuuucgcggcgccgacuauagccuuagagcugugcggaugaaaauccgcccgcuggugacccaguga

SEQ ID NO: 8556 - protein, 491 aa, Artificial Sequence
  Fibrinogen__Homo_sapiens__P02675
MKRMVSWSFHKLKTMKHLLLLLLCVFLVKSQGVNDNEEGFFSARGHRPLDKKREEAPSLRPAPPPISGGGYRARPAKAAATQKKVERKAPDAGGCLHADPDLGVLCPTGCQLQEALLQQERPIRNSVDELNNNVEAVSQTSSSSFQYMYLLKDLWQKRQKQVKDNENVVNEYSSELEKHQLYIDETVNSNIPTNLRVLRSILENLRSKIQKLESDVSAQMEYCRTPCTVSCNIPVVSGKECEEIIRKGGETSEMYLIQPDSSVKPYRVYCDMNTENGGWTVIQNRQDGSVDFGRKWDPYKQGFGNVATNTDGKNYCGLPGEYWLGNDKISQLTRMGPTELLIEMEDWKGDKVKAHYGGFTVQNEANKYQISVNKYRGTAGNALMDGASQLMGENRTMTIHNGMFFSTYDRDNDGWLTSDPRKQCSKEDGGGWWYNRCHAANPNGRYYWGGQYTWDMAKHGTDDGVVWMNWKGSWYSMRKMSMKIRPFFPQQ

SEQ ID NO: 8557 - RNA, 1476 nt, Artificial Sequence
  Fibrinogen__Homo_sapiens__AAA18024
augaaaaggaugguuucuuggagcuuccacaaacuuaaaaccaugaaacaucuauuauugcuacuauuguguguuuuucuaguuaagucccaaggugucaacgacaaugaggaggguuucuucagugcccguggucaucgaccccuugacaagaagagagaagaggcucccagccugaggccugccccaccgcccaucaguggagguggcuaucgggcucguccagccaaagcagcugccacucaaaagaaaguagaaagaaaagccccugaugcuggaggcugucuucacgcugacccagaccuggggguguuguguccuacaggaugucaguugcaagaggcuuugcuacaacaggaaaggccaaucagaaauaguguugaugaguuaaauaacaauguggaagcuguuucccagaccuccucuucuuccuuucaguacauguauuugcugaaagaccuguggcaaaagaggcagaagcaaguaaaagauaaugaaaauguagucaaugaguacuccucagaacuggaaaagcaccaauuauauauagaugagacugugaauagcaauaucccaacuaaccuucgugugcuucguucaauccuggaaaaccugagaagcaaaauacaaaaguuagaaucugaugucucagcucaaauggaauauugucgcaccccaugcacugucaguugcaauauuccuguggugucuggcaaagaaugugaggaaauuaucaggaaaggaggugaaacaucugaaauguaucucauucaaccugacaguucugucaaaccguauagaguauacugugacaugaauacagaaaauggaggauggacagugauucagaaccgucaagacgguaguguugacuuuggcaggaaaugggauccauauaaacagggauuuggaaauguugcaaccaacacagaugggaagaauuacuguggccuaccaggugaauauuggcuuggaaaugauaaaauuagccagcuuaccaggaugggacccacagaacuuuugauagaaauggaggacuggaaaggagacaaaguaaaggcucacuauggaggauucacuguacagaaugaagccaacaaauaccagaucucagugaacaaauacagaggaacagccgguaaugcccucauggauggagcaucucagcugaugggagaaaacaggaccaugaccauucacaacggcauguucuucagcacguaugacagagacaaugacggcugguuaacaucagaucccagaaaacaguguucuaaagaagacggugguggauggugguauaauagaugucaugcagccaauccaaacggcagauacuacugggguggacaguacaccugggacauggcaaagcauggcacagaugaugguguaguauggaugaauuggaaggggucaugguacucaaugaggaagaugaguaugaagaucaggcccuucuucccacagcaauag

SEQ ID NO: 8558 - RNA, 1476 nt, Artificial Sequence
  derived and/or modified sequence opt1 from Fibrinogen__Homo_sapiens__AAA18024
augaagcgcauggugagcugguccuuccacaagcugaagaccaugaagcaccuccugcugcuccugcugugcgucuuccucgucaagagccagggcgugaacgacaacgaggagggguucuucuccgcccggggccaccgcccccuggacaagaagcgggaggaggccccgagccugcgccccgcgcccccgcccaucuccgggggcggguaccgggcccgccccgccaaggccgccgcgacccagaagaagguggagcggaaggcccccgacgccggcggcugccuccacgccgaccccgaccugggggugcugugcccgacgggcugccagcuccaggaggcgcugcugcagcaggagcgccccauccggaacagcguggacgagcucaacaacaacgucgaggccgugucccagaccagcuccagcuccuuccaguacauguaccugcugaaggaccucuggcagaagcgccagaagcaggucaaggacaacgagaacguggugaacgaguacagcuccgagcuggagaagcaccagcuguacaucgacgagaccgugaacagcaacauccccaccaaccuccggguccugcgcuccauccuggagaaccuccggagcaagauccagaagcuggaguccgacgugagcgcccagauggaguacugccgcacgcccugcaccguguccugcaacaucccggucgugagcgggaaggagugcgaggagaucauccggaagggcggggagaccagcgagauguaccugauccagcccgacuccagcgugaagcccuaccgcgucuacugcgacaugaacaccgagaacggcggcuggacggugauccagaaccggcaggacggguccguggacuucggccgcaagugggaccccuacaagcagggguucggcaacgucgccaccaacaccgacggcaagaacuacugcgggcucccgggcgaguacuggcuggggaacgacaagaucagccagcugacccggaugggccccacggagcuccugaucgagauggaggacuggaagggggacaaggugaaggcccacuacggcggcuucaccgugcagaacgaggcgaacaaguaccagaucuccgucaacaaguaccgcgggaccgccggcaacgcccugauggacggggccagccagcucaugggcgagaaccggaccaugacgauccacaacgggauguucuucuccaccuacgaccgcgacaacgacggcuggcugaccagcgacccccgcaagcagugcuccaaggaggacggcgggggcuggugguacaaccggugccacgccgcgaaccccaacgggcgcuacuacuggggcgggcaguacaccugggacauggccaagcacggcacggacgacggcguggucuggaugaacuggaaggggagcugguacuccaugcggaagaugagcaugaagauccgcccguucuucccccagcaguga

SEQ ID NO: 8559 - RNA, 1476 nt, Artificial Sequence
  derived and/or modified sequence opt2 from Fibrinogen__Homo_sapiens__AAA18024
augaagcgcauggucuccugguccuuccacaagcucaagaccaugaagcaccuccuccuccuccuccucugcgucuuccucgucaagucccagggcgucaacgacaacgaggagggcuucuucuccgcccgcggccaccgcccccucgacaagaagcgcgaggaggcccccucccuccgccccgcccccccccccaucuccggcggcggcuaccgcgcccgccccgccaaggccgccgccacccagaagaaggucgagcgcaaggcccccgacgccggcggcugccuccacgccgaccccgaccucggcguccucugccccaccggcugccagcuccaggaggcccuccuccagcaggagcgccccauccgcaacuccgucgacgagcucaacaacaacgucgaggccgucucccagaccuccuccuccuccuuccaguacauguaccuccucaaggaccucuggcagaagcgccagaagcaggucaaggacaacgagaacgucgucaacgaguacuccuccgagcucgagaagcaccagcucuacaucgacgagaccgucaacuccaacauccccaccaaccuccgcguccuccgcuccauccucgagaaccuccgcuccaagauccagaagcucgaguccgacgucuccgcccagauggaguacugccgcacccccugcaccgucuccugcaacauccccgucgucuccggcaaggagugcgaggagaucauccgcaagggcggcgagaccuccgagauguaccucauccagcccgacuccuccgucaagcccuaccgcgucuacugcgacaugaacaccgagaacggcggcuggaccgucauccagaaccgccaggacggcuccgucgacuucggccgcaagugggaccccuacaagcagggcuucggcaacgucgccaccaacaccgacggcaagaacuacugcggccuccccggcgaguacuggcucggcaacgacaagaucucccagcucacccgcaugggccccaccgagcuccucaucgagauggaggacuggaagggcgacaaggucaaggcccacuacggcggcuucaccguccagaacgaggccaacaaguaccagaucuccgucaacaaguaccgcggcaccgccggcaacgcccucauggacggcgccucccagcucaugggcgagaaccgcaccaugaccauccacaacggcauguucuucuccaccuacgaccgcgacaacgacggcuggcucaccuccgacccccgcaagcagugcuccaaggaggacggcggcggcuggugguacaaccgcugccacgccgccaaccccaacggccgcuacuacuggggcggccaguacaccugggacauggccaagcacggcaccgacgacggcgucgucuggaugaacuggaagggcuccugguacuccaugcgcaagauguccaugaagauccgccccuucuucccccagcaguga

SEQ ID NO: 8560 - RNA, 1476 nt, Artificial Sequence
  derived and/or modified sequence opt3 from Fibrinogen__Homo_sapiens__AAA18024
augaagagaauggugagcugguccuuccacaaacugaagaccaugaaacaucuccuucuguuguuacugugcgucuuucuaguuaagucucagggcgugaacgacaaugaggaaggguucuuuucagccaggggacaccggccccucgauaaaaagcgcgaggaagcuccuagucugcgaccagcaccgcccccuaucagcgguggcggguaccgugccagaccagcgaaggcugccgcaacacaaaagaagguagagaggaaagcccccgacgcuggaggcugucuucaugcagauccugaccuggguguguugugcccaacugggugucagcuccaggaagcccugcugcagcaagagcggcccauucgcaacuccgucgaugagcucaauaacaauguggaagcuguuucucagacgucgucaagcaguuuccaguauauguacuuacugaaggaccuuuggcagaaaagacaaaaacaggugaaggauaacgagaaugucgugaacgaauauuccucugaguuggagaaacaccagcuguacauagacgaaaccguaaauagcaacaucccuacaaaucuaaggguucuccgguccauucuggagaaccuucgcucaaagauccagaaacuggaaagugaugugagcgcccaaauggaguauugccgaacuccauguaccgucucuugcaauauuccggugguguccggaaaggaaugugaggagaucauaagaaaaggcggcgaaacaucagagauguacuugauccagcccgacagcagugucaagccuuauaggguuuacugcgauaugaacaccgaaaaugggggauggacugugauucagaaccggcaagacgguucuguagauuuuggccguaaaugggacccauacaagcagggguucggaaacguggcgacaaauaccgacggcaagaacuauuguggucuccccggggaguacuggcugggaaaugauaaaaucucccaguuaacgcgcaugggcccuacugaacugcucauugagauggaggacuggaagggcgauaaagucaaggcacauuaugggggauuuaccgugcagaacgaagccaauaaauaccaaaucagcguuaacaaguauagagguacagcuggcaaugcccuuauggacggggcaucgcagcugaugggagagaacaggacuaugaccauacacaauggcauguucuuuucuacauacgaucgggacaacgaugguugguugaccuccgacccacgaaagcagugcucaaaagaagaugggggcggauggugguauaaucgcugucacgcugccaaccccaauggcagauacuacuggggagggcaguauacgugggacauggcgaagcaugguacugaugacggcguggucuggaugaacuggaaagggaguugguacagcaugaggaagauguccaugaaaauucggccguucuuuccucaacaguga

SEQ ID NO: 8561 - RNA, 1476 nt, Artificial Sequence
  derived and/or modified sequence opt4 from Fibrinogen__Homo_sapiens__AAA18024
augaagagaauggugagcuggagcuuccacaagcugaagaccaugaagcaccugcugcugcugcugcugugcguguuccuggugaagagccagggcgugaacgacaacgaggagggcuucuucagcgccagaggccacagaccccuggacaagaagagagaggaggcccccagccugagacccgcccccccccccaucagcggcggcggcuacagagccagacccgccaaggccgccgccacccagaagaagguggagagaaaggcccccgacgccggcggcugccugcacgccgaccccgaccugggcgugcugugccccaccggcugccagcugcaggaggcccugcugcagcaggagagacccaucagaaacagcguggacgagcugaacaacaacguggaggccgugagccagaccagcagcagcagcuuccaguacauguaccugcugaaggaccuguggcagaagagacagaagcaggugaaggacaacgagaacguggugaacgaguacagcagcgagcuggagaagcaccagcuguacaucgacgagaccgugaacagcaacauccccaccaaccugagagugcugagaagcauccuggagaaccugagaagcaagauccagaagcuggagagcgacgugagcgcccagauggaguacugcagaacccccugcaccgugagcugcaacauccccguggugagcggcaaggagugcgaggagaucaucagaaagggcggcgagaccagcgagauguaccugauccagcccgacagcagcgugaagcccuacagaguguacugcgacaugaacaccgagaacggcggcuggaccgugauccagaacagacaggacggcagcguggacuucggcagaaagugggaccccuacaagcagggcuucggcaacguggccaccaacaccgacggcaagaacuacugcggccugcccggcgaguacuggcugggcaacgacaagaucagccagcugaccagaaugggccccaccgagcugcugaucgagauggaggacuggaagggcgacaaggugaaggcccacuacggcggcuucaccgugcagaacgaggccaacaaguaccagaucagcgugaacaaguacagaggcaccgccggcaacgcccugauggacggcgccagccagcugaugggcgagaacagaaccaugaccauccacaacggcauguucuucagcaccuacgacagagacaacgacggcuggcugaccagcgaccccagaaagcagugcagcaaggaggacggcggcggcuggugguacaacagaugccacgccgccaaccccaacggcagauacuacuggggcggccaguacaccugggacauggccaagcacggcaccgacgacggcgugguguggaugaacuggaagggcagcugguacagcaugagaaagaugagcaugaagaucagacccuucuucccccagcaguga

SEQ ID NO: 8562 - RNA, 1476 nt, Artificial Sequence
  derived and/or modified sequence opt5 from Fibrinogen__Homo_sapiens__AAA18024
augaagagaauggugagcugguccuuccacaaacugaagaccaugaaacaucuccugcuucugcuccugugcgucuuucuuguuaagucucagggcgugaacgacaaugaggaaggguucuuuagcgcccggggacaccgcccccuggauaaaaagagagaggaagcuccuucccuccggccggcgcccccucccaucucuggcgggggauaccgcgccagaccugcuaaggccgccgcuacacagaaaaagguggagcggaaagcccccgacgcuggcgggugucugcaugccgauccugaccugggaguccucugcccgacgggcugucaacugcaggaagcgcuucugcagcaagagcgccccauuagaaacagcguggaugagcucaauaacaauguugaagccgugucccagaccucuagcuccagcuuccaguauauguaccugcuuaaggaccuguggcagaaacggcaaaagcaggucaaggauaacgagaaugugguuaacgaauauucuuccgagcucgagaaacaccagcuguacaucgacgaaacagugaauagcaacauuccuaccaaucugcgcguccucagaucuauccuggagaaccuucgguccaagauucagaaacuggaaagcgaugugucugcucaaauggaguauugccgcacacccuguaccguguccugcaauaucccugucguuagcggcaaggaaugugaggagaucauuagaaaagggggagaaacauccgagauguaccucauccagcccgacucuagcgugaagccguaucggguguacugcgauaugaacaccgaaaauggcggguggacggucauucagaaccgccaagacggauccguggauuuuggcagaaaaugggacccuuacaagcagggguucggaaacguugccaccaauacagacggcaagaacuauuguggccugcccggggaguacuggcuuggaaaugauaaaaucagccagcugacccggaugggcccuacagaacuccugauugagauggaggacuggaagggggauaaagugaaggcucauuauggaggcuuuaccguccagaacgaagccaauaaauaccaaaucucugugaacaaguauagagggacggcgggaaaugcccugauggacggcgcuucccagcucaugggcgagaaccgcacaaugaccauucacaaugggauguucuuuagcacauacgaucgggacaacgauggauggcugaccucugaccccagaaagcagugcagcaaagaagauggcgggggauggugguauaaucgcugucacgccgcuaaccccaauggccgguacuacuggggcgggcaguauaccugggacauggccaagcauggaacagaugacggcguuguguggaugaacuggaaaggguccugguacucuaugagaaagaugagcaugaaaauccgcccuuucuuuccgcaacaguga

SEQ ID NO: 8563 - protein, 453 aa, Artificial Sequence
  Fibrinogen__Homo_sapiens__P02679
MSWSLHPRNLILYFYALLFLSSTCVAYVATRDNCCILDERFGSYCPTTCGIADFLSTYQTKVDKDLQSLEDILHQVENKTSEVKQLIKAIQLTYNPDESSKPNMIDAATLKSRKMLEEIMKYEASILTHDSSIRYLQEIYNSNNQKIVNLKEKVAQLEAQCQEPCKDTVQIHDITGKDCQDIANKGAKQSGLYFIKPLKANQQFLVYCEIDGSGNGWTVFQKRLDGSVDFKKNWIQYKEGFGHLSPTGTTEFWLGNEKIHLISTQSAIPYALRVELEDWNGRTSTADYAMFKVGPEADKYRLTYAYFAGGDAGDAFDGFDFGDDPSDKFFTSHNGMQFSTWDNDNDKFEGNCAEQDGSGWWMNKCHAGHLNGVYYQGGTYSKASTPNGYDNGIIWATWKTRWYSMKKTTMKIIPFNRLTIGEGQQHHLGGAKQVRPEHPAETEYDSLYPEDDL

SEQ ID NO: 8564 - RNA, 1362 nt, Artificial Sequence
  Fibrinogen__Homo_sapiens__AAK19752
augaguugguccuugcacccccggaauuuaauucucuacuucuaugcucuuuuauuucucucuucaacauguguagcauauguugcuaccagagacaacugcugcaucuuagaugaaagauucgguaguuauuguccaacuaccuguggcauugcagauuuccugucuacuuaucaaaccaaaguagacaaggaucuacagucuuuggaagacaucuuacaucaaguugaaaacaaaacaucagaagucaaacagcugauaaaagcaauccaacucacuuauaauccugaugaaucaucaaaaccaaauaugauagacgcugcuacuuugaaguccaggaaaauguuagaagaaauuaugaaauaugaagcaucgauuuuaacacaugacucaaguauucgauauuugcaggaaauauauaauucaaauaaucaaaagauuguuaaccugaaagagaagguagcccagcuugaagcacagugccaggaaccuugcaaagacacggugcaaauccaugauaucacugggaaagauugucaagacauugccaauaagggagcuaaacagagcgggcuuuacuuuauuaaaccucugaaagcuaaccagcaauucuuagucuacugugaaaucgaugggucuggaaauggauggacuguguuucagaagagacuugauggcaguguagauuucaagaaaaacuggauucaauauaaagaaggauuuggacaucugucuccuacuggcacaacagaauuuuggcugggaaaugagaagauucauuugauaagcacacagucugccaucccauaugcauuaagaguggaacuggaagacuggaauggcagaaccaguacugcagacuaugccauguucaaggugggaccugaagcugacaaguaccgccuaacauaugccuacuucgcugguggggaugcuggagaugccuuugauggcuuugauuuuggcgaugauccuagugacaaguuuuucacaucccauaauggcaugcaguucaguaccugggacaaugacaaugauaaguuugaaggcaacugugcugaacaggauggaucugguugguggaugaacaagugucacgcuggccaucucaauggaguuuauuaccaagguggcacuuacucaaaagcaucuacuccuaaugguuaugauaauggcauuauuugggccacuuggaaaacccggugguauuccaugaagaaaaccacuaugaagauaaucccauucaacagacucacaauuggagaaggacagcaacaccaccuggggggagccaaacaggucagaccagagcacccugcggaaacagaauaugacucacuuuacccugaggaugauuuguag

SEQ ID NO: 8565 - RNA, 1362 nt, Artificial Sequence
  derived and/or modified sequence opt1 from Fibrinogen__Homo_sapiens__AAK19752
augagcuggucccugcacccccgcaaccucauccuguacuucuacgcccugcucuuccugagcuccaccugcguggccuacgucgcgacccgggacaacugcugcauccuggacgagcgcuucggcagcuacugcccgacgaccugcgggaucgccgacuuccucuccaccuaccagaccaagguggacaaggaccugcagagccuggaggacauccuccaccagguggagaacaagacguccgaggucaagcagcugaucaaggccauccagcugaccuacaaccccgacgagagcuccaagcccaacaugaucgacgccgccacccucaagagccggaagaugcuggaggagaucaugaaguacgaggcguccauccugacccacgacagcuccauccgcuaccuccaggagaucuacaacagcaacaaccagaagaucgugaaccugaaggagaagguggcccagcuggaggcccagugccaggagcccugcaaggacacgguccagauccacgacaucaccggcaaggacugccaggacaucgccaacaagggggcgaagcaguccggccucuacuucaucaagccgcugaaggccaaccagcaguuccugguguacugcgagaucgacgggagcggcaacggcuggaccguguuccagaagcggcucgacggguccgucgacuucaagaagaacuggauccaguacaaggagggcuucgggcaccugagccccaccggcacgaccgaguucuggcuggggaacgagaagauccaccucaucuccacccagagcgccauccccuacgcccugcgcguggagcuggaggacuggaacggccggaccagcacggccgacuacgcgauguucaaggugggccccgaggccgacaaguaccgccucaccuacgccuacuucgccgggggcgacgccggggacgcguucgacggcuucgacuucggcgacgacccguccgacaaguucuucaccagccacaacgggaugcaguucuccaccugggacaacgacaacgacaaguucgagggcaacugcgccgagcaggacgggagcggcugguggaugaacaagugccacgccgggcaccugaacggcgucuacuaccagggcgggacguacuccaaggccagcacccccaacggcuacgacaacgggaucaucugggccaccuggaagacccggugguacuccaugaagaagacgaccaugaagaucauccccuucaaccgccugaccaucggcgaggggcagcagcaccaccucggcggcgcgaagcaggugcggcccgagcacccggccgagaccgaguacgacagccuguaccccgaggacgaccuguga

SEQ ID NO: 8566 - RNA, 1362 nt, Artificial Sequence
  derived and/or modified sequence opt2 from Fibrinogen__Homo_sapiens__AAK19752
auguccuggucccuccacccccgcaaccucauccucuacuucuacgcccuccucuuccucuccuccaccugcgucgccuacgucgccacccgcgacaacugcugcauccucgacgagcgcuucggcuccuacugccccaccaccugcggcaucgccgacuuccucuccaccuaccagaccaaggucgacaaggaccuccagucccucgaggacauccuccaccaggucgagaacaagaccuccgaggucaagcagcucaucaaggccauccagcucaccuacaaccccgacgaguccuccaagcccaacaugaucgacgccgccacccucaagucccgcaagaugcucgaggagaucaugaaguacgaggccuccauccucacccacgacuccuccauccgcuaccuccaggagaucuacaacuccaacaaccagaagaucgucaaccucaaggagaaggucgcccagcucgaggcccagugccaggagcccugcaaggacaccguccagauccacgacaucaccggcaaggacugccaggacaucgccaacaagggcgccaagcaguccggccucuacuucaucaagccccucaaggccaaccagcaguuccucgucuacugcgagaucgacggcuccggcaacggcuggaccgucuuccagaagcgccucgacggcuccgucgacuucaagaagaacuggauccaguacaaggagggcuucggccaccucucccccaccggcaccaccgaguucuggcucggcaacgagaagauccaccucaucuccacccaguccgccauccccuacgcccuccgcgucgagcucgaggacuggaacggccgcaccuccaccgccgacuacgccauguucaaggucggccccgaggccgacaaguaccgccucaccuacgccuacuucgccggcggcgacgccggcgacgccuucgacggcuucgacuucggcgacgaccccuccgacaaguucuucaccucccacaacggcaugcaguucuccaccugggacaacgacaacgacaaguucgagggcaacugcgccgagcaggacggcuccggcugguggaugaacaagugccacgccggccaccucaacggcgucuacuaccagggcggcaccuacuccaaggccuccacccccaacggcuacgacaacggcaucaucugggccaccuggaagacccgcugguacuccaugaagaagaccaccaugaagaucauccccuucaaccgccucaccaucggcgagggccagcagcaccaccucggcggcgccaagcagguccgccccgagcaccccgccgagaccgaguacgacucccucuaccccgaggacgaccucuga

SEQ ID NO: 8567 - RNA, 1362 nt, Artificial Sequence
  derived and/or modified sequence opt3 from Fibrinogen__Homo_sapiens__AAK19752
augagcuggucccugcaccccagaaaccucauccuuuacuucuaugcccuguuguuuuuaucuucaaccugcguggcuuacgucgcaacaagggacaauuguugcauucuggaugagcgguucggcaguuauuguccuacuacgugcgggauagccgacuuucuaagcaccuaccagacaaagguugauaaagaccuccaaucccuggaagauauccuucaucagguggagaacaagacuucugaaguaaaacagcugauuaaggcgauccaguugaccuauaauccagacgagucgucaaaaccgaacaugauugaugcugccacacucaagagccgcaagaugcuggaagagaucaugaaauacgaggcaaguauacugacccacgacuccucuauccgauaucuccaagaaauuuacaauagcaacaaucagaagaucgugaacuuaaaagagaaggucgcccagcuggaagcucagugucaagagcccugcaaagauacugugcagauucaugacaucacaggaaaggauugucaggacauagcaaauaagggugccaaacaguccggccuuuacuucauuaagccuuugaaagcuaaccaacaguuucugguuuauugcgagaucgaugggucaggaaauggcuggaccguguuccagaagcgucuagacgguagugucgacuuuaaaaagaacuggauucaauacaaagaaggguucggacaccucagcccaacgggcacuaccgaguuuuggcugggcaaugaaaagauccaucuuaucucuacacaguccgccauucccuaugcgcugagaguggaguuggaagauuggaacgggaggacuucaaccgcagacuacgccauguucaagguaggaccugaggcugauaaauaucggcucacauacgccuauuuugcugguggcgacgcaggggaugccuucgacggauuugauuucggcgacgauccaagcgacaaguucuuuaccagucacaaugguaugcaguucucuacgugggauaacgacaacgacaaauuugaggggaauugugcggaacaggauggauccggcugguggaugaacaagugccacgccggccaucugaaugggguuuacuaccaaggagguacuuauagcaaagcaucgacacccaacggcuacgacaaugggauaaucugggcuaccuggaagacucgcugguauucuaugaagaaaacaaccaugaagauuaucccuuucaacagauuaacgauaggagagggccagcagcaccaucuggguggggccaaacaggugaggccagaacacccggcugagaccgaauacgauucccucuaucccgaggacgaucuuuga

SEQ ID NO: 8568 - RNA, 1362 nt, Artificial Sequence
  derived and/or modified sequence opt4 from Fibrinogen__Homo_sapiens__AAK19752
augagcuggagccugcaccccagaaaccugauccuguacuucuacgcccugcuguuccugagcagcaccugcguggccuacguggccaccagagacaacugcugcauccuggacgagagauucggcagcuacugccccaccaccugcggcaucgccgacuuccugagcaccuaccagaccaagguggacaaggaccugcagagccuggaggacauccugcaccagguggagaacaagaccagcgaggugaagcagcugaucaaggccauccagcugaccuacaaccccgacgagagcagcaagcccaacaugaucgacgccgccacccugaagagcagaaagaugcuggaggagaucaugaaguacgaggccagcauccugacccacgacagcagcaucagauaccugcaggagaucuacaacagcaacaaccagaagaucgugaaccugaaggagaagguggcccagcuggaggcccagugccaggagcccugcaaggacaccgugcagauccacgacaucaccggcaaggacugccaggacaucgccaacaagggcgccaagcagagcggccuguacuucaucaagccccugaaggccaaccagcaguuccugguguacugcgagaucgacggcagcggcaacggcuggaccguguuccagaagagacuggacggcagcguggacuucaagaagaacuggauccaguacaaggagggcuucggccaccugagccccaccggcaccaccgaguucuggcugggcaacgagaagauccaccugaucagcacccagagcgccauccccuacgcccugagaguggagcuggaggacuggaacggcagaaccagcaccgccgacuacgccauguucaaggugggccccgaggccgacaaguacagacugaccuacgccuacuucgccggcggcgacgccggcgacgccuucgacggcuucgacuucggcgacgaccccagcgacaaguucuucaccagccacaacggcaugcaguucagcaccugggacaacgacaacgacaaguucgagggcaacugcgccgagcaggacggcagcggcugguggaugaacaagugccacgccggccaccugaacggcguguacuaccagggcggcaccuacagcaaggccagcacccccaacggcuacgacaacggcaucaucugggccaccuggaagaccagaugguacagcaugaagaagaccaccaugaagaucauccccuucaacagacugaccaucggcgagggccagcagcaccaccugggcggcgccaagcaggugagacccgagcaccccgccgagaccgaguacgacagccuguaccccgaggacgaccuguga

SEQ ID NO: 8569 - RNA, 1362 nt, Artificial Sequence
  derived and/or modified sequence opt5 from Fibrinogen__Homo_sapiens__AAK19752
augagcuggucccugcaccccagaaaccucauccuguacuucuaugcccuucuguuucucucuagcacaugcguggcuuacgucgccacccgggacaauuguugcauucuggaugagcgcuucggcuccuauuguccuacgaccugcgggaucgcggacuuucuuucuacauaccagaccaagguugauaaagaccugcaaagccucgaagauauucugcaucagguggagaacaagacauccgaagugaaacagcugaucaaggcuauucagcucaccuauaauccggacgagucuagcaaacccaacaugaucgaugccgccacacugaaguccagaaagaugcuugaagagaucaugaaauacgaggcuagcauucugacccacgacucuuccauccgguaucuccaagaaauuuacaauagcaacaaucagaagaucgucaaccugaaagagaagguggcccagcuugaagcucagugucaagagccuugcaaagauacgguucagauucaugacaucaccggaaaggauugucaggacauugccaauaagggcgcgaaacagucugggcuguacuucaucaagccccucaaagccaaccaacaguuucugguguauugcgagaucgauggauccggcaauggguggacagucuuccagaagcgccuggacggaagcguggacuuuaaaaagaacuggauucaauacaaagaaggcuucggccaccucucuccuaccgggacaaccgaguuuuggcugggaaaugaaaagauccaucuuauuuccacgcagagcgcuauccccuaugcccugagaguugagcucgaagauuggaacggccggacauccaccgcugacuacgccauguucaagguggggccugaggcggauaaauaucgccugacauacgccuauuuugcuggaggcgacgccggggaugcuuucgacggauuugauuucggcgacgauccgucugacaaguucuuuaccagccacaauggcaugcaguucuccaccugggauaacgacaacgacaaauuugaggggaauugugccgaacaggauggaagcggcugguggaugaacaagugccacgccgggcaucuuaauggagucuacuaccaaggcgggacauauucuaaggcuuccacgcccaacggauacgacaauggcauuaucugggcgaccuggaaaacaagaugguauagcaugaagaaaaccacaaugaagaucauuccuuucaaccggcugaccaucggcgaggggcagcagcaccaucucggaggcgccaaacaggugcgccccgaacacccugcugagacggaauacgauucucuguaucccgaggacgaucuguga

SEQ ID NO: 8570 - protein, 312 aa, Artificial Sequence
  Fibrinogen__Homo_sapiens__Q08830
MAKVFSFILVTTALTMGREISALEDCAQEQMRLRAQVRLLETRVKQQQVKIKQLLQENEVQFLDKGDENTVIDLGSKRQYADCSEIFNDGYKLSGFYKIKPLQSPAEFSVYCDMSDGGGWTVIQRRSDGSENFNRGWKDYENGFGNFVQKHGEYWLGNKNLHFLTTQEDYTLKIDLADFEKNSRYAQYKNFKVGDEKNFYELNIGEYSGTAGDSLAGNFHPEVQWWASHQRMKFSTWDRDHDNYEGNCAEEDQSGWWFNRCHSANLNGVYYSGPYTAKTDNGIVWYTWHGWWYSLKSVVMKIRPNDFIPNVI

SEQ ID NO: 8571 - RNA, 939 nt, Artificial Sequence
  Fibrinogen__Homo_sapiens__AAH07047
auggcaaagguguucaguuucauccuuguuaccaccgcucuuacaaugggcagggaaauuucggcgcucgaggacugugcccaggagcagaugcggcucagagcccaggugcgccugcuugagacccgggucaaacagcaacaggucaagaucaagcagcuuuugcaggagaaugaaguccaguuccuugauaaaggagaugagaauacugucauugaucuuggaagcaagaggcaguaugcagauuguucagagauuuucaaugauggguauaagcucaguggauuuuacaaaaucaaaccucuccagagcccagcagaauuuucuguuuauugugacauguccgauggaggaggauggacuguaauucagagacgaucugauggcagugaaaacuuuaacagaggauggaaagacuaugaaaauggcuuuggaaauuuuguccaaaaacauggugaauauuggcugggcaauaaaaaucuucacuucuugaccacucaagaagacuacacuuuaaaaaucgaccuugcagauuuugaaaaaaauagccguuaugcacaauauaagaauuucaaaguuggagaugaaaagaauuucuacgaguugaauauuggggaauauucuggaacagcuggagauucccuugcggggaauuuucauccugaggugcaguggugggcuagucaccaaagaaugaaauucagcacgugggacagagaucaugacaacuaugaagggaacugcgcagaagaagaucagucuggcuggugguuuaacaggugucacucugcaaaccugaaugguguauacuacagcggccccuacacggcuaaaacagacaaugggauugucugguacaccuggcauggguggugguauucucugaaaucugugguuaugaaaauuaggccaaaugauuuuauuccaaauguaauuuaa

SEQ ID NO: 8572 - RNA, 939 nt, Artificial Sequence
  derived and/or modified sequence opt1 from Fibrinogen__Homo_sapiens__AAH07047
auggccaagguguucagcuucauccuggucaccaccgcccucacgaugggccgcgagaucuccgcgcuggaggacugcgcccaggagcagaugcggcugcgcgcccaggugcggcuccuggagacccgcgugaagcagcagcaggucaagaucaagcagcugcuccaggagaacgaggugcaguuccuggacaagggggacgagaacaccgugaucgaccugggcagcaagcggcaguacgccgacugcuccgagaucuucaacgacggguacaagcucagcggcuucuacaagaucaagccccugcaguccccggccgaguucagcgucuacugcgacauguccgacgggggcggcuggaccgugauccagcgccggagcgacggguccgagaacuucaaccgcggcuggaaggacuacgagaacggguucggcaacuucgugcagaagcacggggaguacuggcugggcaacaagaaccuccacuuccugacgacccaggaggacuacacccugaagaucgaccucgcggacuucgagaagaacagccgguacgcccaguacaagaacuucaaggucggcgacgagaagaacuucuacgagcugaacaucggggaguacuccggcaccgccggggacagccuggccggcaacuuccaccccgaggugcaguggugggcgucccaccagcgcaugaaguucagcacgugggaccgggaccacgacaacuacgagggcaacugcgccgaggaggaccaguccggguggugguucaaccgcugccacagcgccaaccucaacggcguguacuacuccgggcccuacaccgccaagaccgacaacggcaucgucugguacaccuggcacggguggugguacagccugaaguccguggugaugaagauccggcccaacgacuucaucccgaacgucaucuga

SEQ ID NO: 8573 - RNA, 939 nt, Artificial Sequence
  derived and/or modified sequence opt2 from Fibrinogen__Homo_sapiens__AAH07047
auggccaaggucuucuccuucauccucgucaccaccgcccucaccaugggccgcgagaucuccgcccucgaggacugcgcccaggagcagaugcgccuccgcgcccagguccgccuccucgagacccgcgucaagcagcagcaggucaagaucaagcagcuccuccaggagaacgagguccaguuccucgacaagggcgacgagaacaccgucaucgaccucggcuccaagcgccaguacgccgacugcuccgagaucuucaacgacggcuacaagcucuccggcuucuacaagaucaagccccuccagucccccgccgaguucuccgucuacugcgacauguccgacggcggcggcuggaccgucauccagcgccgcuccgacggcuccgagaacuucaaccgcggcuggaaggacuacgagaacggcuucggcaacuucguccagaagcacggcgaguacuggcucggcaacaagaaccuccacuuccucaccacccaggaggacuacacccucaagaucgaccucgccgacuucgagaagaacucccgcuacgcccaguacaagaacuucaaggucggcgacgagaagaacuucuacgagcucaacaucggcgaguacuccggcaccgccggcgacucccucgccggcaacuuccaccccgagguccaguggugggccucccaccagcgcaugaaguucuccaccugggaccgcgaccacgacaacuacgagggcaacugcgccgaggaggaccaguccggcuggugguucaaccgcugccacuccgccaaccucaacggcgucuacuacuccggccccuacaccgccaagaccgacaacggcaucgucugguacaccuggcacggcuggugguacucccucaaguccgucgucaugaagauccgccccaacgacuucauccccaacgucaucuga

SEQ ID NO: 8574 - RNA, 939 nt, Artificial Sequence
  derived and/or modified sequence opt3 from Fibrinogen__Homo_sapiens__AAH07047
auggccaagguguucagcuuuauccuggucaccacagcucucacuaugggcagagagauuuccgcacuugaagacugcgcccaggagcaaaugaggcugcgggcgcagguucgcuuguuagaaacgcgagugaaacagcagcaaguaaagauaaaacagcugcuacaggagaacgaagugcaguuccucgauaagggggacgagaauaccgucaucgaucugggaucuaaacgucaauacgcugacuguucagagauuuuuaacgaugguuauaaacuuaguggcuucuacaagaucaagccccugcagagcccugccgaauuuuccguguauugcgacaugucugaugggggaggcuggacaguuauucagagaaggucggacgguucagagaauuucaaccggggguggaaggauuacgaaaauggauuuggcaacuucgugcagaaacacggcgaguauugguuggggaauaagaaccuccauuuucugacuacccaagaggacuacacacugaaaaucgaucucgcagacuucgaaaagaauagccgcuaugcccaguacaagaacuuuaaagucggagaugagaagaauuucuacgaauuaaacauaggugaguauaguggcaccgcuggggacucccuggcaggaaauuuucacccagaagugcaguggugggccucucaucaaagaaugaaauucagcacuugggacagggaucacgacaacuacgagggcaauugugcugaggaagaucaguccgguuggugguucaaccggugccauucagccaaccuuaaugggguauauuacaguggaccguauacagcgaagaccgacaacggcaucguuugguacacguggcacggcuggugguauagcuugaaaucuguggucaugaagauucgccccaaugauuuuaucccuaacgugauuuga

SEQ ID NO: 8575 - RNA, 939 nt, Artificial Sequence
  derived and/or modified sequence opt4 from Fibrinogen__Homo_sapiens__AAH07047
auggccaagguguucagcuucauccuggugaccaccgcccugaccaugggcagagagaucagcgcccuggaggacugcgcccaggagcagaugagacugagagcccaggugagacugcuggagaccagagugaagcagcagcaggugaagaucaagcagcugcugcaggagaacgaggugcaguuccuggacaagggcgacgagaacaccgugaucgaccugggcagcaagagacaguacgccgacugcagcgagaucuucaacgacggcuacaagcugagcggcuucuacaagaucaagccccugcagagccccgccgaguucagcguguacugcgacaugagcgacggcggcggcuggaccgugauccagagaagaagcgacggcagcgagaacuucaacagaggcuggaaggacuacgagaacggcuucggcaacuucgugcagaagcacggcgaguacuggcugggcaacaagaaccugcacuuccugaccacccaggaggacuacacccugaagaucgaccuggccgacuucgagaagaacagcagauacgcccaguacaagaacuucaaggugggcgacgagaagaacuucuacgagcugaacaucggcgaguacagcggcaccgccggcgacagccuggccggcaacuuccaccccgaggugcaguggugggccagccaccagagaaugaaguucagcaccugggacagagaccacgacaacuacgagggcaacugcgccgaggaggaccagagcggcuggugguucaacagaugccacagcgccaaccugaacggcguguacuacagcggccccuacaccgccaagaccgacaacggcaucgugugguacaccuggcacggcuggugguacagccugaagagcguggugaugaagaucagacccaacgacuucauccccaacgugaucuga

SEQ ID NO: 8576 - RNA, 939 nt, Artificial Sequence
  derived and/or modified sequence opt5 from Fibrinogen__Homo_sapiens__AAH07047
auggccaagguguucagcuuuauccuggucaccacagcucucacgaugggcagagagauuuccgcccuggaagacugcgcgcaggagcaaaugcggcuucgcgcucagguuagacugcucgaaacccgggugaaacagcagcaagugaagaucaaacagcugcuucaggagaacgaaguccaguuccuggauaagggggacgagaauacagugauugaucucggaucuaaacgccaauacgccgacuguagcgagaucuuuaacgauggcuauaagcuguccggguucuacaagauuaaaccccugcagucuccugccgaauuuagcguuuauugcgacauguccgauggaggcggguggaccgugauccagagacggucugacggaagcgagaauuucaaccgcggcuggaaggauuacgaaaauggcuuugggaacuucguccagaaacacggagaguauuggcucggcaauaagaaccugcauuuucuuacaacccaagaggacuacacacugaaaaucgaucucgcugacuucgaaaagaacuccagauaugcccaguacaagaauuuuaaagugggggaugagaagaauuucuacgaacugaacauuggagaguauagcggcaccgcuggggacucucuugccggaaauuuucacccggaaguucaguggugggcgucccaucaacggaugaaauucagcacgugggaccgcgaucacgacaacuacgagggcaauugugccgaggaagaucagucuggcuggugguucaacagaugccauuccgcuaaccugaaugggguguauuacagcggacccuauaccgccaagacagacaacggcaucgucugguacaccuggcacggguggugguauucucucaaauccguggugaugaagauucggccuaaugauuuuauccccaacgucauuuga

SEQ ID NO: 8577 - protein, 439 aa, Artificial Sequence; identical to SEQ ID NO: 8500
  Fibrinogen__Homo_sapiens__Q14314

SEQ ID NO: 8578 - RNA, 1320 nt, Artificial Sequence
  Fibrinogen__Homo_sapiens__AAD10825
augaagcuggcuaacugguacuggcugagcucagcuguucuugccacuuacgguuuuuugguuguggcaaacaaugaaacagaggaaauuaaagaugaaagagcaaaggaugucugcccagugagacuagaaagcagagggaaaugcgaagaggcaggggagugccccuaccagguaagccugccccccuugacuauucagcucccgaagcaauucagcaggaucgaggagguguucaaagaaguccaaaaccucaaggaaaucguaaauagucuaaagaaaucuugccaagacugcaagcugcaggcugaugacaacggagacccaggcagaaacggacuguuguuacccaguacaggagccccgggagagguuggugauaacagaguuagagaauuagagagugagguuaacaagcuguccucugagcuaaagaaugccaaagaggagaucaauguacuucauggucgccuggagaagcugaaucuuguaaauaugaacaacauagaaaauuauguugacagcaaaguggcaaaucuaacauuuguugucaauaguuuggauggcaaauguucaaagugucccagccaagaacaaauacagucacguccaguucaacaucuaauauauaaagauugcucugacuacuacgcaauaggcaaaagaagcagugagaccuacagaguuacaccugaucccaaaaauaguagcuuugaaguuuacugugacauggagaccauggggggaggcuggacagugcugcaggcacgucucgaugggagcaccaacuucaccagaacauggcaagacuacaaagcaggcuuuggaaaccucagaagggaauuuuggcuggggaacgauaaaauucaucuucugaccaagaguaaggaaaugauucugagaauagaucuugaagacuuuaauggugucgaacuauaugccuuguaugaucaguuuuauguggcuaaugaguuucucaaauaucguuuacacguugguaacuauaauggcacagcuggagaugcauuacguuucaacaaacauuacaaccacgaucugaaguuuuucaccacuccagauaaagacaaugaucgauauccuucugggaacugugggcuguacuacaguucaggcuggugguuugaugcaugucuuucugcaaacuuaaauggcaaauauuaucaccaaaaauacagagguguccguaaugggauuuucugggguaccuggccugguguaagugaggcacacccugguggcuacaaguccuccuucaaagaggcuaagaugaugaucagacccaagcacuuuaagccauaa

SEQ ID NO: 8579 - RNA, 1320 nt, Artificial Sequence; identical to SEQ ID NO: 8502
  derived and/or modified sequence opt1 from Fibrinogen__Homo_sapiens__AAD10825

SEQ ID NO: 8580 - RNA, 1320 nt, Artificial Sequence; identical to SEQ ID NO: 8503
  derived and/or modified sequence opt2 from Fibrinogen__Homo_sapiens__AAD10825

SEQ ID NO: 8581 - RNA, 1320 nt, Artificial Sequence; identical to SEQ ID NO: 8504
  derived and/or modified sequence opt3 from Fibrinogen__Homo_sapiens__AAD10825

SEQ ID NO: 8582 - RNA, 1320 nt, Artificial Sequence; identical to SEQ ID NO: 8505
  derived and/or modified sequence opt4 from Fibrinogen__Homo_sapiens__AAD10825

SEQ ID NO: 8583 - RNA, 1320 nt, Artificial Sequence; identical to SEQ ID NO: 8506
  derived and/or modified sequence opt5 from Fibrinogen__Homo_sapiens__AAD10825

SEQ ID NO: 8584 - protein, 288 aa, Artificial Sequence
  Fibrinogen__Homo_sapiens__Q6UXM4
MDLLWILPSLWLLLLGGPACLKTQEHPSCPGPRELEASKVVLLPSCPGAPGSPGEKGAPGPQGPPGPPGKMGPKGEPGPRNCRELLSQGATLSGWYHLCLPEGRALPVFCDMDTEGGGWLVFQRRQDGSVDFFRSWSSYRAGFGNQESEFWLGNENLHQLTLQGNWELRVELEDFNGNRTFAHYATFRLLGEVDHYQLALGKFSEGTAGDSLSLHSGRPFTTYDADHDSSNSNCAVIVHGAWWYASCYRSNLNGRYAVSEAAAHKYGIDWASGRGVGHPYRRVRMMLR

SEQ ID NO: 8585 - RNA, 867 nt, Artificial Sequence
  Fibrinogen__Homo_sapiens__AAQ88650
auggaucuacuguggauccugcccucccuguggcuucuccugcuuggggggccugccugccugaagacccaggaacaccccagcugcccaggacccagggaacuggaagccagcaaaguuguccuccugcccaguugucccggagcuccaggaaguccuggggagaagggagccccagguccucaagggccaccuggaccaccaggcaagaugggccccaagggugagccaggccccagaaacugccgggagcuguugagccagggcgccaccuugagcggcugguaccaucugugccuaccugagggcagggcccucccagucuuuugugacauggacaccgaggggggcggcuggcugguguuucagaggcgccaggaugguucuguggauuucuuccgcucuugguccuccuacagagcagguuuugggaaccaagagucugaauucuggcugggaaaugagaauuugcaccagcuuacucuccaggguaacugggagcugcggguagagcuggaagacuuuaaugguaaccguacuuucgcccacuaugcgaccuuccgccuccucggugagguagaccacuaccagcuggcacugggcaaguucucagagggcacugcaggggauucccugagccuccacagugggaggcccuuuaccaccuaugacgcugaccacgauucaagcaacagcaacugugcagugauuguccacggugccuggugguaugcauccuguuaccgaucaaaucucaauggucgcuaugcagugucugaggcugccgcccacaaauauggcauugacugggccucaggccguggugugggccaccccuaccgcaggguucggaugaugcuucgauag

SEQ ID NO: 8586 - RNA, 867 nt, Artificial Sequence
  derived and/or modified sequence opt1 from Fibrinogen__Homo_sapiens__AAQ88650
auggaccugcucuggauccugcccagccuguggcuccugcugcucggcgggccggccugccugaagacccaggagcaccccuccugccccggcccccgcgagcuggaggccagcaaggugguccuccugccguccugccccggggcgcccggcagccccggggagaagggcgccccgggcccccaggggccgcccggcccgcccgggaagaugggccccaagggggagcccggcccccggaacugccgcgagcugcucucccagggcgccacccugagcgggugguaccaccugugccuccccgagggccgggcccugcccguguucugcgacauggacacggagggcgggggcuggcugguguuccagcgccggcaggacggguccgucgacuucuuccgcagcugguccagcuaccgggccggcuucgggaaccaggaguccgaguucuggcucggcaacgagaaccugcaccagcugacccuccaggggaacugggagcugcgcguggagcuggaggacuucaacggcaaccggaccuucgcgcacuacgccaccuuccgccuccugggcgagguggaccacuaccagcuggcccucgggaaguucagcgagggcacggccggggacucccugagccugcacuccggccggcccuucaccaccuacgacgcggaccacgacagcuccaacagcaacugcgccgucaucgugcacggggccuggugguacgccuccugcuaccgcagcaaccucaacggccgguacgccgugagcgaggcggccgcccacaaguacggcaucgacugggccuccgggcgcggcgucgggcacccguaccggcgcgugcggaugaugcugcgcuga

SEQ ID NO: 8587 - RNA, 867 nt, Artificial Sequence
  derived and/or modified sequence opt2 from Fibrinogen__Homo_sapiens__AAQ88650
auggaccuccucuggauccuccccucccucuggcuccuccuccucggcggccccgccugccucaagacccaggagcaccccuccugccccggcccccgcgagcucgaggccuccaaggucguccuccuccccuccugccccggcgcccccggcucccccggcgagaagggcgcccccggcccccagggcccccccggcccccccggcaagaugggccccaagggcgagcccggcccccgcaacugccgcgagcuccucucccagggcgccacccucuccggcugguaccaccucugccuccccgagggccgcgcccuccccgucuucugcgacauggacaccgagggcggcggcuggcucgucuuccagcgccgccaggacggcuccgucgacuucuuccgcuccugguccuccuaccgcgccggcuucggcaaccaggaguccgaguucuggcucggcaacgagaaccuccaccagcucacccuccagggcaacugggagcuccgcgucgagcucgaggacuucaacggcaaccgcaccuucgcccacuacgccaccuuccgccuccucggcgaggucgaccacuaccagcucgcccucggcaaguucuccgagggcaccgccggcgacucccucucccuccacuccggccgccccuucaccaccuacgacgccgaccacgacuccuccaacuccaacugcgccgucaucguccacggcgccuggugguacgccuccugcuaccgcuccaaccucaacggccgcuacgccgucuccgaggccgccgcccacaaguacggcaucgacugggccuccggccgcggcgucggccaccccuaccgccgcguccgcaugaugcuccgcuga

SEQ ID NO: 8588 - RNA, 867 nt, Artificial Sequence
  derived and/or modified sequence opt3 from Fibrinogen__Homo_sapiens__AAQ88650
auggaccugcucuggauccuucccagccugugguuguuacugcuaggcgggccugccugccucaagacccaggagcacccauccuguccgggacccagagaacuggaggcuucuaaagugguccuucugccuucaugcccaggugcacccggcaguccuggggaaaagggagccccaggcccccaagguccuccagggccgcccggaaaaaugggcccuaagggcgagccagggcccaggaacugucgggaauugcucagccagggagcgacacuguccgguugguaccaucugugccucccugagggccgcgcuuuaccaguuuucugugauauggacacugaagggggaggcuggcugguguuucagcgacgucaggaugguucuguagacuucuuuagaucguggucaagcuauagggccggguucggaaaucaagagagugaguuuuggcuuggcaacgaaaauuugcaccagcugacgcuacagggcaacugggagcuccggguggagcuggaagauuucaaugggaaccgcaccuuugcacauuacgccacauucagacuucugggagaggucgaccacuaucaguuggcucucgguaaauuuuccgaaggcacugcaggggauucucugagcuuacauuccggaaggcccuucaccacauacgacgccgaucacgacucaaguaauagcaacugcgcugugauuguucacggcgccuggugguaugcgucuuguuaccgguccaaucugaacggucgcuaugcagugucagaggccgcugcccauaaguacgggauagauugggcaagcggccgaggagucggccacccguacagaagggugcggaugaugcuccguuga

SEQ ID NO: 8589 - RNA, 867 nt, Artificial Sequence
  derived and/or modified sequence opt4 from Fibrinogen__Homo_sapiens__AAQ88650
auggaccugcuguggauccugcccagccuguggcugcugcugcugggcggccccgccugccugaagacccaggagcaccccagcugccccggccccagagagcuggaggccagcaagguggugcugcugcccagcugccccggcgcccccggcagccccggcgagaagggcgcccccggcccccagggcccccccggcccccccggcaagaugggccccaagggcgagcccggccccagaaacugcagagagcugcugagccagggcgccacccugagcggcugguaccaccugugccugcccgagggcagagcccugcccguguucugcgacauggacaccgagggcggcggcuggcugguguuccagagaagacaggacggcagcguggacuucuucagaagcuggagcagcuacagagccggcuucggcaaccaggagagcgaguucuggcugggcaacgagaaccugcaccagcugacccugcagggcaacugggagcugagaguggagcuggaggacuucaacggcaacagaaccuucgcccacuacgccaccuucagacugcugggcgagguggaccacuaccagcuggcccugggcaaguucagcgagggcaccgccggcgacagccugagccugcacagcggcagacccuucaccaccuacgacgccgaccacgacagcagcaacagcaacugcgccgugaucgugcacggcgccuggugguacgccagcugcuacagaagcaaccugaacggcagauacgccgugagcgaggccgccgcccacaaguacggcaucgacugggccagcggcagaggcgugggccaccccuacagaagagugagaaugaugcugagauga

SEQ ID NO: 8590 - RNA, 867 nt, Artificial Sequence
  derived and/or modified sequence opt5 from Fibrinogen__Homo_sapiens__AAQ88650
auggaccugcucuggauccugcccagccuuuggcugcuccugcuuggcgggccugccugccugaagacccaggagcacccguccugucccggaccuagagaacucgaggcuucuaaagugguccugcugcccagcugcccuggcgcccccggguccccuggagaaaagggcgcgccggggccccaaggaccucccggcccucccggcaaaauggggccgaagggagagccuggcccccggaacugucgcgaacuccugucucagggggcuacacuuagcggaugguaccaucugugccucccugagggcagagcccugcccguuuucugugauauggacacggaagggggaggcuggcuuguguuucagcggcgccaggauggcuccguggacuucuuuagaucuuggagcuccuaucgggccggguucggaaaucaagagagcgaguuuuggcugggcaacgaaaaucuccaccagcugacccugcaggggaacugggagcuccgcgucgagcuggaagauuucaauggaaacagaacauuugcucauuacgccaccuuccggcuucugggcgagguggaccacuaucagcucgcucuggggaaauuuucugaaggaacagccggcgauucccuuagccugcauucuggccgccccuucaccacauacgacgcggaucacgacuccagcaauucuaacugcgccguuauugugcacggggcuuggugguaugccuccuguuacagaagcaaucucaacggacgguaugcugucuccgaggccgcggcccauaaguacggcaucgauugggcuucugggcgcggagugggccacccuuacagacggguucgcaugaugcugagauga

SEQ ID NO: 8591 - protein, 211 aa, Artificial Sequence [sequence omitted]

SEQ ID NO: 8592 - RNA, 636 nt, Artificial Sequence
  Fibrinogen__Homo_sapiens__CAA50740
augcagaacggagccggugccuccaggaccagcaccaucuuccucaacggcaaccgcgagcggccccugaacguguuuugcgacauggagacugaugggggcggcuggcugguguuccagcgccgcauggauggacagacagacuucuggagggacugggaggacuaugcccaugguuuugggaacaucucuggagaguucuggcugggcaaugaggcccugcacagccugacacaggcaggugacuacuccauccgcguggaccugcgggcuggggacgaggcuguguucgcccaguacgacuccuuccacguagacucggcugcggaguacuaccgccuccacuuggagggcuaccacggcaccgcaggggacuccaugagcuaccacagcggcagugucuucucugcccgugaucgggaccccaacagcuugcucaucuccugcgcugucuccuaccgaggggccuggugguacaggaacugccacuacgccaaccucaacgggcucuacgggagcacaguggaccaucagggagugagcugguaccacuggaagggcuucgaguucucggugcccuucacggaaaugaagcugagaccaagaaacuuucgcuccccagcggggggaggcuga

SEQ ID NO: 8593 - RNA, 636 nt, Artificial Sequence
  derived and/or modified sequence opt1 from Fibrinogen__Homo_sapiens__CAA50740
augcagaacggcgccggggccagccgcaccuccaccaucuuccugaacggcaaccgggagcgcccccucaacguguucugcgacauggagacggacgggggcggguggcuggucuuccagcggcgcauggacggccagaccgacuucuggcgggacugggaggacuacgcgcacggcuucgggaacaucagcggcgaguucuggcuggggaacgaggcccuccacucccugacccaggccggcgacuacagcauccgcguggaccugcgggccggggacgaggccguguucgcgcaguacgacuccuuccacgucgacagcgccgccgaguacuaccgccuccaccuggagggcuaccacggcaccgccggggacuccaugagcuaccacuccggcagcguguucuccgcgcgggaccgcgacccgaacagccugcucaucuccugcgccgugagcuaccgcggggccuggugguaccggaacugccacuacgccaaccugaacggccuguacggcuccacggucgaccaccagggggugagcugguaccacuggaagggcuucgaguucuccgugcccuucaccgagaugaagcuccggccccgcaacuuccggagccccgccgggggcggguga

SEQ ID NO: 8594 - RNA, 636 nt, Artificial Sequence
  derived and/or modified sequence opt2 from Fibrinogen__Homo_sapiens__CAA50740
augcagaacggcgccggcgccucccgcaccuccaccaucuuccucaacggcaaccgcgagcgcccccucaacgucuucugcgacauggagaccgacggcggcggcuggcucgucuuccagcgccgcauggacggccagaccgacuucuggcgcgacugggaggacuacgcccacggcuucggcaacaucuccggcgaguucuggcucggcaacgaggcccuccacucccucacccaggccggcgacuacuccauccgcgucgaccuccgcgccggcgacgaggccgucuucgcccaguacgacuccuuccacgucgacuccgccgccgaguacuaccgccuccaccucgagggcuaccacggcaccgccggcgacuccauguccuaccacuccggcuccgucuucuccgcccgcgaccgcgaccccaacucccuccucaucuccugcgccgucuccuaccgcggcgccuggugguaccgcaacugccacuacgccaaccucaacggccucuacggcuccaccgucgaccaccagggcgucuccugguaccacuggaagggcuucgaguucuccguccccuucaccgagaugaagcuccgcccccgcaacuuccgcucccccgccggcggcggcuga

SEQ ID NO: 8595 - RNA, 636 nt, Artificial Sequence
  derived and/or modified sequence opt3 from Fibrinogen__Homo_sapiens__CAA50740
augcagaacggcgccggggcuagcagaaccuccacaaucuuccugaauggaaacagggagcggccccucaauguguuuugcgacauggaaacugaugguggcggguggcuugucuuccaacgccgaauggacggacagacggauuuuuggcgugacugggaggauuacgcacacggcuucgguaacauuucuggggaauuuuggcugggaaaugaggccuugcauucauuaacccaggcgggcgacuauaguauaagaguugaucugagggcuggcgacgaagccguguucgcacaguacgauagcuuucacguagacuccgccgcugaguauuaccggcuacaucucgagggguaucacggaacagcaggggauucuaugucguaccauucaggcagcguguucagugcccgcgacagagauccuaacucccugcuuaucucuugugcugucagcuauaggggugccuggugguaccggaauugccacuacgcgaaccugaauggauuguauggcuccacuguggaccaccaagguguuucaugguaccauuggaagggguuugaguucagugugccauuuaccgaaaugaaacuccgcccgcgaaacuucagaagccccgcaggaggcggcuga

SEQ ID NO: 8596 - RNA, 636 nt, Artificial Sequence
  derived and/or modified sequence opt4 from Fibrinogen__Homo_sapiens__CAA50740
augcagaacggcgccggcgccagcagaaccagcaccaucuuccugaacggcaacagagagagaccccugaacguguucugcgacauggagaccgacggcggcggcuggcugguguuccagagaagaauggacggccagaccgacuucuggagagacugggaggacuacgcccacggcuucggcaacaucagcggcgaguucuggcugggcaacgaggcccugcacagccugacccaggccggcgacuacagcaucagaguggaccugagagccggcgacgaggccguguucgcccaguacgacagcuuccacguggacagcgccgccgaguacuacagacugcaccuggagggcuaccacggcaccgccggcgacagcaugagcuaccacagcggcagcguguucagcgccagagacagagaccccaacagccugcugaucagcugcgccgugagcuacagaggcgccuggugguacagaaacugccacuacgccaaccugaacggccuguacggcagcaccguggaccaccagggcgugagcugguaccacuggaagggcuucgaguucagcgugcccuucaccgagaugaagcugagacccagaaacuucagaagccccgccggcggcggcuga

SEQ ID NO: 8597 - RNA, 636 nt, Artificial Sequence
  derived and/or modified sequence opt5 from Fibrinogen__Homo_sapiens__CAA50740
augcagaacggcgccggggcuagcagaaccuccacaaucuuccugaauggaaaccgggagcgcccccucaauguguuuugcgacauggaaacggauggcgggggauggcuggucuuccaaagacggauggacggccagaccgauuuuuggcgcgacugggaggauuacgcccacggguucggaaacauuucuggcgaauuuuggcuuggcaaugaggcgcugcauagccucacacaggcuggggacuauuccaucagaguugaucugcgggccggagacgaagccguguucgcucaguacgauucuuuucacguggacagcgccgcugaguauuaccgccuucaucuggagggcuaucacgggaccgccggagauuccaugucuuaccauagcggcuccgucuucagcgcgagagaccgggauccuaacucucuccugauuuccugugccgugagcuaucgcggggcuuggugguacagaaauugccacuacgccaaccugaauggacucuauggcucuacaguugaccaccaaggcguguccugguaccauuggaagggguuugaguucagcgucccguuuaccgaaaugaaacugcggccccgcaacuucagaucuccugcuggaggcggguga

SEQ ID NO: 8598 - protein, 508 aa, Artificial Sequence
  FOS__Homo_sapiens__A0A024RD16
MLPTQAGAAAALGRGSALGGSLNRTPTGRPGGGGGTRGANGGRVPGNGAGLGPGRLEREAAAAAATTPAPTAGALYSGSEGDSESGEEEELGAERRGLKRSLSEMEIGMVVGGPEASAAATGGYGPVSGAVSGAKPGKKTRGRVKIKMEFIDNKLRRYTTFSKRKTGIMKKAYELSTLTGTQVLLLVASETGHVYTFATRKLQPMITSETGKALIQTCLNSPDSPPRSDPTTDQRMSATGFEETDLTYQVSESDSSGETKDTLKPAFTVTNLPGTTSTIQTAPSTSTTMQVSSGPSFPITNYLAPVSASVSPSAVSSANGTVLKSTGSGPVSSGGLMQLPTSFTLMPGGAVAQQVPVQAIQVHQAPQQASPSRDSSTDLTQTSSSGTVTLPATIMTSSVPTTVGGHMMYPSPHAVMYAPTSGLGDGSLTVLNAFSQAPSTMQVSHSQVQEPGGVPQVFLTASSGTVQIPVSAVQLHQMAVIGQQAGSSSNLTELQVVNLDTAHSTKSE

SEQ ID NO: 8599 - RNA, 1527 nt, Artificial Sequence
  FOS__Homo_sapiens__EAX04162
auguuaccgacccaagcuggggccgcggcggcucugggccggggcucggcccuggggggcagccugaaccggaccccgacggggcggccgggcggcggcggcgggacacgcggggcuaacgggggccggguccccgggaauggcgcggggcucgggcccggccgccuggagcgggaggcugcggcagcggcggcaaccaccccggcgcccaccgcgggggcccucuacagcggcagcgagggcgacucggagucgggcgaggaggaggagcugggcgccgagcggcgcggccugaagcggagccugagcgagauggagaucgguaugguggucggugggcccgaggcgucggcagcggccaccgggggcuacgggccggugagcggcgcggugagcggggccaagccggguaagaagacccggggccgcgugaagaucaagauggaguucaucgacaacaagcugcggcgcuacacgaccuucagcaagaggaagacgggcaucaugaagaaggccuaugagcuguccacgcugacagggacacaggugcuguugcugguggccagugagacaggccauguguauaccuuugccacccgaaaacugcagcccaugaucaccagugagaccggcaaggcacugauucagaccugccucaacucgccagacucuccaccccguucagaccccacaacagaccagagaaugagugccacuggcuuugaagagacagaucucaccuaccaggugucggagucugacagcaguggggagaccaaggacacacugaagccggcguucacagucaccaaccugccggguacaaccuccaccauccaaacagcaccuagcaccucuaccaccaugcaagucagcagcggccccuccuuucccaucaccaacuaccuggcaccagugucugcuagugucagccccagugcugucagcagugccaaugggacugugcugaagaguacaggcagcggcccugucuccucugggggccuuaugcagcugccuaccagcuucacccucaugccugguggggcaguggcccagcaggucccagugcaggccauucaagugcaccaggccccacagcaagcgucucccucccgugacagcagcacagaccucacgcagaccuccuccagcgggacagugacgcugcccgccaccaucaugacgucauccgugcccacaacuguggguggccacaugauguacccuagcccgcaugcggugauguaugcccccaccucgggccugggugauggcagccucaccgugcugaaugccuucucccaggcaccauccaccaugcaggugucacacagccagguccaggagccagguggcgucccccagguguuccugacagcaucaucugggacagugcagaucccuguuucagcaguucagcuccaccagauggcugugauagggcagcaggccgggagcagcagcaaccucaccgagcuacagguggugaaccuggacaccgcccacagcaccaagagugaauga

SEQ ID NO: 8600 - RNA, 1527 nt, Artificial Sequence
  derived and/or modified sequence opt1 from FOS__Homo_sapiens__EAX04162
augcugcccacccaggccggcgccgcggccgcccuggggcgcggcagcgcccucgggggcucccugaaccggaccccgacggggcgccccggcggcgggggcgggacccggggcgccaacgggggccgcgugcccggcaacggggcgggccuggggcccggccggcuggagcgcgaggccgccgccgcggccgccaccaccccggcccccacggccggcgcgcuguacagcggguccgagggcgacagcgaguccggggaggaggaggagcucggcgccgagcggcgcgggcugaagcggagccuguccgagauggagaucggcauggucgugggcgggcccgaggccagcgccgccgcgaccggcggguacggccccguguccggggccgucagcggcgccaagccgggcaagaagacccgcgggcgggugaagaucaagauggaguucaucgacaacaagcuccgccgguacaccacguucuccaagcgcaagaccggcaucaugaagaaggccuacgagcugagcacccugaccgggacccaggugcuccugcuggucgccuccgagacgggccacguguacaccuucgcgacccggaagcuccagcccaugaucacgagcgagaccgggaaggcccugauccagaccugccugaacucccccgacagcccgccccgcuccgaccccaccacggaccagcggaugagcgccaccggcuucgaggagaccgaccucaccuaccagguguccgagagcgacagcuccggcgagacgaaggacacccugaagcccgccuucaccgucaccaaccugcccgggacgaccagcaccauccagaccgccccguccacgagcaccaccaugcaggucuccagcggccccuccuuccccaucaccaacuaccucgcgcccgugagcgccuccgugagcccguccgccgugagcuccgccaacgggacggugcugaaguccaccggcuccggccccgucagcuccgggggccugaugcagcuccccaccagcuucacccugaugcccgggggcgcgguggcccagcaggucccggugcaggccauccaggugcaccaggcgccccagcaggccucccccagccgcgacagcuccaccgaccugacgcagaccagcuccagcgggaccgugacccuccccgccacgaucaugaccuccagcgucccgaccaccgugggcggccacaugauguaccccagcccccacgccgugauguacgccccgacgagcgggcugggcgacgggucccugaccguccucaacgccuucagccaggcccccuccaccaugcaggucagccacucccaggugcaggagcccggcggggugccccagguguuccugaccgcgagcuccggcacgguccagaucccggugagcgccgugcagcugcaccagauggccgucaucggccagcaggccggguccagcagcaaccucaccgagcuccagguggugaaccuggacaccgcccacuccaccaagagcgaguga

SEQ ID NO: 8601 - RNA, 1527 nt, Artificial Sequence
  derived and/or modified sequence opt2 from FOS__Homo_sapiens__EAX04162
augcuccccacccaggccggcgccgccgccgcccucggccgcggcuccgcccucggcggcucccucaaccgcacccccaccggccgccccggcggcggcggcggcacccgcggcgccaacggcggccgcguccccggcaacggcgccggccucggccccggccgccucgagcgcgaggccgccgccgccgccgccaccacccccgcccccaccgccggcgcccucuacuccggcuccgagggcgacuccgaguccggcgaggaggaggagcucggcgccgagcgccgcggccucaagcgcucccucuccgagauggagaucggcauggucgucggcggccccgaggccuccgccgccgccaccggcggcuacggccccgucuccggcgccgucuccggcgccaagcccggcaagaagacccgcggccgcgucaagaucaagauggaguucaucgacaacaagcuccgccgcuacaccaccuucuccaagcgcaagaccggcaucaugaagaaggccuacgagcucuccacccucaccggcacccagguccuccuccucgucgccuccgagaccggccacgucuacaccuucgccacccgcaagcuccagcccaugaucaccuccgagaccggcaaggcccucauccagaccugccucaacucccccgacucccccccccgcuccgaccccaccaccgaccagcgcauguccgccaccggcuucgaggagaccgaccucaccuaccaggucuccgaguccgacuccuccggcgagaccaaggacacccucaagcccgccuucaccgucaccaaccuccccggcaccaccuccaccauccagaccgcccccuccaccuccaccaccaugcaggucuccuccggccccuccuuccccaucaccaacuaccucgcccccgucuccgccuccgucucccccuccgccgucuccuccgccaacggcaccguccucaaguccaccggcuccggccccgucuccuccggcggccucaugcagcuccccaccuccuucacccucaugcccggcggcgccgucgcccagcagguccccguccaggccauccagguccaccaggccccccagcaggccucccccucccgcgacuccuccaccgaccucacccagaccuccuccuccggcaccgucacccuccccgccaccaucaugaccuccuccguccccaccaccgucggcggccacaugauguaccccuccccccacgccgucauguacgcccccaccuccggccucggcgacggcucccucaccguccucaacgccuucucccaggcccccuccaccaugcaggucucccacucccagguccaggagcccggcggcgucccccaggucuuccucaccgccuccuccggcaccguccagauccccgucuccgccguccagcuccaccagauggccgucaucggccagcaggccggcuccuccuccaaccucaccgagcuccaggucgucaaccucgacaccgcccacuccaccaaguccgaguga

SEQ ID NO: 8602 - RNA, 1527 nt, Artificial Sequence
  derived and/or modified sequence opt3 from FOS__Homo_sapiens__EAX04162
augcugcccacccaggccggcgcugcagccgcgcucgggagaggaagcgcucuugguggcucccugaacaggacaccuacugggcggccaggaggcggugggggaacgcgcggcgccaauggcgggcgagugccgggaaacggugcaggcuuggggcccggacguuuagagagagaagccgcugcagccgcugccaccacuccugcgccaacugcaggcgcccuguacucugguucagagggggacagugaaagcggagaggaagaggagcuaggcgcugaaaggcggggccucaagcgcucccugucugagauggaaaucgggauggucguuggaggucccgaggccucggcagcugccaccggcggguauggaccugugucaggcgcgguaagcggugccaaaccagggaagaaaacaagaggcagggugaagauuaaaauggaguucauagauaauaaacuucggcgcuacaccacuuuuaguaagcgaaaaacaggaaucaugaagaaagcauaugaacuguccaccuugacgggcacucaaguccuccugcugguggcuucugagaccgggcacguuuacacauucgccacuagaaagcuccagcccaugauuaccagcgaaacaggaaaggcuuuaauccagaccugccugaacuccccugacucaccaccgaggagugaucccacgacugaccagcggaugagcgccacagguuuugaggaaaccgaucuuacuuaucaagugucugaguccgacucaagcggcgagacaaaggauaccuugaagccugcauucacggucaccaaucugccagggacaacaaguaccauucagacagcccccucuacuuccaccacaaugcaagugagcucgggaccuucuuuuccaaucaccaacuaccuagcucccguauccgcgucaguuaguccgagcgcaguguccucugccaauggcacuguccucaaaagcacggguucagggccugugaguuccggcggacugaugcagcuucccacaucuuucacccugaugccaggcggggcuguggcccagcaggucccuguucaggcaauacaggugcaucaagcuccccagcaggccucuccaucacgugacaguagcacugauuugacccaaacauccucuucgggaaccguaacucuccccgccacaaucaugacgagcuccgugccuaccacugucgguggccacaugauguauccaucaccgcaugcagugauguacgcgcccacaagugggcugggagacggcucuuuaaccguucugaacgcuuuuagccaggccccuuccacaaugcaagugucacacagccagguccaggaaccagguggggugccccagguauuccucacugcaucuuccggcaccguucagauuccugugagugccguccagcuucaucaaauggcugugaucggacagcaggccggcagcagcuccaaucugacggaguugcaggucgugaaccuagauaccgcacacucaacaaagagugaauga

SEQ ID NO: 8603 - RNA, 1527 nt, Artificial Sequence
  derived and/or modified sequence opt4 from FOS__Homo_sapiens__EAX04162
augcugcccacccaggccggcgccgccgccgcccugggcagaggcagcgcccugggcggcagccugaacagaacccccaccggcagacccggcggcggcggcggcaccagaggcgccaacggcggcagagugcccggcaacggcgccggccugggccccggcagacuggagagagaggccgccgccgccgccgccaccacccccgcccccaccgccggcgcccuguacagcggcagcgagggcgacagcgagagcggcgaggaggaggagcugggcgccgagagaagaggccugaagagaagccugagcgagauggagaucggcaugguggugggcggccccgaggccagcgccgccgccaccggcggcuacggccccgugagcggcgccgugagcggcgccaagcccggcaagaagaccagaggcagagugaagaucaagauggaguucaucgacaacaagcugagaagauacaccaccuucagcaagagaaagaccggcaucaugaagaaggccuacgagcugagcacccugaccggcacccaggugcugcugcugguggccagcgagaccggccacguguacaccuucgccaccagaaagcugcagcccaugaucaccagcgagaccggcaaggcccugauccagaccugccugaacagccccgacagcccccccagaagcgaccccaccaccgaccagagaaugagcgccaccggcuucgaggagaccgaccugaccuaccaggugagcgagagcgacagcagcggcgagaccaaggacacccugaagcccgccuucaccgugaccaaccugcccggcaccaccagcaccauccagaccgcccccagcaccagcaccaccaugcaggugagcagcggccccagcuuccccaucaccaacuaccuggcccccgugagcgccagcgugagccccagcgccgugagcagcgccaacggcaccgugcugaagagcaccggcagcggccccgugagcagcggcggccugaugcagcugcccaccagcuucacccugaugcccggcggcgccguggcccagcaggugcccgugcaggccauccaggugcaccaggccccccagcaggccagccccagcagagacagcagcaccgaccugacccagaccagcagcagcggcaccgugacccugcccgccaccaucaugaccagcagcgugcccaccaccgugggcggccacaugauguaccccagcccccacgccgugauguacgcccccaccagcggccugggcgacggcagccugaccgugcugaacgccuucagccaggcccccagcaccaugcaggugagccacagccaggugcaggagcccggcggcgugccccagguguuccugaccgccagcagcggcaccgugcagauccccgugagcgccgugcagcugcaccagauggccgugaucggccagcaggccggcagcagcagcaaccugaccgagcugcagguggugaaccuggacaccgcccacagcaccaagagcgaguga

SEQ ID NO: 8604 - RNA, 1527 nt, Artificial Sequence
  derived and/or modified sequence opt5 from FOS__Homo_sapiens__EAX04162
augcugcccacccaggccggcgcugccgcggcucucgggagaggaagcgcccugggcgggucccuuaaccggacaccuacgggacgcccgggcgggggaggcggcaccagaggggccaauggaggccgggugcccgggaacggagcuggccuggggccuggacgccucgagagagaagccgcugccgcggccgcuacaacccccgccccuacagcuggcgcccuguacucuggcagcgagggggacuccgaaucuggagaggaagaggagcuuggcgcggaacggcgcgggcugaagagaagccucuccgagauggaaaucggaauggucguuggcgggcccgaggccucugcugccgcuaccggaggcuauggcccugugagcggggccguguccggagccaaaccgggcaagaaaacacgggggcgcgucaagauuaaaauggaguucaucgauaauaagcugagacgguacaccacguuuagcaagcgcaaaaccggaauuaugaagaaggcuuaugaacugucuacacucaccggcacacaagugcugcuucugguugcguccgagaccgggcacguguacacguucgccacaagaaaacuccagcccaugaucaccagcgaaacaggcaaagcucugauucagaccugccuuaacucuccugacagcccgccucggagcgaucccaccacagaccagcgcaugucugccacgggauuugaggaaaccgaucugacauaucaagucuccgagagcgacuccucuggcgagaccaaggauacacucaagccggccuucaccgugacgaaucugccugggacaaccagcaccauccagacagcucccuccaccagcacaacgaugcagguuucuuccggaccuagcuuucccaucaccaacuaccuggcccccgugucugcgagcgucuccccuucugcugugagcuccgccaauggcacagugcucaaaagcaccgggucuggaccggucuccagcggcgggcugaugcagcuucccacaucuuucacccugaugccuggcggagccguugcucaacaggugcccgugcaggccauucagguccaucaagcuccucagcaggccucccccagcagagacuccucuacggaucucacccaaacaagcuccucuggcaccgugacacugccggcgaccaucaugacgagcuccguuccuacaaccgucgggggacacaugauguaucccagcccucaugccgugauguacgcucccacaucuggccuuggggacggaucccugaccgugcucaacgccuuuagccaggcuccuucuaccaugcagguuucccacagccaggugcaagaacccggcggggucccccagguguuccugacagccucuagcggcacgguccagauuccuguguccgcgguucagcugcaucaaauggccgugaucggacagcaggcuggcuccucuuccaaucucaccgagcugcaggucgugaaccuugauacagcccacagcaccaaguccgaauga

SEQ ID NO: 8605 - protein, 483 aa, Artificial Sequence
  GSK3A__Homo_sapiens__P49840
MSGGGPSGGGPGGSGRARTSSFAEPGGGGGGGGGGPGGSASGPGGTGGGKASVGAMGGGVGASSSGGGPGGSGGGGSGGPGAGTSFPPPGVKLGRDSGKVTTVVATLGQGPERSQEVAYTDIKVIGNGSFGVVYQARLAETRELVAIKKVLQDKRFKNRELQIMRKLDHCNIVRLRYFFYSSGEKKDELYLNLVLEYVPETVYRVARHFTKAKLTIPILYVKVYMYQLFRSLAYIHSQGVCHRDIKPQNLLVDPDTAVLKLCDFGSAKQLVRGEPNVSYICSRYYRAPELIFGATDYTSSIDVWSAGCVLAELLLGQPIFPGDSGVDQLVEIIKVLGTPTREQIREMNPNYTEFKFPQIKAHPWTKVFKSRTPPEAIALCSSLLEYTPSSRLSPLEACAHSFFDELRCLGTQLPNNRPLPPLFNFSAGELSIQPSLNAILIPPHLRSPAGTTTLTPSSQALTETPTSSDWQSTDATPTLTNSS

SEQ ID NO: 8606 - RNA, 1452 nt, Artificial Sequence
  GSK3A__Homo_sapiens__CCDS12599.1
augagcggcggcgggccuucgggaggcggcccugggggcucgggcagggcgcggacuagcucguucgcggagcccggcggcggaggcggaggaggcggcggcggccccggaggcucggccuccggcccaggcggcaccggcggcggaaaggcaucugucggggccaugggugggggcgucggggccucgagcuccggggguggacccggcggcagcggcggaggaggcagcggaggccccggcgcaggcacuagcuucccgccgcccggggugaagcugggccgugacagcgggaaggugaccacagucguagccacucuaggccaaggcccagagcgcucccaagaaguggcuuacacggacaucaaagugauuggcaauggcucauuuggggucguguaccaggcacggcuggcagagaccagggaacuagucgccaucaagaagguucuccaggacaagagguucaagaaccgagagcugcagaucaugcguaagcuggaccacugcaauauugugaggcugagauacuuuuucuacuccaguggcgagaagaaagacgagcuuuaccuaaaucuggugcuggaauaugugcccgagacaguguaccggguggcccgccacuucaccaaggccaaguugaccaucccuauccucuaugucaagguguacauguaccagcucuuccgcagcuuggccuacauccacucccagggcgugugucaccgcgacaucaagccccagaaccugcugguggacccugacacugcuguccucaagcucugcgauuuuggcagugcaaagcaguugguccgaggggagcccaaugucuccuacaucuguucucgcuacuaccgggccccagagcucaucuuuggagccacugauuacaccucauccaucgauguuuggucagcuggcuguguacuggcagagcuccucuugggccagcccaucuucccuggggacagugggguggaccagcugguggagaucaucaaggugcugggaacaccaacccgggaacaaauccgagagaugaaccccaacuacacggaguucaaguucccucagauuaaagcucaccccuggacaaagguguucaaaucucgaacgccgccagaggccaucgcgcucugcucuagccugcuggaguacaccccauccucaaggcucuccccacuagaggccugugcgcacagcuucuuugaugaacugcgaugucugggaacccagcugccuaacaaccgcccacuucccccucucuucaacuucagugcuggugaacucuccauccaaccgucucucaacgccauucucaucccuccucacuugagguccccagcgggcacuaccacccucaccccguccucacaagcuuuaacugagacuccgaccagcucagacuggcagucgaccgaugccacaccuacccucacuaacuccuccuga

SEQ ID NO: 8607 - RNA, 1452 nt, Artificial Sequence
  derived and/or modified sequence opt1 from GSK3A__Homo_sapiens__CCDS12599.1
augagcggcgggggccccuccgggggcgggccgggcggcagcgggcgcgcccggaccuccagcuucgccgagcccggcgggggcgggggcggcgggggcgggggccccggcggguccgcgagcggccccgggggcaccgggggcggcaaggccuccgugggggccaugggcgggggcgucggggccagcuccagcggcggcgggccgggcggguccggcgggggcggcagcgggggccccggggccggcacguccuucccgccgcccggcgugaagcuggggcgcgacagcggcaaggugaccaccgucguggcgacccucgggcagggccccgagcggucccaggagguggccuacacggacaucaaggucaucgggaacggcagcuucggcgugguguaccaggcccgccuggccgagacccgggagcuggucgcgaucaagaaggugcuccaggacaagcgcuucaagaaccgggagcugcagaucaugcgcaagcuggaccacugcaacaucgugcggcuccgcuacuucuucuacuccagcggggagaagaaggacgagcuguaccugaaccucguccuggaguacgugcccgagaccguguaccgggucgcccgccacuucaccaaggccaagcugacgauccccauccucuacgugaagguguacauguaccagcuguuccggucccuggccuacauccacagccagggcgucugccaccgcgacaucaagccccagaaccuccugguggaccccgacaccgccgugcugaagcucugcgacuucgggagcgcgaagcagcugguccggggcgagcccaacguguccuacaucugcagccgcuacuaccgggcccccgagcugaucuucggggccaccgacuacaccuccagcaucgacgugugguccgccggcugcguccucgccgagcugcugcucggccagccgaucuuccccggggacagcggcguggaccagcuggucgagaucaucaaggugcuggggacgcccacccgcgagcagauccgggagaugaaccccaacuacaccgaguucaaguucccgcagaucaaggcgcaccccuggaccaagguguucaagucccgcacgccgcccgaggccaucgcccucugcagcucccugcuggaguacacccccagcucccggcucagcccccuggaggccugcgcccacuccuucuucgacgagcugcgcugccucggcacccagcugcccaacaaccgcccccugccgccccucuucaacuucagcgcgggggagcuguccauccagcccagccugaacgccauccucaucccgccccaccuccggucccccgccggcaccacgacccugacccccagcucccaggcccugaccgagacgccgaccagcagcgacuggcaguccaccgacgccacccccacgcugaccaacagcuccuga

SEQ ID NO: 8608 - RNA, 1452 nt, Artificial Sequence
  derived and/or modified sequence opt2 from GSK3A__Homo_sapiens__CCDS12599.1
auguccggcggcggccccuccggcggcggccccggcggcuccggccgcgcccgcaccuccuccuucgccgagcccggcggcggcggcggcggcggcggcggcggccccggcggcuccgccuccggccccggcggcaccggcggcggcaaggccuccgucggcgccaugggcggcggcgucggcgccuccuccuccggcggcggccccggcggcuccggcggcggcggcuccggcggccccggcgccggcaccuccuuccccccccccggcgucaagcucggccgcgacuccggcaaggucaccaccgucgucgccacccucggccagggccccgagcgcucccaggaggucgccuacaccgacaucaaggucaucggcaacggcuccuucggcgucgucuaccaggcccgccucgccgagacccgcgagcucgucgccaucaagaagguccuccaggacaagcgcuucaagaaccgcgagcuccagaucaugcgcaagcucgaccacugcaacaucguccgccuccgcuacuucuucuacuccuccggcgagaagaaggacgagcucuaccucaaccucguccucgaguacguccccgagaccgucuaccgcgucgcccgccacuucaccaaggccaagcucaccauccccauccucuacgucaaggucuacauguaccagcucuuccgcucccucgccuacauccacucccagggcgucugccaccgcgacaucaagccccagaaccuccucgucgaccccgacaccgccguccucaagcucugcgacuucggcuccgccaagcagcucguccgcggcgagcccaacgucuccuacaucugcucccgcuacuaccgcgcccccgagcucaucuucggcgccaccgacuacaccuccuccaucgacgucugguccgccggcugcguccucgccgagcuccuccucggccagcccaucuuccccggcgacuccggcgucgaccagcucgucgagaucaucaagguccucggcacccccacccgcgagcagauccgcgagaugaaccccaacuacaccgaguucaaguucccccagaucaaggcccaccccuggaccaaggucuucaagucccgcaccccccccgaggccaucgcccucugcuccucccuccucgaguacacccccuccucccgccucuccccccucgaggccugcgcccacuccuucuucgacgagcuccgcugccucggcacccagcuccccaacaaccgcccccuccccccccucuucaacuucuccgccggcgagcucuccauccagcccucccucaacgccauccucauccccccccaccuccgcucccccgccggcaccaccacccucacccccuccucccaggcccucaccgagacccccaccuccuccgacuggcaguccaccgacgccacccccacccucaccaacuccuccuga

SEQ ID NO: 8609 - RNA, 1452 nt, Artificial Sequence
  derived and/or modified sequence opt3 from GSK3A__Homo_sapiens__CCDS12599.1
augagcggcgggggacccuccgguggcgggccuggaggcucugguagagccaggaccucaaguuucgcugagccagggggaggcggcgggggagguggcgggggaccgggcgguagcgcauccgggcccggaggcacaggcgggggaaaggccucugugggugcgaugggcgggggagucggcgcuucgucaagcggugggggcccuggaggcagugggggagguggcuccgggggaccaggcgccgguacuucuuuucccccuccagggguuaaacugggccgggacagcggaaaggugacgaccguaguggcaacacucggccaggggcccgaacgcucccaagaggucgccuacacugauaucaaagugauuggaaacgguucauucggcguuguguaucaggcucgacuugcagaaacccgugagcuggucgccauaaagaaaguguugcaggacaagagauuuaagaauagggaauuacagaucaugcggaaacuggaucacugcaacauuguacgccuaagauacuucuuuuauaguagcggggagaagaaagacgagcucuaccugaaucuuguucuggaauaugugccugagacagucuacaggguggcucggcacuucaccaaggccaaauugacuaucccaauucucuaugugaaggucuacauguaccaacuguuucgcucucuggcguauauccacucccagggaguuugucaucgagauauaaagccgcagaaccucuuaguggaccccgauacagcaguacugaaacuuugcgacuucggcucagccaagcaguuggugagaggugaaccuaaugucagcuacaucuguaguagguauuaccgggcuccagagcugauuuuuggggccaccgauuauacgucuuccaucgacguguggagcgcaggcugcguucuagcugagcuccugcuuggacaacccauuuucccuggcgauucggggguggaccagcuggucgaaaucauaaaaguguugggaacuccaacccgugagcagauucgcgaaaugaaccccaauuacacagaguuuaaguucccgcagaucaaagcccacccuuggacuaagguauuuaaaucuagaacacccccagaagcgauugcccucuguuccucacuguuagaguauaccccuaguagcaggcugucuccccucgaggcaugcgcucauuccuucuucgaugaacuucggugucugggcacccaauugccaaacaaucgaccccuaccuccacuguuuaacuucagcgccggugagcucucaauccagccgagucugaaugcuauccuuauucccccucaucugcgcuccccagccgggacgacuacauugacccccagcucucaggcacucacugaaacaccuaccucaagugacuggcaaagcacggacgccaccccaacacugacuaacuccucuuga

SEQ ID NO: 8610 - RNA, 1452 nt, Artificial Sequence
  derived and/or modified sequence opt4 from GSK3A__Homo_sapiens__CCDS12599.1
augagcggcggcggccccagcggcggcggccccggcggcagcggcagagccagaaccagcagcuucgccgagcccggcggcggcggcggcggcggcggcggcggccccggcggcagcgccagcggccccggcggcaccggcggcggcaaggccagcgugggcgccaugggcggcggcgugggcgccagcagcagcggcggcggccccggcggcagcggcggcggcggcagcggcggccccggcgccggcaccagcuuccccccccccggcgugaagcugggcagagacagcggcaaggugaccaccgugguggccacccugggccagggccccgagagaagccaggagguggccuacaccgacaucaaggugaucggcaacggcagcuucggcgugguguaccaggccagacuggccgagaccagagagcugguggccaucaagaaggugcugcaggacaagagauucaagaacagagagcugcagaucaugagaaagcuggaccacugcaacaucgugagacugagauacuucuucuacagcagcggcgagaagaaggacgagcuguaccugaaccuggugcuggaguacgugcccgagaccguguacagaguggccagacacuucaccaaggccaagcugaccauccccauccuguacgugaagguguacauguaccagcuguucagaagccuggccuacauccacagccagggcgugugccacagagacaucaagccccagaaccugcugguggaccccgacaccgccgugcugaagcugugcgacuucggcagcgccaagcagcuggugagaggcgagcccaacgugagcuacaucugcagcagauacuacagagcccccgagcugaucuucggcgccaccgacuacaccagcagcaucgacguguggagcgccggcugcgugcuggccgagcugcugcugggccagcccaucuuccccggcgacagcggcguggaccagcugguggagaucaucaaggugcugggcacccccaccagagagcagaucagagagaugaaccccaacuacaccgaguucaaguucccccagaucaaggcccaccccuggaccaagguguucaagagcagaaccccccccgaggccaucgcccugugcagcagccugcuggaguacacccccagcagcagacugagcccccuggaggccugcgcccacagcuucuucgacgagcugagaugccugggcacccagcugcccaacaacagaccccugcccccccuguucaacuucagcgccggcgagcugagcauccagcccagccugaacgccauccugauccccccccaccugagaagccccgccggcaccaccacccugacccccagcagccaggcccugaccgagacccccaccagcagcgacuggcagagcaccgacgccacccccacccugaccaacagcagcuga

SEQ ID NO: 8611 - RNA, 1452 nt, Artificial Sequence
  derived and/or modified sequence opt5 from GSK3A__Homo_sapiens__CCDS12599.1
augagcggcgggggacccuccggcgggggaccuggcgggucuggacgcgcccggaccagcuccuucgcugagccgggcggcgggggaggcgggggaggcgggggacccggcggcucugccagcgggccuggaggcacagggggaggcaaggcguccgugggggcuaugggaggcggcgucggggccucuagcuccggaggcgggcccggaggcagcgggggcggaggcucugggggaccuggcgccgggacguccuuucccccuccgggaguuaaacugggccgcgacagcgggaaggugaccacaguggucgcuacccucggccagggacccgaaagaucucaagagguggccuacacagauaucaaaguuaucggcaacggguccuucggaguggucuaucaggcucggcuggccgaaacccgcgagcuuguggcgaucaagaaaguucugcaggacaagagauuuaagaaucgggaacuccagauuaugcgcaaacuggaucacugcaacaucgugagacuucgguacuucuuuuauagcucuggcgagaagaaagacgagcuguaccucaaucugguccuggaauaugugccugagacaguguaccgcgucgccagacauuucaccaaggcuaaacucacgauucccauccuguauguuaagguguacauguaccaacuuuuucggucccuggccuauauccacagccagggggugugucaucgcgauauuaagccucagaaccuccuggucgaccccgauaccgcugugcuuaaacugugcgacuucggauccgccaagcagcucguuagaggcgaaccgaaugugucuuacaucuguagccgguauuaccgcgcgccugagcugauuuuuggggccacagauuauaccuccagcaucgacgucuggucugcuggcugcgugcuggccgagcuccugcuuggacaacccauuuucccuggcgauuccgggguugaccagcugguggaaaucauuaaaguccucggaacacccaccagagagcagauccgggaaaugaaccccaauuacacggaguuuaaguucccucagaucaaagcucacccguggacaaagguguuuaaaagcagaacacccccugaagccauugcccuguguucuagccuucuggaguauacccccuccucucgccucagcccucuggaggcuugcgcgcauuccuucuucgaugaacugcggugucucggcacccaacugcccaacaauagaccgcuuccuccccuguuuaacuucagcgccggggagcucucuauccagccuucccugaaugcuauucuuauucccccucaccugagaagccccgccggaaccacaacgcucaccccgucuucccaggcccugacagaaaccccuacaagcuccgacuggcaaucuaccgacgcuacgcccacacugaccaacagcuccuga

SEQ ID NO: 8612 - protein, 420 aa, Artificial Sequence; identical to SEQ ID NO: 393
  GSK3B__Homo_sapiens__P49841

SEQ ID NO: 8613 - RNA, 1263 nt, Artificial Sequence
  GSK3B__Homo_sapiens__AAH12760
augucagggcggcccagaaccaccuccuuugcggagagcugcaagccggugcagcagccuucagcuuuuggcagcaugaaaguuagcagagacaaggacggcagcaaggugacaacagugguggcaacuccugggcaggguccagacaggccacaagaagucagcuauacagacacuaaagugauuggaaauggaucauuuggugugguauaucaagccaaacuuugugauucaggagaacuggucgccaucaagaaaguauugcaggacaagagauuuaagaaucgagagcuccagaucaugagaaagcuagaucacuguaacauaguccgauugcguuauuucuucuacuccaguggugagaagaaagaugaggucuaucuuaaucuggugcuggacuauguuccggaaacaguauacagaguugccagacacuauagucgagccaaacagacgcucccugugauuuaugucaaguuguauauguaucagcuguuccgaaguuuagccuauauccauuccuuuggaaucugccaucgggauauuaaaccgcagaaccucuuguuggauccugauacugcuguauuaaaacucugugacuuuggaagugcaaagcagcugguccgaggagaacccaauguuucguauaucuguucucgguacuauagggcaccagaguugaucuuuggagccacugauuauaccucuaguauagauguauggucugcuggcuguguguuggcugagcuguuacuaggacaaccaauauuuccaggggauagugguguggaucaguugguagaaauaaucaagguccugggaacuccaacaagggagcaaaucagagaaaugaacccaaacuacacagaauuuaaauucccucaaauuaaggcacauccuuggacuaaggucuuccgaccccgaacuccaccggaggcaauugcacuguguagccgucugcuggaguauacaccaacugcccgacuaacaccacuggaagcuugugcacauucauuuuuugaugaauuacgggacccaaaugucaaacuaccaaaugggcgagacacaccugcacucuucaacuucaccacucaagaacugucaaguaauccaccucuggcuaccauccuuauuccuccucaugcucggauucaagcagcugcuucaacccccacaaaugccacagcagcgucagaugcuaauacuggagaccguggacagaccaauaaugcugcuucugcaucagcuuccaacuccaccuga

SEQ ID NO: 8614 - RNA, 1263 nt, Artificial Sequence
  derived and/or modified sequence opt1 from GSK3B__Homo_sapiens__AAH12760
augagcggccgcccccggaccaccuccuucgccgagagcugcaagcccgugcagcagcccuccgccuucgggagcaugaaggucucccgcgacaaggacggcagcaaggugacgaccguggucgcgacccccgggcagggccccgaccggccgcaggagguguccuacaccgacacgaaggugaucgggaacggcagcuucggcgucguguaccaggccaagcugugcgacuccggggagcucguggccaucaagaagguccugcaggacaagcgcuucaagaaccgggagcugcagaucaugcgcaagcucgaccacugcaacaucgugcggcugcgcuacuucuucuacagcuccggcgagaagaaggacgagguguaccugaaccucguccuggacuacgugcccgagaccguguaccgggucgcccgccacuacagccgggccaagcagacccugcccgugaucuacgugaagcucuacauguaccagcuguuccgcucccuggcguacauccacagcuucgggaucugccaccgggacaucaagccccagaaccuccugcuggacccggacaccgccguccucaagcugugcgacuucggcuccgccaagcagcuggugcgcggggagcccaacgugagcuacaucugcucccgguacuaccgcgcccccgagcucaucuucggcgcgacggacuacaccagcuccaucgacgucuggagcgccggcugcgugcuggccgagcugcuccuggggcagcccaucuucccgggcgacagcgggguggaccagcuggucgagaucaucaaggugcucggcacccccacccgggagcagauccgcgagaugaaccccaacuacacggaguucaaguucccccagaucaaggcccacccguggaccaaggucuuccggccccgcaccccgcccgaggccaucgcgcugugcucccggcugcucgaguacacccccacggcccgccugacgccccuggaggccugcgcccacagcuucuucgacgagcuccgcgaccccaacgugaagcugcccaacggccgggacaccccggcccuguucaacuucaccacccaggagcucuccagcaacccgccccuggcgaccauccugaucccgccccacgcccgcauccaggccgccgccuccacccccaccaacgcgacggccgccagcgacgccaacaccggggaccggggccagaccaacaacgccgcguccgccagcgccuccaacagcaccuga

SEQ ID NO: 8615 - RNA, 1263 nt, Artificial Sequence
  derived and/or modified sequence opt2 from GSK3B__Homo_sapiens__AAH12760
auguccggccgcccccgcaccaccuccuucgccgaguccugcaagcccguccagcagcccuccgccuucggcuccaugaaggucucccgcgacaaggacggcuccaaggucaccaccgucgucgccacccccggccagggccccgaccgcccccaggaggucuccuacaccgacaccaaggucaucggcaacggcuccuucggcgucgucuaccaggccaagcucugcgacuccggcgagcucgucgccaucaagaagguccuccaggacaagcgcuucaagaaccgcgagcuccagaucaugcgcaagcucgaccacugcaacaucguccgccuccgcuacuucuucuacuccuccggcgagaagaaggacgaggucuaccucaaccucguccucgacuacguccccgagaccgucuaccgcgucgcccgccacuacucccgcgccaagcagacccuccccgucaucuacgucaagcucuacauguaccagcucuuccgcucccucgccuacauccacuccuucggcaucugccaccgcgacaucaagccccagaaccuccuccucgaccccgacaccgccguccucaagcucugcgacuucggcuccgccaagcagcucguccgcggcgagcccaacgucuccuacaucugcucccgcuacuaccgcgcccccgagcucaucuucggcgccaccgacuacaccuccuccaucgacgucugguccgccggcugcguccucgccgagcuccuccucggccagcccaucuuccccggcgacuccggcgucgaccagcucgucgagaucaucaagguccucggcacccccacccgcgagcagauccgcgagaugaaccccaacuacaccgaguucaaguucccccagaucaaggcccaccccuggaccaaggucuuccgcccccgcaccccccccgaggccaucgcccucugcucccgccuccucgaguacacccccaccgcccgccucaccccccucgaggccugcgcccacuccuucuucgacgagcuccgcgaccccaacgucaagcuccccaacggccgcgacacccccgcccucuucaacuucaccacccaggagcucuccuccaaccccccccucgccaccauccucauccccccccacgcccgcauccaggccgccgccuccacccccaccaacgccaccgccgccuccgacgccaacaccggcgaccgcggccagaccaacaacgccgccuccgccuccgccuccaacuccaccuga

SEQ ID NO: 8616 - RNA, 1263 nt, Artificial Sequence
  derived and/or modified sequence opt3 from GSK3B__Homo_sapiens__AAH12760
augagcggcagacccaggaccacauccuucgccgagucuugcaagccugugcagcaaccaucagcuuuugggaguaugaaagucagccgggacaaggauggauccaaaguuacuacggugguagcaaccccgggucagggccccgaccgcccucaggaagugucuuacacagauacuaaggucaucgggaacggaucguucggcgugguuuaucaggccaaacugugugacucaggugagcucguggcgaucaagaagguccuucaagauaaacgauuuaagaaucgugaacugcagauaaugagaaaauuggaccacugcaacaucgugagguuacgguacuucuuuuauagcaguggggagaagaaagaugaaguauaccugaaucuaguucucgacuaugugccagagaccgucuaccgcguggcuagacauuauuccagggccaagcagacacugcccgugauuuacgucaaacuuuacauguaucagcuguuccggucuuuggcauacauccacagcuuuggaauuugucaucgcgauaucaagccucaaaaccuccugcuggacccagauaccgccguucucaaguuaugcgacuucggcuccgcuaaacagcuggugcgaggcgagcccaauguaucauauauauguaguagauacuauagggcaccugaacuuaucuuuggggccacugauuacacaagcucuauugacgugugguccgcuggaugcgucuuggccgagcugcuacucggucagccaaucuucccgggcgacucagggguggaucagcugguugaaauuaucaaggugcuuggaacccccacgcgggagcaaauacgugagaugaacccuaauuauacugaauuuaaauucccacagauuaaggcgcaccccuggaccaaagucuuucgcccuagaacaccacccgaggcaaucgcccuguguagcagguugcucgaauacacuccgaccgcucggcugacaccuuuagaggccugcgcacauaguuucuucgacgaacugcgagaucccaacgugaagcucccaaauggccgcgacaccccugcucuuuuuaacuucacgacucaggagcugucuuccaaucccccauuggccacaauucuaauucccccucacgcgagaauccaagccgcagcuagcaccccaacuaacgccacagcugccucggaugcaaauaccggugacagggggcagacgaacaaugccgcuucugcguccgcaucaaacaguaccuga

SEQ ID NO: 8617 - RNA, 1263 nt, Artificial Sequence
  derived and/or modified sequence opt4 from GSK3B__Homo_sapiens__AAH12760
augagcggcagacccagaaccaccagcuucgccgagagcugcaagcccgugcagcagcccagcgccuucggcagcaugaaggugagcagagacaaggacggcagcaaggugaccaccgugguggccacccccggccagggccccgacagaccccaggaggugagcuacaccgacaccaaggugaucggcaacggcagcuucggcgugguguaccaggccaagcugugcgacagcggcgagcugguggccaucaagaaggugcugcaggacaagagauucaagaacagagagcugcagaucaugagaaagcuggaccacugcaacaucgugagacugagauacuucuucuacagcagcggcgagaagaaggacgagguguaccugaaccuggugcuggacuacgugcccgagaccguguacagaguggccagacacuacagcagagccaagcagacccugcccgugaucuacgugaagcuguacauguaccagcuguucagaagccuggccuacauccacagcuucggcaucugccacagagacaucaagccccagaaccugcugcuggaccccgacaccgccgugcugaagcugugcgacuucggcagcgccaagcagcuggugagaggcgagcccaacgugagcuacaucugcagcagauacuacagagcccccgagcugaucuucggcgccaccgacuacaccagcagcaucgacguguggagcgccggcugcgugcuggccgagcugcugcugggccagcccaucuuccccggcgacagcggcguggaccagcugguggagaucaucaaggugcugggcacccccaccagagagcagaucagagagaugaaccccaacuacaccgaguucaaguucccccagaucaaggcccaccccuggaccaagguguucagacccagaaccccccccgaggccaucgcccugugcagcagacugcuggaguacacccccaccgccagacugaccccccuggaggccugcgcccacagcuucuucgacgagcugagagaccccaacgugaagcugcccaacggcagagacacccccgcccuguucaacuucaccacccaggagcugagcagcaaccccccccuggccaccauccugauccccccccacgccagaauccaggccgccgccagcacccccaccaacgccaccgccgccagcgacgccaacaccggcgacagaggccagaccaacaacgccgccagcgccagcgccagcaacagcaccuga

SEQ ID NO: 8618 - RNA, 1263 nt, Artificial Sequence
  derived and/or modified sequence opt5 from GSK3B__Homo_sapiens__AAH12760
augagcggcagaccccggaccacauccuucgccgagucuugcaagccugugcagcaaccgagcgcuuuuggguccaugaaagucucucgcgacaaggauggaagcaaaguuacgaccgugguggccacacccggccaggggccugacagaccccaggaagucuccuacaccgauacaaaggugaucggaaacggcucuuucgggguuguguaucaggcgaaacugugugacagcggagagcucgucgcuauuaagaaggugcugcaagauaaacgguuuaagaaucgcgaacuucagaucaugagaaaacuggaccacugcaacauuguucggcuccgcuacuucuuuuauuccagcggcgagaagaaagaugaaguguaccugaaucuuguccuggacuaugugccugagaccguguacagagucgcccggcauuauucucgcgccaagcagacacuccccguuaucuacgugaagcuguacauguaucagcuguucagaucccucgcuuacauucacagcuuuggcaucugucaucgggauaucaaaccucaaaaccugcuucuggacccggauaccgccgugcucaagcugugcgacuucgggucugcuaaacagcuuguccgcggagagcccaauguguccuauauuuguagcagauacuaucgggccccugaacugaucuuuggcgcgacggauuacaccucuuccauugacguuuggagcgccgggugcgugcucgcugagcugcugcucggacagcccaucuucccuggcgacuccggggucgaucagcugguggaaauuaucaagguucuuggaacacccacccgcgagcaaauuagagagaugaacccgaauuauacagaauuuaaauucccucagaucaaggcccaccccuggaccaaaguguuucggccuagaacgccucccgaggcuaucgcccuguguucucgccuccuggaauacacacccaccgcgcggcuuacaccgcuggaggccugcgcucauagcuucuucgacgaacucagagaucccaacgucaagcugccuaauggccgcgacacccccgcccuguuuaacuucaccacacaggagcucuccagcaauccuccccuggcuacgauucuuaucccgccucacgcccggauucaagccgcugcgucuacccccacaaacgccaccgcugccuccgaugccaauacaggcgacagagggcagaccaacaaugcugccagcgcgucugcuagcaacuccacguga

SEQ ID NO: 8619 - protein, 102 aa, Artificial Sequence
  HSP10__Homo_sapiens__P61604
MAGQAFRKFLPLFDRVLVERSAAETVTKGGIMLPEKSQGKVLQATVVAVGSGSKGKGGEIQPVSVKVGDKVLLPEYGGTKVVLDDKDYFLFRDGDILGKYVD

SEQ ID NO: 8620 - RNA, 309 nt, Artificial Sequence
  HSP10__Homo_sapiens__AAA50953
auggcaggacaagcguuuagaaaguuucuuccacucuuugaccgaguauugguugaaaggagugcugcugaaacuguaaccaaaggaggcauuaugcuuccagaaaaaucucaaggaaaaguauugcaagcaacaguagucgcuguuggaucggguucuaaaggaaaggguggagagauucaaccaguuagcgugaaaguuggagauaaaguucuucucccagaauauggaggcaccaaaguaguucuagaugacaaggauuauuuccuauuuagagauggugacauucuuggaaaguacguagacuga

SEQ ID NO: 8621 - RNA, 309 nt, Artificial Sequence
  derived and/or modified sequence opt1 from HSP10__Homo_sapiens__AAA50953
auggccggccaggccuuccgcaaguuccugccccucuucgaccgggugcuggucgagcgcagcgcggccgagaccgugaccaagggcgggaucaugcugccggagaagucccaggggaaggugcuccaggccacggucguggccgugggcagcggguccaagggcaagggcggggagauccagcccgucagcgugaaggugggcgacaagguccugcugcccgaguacgggggcaccaagguggugcucgacgacaaggacuacuuccuguuccgggacggggacauccugggcaaguacgucgacuga

SEQ ID NO: 8622 - RNA, 309 nt, Artificial Sequence
  derived and/or modified sequence opt2 from HSP10__Homo_sapiens__AAA50953
auggccggccaggccuuccgcaaguuccucccccucuucgaccgcguccucgucgagcgcuccgccgccgagaccgucaccaagggcggcaucaugcuccccgagaagucccagggcaagguccuccaggccaccgucgucgccgucggcuccggcuccaagggcaagggcggcgagauccagcccgucuccgucaaggucggcgacaagguccuccuccccgaguacggcggcaccaaggucguccucgacgacaaggacuacuuccucuuccgcgacggcgacauccucggcaaguacgucgacuga

SEQ ID NO: 8623 - RNA, 309 nt, Artificial Sequence
  derived and/or modified sequence opt3 from HSP10__Homo_sapiens__AAA50953
auggccggccaggcuuucagaaaguuucugccccucuucgacagggugcuugucgagcggagcgcagccgaaaccguuacaaaagggggaaucaugcugccugagaagucccaagguaaaguguugcaggcgacuguaguggcugucggcucugggucaaagggaaaaggcggugaaauucagccagugaguguuaaggugggggauaaggucuuacugccggaguacggaggcacgaaagugguacuagacgauaaggacuauuuucucuuccgcgauggcgacauacuggggaaauacguugauuga

SEQ ID NO: 8624 - RNA, 309 nt, Artificial Sequence
  derived and/or modified sequence opt4 from HSP10__Homo_sapiens__AAA50953
auggccggccaggccuucagaaaguuccugccccuguucgacagagugcugguggagagaagcgccgccgagaccgugaccaagggcggcaucaugcugcccgagaagagccagggcaaggugcugcaggccaccgugguggccgugggcagcggcagcaagggcaagggcggcgagauccagcccgugagcgugaaggugggcgacaaggugcugcugcccgaguacggcggcaccaagguggugcuggacgacaaggacuacuuccuguucagagacggcgacauccugggcaaguacguggacuga

SEQ ID NO: 8625 - RNA, 309 nt, Artificial Sequence
  derived and/or modified sequence opt5 from HSP10__Homo_sapiens__AAA50953
auggccggccaggcuuucagaaaguuucugccccucuucgaccgggugcuggucgagcgcagcgccgcggaaaccguuacaaaagggggaaucaugcuuccugagaagucccaaggcaaagugcugcaggcuacgguggucgccguggggucuggaagcaagggcaaagggggagaaauucagccgguuuccgugaaggucggcgauaaggugcuccugcccgaguacggcgggaccaaaguugugcuugacgauaaggacuauuuucuguucagagauggagacauccucggcaaauacgucgauuga

SEQ ID NO: 8626 - protein, 704 aa, Artificial Sequence
  HSP75__Homo_sapiens__Q12931
MARELRALLLWGRRLRPLLRAPALAAVPGGKPILCPRRTTAQLGPRRNPAWSLQAGRLFSTQTAEDKEEPLHSIISSTESVQGSTSKHEFQAETKKLLDIVARSLYSEKEVFIRELISNASDALEKLRHKLVSDGQALPEMEIHLQTNAEKGTITIQDTGIGMTQEELVSNLGTIARSGSKAFLDALQNQAEASSKIIGQFGVGFYSAFMVADRVEVYSRSAAPGSLGYQWLSDGSGVFEIAEASGVRTGTKIIIHLKSDCKEFSSEARVRDVVTKYSNFVSFPLYLNGRRMNTLQAIWMMDPKDVREWQHEEFYRYVAQAHDKPRYTLHYKTDAPLNIRSIFYVPDMKPSMFDVSRELGSSVALYSRKVLIQTKATDILPKWLRFIRGVVDSEDIPLNLSRELLQESALIRKLRDVLQQRLIKFFIDQSKKDAEKYAKFFEDYGLFMREGIVTATEQEVKEDIAKLLRYESSALPSGQLTSLSEYASRMRAGTRNIYYLCAPNRHLAEHSPYYEAMKKKDTEVLFCFEQFDELTLLHLREFDKKKLISVETDIVVDHYKEEKFEDRSPAAECLSEKETEELMAWMRNVLGSRVTNVKVTLRLDTHPAMVTVLEMGAARHFLRMQQLAKTQEERAQLLQPTLEINPRHALIKKLNQLRASEPGLAQLLVDQIYENAMIAAGLVDDPRAMVGRLNELLVKALERH

SEQ ID NO: 8627 - RNA, 2115 nt, Artificial Sequence
  HSP75__Homo_sapiens__AAH18950
auggcgcgcgagcugcgggcgcugcugcuguggggccgccgccugcggccuuugcugcgggcgccggcgcuggcggccgugccgggaggaaaaccaauucuguguccucggaggaccacagcccaguugggccccaggcgaaacccagccuggagcuugcaggcaggacgacuguucagcacgcagaccgccgaggacaaggaggaaccccugcacucgauuaucagcagcacagagagcgugcaggguuccacuuccaaacaugaguuccaggccgagacaaagaagcuuuuggacauuguugcccggucccuguacucagaaaaagagguguuuauacgggagcugaucuccaaugccagcgaugccuuggaaaaacugcgucacaaacuggugucugacggccaagcacugccagaaauggagauucacuugcagaccaaugccgagaaaggcaccaucaccauccaggauacugguaucgggaugacacaggaagagcugguguccaaccuggggacgauugccagaucggggucaaaggccuuccuggaugcucugcagaaccaggcugaggccagcagcaagaucaucggccaguuuggaguggguuucuacucagcuuucaugguggcugacagaguggaggucuauucccgcucggcagccccggggagccuggguuaccaguggcuuucagaugguucuggaguguuugaaaucgccgaagcuucgggaguuagaaccgggacaaaaaucaucauccaccugaaauccgacugcaaggaguuuuccagcgaggcccgggugcgagaugugguaacgaaguacagcaacuucgucagcuuccccuuguacuugaauggaaggcggaugaacaccuugcaggccaucuggaugauggaccccaaggauguccgugaguggcaacaugaggaguucuaccgcuacgucgcgcaggcucacgacaagccccgcuacacccugcacuauaagacggacgcaccgcucaacauccgcagcaucuucuacgugcccgacaugaaaccguccauguuugaugugagccgggagcugggcuccagcguugcacuguacagccgcaaaguccucauccagaccaaggccacggacauccugcccaaguggcugcgcuucauccgaggugugguggacagugaggacauuccccugaaccucagccgggagcugcugcaggagagcgcacucaucaggaaacuccgggacguuuuacagcagaggcugaucaaauucuucauugaccagaguaaaaaagaugcugagaaguaugcaaaguuuuuugaagauuacggccuguucaugcgggagggcauugugaccgccaccgagcaggaggucaaggaggacauagcaaagcugcugcgcuacgaguccucggcgcugcccuccgggcagcuaaccagccucucagaauacgccagccgcaugcgggccggcacccgcaacaucuacuaccugugcgcccccaaccgucaccuggcagagcacucacccuacuaugaggccaugaagaagaaagacacagagguucucuucugcuuugagcaguuugaugagcucacccugcugcaccuucgugaguuugacaagaagaagcugaucucuguggagacggacauagucguggaucacuacaaggaggagaaguuugaggacagguccccagccgccgagugccuaucagagaaggagacggaggagcucauggccuggaugagaaaugugcuggggucgcgugucaccaacgugaaggugacccuccgacuggacacccacccugccauggucaccgugcuggagaugggggcugcccgccacuuccugcgcaugcagcagcuggccaagacccaggaggagcgcgcacagcuccugcagcccacgcuggagaucaaccccaggcacgcgcucaucaagaagcugaaucagcugcgcgcaagcgagccuggccuggcucagcugcugguggaucagauauacgagaacgccaugauugcugcuggacuuguugacgacccuagggccauggugggccgcuugaaugagcugcuugucaaggcccuggagcgacacuga

SEQ ID NO: 8628 - RNA, 2115 nt, Artificial Sequence
  derived and/or modified sequence opt1 from HSP75__Homo_sapiens__AAH18950
auggcccgcgagcugcgggcccuccugcuguggggccgccggcuccgcccccugcugcgggcgccggcccucgccgccgugcccgggggcaagcccauccugugcccccgccggaccaccgcccagcuggggccgcgccggaaccccgcguggagccuccaggccggccgccuguucuccacgcagaccgccgaggacaaggaggagccccugcacagcaucaucuccagcaccgaguccguccaggggagcaccuccaagcacgaguuccaggccgagacgaagaagcuccuggacaucguggcgcggagccuguacuccgagaaggagguguucauccgcgagcucaucagcaacgccuccgacgcccuggagaagcugcggcacaagcucgucagcgacggccaggcccugcccgagauggagauccaccuccagaccaacgccgagaagggcaccaucaccauccaggacacggggaucggcaugacccaggaggagcugguguccaaccuggggaccaucgcgcgcagcggcuccaaggccuuccuggacgcccuccagaaccaggccgaggccagcuccaagaucaucgggcaguucggcgugggcuucuacagcgcguucauggucgccgaccggguggagguguacucccgcagcgccgccccggggagccugggcuaccaguggcuguccgacgggagcggcgucuucgagaucgccgaggcguccggcgugcggaccgggacgaagaucaucauccaccucaagagcgacugcaaggaguucuccagcgaggcccgcgugcgggacgucgugaccaaguacuccaacuucgugagcuucccccuguaccugaacggccgccggaugaacacccuccaggccaucuggaugauggaccccaaggacguccgcgaguggcagcacgaggaguucuaccgcuacguggcccaggcccacgacaagccccgguacacccugcacuacaagacggacgcgccgcugaacauccgcuccaucuucuacgugcccgacaugaagcccagcauguucgacgucucccgggagcucgggagcuccguggcccuguacagccgcaaggugcugauccagaccaaggccaccgacauccuccccaaguggcugcgguucauccgcggcgucguggacuccgaggacaucccgcugaaccucagccgggagcugcugcaggaguccgcccucauccgcaagcugcgggacgugcugcagcagcgccucaucaaguucuucaucgaccagagcaagaaggacgcggagaaguacgccaaguucuucgaggacuacgggcuguucaugcgggagggcaucgucaccgccacggagcaggaggugaaggaggacaucgccaagcugcuccgcuacgaguccagcgcccugcccagcggccagcugaccucccugagcgaguacgcgucccggaugcgcgccgggacccggaacaucuacuaccucugcgcccccaaccgccaccuggccgagcacagccccuacuacgaggccaugaagaagaaggacaccgagguccuguucugcuucgagcaguucgacgagcucacgcugcugcaccuccgggaguucgacaagaagaagcugaucuccguggagaccgacaucguggucgaccacuacaaggaggagaaguucgaggaccgcagcccggcggccgagugccuguccgagaaggagaccgaggagcucauggccuggaugcggaacgugcugggcagccgcgugaccaacgucaaggugacgcugcgccucgacacccaccccgccauggugaccguccuggagaugggggccgcgcggcacuuccugcgcaugcagcagcucgccaagacccaggaggagcgggcccagcugcugcagcccacgcucgagaucaacccccgccacgcccugaucaagaagcugaaccagcuccgggcguccgagccgggccuggcccagcugcucguggaccagaucuacgagaacgccaugaucgccgccgggcugguggacgacccccgcgcgauggucggccggcugaacgagcuccuggugaaggcccuggagcgccacuga

SEQ ID NO: 8629 - RNA, 2115 nt, Artificial Sequence
  derived and/or modified sequence opt2 from HSP75__Homo_sapiens__AAH18950
auggcccgcgagcuccgcgcccuccuccucuggggccgccgccuccgcccccuccuccgcgcccccgcccucgccgccguccccggcggcaagcccauccucugcccccgccgcaccaccgcccagcucggcccccgccgcaaccccgccuggucccuccaggccggccgccucuucuccacccagaccgccgaggacaaggaggagccccuccacuccaucaucuccuccaccgaguccguccagggcuccaccuccaagcacgaguuccaggccgagaccaagaagcuccucgacaucgucgcccgcucccucuacuccgagaaggaggucuucauccgcgagcucaucuccaacgccuccgacgcccucgagaagcuccgccacaagcucgucuccgacggccaggcccuccccgagauggagauccaccuccagaccaacgccgagaagggcaccaucaccauccaggacaccggcaucggcaugacccaggaggagcucgucuccaaccucggcaccaucgcccgcuccggcuccaaggccuuccucgacgcccuccagaaccaggccgaggccuccuccaagaucaucggccaguucggcgucggcuucuacuccgccuucauggucgccgaccgcgucgaggucuacucccgcuccgccgcccccggcucccucggcuaccaguggcucuccgacggcuccggcgucuucgagaucgccgaggccuccggcguccgcaccggcaccaagaucaucauccaccucaaguccgacugcaaggaguucuccuccgaggcccgcguccgcgacgucgucaccaaguacuccaacuucgucuccuucccccucuaccucaacggccgccgcaugaacacccuccaggccaucuggaugauggaccccaaggacguccgcgaguggcagcacgaggaguucuaccgcuacgucgcccaggcccacgacaagccccgcuacacccuccacuacaagaccgacgccccccucaacauccgcuccaucuucuacguccccgacaugaagcccuccauguucgacgucucccgcgagcucggcuccuccgucgcccucuacucccgcaagguccucauccagaccaaggccaccgacauccuccccaaguggcuccgcuucauccgcggcgucgucgacuccgaggacaucccccucaaccucucccgcgagcuccuccaggaguccgcccucauccgcaagcuccgcgacguccuccagcagcgccucaucaaguucuucaucgaccaguccaagaaggacgccgagaaguacgccaaguucuucgaggacuacggccucuucaugcgcgagggcaucgucaccgccaccgagcaggaggucaaggaggacaucgccaagcuccuccgcuacgaguccuccgcccuccccuccggccagcucaccucccucuccgaguacgccucccgcaugcgcgccggcacccgcaacaucuacuaccucugcgcccccaaccgccaccucgccgagcacucccccuacuacgaggccaugaagaagaaggacaccgagguccucuucugcuucgagcaguucgacgagcucacccuccuccaccuccgcgaguucgacaagaagaagcucaucuccgucgagaccgacaucgucgucgaccacuacaaggaggagaaguucgaggaccgcucccccgccgccgagugccucuccgagaaggagaccgaggagcucauggccuggaugcgcaacguccucggcucccgcgucaccaacgucaaggucacccuccgccucgacacccaccccgccauggucaccguccucgagaugggcgccgcccgccacuuccuccgcaugcagcagcucgccaagacccaggaggagcgcgcccagcuccuccagcccacccucgagaucaacccccgccacgcccucaucaagaagcucaaccagcuccgcgccuccgagcccggccucgcccagcuccucgucgaccagaucuacgagaacgccaugaucgccgccggccucgucgacgacccccgcgccauggucggccgccucaacgagcuccucgucaaggcccucgagcgccacuga

SEQ ID NO: 8630 - RNA, 2115 nt, Artificial Sequence
  derived and/or modified sequence opt3 from HSP75__Homo_sapiens__AAH18950
auggccagagagcugagggcucuccuucuguggggccggcgcuugcgacccuuacugcgugcuccugcccuagcggcugugccagggggaaagccgauccucugccccagaaggaccacagcccagcuggguccucggcgcaacccagcauggagccuucaagccggcagacuguucuccacucagacggcugaagacaaagaggaacccuugcacucuauuauaucaaguaccgagagcguccagggguccacaucuaagcaugaauuucaggcagagacuaaaaagcuccuggauaucguugccaggucgcuguacucagagaaagaaguguucauucgggagcucaucagcaaugcuagugacgccuuagaaaagcugcgccacaagcuaguauccgauggacaagcguugccugagauggagauucaucugcagaccaacgcagaaaaaggcacaaucaccauacaggacacugguaucgggaugacacaggaggaacuugugucuaaucucggaaccauugcccgaagcggcuccaaggcuuuucuggaugcccuucaaaaccaggcagaggcuucaaguaaaaucauuggccaguucggggucggauuuuauagcgccuucaugguggcggacagaguugaaguguacucuagguccgccgcaccagguucacugggcuaucagugguugagcgaugggaguggagucuuugagaucgcugaggccucuggcgugcggacggguacuaagauaauuauccaccucaaauccgacuguaaggaauuuagcucggaggcucguguacgcgauguugugaccaaguacucuaauuuugucuccuucccccuguauuuaaacgggagaaggaugaauacacugcaagccauuuggaugauggacccuaaagaugugcgggaauggcagcaugaggaauuuuaccgauauguggcacaggcccacgacaagccacgcuacacucuccacuacaaaaccgaugcuccgcuuaacaucagaucaaucuucuauguccccgacaugaagccuaguauguuugacguuagcagggagcugggauccucuguggcguuguacagccggaaaguacuaauucaaacaaaggcaaccgauauacugccaaaauggcuccgcuucaucagaggcguggucgacucagaggauauuccccugaaucuuaguagggaacuguugcaggaguccgcccucauccguaagcugcgggacguguuacagcagcgacugauaaaguucuuuauugaucaaagcaaaaaggacgcugaaaaauaugccaaguucuuugaggauuacggccuauucaugagagaagggaucguuacggcaacugagcaggaggugaaagaagacaucgccaagcuccugagguaugagucuucagcacuuccuaguggacaguugacaagccuguccgaauacgccucucgcaugcgggcagguaccagaaacauuuauuaccucugcgcgccaaauaggcaucuggcugagcacucgcccuacuaugaggccaugaagaaaaaggauacugaaguccuuuucuguuucgagcaguuugacgaacugacauugcuccaucugcgcgaguucgauaaaaagaaauuaaucagcguggaaaccgacauuguaguugaccacuacaaggaggagaaguuugaagaucgauccccggcagccgagugccugucagaaaaagagacggaagaacuaauggcuuggaugcggaacgugcucggcagucgugucaccaaugugaaggucacacugagacuugacacucacccugccauggugaccguuuuggagaugggggcagcuaggcauuuccugcgcaugcaacagcucgccaaaacacaggaggagcgggcgcagcuguuacaacccacucuggaaauaaacccaagacacgcccuuaucaagaaauugaaucagcucagggcuucugagccuggacuggcacagcuacugguggaucagauuuaugaaaacgccaugaucgcugccggccucguagacgauccccgagcaauggucggucgccugaacgagcuuuuggugaaggcgcuggagcggcauuga

SEQ ID NO: 8631 - RNA, 2115 nt, Artificial Sequence
  derived and/or modified sequence opt4 from HSP75__Homo_sapiens__AAH18950
auggccagagagcugagagcccugcugcuguggggcagaagacugagaccccugcugagagcccccgcccuggccgccgugcccggcggcaagcccauccugugccccagaagaaccaccgcccagcugggccccagaagaaaccccgccuggagccugcaggccggcagacuguucagcacccagaccgccgaggacaaggaggagccccugcacagcaucaucagcagcaccgagagcgugcagggcagcaccagcaagcacgaguuccaggccgagaccaagaagcugcuggacaucguggccagaagccuguacagcgagaaggagguguucaucagagagcugaucagcaacgccagcgacgcccuggagaagcugagacacaagcuggugagcgacggccaggcccugcccgagauggagauccaccugcagaccaacgccgagaagggcaccaucaccauccaggacaccggcaucggcaugacccaggaggagcuggugagcaaccugggcaccaucgccagaagcggcagcaaggccuuccuggacgcccugcagaaccaggccgaggccagcagcaagaucaucggccaguucggcgugggcuucuacagcgccuucaugguggccgacagaguggagguguacagcagaagcgccgcccccggcagccugggcuaccaguggcugagcgacggcagcggcguguucgagaucgccgaggccagcggcgugagaaccggcaccaagaucaucauccaccugaagagcgacugcaaggaguucagcagcgaggccagagugagagacguggugaccaaguacagcaacuucgugagcuucccccuguaccugaacggcagaagaaugaacacccugcaggccaucuggaugauggaccccaaggacgugagagaguggcagcacgaggaguucuacagauacguggcccaggcccacgacaagcccagauacacccugcacuacaagaccgacgccccccugaacaucagaagcaucuucuacgugcccgacaugaagcccagcauguucgacgugagcagagagcugggcagcagcguggcccuguacagcagaaaggugcugauccagaccaaggccaccgacauccugcccaaguggcugagauucaucagaggcgugguggacagcgaggacaucccccugaaccugagcagagagcugcugcaggagagcgcccugaucagaaagcugagagacgugcugcagcagagacugaucaaguucuucaucgaccagagcaagaaggacgccgagaaguacgccaaguucuucgaggacuacggccuguucaugagagagggcaucgugaccgccaccgagcaggaggugaaggaggacaucgccaagcugcugagauacgagagcagcgcccugcccagcggccagcugaccagccugagcgaguacgccagcagaaugagagccggcaccagaaacaucuacuaccugugcgcccccaacagacaccuggccgagcacagccccuacuacgaggccaugaagaagaaggacaccgaggugcuguucugcuucgagcaguucgacgagcugacccugcugcaccugagagaguucgacaagaagaagcugaucagcguggagaccgacaucgugguggaccacuacaaggaggagaaguucgaggacagaagccccgccgccgagugccugagcgagaaggagaccgaggagcugauggccuggaugagaaacgugcugggcagcagagugaccaacgugaaggugacccugagacuggacacccaccccgccauggugaccgugcuggagaugggcgccgccagacacuuccugagaaugcagcagcuggccaagacccaggaggagagagcccagcugcugcagcccacccuggagaucaaccccagacacgcccugaucaagaagcugaaccagcugagagccagcgagcccggccuggcccagcugcugguggaccagaucuacgagaacgccaugaucgccgccggccugguggacgaccccagagccauggugggcagacugaacgagcugcuggugaaggcccuggagagacacuga

SEQ ID NO: 8632 - RNA, 2115 nt, Artificial Sequence
  derived and/or modified sequence opt5 from HSP75__Homo_sapiens__AAH18950
auggccagagagcugcgggcucuccugcuuuggggccgcagacugcggccccuccugcgcgccccugcgcuugcugccgugcccgggggaaagccgauccugugcccuagacggaccacagcccagcucggcccccgcagaaacccugcuuggagccugcaagccgggcggcuguucuccacgcagaccgcugaagacaaagaggaaccccuccacucuauuaucagcuccacagagucuguccagggaagcaccuccaagcaugaauuucaggccgagacaaagaagcugcuugauauuguugcgcgcucucuguacagcgagaaagaaguguucaucagagagcucauuuccaaugccagcgacgcucuggaaaaacuucggcacaagcuggugucugauggccaagcccucccugagauggagauccaucugcagaccaacgcugaaaaagggacaaucaccauucaggacacgggaaucggcaugacccaggaggaacuggucuccaaucucggcacaauugcccgcagcgggucuaaggcguuucuggaugcccuucaaaaccaggcugaggccuccagcaaaaucauuggacaguucggcgugggguuuuauucugcuuucaugguugccgacagaguggaagucuacucccggagcgccgcuccgggaucccugggcuaucaguggcucucugaugggagcggaguguuugagaucgcggaggccuccggcguucgcaccggcacaaagauuaucauccaccugaaaagcgacuguaaggaguucucuuccgaggcuagagugcgggaugucgugaccaaguacagcaauuuugugucuuucccccuuuaucugaacgggagacgcaugaauacgcuccaagccauuuggaugauggacccuaaagauguccgggaauggcagcaugaggaauuuuacagauauguugcccaggcucacgacaagccccgcuacacacugcacuacaaaaccgaugccccucugaacauccggagcauuuucuaugugcccgacaugaagccguccauguuugacgugucuagagagcucggaagcuccgucgcgcuguacagccgcaaagugcuuauccaaacaaaggcuaccgauauucugccuaaauggcuccgguucaucagaggcguuguggacucugaggauaucccccugaaucuuucccgcgaacugcuccaggagagcgcccugauucggaagcugagagacguccuccagcagcgccugaucaaguucuuuauugaucaaucuaaaaaggacgccgaaaaauaugcuaaguucuuugaggauuacgggcuuuucaugcgggaaggaaucgugaccgccacagagcaggagguuaaagaagacauugcuaagcugcucagauaugaguccagcgcccugccuuccggccagcugacgucucuuagcgaauacgcgucccggaugcgcgccgggaccagaaacaucuauuaccucugcgcucccaaucggcaucuggccgagcacucucccuacuaugaggcuaugaagaaaaaggauacagaagugcuguuuuguuucgagcaguuugacgaacucacccugcuucaucugagagaguucgauaaaaagaaacucaucagcgucgaaacagacauuguggucgaccacuacaaggaggagaaguuugaagaucgcuccccugccgcggagugccugagcgaaaaagagaccgaagaacugauggccuggaugcggaacgugcuuggaucuagaguuacgaaugugaaggucacacuccgccuggacacccacccggcuauggugaccguucuggagaugggcgccgcuagacauuuccuccggaugcaacagcuggccaaaacacaggaggaacgcgcccagcuucugcaacccacccucgaaaucaacccuagacacgcucugauuaagaaacugaaucagcuucgggcguccgagcccggccucgcccagcugcugguggaucagaucuaugaaaacgcuaugauugccgccgggcucgucgacgauccucgcgcuauggugggaagacugaacgagcuucuggugaaggcccucgagcggcauuga

SEQ ID NO: 8633 - protein, 802 aa, Artificial Sequence
  HSP90B1__Homo_sapiens__Q5CAQ5
MRALWVLGLCCVLLTFGSVRADDEVDVDGTVEEDLGKSREGSRTDDEVVQREEEAIQLDGLNASQIRELREKSEKFAFQAEVNRMMKLIINSLYKNKEIFLRELISNASDALDKIRLISLTDENALSGNEELTVKIKCDKEKNLLHVTDTGVGMTREELVKNLGTIAKSGTSEFLNKMTEAQEDGQSTSELIGQFGVGFYSAFLVADKVIVTSKHNNDTQHIWESDSNEFSVIADPRGNTLGRGTTITLVLKEEASDYLELDTIKNLVKKYSQFINFPIYVWSSKTETVEEPMEEEEAAKEEKEESDDEAAVEEEEEEKKPKTKKVEKTVWDWELMNDIKPIWQRPSKEVEEDEYKAFYKSFSKESDDPMAYIHFTAEGEVTFKSILFVPTSAPRGLFDEYGSKKSDYIKLYVRRVFITDDFHDMMPKYLNFVKGVVDSDDLPLNVSRETLQQHKLLKVIRKKLVRKTLDMIKKIADDKYNDTFWKEFGTNIKLGVIEDHSNRTRLAKLLRFQSSHHPTDITSLDQYVERMKEKQDKIYFMAGSSRKEAESSPFVERLLKKGYEVIYLTEPVDEYCIQALPEFDGKRFQNVAKEGVKFDESEKTKESREAVEKEFEPLLNWMKDKALKDKIEKAVVSQRLTESPCALVASQYGWSGNMERIMKAQAYQTGKDISTNYYASQKKTFEINPRHPLIRDMLRRIKEDEDDKTVLDLAVVLFETATLRSGYLLPDTKAYGDRIERMLRLSLNIDPDAKVEEEPEEEPEETAEDTTEDTEQDEDEEMDVGTDEEETAKESTAEKDEL

SEQ ID NO: 8634 - RNA, 2409 nt, Artificial Sequence
  HSP90B1__Homo_sapiens__CAI64497
augagggcccugugggugcugggccucugcugcguccugcugaccuucgggucggucagagcugacgaugaaguugauguggaugguacaguagaagaggaucuggguaaaaguagagaaggaucaaggacggaugaugaaguaguacagagagaggaagaagcuauucaguuggauggauuaaaugcaucacaaauaagagaacuuagagagaagucggaaaaguuugccuuccaagccgaaguuaacagaaugaugaaacuuaucaucaauucauuguauaaaaauaaagagauuuuccugagagaacugauuucaaaugcuucugaugcuuuagauaagauaaggcuaauaucacugacugaugaaaaugcucuuucuggaaaugaggaacuaacagucaaaauuaagugugauaaggagaagaaccugcugcaugucacagacaccgguguaggaaugaccagagaagaguugguuaaaaaccuugguaccauagccaaaucugggacaagcgaguuuuuaaacaaaaugacugaagcacaggaagauggccagucaacuucugaauugauuggccaguuuggugucgguuucuauuccgccuuccuuguagcagauaagguuauugucacuucaaaacacaacaacgauacucagcacaucugggagucugacuccaaugaauuuucuguaauugcugacccaagaggaaacacucuaggacggggaacgacaauuacccuugucuuaaaagaagaagcaucugauuaccuugaauuggauacaauuaaaaaucucgucaaaaaauauucacaguucauaaacuuuccuauuuauguauggagcagcaagacugaaacuguugaggagcccauggaggaagaagaagcagccaaagaagagaaagaagaaucugaugaugaagcugcaguagaggaagaagaagaagaaaagaaaccaaagacuaaaaaaguugaaaaaacugucugggacugggaacuuaugaaugauaucaaaccaauauggcagagaccaucaaaagaaguagaagaagaugaauacaaagcuuucuacaaaucauuuucaaaggaaagugaugaccccauggcuuauauucacuuuacugcugaaggggaaguuaccuucaaaucaauuuuauuuguacccacaucugcuccacguggucuguuugacgaauauggaucuaaaaagagcgauuacauuaagcucuaugugcgccguguauucaucacagacgacuuccaugauaugaugccuaaauaccucaauuuugucaagggugugguggacucagaugaucuccccuugaauguuucccgcgagacucuucagcaacauaaacugcuuaaggugauuaggaagaagcuuguucguaaaacgcuggacaugaucaagaagauugcugaugauaaauacaaugauacuuuuuggaaagaauuugguaccaacaucaagcuuggugugauugaagaccacucgaaucgaacacgucuugcuaaacuucuuagguuccagucuucucaucauccaacugacauuacuagccuagaccaguauguggaaagaaugaaggaaaaacaagacaaaaucuacuucauggcuggguccagcagaaaagaggcugaaucuucuccauuuguugagcgacuucugaaaaagggcuaugaaguuauuuaccucacagaaccuguggaugaauacuguauucaggcccuucccgaauuugaugggaagagguuccagaauguugccaaggaaggagugaaguucgaugaaagugagaaaacuaaggagagucgugaagcaguugagaaagaauuugagccucugcugaauuggaugaaagauaaagcccuuaaggacaagauugaaaaggcuguggugucucagcgccugacagaaucuccgugugcuuugguggccagccaguacggauggucuggcaacauggagagaaucaugaaagcacaagcguaccaaacgggcaaggacaucucuacaaauuacuaugcgagucagaagaaaacauuugaaauuaaucccagacacccgcugaucagagacaugcuucgacgaauuaaggaagaugaagaugauaaaacaguuuuggaucuugcugugguuuuguuugaaacagcaacgcuucggucaggguaucuuuuaccagacacuaaagcauauggagauagaauagaaagaaugcuucgccucaguuugaacauugacccugaugcaaagguggaagaagagcccgaagaagaaccugaagagacagcagaagacacaacagaagacacagagcaagacgaagaugaagaaauggaugugggaacagaugaagaagaaacagcaaaggaaucuacagcugaaaaagaugaauuguaa

SEQ ID NO: 8635 - RNA, 2409 nt, Artificial Sequence
  derived and/or modified sequence opt1 from HSP90B1__Homo_sapiens__CAI64497
augcgcgcccugugggugcucggccugugcugcguccugcucaccuucgggagcgugcgggccgacgacgagguggacgucgacggcaccguggaggaggaccuggggaagucccgcgagggcagccggacggacgacgaggugguccagcgcgaggaggaggcgauccagcuggacgggcucaacgccucccagauccgggagcugcgcgagaaguccgagaaguucgccuuccaggccgaggugaaccggaugaugaagcugaucaucaacagccucuacaagaacaaggagaucuuccugcgcgagcugaucagcaacgccuccgacgcgcucgacaagauccggcugaucagccugaccgacgagaacgcccucuccggcaacgaggagcugaccgugaagaucaagugcgacaaggagaagaaccugcuccacgucaccgacacgggcguggggaugacccgcgaggagcuggugaagaaccugggcaccaucgccaagagcgggaccuccgaguuccucaacaagaugacggaggcccaggaggacggccagagcaccuccgagcugaucgggcaguucggcgucggcuucuacagcgcguuccugguggccgacaaggugaucgucaccuccaagcacaacaacgacacccagcacaucugggagagcgacuccaacgaguucagcgugaucgccgacccccgggggaacacgcucggccgcgggaccaccaucacccuggugcugaaggaggaggccuccgacuaccucgagcuggacacgaucaagaaccuggucaagaaguacagccaguucaucaacuucccgaucuacguguggagcuccaagaccgagaccguggaggagcccauggaggaggaggaggccgcgaaggaggagaaggaggagagcgacgacgaggccgccgucgaggaggaggaggaggagaagaagcccaagaccaagaagguggagaagacggugugggacugggagcucaugaacgacaucaagcccaucuggcagcggccguccaaggaggucgaggaggacgaguacaaggccuucuacaagagcuucuccaaggagagcgacgaccccauggccuacauccacuucaccgcggagggcgaggugaccuucaaguccauccuguucguccccaccagcgcgccccgcggccuguucgacgaguacggguccaagaaguccgacuacaucaagcucuacgugcggcgcguguucaucacggacgacuuccacgacaugaugccgaaguaccugaacuucgucaagggcgugguggacagcgacgaccugccccucaacgucagccgggagacccugcagcagcacaagcugcucaaggugauccgcaagaagcuggugcggaagacccuggacaugaucaagaagaucgccgacgacaaguacaacgacaccuucuggaaggaguucgggacgaacaucaagcucggcgucaucgaggaccacuccaaccgcacccggcuggccaagcugcuccgcuuccagagcucccaccaccccaccgacaucaccagccuggaccaguacguggagcgcaugaaggagaagcaggacaagaucuacuucauggccggguccagccggaaggaggccgaguccagccccuucguggagcgccugcucaagaagggcuacgaggucaucuaccugacggagccgguggacgaguacugcauccaggcccugcccgaguucgacggcaagcgguuccagaacguggccaaggagggggucaaguucgacgagagcgagaagaccaaggagucccgcgaggccguggagaaggaguucgagccccugcucaacuggaugaaggacaaggcccugaaggacaagaucgagaaggcgguggucagccagcggcugaccgagucccccugcgcccucguggccagccaguacggcugguccgggaacauggagcgcaucaugaaggcccaggcguaccagaccggcaaggacaucagcacgaacuacuacgccucccagaagaagaccuucgagaucaacccgcggcacccccugauccgcgacaugcugcggcgcaucaaggaggacgaggacgacaagaccgugcucgaccuggccgucgugcuguucgagaccgccacccuccggagcggguaccugcugcccgacacgaaggccuacggcgaccgcaucgagcggaugcuccgccugucccugaacaucgaccccgacgcgaagguggaggaggagccggaggaggagcccgaggagaccgccgaggacaccaccgaggacacggagcaggacgaggacgaggagauggacgucggcaccgacgaggaggagaccgccaaggagagcaccgccgagaaggacgagcucuga

SEQ ID NO: 8636 - RNA, 2409 nt, Artificial Sequence
  derived and/or modified sequence opt2 from HSP90B1__Homo_sapiens__CAI64497
augcgcgcccucuggguccucggccucugcugcguccuccucaccuucggcuccguccgcgccgacgacgaggucgacgucgacggcaccgucgaggaggaccucggcaagucccgcgagggcucccgcaccgacgacgaggucguccagcgcgaggaggaggccauccagcucgacggccucaacgccucccagauccgcgagcuccgcgagaaguccgagaaguucgccuuccaggccgaggucaaccgcaugaugaagcucaucaucaacucccucuacaagaacaaggagaucuuccuccgcgagcucaucuccaacgccuccgacgcccucgacaagauccgccucaucucccucaccgacgagaacgcccucuccggcaacgaggagcucaccgucaagaucaagugcgacaaggagaagaaccuccuccacgucaccgacaccggcgucggcaugacccgcgaggagcucgucaagaaccucggcaccaucgccaaguccggcaccuccgaguuccucaacaagaugaccgaggcccaggaggacggccaguccaccuccgagcucaucggccaguucggcgucggcuucuacuccgccuuccucgucgccgacaaggucaucgucaccuccaagcacaacaacgacacccagcacaucugggaguccgacuccaacgaguucuccgucaucgccgacccccgcggcaacacccucggccgcggcaccaccaucacccucguccucaaggaggaggccuccgacuaccucgagcucgacaccaucaagaaccucgucaagaaguacucccaguucaucaacuuccccaucuacgucugguccuccaagaccgagaccgucgaggagcccauggaggaggaggaggccgccaaggaggagaaggaggaguccgacgacgaggccgccgucgaggaggaggaggaggagaagaagcccaagaccaagaaggucgagaagaccgucugggacugggagcucaugaacgacaucaagcccaucuggcagcgccccuccaaggaggucgaggaggacgaguacaaggccuucuacaaguccuucuccaaggaguccgacgaccccauggccuacauccacuucaccgccgagggcgaggucaccuucaaguccauccucuucguccccaccuccgccccccgcggccucuucgacgaguacggcuccaagaaguccgacuacaucaagcucuacguccgccgcgucuucaucaccgacgacuuccacgacaugaugcccaaguaccucaacuucgucaagggcgucgucgacuccgacgaccucccccucaacgucucccgcgagacccuccagcagcacaagcuccucaaggucauccgcaagaagcucguccgcaagacccucgacaugaucaagaagaucgccgacgacaaguacaacgacaccuucuggaaggaguucggcaccaacaucaagcucggcgucaucgaggaccacuccaaccgcacccgccucgccaagcuccuccgcuuccaguccucccaccaccccaccgacaucaccucccucgaccaguacgucgagcgcaugaaggagaagcaggacaagaucuacuucauggccggcuccucccgcaaggaggccgaguccucccccuucgucgagcgccuccucaagaagggcuacgaggucaucuaccucaccgagcccgucgacgaguacugcauccaggcccuccccgaguucgacggcaagcgcuuccagaacgucgccaaggagggcgucaaguucgacgaguccgagaagaccaaggagucccgcgaggccgucgagaaggaguucgagccccuccucaacuggaugaaggacaaggcccucaaggacaagaucgagaaggccgucgucucccagcgccucaccgagucccccugcgcccucgucgccucccaguacggcugguccggcaacauggagcgcaucaugaaggcccaggccuaccagaccggcaaggacaucuccaccaacuacuacgccucccagaagaagaccuucgagaucaacccccgccacccccucauccgcgacaugcuccgccgcaucaaggaggacgaggacgacaagaccguccucgaccucgccgucguccucuucgagaccgccacccuccgcuccggcuaccuccuccccgacaccaaggccuacggcgaccgcaucgagcgcaugcuccgccucucccucaacaucgaccccgacgccaaggucgaggaggagcccgaggaggagcccgaggagaccgccgaggacaccaccgaggacaccgagcaggacgaggacgaggagauggacgucggcaccgacgaggaggagaccgccaaggaguccaccgccgagaaggacgagcucuga

SEQ ID NO: 8637 - RNA, 2409 nt, Artificial Sequence
  derived and/or modified sequence opt3 from HSP90B1__Homo_sapiens__CAI64497
augagagcccugugggugcucggccuuugcuguguccuguugaccuucgggagcguuagggcugacgaugagguggacguagauggaacaguggaagaggacuuagguaagucccgggaaggcucucgcacugaugacgaggucgugcagcgagaagaggaggcaauccaacuggaugggcuaaacgccucacagauucgugaacucagagagaaaagugaaaaguuugcguuccaggcugagguuaauaggaugaugaaacugauaaucaacagccuuuacaagaauaaagagauuuuucugcgggaauugaucuccaacgccucugacgcacucgauaagauucgccugaucucgcugacggacgagaaugcccucucaggaaacgaagaguuaaccgugaagauaaaaugcgauaaggagaaaaaucugcuucacgucacagacacuggcguggguaugaccagagaggaguugguaaagaaccuggggacaaucgcuaaaagcggaaccagugaguuccuaaauaagaugacugaagcacaggaagauggccaauccacaucugagcucauuggccaguuugggguuggauucuauagcgccuuucugguggcugacaaggucaucgugaccuccaaacauaacaaugacacgcagcacauuugggaaucagauaguaacgaguucagcgugaucgccgaccccagggguaauacucuuggccgggggaccacaauaacucuggucuugaaggaggaagcgucugauuaccucgagcuggacaccauuaaaaacuuaguuaagaaauauucccaguuuaucaauuucccuauuuacguguggucaagcaagacagaaaccguagaggaaccaauggaggaggaagaggcagccaaagaagagaaggaggaaagugaugacgaggcugccguggaagaggaagaggaggaaaagaaaccgaagacgaaaaaggucgagaaaacugugugggauugggaacugaugaacgacaucaagcccaucuggcaacgcccuucuaaggagguugaagaggaugaguauaaagcauuuuacaaguccuucagcaaagaaucggacgauccaauggcuuauauucauuuuacagccgagggagaagugaccuucaagucuauacucuucguccccacuuccgcgccucgaggccuuuuugacgaguacgguaguaaaaagucagacuacaucaagcuguaugugagaaggguauucauuacagaugacuuucacgauaugaugccaaaauacuugaacuucguuaaggggguggucgacagcgaugaccuaccccugaaugugucccgggaaacccuccagcagcauaaacugcuuaaggucauccguaaaaagcuggugcgcaagacguuggauaugauuaaaaagauagccgacgauaaauauaacgacaccuuuuggaaggaguucggaacaaauaucaaacucggcguuaucgaggaucacucuaacagaacuaggcuggcaaaguuacugcgguuucagagcucacaccauccuaccgacauuacaagucuagaucaauacguggaacgaaugaaagagaagcaggacaagaucuauuucauggcuggcuccagccgcaaagaagccgagucuucaccauuuguagagagacuccugaagaaaggguacgaagucauuuaucuuacugagccgguggacgaauacuguauacaggcuuugcccgaguucgauggaaagagguuucaaaauguugccaaagaaggugugaaguucgacgagagugagaagaccaaagaaagccgggaggcagucgaaaaggaguuugaaccucugcucaacuggaugaaagauaaggcccugaaagacaagaucgagaaggcugugguaucccagcgccuuacagagucuccaugcgcgcugguggcaucgcaguacggcuggagcgggaauauggaaagaauuaugaaagcccaggcuuaucaaaccggaaaggauaucuccacuaacuacuaugccucacagaaaaagacguucgagaucaaucccaggcacccuuugauucgugacaugcuccggcgaauaaaagaagaugaggacgauaagacaguucuggacuuagcagucgugcuguucgaaaccgccacucuaagaaguggcuaccuccugccagauaccaaggcuuauggugacaggaucgagcgcaugcuucgguugucucugaacauugaucccgacgccaaaguggaggaagaaccggaagaggagccugaagagacagcagaagacaccacugaggauacagaacaggacgaggaugaggaaauggacgucgggacggaugaggaagagaccgcgaaggaaagcacugcugagaaagacgagcucuga

SEQ ID NO: 8638 - RNA, 2409 nt, Artificial Sequence
  derived and/or modified sequence opt4 from HSP90B1__Homo_sapiens__CAI64497
augagagcccugugggugcugggccugugcugcgugcugcugaccuucggcagcgugagagccgacgacgagguggacguggacggcaccguggaggaggaccugggcaagagcagagagggcagcagaaccgacgacgagguggugcagagagaggaggaggccauccagcuggacggccugaacgccagccagaucagagagcugagagagaagagcgagaaguucgccuuccaggccgaggugaacagaaugaugaagcugaucaucaacagccuguacaagaacaaggagaucuuccugagagagcugaucagcaacgccagcgacgcccuggacaagaucagacugaucagccugaccgacgagaacgcccugagcggcaacgaggagcugaccgugaagaucaagugcgacaaggagaagaaccugcugcacgugaccgacaccggcgugggcaugaccagagaggagcuggugaagaaccugggcaccaucgccaagagcggcaccagcgaguuccugaacaagaugaccgaggcccaggaggacggccagagcaccagcgagcugaucggccaguucggcgugggcuucuacagcgccuuccugguggccgacaaggugaucgugaccagcaagcacaacaacgacacccagcacaucugggagagcgacagcaacgaguucagcgugaucgccgaccccagaggcaacacccugggcagaggcaccaccaucacccuggugcugaaggaggaggccagcgacuaccuggagcuggacaccaucaagaaccuggugaagaaguacagccaguucaucaacuuccccaucuacguguggagcagcaagaccgagaccguggaggagcccauggaggaggaggaggccgccaaggaggagaaggaggagagcgacgacgaggccgccguggaggaggaggaggaggagaagaagcccaagaccaagaagguggagaagaccgugugggacugggagcugaugaacgacaucaagcccaucuggcagagacccagcaaggagguggaggaggacgaguacaaggccuucuacaagagcuucagcaaggagagcgacgaccccauggccuacauccacuucaccgccgagggcgaggugaccuucaagagcauccuguucgugcccaccagcgcccccagaggccuguucgacgaguacggcagcaagaagagcgacuacaucaagcuguacgugagaagaguguucaucaccgacgacuuccacgacaugaugcccaaguaccugaacuucgugaagggcgugguggacagcgacgaccugccccugaacgugagcagagagacccugcagcagcacaagcugcugaaggugaucagaaagaagcuggugagaaagacccuggacaugaucaagaagaucgccgacgacaaguacaacgacaccuucuggaaggaguucggcaccaacaucaagcugggcgugaucgaggaccacagcaacagaaccagacuggccaagcugcugagauuccagagcagccaccaccccaccgacaucaccagccuggaccaguacguggagagaaugaaggagaagcaggacaagaucuacuucauggccggcagcagcagaaaggaggccgagagcagccccuucguggagagacugcugaagaagggcuacgaggugaucuaccugaccgagcccguggacgaguacugcauccaggcccugcccgaguucgacggcaagagauuccagaacguggccaaggagggcgugaaguucgacgagagcgagaagaccaaggagagcagagaggccguggagaaggaguucgagccccugcugaacuggaugaaggacaaggcccugaaggacaagaucgagaaggccguggugagccagagacugaccgagagccccugcgcccugguggccagccaguacggcuggagcggcaacauggagagaaucaugaaggcccaggccuaccagaccggcaaggacaucagcaccaacuacuacgccagccagaagaagaccuucgagaucaaccccagacacccccugaucagagacaugcugagaagaaucaaggaggacgaggacgacaagaccgugcuggaccuggccguggugcuguucgagaccgccacccugagaagcggcuaccugcugcccgacaccaaggccuacggcgacagaaucgagagaaugcugagacugagccugaacaucgaccccgacgccaagguggaggaggagcccgaggaggagcccgaggagaccgccgaggacaccaccgaggacaccgagcaggacgaggacgaggagauggacgugggcaccgacgaggaggagaccgccaaggagagcaccgccgagaaggacgagcuguga

SEQ ID NO: 8639 - RNA, 2409 nt, Artificial Sequence
  derived and/or modified sequence opt5 from HSP90B1__Homo_sapiens__CAI64497
augagagcccugugggugcucggccugugcuguguccuucugaccuucgggagcguucgggcugacgaugagguggacguggauggaacagucgaagaggaccucggcaagucccgcgaagggucuagaacggaugacgaggugguucagcgggaagaggaggccauccaacuggauggacuuaacgcgagccagauucgcgaacugagagagaaauccgaaaaguuugcuuuccaggccgaggugaaucggaugaugaaacucaucauuaacucucuguacaagaauaaagagaucuuucugcgcgaacucauuagcaacgccuccgacgcucuggauaagaucagacuuaucucucugaccgacgagaaugcccucagcggcaacgaagaacugacagucaagauuaaaugcgauaaggagaaaaaucuucugcacgugaccgacacagggguuggaaugacccgggaggagcucgugaagaaccugggcacaaucgcuaaauccggcaccagcgaguuccugaauaagaugacggaggcccaggaagaugggcaaucuaccuccgagcucauuggacaguuuggcgucggguucuauagcgcguuucugguggccgacaaggugaucgucacaucuaaacauaacaaugacacccagcacauuugggaauccgauagcaacgaguucucuguuaucgcugacccccgcggaaauacacuuggcagagggaccacgauuacacuggugcucaaggaggaagccuccgauuaccuggagcuugacaccaucaaaaaccuggugaagaaauauagccaguuuaucaauuucccuauuuacgucugguccucuaagacagaaaccguggaggaaccgauggaggaggaagaggcugccaaagaagagaaggaggaaagcgaugacgaggcggccguugaagaggaagaggaggaaaagaaacccaagaccaaaaagguggagaaaacagucugggauugggaacucaugaacgacaucaagccuauuuggcaacggcccuccaaggagguggaagaggaugaguauaaagccuuuuacaagagcuucucuaaagaauccgacgauccuauggcuuauauccauuuuacggcugagggagaaguuaccuucaagagcauucuguucgugcccacaucugccccucgcggccuguuugacgaguacggcagcaaaaaguccgacuacaucaagcucuaugucagacggguguucaucaccgaugacuuucacgauaugaugccgaaauaccugaacuucgucaagggggugguugacucugaugaccuuccccugaaugugagccgcgaaacacuccagcagcauaaacugcuuaaggucauucggaaaaagcuggugagaaagacccucgauaugaucaaaaagauugccgacgauaaauauaacgacacguuuuggaaggaguucggaacaaauaucaaacugggcguuauugaggaucacuccaacagaacccgccuggcuaagcuccugcgguuucagagcucucaccauccuaccgacaucacaucccuugaucaauacguggaaagaaugaaagagaagcaggacaagaucuauuucauggcggggagcucucgcaaagaagccgaguccagccccuuugucgagcggcugcucaagaaaggauacgaagugauuuaucugaccgagccuguggacgaauacuguauccaggcucugcccgaguucgauggcaagagauuucaaaauguugccaaagaaggggucaaguucgacgaguccgagaagacaaaagaaucucgcgaggccguggaaaaggaguuugaaccgcuucucaacuggaugaaagauaaggcucugaaagacaagauugagaaggccguggucagccagcggcugacggaguccccuugcgcgcucguggcuucucaguacggauggagcggcaauauggaaagaaucaugaaagcccaggccuaucaaaccggcaaggauauuuccacaaacuacuaugcuagccagaaaaagaccuucgagaucaauccccgccacccucugauucgggacaugcuuagacgcaucaaagaagaugaggacgauaagacaguucuggaccucgccgugguccuguucgaaaccgcuacgcugcggucuggguaccuucuccccgauaccaaggccuauggagacagaaucgagcggaugcugcgccugucccucaacauugaucccgacgcgaaaguggaggaagaaccugaagaggagccggaagagacagccgaagacaccacagaggauaccgaacaggacgaggaugaggaaauggacguuggcacggaugaggaagagacagcuaaggaaagcaccgccgagaaagacgagcuguga

SEQ ID NO: 8640 - protein, 756 aa, Artificial Sequence
  IKK__Homo_sapiens__O14920
MSWSPSLTTQTCGAWEMKERLGTGGFGNVIRWHNQETGEQIAIKQCRQELSPRNRERWCLEIQIMRRLTHPNVVAARDVPEGMQNLAPNDLPLLAMEYCQGGDLRKYLNQFENCCGLREGAILTLLSDIASALRYLHENRIIHRDLKPENIVLQQGEQRLIHKIIDLGYAKELDQGSLCTSFVGTLQYLAPELLEQQKYTVTVDYWSFGTLAFECITGFRPFLPNWQPVQWHSKVRQKSEVDIVVSEDLNGTVKFSSSLPYPNNLNSVLAERLEKWLQLMLMWHPRQRGTDPTYGPNGCFKALDDILNLKLVHILNMVTGTIHTYPVTEDESLQSLKARIQQDTGIPEEDQELLQEAGLALIPDKPATQCISDGKLNEGHTLDMDLVFLFDNSKITYETQISPRPQPESVSCILQEPKRNLAFFQLRKVWGQVWHSIQTLKEDCNRLQQGQRAAMMNLLRNNSCLSKMKNSMASMSQQLKAKLDFFKTSIQIDLEKYSEQTEFGITSDKLLLAWREMEQAVELCGRENEVKLLVERMMALQTDIVDLQRSPMGRKQGGTLDDLEEQARELYRRLREKPRDQRTEGDSQEMVRLLLQAIQSFEKKVRVIYTQLSKTVVCKQKALELLPKVEEVVSLMNEDEKTVVRLQEKRQKELWNLLKIACSKVRGPVSGSPDSMNASRLSQPGQLMSQPSTASNSLPEPAKKSEELVAEAHNLCTLLENAIQDTVREQDQSFTALDWSWLQTEEEEHSCLEQAS

SEQ ID NO: 8641 - RNA, 2271 nt, Artificial Sequence
  IKK__Homo_sapiens__AAD08997
augagcuggucaccuucccugacaacgcagacauguggggccugggaaaugaaagagcgccuugggacagggggauuuggaaaugucauccgauggcacaaucaggaaacaggugagcagauugccaucaagcagugccggcaggagcucagcccccggaaccgagagcgguggugccuggagauccagaucaugagaaggcugacccaccccaaugugguggcugcccgagaugucccugaggggaugcagaacuuggcgcccaaugaccugccccugcuggccauggaguacugccaaggaggagaucuccggaaguaccugaaccaguuugagaacugcuguggucugcgggaaggugccauccucaccuugcugagugacauugccucugcgcuuagauaccuucaugaaaacagaaucauccaucgggaucuaaagccagaaaacaucguccugcagcaaggagaacagagguuaauacacaaaauuauugaccuaggauaugccaaggagcuggaucagggcagucuuugcacaucauucguggggacccugcaguaccuggccccagagcuacuggagcagcagaaguacacagugaccgucgacuacuggagcuucggcacccuggccuuugagugcaucacgggcuuccggcccuuccuccccaacuggcagcccgugcaguggcauucaaaagugcggcagaagagugagguggacauuguuguuagcgaagacuugaauggaacggugaaguuuucaagcucuuuacccuaccccaauaaucuuaacaguguccuggcugagcgacuggagaaguggcugcaacugaugcugauguggcacccccgacagaggggcacggaucccacguaugggcccaauggcugcuucaaggcccuggaugacaucuuaaacuuaaagcugguucauaucuugaacauggucacgggcaccauccacaccuacccugugacagaggaugagagucugcagagcuugaaggccagaauccaacaggacacgggcaucccagaggaggaccaggagcugcugcaggaagcgggccuggcguugauccccgauaagccugccacucaguguauuucagacggcaaguuaaaugagggccacacauuggacauggaucuuguuuuucucuuugacaacaguaaaaucaccuaugagacucagaucuccccacggccccaaccugaaagugucagcuguauccuucaagagcccaagaggaaucucgccuucuuccagcugaggaagguguggggccaggucuggcacagcauccagacccugaaggaagauugcaaccggcugcagcagggacagcgagccgccaugaugaaucuccuccgaaacaacagcugccucuccaaaaugaagaauuccauggcuuccaugucucagcagcucaaggccaaguuggauuucuucaaaaccagcauccagauugaccuggagaaguacagcgagcaaaccgaguuugggaucacaucagauaaacugcugcuggccuggagggaaauggagcaggcuguggagcucugugggcgggagaacgaagugaaacuccugguagaacggaugauggcucugcagaccgacauuguggacuuacagaggagccccaugggccggaagcaggggggaacgcuggacgaccuagaggagcaagcaagggagcuguacaggagacuaagggaaaaaccucgagaccagcgaacugagggugacagucaggaaaugguacggcugcugcuucaggcaauucagagcuucgagaagaaagugcgagugaucuauacgcagcucaguaaaacugugguuugcaagcagaaggcgcuggaacuguugcccaagguggaagagguggugagcuuaaugaaugaggaugagaagacuguuguccggcugcaggagaagcggcagaaggagcucuggaaucuccugaagauugcuuguagcaagguccgugguccugucaguggaagcccggauagcaugaaugccucucgacuuagccagccugggcagcugaugucucagcccuccacggccuccaacagcuuaccugagccagccaagaagagugaagaacugguggcugaagcacauaaccucugcacccugcuagaaaaugccauacaggacacugugagggaacaagaccagaguuucacggcccuagacuggagcugguuacagacggaagaagaagagcacagcugccuggagcaggccucauga

SEQ ID NO: 8642 - RNA, 2271 nt, Artificial Sequence
  derived and/or modified sequence opt1 from IKK__Homo_sapiens__AAD08997
augagcuggucccccagccugaccacccagacgugcggcgccugggagaugaaggagcgccucgggaccggcggguucggcaacgugauccgguggcacaaccaggagaccggggagcagaucgccaucaagcagugccgccaggagcuguccccgcggaaccgcgagcgguggugccuggagauccagaucaugcgccggcucacccaccccaacgucguggcggcccgcgacgugcccgagggcaugcagaaccuggcccccaacgaccugccgcuccuggccauggaguacugccagggcggggaccugcggaaguaccucaaccaguucgagaacugcugcggccugcgcgagggggccauccugacgcuccugagcgacaucgcguccgcccugcgguaccuccacgagaaccgcaucauccaccgggaccugaagcccgagaacaucguccugcagcagggcgagcagcgccucauccacaagaucaucgaccugggguacgccaaggagcuggaccagggcagccucugcaccuccuucgugggcacccugcaguaccuggcccccgagcuccuggagcagcagaaguacaccgugacggucgacuacuggagcuucgggacccuggcguucgagugcaucaccggcuuccggcccuuccucccgaacuggcagcccgugcaguggcacuccaaggugcgccagaaguccgaggucgacaucguggugagcgaggaccugaacgggaccgucaaguucagcuccagccugcccuaccccaacaaccucaacuccgugcuggccgagcggcuggagaaguggcuccagcugaugcugauguggcacccgcgccagcggggcacggaccccaccuacggccccaacgggugcuucaaggcccucgacgacauccugaaccugaagcucgugcacauccugaacauggucaccggcaccauccacacguaccccgugaccgaggacgagagccugcagucccucaaggcccgcauccagcaggacaccgggaucccggaggaggaccaggagcugcugcaggaggccggccucgcgcugauccccgacaagcccgccacccagugcaucagcgacgggaagcugaacgagggccacacgcucgacauggaccugguguuccuguucgacaacuccaagaucaccuacgagacccagaucagcccccggccgcagcccgagagcgucuccugcauccugcaggagcccaagcgcaaccucgccuucuuccagcugcgcaagguguggggccagguguggcacagcauccagacccugaaggaggacugcaaccggcuccagcaggggcagcgcgccgccaugaugaaccugcugcggaacaacuccugccucagcaagaugaagaacuccauggcgagcaugucccagcagcugaaggccaagcuggacuucuucaagacgagcauccagaucgaccucgagaaguacuccgagcagaccgaguucggcaucaccagcgacaagcugcugcucgccuggcgcgagauggagcaggccgucgagcugugcgggcgggagaacgaggugaagcugcucguggagcgcaugauggcccugcagaccgacaucgucgaccugcagcggucccccaugggccgcaagcagggcgggacgcucgacgaccuggaggagcaggcgcgggagcuguaccgccggcuccgcgagaagccgcgggaccagcgcaccgagggcgacagccaggagauggugcggcugcugcuccaggccauccaguccuucgagaagaagguccgcgugaucuacacccagcugagcaagaccguggucugcaagcagaaggcccuggagcuccugcccaagguggaggagguggucucccugaugaacgaggacgagaagacgguggugcggcuccaggagaagcgccagaaggagcuguggaaccugcucaagaucgccugcagcaagguccgggggcccguguccggcagccccgacuccaugaacgccagccgccugagccagccggggcagcugaugucccagcccagcaccgcguccaacagccuccccgagccggccaagaaguccgaggagcugguggccgaggcccacaaccugugcacccuccuggagaacgcgauccaggacaccguccgcgagcaggaccagagcuucacggcccuggacugguccuggcuccagaccgaggaggaggagcacagcugccuggagcaggccuccuga

SEQ ID NO: 8643 - RNA, 2271 nt, Artificial Sequence
  derived and/or modified sequence opt2 from IKK__Homo_sapiens__AAD08997
auguccuggucccccucccucaccacccagaccugcggcgccugggagaugaaggagcgccucggcaccggcggcuucggcaacgucauccgcuggcacaaccaggagaccggcgagcagaucgccaucaagcagugccgccaggagcucuccccccgcaaccgcgagcgcuggugccucgagauccagaucaugcgccgccucacccaccccaacgucgucgccgcccgcgacguccccgagggcaugcagaaccucgcccccaacgaccucccccuccucgccauggaguacugccagggcggcgaccuccgcaaguaccucaaccaguucgagaacugcugcggccuccgcgagggcgccauccucacccuccucuccgacaucgccuccgcccuccgcuaccuccacgagaaccgcaucauccaccgcgaccucaagcccgagaacaucguccuccagcagggcgagcagcgccucauccacaagaucaucgaccucggcuacgccaaggagcucgaccagggcucccucugcaccuccuucgucggcacccuccaguaccucgcccccgagcuccucgagcagcagaaguacaccgucaccgucgacuacugguccuucggcacccucgccuucgagugcaucaccggcuuccgccccuuccuccccaacuggcagcccguccaguggcacuccaagguccgccagaaguccgaggucgacaucgucgucuccgaggaccucaacggcaccgucaaguucuccuccucccuccccuaccccaacaaccucaacuccguccucgccgagcgccucgagaaguggcuccagcucaugcucauguggcacccccgccagcgcggcaccgaccccaccuacggccccaacggcugcuucaaggcccucgacgacauccucaaccucaagcucguccacauccucaacauggucaccggcaccauccacaccuaccccgucaccgaggacgagucccuccagucccucaaggcccgcauccagcaggacaccggcauccccgaggaggaccaggagcuccuccaggaggccggccucgcccucauccccgacaagcccgccacccagugcaucuccgacggcaagcucaacgagggccacacccucgacauggaccucgucuuccucuucgacaacuccaagaucaccuacgagacccagaucuccccccgcccccagcccgaguccgucuccugcauccuccaggagcccaagcgcaaccucgccuucuuccagcuccgcaaggucuggggccaggucuggcacuccauccagacccucaaggaggacugcaaccgccuccagcagggccagcgcgccgccaugaugaaccuccuccgcaacaacuccugccucuccaagaugaagaacuccauggccuccaugucccagcagcucaaggccaagcucgacuucuucaagaccuccauccagaucgaccucgagaaguacuccgagcagaccgaguucggcaucaccuccgacaagcuccuccucgccuggcgcgagauggagcaggccgucgagcucugcggccgcgagaacgaggucaagcuccucgucgagcgcaugauggcccuccagaccgacaucgucgaccuccagcgcucccccaugggccgcaagcagggcggcacccucgacgaccucgaggagcaggcccgcgagcucuaccgccgccuccgcgagaagccccgcgaccagcgcaccgagggcgacucccaggagaugguccgccuccuccuccaggccauccaguccuucgagaagaagguccgcgucaucuacacccagcucuccaagaccgucgucugcaagcagaaggcccucgagcuccuccccaaggucgaggaggucgucucccucaugaacgaggacgagaagaccgucguccgccuccaggagaagcgccagaaggagcucuggaaccuccucaagaucgccugcuccaagguccgcggccccgucuccggcucccccgacuccaugaacgccucccgccucucccagcccggccagcucaugucccagcccuccaccgccuccaacucccuccccgagcccgccaagaaguccgaggagcucgucgccgaggcccacaaccucugcacccuccucgagaacgccauccaggacaccguccgcgagcaggaccaguccuucaccgcccucgacugguccuggcuccagaccgaggaggaggagcacuccugccucgagcaggccuccuga

SEQ ID NO: 8644 - RNA, 2271 nt, Artificial Sequence
  derived and/or modified sequence opt3 from IKK__Homo_sapiens__AAD08997
augagcuggucccccucucugaccacacagacuugcggcgccugggagaugaaggaaagacucgggacgggagguuucggcaacgugaucagguggcacaaucaagagaccggggaacagauugcuauaaaacagugucggcaggagcuuucaccucgcaaccgagaacguuggugccuggagauccaaauuaugagaagguugacacauccaaaugucguugcagcccgggacgugccggagggaaugcagaacuuagcgcccaaugaucugccucuacucgcuauggaauacugucagggcggugaccugcgcaaguaucuuaaccaguuugagaauugcugugggcugagagaaggagccaucuugacucuccugagugauauugcaagcgcccugagguaccuccacgagaaccggaucauacaucgcgacuuaaaaccagagaauaucguacugcaacagggcgaacagcgacuuauucacaagaucauugauuugggcuaugcuaaagagcuggaccaggggucccuaugcaccucuuucgugggaacacuccaauaccuggcacccgaacuucuggagcagcagaaguauaccgucacuguggauuacuggucguuugguacauuggccuucgaauguaucaccggcuuuagaccuuuccucccaaacuggcaacccguucaguggcauucaaaggugaggcagaaaagcgaggucgacauagugguaagugaggaucugaaugggacgguuaaguuuuccucuagcuuaccuuauccaaacaaucugaacuccgugcucgcugaacggcuugagaaauggcugcaguugaugcuaauguggcacccgcgucaacgcggaacugaccccaccuacggcccuaaugguugcuucaaggcccuggaugacauucucaaccugaaacuuguccacauccugaacauggugacagggacuauucauaccuacccagugacagaagaugagucauugcagagucucaaggcgagaauccagcaggacaccggaauccccgaagaggaccaagagcuguuacaggaagcaggccuggcccuaauuccugauaagccagcuacgcaguguauaagcgacggcaaacucaaugaggggcacacucuggauauggaccuugucuuuuuguucgauaacucuaagaucacauaugaaacccagauuucccccaggccgcaaccugagucaguuagcugcauccugcaggaacccaaacggaaucucgccuuuuuccagcugcgaaagguguggggacagguauggcauaguauacaaacucuuaaagaggacuguaaccgccugcagcagggucaaagagcagcuaugaugaauuugcucaggaacaauucuugccuguccaagaugaaaaacagcauggccucgaugucucagcaguuaaaggcgaagcuggacuuuuucaaaacauccauucagaucgaucuagagaaguacucagaacaaaccgaguucggcaucacgagugauaaacuccugcuugccuggcgggaaauggagcaggcaguggaguugugcgggcgcgaaaaugaggucaagcugcucguggaaagaaugauggcucugcagaccgacauuguugauuuacagaggagcccaaugggacguaaacaaggcgguacacuggacgaccuugaggaacaggcccgggaguuguaucgaagacucagggagaagccucgcgaucagcggacugaaggggacucccaggagauggugagacugcuacugcaagcuauccagucuuuugaaaagaaagucagggugauuuacacccagcucagcaagacaguaguuuguaaacaaaaggcccuggagcuuuugcccaaaguggaagaggucgugucacugaugaacgaggaugaaaagacugucgugcgcuuacaggagaagcgacagaaagaacucuggaaucugcuuaagauagcaugcaguaaaguucggggcccaguguccggaagccccgacucuaugaacgccucacgucugagucagccuggccaauugaugagccagccauccaccgcuucuaauucgcucccggagcccgcgaagaaaagcgaggaacugguagcagaggcccacaaccuauguacacugcucgaaaaugcuauccaggauaccgucagagagcaggaccaauccuucacugcccuggauuggucauggcuucagacggaagaggaggaacacaguugcuuggagcaggcaucuuga

SEQ ID NO: 8645 - RNA, 2271 nt, Artificial Sequence
  derived and/or modified sequence opt4 from IKK__Homo_sapiens__AAD08997
augagcuggagccccagccugaccacccagaccugcggcgccugggagaugaaggagagacugggcaccggcggcuucggcaacgugaucagauggcacaaccaggagaccggcgagcagaucgccaucaagcagugcagacaggagcugagccccagaaacagagagagauggugccuggagauccagaucaugagaagacugacccaccccaacgugguggccgccagagacgugcccgagggcaugcagaaccuggcccccaacgaccugccccugcuggccauggaguacugccagggcggcgaccugagaaaguaccugaaccaguucgagaacugcugcggccugagagagggcgccauccugacccugcugagcgacaucgccagcgcccugagauaccugcacgagaacagaaucauccacagagaccugaagcccgagaacaucgugcugcagcagggcgagcagagacugauccacaagaucaucgaccugggcuacgccaaggagcuggaccagggcagccugugcaccagcuucgugggcacccugcaguaccuggcccccgagcugcuggagcagcagaaguacaccgugaccguggacuacuggagcuucggcacccuggccuucgagugcaucaccggcuucagacccuuccugcccaacuggcagcccgugcaguggcacagcaaggugagacagaagagcgagguggacaucguggugagcgaggaccugaacggcaccgugaaguucagcagcagccugcccuaccccaacaaccugaacagcgugcuggccgagagacuggagaaguggcugcagcugaugcugauguggcaccccagacagagaggcaccgaccccaccuacggccccaacggcugcuucaaggcccuggacgacauccugaaccugaagcuggugcacauccugaacauggugaccggcaccauccacaccuaccccgugaccgaggacgagagccugcagagccugaaggccagaauccagcaggacaccggcauccccgaggaggaccaggagcugcugcaggaggccggccuggcccugauccccgacaagcccgccacccagugcaucagcgacggcaagcugaacgagggccacacccuggacauggaccugguguuccuguucgacaacagcaagaucaccuacgagacccagaucagccccagaccccagcccgagagcgugagcugcauccugcaggagcccaagagaaaccuggccuucuuccagcugagaaagguguggggccagguguggcacagcauccagacccugaaggaggacugcaacagacugcagcagggccagagagccgccaugaugaaccugcugagaaacaacagcugccugagcaagaugaagaacagcauggccagcaugagccagcagcugaaggccaagcuggacuucuucaagaccagcauccagaucgaccuggagaaguacagcgagcagaccgaguucggcaucaccagcgacaagcugcugcuggccuggagagagauggagcaggccguggagcugugcggcagagagaacgaggugaagcugcugguggagagaaugauggcccugcagaccgacaucguggaccugcagagaagccccaugggcagaaagcagggcggcacccuggacgaccuggaggagcaggccagagagcuguacagaagacugagagagaagcccagagaccagagaaccgagggcgacagccaggagauggugagacugcugcugcaggccauccagagcuucgagaagaaggugagagugaucuacacccagcugagcaagaccguggugugcaagcagaaggcccuggagcugcugcccaagguggaggagguggugagccugaugaacgaggacgagaagaccguggugagacugcaggagaagagacagaaggagcuguggaaccugcugaagaucgccugcagcaaggugagaggccccgugagcggcagccccgacagcaugaacgccagcagacugagccagcccggccagcugaugagccagcccagcaccgccagcaacagccugcccgagcccgccaagaagagcgaggagcugguggccgaggcccacaaccugugcacccugcuggagaacgccauccaggacaccgugagagagcaggaccagagcuucaccgcccuggacuggagcuggcugcagaccgaggaggaggagcacagcugccuggagcaggccagcuga

SEQ ID NO: 8646 - RNA, 2271 nt, Artificial Sequence
  derived and/or modified sequence opt5 from IKK__Homo_sapiens__AAD08997
augagcuggucccccucucugaccacacagacgugcggcgccugggagaugaaggaaagacucgggaccggaggcuucgggaacgugauccgguggcacaaucaagagacaggagaacagauugcuaucaaacagugucgccaggagcugagcccuagaaaccgggaacgcuggugccuugagauucaaaucaugagacggcugacccauccgaaugucguugccgcgcgcgacgugcccgagggcaugcagaaccucgcuccuaaugaucugccccuucuggccauggaauacugucagggaggagaccucagaaaguaucugaaccaguuugagaauugcuguggccugcgggaaggcgccauucucacacugcuuuccgauaucgcuucugcccugcgcuaccuccacgagaacagaaucauucaucgggaccugaaaccugagaauaucgugcuucaacagggggaacagcgccugauucacaagaucauugaucucggauaugcuaaagagcuggaccagggcagccugugcaccuccuucgucgggacacuccaauaccuggcccccgaacuucuggagcagcagaaguauaccgugacgguugauuacuggucuuuuggaacccucgcguucgaauguaucacaggcuuuagaccuuuccugccgaacuggcaacccgugcaguggcauagcaagguccggcagaaauccgagguggacauuguugugagcgaggaucuuaaugggaccgucaaguuuucuuccagccugccuuaucccaacaaucucaacucugugcuggccgaacgccuggagaaauggcuccagcugaugcuuauguggcacccuagacaacggggaacagaccccaccuacggcccgaauggcugcuucaaggcucuggaugacauccucaaccugaaacuugugcacauccugaacauggucacggggacaauucauaccuacccuguuacagaagaugagucccuccagagccugaaggccagaauccagcaggacaccgggauucccgaagaggaccaagagcugcuccaggaagcuggccuggcccuuaucccugauaagcccgcgacccaguguauuucugacgggaaacugaaugagggacacacacucgauauggaccugguguuucuguucgauaacuccaagaucacguaugaaacccagaucagcccccgcccucaaccggaguccgugucuugcauucuucaggaacccaaacggaaucucgccuuuuuccagcugagaaaggucuggggccagguguggcauagcauccaaacacugaaagaggacuguaaccgccuccagcaggggcaacgggcugccaugaugaaucugcuuagaaacaauuccugccugagcaagaugaaaaacucuauggcuuccaugagccagcagcucaaggccaagcuggacuuuuucaaaaccucuauucagaucgaucuggagaaguacagcgaacaaacagaguucggaauuaccuccgauaaacuucuccuggccuggcgcgaaauggagcaggcuguugagcugugcggccgggaaaaugaggugaagcuccuggucgaaagaaugauggcgcuucagacggacaucguggaucugcagcgcucuccuaugggccggaaacaagggggaacacucgacgaccuggaggaacaggccagagagcuguaucgccggcuuagagagaagccccgggaucagcgcaccgaaggcgacagccaggagaugguuagacuccugcugcaagcuauccaguccuuugaaaagaaagugcgggucauuuacacccagcucagcaagacaguggucuguaaacaaaaggcccuggagcuucugccuaaaguggaagagguugugucucucaugaacgaggaugaaaagaccgucgugagacugcaggagaagcgccagaaagaacuguggaaucuucucaagaucgccugcuccaaaguucgggggcccgugagcggaucuccggacuccaugaacgcuagcagacugucccagccuggccaacugaugucucagcccagcacagccuccaauucucucccugagcccgcgaagaaaagcgaggaacuggucgcugaggcccacaaccuuuguacgcugcucgaaaaugccauucaggauaccgugcgcgagcaggaccaauccuucacagcucuggauuggagcuggcugcagaccgaagaggaggaacacucuugccuugagcaggccuccuga

SEQ ID NO: 8647 - protein, 716 aa, Artificial Sequence
  IKK__Homo_sapiens__Q14164
MQSTANYLWHTDDLLGQGATASVYKARNKKSGELVAVKVFNTTSYLRPREVQVREFEVLRKLNHQNIVKLFAVEETGGSRQKVLVMEYCSSGSLLSVLESPENAFGLPEDEFLVVLRCVVAGMNHLRENGIVHRDIKPGNIMRLVGEEGQSIYKLTDFGAARELDDDEKFVSVYGTEEYLHPDMYERAVLRKPQQKAFGVTVDLWSIGVTLYHAATGSLPFIPFGGPRRNKEIMYRITTEKPAGAIAGAQRRENGPLEWSYTLPITCQLSLGLQSQLVPILANILEVEQAKCWGFDQFFAETSDILQRVVVHVFSLSQAVLHHIYIHAHNTIAIFQEAVHKQTSVAPRHQEYLFEGHLCVLEPSVSAQHIAHTTASSPLTLFSTAIPKGLAFRDPALDVPKFVPKVDLQADYNTAKGVLGAGYQALRLARALLDGQELMFRGLHWVMEVLQATCRRTLEVARTSLLYLSSSLGTERFSSVAGTPEIQELKAAAELRSRLRTLAEVLSRCSQNITETQESLSSLNRELVKSRDQVHEDRSIQQIQCCLDKMNFIYKQFKKSRMRPGLGYNEEQIHKLDKVNFSHLAKRLLQVFQEECVQKYQASLVTHGKRMRVVHETRNHLRLVGCSVAACNTEAQGVQESLSKLLEELSHQLLQDRAKGAQASPPPIAPYPSPTRKDLLLHMQELCEGMKLLASDLLDNNRIIERLNRVPAPPDV

SEQ ID NO: 8648 - RNA, 2151 nt, Artificial Sequence
  IKK__Homo_sapiens__AAF45307
augcagagcacagccaauuaccuguggcacacagaugaccugcuggggcagggggccacugccaguguguacaaggcccgcaacaagaaauccggagagcugguugcugugaaggucuucaacacuaccagcuaccugcggccccgcgaggugcaggugagggaguuugagguccugcggaagcugaaccaccagaacaucgucaagcucuuugcgguggaggagacgggcggaagccggcagaagguacuggugauggaguacugcuccagugggagccugcugagugugcuggagagcccugagaaugccuuugggcugccugaggaugaguuccugguggugcugcgcugugugguggccggcaugaaccaccugcgggagaacggcauugugcaucgcgacaucaagccggggaacaucaugcgccucguaggggaggaggggcagagcaucuacaagcugacagacuucggcgcugcccgggagcuggaugaugaugagaaguucgucucggucuaugggacugaggaguaccugcaucccgacauguaugagcgggcggugcuucgaaagccccagcaaaaagcguucggggugacuguggaucucuggagcauuggagugaccuuguaccaugcagccacuggcagccugcccuucauccccuuuggugggccacggcggaacaaggagaucauguaccggaucaccacggagaagccggcuggggccauugcaggugcccagaggcgggagaacgggccccuggaguggagcuacacccuccccaucaccugccagcugucacuggggcugcagagccagcuggugcccauccuggccaacauccuggagguggagcaggccaagugcuggggcuucgaccaguucuuugcggagaccagugacauccugcagcgaguugucguccaugucuucucccugucccaggcaguccugcaccacaucuauauccaugcccacaacacgauagccauuuuccaggaggccgugcacaagcagaccaguguggccccccgacaccaggaguaccucuuugagggucaccucuguguccucgagcccagcgucucagcacagcacaucgcccacacgacggcaagcagcccccugacccucuucagcacagccaucccuaaggggcuggccuucagggacccugcucuggacguccccaaguucguccccaaaguggaccugcaggcggauuacaacacugccaagggcguguugggcgccggcuaccaggcccugcggcuggcacgggcccugcuggaugggcaggagcuaauguuucgggggcugcacugggucauggaggugcuccaggccacaugcagacggacucuggaaguggcaaggacaucccuccucuaccucagcagcagccugggaacugagagguucagcagcguggcuggaacgccugagauccaggaacugaaggcggcugcagaacugagguccaggcugcggacucuagcggagguccucuccagaugcucccaaaauaucacggagacccaggagagccugagcagccugaaccgggagcuggugaagagccgggaucagguacaugaggacagaagcauccagcagauucagugcuguuuggacaagaugaacuucaucuacaaacaguucaagaagucuaggaugaggccagggcuuggcuacaacgaggagcagauucacaagcuggauaaggugaauuucagucauuuagccaaaagacuccugcagguguuccaggaggagugcgugcagaaguaucaagcguccuuagucacacacggcaagaggaugaggguggugcacgagaccaggaaccaccugcgccugguuggcuguucuguggcugccuguaacacagaagcccaggggguccaggagagucucagcaagcuccuggaagagcuaucucaccagcuccuucaggaccgagcaaagggggcucaggccucgccgccucccauagcuccuuaccccagcccuacacgaaaggaccugcuucuccacaugcaagagcucugcgaggggaugaagcugcuggcaucugaccuccuggacaacaaccgcaucaucgaacggcuaaauagagucccagcaccuccugaugucuga

SEQ ID NO: 8649 - RNA, 2151 nt, Artificial Sequence
  derived and/or modified sequence opt1 from IKK__Homo_sapiens__AAF45307
augcagagcaccgccaacuaccuguggcacaccgacgaccuccugggccagggggccacggcguccguguacaaggcccgcaacaagaaguccggcgagcuggucgccgugaagguguucaacaccaccuccuaccuccggccccgcgagguccaggugcgggaguucgaggugcugcgcaagcugaaccaccagaacaucgucaagcuguucgccguggaggagaccgggggcagccggcagaaggugcuggucauggaguacugcuccagcgggucccugcucagcgugcuggagucccccgagaacgccuucggccugcccgaggacgaguuccucgugguccugcgcugcgugguggcgggcaugaaccaccuccgggagaacgggaucguccaccgcgacaucaagcccggcaacaucaugcggcucgugggggaggagggccagagcaucuacaagcugacggacuucggggccgcccgcgagcuggacgacgacgagaaguucguguccgucuacggcaccgaggaguaccuccaccccgacauguacgagcgggccgugcugcgcaagccgcagcagaaggcguucggcgugaccgucgaccuguggagcaucggggugacccucuaccacgccgccacgggcucccugcccuucauccccuucgggggcccccggcgcaacaaggagaucauguaccggaucaccaccgagaagccggccggcgccaucgcgggggcccagcgccgggagaacggcccccuggaguggagcuacacccuccccaucacgugccagcugucccuggggcuccagagccagcuggugcccauccuggccaacauccucgaggucgagcaggccaagugcuggggcuucgaccaguucuucgccgagaccuccgacauccugcagcgcguggucgugcacguguucagccugucccaggcgguccuccaccacaucuacauccacgcccacaacaccaucgccaucuuccaggaggccgugcacaagcagaccagcguggccccgcggcaccaggaguaccuguucgaggggcaccugugcguccucgagcccagcguguccgcgcagcacaucgcccacacgaccgccagcagcccccugacccuguucagcaccgccauccccaagggccucgccuuccgcgacccggcgcuggacgugcccaaguucguccccaagguggaccugcaggccgacuacaacacggccaagggcgugcucggggccggcuaccaggcgcugcggcuggcccgcgcccuccuggacgggcaggagcugauguuccgcggccuccacugggucauggaggugcugcaggcgaccugccggcgcacccuggagguggcccggaccucccugcucuaccugagcuccagccuggggacggagcgcuucuccagcgucgccggcacccccgagauccaggagcucaaggccgccgccgagcugcggucccgccugcggacccucgccgaggugcugagccgcugcucccagaacaucaccgagacgcaggagagccuguccagccucaaccgggagcuggugaagucccgcgaccagguccacgaggaccggagcauccagcagauccagugcugccuggacaagaugaacuucaucuacaagcaguucaagaagucccgcaugcggccgggccucggguacaacgaggagcagauccacaagcuggacaaggugaacuucagccaccuggcgaagcgccuccugcaggucuuccaggaggagugcgugcagaaguaccaggccagccuggugacccacggcaagcggaugcgcgugguccacgagacccggaaccaccuccgccugguggggugcuccguggccgccugcaacaccgaggcccagggcguccaggagagccuguccaagcuccuggaggagcugagccaccagcuccugcaggaccgggcgaagggggcccaggccagcccgccgcccaucgcccccuaccccucccccacgcgcaaggaccugcuccugcacaugcaggagcugugcgagggcaugaagcuccuggcguccgaccugcucgacaacaaccgcaucaucgagcggcugaaccgcgugcccgccccgcccgacguguga

SEQ ID NO: 8650 - RNA, 2151 nt, Artificial Sequence
  derived and/or modified sequence opt2 from IKK__Homo_sapiens__AAF45307
augcaguccaccgccaacuaccucuggcacaccgacgaccuccucggccagggcgccaccgccuccgucuacaaggcccgcaacaagaaguccggcgagcucgucgccgucaaggucuucaacaccaccuccuaccuccgcccccgcgagguccagguccgcgaguucgagguccuccgcaagcucaaccaccagaacaucgucaagcucuucgccgucgaggagaccggcggcucccgccagaagguccucgucauggaguacugcuccuccggcucccuccucuccguccucgagucccccgagaacgccuucggccuccccgaggacgaguuccucgucguccuccgcugcgucgucgccggcaugaaccaccuccgcgagaacggcaucguccaccgcgacaucaagcccggcaacaucaugcgccucgucggcgaggagggccaguccaucuacaagcucaccgacuucggcgccgcccgcgagcucgacgacgacgagaaguucgucuccgucuacggcaccgaggaguaccuccaccccgacauguacgagcgcgccguccuccgcaagccccagcagaaggccuucggcgucaccgucgaccucugguccaucggcgucacccucuaccacgccgccaccggcucccuccccuucauccccuucggcggcccccgccgcaacaaggagaucauguaccgcaucaccaccgagaagcccgccggcgccaucgccggcgcccagcgccgcgagaacggcccccucgagugguccuacacccuccccaucaccugccagcucucccucggccuccagucccagcucguccccauccucgccaacauccucgaggucgagcaggccaagugcuggggcuucgaccaguucuucgccgagaccuccgacauccuccagcgcgucgucguccacgucuucucccucucccaggccguccuccaccacaucuacauccacgcccacaacaccaucgccaucuuccaggaggccguccacaagcagaccuccgucgccccccgccaccaggaguaccucuucgagggccaccucugcguccucgagcccuccgucuccgcccagcacaucgcccacaccaccgccuccuccccccucacccucuucuccaccgccauccccaagggccucgccuuccgcgaccccgcccucgacguccccaaguucguccccaaggucgaccuccaggccgacuacaacaccgccaagggcguccucggcgccggcuaccaggcccuccgccucgcccgcgcccuccucgacggccaggagcucauguuccgcggccuccacugggucauggagguccuccaggccaccugccgccgcacccucgaggucgcccgcaccucccuccucuaccucuccuccucccucggcaccgagcgcuucuccuccgucgccggcacccccgagauccaggagcucaaggccgccgccgagcuccgcucccgccuccgcacccucgccgagguccucucccgcugcucccagaacaucaccgagacccaggagucccucuccucccucaaccgcgagcucgucaagucccgcgaccagguccacgaggaccgcuccauccagcagauccagugcugccucgacaagaugaacuucaucuacaagcaguucaagaagucccgcaugcgccccggccucggcuacaacgaggagcagauccacaagcucgacaaggucaacuucucccaccucgccaagcgccuccuccaggucuuccaggaggagugcguccagaaguaccaggccucccucgucacccacggcaagcgcaugcgcgucguccacgagacccgcaaccaccuccgccucgucggcugcuccgucgccgccugcaacaccgaggcccagggcguccaggagucccucuccaagcuccucgaggagcucucccaccagcuccuccaggaccgcgccaagggcgcccaggccucccccccccccaucgcccccuaccccucccccacccgcaaggaccuccuccuccacaugcaggagcucugcgagggcaugaagcuccucgccuccgaccuccucgacaacaaccgcaucaucgagcgccucaaccgcguccccgccccccccgacgucuga

SEQ ID NO: 8651 - RNA, 2151 nt, Artificial Sequence
  derived and/or modified sequence opt3 from IKK__Homo_sapiens__AAF45307
augcagagcaccgccaacuaccuguggcacacagacgaucuccuuggccaaggggcuacugcauccguguauaaggccagaaauaaaaagucuggagagcuggucgcgguuaaaguguucaacacgaccucauacuugaggccccgggaaguacaggugcgcgaguuugaagucuuacgaaagcugaaucaucagaacaucgugaaacuauucgcuguugaggaaacagguggcagucgucagaaggugcucgucauggaguauugcagcuccgggucucugcuuucggugcuggagucaccugaaaaugccuuuggauugccagaggacgaguuccucguaguucugagauguguggucgcaggcaugaaccaccugagggaaaaugguauugugcaucgggauauaaagccggggaacaucaugcgccucgugggagaggaaggccaaagcauuuacaaauuaacugacuuuggcgccgcuagagagcuggaugacgaugaaaaguucgucaguguuuaugggaccgaggaauaccuucaccccgacauguaugagagggcaguguugcggaaaccucagcagaaggccuuuggaguaacaguggaucugugguccaucggugucacccuauaccaugcugccacuggcucucucccauucauucccuuugggggaccucgccgaaauaaagagaucauguacagaauaacaaccgaaaagccagcgggcgcaaucgccggugcucagaggcgggagaacgggccccuggaauggagcuauacgcuuccuauuacuugccaacuguccuugggacuccagucacagcuggugccaaucuuagccaauauucuggagguugaacaggcaaaguguuggggcuucgaccaauuuuucgcugagaccagugauauccuccagcguguggucgugcacguauuuagccuuucucaggccguucugcaccauauauacauucacgcgcauaacacaaucgccauuuuccaagaggcagugcacaaacagacuuccgucgcuccgcgccaccaggaauauuuguucgagggccaucuaugcgugcuggaacccucagucagcgcccagcacaucgcucauaccacagccaguucuccucucacccuguuuuccacggcaaucccaaaggggcuugccuucagagaccccgcucuggaugugccuaaauuuguuccaaagguggacuugcaagcggacuacaauacugcaaaaggaguacucggugccggcuaucaggcucugagguuagcccgggcacugcuagaugggcaggagcucauguuccgaggacugcacugggucauggaagugcuucaggccacaugucgcagaaccuuggagguugcuaggacuagccugcucuaccugucgucuucccuuggcacagagcgguuuucaaguguggccgguacccccgaaauucaagagcugaaggcagcggcugaauugcgcagcagacucaggacgcuggccgaggucuuaucccguugcucucagaacauaaccgagacacaggaaagccugucaagucuaaaucgggagcucgugaaaucccgagaccagguacaugaagauagaagcauccaacagauucaguguugccuggacaagaugaacuucaucuauaagcaguuuaaaaagucuaggaugcgcccggggcuuggcuacaacgaggaacaaauacacaaauuggauaaggugaauuucucacaccuggcaaaacggcuccugcagguuuuucaggaggaguguguccaaaaguaccaggccaguuuagugacucauggaaagagaaugagggugguccacgaaacccgcaaccaucugcgacuuguuggcugcagcguggcugccuguaauacagaggcacagggggugcaggaauccuugucuaaacuccuggaggaacuaucgcaccaacugcuccaggaccgggcuaagggagcccaggcgagcccucccccaauugccccuuaucccuccccaacucguaaagaucugcuuuugcacaugcaggagcugugcgaggguaugaaguuacucgcuucagaccugcuugauaacaauagaaucaucgaaaggcugaaccgcguacccgcaccuccagacgucuga

SEQ ID NO: 8652 - RNA, 2151 nt, Artificial Sequence
  derived and/or modified sequence opt4 from IKK__Homo_sapiens__AAF45307
augcagagcaccgccaacuaccuguggcacaccgacgaccugcugggccagggcgccaccgccagcguguacaaggccagaaacaagaagagcggcgagcugguggccgugaagguguucaacaccaccagcuaccugagacccagagaggugcaggugagagaguucgaggugcugagaaagcugaaccaccagaacaucgugaagcuguucgccguggaggagaccggcggcagcagacagaaggugcuggugauggaguacugcagcagcggcagccugcugagcgugcuggagagccccgagaacgccuucggccugcccgaggacgaguuccugguggugcugagaugcgugguggccggcaugaaccaccugagagagaacggcaucgugcacagagacaucaagcccggcaacaucaugagacuggugggcgaggagggccagagcaucuacaagcugaccgacuucggcgccgccagagagcuggacgacgacgagaaguucgugagcguguacggcaccgaggaguaccugcaccccgacauguacgagagagccgugcugagaaagccccagcagaaggccuucggcgugaccguggaccuguggagcaucggcgugacccuguaccacgccgccaccggcagccugcccuucauccccuucggcggccccagaagaaacaaggagaucauguacagaaucaccaccgagaagcccgccggcgccaucgccggcgcccagagaagagagaacggcccccuggaguggagcuacacccugcccaucaccugccagcugagccugggccugcagagccagcuggugcccauccuggccaacauccuggagguggagcaggccaagugcuggggcuucgaccaguucuucgccgagaccagcgacauccugcagagagugguggugcacguguucagccugagccaggccgugcugcaccacaucuacauccacgcccacaacaccaucgccaucuuccaggaggccgugcacaagcagaccagcguggcccccagacaccaggaguaccuguucgagggccaccugugcgugcuggagcccagcgugagcgcccagcacaucgcccacaccaccgccagcagcccccugacccuguucagcaccgccauccccaagggccuggccuucagagaccccgcccuggacgugcccaaguucgugcccaagguggaccugcaggccgacuacaacaccgccaagggcgugcugggcgccggcuaccaggcccugagacuggccagagcccugcuggacggccaggagcugauguucagaggccugcacugggugauggaggugcugcaggccaccugcagaagaacccuggagguggccagaaccagccugcuguaccugagcagcagccugggcaccgagagauucagcagcguggccggcacccccgagauccaggagcugaaggccgccgccgagcugagaagcagacugagaacccuggccgaggugcugagcagaugcagccagaacaucaccgagacccaggagagccugagcagccugaacagagagcuggugaagagcagagaccaggugcacgaggacagaagcauccagcagauccagugcugccuggacaagaugaacuucaucuacaagcaguucaagaagagcagaaugagacccggccugggcuacaacgaggagcagauccacaagcuggacaaggugaacuucagccaccuggccaagagacugcugcagguguuccaggaggagugcgugcagaaguaccaggccagccuggugacccacggcaagagaaugagaguggugcacgagaccagaaaccaccugagacuggugggcugcagcguggccgccugcaacaccgaggcccagggcgugcaggagagccugagcaagcugcuggaggagcugagccaccagcugcugcaggacagagccaagggcgcccaggccagccccccccccaucgcccccuaccccagccccaccagaaaggaccugcugcugcacaugcaggagcugugcgagggcaugaagcugcuggccagcgaccugcuggacaacaacagaaucaucgagagacugaacagagugcccgccccccccgacguguga

SEQ ID NO: 8653 - RNA, 2151 nt, Artificial Sequence
  derived and/or modified sequence opt5 from IKK__Homo_sapiens__AAF45307
augcagagcaccgccaacuaccuguggcacacagacgaucuccugggccaaggggcuacggccuccguguauaaggcgagaaauaaaaagucuggagagcuugucgcuguuaaaguguucaacaccacaagcuaccugcggccccgcgaagugcaggucagagaguuugaagugcuccggaagcugaaucaucagaacaucguuaaacuuuucgccguggaggaaaccggcgggucccgccagaagguccuggugauggaguauugcucuagcggaucccuccugucuguucuggagagcccugaaaaugccuuuggccucccggaggacgaguuccuggugguccuuagaugugugguggcugggaugaaccaucugcgggaaaauggaauuguccaccgcgauaucaagcccggcaacauuaugagacucguuggcgaggaagggcaauccaucuacaaacugacagacuuuggagccgcucgggagcuugaugacgaugaaaaguucgugagcguguauggcaccgaggaauaccugcacccugacauguaugagcgcgccguccucagaaaaccccagcagaaggcguuuggggugacaguugaucuguggucuauuggagugacccuguaccaugccgcuacgggcucccucccuuucauccccuuugggggaccucggcgcaauaaagagaucauguacagaauuaccacagaaaagccggccggcgcuaucgccggcgcgcagcggcgcgagaacgggccccuggaauggagcuauacccuuccuauuacaugccaacugucucucggacugcagucccagcuuguccccauccuggccaauauucucgagguggaacaggcuaaguguuggggcuucgaccaauuuuucgccgagaccagcgauauccugcagagaguugugguccacguguuuucucugucccaggcuguccuccaccauauuuacauccacgcccauaacacgaucgccauuuuccaagaggcugugcacaaacagacaagcguugcgccucggcaccaggaauaucuguucgaggggcaucuuugcgugcuggaacccuccgucucugcccagcacaucgcucauaccacagccagcuccccgcucacccuguuuagcaccgccauuccuaagggacuugcuuucagagaccccgcccuggaugugccuaaauuuguucccaagguggaccuccaagcggacuacaauacagcuaaaggcguccugggggccggauaucaggcccugcgccucgcucgggcccugcuugauggccaggagcugauguucagaggccuccacugggugauggaagugcugcaggcuacgugucgccggacccuggagguugccagaacaucucuucucuaccuguccagcucucuggggaccgagcgcuuuagcuccgucgcgggaacacccgaaauccaagagcucaaggccgcugccgaacugcggucuagacuucgcacccuggcugaggugcucagccggugcucccagaacauuacggagacacaggaaagccugucuucccugaauagagagcuugugaaaagccgcgaccagguccaugaagaucggucuauccaacagauccaguguugccucgacaagaugaacuucauuuauaagcaguuuaaaaaguccagaaugcggccuggccugggguacaacgaggaacaaauccacaaacuggauaaggugaauuucagccaccucgccaaacgccugcuucagguuuuucaggaggagugugugcaaaaguaccaggcgucccuggucacccauggaaagagaaugcgggugguucacgaaaccagaaaccaucuccgccuggugggcugcucugucgccgcuuguaauacagaggcccagggggugcaggaaagccuguccaaacuucucgaggaacugucucaccaacugcuccaggaccgggcuaagggcgcccaggccagcccgcccccuauugcucccuauccuucccccaccagaaaagaucugcuucugcacaugcaggagcucugcgagggaaugaagcugcuggcgagcgaccuucucgauaacaaucgcaucauugaaagacugaaccggguuccggccccucccgacguguga

SEQ ID NO: 8654 - protein, 419 aa, Artificial Sequence
  IKK__Homo_sapiens__Q9Y6K9
MNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAKQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 8655 - RNA, 1260 nt, Artificial Sequence
  IKK__Homo_sapiens__AAC36330
augaauaggcaccucuggaagagccaacugugugagauggugcagcccagugguggcccggcagcagaucaggacguacugggcgaagagucuccucuggggaagccagccaugcugcaccugccuucagaacagggcgcuccugagacccuccagcgcugccuggaggagaaucaagagcuccgagaugccauccggcagagcaaccagauucugcgggagcgcugcgaggagcuucugcauuuccaagccagccagagggaggagaaggaguuccucaugugcaaguuccaggaggccaggaaacugguggagagacucggccuggagaagcucgaucugaagaggcagaaggagcaggcucugcgggagguggagcaccugaagagaugccagcagcagauggcugaggacaaggccucugugaaagcccaggugacguccuugcucggggagcugcaggagagccagagucgcuuggaggcugccacuaaggaaugccaggcucuggagggucgggcccgggcggccagcgagcaggcgcggcagcuggagagugagcgcgaggcgcugcagcagcagcacagcgugcagguggaccagcugcgcaugcagggccagagcguggaggccgcgcuccgcauggagcgccaggccgccucggaggagaagaggaagcuggcccaguugcagguggccuaucaccagcucuuccaagaauacgacaaccacaucaagagcagcguggugggcagugagcggaagcgaggaaugcagcuggaagaucucaaacagcagcuccagcaggccgaggaggcccugguggccaaacaggaggugaucgauaagcugaaggaggaggccgagcagcacaagauugugauggagaccguuccggugcugaaggcccaggcggauaucuacaaggcggacuuccaggcugagaggcaggcccgggagaagcuggccgagaagaaggagcuccugcaggagcagcuggagcagcugcagagggaguacagcaaacugaaggccagcugucaggagucggccaggaucgaggacaugaggaagcggcaugucgaggucucccaggcccccuugccccccgccccugccuaccucuccucuccccuggcccugcccagccagaggaggagcccccccgaggagccaccugacuucugcugucccaagugccaguaucaggccccugauauggacacccugcagauacaugucauggagugcauugaguag

SEQ ID NO: 8656 - RNA, 1260 nt, Artificial Sequence
  derived and/or modified sequence opt1 from IKK__Homo_sapiens__AAC36330
augaaccgccaccuguggaagucccagcucugcgagauggugcagcccagcggcgggccggccgccgaccaggacguccugggcgaggagagcccccuggggaagcccgcgaugcuccaccuccccuccgagcagggcgccccggagacccugcagcggugccucgaggagaaccaggagcugcgcgacgccauccggcagagcaaccagauccugcgcgagcggugcgaggagcuccugcacuuccaggccucccagcgcgaggagaaggaguuccugaugugcaaguuccaggaggcccggaagcucguggagcgccuggggcuggagaagcucgaccugaagcggcagaaggagcaggcgcugcgcgagguggagcaccucaagcggugccagcagcagauggccgaggacaaggccagcgucaaggcccaggugaccucccugcugggcgagcuccaggagagccagucccgccuggaggcggccacgaaggagugccaggcccuggagggccgggcccgcgccgcgagcgagcaggcccggcagcucgaguccgagcgcgaggcccugcagcagcagcacagcgugcaggucgaccagcugcggaugcaggggcaguccguggaggccgcccuccgcauggagcggcaggcggccagcgaggagaagcgcaagcuggcccagcuccagguggccuaccaccagcuguuccaggaguacgacaaccacaucaaguccagcgucgugggcuccgagcggaagcgcgggaugcagcuggaggaccugaagcagcagcugcagcaggccgaggaggcgcugguggccaagcaggaggucaucgacaagcugaaggaggaggccgagcagcacaagaucgugauggagaccgugcccguccucaaggcccaggccgacaucuacaaggcggacuuccaggccgagcgccaggcccgggagaagcuggccgagaagaaggagcugcuccaggagcagcuggagcagcugcagcgcgaguacagcaagcucaaggcguccugccaggagagcgcccggaucgaggacaugcgcaagcggcacguggaggugagccaggcgccccugcccccggcccccgccuaccuguccagcccccucgcccugcccucccagcgccggagcccgcccgaggagccgcccgacuucugcugccccaagugccaguaccaggcccccgacauggacacccugcagauccacgucauggagugcaucgaguga

SEQ ID NO: 8657 - RNA, 1260 nt, Artificial Sequence
  derived and/or modified sequence opt2 from IKK__Homo_sapiens__AAC36330
augaaccgccaccucuggaagucccagcucugcgagaugguccagcccuccggcggccccgccgccgaccaggacguccucggcgaggaguccccccucggcaagcccgccaugcuccaccuccccuccgagcagggcgcccccgagacccuccagcgcugccucgaggagaaccaggagcuccgcgacgccauccgccaguccaaccagauccuccgcgagcgcugcgaggagcuccuccacuuccaggccucccagcgcgaggagaaggaguuccucaugugcaaguuccaggaggcccgcaagcucgucgagcgccucggccucgagaagcucgaccucaagcgccagaaggagcaggcccuccgcgaggucgagcaccucaagcgcugccagcagcagauggccgaggacaaggccuccgucaaggcccaggucaccucccuccucggcgagcuccaggagucccagucccgccucgaggccgccaccaaggagugccaggcccucgagggccgcgcccgcgccgccuccgagcaggcccgccagcucgaguccgagcgcgaggcccuccagcagcagcacuccguccaggucgaccagcuccgcaugcagggccaguccgucgaggccgcccuccgcauggagcgccaggccgccuccgaggagaagcgcaagcucgcccagcuccaggucgccuaccaccagcucuuccaggaguacgacaaccacaucaaguccuccgucgucggcuccgagcgcaagcgcggcaugcagcucgaggaccucaagcagcagcuccagcaggccgaggaggcccucgucgccaagcaggaggucaucgacaagcucaaggaggaggccgagcagcacaagaucgucauggagaccguccccguccucaaggcccaggccgacaucuacaaggccgacuuccaggccgagcgccaggcccgcgagaagcucgccgagaagaaggagcuccuccaggagcagcucgagcagcuccagcgcgaguacuccaagcucaaggccuccugccaggaguccgcccgcaucgaggacaugcgcaagcgccacgucgaggucucccaggccccccucccccccgcccccgccuaccucuccuccccccucgcccuccccucccagcgccgcuccccccccgaggagccccccgacuucugcugccccaagugccaguaccaggcccccgacauggacacccuccagauccacgucauggagugcaucgaguga

SEQ ID NO: 8658 - RNA, 1260 nt, Artificial Sequence
  derived and/or modified sequence opt3 from IKK__Homo_sapiens__AAC36330
augaacagacaccuguggaaaagccagcucugcgagauggugcaacccuccggcgggccugccgcugaccaggauguccuuggagaagagucuccacuggguaaaccggcaauguugcauuuacccucagaacagggcgccccugagacccugcagaggugucuagaagagaaucaagagcuccgggacgcgauccgccagaguaaccagauucugcgagaacguugcgaggaacuucugcacuuccaggcuagccaaagagaggagaaggaauuuuugauguguaaauuccaggaggccaggaagcucguugaacggcuggggcuggagaaacucgauuuaaagcgccagaaggaacaggcacugagagagguggagcaucuuaaaaggugccaacagcagauggccgaagacaaggcuuccguaaaagcacaagugacaucuuugcugggagagcuacaggaaucgcagucacggcucgaggccgcuacuaaggaaugucaggcccuggagggccgcgcgcgagcagccagcgagcaagcuagacagcuugaaagugagagggaagcccugcagcagcaacacuccguccagguggaucaguugcggaugcagggucaaucuguugaggcagcucuccguauggaacgccaggccgcgagcgaggagaaaagaaagcuggcccaguuacagguggcauaccaucaacuguuucaggaauaugacaaucacauaaaguccucagucguggggagugagaggaaacggggaaugcagcucgaagaucuuaagcaacagcugcagcaggcugaggaggccuugguagcuaaacaagaaguuaucgacaagcuaaaagaggaagccgagcagcacaagauugugauggaaacggucccagugcugaaagcacaggccgauaucuacaaggcugacuuccaggcggagcgacaagcacgcgagaagcucgccgaaaagaaggagcugcuucaggaacagcuggagcaguugcaaagagaauauagcaaacucaaggcuucuugccaggaguccgccaggauugaggauaugcggaaacgccauguggaagucucacaggcaccccugccuccagcccccgcuuacuuaagcaguccucuggcccuaccaucucaaagaagguccccgcccgaggaaccuccagacuuuuguugccccaagugucaguaucaggcaccugauauggacacccuccagauccacguuauggagugcauagaauga

SEQ ID NO: 8659 - RNA, 1260 nt, Artificial Sequence
  derived and/or modified sequence opt4 from IKK__Homo_sapiens__AAC36330
augaacagacaccuguggaagagccagcugugcgagauggugcagcccagcggcggccccgccgccgaccaggacgugcugggcgaggagagcccccugggcaagcccgccaugcugcaccugcccagcgagcagggcgcccccgagacccugcagagaugccuggaggagaaccaggagcugagagacgccaucagacagagcaaccagauccugagagagagaugcgaggagcugcugcacuuccaggccagccagagagaggagaaggaguuccugaugugcaaguuccaggaggccagaaagcugguggagagacugggccuggagaagcuggaccugaagagacagaaggagcaggcccugagagagguggagcaccugaagagaugccagcagcagauggccgaggacaaggccagcgugaaggcccaggugaccagccugcugggcgagcugcaggagagccagagcagacuggaggccgccaccaaggagugccaggcccuggagggcagagccagagccgccagcgagcaggccagacagcuggagagcgagagagaggcccugcagcagcagcacagcgugcagguggaccagcugagaaugcagggccagagcguggaggccgcccugagaauggagagacaggccgccagcgaggagaagagaaagcuggcccagcugcagguggccuaccaccagcuguuccaggaguacgacaaccacaucaagagcagcguggugggcagcgagagaaagagaggcaugcagcuggaggaccugaagcagcagcugcagcaggccgaggaggcccugguggccaagcaggaggugaucgacaagcugaaggaggaggccgagcagcacaagaucgugauggagaccgugcccgugcugaaggcccaggccgacaucuacaaggccgacuuccaggccgagagacaggccagagagaagcuggccgagaagaaggagcugcugcaggagcagcuggagcagcugcagagagaguacagcaagcugaaggccagcugccaggagagcgccagaaucgaggacaugagaaagagacacguggaggugagccaggccccccugccccccgcccccgccuaccugagcagcccccuggcccugcccagccagagaagaagcccccccgaggagccccccgacuucugcugccccaagugccaguaccaggcccccgacauggacacccugcagauccacgugauggagugcaucgaguga

SEQ ID NO: 8660 - RNA, 1260 nt, Artificial Sequence
  derived and/or modified sequence opt5 from IKK__Homo_sapiens__AAC36330
augaacagacaccuguggaaaagccagcucugcgagauggugcaacccuccggcgggccugccgcugaccaggauguccugggagaagagucuccgcuuggcaaacccgccaugcugcaucucccuagcgaacagggggcgcccgagacccugcagcggugucuugaagagaaucaagagcugcgcgacgcuaucagacaguccaaccagauucuccgggaacgcugcgaggaacugcugcacuuccaggccucucaaagagaggagaaggaauuucucauguguaaauuccaggaggcccggaagcugguugaacgccuuggacuggagaaacucgaucugaagagacagaaggaacaggcccuucgggagguggagcaucugaaacgcugccaacagcagauggccgaagacaaggcuagcgugaaagcccaagucacaucccuccugggcgagcugcaggaaucucagagcagacucgaggcggccacgaaggaaugucaggcucuggaggggcgggcccgcgcugccuccgagcaagcgagacagcuugaaagcgagcgggaagcccugcagcagcaacacucugugcagguugaucagcuccgcaugcagggacaauccguggaggcugcccugagaauggaacggcaggcugccagcgaggagaaaagaaaacuugcccagcugcaggucgcuuaccaucaacucuuucaggaauaugacaaucacaucaagucuuccgugguuggcagcgagcgcaagcggggcaugcagcuggaagaucugaagcaacagcuccagcaggcggaggaggcccugguggcuaaacaagaagucauugacaaacuuaaggaggaagccgagcagcacaagaucgugauggaaaccgugccuguccugaaagcccaggcugauauuuacaaggccgacuuccaggcggagagacaagcucgcgagaagcucgccgaaaagaaggagcugcuucaggaacagcuggagcagcuccaacgggaauauucuaaacugaaggccuccugccaggagagcgcuagaaucgaggauaugcgcaaacggcauguugaagugucccaggcuccccugccuccggcucccgccuaccucucuagcccucuggcgcuucccucccaaagacgcagcccucccgaggaaccgccugacuuuuguugccccaagugucaguaucaggccccugauauggacacacugcagauccacgugauggagugcauugaauga

SEQ ID NO: 8661 - protein, 540 aa, Artificial Sequence
  IL-1__Homo_sapiens__O43353
MNGEAICSALPTIPYHKLADLRYLSRGASGTVSSARHADWRVQVAVKHLHIHTPLLDSERKDVLREAEILHKARFSYILPILGICNEPEFLGIVTEYMPNGSLNELLHRKTEYPDVAWPLRFRILHEIALGVNYLHNMTPPLLHHDLKTQNILLDNEFHVKIADFGLSKWRMMSLSQSRSSKSAPEGGTIIYMPPENYEPGQKSRASIKHDIYSYAVITWEVLSRKQPFEDVTNPLQIMYSVSQGHRPVINEESLPYDIPHRARMISLIESGWAQNPDERPSFLKCLIELEPVLRTFEEITFLEAVIQLKKTKLQSVSSAIHLCDKKKMELSLNIPVNHGPQEESCGSSQLHENSGSPETSRSLPAPQDNDFLSRKAQDCYFMKLHHCPGNHSWDSTISGSQRAAFCDHKTTPCSSAIINPLSTAGNSERLQPGIAQQWIQSKREDIVNQMTEACLNQSLDALLSRDLIMKEDYELVSTKPTRTSKVRQLLDTTDIQGEEFAKVIVQKLKDNKQMGLQPYPEILVVSRSPSLNLLQNKSM

SEQ ID NO: 8662 - RNA, 1623 nt, Artificial Sequence
  IL-1__Homo_sapiens__AAC24561
augaacggggaggccaucugcagcgcccugcccaccauucccuaccacaaacucgccgaccugcgcuaccugagccgcggcgccucuggcacugugucguccgcccgccacgcagacuggcgcguccagguggccgugaagcaccugcacauccacacuccgcugcucgacagugaaagaaaggaugucuuaagagaagcugaaauuuuacacaaagcuagauuuaguuacauucuuccaauuuugggaauuugcaaugagccugaauuuuugggaauaguuacugaauacaugccaaauggaucauuaaaugaacuccuacauaggaaaacugaauauccugauguugcuuggccauugagauuucgcauccugcaugaaauugcccuugguguaaauuaccugcacaauaugacuccuccuuuacuucaucaugacuugaagacucagaauaucuuauuggacaaugaauuucauguuaagauugcagauuuugguuuaucaaaguggcgcaugaugucccucucacagucacgaaguagcaaaucugcaccagaaggagggacaauuaucuauaugccaccugaaaacuaugaaccuggacaaaaaucaagggccaguaucaagcacgauauauauagcuaugcaguuaucacaugggaaguguuauccagaaaacagccuuuugaagaugucaccaauccuuugcagauaauguauagugugucacaaggacaucgaccuguuauuaaugaagaaaguuugccauaugauauaccucaccgagcacguaugaucucucuaauagaaaguggaugggcacaaaauccagaugaaagaccaucuuucuuaaaauguuuaauagaacuugaaccaguuuugagaacauuugaagagauaacuuuucuugaagcuguuauucagcuaaagaaaacaaaguuacagaguguuucaagugccauucaccuaugugacaagaagaaaauggaauuaucucugaacauaccuguaaaucaugguccacaagaggaaucauguggauccucucagcuccaugaaaauagugguucuccugaaacuucaaggucccugccagcuccucaagacaaugauuuuuuaucuagaaaagcucaagacuguuauuuuaugaagcugcaucacuguccuggaaaucacaguugggauagcaccauuucuggaucucaaagggcugcauucugugaucacaagaccacuccaugcucuucagcaauaauaaauccacucucaacugcaggaaacucagaacgucugcagccugguauagcccagcaguggauccagagcaaaagggaagacauugugaaccaaaugacagaagccugccuuaaccagucgcuagaugcccuucuguccagggacuugaucaugaaagaggacuaugaacuuguuaguaccaagccuacaaggaccucaaaagucagacaauuacuagacacuacugacauccaaggagaagaauuugccaaaguuauaguacaaaaauugaaagauaacaaacaaaugggucuucagccuuacccggaaauacuugugguuucuagaucaccaucuuuaaauuuacuucaaaauaaaagcauguaa

SEQ ID NO: 8663 - RNA, 1623 nt, Artificial Sequence
  derived and/or modified sequence opt1 from IL-1__Homo_sapiens__AAC24561
augaacggcgaggccaucugcagcgcccugcccaccaucccguaccacaagcucgcggaccugcgcuaccugucccgcggggccagcggcaccguguccagcgcccggcacgccgacuggcggguccagguggccgugaagcaccuccacauccacacgccccugcuggacuccgagcgcaaggacguccuccgggaggcggagauccugcacaaggcccgcuucagcuacauccugcccauccucgggaucugcaacgagcccgaguuccugggcaucgugaccgaguacaugccgaacgggucccugaacgagcuccugcaccggaagaccgaguaccccgacguggccuggccccugcgcuuccggauccuccacgagaucgcccugggcgucaacuaccugcacaacaugacgcccccgcuccugcaccacgaccugaagacccagaacauccuccuggacaacgaguuccacgugaagaucgcggacuucggccugagcaaguggcgcaugaugucccucagccagucccggagcuccaagagcgcccccgagggcgggaccaucaucuacaugccgcccgagaacuacgagcccgggcagaagucccgcgccagcaucaagcacgacaucuacuccuacgccgugaucaccugggagguccugagccggaagcagcccuucgaggacgugaccaacccccugcagaucauguacuccgugagccagggccaccgccccgucaucaacgaggagagccucccguacgacaucccccaccgggcccgcaugaucucccugaucgagagcgggugggcgcagaaccccgacgagcggcccuccuuccugaagugccucaucgagcuggagccggugcugcgcacguucgaggagaucaccuuccucgaggccgugauccagcugaagaagaccaagcugcagagcgucuccagcgccauccaccucugcgacaagaagaagauggagcugucccugaacauccccgugaaccacggcccccaggaggagagcugcggcuccagccagcuccacgagaacuccgggagccccgagaccucccggagccugccggcgccccaggacaacgacuuccugucccgcaaggcccaggacugcuacuucaugaagcuccaccacugccccggcaaccacagcugggacuccacgaucagcgggucccagcgggccgccuucugcgaccacaagaccacccccugcagcagcgccaucaucaacccgcuguccaccgccggcaacagcgagcgccugcagcccggcaucgcccagcaguggauccaguccaagcgcgaggacaucgugaaccagaugacggaggcgugccucaaccagagccuggacgcccugcucucccgggaccugaucaugaaggaggacuacgagcuggucagcaccaagcccacccgcaccuccaaggugcggcagcugcucgacacgaccgacauccagggggaggaguucgccaaggugaucguccagaagcugaaggacaacaagcagaugggccugcagccguaccccgagauccucguggugagccgcucccccagccugaaccugcuccagaacaaguccauguga

SEQ ID NO: 8664 - RNA, 1623 nt, Artificial Sequence
  derived and/or modified sequence opt2 from IL-1__Homo_sapiens__AAC24561
augaacggcgaggccaucugcuccgcccuccccaccauccccuaccacaagcucgccgaccuccgcuaccucucccgcggcgccuccggcaccgucuccuccgcccgccacgccgacuggcgcguccaggucgccgucaagcaccuccacauccacaccccccuccucgacuccgagcgcaaggacguccuccgcgaggccgagauccuccacaaggcccgcuucuccuacauccuccccauccucggcaucugcaacgagcccgaguuccucggcaucgucaccgaguacaugcccaacggcucccucaacgagcuccuccaccgcaagaccgaguaccccgacgucgccuggccccuccgcuuccgcauccuccacgagaucgcccucggcgucaacuaccuccacaacaugacccccccccuccuccaccacgaccucaagacccagaacauccuccucgacaacgaguuccacgucaagaucgccgacuucggccucuccaaguggcgcaugaugucccucucccagucccgcuccuccaaguccgcccccgagggcggcaccaucaucuacaugccccccgagaacuacgagcccggccagaagucccgcgccuccaucaagcacgacaucuacuccuacgccgucaucaccugggagguccucucccgcaagcagcccuucgaggacgucaccaacccccuccagaucauguacuccgucucccagggccaccgccccgucaucaacgaggagucccuccccuacgacaucccccaccgcgcccgcaugaucucccucaucgaguccggcugggcccagaaccccgacgagcgccccuccuuccucaagugccucaucgagcucgagcccguccuccgcaccuucgaggagaucaccuuccucgaggccgucauccagcucaagaagaccaagcuccaguccgucuccuccgccauccaccucugcgacaagaagaagauggagcucucccucaacauccccgucaaccacggcccccaggaggaguccugcggcuccucccagcuccacgagaacuccggcucccccgagaccucccgcucccuccccgccccccaggacaacgacuuccucucccgcaaggcccaggacugcuacuucaugaagcuccaccacugccccggcaaccacuccugggacuccaccaucuccggcucccagcgcgccgccuucugcgaccacaagaccacccccugcuccuccgccaucaucaacccccucuccaccgccggcaacuccgagcgccuccagcccggcaucgcccagcaguggauccaguccaagcgcgaggacaucgucaaccagaugaccgaggccugccucaaccagucccucgacgcccuccucucccgcgaccucaucaugaaggaggacuacgagcucgucuccaccaagcccacccgcaccuccaagguccgccagcuccucgacaccaccgacauccagggcgaggaguucgccaaggucaucguccagaagcucaaggacaacaagcagaugggccuccagcccuaccccgagauccucgucgucucccgcucccccucccucaaccuccuccagaacaaguccauguga

SEQ ID NO: 8665 - RNA, 1623 nt, Artificial Sequence
  derived and/or modified sequence opt3 from IL-1__Homo_sapiens__AAC24561
augaacggcgaggccaucugcagcgcucugccaaccauuccuuaccacaagcucgcagaccuuagauaucuguccaggggagccucugggacagugucaagugcgcggcaugcugauuggcgcguccagguugccgugaaacacuugcauauacacacuccauuacuggacagcgaacgaaaggauguacuacgugaggcagaaauccuccauaaagccagauucuccuacauucugccgauccuugguauuuguaaugagcccgaauuucugggcaucgugacggaguauaugccuaacgggucuuugaaugagcuccugcacaggaagaccgaauacccagacgucgcuuggccccugcgguuccgcauacuccacgagaucgcauuaggagugaacuaucugcauaauaugacaccuccacuuuugcaccaugaucugaaaacucaaaacauucuacucgacaaugaauuucacguuaagaucgccgauuucggccugucgaaguggagaaugaugucacuuagccagaguagguccucuaaaagcgcucccgagggugggaccauuaucuacaugccuccagagaacuaugaaccgggacagaagucccgggccucaauaaaacacgacauuuacaguuacgcggugaucacaugggagguccugagccgcaagcagcccuuugaagaugugaccaauccuuugcaaauuauguauucuguaucccagggccaucgaccaguuaucaacgaggaaucacuccccuacgacaucccucacagagcaaggaugauuagccugauagagaguggcugggcccagaauccagaugagcggcccucuuucuuaaaaugccugaucgaacucgagccggugcuucguacuuuugaagagauuacauuccuggaagcugucauccaguugaagaagaccaaacuacaauccgugagcucggccauacaucugugugacaagaaaaagauggagcucucucugaacauuccugugaaucacgggccccaggaggaauccugcggaucaagucagcuucaugagaacagcgguuccccagaaacgucucgcagccugccugcaccccaggauaaugacuuuuugucaagaaaagcucaagacuguuauuucaugaagcuccaccacugcccaggcaaccauaguugggauuccacuaucagcgggucucagagggccgcguuuugugaccacaaaaccacacccugcucaagugccaucauuaacccucugagcacugcaggaaauuccgagcgguuacagccaggcaucgcucaacaguggauucagucuaagcgagaagauauagucaaccagaugaccgaggccugucugaaucaaucgcuagacgcucuccugagccgcgaucuuaucaugaaggaggacuacgaauugguuuccacaaaaccgaccagaacgucaaaggugaggcagcugcucgauacuacagacauucagggugaggaguucgccaaaguaaucgugcagaagcugaaagauaacaagcaaauggggcuucagcccuauccugaaauccuggucgugagucggucucccagcuugaaucuccugcagaacaaguccauguga

SEQ ID NO: 8666 - RNA, 1623 nt, Artificial Sequence
  derived and/or modified sequence opt4 from IL-1__Homo_sapiens__AAC24561
augaacggcgaggccaucugcagcgcccugcccaccauccccuaccacaagcuggccgaccugagauaccugagcagaggcgccagcggcaccgugagcagcgccagacacgccgacuggagagugcagguggccgugaagcaccugcacauccacaccccccugcuggacagcgagagaaaggacgugcugagagaggccgagauccugcacaaggccagauucagcuacauccugcccauccugggcaucugcaacgagcccgaguuccugggcaucgugaccgaguacaugcccaacggcagccugaacgagcugcugcacagaaagaccgaguaccccgacguggccuggccccugagauucagaauccugcacgagaucgcccugggcgugaacuaccugcacaacaugacccccccccugcugcaccacgaccugaagacccagaacauccugcuggacaacgaguuccacgugaagaucgccgacuucggccugagcaaguggagaaugaugagccugagccagagcagaagcagcaagagcgcccccgagggcggcaccaucaucuacaugccccccgagaacuacgagcccggccagaagagcagagccagcaucaagcacgacaucuacagcuacgccgugaucaccugggaggugcugagcagaaagcagcccuucgaggacgugaccaacccccugcagaucauguacagcgugagccagggccacagacccgugaucaacgaggagagccugcccuacgacaucccccacagagccagaaugaucagccugaucgagagcggcugggcccagaaccccgacgagagacccagcuuccugaagugccugaucgagcuggagcccgugcugagaaccuucgaggagaucaccuuccuggaggccgugauccagcugaagaagaccaagcugcagagcgugagcagcgccauccaccugugcgacaagaagaagauggagcugagccugaacauccccgugaaccacggcccccaggaggagagcugcggcagcagccagcugcacgagaacagcggcagccccgagaccagcagaagccugcccgccccccaggacaacgacuuccugagcagaaaggcccaggacugcuacuucaugaagcugcaccacugccccggcaaccacagcugggacagcaccaucagcggcagccagagagccgccuucugcgaccacaagaccacccccugcagcagcgccaucaucaacccccugagcaccgccggcaacagcgagagacugcagcccggcaucgcccagcaguggauccagagcaagagagaggacaucgugaaccagaugaccgaggccugccugaaccagagccuggacgcccugcugagcagagaccugaucaugaaggaggacuacgagcuggugagcaccaagcccaccagaaccagcaaggugagacagcugcuggacaccaccgacauccagggcgaggaguucgccaaggugaucgugcagaagcugaaggacaacaagcagaugggccugcagcccuaccccgagauccugguggugagcagaagccccagccugaaccugcugcagaacaagagcauguga

SEQ ID NO: 8667 - RNA, 1623 nt, Artificial Sequence
  derived and/or modified sequence opt5 from IL-1__Homo_sapiens__AAC24561
augaacggcgaggccaucugcagcgcucugcccaccauuccuuaccacaagcucgccgaccugagauaucuuuccagaggggcgucuggaacagugagcuccgcucgccaugccgauuggagaguccagguugccgugaaacaucugcacauccacacgccgcuccuggacucugaacggaaggaugugcuucgcgaggcugaaauucugcauaaagccagauucagcuacauccuccccauucugggcaucuguaaugagccugaauuucuggggaucgucaccgaguauaugcccaacggaucccucaaugagcugcuucaccggaagacagaauacccugacguggcuuggccccugcgcuuccggauucuccacgagaucgcccugggcguuaacuaucuucauaauaugaccccuccgcugcuccaccaugaucugaaaacacaaaacauucugcucgacaaugaauuucacgugaagaucgcggauuucgggcugucuaaguggcggaugaugagccuuucccagagcagaucuuccaaaagcgcccccgagggaggcaccauuaucuacaugccucccgagaacuaugaaccuggccagaagucucgcgcuuccauuaaacacgacaucuacagcuacgccgucaucacaugggaggugcugucucggaagcagcccuuugaagauguuaccaauccgcuccaaauuauguauuccgugagccaggggcaucgcccugucaucaacgaggaaucccugcccuacgacauuccucacagagcucggaugaucucucuuauugagagcggaugggcccagaaucccgaugagcgccccuccuuccugaaaugccucaucgaacuggagccugugcugagaacguuugaagagaucaccuuccucgaagcggugauucagcugaagaagacaaaacuucaaagcgucucuuccgccauccaucugugugacaagaaaaagauggagcucagccugaacauuccgguuaaucacggcccccaggaggaaucuugcgggagcucccagcuucaugagaacucuggaagcccugaaaccucccggagccugcccgcuccucaggauaaugacuuucucucuagaaaagcccaagacuguuauuucaugaagcugcaccacugccccggcaaccauuccugggauagcacaaucucugggucccagcgcgcugccuuuugugaccacaaaaccacgccgugcagcuccgccauuaucaacccucugucuacagcuggaaauagcgagcggcuccagcccggcaucgcgcaacaguggauucaguccaagagagaagauaucgugaaccagaugaccgaggccugucugaaucaaucucuugacgcucugcucagccgcgaucugauuaugaaggaggacuacgaacugguguccacaaaaccuacccggaccagcaaggucagacagcuucucgauacaacggacauccagggcgaggaguucgccaaagugauuguucagaagcugaaagauaacaagcaaauggggcugcagcccuauccugaaauccucguggucucucgcucccccagccugaaucuucugcagaacaagucuauguga

SEQ ID NO: 8668 - protein, 224 aa, Artificial Sequence
  IL-1__Homo_sapiens__Q8N9C1
MIVVLSPDYVTEKSISMLEFKLGVMCQNSIATKLIVVEYRPLEHPHPGILQLKESVSFVSWKGEKSKHSGSKFWKALRLALPLRSLSASSGWNESCSSQSDISLDHVQRRRSRLKEPPELQSSERAAGSPPAPGTMSKHRGKSSATCRCCVTYCEGENHLRNKSRAEIHNQPQWETHLCKPVPQESETQWIQNGTRLEPPAPQISALALHHFTDLSNNNDFYIL

SEQ ID NO: 8669 - RNA, 675 nt, Artificial Sequence
  IL-1__Homo_sapiens__BAC04487
augauuguuguucugagcccugacuaugugacagaaaagagcaucagcaugcuggaguuuaaacugggugucaugugccagaacuccauugccaccaagcucauugugguugaguaccguccccuugagcacccucacccaggcauucuucagcucaaagagucugugucuuuugugagcuggaagggagaaaaguccaaacauucuggcucuaaauucuggaaagcuuugcgguuggcucuuccccugagaagucugagugccaguucuggcuggaaugagagcugcucuucccagucugacaucagucuggaucacguucaaaggaggagaagucguuugaaagagcccccagaacuucagagcucagagagggcugcagguagcccuccagccccaggcacaauguccaagcaccgagggaaguccuccgccaccugccgcuguugugucaccuacugugaaggagagaaucaccuuaggaacaagagccgggcagagauucauaaccagccccagugggagacacaccucuguaagccuguuccccaagagucagaaacucaauggauacaaaauggcaccagauuggaacccccugcuccccagaucucagcccuugcucuucaucauuucacggacuuauccaauaacaacgacuuuuauauccuauaa

SEQ ID NO: 8670 - RNA, 675 nt, Artificial Sequence
  derived and/or modified sequence opt1 from IL-1__Homo_sapiens__BAC04487
augaucgugguccugagccccgacuacgugaccgagaaguccaucagcaugcucgaguucaagcugggcgugaugugccagaacuccaucgccaccaagcugaucgucguggaguaccgcccgcucgagcacccccaccccgggauccugcagcugaaggagagcguguccuucgucagcuggaagggcgagaaguccaagcacagcggguccaaguucuggaaggcccuccggcuggcgcugccccuccgcagccuguccgccagcuccggcuggaacgagagcugcuccagccaguccgacaucagccuggaccacgugcagcggcgccggucccgccucaaggagccgcccgagcugcagagcagcgagcgggccgccggguccccgcccgcccccggcacgaugagcaagcaccgcggcaaguccagcgcgaccugccggugcugcgugaccuacugcgagggggagaaccaccuccgcaacaagucccgggccgagauccacaaccagccccagugggagacccaccugugcaagcccgucccccaggagagcgagacgcaguggauccagaacggcacccgccuggagccgcccgcgccccagaucuccgcccuggcccuccaccacuucaccgaccugagcaacaacaacgacuucuacauccuguga

SEQ ID NO: 8671 - RNA, 675 nt, Artificial Sequence
  derived and/or modified sequence opt2 from IL-1__Homo_sapiens__BAC04487
augaucgucguccucucccccgacuacgucaccgagaaguccaucuccaugcucgaguucaagcucggcgucaugugccagaacuccaucgccaccaagcucaucgucgucgaguaccgcccccucgagcacccccaccccggcauccuccagcucaaggaguccgucuccuucgucuccuggaagggcgagaaguccaagcacuccggcuccaaguucuggaaggcccuccgccucgcccucccccuccgcucccucuccgccuccuccggcuggaacgaguccugcuccucccaguccgacaucucccucgaccacguccagcgccgccgcucccgccucaaggagccccccgagcuccaguccuccgagcgcgccgccggcuccccccccgcccccggcaccauguccaagcaccgcggcaaguccuccgccaccugccgcugcugcgucaccuacugcgagggcgagaaccaccuccgcaacaagucccgcgccgagauccacaaccagccccagugggagacccaccucugcaagcccgucccccaggaguccgagacccaguggauccagaacggcacccgccucgagccccccgccccccagaucuccgcccucgcccuccaccacuucaccgaccucuccaacaacaacgacuucuacauccucuga

SEQ ID NO: 8672 - RNA, 675 nt, Artificial Sequence
  derived and/or modified sequence opt3 from IL-1__Homo_sapiens__BAC04487
augaucgugguccugagccccgacuacguuaccgagaaguccauuucuaugcucgaguucaaacuuggcgugaugugccagaacucaauagccacaaagcugaucguaguggaauauagaccuuuggaacacccacauccggggauuuuacaacugaaagagagugucagcuuuguguccuggaagggagaaaaaucuaagcacucggguucaaaguucuggaaagcucuaaggcucgcacugccccuucggagccugagugccuccucuggcuggaaugagagcuguuccucacagagugauaucagcuuggaccauguucagcgccgacguucuagacucaaggagccuccagaacugcaguccucagagagggcggcugggagucccccugccccaggaacuaugagcaaacaccggggcaagucuuccgcaacgugccgcuguugcgugaccuacugugaaggugagaaccaucugagaaauaaaagcagggccgagauucacaaccaaccccagugggaaacacaccucugcaagccugucccacaggagucggaaacucaguggauccaaaaugggacccgguuagagccgcccgcuccucagauaucugcacuggcccuucaucacuuuacagauuuguccaacaauaacgacuucuauauccuguga

SEQ ID NO: 8673 - RNA, 675 nt, Artificial Sequence
  derived and/or modified sequence opt4 from IL-1__Homo_sapiens__BAC04487
augaucguggugcugagccccgacuacgugaccgagaagagcaucagcaugcuggaguucaagcugggcgugaugugccagaacagcaucgccaccaagcugaucgugguggaguacagaccccuggagcacccccaccccggcauccugcagcugaaggagagcgugagcuucgugagcuggaagggcgagaagagcaagcacagcggcagcaaguucuggaaggcccugagacuggcccugccccugagaagccugagcgccagcagcggcuggaacgagagcugcagcagccagagcgacaucagccuggaccacgugcagagaagaagaagcagacugaaggagccccccgagcugcagagcagcgagagagccgccggcagcccccccgcccccggcaccaugagcaagcacagaggcaagagcagcgccaccugcagaugcugcgugaccuacugcgagggcgagaaccaccugagaaacaagagcagagccgagauccacaaccagccccagugggagacccaccugugcaagcccgugccccaggagagcgagacccaguggauccagaacggcaccagacuggagccccccgccccccagaucagcgcccuggcccugcaccacuucaccgaccugagcaacaacaacgacuucuacauccuguga

SEQ ID NO: 8674 - RNA, 675 nt, Artificial Sequence
  derived and/or modified sequence opt5 from IL-1__Homo_sapiens__BAC04487
augaucgugguccugagccccgacuacguuaccgagaaguccauuucuaugcucgaguucaaacugggcgugaugugccagaacagcaucgccacaaaacuuauuguggucgaauauagaccucuggaacacccgcaucccgggauccuccaacugaaggaguccgugucuuuuguuagcuggaagggagaaaaauccaagcacucuggcagcaaguucuggaaagcccuucggcuggcucucccucugcgcucccugagcgcgucuuccggguggaaugagagcuguucuucccagagcgauauuucucucgaccaugugcagagacggcgcuccagacugaaggagcccccugaacuucagagcuccgagcgggcugccggaucucccccugccccgggcacgaugagcaaacaccgcgggaaguccagcgcuaccugcagauguugcgucacauacugugaaggagagaaccaucugcggaauaaaucucgcgccgagauccacaaccaaccccagugggaaacccaccucugcaagccugugccccaggaguccgaaacacaguggauccaaaauggcaccagacuggagccucccgcuccgcagauuagcgcccuugcgcugcaucacuuuacagaucucucuaacaauaacgacuucuauauccuguga

SEQ ID NO: 8675 - protein, 152 aa, Artificial Sequence
  IL-1__Homo_sapiens__Q8WWZ1
MCSLPMARYYIIKYADQKALYTRDGQLLVGDPVADNCCAEKICILPNRGLARTKVPIFLGIQGGSRCLACVETEEGPSLQLEDVNIEELYKGGEEATRFTFFQSSSGSAFRLEAAAWPGWFLCGPAEPQQPVQLTKESEPSARTKFYFEQSW

SEQ ID NO: 8676 - RNA, 459 nt, Artificial Sequence
  IL-1__Homo_sapiens__AAK33010
auguguucccuccccauggcaagauacuacauaauuaaauaugcagaccagaaggcucuauacacaagagauggccagcugcuggugggagauccuguugcagacaacugcugugcagagaagaucugcauacuuccuaacagaggcuuggcccgcaccaagguccccauuuuccuggggauccagggagggagccgcugccuggcauguguggagacagaagaggggccuucccuacagcuggaggaugugaacauugaggaacuguacaaagguggugaagaggccacacgcuucaccuucuuccagagcagcucaggcuccgccuucaggcuugaggcugcugccuggccuggcugguuccuguguggcccggcagagccccagcagccaguacagcucaccaaggagagugagcccucagcccguaccaaguuuuacuuugaacagagcugguag

SEQ ID NO: 8677 - RNA, 459 nt, Artificial Sequence
  derived and/or modified sequence opt1 from IL-1__Homo_sapiens__AAK33010
augugcagccugcccauggcccgcuacuacaucaucaaguacgccgaccagaaggcgcucuacacccgggacggccagcugcuggugggggacccggucgccgacaacugcugcgccgagaagaucugcauccuccccaaccgcggccuggcccggaccaaggugcccaucuuccuggggauccagggcgggucccgcugccucgccugcguggagacggaggagggccccagccugcagcuggaggacgucaacaucgaggagcucuacaagggcggggaggaggcgacccgguucaccuucuuccaguccagcuccggcagcgccuuccgccuggaggccgccgcguggccggggugguuccugugcggccccgccgagccccagcagcccgugcagcucaccaaggaguccgagccgagcgcccggacgaaguucuacuucgagcaguccugguga

SEQ ID NO: 8678 - RNA, 459 nt, Artificial Sequence
  derived and/or modified sequence opt2 from IL-1__Homo_sapiens__AAK33010
augugcucccuccccauggcccgcuacuacaucaucaaguacgccgaccagaaggcccucuacacccgcgacggccagcuccucgucggcgaccccgucgccgacaacugcugcgccgagaagaucugcauccuccccaaccgcggccucgcccgcaccaagguccccaucuuccucggcauccagggcggcucccgcugccucgccugcgucgagaccgaggagggccccucccuccagcucgaggacgucaacaucgaggagcucuacaagggcggcgaggaggccacccgcuucaccuucuuccaguccuccuccggcuccgccuuccgccucgaggccgccgccuggcccggcugguuccucugcggccccgccgagccccagcagcccguccagcucaccaaggaguccgagcccuccgcccgcaccaaguucuacuucgagcaguccugguga

SEQ ID NO: 8679 - RNA, 459 nt, Artificial Sequence
  derived and/or modified sequence opt3 from IL-1__Homo_sapiens__AAK33010
augugcagccugcccauggccagauacuauaucauuaaguacgcugaccagaaagcacucuauaccagggauggccaacuucuggugggggacccugucgccgauaacuguugcgcggagaagauauguaucuugccaaaucggggauuagcucgcacaaaaguuccgauuuuccuggguauccagggcgggucccgaugccuagccuguguggaaacugaggaaggacccucucuccagcuggaggacguaaacauugaggaacuuuacaagggcggugaggaagcaacgcguuuuaccuucuuucagucaaguagcggguccgccuucagacuggaggcugcagccuggccuggaugguuuuugugcggcccagcugaaccccaacagccugugcagcucacaaaagagucugagccaucggccaggacuaaguucuauuuugaacagucaugguga

SEQ ID NO: 8680 - RNA, 459 nt, Artificial Sequence
  derived and/or modified sequence opt4 from IL-1__Homo_sapiens__AAK33010
augugcagccugcccauggccagauacuacaucaucaaguacgccgaccagaaggcccuguacaccagagacggccagcugcuggugggcgaccccguggccgacaacugcugcgccgagaagaucugcauccugcccaacagaggccuggccagaaccaaggugcccaucuuccugggcauccagggcggcagcagaugccuggccugcguggagaccgaggagggccccagccugcagcuggaggacgugaacaucgaggagcuguacaagggcggcgaggaggccaccagauucaccuucuuccagagcagcagcggcagcgccuucagacuggaggccgccgccuggcccggcugguuccugugcggccccgccgagccccagcagcccgugcagcugaccaaggagagcgagcccagcgccagaaccaaguucuacuucgagcagagcugguga

SEQ ID NO: 8681 - RNA, 459 nt, Artificial Sequence
  derived and/or modified sequence opt5 from IL-1__Homo_sapiens__AAK33010
augugcagccugcccauggccagauacuauaucauuaaguacgcugaccagaaagcccucuauacccgggauggccaacugcuugugggggacccugucgcggauaacuguugcgcugagaagaucuguauucugccgaaucgcggacucgccagaacaaaaguucccaucuuccugggcauucaagggggaucccggugccuugccuguguggaaacggaggaaggcccuucucugcagcucgaggacgugaacaucgaggaacuguacaaagggggagaggaagcuacccgcuuuacauucuuucagagcuccucuggcagcgccuucagacuggaggcugccgcguggcccggcugguuucucugcgggccugccgaaccccagcagccuguccagcugaccaaggaguccgagccgucugcucggacaaaguucuauuuugaacagagcugguga

SEQ ID NO: 8682 - protein, 164 aa, Artificial Sequence
  IL-1__Homo_sapiens__Q9NZH7
MNPQREAAPKSYAIRDSRQMVWVLSGNSLIAAPLSRSIKPVTLHLIACRDTEFSDKEKGNMVYLGIKGKDLCLFCAEIQGKPTLQLKLQGSQDNIGKDTCWKLVGIHTCINLDVRESCFMGTLDQWGIGVGRKKWKSSFQHHHLRKKDKDFSSMRTNIGMPGRM

SEQ ID NO: 8683 - RNA, 495 nt, Artificial Sequence
  IL-1__Homo_sapiens__AAF69250
augaacccacaacgggaggcagcacccaaauccuaugcuauucgugauucucgacagaugguguggguccugaguggaaauucuuuaauagcagcuccucuuagccgcagcauuaagccugucacucuucauuuaauagccuguagagacacagaauucagugacaaggaaaaggguaauaugguuuaccugggaaucaagggaaaagaucucugucucuucugugcagaaauucagggcaagccuacuuugcagcuuaagcuucagggcucccaagauaacauagggaaggacacuugcuggaaacuaguuggaauucacacaugcauaaaccuggaugugagagagagcugcuucaugggaacccuugaccaauggggaauaggaguggguagaaagaaguggaagaguuccuuucaacaucaccaucucaggaagaaggacaaagauuucucauccaugcggaccaacauaggaaugccaggaaggauguag

SEQ ID NO: 8684 - RNA, 495 nt, Artificial Sequence
  derived and/or modified sequence opt1 from IL-1__Homo_sapiens__AAF69250
augaacccccagcgcgaggccgcccccaagagcuacgcgauccgggacucccgccagaugguguggguccugagcggcaacucccugaucgccgccccgcugagccgguccaucaagcccgugacccugcaccucaucgccugccgcgacaccgaguucagcgacaaggagaaggggaacaugguguaccugggcaucaaggggaaggaccugugccucuucugcgccgagauccagggcaagcccacccugcagcugaagcuccaggggucccaggacaacaucggcaaggacacgugcuggaagcuggucggcauccacacgugcaucaaccuggacgugcgggagagcugcuucauggggacccucgaccaguggggcaucggggugggccgcaagaaguggaaguccagcuuccagcaccaccaccuccggaagaaggacaaggacuucuccagcaugcgcaccaacaucgggaugccgggccggauguga

SEQ ID NO: 8685 - RNA, 495 nt, Artificial Sequence
  derived and/or modified sequence opt2 from IL-1__Homo_sapiens__AAF69250
augaacccccagcgcgaggccgcccccaaguccuacgccauccgcgacucccgccagauggucuggguccucuccggcaacucccucaucgccgccccccucucccgcuccaucaagcccgucacccuccaccucaucgccugccgcgacaccgaguucuccgacaaggagaagggcaacauggucuaccucggcaucaagggcaaggaccucugccucuucugcgccgagauccagggcaagcccacccuccagcucaagcuccagggcucccaggacaacaucggcaaggacaccugcuggaagcucgucggcauccacaccugcaucaaccucgacguccgcgaguccugcuucaugggcacccucgaccaguggggcaucggcgucggccgcaagaaguggaaguccuccuuccagcaccaccaccuccgcaagaaggacaaggacuucuccuccaugcgcaccaacaucggcaugcccggccgcauguga

SEQ ID NO: 8686 - RNA, 495 nt, Artificial Sequence
  derived and/or modified sequence opt3 from IL-1__Homo_sapiens__AAF69250
augaacccccagagagaggccgcuccuaagagcuacgcaaucagggacucccggcaaaugguguggguccugucuggcaauucacucauugccgcgccacuuagucgcagcauaaaaccgguuacccugcacuugaucgcuugccgagauacagaguucuccgacaaggaaaaagggaacaugguguauuuaggaauuaaggguaaagaucugugucuauuuugcgccgaaauccagggcaagcccacucuccagcugaaacuucaggggucucaagacaauauuggaaaagauacguguuggaagcugguaggcauccauaccugcauaaacuuggacgugcgugagucguguuucauggguacacucgaucagugggggaucggagucggcagaaagaaguggaaaagcucauuucagcaccaucaccugaggaagaaggacaaagauuucaguuccaugcggacuaauauuggcaugccugggcgcauguga

SEQ ID NO: 8687 - RNA, 495 nt, Artificial Sequence
  derived and/or modified sequence opt4 from IL-1__Homo_sapiens__AAF69250
augaacccccagagagaggccgcccccaagagcuacgccaucagagacagcagacagauggugugggugcugagcggcaacagccugaucgccgccccccugagcagaagcaucaagcccgugacccugcaccugaucgccugcagagacaccgaguucagcgacaaggagaagggcaacaugguguaccugggcaucaagggcaaggaccugugccuguucugcgccgagauccagggcaagcccacccugcagcugaagcugcagggcagccaggacaacaucggcaaggacaccugcuggaagcuggugggcauccacaccugcaucaaccuggacgugagagagagcugcuucaugggcacccuggaccaguggggcaucggcgugggcagaaagaaguggaagagcagcuuccagcaccaccaccugagaaagaaggacaaggacuucagcagcaugagaaccaacaucggcaugcccggcagaauguga

SEQ ID NO: 8688 - RNA, 495 nt, Artificial Sequence
  derived and/or modified sequence opt5 from IL-1__Homo_sapiens__AAF69250
augaacccccagagagaggccgcuccuaagagcuacgccauccgggacucccgccaaaugguguggguccugucuggcaauagccucauugcggcuccgcuguccagaucuaucaaacccguuacccuucaccugauugccugccgggauacagaauuuagcgacaaggagaaagggaacaugguguaucucggaaucaagggcaaagaucugugucuuuucugcgccgaaauucaggggaagccuacgcugcagcucaagcugcagggaucccaagacaauaucggcaaagauaccuguuggaagcugguggggauccauacaugcauuaaccucgacguccgcgagucuuguuucaugggaacccuggaucaguggggcaucggcguggggcggaaaaaguggaaaagcuccuuucagcaccaucaccuuagaaagaaggacaaagauuucagcucuaugcgcacaaauauuggaaugcccggcagaauguga

SEQ ID NO: 8689 - protein, 155 aa, Artificial Sequence
  IL-1__Homo_sapiens__Q9UBH0
MVLSGALCFRMKDSALKVLYLHNNQLLAGGLHAGKVIKGEEISVVPNRWLDASLSPVILGVQGGSQCLSCGVGQEPTLTLEPVNIMELYLGAKESKSFTFYRRDMGLTSSFESAAYPGWFLCTVPEADQPVRLTQLPENGGWNAPITDFYFQQCD

SEQ ID NO: 8690 - RNA, 468 nt, Artificial Sequence
  IL-1__Homo_sapiens__AAF02757
augguccugaguggggcgcugugcuuccgaaugaaggacucggcauugaaggugcuuuaucugcauaauaaccagcuucuagcuggagggcugcaugcagggaaggucauuaaaggugaagagaucagcgugguccccaaucgguggcuggaugccagccugucccccgucauccuggguguccaggguggaagccagugccugucaugugggguggggcaggagccgacucuaacacuagagccagugaacaucauggagcucuaucuuggugccaaggaauccaagagcuucaccuucuaccggcgggacauggggcucaccuccagcuucgagucggcugccuacccgggcugguuccugugcacggugccugaagccgaucagccugucagacucacccagcuucccgagaaugguggcuggaaugcccccaucacagacuucuacuuccagcagugugacuag

SEQ ID NO: 8691 - RNA, 468 nt, Artificial Sequence
  derived and/or modified sequence opt1 from IL-1__Homo_sapiens__AAF02757
auggugcugagcggcgcccucugcuuccgcaugaaggacuccgcccugaagguccuguaccuccacaacaaccagcugcuggccgggggccuccacgcggggaaggugaucaagggcgaggagaucagcgugguccccaaccgguggcuggacgccucccugagcccggugauccucggggugcagggcggcucccagugccugagcugcggggucggccaggagcccacccugacccucgagcccgugaacaucauggagcuguaccugggggccaaggaguccaagagcuucacguucuaccgccgggacaugggccucaccuccagcuucgaguccgccgcguaccccgggugguuccugugcaccgugccggaggccgaccagcccguccgccugacccagcuccccgagaacggcggcuggaacgcccccaucacggacuucuacuuccagcagugcgacuga

SEQ ID NO: 8692 - RNA, 468 nt, Artificial Sequence
  derived and/or modified sequence opt2 from IL-1__Homo_sapiens__AAF02757
augguccucuccggcgcccucugcuuccgcaugaaggacuccgcccucaagguccucuaccuccacaacaaccagcuccucgccggcggccuccacgccggcaaggucaucaagggcgaggagaucuccgucguccccaaccgcuggcucgacgccucccucucccccgucauccucggcguccagggcggcucccagugccucuccugcggcgucggccaggagcccacccucacccucgagcccgucaacaucauggagcucuaccucggcgccaaggaguccaaguccuucaccuucuaccgccgcgacaugggccucaccuccuccuucgaguccgccgccuaccccggcugguuccucugcaccguccccgaggccgaccagcccguccgccucacccagcuccccgagaacggcggcuggaacgcccccaucaccgacuucuacuuccagcagugcgacuga

SEQ ID NO: 8693 - RNA, 468 nt, Artificial Sequence
  derived and/or modified sequence opt3 from IL-1__Homo_sapiens__AAF02757
auggugcugagcggcgcccucugcuucagaaugaaggacuccgcucuuaaaguccuguacuugcacaacaaucaguuacuggcagggggacuacaugccgguaagguuaucaaaggcgaggaaauuucugugguacccaacagguggcucgaugcgucacugaguccugugauacuugggguccaaggaggcagccagugucuguccugcgguguggggcaggagccaaccuugacacucgaaccgguuaauaucauggagcuguaucugggagcuaaggaaucuaaaucguuuacuuucuaccggcgcgacaugggccucacgagcucauuugagagugccgcauaucccggcugguucuuauguaccgugccugaggccgaucagccaguccgacugacacaacuucccgaaaacgggggauggaaugcuccuauuacugacuuuuacuuccagcagugcgauuga

SEQ ID NO: 8694 - RNA, 468 nt, Artificial Sequence
  derived and/or modified sequence opt4 from IL-1__Homo_sapiens__AAF02757
auggugcugagcggcgcccugugcuucagaaugaaggacagcgcccugaaggugcuguaccugcacaacaaccagcugcuggccggcggccugcacgccggcaaggugaucaagggcgaggagaucagcguggugcccaacagauggcuggacgccagccugagccccgugauccugggcgugcagggcggcagccagugccugagcugcggcgugggccaggagcccacccugacccuggagcccgugaacaucauggagcuguaccugggcgccaaggagagcaagagcuucaccuucuacagaagagacaugggccugaccagcagcuucgagagcgccgccuaccccggcugguuccugugcaccgugcccgaggccgaccagcccgugagacugacccagcugcccgagaacggcggcuggaacgcccccaucaccgacuucuacuuccagcagugcgacuga

SEQ ID NO: 8695 - RNA, 468 nt, Artificial Sequence
  derived and/or modified sequence opt5 from IL-1__Homo_sapiens__AAF02757
auggugcugagcggcgcccucugcuucagaaugaaggacuccgcucugaaaguccuuuaccugcacaacaaucagcuccuggccgggggacuucaugcgggcaagguuaucaaaggggaggaaauuucuguggugcccaaccgguggcuggaugcuagccucuccccugucauccugggagugcaaggcgggucucagugucugagcugcggaguuggccaggagccgacccucacacuggaacccgugaauauuauggagcuuuaucugggcgccaaggaauccaaaucuuuuacguucuaccgcagagacauggggcucaccagcuccuuugagagcgccgcuuauccuggaugguuccuguguacaguccccgaggccgaucagccugugcggcuuacccaacugcccgaaaacggcggguggaaugcuccuaucacagacuuuuacuuccagcagugcgauuga

SEQ ID NO: 8696 - protein, 158 aa, Artificial Sequence
  IL-1__Homo_sapiens__Q9UHA7
MEKALKIDTPQQGSIQDINHRVWVLQDQTLIAVPRKDRMSPVTIALISCRHVETLEKDRGNPIYLGLNGLNLCLMCAKVGDQPTLQLKEKDIMDLYNQPEPVKSFLFYHSQSGRNSTFESVAFPGWFIAVSSEGGCPLILTQELGKANTTDFGLTMLF

SEQ ID NO: 8697 - RNA, 477 nt, Artificial Sequence
  IL-1__Homo_sapiens__AAF25211
auggaaaaagcauugaaaauugacacaccucagcaggggagcauucaggauaucaaucaucggguguggguucuucaggaccagacgcucauagcagucccgaggaaggaccguaugucuccagucacuauugccuuaaucucaugccgacauguggagacccuugagaaagacagagggaaccccaucuaccugggccugaauggacucaaucucugccugaugugugcuaaagucggggaccagcccacacugcagcugaaggaaaaggauauaauggauuuguacaaccaacccgagccugugaaguccuuucucuucuaccacagccagaguggcaggaacuccaccuucgagucuguggcuuucccuggcugguucaucgcugucagcucugaaggaggcuguccucucauccuuacccaagaacuggggaaagccaacacuacugacuuuggguuaacuaugcuguuuuaa

SEQ ID NO: 8698 - RNA, 477 nt, Artificial Sequence
  derived and/or modified sequence opt1 from IL-1__Homo_sapiens__AAF25211
auggagaaggcccugaagaucgacacgccccagcagggcagcauccaggacaucaaccaccgcguguggguccuccaggaccagacccugaucgccgugccgcggaaggaccgcaugucccccgugaccaucgcgcugaucagcugccggcacgucgagacccucgagaaggaccgcgggaaccccaucuaccugggccugaacgggcucaaccugugccugaugugcgccaaggugggcgaccagcccacccuccagcugaaggagaaggacaucauggaccuguacaaccagccggagcccgugaaguccuuccucuucuaccacagccaguccgggcggaacagcaccuucgaguccgucgccuuccccggcugguucaucgccgugagcuccgagggcgggugcccccugauccugacgcaggagcucggcaaggccaacaccaccgacuucgggcugaccaugcuguucuga

SEQ ID NO: 8699 - RNA, 477 nt, Artificial Sequence
  derived and/or modified sequence opt2 from IL-1__Homo_sapiens__AAF25211
auggagaaggcccucaagaucgacaccccccagcagggcuccauccaggacaucaaccaccgcgucuggguccuccaggaccagacccucaucgccgucccccgcaaggaccgcaugucccccgucaccaucgcccucaucuccugccgccacgucgagacccucgagaaggaccgcggcaaccccaucuaccucggccucaacggccucaaccucugccucaugugcgccaaggucggcgaccagcccacccuccagcucaaggagaaggacaucauggaccucuacaaccagcccgagcccgucaaguccuuccucuucuaccacucccaguccggccgcaacuccaccuucgaguccgucgccuuccccggcugguucaucgccgucuccuccgagggcggcugcccccucauccucacccaggagcucggcaaggccaacaccaccgacuucggccucaccaugcucuucuga

SEQ ID NO: 8700 - RNA, 477 nt, Artificial Sequence
  derived and/or modified sequence opt3 from IL-1__Homo_sapiens__AAF25211
auggagaaggcccugaaaaucgacacaccccagcaaggcagcauucaggauauaaaccacagaguguggguccuccaggaccagacccuuaucgcuguuccuaggaaggaucggauguccccagugacuauugcacugaucucuugccgccauguagaaacguuggagaaagaccgagggaauccgauuuacuuaggacugaacggucuaaaucucugucugaugugcgccaaggugggcgaucaacccacccuucagcugaaagaaaaggacaucauggauuuguauaaccagccugagccagucaagucauuccucuuuuaccacagucagagcgggcguaauuccacauucgaaucuguggcguuucccggaugguucauagcuguuucgucagagggcgguuguccucugauccugacucaagagcucgggaaagccaacaccacagacuuuggauuaaccaugcuguucuga

SEQ ID NO: 8701 - RNA, 477 nt, Artificial Sequence
  derived and/or modified sequence opt4 from IL-1__Homo_sapiens__AAF25211
auggagaaggcccugaagaucgacaccccccagcagggcagcauccaggacaucaaccacagagugugggugcugcaggaccagacccugaucgccgugcccagaaaggacagaaugagccccgugaccaucgcccugaucagcugcagacacguggagacccuggagaaggacagaggcaaccccaucuaccugggccugaacggccugaaccugugccugaugugcgccaaggugggcgaccagcccacccugcagcugaaggagaaggacaucauggaccuguacaaccagcccgagcccgugaagagcuuccuguucuaccacagccagagcggcagaaacagcaccuucgagagcguggccuuccccggcugguucaucgccgugagcagcgagggcggcugcccccugauccugacccaggagcugggcaaggccaacaccaccgacuucggccugaccaugcuguucuga

SEQ ID NO: 8702 - RNA, 477 nt, Artificial Sequence
  derived and/or modified sequence opt5 from IL-1__Homo_sapiens__AAF25211
auggagaaggcccugaaaaucgacacaccccagcaaggcagcauucaggauaucaaccacagaguguggguccuccaggaccagacccugauugcuguuccucggaaggaucgcauguccccggugacgaucgcccuuauuucuugcagacauguggagacccuggagaaagaccgggggaaucccaucuaccucggacugaacggccuuaaucugugucucaugugcgcgaaggucggggaucaaccuacacugcagcugaaagaaaaggacaucauggaucucuauaaccagcccgagccuguuaagagcuuccuguuuuaccacucccagucuggacgcaauagcaccuucgaauccguggcuuuucccggcugguucauugccgugucuagcgaagggggauguccucuuauccugacacaagagcucggcaaagccaacaccacagacuuuggccugaccaugcuuuucuga

SEQ ID NO: 8703 - protein, 569 aa, Artificial Sequence
  IL-1R1__Homo_sapiens__P14778
MKVLLRLICFIALLISSLEADKCKEREEKIILVSSANEIDVRPCPLNPNEHKGTITWYKDDSKTPVSTEQASRIHQHKEKLWFVPAKVEDSGHYYCVVRNSSYCLRIKISAKFVENEPNLCYNAQAIFKQKLPVAGDGGLVCPYMEFFKNENNELPKLQWYKDCKPLLLDNIHFSGVKDRLIVMNVAEKHRGNYTCHASYTYLGKQYPITRVIEFITLEENKPTRPVIVSPANETMEVDLGSQIQLICNVTGQLSDIAYWKWNGSVIDEDDPVLGEDYYSVENPANKRRSTLITVLNISEIESRFYKHPFTCFAKNTHGIDAAYIQLIYPVTNFQKHMIGICVTLTVIIVCSVFIYKIFKIDIVLWYRDSCYDFLPIKASDGKTYDAYILYPKTVGEGSTSDCDIFVFKVLPEVLEKQCGYKLFIYGRDDYVGEDIVEVINENVKKSRRLIIILVRETSGFSWLGGSSEEQIAMYNALVQDGIKVVLLELEKIQDYEKMPESIKFIKQKHGAIRWSGDFTQGPQSAKTRFWKNVRYHMPVQRRSPSSKHQLLSPATKEKLQREAHVPLG

SEQ ID NO: 8704 - RNA, 1710 nt, Artificial Sequence
  IL-1R1__Homo_sapiens__AAA59137
augaaaguguuacucagacuuauuuguuucauagcucuacugauuucuucucuggaggcugauaaaugcaaggaacgugaagaaaaaauaauuuuagugucaucugcaaaugaaauugauguucgucccuguccucuuaacccaaaugaacacaaaggcacuauaacuugguauaaagaugacagcaagacaccuguaucuacagaacaagccuccaggauucaucaacacaaagagaaacuuugguuuguuccugcuaagguggaggauucaggacauuacuauugcgugguaagaaauucaucuuacugccucagaauuaaaauaagugcaaaauuuguggagaaugagccuaacuuauguuauaaugcacaagccauauuuaagcagaaacuacccguugcaggagacggaggacuugugugcccuuauauggaguuuuuuaaaaaugaaaauaaugaguuaccuaaauuacagugguauaaggauugcaaaccucuacuucuugacaauauacacuuuaguggagucaaagauaggcucaucgugaugaauguggcugaaaagcauagagggaacuauacuugucaugcauccuacacauacuugggcaagcaauauccuauuacccggguaauagaauuuauuacucuagaggaaaacaaacccacaaggccugugauugugagcccagcuaaugagacaauggaaguagacuugggaucccagauacaauugaucuguaaugucaccggccaguugagugacauugcuuacuggaaguggaaugggucaguaauugaugaagaugacccagugcuaggggaagacuauuacaguguggaaaauccugcaaacaaaagaaggaguacccucaucacagugcuuaauauaucggaaauugaaaguagauuuuauaaacauccauuuaccuguuuugccaagaauacacaugguauagaugcagcauauauccaguuaauauauccagucacuaauuuccagaagcacaugauugguauaugugucacguugacagucauaauuguguguucuguuuucaucuauaaaaucuucaagauugacauugugcuuugguacagggauuccugcuaugauuuucucccaauaaaagcuucagauggaaagaccuaugacgcauauauacuguauccaaagacuguuggggaagggucuaccucugacugugauauuuuuguguuuaaagucuugccugaggucuuggaaaaacaguguggauauaagcuguucauuuauggaagggaugacuacguuggggaagacauuguugaggucauuaaugaaaacguaaagaaaagcagaagacugauuaucauuuuagucagagaaacaucaggcuucagcuggcugggugguucaucugaagagcaaauagccauguauaaugcucuuguucaggauggaauuaaaguuguccugcuugagcuggagaaaauccaagacuaugagaaaaugccagaaucgauuaaauucauuaagcagaaacauggggcuauccgcuggucaggggacuuuacacagggaccacagucugcaaagacaagguucuggaagaaugucagguaccacaugccaguccagcgacggucaccuucaucuaaacaccaguuacugucaccagccacuaaggagaaacugcaaagagaggcucacgugccucucggguag

SEQ ID NO: 8705 - RNA, 1710 nt, Artificial Sequence
  derived and/or modified sequence opt1 from IL-1R1__Homo_sapiens__AAA59137
augaaggugcugcuccgccugaucugcuucaucgcccugcucaucagcucccuggaggccgacaagugcaaggagcgggaggagaagaucauccuggucagcuccgcgaacgagaucgacgugcgccccugcccgcucaaccccaacgagcacaagggcaccaucaccugguacaaggacgacagcaagacgcccguguccaccgagcaggccagccggauccaccagcacaaggagaagcugugguucguccccgccaagguggaggacuccgggcacuacuacugcgugguccgcaacagcuccuacugccugcggaucaagaucagcgccaaguucguggagaacgagccgaaccucugcuacaacgcccaggcgaucuucaagcagaagcugcccguggccggcgacgggggccuggucugccccuacauggaguucuucaagaacgagaacaacgagcuccccaagcugcagugguacaaggacugcaagccgcugcuccuggacaacauccacuucuccggggugaaggaccgccugaucgugaugaacgucgccgagaagcaccggggcaacuacacgugccacgccagcuacaccuaccucggcaagcaguaccccaucacccgcgugaucgaguucaucacccuggaggagaacaagcccacccggcccgugaucgucuccccggcgaacgagaccauggagguggaccuggggagccagauccagcucaucugcaacgugacgggccagcuguccgacaucgccuacuggaaguggaacgggagcgucaucgacgaggacgaccccgugcugggcgaggacuacuacuccguggagaaccccgccaacaagcgccggagcacccucaucaccguccugaacaucuccgagaucgagagccgcuucuacaagcaccccuucacgugcuucgccaagaacacccacgggaucgacgccgcguacauccagcugaucuacccggugaccaacuuccagaagcacaugaucggcaucugcgugacccucaccgucaucaucgugugcagcgucuucaucuacaagaucuucaagaucgacaucgugcugugguaccgggacuccugcuacgacuuccugcccaucaaggccagcgacggcaagacguacgacgccuacauccucuaccccaagaccgugggggagggcuccaccagcgacugcgacaucuucgucuucaaggugcugcccgaggugcuggagaagcagugcggguacaagcuguucaucuacggccgcgacgacuacgucggcgaggacaucguggaggugaucaacgagaacgucaagaagucccggcgccucaucaucauccuggugcgggagaccagcggguucuccuggcucggcgggagcuccgaggagcagaucgccauguacaacgcccuggugcaggacggcaucaaggucgugcugcucgagcuggagaagauccaggacuacgagaagaugccggagagcaucaaguucaucaagcagaagcacggggcgauccgcugguccggcgacuucacgcagggcccccagagcgccaagacccgguucuggaagaacgugcgcuaccacaugcccguccagcggcgcucccccagcuccaagcaccagcugcucagcccggccaccaaggagaagcugcagcgcgaggcccacgugccccugggguga

SEQ ID NO: 8706 - RNA, 1710 nt, Artificial Sequence
  derived and/or modified sequence opt2 from IL-1R1__Homo_sapiens__AAA59137
augaagguccuccuccgccucaucugcuucaucgcccuccucaucuccucccucgaggccgacaagugcaaggagcgcgaggagaagaucauccucgucuccuccgccaacgagaucgacguccgccccugcccccucaaccccaacgagcacaagggcaccaucaccugguacaaggacgacuccaagacccccgucuccaccgagcaggccucccgcauccaccagcacaaggagaagcucugguucguccccgccaaggucgaggacuccggccacuacuacugcgucguccgcaacuccuccuacugccuccgcaucaagaucuccgccaaguucgucgagaacgagcccaaccucugcuacaacgcccaggccaucuucaagcagaagcuccccgucgccggcgacggcggccucgucugccccuacauggaguucuucaagaacgagaacaacgagcuccccaagcuccagugguacaaggacugcaagccccuccuccucgacaacauccacuucuccggcgucaaggaccgccucaucgucaugaacgucgccgagaagcaccgcggcaacuacaccugccacgccuccuacaccuaccucggcaagcaguaccccaucacccgcgucaucgaguucaucacccucgaggagaacaagcccacccgccccgucaucgucucccccgccaacgagaccauggaggucgaccucggcucccagauccagcucaucugcaacgucaccggccagcucuccgacaucgccuacuggaaguggaacggcuccgucaucgacgaggacgaccccguccucggcgaggacuacuacuccgucgagaaccccgccaacaagcgccgcuccacccucaucaccguccucaacaucuccgagaucgagucccgcuucuacaagcaccccuucaccugcuucgccaagaacacccacggcaucgacgccgccuacauccagcucaucuaccccgucaccaacuuccagaagcacaugaucggcaucugcgucacccucaccgucaucaucgucugcuccgucuucaucuacaagaucuucaagaucgacaucguccucugguaccgcgacuccugcuacgacuuccuccccaucaaggccuccgacggcaagaccuacgacgccuacauccucuaccccaagaccgucggcgagggcuccaccuccgacugcgacaucuucgucuucaagguccuccccgagguccucgagaagcagugcggcuacaagcucuucaucuacggccgcgacgacuacgucggcgaggacaucgucgaggucaucaacgagaacgucaagaagucccgccgccucaucaucauccucguccgcgagaccuccggcuucuccuggcucggcggcuccuccgaggagcagaucgccauguacaacgcccucguccaggacggcaucaaggucguccuccucgagcucgagaagauccaggacuacgagaagaugcccgaguccaucaaguucaucaagcagaagcacggcgccauccgcugguccggcgacuucacccagggcccccaguccgccaagacccgcuucuggaagaacguccgcuaccacaugcccguccagcgccgcucccccuccuccaagcaccagcuccucucccccgccaccaaggagaagcuccagcgcgaggcccacgucccccucggcuga

SEQ ID NO: 8707 - RNA, 1710 nt, Artificial Sequence
  derived and/or modified sequence opt3 from IL-1R1__Homo_sapiens__AAA59137
augaaggugcugcucagacuuaucugcuucauugcccuguugauaagcuccuuagaggcugacaaauguaaggaaagggaggagaaaaucauucuggucucuucagcaaacgaaaucgauguucggcccugcccucuaaauccaaacgaacacaagggcaccauuacaugguacaaagacgauaguaagacuccggugagcacggagcaggccucccgcauccaucaacacaaggagaaacucugguuuguacccgcgaagguggaagacucugggcauuauuacugugucgugcgaaauucgucauauugccugcguauaaaaaucagcgcuaaguucguugagaacgaaccuaaucuuuguuacaacgcccaggcaauuuuuaaacagaagcugccaguggccggagaugguggcuuggucugccccuauauggaguucuuuaagaaugagaacaaugaacucccuaaacugcagugguacaaggacuguaaaccacugcucuuagauaacauccacuucaguggggugaaggacagacugauuguaaugaauguugcugagaaacauaggggaaacuauaccugccacgcauccuacacauaccuuggcaagcaauaucccaucacucgggugauagaauuuauuaccuuggaggaaaauaaaccuacacgcccagucaucgugucuccggccaacgagaccauggagguggaucuggguagccagauucagcuaaucuguaaugucacugggcagcucuccgacaucgcuuacuggaaguggaacggaucaguuauugaugaagacgaucccgugcugggcgaggacuauuacaguguagaaaacccugccaauaagagaaggagcacacuuauaaccgugcugaacaucucugagauugaaucccgguucuauaaacacccauuuacgugcuucgcgaagaauacucauggcaucgacgcagccuacauacaauugauuuaucccgucaccaacuuucagaaacacaugaucgggaucugugugacacucacuguuauuaucgugugcucagucuucauuuacaagauauuuaaaaucgauauugugcugugguaccgcgacagcugcuaugauuucuuaccuaucaaggcuagugacggaaagaccuacgaugccuauauccuguacccaaaaacaguaggugagggcucuaccuccgacugugauauuuucguuuuuaaggugcuccccgagguccuugaaaaacagugcggguauaagcuguucauauacggacgagacgauuaugugggcgaggacaucgucgaagugauuaaugagaacguuaaaaagagcagaagguugaucauuauccuagugcgggaaacgucggguuuuucuuggcucgggggauccucagaggagcagauagcaauguacaaugcucugguacaagauggcaucaaggucgugcugcuugaacuggagaaaauucaggacuacgaaaagaugccggagaguaucaaauucauuaagcagaaacauggcgccauccguuggagcggggacuuuacucaaggaccucaguccgcgaagacacgcuucuggaagaacguuagauaucacaugcccgugcagaggcggucuccaagcucaaaacaccaguugcucaguccugccaccaaggagaaacugcaacgagaagcacauguccccuuagguuga

SEQ ID NO: 8708 - RNA, 1710 nt, Artificial Sequence
  derived and/or modified sequence opt4 from IL-1R1__Homo_sapiens__AAA59137
augaaggugcugcugagacugaucugcuucaucgcccugcugaucagcagccuggaggccgacaagugcaaggagagagaggagaagaucauccuggugagcagcgccaacgagaucgacgugagacccugcccccugaaccccaacgagcacaagggcaccaucaccugguacaaggacgacagcaagacccccgugagcaccgagcaggccagcagaauccaccagcacaaggagaagcugugguucgugcccgccaagguggaggacagcggccacuacuacugcguggugagaaacagcagcuacugccugagaaucaagaucagcgccaaguucguggagaacgagcccaaccugugcuacaacgcccaggccaucuucaagcagaagcugcccguggccggcgacggcggccuggugugccccuacauggaguucuucaagaacgagaacaacgagcugcccaagcugcagugguacaaggacugcaagccccugcugcuggacaacauccacuucagcggcgugaaggacagacugaucgugaugaacguggccgagaagcacagaggcaacuacaccugccacgccagcuacaccuaccugggcaagcaguaccccaucaccagagugaucgaguucaucacccuggaggagaacaagcccaccagacccgugaucgugagccccgccaacgagaccauggagguggaccugggcagccagauccagcugaucugcaacgugaccggccagcugagcgacaucgccuacuggaaguggaacggcagcgugaucgacgaggacgaccccgugcugggcgaggacuacuacagcguggagaaccccgccaacaagagaagaagcacccugaucaccgugcugaacaucagcgagaucgagagcagauucuacaagcaccccuucaccugcuucgccaagaacacccacggcaucgacgccgccuacauccagcugaucuaccccgugaccaacuuccagaagcacaugaucggcaucugcgugacccugaccgugaucaucgugugcagcguguucaucuacaagaucuucaagaucgacaucgugcugugguacagagacagcugcuacgacuuccugcccaucaaggccagcgacggcaagaccuacgacgccuacauccuguaccccaagaccgugggcgagggcagcaccagcgacugcgacaucuucguguucaaggugcugcccgaggugcuggagaagcagugcggcuacaagcuguucaucuacggcagagacgacuacgugggcgaggacaucguggaggugaucaacgagaacgugaagaagagcagaagacugaucaucauccuggugagagagaccagcggcuucagcuggcugggcggcagcagcgaggagcagaucgccauguacaacgcccuggugcaggacggcaucaagguggugcugcuggagcuggagaagauccaggacuacgagaagaugcccgagagcaucaaguucaucaagcagaagcacggcgccaucagauggagcggcgacuucacccagggcccccagagcgccaagaccagauucuggaagaacgugagauaccacaugcccgugcagagaagaagccccagcagcaagcaccagcugcugagccccgccaccaaggagaagcugcagagagaggcccacgugccccugggcuga

SEQ ID NO: 8709 - RNA, 1710 nt, Artificial Sequence
  derived and/or modified sequence opt5 from IL-1R1__Homo_sapiens__AAA59137
augaaggugcugcucagacugaucugcuucauugcccuucugaucagcucccucgaggcugacaaauguaaggaacgggaggaaaagauuauccuggucucuagcgccaacgagauugauguucgccccugcccucuuaauccgaacgaacacaagggcaccaucacaugguacaaagacgauuccaagacgcccgugucuaccgagcaggcgagcagaauccaucaacacaaggagaaacugugguuugugccugcuaaggucgaagacuccgggcauuauuacugugugguucgcaauucuagcuauugccuccggauuaaaaucuccgccaaguucguggagaacgaacccaaucuguguuacaacgcccaggcuauuuuuaaacagaagcugccugucgccggagauggcgggcucgugugccccuauauggaguucuuuaagaaugagaacaaugaacugccuaaacuucagugguacaaggacuguaaaccgcugcuccuggauaacauccacuucagcggaguuaaggacagacuuauugugaugaaugucgcugagaaacaucggggcaacuauacaugccacgccucuuacaccuaccuggggaagcaauaucccaucacacgcgugauugaauuuaucacccucgaggaaaauaaaccuacaagacccgugaucgucuccccugcgaacgagaccauggagguugaucugggaagccagauucagcugaucuguaaugugacgggccagcucucugacauugccuacuggaaguggaacggcuccgugaucgaugaagacgaucccguccugggggaggacuauuacagcguggaaaacccggcuaauaagcggcgcucuacccuuauuacaguucugaacaucuccgagaucgaaagcagauucuauaaacacccuuuuaccugcuucgccaagaauacacauggaauugacgcugccuacauccaacucauuuaucccgugaccaacuuucagaaacacaugaucggcauuugugucacgcugacagugaucaucguuugcuccguguucauuuacaagaucuuuaaaauugauaucguccuuugguaccgggacucuugcuaugauuuccugccuauuaaggcgagcgacgggaagaccuacgaugccuauauccucuaccccaaaacagugggagagggcuccaccagcgacugugauauuuucgucuuuaaggugcugcccgagguucuggaaaaacagugcggguauaaacucuucaucuacggacgcgacgauuaugugggcgaggacaucgucgaagugauuaaugagaacguuaaaaagucuagacggcugaucauuauccuugugcgcgaaaccuccggcuuuagcuggcucgggggaucuagcgaggagcagauugcuauguacaaugcccugguccaagauggcaucaagguggugcugcuugaacuggagaaaauccaggacuacgaaaagaugccugaguccauuaaauucaucaagcagaaacauggggcuauuagauggucuggagacuuuacacaaggcccgcagagcgccaagacgcgguucuggaagaacguuagauaucacaugcccguccagcgccgguccccuagcucuaaacaccagcuccugucccccgccaccaaggagaaacugcaaagagaagcucaugugccucucggguga

SEQ ID NO: 8710 - protein, 569 aa, Artificial Sequence [sequence omitted]

SEQ ID NO: 8711 - RNA, 1710 nt, Artificial Sequence
  IL-1R1__Homo_sapiens__AAH67508
augaaaguguuacucagacuuauuuguuucauagcucuacugauuucuucucuggaggcugauaaaugcaaggaacgugaagaaaaaauaauuuuagugucaucugcaaaugaaauugauguucgucccuguccucuuaacccaaaugaacacaaaggcacuauaacuugguauaaagaugacagcaagacaccuguaucuacagaacaagccuccaggauucaucaacacaaagagaaacuuugguuuguuccugcuaagguggaggauucaggacauuacuauugcgugguaagaaauucaucuuacugccucagaauuaaaauaagugcaaaauuuguggagaaugagccuaacuuauguuauaaugcacaagccauauuuaagcagaaccuacccguugcaggagacggaggacuugugugcccuuauauggaguuuuuuaaaaaugaaaauaaugaguuaccuaaauuacagugguauaaggauugcaaaccucuacuucuugacaauauacacuuuaguggagucaaagauaggcucaucgugaugaauguggcugaaaagcauagagggaacuauacuugucaugcauccuacacauacuugggcaagcaauauccuauuacccggguaauagaauuuauuacucuagaggaaaacaaacccacaaggccugugauugugagcccagcuaaugagacaauggaaguagacuugggaucccagauacaauugaucuguaaugucaccggccaguugagugacauugcuuacuggaaguggaaugggucaguaauugaugaagaugacccagugcuaggggaagacuauuacaguguggaaaauccugcaaacaaaagaaggaguacccucaucacagugcuuaauauaucggaaauugaaaguagauuuuauaaacauccauuuaccuguuuugccaagaauacacaugguauagaugcagcauauauccaguuaauauauccagucacuaauuuccagaagcacaugauugguauaugugucacguugacagucauaauuguguguucuguuuucaucuauaaaaucuucaagauugacauugugcuuugguacagggauuccugcuaugauuuucucccaauaaaagcuucagauggaaagaccuaugacgcauauauacuguauccaaagacuguuggggaagggucuaccucugacugugauauuuuuguguuuaaagucuugccugaggucuuggaaaaacaguguggauauaagcuguucauuuauggaagggaugacuacguuggggaagacauuguugaggucauuaaugaaaacguaaagaaaagcagaagacugauuaucauuuuagucagagaaacaucaagcuucagcuggcugggugguucaucugaagagcaaauagccauguauaaugcucuuguucaggauggaauuaaaguuguccugcuugagcuggagaaaauccaagacuaugagaaaaugccagaaucgauuaaauucauuaagcagaaacauggggcuauccgcuggucaggggacuuuacacagggaccacagucugcaaagacaagguucuggaagaaugucagguaccacaugccaguccagcgacggucaccuucaucuaaacaccaguuacugucaccagccacuaaggagaaacugcaaagagaggcucacgugccucucggguag

SEQ ID NO: 8712 - RNA, 1710 nt, Artificial Sequence
  derived and/or modified sequence opt1 from IL-1R1__Homo_sapiens__AAH67508
augaaggugcugcuccgccugaucugcuucaucgcccugcucaucagcucccuggaggccgacaagugcaaggagcgggaggagaagaucauccuggucagcuccgcgaacgagaucgacgugcgccccugcccgcucaaccccaacgagcacaagggcaccaucaccugguacaaggacgacagcaagacgcccguguccaccgagcaggccagccggauccaccagcacaaggagaagcugugguucguccccgccaagguggaggacuccgggcacuacuacugcgugguccgcaacagcuccuacugccugcggaucaagaucagcgccaaguucguggagaacgagccgaaccucugcuacaacgcccaggcgaucuucaagcagaaccugcccguggccggcgacgggggccuggucugccccuacauggaguucuucaagaacgagaacaacgagcuccccaagcugcagugguacaaggacugcaagccgcugcuccuggacaacauccacuucuccggggugaaggaccgccugaucgugaugaacgucgccgagaagcaccggggcaacuacacgugccacgccagcuacaccuaccucggcaagcaguaccccaucacccgcgugaucgaguucaucacccuggaggagaacaagcccacccggcccgugaucgucuccccggcgaacgagaccauggagguggaccuggggagccagauccagcucaucugcaacgugacgggccagcuguccgacaucgccuacuggaaguggaacgggagcgucaucgacgaggacgaccccgugcugggcgaggacuacuacuccguggagaaccccgccaacaagcgccggagcacccucaucaccguccugaacaucuccgagaucgagagccgcuucuacaagcaccccuucacgugcuucgccaagaacacccacgggaucgacgccgcguacauccagcugaucuacccggugaccaacuuccagaagcacaugaucggcaucugcgugacccucaccgucaucaucgugugcagcgucuucaucuacaagaucuucaagaucgacaucgugcugugguaccgggacuccugcuacgacuuccugcccaucaaggccagcgacggcaagacguacgacgccuacauccucuaccccaagaccgugggggagggcuccaccagcgacugcgacaucuucgucuucaaggugcugcccgaggugcuggagaagcagugcggguacaagcuguucaucuacggccgcgacgacuacgucggcgaggacaucguggaggugaucaacgagaacgucaagaagucccggcgccucaucaucauccuggugcgggagaccagcuccuucagcuggcucgggggcuccagcgaggagcagaucgccauguacaacgcccuggugcaggacgggaucaaggucgugcugcucgagcuggagaagauccaggacuacgagaagaugccggaguccaucaaguucaucaagcagaagcacggcgcgauccgcuggagcggggacuucacgcagggcccccaguccgccaagacccgguucuggaagaacgugcgcuaccacaugcccguccagcggcgcagccccuccagcaagcaccagcugcucuccccggccaccaaggagaagcugcagcgcgaggcccacgugccccugggcuga

SEQ ID NO: 8713 - RNA, 1710 nt, Artificial Sequence
  derived and/or modified sequence opt2 from IL-1R1__Homo_sapiens__AAH67508
augaagguccuccuccgccucaucugcuucaucgcccuccucaucuccucccucgaggccgacaagugcaaggagcgcgaggagaagaucauccucgucuccuccgccaacgagaucgacguccgccccugcccccucaaccccaacgagcacaagggcaccaucaccugguacaaggacgacuccaagacccccgucuccaccgagcaggccucccgcauccaccagcacaaggagaagcucugguucguccccgccaaggucgaggacuccggccacuacuacugcgucguccgcaacuccuccuacugccuccgcaucaagaucuccgccaaguucgucgagaacgagcccaaccucugcuacaacgcccaggccaucuucaagcagaaccuccccgucgccggcgacggcggccucgucugccccuacauggaguucuucaagaacgagaacaacgagcuccccaagcuccagugguacaaggacugcaagccccuccuccucgacaacauccacuucuccggcgucaaggaccgccucaucgucaugaacgucgccgagaagcaccgcggcaacuacaccugccacgccuccuacaccuaccucggcaagcaguaccccaucacccgcgucaucgaguucaucacccucgaggagaacaagcccacccgccccgucaucgucucccccgccaacgagaccauggaggucgaccucggcucccagauccagcucaucugcaacgucaccggccagcucuccgacaucgccuacuggaaguggaacggcuccgucaucgacgaggacgaccccguccucggcgaggacuacuacuccgucgagaaccccgccaacaagcgccgcuccacccucaucaccguccucaacaucuccgagaucgagucccgcuucuacaagcaccccuucaccugcuucgccaagaacacccacggcaucgacgccgccuacauccagcucaucuaccccgucaccaacuuccagaagcacaugaucggcaucugcgucacccucaccgucaucaucgucugcuccgucuucaucuacaagaucuucaagaucgacaucguccucugguaccgcgacuccugcuacgacuuccuccccaucaaggccuccgacggcaagaccuacgacgccuacauccucuaccccaagaccgucggcgagggcuccaccuccgacugcgacaucuucgucuucaagguccuccccgagguccucgagaagcagugcggcuacaagcucuucaucuacggccgcgacgacuacgucggcgaggacaucgucgaggucaucaacgagaacgucaagaagucccgccgccucaucaucauccucguccgcgagaccuccuccuucuccuggcucggcggcuccuccgaggagcagaucgccauguacaacgcccucguccaggacggcaucaaggucguccuccucgagcucgagaagauccaggacuacgagaagaugcccgaguccaucaaguucaucaagcagaagcacggcgccauccgcugguccggcgacuucacccagggcccccaguccgccaagacccgcuucuggaagaacguccgcuaccacaugcccguccagcgccgcucccccuccuccaagcaccagcuccucucccccgccaccaaggagaagcuccagcgcgaggcccacgucccccucggcuga

SEQ ID NO: 8714 - RNA, 1710 nt, Artificial Sequence
  derived and/or modified sequence opt3 from IL-1R1__Homo_sapiens__AAH67508
augaaggugcugcucagacuuaucugcuucauugcccuguugauaagcuccuuagaggcugacaaauguaaggaaagggaggagaaaaucauucuggucucuucagcaaacgaaaucgauguucggcccugcccucuaaauccaaacgaacacaagggcaccauuacaugguacaaagacgauaguaagacuccggugagcacggagcaggccucccgcauccaucaacacaaggagaaacucugguuuguacccgcgaagguggaagacucugggcauuauuacugugucgugcgaaauucgucauauugccugcguauaaaaaucagcgcuaaguucguugagaacgaaccuaaucuuuguuacaacgcccaggcaauuuuuaaacagaaucugccaguggccggagaugguggcuuggucugccccuauauggaguucuuuaagaacgagaauaacgaacucccuaagcugcagugguacaaagacuguaagccacugcucuuagauaauauccacuucaguggggugaaagacagacugauuguaaugaacguugcugagaagcauaggggaaauuauaccugccacgcauccuacacauaccuuggcaaacaauaucccaucacucgggugauagaauuuauuaccuuggaggaaaacaagccuacacgcccagucaucgugucuccggccaaugagaccauggagguggaucuggguagccagauucagcuaaucuguaacgucacugggcagcucuccgacaucgcuuacuggaaauggaacggaucaguuauugaugaagacgaucccgugcugggcgaggacuauuacaguguagaaaauccugccaacaagagaaggagcacacuuauaaccgugcugaauaucucugagauugaaucccgguucuauaagcacccauuuacgugcuucgcgaaaaacacucauggcaucgacgcagccuacauacaauugauuuaucccgucaccaauuuucagaagcacaugaucgggaucugugugacacucacuguuauuaucgugugcucagucuucauuuacaaaauauuuaagaucgauauugugcugugguaccgcgacagcugcuaugauuucuuaccuaucaaagcuagugacggaaagaccuacgaugccuauauccuguacccaaagacaguaggugagggcucuaccuccgacugugauauuuucguuuuuaaagugcuccccgagguccuugaaaagcagugcggguauaaacuguucauauacggacgagacgauuaugugggcgaggacaucgucgaagugauuaacgagaauguuaagaaaagcagaagguugaucauuauccuagugcgggaaacgucgucuuuuuccuggcugggugggucaagugaggagcagauagcaauguacaacgcucucguacaagauggaaucaaggucgugcugcuugaacuggagaagauucaggacuacgagaaaaugccggaaagcaucaaguucauuaaacagaagcauggcgccauccguugguccggcgacuuuacucaagggccucagucugcgaaaacacgcuucuggaagaauguuagauaucacaugcccgugcagaggcggagcccaucaaguaagcaccaguugcucuccccugccaccaaagagaagcugcaacgagaagcacauguccccuuaggauga

SEQ ID NO: 8715 - RNA, 1710 nt, Artificial Sequence
  derived and/or modified sequence opt4 from IL-1R1__Homo_sapiens__AAH67508
augaaggugcugcugagacugaucugcuucaucgcccugcugaucagcagccuggaggccgacaagugcaaggagagagaggagaagaucauccuggugagcagcgccaacgagaucgacgugagacccugcccccugaaccccaacgagcacaagggcaccaucaccugguacaaggacgacagcaagacccccgugagcaccgagcaggccagcagaauccaccagcacaaggagaagcugugguucgugcccgccaagguggaggacagcggccacuacuacugcguggugagaaacagcagcuacugccugagaaucaagaucagcgccaaguucguggagaacgagcccaaccugugcuacaacgcccaggccaucuucaagcagaaccugcccguggccggcgacggcggccuggugugccccuacauggaguucuucaagaacgagaacaacgagcugcccaagcugcagugguacaaggacugcaagccccugcugcuggacaacauccacuucagcggcgugaaggacagacugaucgugaugaacguggccgagaagcacagaggcaacuacaccugccacgccagcuacaccuaccugggcaagcaguaccccaucaccagagugaucgaguucaucacccuggaggagaacaagcccaccagacccgugaucgugagccccgccaacgagaccauggagguggaccugggcagccagauccagcugaucugcaacgugaccggccagcugagcgacaucgccuacuggaaguggaacggcagcgugaucgacgaggacgaccccgugcugggcgaggacuacuacagcguggagaaccccgccaacaagagaagaagcacccugaucaccgugcugaacaucagcgagaucgagagcagauucuacaagcaccccuucaccugcuucgccaagaacacccacggcaucgacgccgccuacauccagcugaucuaccccgugaccaacuuccagaagcacaugaucggcaucugcgugacccugaccgugaucaucgugugcagcguguucaucuacaagaucuucaagaucgacaucgugcugugguacagagacagcugcuacgacuuccugcccaucaaggccagcgacggcaagaccuacgacgccuacauccuguaccccaagaccgugggcgagggcagcaccagcgacugcgacaucuucguguucaaggugcugcccgaggugcuggagaagcagugcggcuacaagcuguucaucuacggcagagacgacuacgugggcgaggacaucguggaggugaucaacgagaacgugaagaagagcagaagacugaucaucauccuggugagagagaccagcagcuucagcuggcugggcggcagcagcgaggagcagaucgccauguacaacgcccuggugcaggacggcaucaagguggugcugcuggagcuggagaagauccaggacuacgagaagaugcccgagagcaucaaguucaucaagcagaagcacggcgccaucagauggagcggcgacuucacccagggcccccagagcgccaagaccagauucuggaagaacgugagauaccacaugcccgugcagagaagaagccccagcagcaagcaccagcugcugagccccgccaccaaggagaagcugcagagagaggcccacgugccccugggcuga

SEQ ID NO: 8716 - RNA, 1710 nt, Artificial Sequence
  derived and/or modified sequence opt5 from IL-1R1__Homo_sapiens__AAH67508
augaaggugcugcucagacugaucugcuucauugcccuucugaucagcucccucgaggcugacaaauguaaggaacgggaggaaaagauuauccuggucucuagcgccaacgagauugauguucgccccugcccucuuaauccgaacgaacacaagggcaccaucacaugguacaaagacgauuccaagacgcccgugucuaccgagcaggcgagcagaauccaucaacacaaggagaaacugugguuugugccugcuaaggucgaagacuccgggcauuauuacugugugguucgcaauucuagcuauugccuccggauuaaaaucuccgccaaguucguggagaacgaacccaaucuguguuacaacgcccaggcuauuuuuaaacagaaucugccugucgccggagauggcgggcucgugugccccuauauggaguucuuuaagaacgagaauaacgaacugccuaaacuucagugguacaaagacuguaagccgcugcuccuggauaauauccacuucagcggaguuaaagacagacuuauugugaugaacgucgcugagaagcaucggggcaauuauacaugccacgccucuuacaccuaccuggggaaacaauaucccaucacacgcgugauugaauuuaucacccucgaggaaaacaagccuacaagacccgugaucgucuccccugcgaaugagaccauggagguugaucugggaagccagauucagcugaucuguaacgugacgggccagcucucugacauugccuacuggaaauggaacggcuccgugaucgaugaagacgaucccguccugggggaggacuauuacagcguggaaaauccggcuaacaagcggcgcucuacccuuauuacaguucugaauaucuccgagaucgaaagcagauucuauaagcacccuuuuaccugcuucgccaaaaacacacauggaauugacgcugccuacauccaacucauuuaucccgugaccaauuuucagaagcacaugaucggcauuugugucacgcugacagugaucaucguuugcuccguguucauuuacaaaaucuuuaagauugauaucguccuuugguaccgggacucuugcuaugauuuccugccuauuaaagcgagcgacgggaagaccuacgaugccuauauccucuaccccaagacagugggagagggcuccaccagcgacugugauauuuucgucuuuaaagugcugcccgagguucuggaaaagcagugcggguauaaacucuucaucuacggacgcgacgauuaugugggcgaggacaucgucgaagugauuaacgagaauguuaagaaaucuagacggcugaucauuauccuugugcgcgaaaccuccagcuuuucuuggcugggcgggagcuccgaggagcagauugcuauguacaacgcccucguccaagauggaaucaagguggugcugcuugaacuggagaagauccaggacuacgagaaaaugccugaaucuauuaaguucaucaaacagaagcauggcgcuauuagauggagcggggacuuuacacaaggaccgcaguccgccaaaacgcgguucuggaagaauguuagauaucacaugcccguccagcgccggagcccuucuuccaagcaccagcuccugagccccgccaccaaagagaagcugcaaagagaagcucaugugccucucggcuga

SEQ ID NO: 8717 - protein, 569 aa, Artificial Sequence [sequence omitted]

SEQ ID NO: 8718 - RNA, 1710 nt, Artificial Sequence
  IL-1R1__Homo_sapiens__AAH67507
augaaaguguuacucagacuuauuuguuucauagcucuacugauuucuucucuggaggcugauaaaugcaaggaacgugaagaaaaaauaauuuuagugucaucugcaaaugaaauugauguucgucccuguccucuuaacccaaaugaacacaaaggcacuauaacuugguauaaagaugacagcaagacaccuguaucuacagaacaagccuccaggauucaucaacacaaagagaaacuuugguuuguuccugcuaagguggaagauucaggacauuacuauugcgugguaagaaauucaucuuacugccucagaauuaaaauaagugcaaaauuuguggagaaugagccuaacuuauguuauaaugcacaagccauauuuaagcagaaacuacccguugcaggagacggaggacuugugugcccuuauauggaguuuuuuaaaaaugaaaauaaugaguuaccuaaauuacagugguauaaggauugcaaaccucuacuucuugacaauauacacuuuaguggagucaaagauaggcucaucgugaugaauguggcugaaaagcauagagggaacuauacucgucaugcauccuacacauacuugggcaagcaauauccuauuacccggguaauagaauuuauuacucuagaggaaaacaaacccacaaggccugugauugugagcccagcuaaugagacaauggaaguagacuugggaucccagauacaauugaucuguaaugucaccggccaguugagugacauugcuuacuggaaguggaaugggucaguaauugaugaagaugacccagugcuaggggaagacuauuacaguguggagaauccugcaaacaaaagaaggaguacccucaucacagugcuuaauauaucggaaauugaaaguagauuuuauaaacauccauuuaccuguuuugccaagaauacacaugguauagaugcagcauauauccaguuaauauauccagucacuaauuuccagaagcacaugauugguauaugugucacguugacagucauaauuguguguucuguuuucaucuauaaaaucuucaagauugacauugugcuuugguacagggauuccugcuaugauuuucucccaauaaaagcuucagauggaaagaccuaugacgcauauauacuguauccaaagacuguuggggaagggucuaccucugacugugauauuuuuguguuuaaagucuugccuggggucuuggaaaaacaguguggauauaagcuguucauuuauggaagggaugacuacguuggggaagacauuguugaggucauuaaugaaaacguaaagaaaagcagaagacugauuaucauuuuagucagagaaacaucaggcuucagcuggcugggugguucaucugaagagcaaauagccauguauaaugcucuuguucaggacggaauuaaaguuguccugcuugagcuggagaaaauccaagacuaugagaaaaugccagaaucgauuaaauucauuaagcagaaacaugggacuauccgcuggucaggggacuuuacacagggaccacagucugcaaagacaagguucuggaagaaugucagauaccacaugccaguccagcgacggucaccuucaucuaaacaccaguuacugucaccagccacuaaggagaaacugcaaagagaggcucacgugccucucggguag

SEQ ID NO: 8719 - RNA, 1710 nt, Artificial Sequence
  derived and/or modified sequence opt1 from IL-1R1__Homo_sapiens__AAH67507
augaaggugcugcuccgccugaucugcuucaucgcccugcucaucagcucccuggaggccgacaagugcaaggagcgggaggagaagaucauccuggucagcuccgcgaacgagaucgacgugcgccccugcccgcucaaccccaacgagcacaagggcaccaucaccugguacaaggacgacagcaagacgcccguguccaccgagcaggccagccggauccaccagcacaaggagaagcugugguucguccccgccaagguggaggacuccgggcacuacuacugcgugguccgcaacagcuccuacugccugcggaucaagaucagcgccaaguucguggagaacgagccgaaccucugcuacaacgcccaggcgaucuucaagcagaagcugcccguggccggcgacgggggccuggucugccccuacauggaguucuucaagaacgagaacaacgagcuccccaagcugcagugguacaaggacugcaagccgcugcuccuggacaacauccacuucuccggggugaaggaccgccugaucgugaugaacgucgccgagaagcaccggggcaacuacacccgccacgccagcuacaccuaccucggcaagcaguaccccaucacgcgggugaucgaguucaucacccuggaggagaacaagcccacccgccccgugaucgucuccccggcgaacgagaccauggagguggaccuggggagccagauccagcucaucugcaacgugacgggccagcuguccgacaucgccuacuggaaguggaacgggagcgucaucgacgaggacgaccccgugcugggcgaggacuacuacuccguggagaaccccgccaacaagcggcgcagcacccucaucaccguccugaacaucuccgagaucgagagccgguucuacaagcaccccuucacgugcuucgccaagaacacccacgggaucgacgccgcguacauccagcugaucuacccggugaccaacuuccagaagcacaugaucggcaucugcgugacccucaccgucaucaucgugugcagcgucuucaucuacaagaucuucaagaucgacaucgugcugugguaccgcgacuccugcuacgacuuccugcccaucaaggccagcgacggcaagacguacgacgccuacauccucuaccccaagaccgugggggagggcuccaccagcgacugcgacaucuucgucuucaaggugcugcccggggugcuggagaagcagugcggcuacaagcuguucaucuacggccgggacgacuacgucggggaggacaucguggaggugaucaacgagaacgucaagaagucccgccggcucaucaucauccuggugcgcgagaccagcggcuucuccuggcucgggggcagcuccgaggagcagaucgccauguacaacgcccuggugcaggacgggaucaaggucgugcugcucgagcuggagaagauccaggacuacgagaagaugccggagagcaucaaguucaucaagcagaagcacggcacgauccggugguccggcgacuucacccaggggccccagagcgcgaagacccgcuucuggaagaacgugcgguaccacaugcccguccagcgccgcucccccagcuccaagcaccagcugcucagcccggccaccaaggagaagcugcagcgggaggcccacgugccccugggcuga

SEQ ID NO: 8720 - RNA, 1710 nt, Artificial Sequence
  derived and/or modified sequence opt2 from IL-1R1__Homo_sapiens__AAH67507
augaagguccuccuccgccucaucugcuucaucgcccuccucaucuccucccucgaggccgacaagugcaaggagcgcgaggagaagaucauccucgucuccuccgccaacgagaucgacguccgccccugcccccucaaccccaacgagcacaagggcaccaucaccugguacaaggacgacuccaagacccccgucuccaccgagcaggccucccgcauccaccagcacaaggagaagcucugguucguccccgccaaggucgaggacuccggccacuacuacugcgucguccgcaacuccuccuacugccuccgcaucaagaucuccgccaaguucgucgagaacgagcccaaccucugcuacaacgcccaggccaucuucaagcagaagcuccccgucgccggcgacggcggccucgucugccccuacauggaguucuucaagaacgagaacaacgagcuccccaagcuccagugguacaaggacugcaagccccuccuccucgacaacauccacuucuccggcgucaaggaccgccucaucgucaugaacgucgccgagaagcaccgcggcaacuacacccgccacgccuccuacaccuaccucggcaagcaguaccccaucacccgcgucaucgaguucaucacccucgaggagaacaagcccacccgccccgucaucgucucccccgccaacgagaccauggaggucgaccucggcucccagauccagcucaucugcaacgucaccggccagcucuccgacaucgccuacuggaaguggaacggcuccgucaucgacgaggacgaccccguccucggcgaggacuacuacuccgucgagaaccccgccaacaagcgccgcuccacccucaucaccguccucaacaucuccgagaucgagucccgcuucuacaagcaccccuucaccugcuucgccaagaacacccacggcaucgacgccgccuacauccagcucaucuaccccgucaccaacuuccagaagcacaugaucggcaucugcgucacccucaccgucaucaucgucugcuccgucuucaucuacaagaucuucaagaucgacaucguccucugguaccgcgacuccugcuacgacuuccuccccaucaaggccuccgacggcaagaccuacgacgccuacauccucuaccccaagaccgucggcgagggcuccaccuccgacugcgacaucuucgucuucaagguccuccccggcguccucgagaagcagugcggcuacaagcucuucaucuacggccgcgacgacuacgucggcgaggacaucgucgaggucaucaacgagaacgucaagaagucccgccgccucaucaucauccucguccgcgagaccuccggcuucuccuggcucggcggcuccuccgaggagcagaucgccauguacaacgcccucguccaggacggcaucaaggucguccuccucgagcucgagaagauccaggacuacgagaagaugcccgaguccaucaaguucaucaagcagaagcacggcaccauccgcugguccggcgacuucacccagggcccccaguccgccaagacccgcuucuggaagaacguccgcuaccacaugcccguccagcgccgcucccccuccuccaagcaccagcuccucucccccgccaccaaggagaagcuccagcgcgaggcccacgucccccucggcuga

SEQ ID NO: 8721 - RNA, 1710 nt, Artificial Sequence
  derived and/or modified sequence opt3 from IL-1R1__Homo_sapiens__AAH67507
augaaggugcugcucagacuuaucugcuucauugcccuguugauaagcuccuuagaggcugacaaauguaaggaaagggaggagaaaaucauucuggucucuucagcaaacgagaucgauguucggcccugcccucuaaauccaaacgaacacaagggcaccauuacaugguacaaagacgauaguaagacuccggugagcacggagcaggccucccgcauccaucaacacaaggagaaacucugguuuguacccgcgaagguggaagacucugggcauuauuacugugucgugcgaaauucgucauauugccugcguauaaaaaucagcgcuaaguucguugagaacgaaccuaaucuuuguuacaacgcccaggcaauuuuuaaacagaagcugccaguggccggagaugguggcuuggucugccccuauauggaguucuuuaagaaugagaacaaugaacucccuaaacugcagugguacaaggacuguaaaccacugcucuuagauaacauccacuucaguggggugaaggacagacugauuguaaugaauguugcugagaaacauaggggaaacuauacccggcacgcauccuacacauaccuuggcaagcaauaucccaucacucgcgugauagaauuuauuaccuuggaggaaaauaaaccuacaagaccagucaucgugucuccggccaacgagaccauggagguggaucuggguagccagauucagcuaaucugcaaugucacugggcagcucuccgacaucgcuuacuggaaguggaacggaucaguuauugaugaagacgaucccgugcugggcgaggacuauuacaguguagaaaacccugccaauaagaggcggagcacacuuauaaccgugcugaacaucucugagauugaaucccgcuucuauaaacacccauuuacguguuucgcgaagaauacucauggcaucgacgcagccuacauacaauugauuuaucccgucaccaacuuucagaaacacaugaucgggaucugcgugacacucacuguuauuaucguguguucagucuucauuuacaagauauuuaaaaucgauauugugcugugguaccgagacagcugcuaugauuucuuaccuaucaaggcuagugacggaaagaccuacgaugccuauauccuguacccaaaaacaguaggugagggcucuaccuccgacugcgauauuuucguuuuuaaggugcuccccgggguccuugagaaacaguguggauauaagcuguucauauacggcagagacgauuaugugggugaagacaucgucgaggugauuaaugaaaacguuaaaaagagcaggcgguugaucauuauccuagugcgugagacgucgggguuuucuuggcugggaggcuccucagaagaacagauagcaauguacaaugcucucguacaagauggcaucaaggucgugcugcuugagcuggagaaaauucaggacuacgaaaagaugccggaaaguaucaaauucauuaagcagaaacaugggacuauccgcuggagcggagacuuuacacaagguccucaguccgccaagaccagauucuggaagaacguuagguaucacaugcccgugcagcggcgaucuccaagcucaaaacaccaguugcucaguccugcgacuaaggagaaacugcaacgcgaggcccauguccccuuaggcuga

SEQ ID NO: 8722 - RNA, 1710 nt, Artificial Sequence
  derived and/or modified sequence opt4 from IL-1R1__Homo_sapiens__AAH67507
augaaggugcugcugagacugaucugcuucaucgcccugcugaucagcagccuggaggccgacaagugcaaggagagagaggagaagaucauccuggugagcagcgccaacgagaucgacgugagacccugcccccugaaccccaacgagcacaagggcaccaucaccugguacaaggacgacagcaagacccccgugagcaccgagcaggccagcagaauccaccagcacaaggagaagcugugguucgugcccgccaagguggaggacagcggccacuacuacugcguggugagaaacagcagcuacugccugagaaucaagaucagcgccaaguucguggagaacgagcccaaccugugcuacaacgcccaggccaucuucaagcagaagcugcccguggccggcgacggcggccuggugugccccuacauggaguucuucaagaacgagaacaacgagcugcccaagcugcagugguacaaggacugcaagccccugcugcuggacaacauccacuucagcggcgugaaggacagacugaucgugaugaacguggccgagaagcacagaggcaacuacaccagacacgccagcuacaccuaccugggcaagcaguaccccaucaccagagugaucgaguucaucacccuggaggagaacaagcccaccagacccgugaucgugagccccgccaacgagaccauggagguggaccugggcagccagauccagcugaucugcaacgugaccggccagcugagcgacaucgccuacuggaaguggaacggcagcgugaucgacgaggacgaccccgugcugggcgaggacuacuacagcguggagaaccccgccaacaagagaagaagcacccugaucaccgugcugaacaucagcgagaucgagagcagauucuacaagcaccccuucaccugcuucgccaagaacacccacggcaucgacgccgccuacauccagcugaucuaccccgugaccaacuuccagaagcacaugaucggcaucugcgugacccugaccgugaucaucgugugcagcguguucaucuacaagaucuucaagaucgacaucgugcugugguacagagacagcugcuacgacuuccugcccaucaaggccagcgacggcaagaccuacgacgccuacauccuguaccccaagaccgugggcgagggcagcaccagcgacugcgacaucuucguguucaaggugcugcccggcgugcuggagaagcagugcggcuacaagcuguucaucuacggcagagacgacuacgugggcgaggacaucguggaggugaucaacgagaacgugaagaagagcagaagacugaucaucauccuggugagagagaccagcggcuucagcuggcugggcggcagcagcgaggagcagaucgccauguacaacgcccuggugcaggacggcaucaagguggugcugcuggagcuggagaagauccaggacuacgagaagaugcccgagagcaucaaguucaucaagcagaagcacggcaccaucagauggagcggcgacuucacccagggcccccagagcgccaagaccagauucuggaagaacgugagauaccacaugcccgugcagagaagaagccccagcagcaagcaccagcugcugagccccgccaccaaggagaagcugcagagagaggcccacgugccccugggcuga

SEQ ID NO: 8723 - RNA, 1710 nt, Artificial Sequence
  derived and/or modified sequence opt5 from IL-1R1__Homo_sapiens__AAH67507
augaaggugcugcucagacugaucugcuucauugcccuucugaucagcucccucgaggcugacaaauguaaggaacgggaggaaaagauuauccuggucucuagcgccaacgagauugauguucgccccugcccucuuaauccgaacgaacacaagggcaccaucacaugguacaaagacgauuccaagacgcccgugucuaccgagcaggcgagcagaauccaucaacacaaggagaaacugugguuugugccugcuaaggucgaagacuccgggcauuauuacugugugguucgcaauucuagcuauugccuccggauuaaaaucuccgccaaguucguggagaacgaacccaaucuguguuacaacgcccaggcuauuuuuaaacagaagcugccugucgccggagauggcgggcucgugugccccuauauggaguucuuuaagaaugagaacaaugaacugccuaaacuucagugguacaaggacuguaaaccgcugcuccuggauaacauccacuucagcggaguuaaggacagacuuauugugaugaaugucgcugagaaacaucggggcaacuauacacgccacgccucuuacaccuaccuggggaagcaauaucccaucacaagagugauugaauuuaucacccucgaggaaaauaaaccuacacggcccgugaucgucuccccugcgaacgagaccauggagguugaucugggaagccagauucagcugaucugcaaugugacgggccagcucucugacauugccuacuggaaguggaacggcuccgugaucgaugaagacgaucccguccugggggaggacuauuacagcguggaaaacccggcuaauaagcgcagaucuacccuuauuacaguucugaacaucuccgagaucgaaagccgguucuauaaacacccuuuuaccuguuucgccaagaauacacauggaauugacgcugccuacauccaacucauuuaucccgugaccaacuuucagaaacacaugaucggcauuugcgucacgcugacagugaucaucguuuguuccguguucauuuacaagaucuuuaaaauugauaucguccuuugguaccgcgacucuugcuaugauuuccugccuauuaaggcgagcgacgggaagaccuacgaugccuauauccucuaccccaaaacagugggagagggcuccaccagcgacugcgauauuuucgucuuuaaggugcugcccgggguucuggagaaacaguguggauauaaacucuucaucuacggcagagacgauuaugugggcgaagacaucgucgaggugauuaaugaaaacguuaaaaagucucggcgccugaucauuauccuugugagagagaccuccggguuuagcuggcugggaggcucuagcgaagaacagauugcuauguacaaugcccucguccaagaugggaucaagguggugcugcuugagcuggagaaaauccaggacuacgagaagaugccugaauccauuaaauucaucaagcagaaacauggaacaauucgguggucuggcgacuuuacgcaagggccgcagagcgcuaagaccagauucuggaagaacguucgcuaucacaugcccguccagcggagauccccuagcucuaaacaccagcuccugucccccgccacaaaggagaaacugcaacgcgaggcccaugugccucucggauga

SEQ ID NO: 8724 - protein, 85 aa, Artificial Sequence
  IRAK1__Homo_sapiens__L8E7M9
MGPWTACSCCRPAPSQAWAWNRTGRGPKKVMNFRADVFTWADPPNPEVKVLMVRSSHGARVLSTLPAVGVGAHARGGEKEVALLF

SEQ ID NO: 8725 - RNA, 258 nt, Artificial Sequence
  IRAK1__Homo_sapiens__CCQ43144
auggggcccuggacagccugcagcugcugucguccagcucccucccaggcuugggccuggaacaggacaggcaggggcccgaagaaagugaugaauuucagagcugauguguucaccugggcagaucccccaaauccggaagucaaaguucucauggucagaaguucucauggugcacgaguccucagcacucugccggcagugggggugggggcccaugcccgcgggggagagaaggagguggcccugcuguucuag

SEQ ID NO: 8726 - RNA, 258 nt, Artificial Sequence
  derived and/or modified sequence opt1 from IRAK1__Homo_sapiens__CCQ43144
augggccccuggaccgccugcagcugcugccgcccggcccccucccaggcgugggccuggaaccggaccgggcgcggccccaagaaggugaugaacuuccgggccgacgucuucacgugggccgacccgcccaaccccgaggugaaggugcugaugguccgcagcucccacggggcccgggugcucagcacccugcccgcggugggcgucggggcccacgcccgcggcggcgagaaggagguggcccuccuguucuga

SEQ ID NO: 8727 - RNA, 258 nt, Artificial Sequence
  derived and/or modified sequence opt2 from IRAK1__Homo_sapiens__CCQ43144
augggccccuggaccgccugcuccugcugccgccccgcccccucccaggccugggccuggaaccgcaccggccgcggccccaagaaggucaugaacuuccgcgccgacgucuucaccugggccgacccccccaaccccgaggucaagguccucaugguccgcuccucccacggcgcccgcguccucuccacccuccccgccgucggcgucggcgcccacgcccgcggcggcgagaaggaggucgcccuccucuucuga

SEQ ID NO: 8728 - RNA, 258 nt, Artificial Sequence
  derived and/or modified sequence opt3 from IRAK1__Homo_sapiens__CCQ43144
augggccccuggaccgccugcagcuguugcagaccugcuccaucccaggcaugggccuggaacaggacagggcggggaccgaagaaagugaugaauuuccgcgcggacgucuuuacuugggcugaucccccuaacccagagguuaaggugcugaugguacgaucuucacacggugcccgugugcucaguacgcuucccgcagucggcgugggggcccaugcuagaggaggcgaaaaagagguugcacuguuguucuga

SEQ ID NO: 8729 - RNA, 258 nt, Artificial Sequence
  derived and/or modified sequence opt4 from IRAK1__Homo_sapiens__CCQ43144
augggccccuggaccgccugcagcugcugcagacccgcccccagccaggccugggccuggaacagaaccggcagaggccccaagaaggugaugaacuucagagccgacguguucaccugggccgacccccccaaccccgaggugaaggugcugauggugagaagcagccacggcgccagagugcugagcacccugcccgccgugggcgugggcgcccacgccagaggcggcgagaaggagguggcccugcuguucuga

SEQ ID NO: 8730 - RNA, 258 nt, Artificial Sequence
  derived and/or modified sequence opt5 from IRAK1__Homo_sapiens__CCQ43144
augggccccuggaccgccugcagcuguugcagaccugcuccgucccaggccugggcguggaaccggacagggcgcggacccaagaaagugaugaauuucagagcugacgucuuuacgugggccgauccucccaacccugagguuaaggugcugauggugcggucuagccacggcgcccgcguccucuccacccugcccgcuguggggguuggagcccaugcuagaggcggggaaaaagagguggcccuucuguucuga

SEQ ID NO: 8731 - protein, 712 aa, Artificial Sequence
  IRAK1__Homo_sapiens__P51617
MAGGPGPGEPAAPGAQHFLYEVPPWVMCRFYKVMDALEPADWCQFAALIVRDQTELRLCERSGQRTASVLWPWINRNARVADLVHILTHLQLLRARDIITAWHPPAPLPSPGTTAPRPSSIPAPAEAEAWSPRKLPSSASTFLSPAFPGSQTHSGPELGLVPSPASLWPPPPSPAPSSTKPGPESSVSLLQGARPFPFCWPLCEISRGTHNFSEELKIGEGGFGCVYRAVMRNTVYAVKRLKENADLEWTAVKQSFLTEVEQLSRFRHPNIVDFAGYCAQNGFYCLVYGFLPNGSLEDRLHCQTQACPPLSWPQRLDILLGTARAIQFLHQDSPSLIHGDIKSSNVLLDERLTPKLGDFGLARFSRFAGSSPSQSSMVARTQTVRGTLAYLPEEYIKTGRLAVDTDTFSFGVVVLETLAGQRAVKTHGARTKYLKDLVEEEAEEAGVALRSTQSTLQAGLAADAWAAPIAMQIYKKHLDPRPGPCPPELGLGLGQLACCCLHRRAKRRPPMTQVYERLEKLQAVVAGVPGHSEAASCIPPSPQENSYVSSTGRAHSGAAPWQPLAAPSGASAQAAEQLQRGPNQPVESDESLGGLSAALRSWHLTPSCPLDPAPLREAGCPQGDTAGESSWGSGPGSRPTAVEGLALGSSASSSSEPPQIIINPARQKMVQKLALYEDGALDSLQLLSSSSLPGLGLEQDRQGPEESDEFQS

SEQ ID NO: 8732 - RNA, 2139 nt, Artificial Sequence
  IRAK1__Homo_sapiens__AAC08756
auggccggggggccgggcccgggggagcccgcagcccccggcgcccagcacuucuuguacgaggugccgcccugggucaugugccgcuucuacaaagugauggacgcccuggagcccgccgacuggugccaguucgccgcccugaucgugcgcgaccagaccgagcugcggcugugcgagcgcuccgggcagcgcacggccagcguccuguggcccuggaucaaccgcaacgcccguguggccgaccucgugcacauccucacgcaccugcagcugcuccgugcgcgggacaucaucacagccuggcacccucccgccccgcuuccguccccaggcaccacugccccgaggcccagcagcaucccugcacccgccgaggccgaggccuggagcccccggaaguugccauccucagccuccaccuuccucuccccagcuuuuccaggcucccagacccauucagggccugagcucggccuggucccaagcccugcuucccuguggccuccaccgccaucuccagccccuucuucuaccaagccaggcccagagagcucagugucccuccugcagggagcccgccccuuuccguuuugcuggccccucugugagauuucccggggcacccacaacuucucggaggagcucaagaucggggaggguggcuuugggugcguguaccgggcggugaugaggaacacgguguaugcugugaagaggcugaaggagaacgcugaccuggaguggacugcagugaagcagagcuuccugaccgagguggagcagcuguccagguuucgucacccaaacauuguggacuuugcuggcuacugugcucagaacggcuucuacugccugguguacggcuuccugcccaacggcucccuggaggaccgucuccacugccagacccaggccugcccaccucucuccuggccucagcgacuggacauccuucuggguacagcccgggcaauucaguuucuacaucaggacagccccagccucauccauggagacaucaagaguuccaacguccuucuggaugagaggcugacacccaagcugggagacuuuggccuggcccgguucagccgcuuugccggguccagccccagccagagcagcaugguggcccggacacagacagugcggggcacccuggccuaccugcccgaggaguacaucaagacgggaaggcuggcuguggacacggacaccuucagcuuuggggugguagugcuagagaccuuggcuggucagagggcugugaagacgcacggugccaggaccaaguaucugaaagaccugguggaagaggaggcugaggaggcuggaguggcuuugagaagcacccagagcacacugcaagcaggucuggcugcagaugccugggcugcucccaucgccaugcagaucuacaagaagcaccuggaccccaggcccgggcccugcccaccugagcugggccugggccugggccagcuggccugcugcugccugcaccgccgggccaaaaggaggccuccuaugacccagguguacgagaggcuagagaagcugcaggcagugguggcgggggugcccgggcauucggaggccgccagcugcauccccccuuccccgcaggagaacuccuacguguccagcacuggcagagcccacaguggggcugcuccauggcagccccuggcagcgccaucaggagccagugcccaggcagcagagcagcugcagagaggccccaaccagcccguggagagugacgagagccuaggcggccucucugcugcccugcgcuccuggcacuugacuccaagcugcccucuggacccagcaccccucagggaggccggcuguccucagggggacacggcaggagaaucgagcugggggaguggcccaggaucccggcccacagccguggaaggacuggcccuuggcagcucugcaucaucgucgucagagccaccgcagauuaucaucaacccugcccgacagaagaugguccagaagcuggcccuguacgaggauggggcccuggacagccugcagcugcugucguccagcucccucccaggcuugggccuggaacaggacaggcaggggcccgaagaaagugaugaauuucagagcuga

SEQ ID NO: 8733 - RNA, 2139 nt, Artificial Sequence
  derived and/or modified sequence opt1 from IRAK1__Homo_sapiens__AAC08756
auggccggcgggcccggcccgggggagcccgccgcgcccggcgcccagcacuuccuguacgaggugcccccgugggucaugugccgcuucuacaaggugauggacgcccucgagcccgccgacuggugccaguucgccgcgcugaucgugcgggaccagaccgagcugcgccucugcgagcggagcgggcagcgcaccgccuccguccuguggcccuggaucaaccggaacgcccgcguggccgaccuggugcacauccucacgcaccuccagcugcugcgggcgcgcgacaucaucaccgccuggcacccgcccgcgccccugcccagccccggcaccaccgccccgcggcccuccagcauccccgcccccgccgaggccgaggccugguccccgcgcaagcugcccagcuccgccagcacguuccucucccccgccuuccccggcagccagacccacuccgggccggagcugggccugguccccagccccgcgucccucuggcccccgccgcccagccccgcccccuccagcaccaagcccgggcccgaguccagcgugucccugcugcagggcgcccggccguuccccuucugcuggccccucugcgagaucagccgcgggacccacaacuucagcgaggagcugaagaucggcgagggcggguucggcugcguguaccgggccgucaugcgcaacacgguguacgccgugaagcggcugaaggagaacgcggaccucgaguggaccgccgucaagcaguccuuccugaccgagguggagcagcugagccgcuuccggcaccccaacaucguggacuucgccggguacugcgcccagaacggcuucuacugccucgucuacggcuuccugccgaacgggucccuggaggaccgccuccacugccagacccaggccugcccgccccugagcuggccccagcggcuggacauccuccugggcacggcgcgcgccauccaguuccugcaccaggacucccccagccucauccacggggacaucaaguccagcaacgugcugcuggacgagcggcucacccccaagcugggcgacuucgggcuggcccgcuucucccgcuucgccggcagcucccccagccaguccagcaugguggcgcggacccagaccguccgcggcacgcucgccuaccugcccgaggaguacaucaagaccgggcggcuggccguggacaccgacaccuucuccuucggcguggucgugcucgagacgcuggccgggcagcgcgccgugaagacccacggcgcgcggaccaaguaccugaaggaccucgucgaggaggaggccgaggaggccgggguggcccugcgcagcacccaguccacgcugcaggccggccucgcggccgacgccugggccgccccgaucgcgaugcagaucuacaagaagcaccuggacccccggcccggccccugcccgcccgagcuggggcugggccucgggcagcuggccugcugcugccugcaccgccgggccaagcgccggccgcccaugacccaggucuacgagcgccucgagaagcugcaggccgugguggcgggcguccccgggcacagcgaggccgccuccugcaucccgcccagcccccaggagaacagcuacguguccagcaccggccgggcccacuccggcgccgcgcccuggcagccccuggccgcccccagcggggccuccgcccaggcggccgagcagcuccagcgcggcccgaaccagcccguggagagcgacgagucccucgggggccugagcgccgcccugcgguccuggcaccugacccccagcugcccccuggacccggcgccccuccgcgaggccggcugcccccagggggacacggccggcgaguccagcuggggguccggccccgggagccggccgaccgccgucgagggccuggcccugggcuccagcgcguccagcagcuccgagccgccccagaucaucaucaaccccgcccgccagaagauggugcagaagcucgcccuguacgaggacggggcccuggacagccuccagcugcuguccagcuccagccuccccggccuggggcuggagcaggaccggcagggccccgaggaguccgacgaguuccagagcuga

SEQ ID NO: 8734 - RNA, 2139 nt, Artificial Sequence
  derived and/or modified sequence opt2 from IRAK1__Homo_sapiens__AAC08756
auggccggcggccccggccccggcgagcccgccgcccccggcgcccagcacuuccucuacgaggucccccccugggucaugugccgcuucuacaaggucauggacgcccucgagcccgccgacuggugccaguucgccgcccucaucguccgcgaccagaccgagcuccgccucugcgagcgcuccggccagcgcaccgccuccguccucuggcccuggaucaaccgcaacgcccgcgucgccgaccucguccacauccucacccaccuccagcuccuccgcgcccgcgacaucaucaccgccuggcacccccccgccccccuccccucccccggcaccaccgccccccgccccuccuccauccccgcccccgccgaggccgaggccugguccccccgcaagcuccccuccuccgccuccaccuuccucucccccgccuuccccggcucccagacccacuccggccccgagcucggccucguccccucccccgccucccucuggccccccccccccucccccgcccccuccuccaccaagcccggccccgaguccuccgucucccuccuccagggcgcccgccccuuccccuucugcuggccccucugcgagaucucccgcggcacccacaacuucuccgaggagcucaagaucggcgagggcggcuucggcugcgucuaccgcgccgucaugcgcaacaccgucuacgccgucaagcgccucaaggagaacgccgaccucgaguggaccgccgucaagcaguccuuccucaccgaggucgagcagcucucccgcuuccgccaccccaacaucgucgacuucgccggcuacugcgcccagaacggcuucuacugccucgucuacggcuuccuccccaacggcucccucgaggaccgccuccacugccagacccaggccugccccccccucuccuggccccagcgccucgacauccuccucggcaccgcccgcgccauccaguuccuccaccaggacucccccucccucauccacggcgacaucaaguccuccaacguccuccucgacgagcgccucacccccaagcucggcgacuucggccucgcccgcuucucccgcuucgccggcuccucccccucccaguccuccauggucgcccgcacccagaccguccgcggcacccucgccuaccuccccgaggaguacaucaagaccggccgccucgccgucgacaccgacaccuucuccuucggcgucgucguccucgagacccucgccggccagcgcgccgucaagacccacggcgcccgcaccaaguaccucaaggaccucgucgaggaggaggccgaggaggccggcgucgcccuccgcuccacccaguccacccuccaggccggccucgccgccgacgccugggccgcccccaucgccaugcagaucuacaagaagcaccucgacccccgccccggccccugcccccccgagcucggccucggccucggccagcucgccugcugcugccuccaccgccgcgccaagcgccgcccccccaugacccaggucuacgagcgccucgagaagcuccaggccgucgucgccggcguccccggccacuccgaggccgccuccugcaucccccccuccccccaggagaacuccuacgucuccuccaccggccgcgcccacuccggcgccgcccccuggcagccccucgccgcccccuccggcgccuccgcccaggccgccgagcagcuccagcgcggccccaaccagcccgucgaguccgacgagucccucggcggccucuccgccgcccuccgcuccuggcaccucacccccuccugcccccucgaccccgccccccuccgcgaggccggcugcccccagggcgacaccgccggcgaguccuccuggggcuccggccccggcucccgccccaccgccgucgagggccucgcccucggcuccuccgccuccuccuccuccgagcccccccagaucaucaucaaccccgcccgccagaagaugguccagaagcucgcccucuacgaggacggcgcccucgacucccuccagcuccucuccuccuccucccuccccggccucggccucgagcaggaccgccagggccccgaggaguccgacgaguuccaguccuga

SEQ ID NO: 8735 - RNA, 2139 nt, Artificial Sequence
  derived and/or modified sequence opt3 from IRAK1__Homo_sapiens__AAC08756
auggccggcgggcccggaccuggugagccagcugcaccgggcgcccagcacuuccuguacgaagugcccccuugggucaugugcagauuuuauaagguuauggacgcgcucgagccagcugauuggugucaauucgccgcacuuaucgugagggaccagaccgaacugcgguugugcgagcgcagcgggcagcgaacagccuccguauuauggcccuggauuaaccguaaugcuagaguggcagaucugguccauauacuaacucaccuccagcugcuuagggcccgggacaucauuacggcuuggcauccuccagcgccccugccuucuccaggaaccacagccccgcgccccucaaguaucccugcaccagccgaagcugaggccuggagccccagaaaauugccuuccucugcaucgacuuuucucucaccagcuuuccccggcagccaaacccacagugguccggagcuggggcuggugccuucccccgccucucucuggccaccucccccaagccccgcgccuuccucaacaaagccaggaccggaaaguagcguuucuuuacugcagggcgccaggcccuuuccuuucuguuggccacuuugcgagauuucccggggcacccauaacuuuucagaagaguugaaaaucggggagggagguuucggcuguguguaccgcgcagucaugcgaaauacuguguaugcuguaaagagacugaaagaaaacgccgaucuagaguggacagcuguuaagcagagcuuucucaccgaaguggagcagcugaguagguuccggcaccccaauauagucgacuuugccggguacugcgcacaaaacggauucuauugucuuguguacggcuuucugccuaaugguucuuuggaagaucgucuccacugccagacgcaggccuguccaccccuguccuggccgcagcgcuuagacauccugcucgggacugcuagagcgauucaauuccuucaucaggauagcccuucgcugauccacggagacauuaagucuuccaacguguugcuagaugagaggcugaccccaaaacucggcgacuucggccuggcacgguuuucacgauucgccgggaguagccccucccagucuagcauggucgcucgcacacaaacuguuagaggaacccuugccuaucugccugaggaauacaucaagacagguagguuggcaguggauaccgacacguuuucauucggcguagugguccucgagacucuggccgggcagcgggcugugaaaacacauggagcccgcaccaaguacuuaaaagaccugguugaagaggaagcagaggaggcgggcguggcucuaagaaguacucaguccacacuccaggccggucuggcagccgaugcuugggccgcacccauagcuaugcaaauuuauaagaagcaccuugacccaaggccugggcccugcccaccggaauugggccugggacucggccagcuggccuguugcugccuucaccgucgggcgaaacgaagaccucccaugacccaggucuacgagaggcuggaaaaguugcaggccgugguagcugggguuccaggacauagcgaggcagccucuuguauucccccuucaccacaagaaaauaguuaugugagcuccacgggucgcgcucacucuggcgccgcacccuggcagccucucgcggccccgucgggggcuagcgcccaggcagcugagcagcugcaacggggaccaaaccagcccgucgaguccgaugaaucauuaggcggucugagugccgcacuaagaucuuggcaucucaccccuagcugcccacuggaccccgccccucuuagggaggcuggguguccgcagggcgauacagcgggagaauccucauggggcagcgggcccggaucucgcccaacugccguggaggguuuggcacugggcuccagugcuucuagcuccucagagccuccccagaucaucaucaauccagcccgacagaaaaugguccaaaagcucgcccuguacgaagacggggcuuuagauagucugcagcuuuugagcucguccucucucccuggacugggccuagagcaagaccggcagggucccgaagagagcgaugaauuucagucauga

SEQ ID NO: 8736 - RNA, 2139 nt, Artificial Sequence
  derived and/or modified sequence opt4 from IRAK1__Homo_sapiens__AAC08756
auggccggcggccccggccccggcgagcccgccgcccccggcgcccagcacuuccuguacgaggugccccccugggugaugugcagauucuacaaggugauggacgcccuggagcccgccgacuggugccaguucgccgcccugaucgugagagaccagaccgagcugagacugugcgagagaagcggccagagaaccgccagcgugcuguggcccuggaucaacagaaacgccagaguggccgaccuggugcacauccugacccaccugcagcugcugagagccagagacaucaucaccgccuggcacccccccgccccccugcccagccccggcaccaccgcccccagacccagcagcauccccgcccccgccgaggccgaggccuggagccccagaaagcugcccagcagcgccagcaccuuccugagccccgccuuccccggcagccagacccacagcggccccgagcugggccuggugcccagccccgccagccuguggccccccccccccagccccgcccccagcagcaccaagcccggccccgagagcagcgugagccugcugcagggcgccagacccuuccccuucugcuggccccugugcgagaucagcagaggcacccacaacuucagcgaggagcugaagaucggcgagggcggcuucggcugcguguacagagccgugaugagaaacaccguguacgccgugaagagacugaaggagaacgccgaccuggaguggaccgccgugaagcagagcuuccugaccgagguggagcagcugagcagauucagacaccccaacaucguggacuucgccggcuacugcgcccagaacggcuucuacugccugguguacggcuuccugcccaacggcagccuggaggacagacugcacugccagacccaggccugccccccccugagcuggccccagagacuggacauccugcugggcaccgccagagccauccaguuccugcaccaggacagccccagccugauccacggcgacaucaagagcagcaacgugcugcuggacgagagacugacccccaagcugggcgacuucggccuggccagauucagcagauucgccggcagcagccccagccagagcagcaugguggccagaacccagaccgugagaggcacccuggccuaccugcccgaggaguacaucaagaccggcagacuggccguggacaccgacaccuucagcuucggcgugguggugcuggagacccuggccggccagagagccgugaagacccacggcgccagaaccaaguaccugaaggaccugguggaggaggaggccgaggaggccggcguggcccugagaagcacccagagcacccugcaggccggccuggccgccgacgccugggccgcccccaucgccaugcagaucuacaagaagcaccuggaccccagacccggccccugcccccccgagcugggccugggccugggccagcuggccugcugcugccugcacagaagagccaagagaagaccccccaugacccagguguacgagagacuggagaagcugcaggccgugguggccggcgugcccggccacagcgaggccgccagcugcaucccccccagcccccaggagaacagcuacgugagcagcaccggcagagcccacagcggcgccgcccccuggcagccccuggccgcccccagcggcgccagcgcccaggccgccgagcagcugcagagaggccccaaccagcccguggagagcgacgagagccugggcggccugagcgccgcccugagaagcuggcaccugacccccagcugcccccuggaccccgccccccugagagaggccggcugcccccagggcgacaccgccggcgagagcagcuggggcagcggccccggcagcagacccaccgccguggagggccuggcccugggcagcagcgccagcagcagcagcgagcccccccagaucaucaucaaccccgccagacagaagauggugcagaagcuggcccuguacgaggacggcgcccuggacagccugcagcugcugagcagcagcagccugcccggccugggccuggagcaggacagacagggccccgaggagagcgacgaguuccagagcuga

SEQ ID NO: 8737 - RNA, 2139 nt, Artificial Sequence
  derived and/or modified sequence opt5 from IRAK1__Homo_sapiens__AAC08756
auggccggcgggcccggaccuggcgagccggcugcccccggggcgcagcacuuccuguacgaagugccucccugggucaugugcagauuuuauaagguuauggacgcucucgagccugccgauuggugucaauucgccgcucugaucgugcgggaccagaccgaacuucgccugugcgagagaagcggacagcggacagccuccgugcucuggcccuggauuaaccgcaaugcuagagucgccgaucuggugcauauccuuacgcaucugcagcuccugcgggcgcgcgacauuaucaccgccuggcacccuccggcuccccugccuucucccggcacaaccgccccuagacccagcuccauuccggcuccugccgaagcggaggccuggucuccccggaaacucccuagcuccgcuucuacauuucugagccccgccuuccccgggucccaaacccacagcggaccugagcuuggccugguuccgucucccgcuucccucuggccucccccucccagcccggccccuucuuccacaaagcccggcccugaaagcucugugucccugcuucagggggcccgccccuuuccuuucuguuggccccugugcgagaucagcagaggaacccauaacuuuuccgaggagcucaaaaucggcgaagggggauucggcugugucuaccgggcugugaugcgcaauacgguuuaugcggugaagagacugaaagaaaacgccgaucuggaguggaccgcugucaagcagucuuuucucacagaaguggagcagcugagccgguuccgccacccgaauauuguggacuuugccggguacugcgcccaaaacggauucuauugucuugucuacggcuuucugccuaauggcucccucgaagauagacugcacugccagacccaggcuuguccuccccuuagcuggccccagcggcuggacauccuccuggggacagccagagcgauucaauuccugcaucaggauucuccgucccucauccacggagacauuaagagcucuaacguucugcuugaugagcgccugacccccaaacucggcgacuucgggcuggcucgguuuagcagauucgccggauccucuccuagccaguccagcaugguggcccgcacgcaaacagugcggggcacccuugcuuaucugcccgaggaauacaucaagacagggagacucgccgucgauaccgacaccuuuucuuucggagugguugugcuggagacacuggcuggccagcgcgccgucaaaacgcauggcgcgcggaccaaguaccucaaagaccugguggaagaggaagccgaggaggcugggguugcccuuagauccacacagagcacccugcaggcuggacucgccgcggaugccugggcugccccuauugcuaugcaaaucuauaagaagcaccuggacccccgcccuggccccugcccgccugaacuggggcuuggacucggccagcuggccuguugcugccugcaccggagagccaaacgccggcccccuaugacacagguguacgagagacucgaaaagcugcaggcugucguggcggggguccccggccauucugaggccgcuuccuguaucccgccuagcccccaagaaaauuccuaugugucuagcaccggacgggcccacuccggcgccgcuccuuggcagccccuugccgcgcccucuggggcuagcgcccaggccgcugagcagcugcaacgcggaccuaaccagccgguugaguccgaugaaagccucggcgggcugucugccgcgcugagauccuggcaucuuacgcccagcugcccucucgaccccgcuccucugcgggaggccggauguccccagggcgauacagccggggaaucuuccuggggcagcggaccuggcucuagaccgaccgcuguggaggggcuggcccucggaagcuccgcuucuagcuccagcgagcccccucagauuaucauuaaucccgcccgccagaaaaugguccaaaagcuggcgcuuuacgaagacggcgcccuggauucccuccagcugcugucuagcuccucucuuccugggcucggacuggagcaagaccggcagggccccgaagagagcgaugaauuucaguccuga

SEQ ID NO: 8738 - protein, 625 aa, Artificial Sequence
  IRAK2__Homo_sapiens__O43187
MACYIYQLPSWVLDDLCRNMDALSEWDWMEFASYVITDLTQLRKIKSMERVQGVSITRELLWWWGMRQATVQQLVDLLCRLELYRAAQIILNWKPAPEIRCPIPAFPDSVKPEKPLAASVRKAEDEQEEGQPVRMATFPGPGSSPARAHQPAFLQPPEEDAPHSLRSDLPTSSDSKDFSTSIPKQEKLLSLAGDSLFWSEADVVQATDDFNQNRKISQGTFADVYRGHRHGKPFVFKKLRETACSSPGSIERFFQAELQICLRCCHPNVLPVLGFCAARQFHSFIYPYMANGSLQDRLQGQGGSDPLPWPQRVSICSGLLCAVEYLHGLEIIHSNVKSSNVLLDQNLTPKLAHPMAHLCPVNKRSKYTMMKTHLLRTSAAYLPEDFIRVGQLTKRVDIFSCGIVLAEVLTGIPAMDNNRSPVYLKDLLLSDIPSSTASLCSRKTGVENVMAKEICQKYLEKGAGRLPEDCAEALATAACLCLRRRNTSLQEVCGSVAAVEERLRGRETLLPWSGLSEGTGSSSNTPEETDDVDNSSLDASSSMSVAPWAGAATPLLPTENGEGRLRVIVGREADSSSEACVGLEPPQDVTETSWQIEINEAKRKLMENILLYKEEKVDSIELFGP

SEQ ID NO: 8739 - RNA, 1878 nt, Artificial Sequence
  IRAK2__Homo_sapiens__AAI25185
auggccugcuacaucuaccagcugcccuccugggugcuggacgaccugugccgcaacauggacgcgcucagcgagugggacuggauggaguucgccuccuacgugaucacagaccugacccagcugcggaagaucaaguccauggagcgggugcagggugugagcaucacgcgggagcugcuguggugguggggcaugcggcaggccaccguccagcaacuuguggaccuccugugccgccuggagcucuaccgggcugcccagaucauccugaacuggaaaccggcuccugaaaucaggugucccauuccagccuucccugacucugugaagccagaaaagccuuuggcagcuucuguaagaaaggcugaggaugaacaggaagaggggcagccugugaggauggccaccuuuccaggcccaggguccucuccagccagagcccaccagccggccuuucuccagccuccugaagaagaugccccucauuccuugagaagcgaccuccccacuucgucugauucaaaggacuucagcaccuccauuccuaagcaggaaaaacuuuugagcuuggcuggagacagccuuuucuggagugaggcagacgugguccaggcaaccgaugacuucaaucaaaaccgcaaaaucagccaggggaccuuugcugacgucuacagagggcacaggcacgggaagccauucgucuucaagaagcucagagagacagccuguucaaguccaggaucaaucgaaagauucuuccaggcagaguugcagauuugucuuagaugcugccaccccaaugucuuaccugugcugggcuucugugcugcaagacaguuucacagcuucaucuaccccuacauggcaaaugguucccuacaggacagacugcagggucaggguggcucggacccccuccccuggccccagcgugucagcaucugcucagggcugcucugugccgucgaguaccugcauggucuggagaucauccacagcaacgucaagagcucuaaugucuugcuggaccaaaaucucacccccaaacuugcucacccaauggcucaucuguguccugucaacaaaaggucaaaauacaccaugaugaagacucaccugcuccggacgucagccgcguaucugccagaggauuucauccggguggggcagcugacaaagcgaguggacaucuucagcuguggaauaguguuggccgagguccucacgggcaucccugcaauggauaacaaccgaagcccgguuuaccugaaggacuuacuccucagugauauuccaagcagcaccgccucgcucugcuccaggaagacgggcguggagaacgugauggcaaaggagaucugccagaaguaccuggagaagggcgcagggaggcuuccggaggacugcgccgaggcccuggccacggcugccugccugugccugcggaggcguaacaccagccugcaggagguguguggcucuguggcugcuguggaagagcggcuccgaggucgggagacguugcucccuuggagugggcuuucugaggguacaggcucuucuuccaacaccccagaggaaacagacgacguugacaauuccagccuugaugccuccuccuccaugaguguggcacccugggcaggggcugccaccccacuucuccccacagagaauggggaaggaaggcugcgggucaucgugggaagggaggcugacuccuccucugaggccuguguuggccuggagccuccccaggauguuacagaaacuucguggcaaauugagaucaaugaggccaaaaggaaacugauggagaauauucugcucuacaaagaggaaaaaguggacagcauugagcucuuuggccccuga

SEQ ID NO: 8740 - RNA, 1878 nt, Artificial Sequence
  derived and/or modified sequence opt1 from IRAK2__Homo_sapiens__AAI25185
auggccugcuacaucuaccagcugcccagcugggugcucgacgaccugugccgcaacauggacgcccuguccgagugggacuggauggaguucgcgagcuacgucaucaccgaccucacccagcugcggaagaucaaguccauggagcgcgugcagggcgugagcaucacgcgggagcugcucugguggugggggaugcgccaggccaccguccagcagcugguggaccugcucugccggcuggagcuguaccgcgccgcccagaucauccucaacuggaagccggcccccgagauccggugccccauccccgcguucccggacuccgugaagcccgagaagccccuggccgccagcguccgcaaggccgaggacgagcaggaggagggccagcccgugcggauggcgaccuucccggggcccggcuccagccccgcccgcgcccaccagcccgccuuccugcagccgcccgaggaggacgcgccccacucccuccggagcgaccugcccaccuccagcgacuccaaggacuucagcacguccaucccgaagcaggagaagcugcucagccuggccggggacucccuguucuggagcgaggccgacgugguccaggccaccgacgacuucaaccagaaccgcaagaucucccagggcaccuucgccgacguguaccggggccaccgccacgggaagcccuucguguucaagaagcuccgggagaccgccugcagcagccccggcuccaucgagcgcuucuuccaggcggagcugcagaucugccugcggugcugccaccccaacguccucccggugcugggguucugcgccgcccgccaguuccacagcuucaucuaccccuacauggccaacggcucccugcaggaccggcuccaggggcagggcggcagcgacccccugcccuggccgcagcgcguguccaucugcagcgggcugcucugcgccgucgaguaccugcacggccuggagaucauccacuccaacgucaagagcuccaacgugcuccuggaccagaaccugacgcccaagcucgcgcaccccauggcccaccugugccccgugaacaagcggagcaaguacaccaugaugaagacccaccuccuccgcaccuccgccgccuaccugccggaggacuucauccgcguggggcagcugacgaagcggguggacaucuucagcugcggcaucguccucgccgaggugcugaccggcauccccgcgauggacaacaaccgcucccccguguaccugaaggaccuccugcugagcgacaucccguccagcaccgccucccucugcagccggaagaccggggucgagaacgugauggccaaggagaucugccagaaguaccuggagaagggcgccgggcgccugcccgaggacugcgcggaggcccuggccacggccgccugccucugccugcggcgccggaacaccucccugcaggaggucugcggcagcguggcggccguggaggagcgccuccgggggcgcgagacccugcugcccuggagcggccucuccgagggcaccgggagcuccagcaacacgcccgaggagaccgacgacgucgacaacuccagccuggacgccuccagcuccaugagcguggccccgugggccggcgcggccacgccccugcuccccaccgagaacggggagggccggcugcgcgugaucgucgggcgggaggccgacuccagcuccgaggccugcgugggccuggagcccccgcaggacgugaccgagaccagcuggcagaucgagaucaacgaggccaagcgcaagcucauggagaacauccugcuguacaaggaggagaaggucgacuccaucgagcuguucggccccuga

SEQ ID NO: 8741 - RNA, 1878 nt, Artificial Sequence
  derived and/or modified sequence opt2 from IRAK2__Homo_sapiens__AAI25185
auggccugcuacaucuaccagcuccccuccuggguccucgacgaccucugccgcaacauggacgcccucuccgagugggacuggauggaguucgccuccuacgucaucaccgaccucacccagcuccgcaagaucaaguccauggagcgcguccagggcgucuccaucacccgcgagcuccucuggugguggggcaugcgccaggccaccguccagcagcucgucgaccuccucugccgccucgagcucuaccgcgccgcccagaucauccucaacuggaagcccgcccccgagauccgcugccccauccccgccuuccccgacuccgucaagcccgagaagccccucgccgccuccguccgcaaggccgaggacgagcaggaggagggccagcccguccgcauggccaccuuccccggccccggcuccucccccgcccgcgcccaccagcccgccuuccuccagccccccgaggaggacgccccccacucccuccgcuccgaccuccccaccuccuccgacuccaaggacuucuccaccuccauccccaagcaggagaagcuccucucccucgccggcgacucccucuucugguccgaggccgacgucguccaggccaccgacgacuucaaccagaaccgcaagaucucccagggcaccuucgccgacgucuaccgcggccaccgccacggcaagcccuucgucuucaagaagcuccgcgagaccgccugcuccucccccggcuccaucgagcgcuucuuccaggccgagcuccagaucugccuccgcugcugccaccccaacguccuccccguccucggcuucugcgccgcccgccaguuccacuccuucaucuaccccuacauggccaacggcucccuccaggaccgccuccagggccagggcggcuccgacccccuccccuggccccagcgcgucuccaucugcuccggccuccucugcgccgucgaguaccuccacggccucgagaucauccacuccaacgucaaguccuccaacguccuccucgaccagaaccucacccccaagcucgcccaccccauggcccaccucugccccgucaacaagcgcuccaaguacaccaugaugaagacccaccuccuccgcaccuccgccgccuaccuccccgaggacuucauccgcgucggccagcucaccaagcgcgucgacaucuucuccugcggcaucguccucgccgagguccucaccggcauccccgccauggacaacaaccgcucccccgucuaccucaaggaccuccuccucuccgacauccccuccuccaccgccucccucugcucccgcaagaccggcgucgagaacgucauggccaaggagaucugccagaaguaccucgagaagggcgccggccgccuccccgaggacugcgccgaggcccucgccaccgccgccugccucugccuccgccgccgcaacaccucccuccaggaggucugcggcuccgucgccgccgucgaggagcgccuccgcggccgcgagacccuccuccccugguccggccucuccgagggcaccggcuccuccuccaacacccccgaggagaccgacgacgucgacaacuccucccucgacgccuccuccuccauguccgucgcccccugggccggcgccgccaccccccuccuccccaccgagaacggcgagggccgccuccgcgucaucgucggccgcgaggccgacuccuccuccgaggccugcgucggccucgagcccccccaggacgucaccgagaccuccuggcagaucgagaucaacgaggccaagcgcaagcucauggagaacauccuccucuacaaggaggagaaggucgacuccaucgagcucuucggccccuga

SEQ ID NO: 8742 - RNA, 1878 nt, Artificial Sequence
  derived and/or modified sequence opt3 from IRAK2__Homo_sapiens__AAI25185
auggccugcuacaucuaucagcugcccagcugggugcucgacgaucuuuguagaaacauggacgcucuguccgagugggauuggauggaauuugcaucuuacgucauuaccgacuugacacaauuaaggaagauaaaaucaauggagcggguucagggcgugaguaucacucgcgaacugcuaugguggugggggaugcgacaggccacgguacagcaacucguggaucugcuuugccgucuggaguuguauagagcggcucagauuauccucaauuggaagccugccccagaaauuagguguccgauccccgcauuuccugacagcgucaaaccagagaagccccuggccgcuuccgugcggaaagcagaggaugaacaggaggaaggacagccuguucgcauggccaccuucccaggucccgggucuucgccugcuagagcccaccaaccagcguuucugcagccgcccgaggaggacgcaccucauucacucaggagcgauuuaccaacaaguuccgacucuaaggauuucagcacuuccauacccaagcaggaaaaacugcuuucauuggccggcgacagucuguuuuggagcgaggcugaugugguccaggccaccgacgacuucaaccaaaaucggaagaucucucagggaacauuugcagauguguaccgcggccaccgacaugguaaaccuuucguauuuaagaaacuaagagaaaccgcuugcuccucaccagggagcauugagagguucuuucaggccgaacuccaaaucugucugcggugcugucaccccaacguucuuccggugcugggauucugcgcggcccgucaguuucauaguuucauuuauccuuacauggcaaauggcucuuugcaggaccgccuccagggccaagggggauccgauccccugccauggccucagagagucagcaucuguucggguuuacugugcgcuguggaguaucuccacggccuugagauaauucacucuaacgugaaguccucaaauguccuguuggaccagaaccuaacucccaagcuggcccauccaauggcucaccucugucccguuaauaaaaggaguaaguacacaaugaugaaaacccaucugcuucggacgagcgccgcauaccugccugaagauuucauccgaguggggcaguugacuaagcgcguagacauuuucuccugcggaaucgugcucgccgagguccugaccggcaucccagcuauggauaacaauagaucuccgguguauuuaaaagaccugcuacucagcgauauucccucaaguacagcgucccugugcagcaggaagacugguguugaaaacgugauggcaaaagagauaugucaaaaguaccuugaaaagggggccggacgguugccugaggacugcgcugaggcccuggcaaccgccgcuugucucugccugcgcagaaggaauacaucucuucaggaagucuguggcucaguggccgcaguagaggaacgucugcggggccgagagaccuugcucccauggagugggcugagcgaaggaacggguuccucuucgaacacucccgaggagacagaugacguugacaauagcuccuuagaugcgucaaguucuaugagcguggcuccuugggccggcgcagccaccccacugcuacccacugaaaacggggagggaagacucagggucaucgugggccgcgaagcugacuccucaagcgaggccugcgucggucuggagccgccucaggaugugacagaaaccucuuggcagauugagaucaacgaagcaaaacggaagcucauggagaauauauugcuguauaaagaagagaagguugacuccauugagcuuuucgggccauga

SEQ ID NO: 8743 - RNA, 1878 nt, Artificial Sequence
  derived and/or modified sequence opt4 from IRAK2__Homo_sapiens__AAI25185
auggccugcuacaucuaccagcugcccagcugggugcuggacgaccugugcagaaacauggacgcccugagcgagugggacuggauggaguucgccagcuacgugaucaccgaccugacccagcugagaaagaucaagagcauggagagagugcagggcgugagcaucaccagagagcugcuguggugguggggcaugagacaggccaccgugcagcagcugguggaccugcugugcagacuggagcuguacagagccgcccagaucauccugaacuggaagcccgcccccgagaucagaugccccauccccgccuuccccgacagcgugaagcccgagaagccccuggccgccagcgugagaaaggccgaggacgagcaggaggagggccagcccgugagaauggccaccuuccccggccccggcagcagccccgccagagcccaccagcccgccuuccugcagccccccgaggaggacgccccccacagccugagaagcgaccugcccaccagcagcgacagcaaggacuucagcaccagcauccccaagcaggagaagcugcugagccuggccggcgacagccuguucuggagcgaggccgacguggugcaggccaccgacgacuucaaccagaacagaaagaucagccagggcaccuucgccgacguguacagaggccacagacacggcaagcccuucguguucaagaagcugagagagaccgccugcagcagccccggcagcaucgagagauucuuccaggccgagcugcagaucugccugagaugcugccaccccaacgugcugcccgugcugggcuucugcgccgccagacaguuccacagcuucaucuaccccuacauggccaacggcagccugcaggacagacugcagggccagggcggcagcgacccccugcccuggccccagagagugagcaucugcagcggccugcugugcgccguggaguaccugcacggccuggagaucauccacagcaacgugaagagcagcaacgugcugcuggaccagaaccugacccccaagcuggcccaccccauggcccaccugugccccgugaacaagagaagcaaguacaccaugaugaagacccaccugcugagaaccagcgccgccuaccugcccgaggacuucaucagagugggccagcugaccaagagaguggacaucuucagcugcggcaucgugcuggccgaggugcugaccggcauccccgccauggacaacaacagaagccccguguaccugaaggaccugcugcugagcgacauccccagcagcaccgccagccugugcagcagaaagaccggcguggagaacgugauggccaaggagaucugccagaaguaccuggagaagggcgccggcagacugcccgaggacugcgccgaggcccuggccaccgccgccugccugugccugagaagaagaaacaccagccugcaggaggugugcggcagcguggccgccguggaggagagacugagaggcagagagacccugcugcccuggagcggccugagcgagggcaccggcagcagcagcaacacccccgaggagaccgacgacguggacaacagcagccuggacgccagcagcagcaugagcguggcccccugggccggcgccgccaccccccugcugcccaccgagaacggcgagggcagacugagagugaucgugggcagagaggccgacagcagcagcgaggccugcgugggccuggagcccccccaggacgugaccgagaccagcuggcagaucgagaucaacgaggccaagagaaagcugauggagaacauccugcuguacaaggaggagaagguggacagcaucgagcuguucggccccuga

SEQ ID NO: 8744 - RNA, 1878 nt, Artificial Sequence
  derived and/or modified sequence opt5 from IRAK2__Homo_sapiens__AAI25185
auggccugcuacaucuaucagcugcccagcugggugcucgacgaucuguguagaaacauggacgcucuuuccgagugggauuggauggaguucgccucuuacgucauuaccgaccugacacaacuccggaagaucaaaagcauggaacgcguucagggcguguccauuacgagagaacugcuuugguggugggggaugcggcaggcgaccgugcagcaacuggucgaucuccugugccgccuggagcucuauagagcugcccagaucauucugaauuggaagccugccccggaaauccggugucccaucccugcuuuucccgacucugugaaaccugagaagccccuugccgcuagcguucgcaaagccgaggaugaacaggaggaaggacagccugugagaauggcgacauucccgggccccggguccucuccugcccgggcucaccaacccgccuuucugcagccucccgaggaggacgcuccgcauagccuccgcuccgaucugccuaccagcucugacuccaaggauuucagcacaucuauucccaagcaggaaaaacuucugucccucgccggagacagccuguuuuggucugaggcggaugucgugcaggccaccgacgacuucaaccaaaauagaaagaucucccagggcacauuugcugauguuuaccgggggcaccgccauggaaaaccuuucguguuuaagaaacugagagaaaccgccugcagcucccccggcucuauugagcgguucuuucaggcugaacuccaaaucugucugcgcugcugucaccccaacguccuuccugugcugggcuucugcgccgccagacaguuucauagcuucauuuauccguacauggcuaaugggucccuccaggaccggcugcagggacaaggcgggagcgauccccuuccuuggccccagagagugucuaucuguuccggacugcucugcgcggucgaguaucugcacggccuggagauuauccacagcaacguuaagucuagcaaugugcuccuggaccagaaccuuacgccuaagcuggcccaucccauggcucaccucuguccggugaauaaacgcuccaaguacaccaugaugaaaacacaucugcuucggaccucugccgccuaccugccugaagauuucaucagagucgggcagcucacaaagcgcguggacauuuuuagcugcggaaucguucuggcugaggugcugaccggcauucccgccauggauaacaaucgguccccugucuaucucaaagaccugcuucugagcgauauccccucuuccacggcgagccucugcucuagaaagacaggcguggaaaacguuauggcuaaagagauuugucaaaaguaccuggaaaagggggccggacgccugccugaggacugcgccgaggcucuugccaccgcugccugucucugccugcggagacgcaauacaucccugcaggaaguguguggcagcgucgcggccguggaggaacggcucagagggcgcgagacccugcuucccugguccggacugucugaaggcaccgggagcuccucuaacacaccggaggagacggaugacgucgacaauagcucccucgaugcuucuagcuccaugagcguggccccuugggcuggagccgcgacaccccugcugcccaccgaaaacggcgagggccggcuuagaguuaucguggggcgggaagccgacucuuccagcgaggcuugcgucggacucgagccuccgcaggaugugaccgaaacaucuuggcagaucgagauuaacgaagccaaacgcaagcugauggagaauauccugcucuauaaagaagagaagguugacagcauugagcuguucggccccuga

SEQ ID NO: 8745 - protein, 460 aa, Artificial Sequence
  IRAK4__Homo_sapiens__Q69FE3
MNKPITPSTYVRCLNVGLIRKLSDFIDPQEGWKKLAVAIKKPSGDDRYNQFHIRRFEALLQTGKSPTSELLFDWGTTNCTVGDLVDLLIQNEFFAPASLLLPDAVPKTANTLPSKEAITVQQKQMPFCDKDRTLMTPVQNLEQSYMPPDSSSPENKSLEVSDTRFHSFSFYELKNVTNNFDERPISVGGNKMGEGGFGVVYKGYVNNTTVAVKKLAAMVDITTEELKQQFDQEIKVMAKCQHENLVELLGFSSDGDDLCLVYVYMPNGSLLDRLSCLDGTPPLSWHMRCKIAQGAANGINFLHENHHIHRDIKSANILLDEAFTAKISDFGLARASEKFAQTVMTSRIVGTTAYMAPEALRGEITPKSDIYSFGVVLLEIITGLPAVDEHREPQLLLDIKEEIEDEEKTIEDYIDKKMNDADSTSVEAMYSVASQCLHEKKNKRPDIKKVQQLLQEMTAS

SEQ ID NO: 8746 - RNA, 1383 nt, Artificial Sequence
  IRAK4__Homo_sapiens__AAR02358
augaacaaacccauaacaccaucaacauaugugcgcugccucaauguuggacuaauuaggaagcugucagauuuuauugauccucaagaaggauggaagaaguuagcuguagcuauuaaaaaaccaucuggugaugauagauacaaucaguuucacauaaggagauuugaagcauuacuucaaacuggaaaaagucccacuucugaauuacuguuugacuggggcaccacaaauugcacaguuggugaucuuguggaucuuuugauccaaaaugaauuuuuugcuccugcgagucuuuugcucccagaugcuguucccaaaacugcuaauacacuaccuucuaaagaagcuauaacaguucagcaaaaacagaugccuuucugugacaaagacaggacauugaugacaccugugcagaaucuugaacaaagcuauaugccaccugacuccucaaguccagaaaauaaaaguuuagaaguuagugauacacguuuucacaguuuuucauuuuaugaauugaagaaugucacaaauaacuuugaugaacgacccauuucuguuggugguaauaaaaugggagagggaggauuuggaguuguauauaaaggcuacguaaauaacacaacuguggcagugaagaagcuugcagcaaugguugacauuacuacugaagaacugaaacagcaguuugaucaagaaauaaaaguaauggcaaagugucaacaugaaaacuuaguagaacuacuugguuucucaagugauggagaugaccucugcuuaguauauguuuacaugccuaaugguucauugcuagacagacucucuugcuuggaugguacuccaccacuuucuuggcacaugagaugcaagauugcucagggugcagcuaauggcaucaauuuucuacaugaaaaucaucauauucauagagauauuaaaagugcaaauaucuuacuggaugaagcuuuuacugcuaaaauaucugacuuuggccuugcacgggcuucugagaaguuugcccagacagucaugacuagcagaauugugggaacaacagcuuauauggcaccagaagcuuugcguggagaaauaacacccaaaucugauauuuacagcuuuggugugguuuuacuagaaauaauaacuggacuuccagcuguggaugaacaccgugaaccucaguuauugcuagauauuaaagaagaaauugaagaugaagaaaagacaauugaagauuauauugauaaaaagaugaaugaugcugauuccacuucaguugaagcuauguacucuguugcuagucaaugucugcaugaaaagaaaaauaagagaccagacauuaagaagguucaacagcugcugcaagagaugacagcuucuuaa

SEQ ID NO: 8747 - RNA, 1383 nt, Artificial Sequence
  derived and/or modified sequence opt1 from IRAK4__Homo_sapiens__AAR02358
augaacaagcccaucaccccgagcaccuacgugcgcugccugaacgucggccucauccggaagcuguccgacuucaucgacccccaggagggguggaagaagcuggccguggccaucaagaagcccagcggcgacgaccgcuacaaccaguuccacauccggcgcuucgaggcgcuccugcagacggggaagucccccaccagcgagcuccuguucgacuggggcaccaccaacugcacggugggggaccuggucgaccugcucauccagaacgaguucuucgccccggccucccugcugcuccccgacgccgugcccaagaccgccaacacccugcccagcaaggaggcgaucaccgugcagcagaagcagaugccguucugcgacaaggaccggacgcugaugacccccguccagaaccucgagcaguccuacaugccgcccgacagcuccagccccgagaacaagucccuggaggugagcgacacccgcuuccacuccuucagcuucuacgagcugaagaacgugaccaacaacuucgacgagcggcccaucuccgucggcggcaacaagaugggggagggcggguucggcgugguguacaagggguacgucaacaacacgaccguggccgugaagaagcucgccgccauggucgacaucaccaccgaggagcugaagcagcaguucgaccaggagaucaaggugauggcgaagugccagcacgagaaccugguggagcuccugggcuucagcuccgacggcgacgaccugugccucgucuacguguacaugcccaacgggagccugcuggaccgccucuccugccuggacggcacgcccccgcugagcuggcacaugcggugcaagaucgcccagggggccgccaacggcaucaacuuccuccacgagaaccaccacauccaccgcgacaucaagagcgccaacauccugcuggacgaggcguucaccgccaagaucuccgacuucggccucgcccgggccagcgagaaguucgcccagaccgugaugaccucccgcaucgucgggacgaccgcguacauggcccccgaggcccugcggggcgagaucacccccaagagcgacaucuacuccuucgggguggugcugcucgagaucaucaccggccugcccgccgucgacgagcaccgcgagccgcagcugcuccuggacaucaaggaggagaucgaggacgaggagaagacgaucgaggacuacaucgacaagaagaugaacgacgccgacagcaccuccguggaggcgauguacagcgucgccucccagugccugcacgagaagaagaacaagcggcccgacaucaagaaggugcagcagcuccugcaggagaugaccgccagcuga

SEQ ID NO: 8748 - RNA, 1383 nt, Artificial Sequence
  derived and/or modified sequence opt2 from IRAK4__Homo_sapiens__AAR02358
augaacaagcccaucacccccuccaccuacguccgcugccucaacgucggccucauccgcaagcucuccgacuucaucgacccccaggagggcuggaagaagcucgccgucgccaucaagaagcccuccggcgacgaccgcuacaaccaguuccacauccgccgcuucgaggcccuccuccagaccggcaagucccccaccuccgagcuccucuucgacuggggcaccaccaacugcaccgucggcgaccucgucgaccuccucauccagaacgaguucuucgcccccgccucccuccuccuccccgacgccguccccaagaccgccaacacccuccccuccaaggaggccaucaccguccagcagaagcagaugcccuucugcgacaaggaccgcacccucaugacccccguccagaaccucgagcaguccuacaugccccccgacuccuccucccccgagaacaagucccucgaggucuccgacacccgcuuccacuccuucuccuucuacgagcucaagaacgucaccaacaacuucgacgagcgccccaucuccgucggcggcaacaagaugggcgagggcggcuucggcgucgucuacaagggcuacgucaacaacaccaccgucgccgucaagaagcucgccgccauggucgacaucaccaccgaggagcucaagcagcaguucgaccaggagaucaaggucauggccaagugccagcacgagaaccucgucgagcuccucggcuucuccuccgacggcgacgaccucugccucgucuacgucuacaugcccaacggcucccuccucgaccgccucuccugccucgacggcacccccccccucuccuggcacaugcgcugcaagaucgcccagggcgccgccaacggcaucaacuuccuccacgagaaccaccacauccaccgcgacaucaaguccgccaacauccuccucgacgaggccuucaccgccaagaucuccgacuucggccucgcccgcgccuccgagaaguucgcccagaccgucaugaccucccgcaucgucggcaccaccgccuacauggcccccgaggcccuccgcggcgagaucacccccaaguccgacaucuacuccuucggcgucguccuccucgagaucaucaccggccuccccgccgucgacgagcaccgcgagccccagcuccuccucgacaucaaggaggagaucgaggacgaggagaagaccaucgaggacuacaucgacaagaagaugaacgacgccgacuccaccuccgucgaggccauguacuccgucgccucccagugccuccacgagaagaagaacaagcgccccgacaucaagaagguccagcagcuccuccaggagaugaccgccuccuga

SEQ ID NO: 8749 - RNA, 1383 nt, Artificial Sequence
  derived and/or modified sequence opt3 from IRAK4__Homo_sapiens__AAR02358
augaacaagcccaucaccccuagcacauacgugagaugccugaaugucggccucauuaggaaacuuuccgacuucauagauccacaggagggguggaagaaacuggccguugcuaucaagaaaccgucuggagacgaucgguauaaccaauuucacauucgccgauucgaagcauuguuacagacugguaagucacccacgagugagcugcuauuugacuggggcaccacaaauuguacugugggggaucucguagaccugcuuauccagaacgaguucuuugccccugcgagccuguugcucccagaugcugugcccaagaccgccaauacacugccuuccaaagaagcaauuaccguccagcaaaagcagaugccauucugcgacaaagaucguacucugaugacacccgugcagaaccucgaacagucuuacaugccuccagacucgucaagcccggagaauaagaguuuagagguuuccgauaccagauuucauucuuucagcuuuuaugaacugaaaaacgugacgaauaacuucgacgagaggcccaucuccgucggaggcaauaagaugggugaagggggauuuggcgugguauacaagggcuauguuaacaauacuaccguggccgucaaaaaguuggcugcaaugguggauauaacaacugaggagcuuaaacaacaguucgaccaggaaaucaaggugauggccaaaugucagcacgagaaccuggucgaacuacucggguuuucaagugacggagaugaccugugccuuguuuacguguauaugccuaaugguagccuguuggaucggcucucuugucuggacggcaccccacccuuauccuggcauaugcgcugcaagauugcucaaggggccgcgaacggaaucaacuuccugcacgagaaucaucacauucacagagauaucaaaucagcaaacauacuccuugacgaagccuucacagcuaagauuagcgauuuuggccuggccagggcaagugagaaguucgcucagaccguaaugacgucucggaucguggguacuacagccuacauggcgccugaggccuugcgcggggaaauuaccccaaaauccgacaucuacagcuuuggagucgugcuacuggagaucauuacuggccuccccgcaguugaugaacaucgagagccgcagcugcuucuggacauaaaggaagagaucgaggaugaagagaaaacaauugaagacuauaucgacaagaaaaugaaugaugcugacucgaccucuguggaggccauguacuccgucgcuucacaauguuugcacgaaaagaagaacaaaagaccugauauaaagaaagugcagcagcuccugcaggagaugacggccaguuga

SEQ ID NO: 8750 - RNA, 1383 nt, Artificial Sequence
  derived and/or modified sequence opt4 from IRAK4__Homo_sapiens__AAR02358
augaacaagcccaucacccccagcaccuacgugagaugccugaacgugggccugaucagaaagcugagcgacuucaucgacccccaggagggcuggaagaagcuggccguggccaucaagaagcccagcggcgacgacagauacaaccaguuccacaucagaagauucgaggcccugcugcagaccggcaagagccccaccagcgagcugcuguucgacuggggcaccaccaacugcaccgugggcgaccugguggaccugcugauccagaacgaguucuucgcccccgccagccugcugcugcccgacgccgugcccaagaccgccaacacccugcccagcaaggaggccaucaccgugcagcagaagcagaugcccuucugcgacaaggacagaacccugaugacccccgugcagaaccuggagcagagcuacaugccccccgacagcagcagccccgagaacaagagccuggaggugagcgacaccagauuccacagcuucagcuucuacgagcugaagaacgugaccaacaacuucgacgagagacccaucagcgugggcggcaacaagaugggcgagggcggcuucggcgugguguacaagggcuacgugaacaacaccaccguggccgugaagaagcuggccgccaugguggacaucaccaccgaggagcugaagcagcaguucgaccaggagaucaaggugauggccaagugccagcacgagaaccugguggagcugcugggcuucagcagcgacggcgacgaccugugccugguguacguguacaugcccaacggcagccugcuggacagacugagcugccuggacggcacccccccccugagcuggcacaugagaugcaagaucgcccagggcgccgccaacggcaucaacuuccugcacgagaaccaccacauccacagagacaucaagagcgccaacauccugcuggacgaggccuucaccgccaagaucagcgacuucggccuggccagagccagcgagaaguucgcccagaccgugaugaccagcagaaucgugggcaccaccgccuacauggcccccgaggcccugagaggcgagaucacccccaagagcgacaucuacagcuucggcguggugcugcuggagaucaucaccggccugcccgccguggacgagcacagagagccccagcugcugcuggacaucaaggaggagaucgaggacgaggagaagaccaucgaggacuacaucgacaagaagaugaacgacgccgacagcaccagcguggaggccauguacagcguggccagccagugccugcacgagaagaagaacaagagacccgacaucaagaaggugcagcagcugcugcaggagaugaccgccagcuga

SEQ ID NO: 8751 - RNA, 1383 nt, Artificial Sequence
  derived and/or modified sequence opt5 from IRAK4__Homo_sapiens__AAR02358
augaacaagcccaucaccccuagcacauacgugagaugccugaaugucggccucauucggaaacuguccgacuucaucgauccgcaggagggguggaagaaacuugccguugcuauuaagaaacccucuggagacgaucgcuauaaccaauuucacaucagacgguucgaagcccugcuccagacgggcaagagcccuaccuccgagcugcuuuuugacugggggacaaccaauuguacagugggagaucugguggaccuccugauucagaacgaguucuuugcgcccgcuucucugcuccugccugaugccguccccaagaccgccaauacacuuccuagcaaagaagcuaucaccgugcagcaaaagcagaugccguucugcgacaaagaucgcacgcugaugacccccguucagaaccucgaacaguccuacaugccucccgacucuagcuccccugagaauaagagccuggaggugucugauacaagauuucauuccuucagcuuuuaugaacuuaaaaacgucaccaauaacuucgacgagcggcccaucucugugggcgggaauaagaugggagaaggcggcuuugggguuguguacaagggauaugucaacaauacaaccguggccgugaaaaagcuggcugccauggucgauauuacgacagaggagcucaaacaacaguucgaccaggaaaucaagguuauggcgaaaugucagcacgagaaccugguggaacugcucggcuuuuccagcgacggggaugaccugugccuuguguacgucuauaugccgaauggaucucugcucgaucgccuguccugucuugacggcaccccuccccugagcuggcauaugagaugcaagauugcccaaggggcugccaacggaaucaacuuccuccacgagaaucaucacauucaccgggauaucaaauccgcuaacauucugcuggacgaagccuucacagcgaagaucucugauuuuggccucgcccgcgcuagcgagaaguucgcccagaccgugaugaccuccagaaucguuggcacaacggcuuacauggccccugaggcccugcgcggggaaauuacccccaaaagcgacaucuacucuuuuggagugguccuucuggagauuaucacaggccuccccgcuguggaugaacaucgggagccucagcugcuucuggacauuaaggaagagaucgaggaugaagagaaaaccaucgaagacuauauugacaagaaaaugaaugaugcggacuccacaagcguugaggccauguacucuguggcuagccaaugucuccacgaaaagaagaacaaaagaccggauaucaagaaaguccagcagcugcugcaggagaugaccgccuccuga

SEQ ID NO: 8752 - protein, 218 aa, Artificial Sequence [sequence omitted]

SEQ ID NO: 8753 - RNA, 657 nt, Artificial Sequence
  IRAK4__Homo_sapiens__AAP57090
augaacaaacccauaacaccaucaacauaugugcgcugccucaauguuggacuaauuaggaagcugucagauuuuauugauccucaagaaggauggaagaaguuagcuguagcuauuaaaaaaccaucuggugaugauagauacaaucaguuucacauaaggagauuugaagcauuacuucaaacuggaaaaagucccacuucugaauuacuguuugacuggggcaccacaaauugcacagcuggugaucuuguggaucuuuugauccaaaaugaauuuuuugcuccugcgagucuuuugcucccagaugcuguucccaaaacugcuaauacacuaccuucuaaagaagcuauaacaguucagcaaaaacagaugccuuucugugacaaagacaggacauugaugacaccugugcagaaucuugaacaaagcuauaugccaccugacuccucaaguccagaaaauaaaaguuuagaaguuagugauacacguuuucacaguuuuucauuuuaugaauugaagaaugucacaaauaacuuugaugaacgacccauuucuguuggugguaauaaaaugggagagggaggauuuggaguuguauauaaaggcuacguaaauaacaacuguggcagugaagaagcuugcagcaaugguuga

SEQ ID NO: 8754 - RNA, 657 nt, Artificial Sequence
  derived and/or modified sequence opt1 from IRAK4__Homo_sapiens__AAP57090
augaacaagcccaucaccccgagcaccuacgugcgcugccugaacgucggccucauccggaagcuguccgacuucaucgacccccaggagggguggaagaagcuggccguggccaucaagaagcccagcggcgacgaccgcuacaaccaguuccacauccggcgcuucgaggcgcuccugcagacggggaagucccccaccagcgagcuccuguucgacuggggcaccaccaacugcacggccggggaccugguggaccugcucauccagaacgaguucuucgccccggccucccugcugcuccccgacgccguccccaagaccgcgaacacccugcccagcaaggaggccaucaccgugcagcagaagcagaugccguucugcgacaaggaccggacgcugaugacccccgugcagaaccucgagcaguccuacaugccgcccgacagcuccagccccgagaacaagucccuggaggucagcgacacccgcuuccacuccuucagcuucuacgagcugaagaacgugaccaacaacuucgacgagcggcccaucuccgugggcggcaacaagaugggggagggcggguucggcgucguguacaagggguacgugaacaacaacugcggcagcgaggaggccugcuccaacggcuga

SEQ ID NO: 8755 - RNA, 657 nt, Artificial Sequence
  derived and/or modified sequence opt2 from IRAK4__Homo_sapiens__AAP57090
augaacaagcccaucacccccuccaccuacguccgcugccucaacgucggccucauccgcaagcucuccgacuucaucgacccccaggagggcuggaagaagcucgccgucgccaucaagaagcccuccggcgacgaccgcuacaaccaguuccacauccgccgcuucgaggcccuccuccagaccggcaagucccccaccuccgagcuccucuucgacuggggcaccaccaacugcaccgccggcgaccucgucgaccuccucauccagaacgaguucuucgcccccgccucccuccuccuccccgacgccguccccaagaccgccaacacccuccccuccaaggaggccaucaccguccagcagaagcagaugcccuucugcgacaaggaccgcacccucaugacccccguccagaaccucgagcaguccuacaugccccccgacuccuccucccccgagaacaagucccucgaggucuccgacacccgcuuccacuccuucuccuucuacgagcucaagaacgucaccaacaacuucgacgagcgccccaucuccgucggcggcaacaagaugggcgagggcggcuucggcgucgucuacaagggcuacgucaacaacaacugcggcuccgaggaggccugcuccaacggcuga

SEQ ID NO: 8756 - RNA, 657 nt, Artificial Sequence
  derived and/or modified sequence opt3 from IRAK4__Homo_sapiens__AAP57090
augaacaagcccaucaccccuagcacauacgugagaugccugaaugucggccucauuaggaaacuuuccgacuucauagauccacaggagggguggaagaaacuggccguugcuaucaagaaaccgucuggagacgaucgguauaaccaauuucacauucgccgauucgaagcauuguuacagacugguaagucacccacgagugagcugcuauuugacuggggcaccacaaauuguacugccggggaucucguggaccugcuuauccagaacgaguucuuugcgccugcuagccuguugcucccagaugccguacccaagaccgcaaauacacugccuuccaaagaagccauuaccgugcagcaaaagcagaugccauucugcgacaaagaucguacucugaugacacccguccagaaccucgaacagucuuacaugccuccagacucgucaagcccggagaauaagaguuuagagguguccgauaccagauuucauucuuucagcuuuuaugaacugaaaaacguuacgaauaacuucgacgagaggcccaucuccgugggaggcaauaagaugggugaagggggauuuggcgucguguacaagggcuauguaaacaauaacugugggucagaggaggcuugcaguaauggauga

SEQ ID NO: 8757 - RNA, 657 nt, Artificial Sequence
  derived and/or modified sequence opt4 from IRAK4__Homo_sapiens__AAP57090
augaacaagcccaucacccccagcaccuacgugagaugccugaacgugggccugaucagaaagcugagcgacuucaucgacccccaggagggcuggaagaagcuggccguggccaucaagaagcccagcggcgacgacagauacaaccaguuccacaucagaagauucgaggcccugcugcagaccggcaagagccccaccagcgagcugcuguucgacuggggcaccaccaacugcaccgccggcgaccugguggaccugcugauccagaacgaguucuucgcccccgccagccugcugcugcccgacgccgugcccaagaccgccaacacccugcccagcaaggaggccaucaccgugcagcagaagcagaugcccuucugcgacaaggacagaacccugaugacccccgugcagaaccuggagcagagcuacaugccccccgacagcagcagccccgagaacaagagccuggaggugagcgacaccagauuccacagcuucagcuucuacgagcugaagaacgugaccaacaacuucgacgagagacccaucagcgugggcggcaacaagaugggcgagggcggcuucggcgugguguacaagggcuacgugaacaacaacugcggcagcgaggaggccugcagcaacggcuga

SEQ ID NO: 8758 - RNA, 657 nt, Artificial Sequence
  derived and/or modified sequence opt5 from IRAK4__Homo_sapiens__AAP57090
augaacaagcccaucaccccuagcacauacgugagaugccugaaugucggccucauucggaaacuguccgacuucaucgauccgcaggagggguggaagaaacuugccguugcuauuaagaaacccucuggagacgaucgcuauaaccaauuucacaucagacgguucgaagcccugcuccagacgggcaagagcccuaccuccgagcugcuuuuugacugggggacaaccaauuguacagcgggagaucugguggaccuccugauucagaacgaguucuuugcucccgccucucugcuccugccugaugccgugcccaagaccgcuaauacacuuccuagcaaagaagccaucaccguccagcaaaagcagaugccguucugcgacaaagaucgcacgcugaugacccccgugcagaaccucgaacaguccuacaugccucccgacucuagcuccccugagaauaagagccuggagguuucugauacaagauuucauuccuucagcuuuuaugaacuuaaaaacgugaccaauaacuucgacgagcggcccaucucugucggcgggaauaagaugggagaaggcggcuuuggggugguuuacaagggauaugugaacaauaacuguggcuccgaggaggcuugcagcaauggguga

SEQ ID NO: 8759 - protein, 292 aa, Artificial Sequence [sequence omitted]

SEQ ID NO: 8760 - RNA, 879 nt, Artificial Sequence
  IRAK4__Homo_sapiens__AAP57089
augaacaaacccauaacaccaucaacauaugugcgcugccucaauguuggacuaauuaggaagcugucagauuuuauugauccucaagaaggauggaagaaguuagcuguagcuauuaaaaaaccaucuggugaugauagauacaaucaguuucacauaaggagauuugaagcauuacuucaaacuggaaaaagucccacuucugaauuacuguuugacuggggcaccacaaauugcacagcuggugaucuuguggaucuuuugauccaaaaugaauuuuuugcuccugcgagucuuuugcucccagaugcuguucccaaaacugcuaauacacuaccuucuaaagaagcuauaacaguucagcaaaaacagaugccuuucugugacaaagacaggacauugaugacaccugugcagaaucuugaacaaagcuauaugccaccugacuccucaaguccagaaaauaaaaguuuagaaguuagugauacacguuuucacaguuuuucauuuuaugaauugaagaaugucacaaauaacuuugaugaacgacccauuucuguuggugguaauaaaaugggagagggaggauuuggaguuguauauaaaggcuacguaaauaacacaacuguggcagugaagaagcuugcagcaaugguugacauuacuacugaagaacugaaacagcaguuugaucaagaaauaaaaguaauggcaaagugucaacaugaaaacuuaguagaacuacuugguuucucaagugauggagaugaccucugcuuaguauauguuuacaugccuaaugguucauugcuagacagacucucuugcuuggaugguacuccaccacuuucuuggcacaugagaugcaagauugcuuag

SEQ ID NO: 8761 - RNA, 879 nt, Artificial Sequence
  derived and/or modified sequence opt1 from IRAK4__Homo_sapiens__AAP57089
augaacaagcccaucaccccgagcaccuacgugcgcugccugaacgucggccucauccggaagcuguccgacuucaucgacccccaggagggguggaagaagcuggccguggccaucaagaagcccagcggcgacgaccgcuacaaccaguuccacauccggcgcuucgaggcgcuccugcagacggggaagucccccaccagcgagcuccuguucgacuggggcaccaccaacugcacggccggggaccugguggaccugcucauccagaacgaguucuucgccccggccucccugcugcuccccgacgccguccccaagaccgcgaacacccugcccagcaaggaggccaucaccgugcagcagaagcagaugccguucugcgacaaggaccggacgcugaugacccccgugcagaaccucgagcaguccuacaugccgcccgacagcuccagccccgagaacaagucccuggaggucagcgacacccgcuuccacuccuucagcuucuacgagcugaagaacgugaccaacaacuucgacgagcggcccaucuccgugggcggcaacaagaugggggagggcggguucggcgucguguacaagggguacgugaacaacacgaccgucgccgugaagaagcucgccgcgaugguggacaucaccaccgaggagcugaagcagcaguucgaccaggagaucaaggucauggccaagugccagcacgagaaccugguggagcuccugggcuucagcuccgacggcgacgaccugugccucguguacgucuacaugcccaacgggagccugcuggaccgccucuccugccuggacggcacgcccccgcugagcuggcacaugcggugcaagaucgccuga

SEQ ID NO: 8762 - RNA, 879 nt, Artificial Sequence
  derived and/or modified sequence opt2 from IRAK4__Homo_sapiens__AAP57089
augaacaagcccaucacccccuccaccuacguccgcugccucaacgucggccucauccgcaagcucuccgacuucaucgacccccaggagggcuggaagaagcucgccgucgccaucaagaagcccuccggcgacgaccgcuacaaccaguuccacauccgccgcuucgaggcccuccuccagaccggcaagucccccaccuccgagcuccucuucgacuggggcaccaccaacugcaccgccggcgaccucgucgaccuccucauccagaacgaguucuucgcccccgccucccuccuccuccccgacgccguccccaagaccgccaacacccuccccuccaaggaggccaucaccguccagcagaagcagaugcccuucugcgacaaggaccgcacccucaugacccccguccagaaccucgagcaguccuacaugccccccgacuccuccucccccgagaacaagucccucgaggucuccgacacccgcuuccacuccuucuccuucuacgagcucaagaacgucaccaacaacuucgacgagcgccccaucuccgucggcggcaacaagaugggcgagggcggcuucggcgucgucuacaagggcuacgucaacaacaccaccgucgccgucaagaagcucgccgccauggucgacaucaccaccgaggagcucaagcagcaguucgaccaggagaucaaggucauggccaagugccagcacgagaaccucgucgagcuccucggcuucuccuccgacggcgacgaccucugccucgucuacgucuacaugcccaacggcucccuccucgaccgccucuccugccucgacggcacccccccccucuccuggcacaugcgcugcaagaucgccuga

SEQ ID NO: 8763 - RNA, 879 nt, Artificial Sequence
  derived and/or modified sequence opt3 from IRAK4__Homo_sapiens__AAP57089
augaacaagcccaucaccccuagcacauacgugagaugccugaaugucggccucauuaggaaacuuuccgacuucauagauccacaggagggguggaagaaacuggccguugcuaucaagaaaccgucuggagacgaucgguauaaccaauuucacauucgccgauucgaagcauuguuacagacugguaagucacccacgagugagcugcuauuugacuggggcaccacaaauuguacugccggggaucucguggaccugcuuauccagaacgaguucuuugcgccugcuagccuguugcucccagaugccguacccaagaccgcaaauacacugccuuccaaagaagccauuaccgugcagcaaaagcagaugccauucugcgacaaagaucguacucugaugacacccguccagaaccucgaacagucuuacaugccuccagacucgucaagcccggagaauaagaguuuagagguguccgauaccagauuucauucuuucagcuuuuaugaacugaaaaacguuacgaauaacuucgacgagaggcccaucuccgugggaggcaauaagaugggugaagggggauuuggcgucguguacaagggcuauguaaacaauacuaccguugcugugaaaaaguuggcagccauggucgauauaacaacugaggagcuuaaacaacaguucgaccaggaaaucaaggugauggcuaaaugucagcacgagaaccugguggaacuacucggguuuucaagugacggagaugaccugugccuugucuacguuuauaugccuaaugguagccuguuggaucggcucucuugucuggacggcaccccacccuuauccuggcauaugcgcugcaagauugccuga

SEQ ID NO: 8764 - RNA, 879 nt, Artificial Sequence
  derived and/or modified sequence opt4 from IRAK4__Homo_sapiens__AAP57089
augaacaagcccaucacccccagcaccuacgugagaugccugaacgugggccugaucagaaagcugagcgacuucaucgacccccaggagggcuggaagaagcuggccguggccaucaagaagcccagcggcgacgacagauacaaccaguuccacaucagaagauucgaggcccugcugcagaccggcaagagccccaccagcgagcugcuguucgacuggggcaccaccaacugcaccgccggcgaccugguggaccugcugauccagaacgaguucuucgcccccgccagccugcugcugcccgacgccgugcccaagaccgccaacacccugcccagcaaggaggccaucaccgugcagcagaagcagaugcccuucugcgacaaggacagaacccugaugacccccgugcagaaccuggagcagagcuacaugccccccgacagcagcagccccgagaacaagagccuggaggugagcgacaccagauuccacagcuucagcuucuacgagcugaagaacgugaccaacaacuucgacgagagacccaucagcgugggcggcaacaagaugggcgagggcggcuucggcgugguguacaagggcuacgugaacaacaccaccguggccgugaagaagcuggccgccaugguggacaucaccaccgaggagcugaagcagcaguucgaccaggagaucaaggugauggccaagugccagcacgagaaccugguggagcugcugggcuucagcagcgacggcgacgaccugugccugguguacguguacaugcccaacggcagccugcuggacagacugagcugccuggacggcacccccccccugagcuggcacaugagaugcaagaucgccuga

SEQ ID NO: 8765 - RNA, 879 nt, Artificial Sequence
  derived and/or modified sequence opt5 from IRAK4__Homo_sapiens__AAP57089
augaacaagcccaucaccccuagcacauacgugagaugccugaaugucggccucauucggaaacuguccgacuucaucgauccgcaggagggguggaagaaacuugccguugcuauuaagaaacccucuggagacgaucgcuauaaccaauuucacaucagacgguucgaagcccugcuccagacgggcaagagcccuaccuccgagcugcuuuuugacugggggacaaccaauuguacagcgggagaucugguggaccuccugauucagaacgaguucuuugcucccgccucucugcuccugccugaugccgugcccaagaccgcuaauacacuuccuagcaaagaagccaucaccguccagcaaaagcagaugccguucugcgacaaagaucgcacgcugaugacccccgugcagaaccucgaacaguccuacaugccucccgacucuagcuccccugagaauaagagccuggagguuucugauacaagauuucauuccuucagcuuuuaugaacuuaaaaacgugaccaauaacuucgacgagcggcccaucucugucggcgggaauaagaugggagaaggcggcuuuggggugguuuacaagggauaugugaacaauacaaccgucgcugugaaaaagcuggccgcgaugguggauauuacgacagaggagcucaaacaacaguucgaccaggaaaucaaggucauggccaaaugucagcacgagaaccugguugaacugcucggcuuuuccagcgacggggaugaccugugccuuguguacguguauaugccgaauggaucucugcucgaucgccuguccugucuugacggcaccccuccccugagcuggcauaugagaugcaagauugcuuga

SEQ ID NO: 8766 - protein, 460 aa, Artificial Sequence; identical to SEQ ID NO: 8745
  IRAK4__Homo_sapiens__Q9NWZ3

SEQ ID NO: 8767 - RNA, 1383 nt, Artificial Sequence
  IRAK4__Homo_sapiens__AAH13316
augaacaaacccauaacaccaucaacauaugugcgcugccucaauguuggacuaauuaggaagcugucagauuuuauugauccucaagaaggauggaagaaguuagcuguagcuauuaaaaaaccaucuggugaugauagauacaaucaguuucacauaaggagauuugaagcauuacuucaaacuggaaaaagucccacuucugaauuacuguuugacuggggcaccacaaauugcacaguuggugaucuuguggaucuuuugauccaaaaugaauuuuuugcuccugcaagucuuuugcucccagaugcuguucccaaaacugcuaauacacuaccuucuaaagaagcuauaacaguucagcaaaaacagaugccuuucugugacaaagacaggacauugaugacaccugugcagaaucuugaacaaagcuauaugccaccugacuccucaaguccagaaaauaaaaguuuagaaguuagugauacacguuuucacaguuuuucauuuuaugaauugaagaaugucacaaauaacuuugaugaacgacccauuucuguuggugguaauaaaaugggagagggaggauuuggaguuguauauaaaggcuacguaaauaacacaacuguggcagugaagaagcuugcagcaaugguugacauuacuacugaagaacugaaacagcaguuugaucaagaaauaaaaguaauggcaaagugucaacaugaaaacuuaguagaacuacuugguuucucaagugauggagaugaccucugcuuaguauauguuuacaugccuaaugguucauugcuagacagacucucuugcuuggaugguacuccaccacuuucuuggcacaugagaugcaagauugcucagggugcagcuaauggcaucaauuuucuacaugaaaaucaucauauucauagagauauuaaaagugcaaauaucuuacuggaugaagcuuuuacugcuaaaauaucugacuuuggccuugcacgggcuucugagaaguuugcccagacagucaugacuagcagaauugugggaacaacagcuuauauggcaccagaagcuuugcguggagaaauaacacccaaaucugauauuuacagcuuuggugugguuuuacuagaaauaauaacuggacuuccagcuguggaugaacaccgugaaccucaguuauugcuagauauuaaagaagaaauugaagaugaagaaaagacaauugaagauuauauugauaaaaagaugaaugaugcugauuccacuucaguugaagcuauguacucuguugcuagucaaugucugcaugaaaagaaaaauaagagaccagacauuaagaagguucaacagcugcugcaagagaugacagcuucuuaa

SEQ ID NO: 8768 - RNA, 1383 nt, Artificial Sequence; identical to SEQ ID NO: 8747
  derived and/or modified sequence opt1 from IRAK4__Homo_sapiens__AAH13316

SEQ ID NO: 8769 - RNA, 1383 nt, Artificial Sequence; identical to SEQ ID NO: 8748
  derived and/or modified sequence opt2 from IRAK4__Homo_sapiens__AAH13316

SEQ ID NO: 8770 - RNA, 1383 nt, Artificial Sequence; identical to SEQ ID NO: 8749
  derived and/or modified sequence opt3 from IRAK4__Homo_sapiens__AAH13316

SEQ ID NO: 8771 - RNA, 1383 nt, Artificial Sequence; identical to SEQ ID NO: 8750
  derived and/or modified sequence opt4 from IRAK4__Homo_sapiens__AAH13316

SEQ ID NO: 8772 - RNA, 1383 nt, Artificial Sequence; identical to SEQ ID NO: 8751
  derived and/or modified sequence opt5 from IRAK4__Homo_sapiens__AAH13316

SEQ ID NO: 8773 - protein, 427 aa, Artificial Sequence
  IRF3__Homo_sapiens__A0A024QZE1
MGTPKPRILPWLVSQLDLGQLEGVAWVNKSRTRFRIPWKHGLRQDAQQEDFGIFQAWAEATGAYVPGRDKPDLPTWKRNFRSALNRKEGLRLAEDRSKDPHDPHKIYEFVNSGVGDFSQPDTSPDTNGGGSTSDTQEDILDELLGNMVLAPLPDPGPPSLAVAPEPCPQPLRSPSLDNPTPFPNLGPSENPLKRLLVPGEEWEFEVTAFYRGRQVFQQTISCPEGLRLVGSEVGDRTLPGWPVTLPDPGMSLTDRGVMSYVRHVLSCLGGGLALWRAGQWLWAQRLGHCHTYWAVSEELLPNSGHGPDGEVPKDKEGGVFDLGPFIVDLITFTEGSGRSPRYALWFCVGESWPQDQPWTKRLVMVKVVPTCLRALVEMARVGGASSLENTVDLHISNSHPLSLTSDQYKAYLQDLVEGMDFQGPGET

SEQ ID NO: 8774 - RNA, 1284 nt, Artificial Sequence
  IRF3__Homo_sapiens__EAW52513
augggaaccccaaagccacggauccugcccuggcuggugucgcagcuggaccuggggcaacuggagggcguggccugggugaacaagagccgcacgcgcuuccgcaucccuuggaagcacggccuacggcaggaugcacagcaggaggauuucggaaucuuccaggccugggccgaggccacuggugcauauguucccgggagggauaagccagaccugccaaccuggaagaggaauuuccgcucugcccucaaccgcaaagaaggguugcguuuagcagaggaccggagcaaggacccucacgacccacauaaaaucuacgaguuugugaacucaggaguuggggacuuuucccagccagacaccucuccggacaccaaugguggaggcaguacuucugauacccaggaagacauucuggaugaguuacuggguaacaugguguuggccccacucccagauccgggacccccaagccuggcuguagccccugagcccugcccucagccccugcggagccccagcuuggacaaucccacucccuucccaaaccuggggcccucugagaacccacugaagcggcuguuggugccgggggaagagugggaguucgaggugacagccuucuaccggggccgccaagucuuccagcagaccaucuccugcccggagggccugcggcuggugggguccgaagugggagacaggacgcugccuggauggccagucacacugccagacccuggcaugucccugacagacaggggagugaugagcuacgugaggcaugugcugagcugccugggugggggacuggcucucuggcgggccgggcaguggcucugggcccagcggcuggggcacugccacacauacugggcagugagcgaggagcugcuccccaacagcgggcaugggccugauggcgagguccccaaggacaaggaaggaggcguguuugaccuggggcccuucauuguagaucugauuaccuucacggaaggaagcggacgcucaccacgcuaugcccucugguucugugugggggagucauggccccaggaccagccguggaccaagaggcucgugauggucaagguugugcccacgugccucagggccuugguagaaauggcccggguagggggugccuccucccuggagaauacuguggaccugcacauuuccaacagccacccacucucccucaccuccgaccaguacaaggccuaccugcaggacuugguggagggcauggauuuccagggcccuggggagaccuga

SEQ ID NO: 8775 - RNA, 1284 nt, Artificial Sequence
  derived and/or modified sequence opt1 from IRF3__Homo_sapiens__EAW52513
augggcacccccaagccgcgcauccugcccuggcucgugagccagcuggaccuggggcagcucgagggcgucgccugggugaacaagucccggacccgcuuccggauccccuggaagcacgggcugcgccaggacgcccagcaggaggacuucggcaucuuccaggcgugggccgaggccacgggggccuacgugcccggccgggacaagccggaccugcccaccuggaagcgcaacuuccggagcgcccucaaccgcaaggagggccugcggcuggcggaggaccgcuccaaggacccccacgacccccacaagaucuacgaguucgucaacagcggggugggcgacuucucccagccggacaccagccccgacaccaacgggggcggguccacgagcgacacccaggaggacauccucgacgagcugcugggcaacauggugcucgcgccccugcccgacccgggcccgcccucccuggccgucgcccccgagcccugcccccagccccuccggagccccucccuggacaacccgacccccuuccccaaccuggggcccagcgagaacccgcucaagcgccugcuggugcccggcgaggagugggaguucgaggugaccgccuucuaccgggggcgccaggucuuccagcagacgaucuccugccccgagggccuccggcuggugggcagcgaggugggggaccgcacccugcccggcuggccggucacccuccccgaccccgggaugucccugaccgaccggggcgugaugagcuacgugcgccacguccuguccugccucgggggcggccuggcccuguggcgggccgggcaguggcucugggcccagcgccugggccacugccacacguacugggccgugagcgaggagcugcucccgaacuccgggcacggccccgacggggaggugcccaaggacaaggagggcggcgucuucgaccuggggcccuucaucguggaccugaucaccuucaccgagggcagcgggcggagcccgcgcuacgcgcucugguucugcgugggcgaguccuggccccaggaccagcccuggaccaagcgccuggucauggugaaggugguccccacgugccugcgggcccucguggagauggcccgcgucgggggcgccagcucccuggagaacaccguggaccugcacaucagcaacucccacccgcucagccugaccuccgaccaguacaaggccuaccugcaggaccucguggagggcauggacuuccaggggcccggcgagaccuga

SEQ ID NO: 8776 - RNA, 1284 nt, Artificial Sequence
  derived and/or modified sequence opt2 from IRF3__Homo_sapiens__EAW52513
augggcacccccaagccccgcauccuccccuggcucgucucccagcucgaccucggccagcucgagggcgucgccugggucaacaagucccgcacccgcuuccgcauccccuggaagcacggccuccgccaggacgcccagcaggaggacuucggcaucuuccaggccugggccgaggccaccggcgccuacguccccggccgcgacaagcccgaccuccccaccuggaagcgcaacuuccgcuccgcccucaaccgcaaggagggccuccgccucgccgaggaccgcuccaaggacccccacgacccccacaagaucuacgaguucgucaacuccggcgucggcgacuucucccagcccgacaccucccccgacaccaacggcggcggcuccaccuccgacacccaggaggacauccucgacgagcuccucggcaacaugguccucgccccccuccccgaccccggcccccccucccucgccgucgcccccgagcccugcccccagccccuccgcucccccucccucgacaaccccacccccuuccccaaccucggccccuccgagaacccccucaagcgccuccucguccccggcgaggagugggaguucgaggucaccgccuucuaccgcggccgccaggucuuccagcagaccaucuccugccccgagggccuccgccucgucggcuccgaggucggcgaccgcacccuccccggcuggcccgucacccuccccgaccccggcaugucccucaccgaccgcggcgucauguccuacguccgccacguccucuccugccucggcggcggccucgcccucuggcgcgccggccaguggcucugggcccagcgccucggccacugccacaccuacugggccgucuccgaggagcuccuccccaacuccggccacggccccgacggcgagguccccaaggacaaggagggcggcgucuucgaccucggccccuucaucgucgaccucaucaccuucaccgagggcuccggccgcuccccccgcuacgcccucugguucugcgucggcgaguccuggccccaggaccagcccuggaccaagcgccucgucauggucaaggucguccccaccugccuccgcgcccucgucgagauggcccgcgucggcggcgccuccucccucgagaacaccgucgaccuccacaucuccaacucccacccccucucccucaccuccgaccaguacaaggccuaccuccaggaccucgucgagggcauggacuuccagggccccggcgagaccuga

SEQ ID NO: 8777 - RNA, 1284 nt, Artificial Sequence
  derived and/or modified sequence opt3 from IRF3__Homo_sapiens__EAW52513
augggcacccccaagccuagaauccugccauggcucgugagccagcuugaccuggggcaauuggagggagucgccuggguuaacaaauccaggacacgguuccgcauuccguggaagcacgguuuacgacaggaugcucagcaggaagacuuuggcauauuccaagcaugggccgaggcgacuggggcuuacgugcccggacgugauaaaccugaccugccaacguggaagagaaauuuuaggucugcccuaaaccggaaagaaggccuccgccuggcagaggauagaucaaaggacccccaugauccucacaagaucuaugaguucguaaauaguggugugggggacuuuagccagccagauaccucccccgacacaaacggaggcggcucuacuucggauacccaggaagacauucuugaugagcuguuggggaauaugguccucgccccucugccagacccgggacccccuucacuggcuguggcaccagaacccugcccucagccacucaggagccccaguuuagacaacccgacaccuuuccccaaucuggguccauccgagaacccucuuaaacgguugcugguucccggcgaagagugggaguuugaagugaccgccuucuaccgcgggcgacaagucuuucagcagacuaucucuuguccagagggacuaagacucgugggcagcgaaguaggugauaggacacugcccggguggccuguuacccuuccagacccgggaaugucccugacggaucggggcgugaugucauauguccgucauguguugaguugccucggcgggggacuggcuuuauggcgcgccggucaguggcugugggcgcaaagacucggccacugucauacuuacugggcagugagcgaggaacuucugcccaauucugggcacggaccugacggcgaggucccaaaggauaaagagggugggguuuucgacuugggccccuuuauuguggaucuaaucaccuucacagaaggauccggcaggucaccucgguaugcccugugguuuugcguaggggagagcuggccacaggaccagcccuggacuaagcgacucgugauggucaaagugguuccgaccugucugcgcgcucuuguggaaauggccagagucggaggugcaaguucucuggagaacacaguggauuugcacauauccaauagccauccucucucgcugaccucugaccaauacaaggcuuauuuacaggaucugguagaaggcauggacuuccaggggccaggagagacguga

SEQ ID NO: 8778 - RNA, 1284 nt, Artificial Sequence
  derived and/or modified sequence opt4 from IRF3__Homo_sapiens__EAW52513
augggcacccccaagcccagaauccugcccuggcuggugagccagcuggaccugggccagcuggagggcguggccugggugaacaagagcagaaccagauucagaauccccuggaagcacggccugagacaggacgcccagcaggaggacuucggcaucuuccaggccugggccgaggccaccggcgccuacgugcccggcagagacaagcccgaccugcccaccuggaagagaaacuucagaagcgcccugaacagaaaggagggccugagacuggccgaggacagaagcaaggacccccacgacccccacaagaucuacgaguucgugaacagcggcgugggcgacuucagccagcccgacaccagccccgacaccaacggcggcggcagcaccagcgacacccaggaggacauccuggacgagcugcugggcaacauggugcuggccccccugcccgaccccggcccccccagccuggccguggcccccgagcccugcccccagccccugagaagccccagccuggacaaccccacccccuuccccaaccugggccccagcgagaacccccugaagagacugcuggugcccggcgaggagugggaguucgaggugaccgccuucuacagaggcagacagguguuccagcagaccaucagcugccccgagggccugagacuggugggcagcgaggugggcgacagaacccugcccggcuggcccgugacccugcccgaccccggcaugagccugaccgacagaggcgugaugagcuacgugagacacgugcugagcugccugggcggcggccuggcccuguggagagccggccaguggcugugggcccagagacugggccacugccacaccuacugggccgugagcgaggagcugcugcccaacagcggccacggccccgacggcgaggugcccaaggacaaggagggcggcguguucgaccugggccccuucaucguggaccugaucaccuucaccgagggcagcggcagaagccccagauacgcccugugguucugcgugggcgagagcuggccccaggaccagcccuggaccaagagacuggugauggugaagguggugcccaccugccugagagcccugguggagauggccagagugggcggcgccagcagccuggagaacaccguggaccugcacaucagcaacagccacccccugagccugaccagcgaccaguacaaggccuaccugcaggaccugguggagggcauggacuuccagggccccggcgagaccuga

SEQ ID NO: 8779 - RNA, 1284 nt, Artificial Sequence
  derived and/or modified sequence opt5 from IRF3__Homo_sapiens__EAW52513
augggcacccccaagccuagaauccugccguggcucgugagccagcuggaccuugggcaacuggagggagucgccuggguuaacaaaucccggacacgcuuccggauucccuggaagcacggccucagacaggaugcucagcaggaagacuuugggaucuuccaagccugggcggaggcuacgggagccuacgugccuggccgcgauaaacccgaccugccuaccuggaagagaaauuuucggucugcccuuaaccgcaaagaagggcugagacucgcugaggaucggagcaaggacccccaugauccucacaagauuuaugaguucgucaauuccggagugggcgacuuuucucagccggauacaagccccgacaccaacggcgggggauccacaucugauacccaggaagacauccuggaugagcugcucggcaauauggugcuggccccucuucccgacccugggcccccgagccuggcuguugccccugaacccugcccucagccccuccgcucccccagccuggacaacccuacaccguuccccaaucuuggaccuucugagaacccccugaaaagacuccuggugccuggcgaagagugggaguuugaagucaccgcguucuaccgggggcgccaaguguuucagcagacgauuuccugucccgagggacugagacucguuggcagcgaagugggcgaucggacccugccgggguggccugucacacuucccgacccuggaaugucucugaccgaucgcggcgugauguccuaugugagacauguccucagcugccuugggggaggccuggcccuguggcgggcugggcaguggcucugggcccaaagacugggacacugucauacauacugggcuguuucugaggaacugcuccccaauuccggccacggcccugacggggaggugcccaaggauaaagagggaggcguguucgaccuggggccguuuaucgucgaucuuaucaccuucacggaaggaagcggccgcuccccucgguaugcccugugguuuugcgugggggagucuuggccccaggaccagcccuggacaaagagacucguuauggugaaagucgugccuaccugucugcgcgcgcuuguugaaauggcccgggugggcggagcuagcucccuggagaacacagucgaucuccacauuagcaauucucauccgcugucccugaccagcgaccaauacaaggccuaucuccaggaucugguggaaggcauggacuuccaggggcccggagagaccuga

SEQ ID NO: 8780 - protein, 392 aa, Artificial Sequence [sequence omitted]

SEQ ID NO: 8781 - RNA, 1179 nt, Artificial Sequence
  IRF3__Homo_sapiens__ADN86147
augguggggcgcaagcaggguuggagcugcaggcuuacgggaauaaaaccgggaaagccggccugggccgaggccacuggugcauauguucccgggagggauaagccagaccugccaaccuggaagaggaauuuccgcucugcccucaaccgcaaagaaggguugcguuuagcagaggaccggagcaaggacccucacgacccacauaaaaucuacgaguuugugaacucaggaguuggggacuuuucccagccagacaccucuccggacaccaaugguggaggcaguacuucugauacccaggaagacauucuggaugaguuacuggguaacaugguguuggccccacucccagauccgggacccccaagccuggcuguagccccugagcccugcccucagccccugcggagccccagcuuggacaaucccacucccuucccaaaccuggggcccucugagaacccacugaagcggcuguuggugccgggggaagagugggaguucgaggugacagccuucuaccggggccgccaagucuuccagcagaccaucuccugcccggagggccugcggcuggugggguccgaagugggagacaggacgcugccuggauggccagucacacugccagacccuggcaugucccugacagacaggggagugaugagcuacgugaggcaugugccgagcugccugggugggggacuggcucucuggcgggccgggcaguggcucugggcccagcggcuggggcacugccacacauacugggcagugagcgaggagcugcuccccaacagcgggcaugggccugauggcgagguccccaaggacaaggaaggaggcguguuugaccuggggcccuucauuguagaucugauuaccuucacggaaggaagcggacgcucaccacgcuaugcccucugguucugugugggggagucauggccccaggaccagccguggaccaagaggcucgugauggucaagguugugcccacgugccucagggccuugguagaaauggcccggguagggggugccuccucccuggagaauacuguggaccugcacauuuccaacagccacccacucucccucaccuccgaccaguacaaggccuaccugcaggacuugguggagggcauggauuuccagggcccuggggagaccuga

SEQ ID NO: 8782 - RNA, 1179 nt, Artificial Sequence
  derived and/or modified sequence opt1 from IRF3__Homo_sapiens__ADN86147
auggugggccgcaagcagggguggagcugccggcugaccggcaucaagcccgggaagccggccugggccgaggcgaccggcgccuacguccccgggcgcgacaagcccgaccuccccacguggaagcggaacuuccgcuccgcccugaaccggaaggagggccugcgccucgccgaggaccggagcaaggacccgcacgacccccacaagaucuacgaguucgugaacuccggcgugggggacuucagccagcccgacaccucccccgacaccaacggcgggggcagcaccuccgacacgcaggaggacauccuggacgagcugcucgggaacaugguccuggccccgcugcccgaccccgggcccccgagccucgcgguggcccccgagcccugcccccagccgcugcgcucccccagccuggacaaccccacccccuucccgaaccucggccccuccgagaacccccugaagcggcugcucgugcccggggaggagugggaguucgaggucaccgccuucuaccgcggccgccagguguuccagcagaccaucagcugcccggaggggcugcggcuggugggcuccgaggucggcgaccggacgcuccccggguggcccgugacccugcccgacccgggcaugagccugaccgaccgcggggugauguccuacguccggcacgugcccagcugccucggcgggggccuggcccuguggcgcgcgggccaguggcucugggcccagcggcuggggcacugccacaccuacugggccguguccgaggagcugcuccccaacagcggccacgggccggacggcgagguccccaaggacaaggagggcggcguguucgaccugggccccuucaucguggaccugaucacguucaccgagggguccggccgcagcccccgguacgcccucugguucugcgucggggagagcuggccgcaggaccagcccuggaccaagcgccuggugauggugaaggucgugccgaccugccugcgggcccucguggagauggcgcgcgucggcggggccuccagccuggagaacacgguggaccugcacaucuccaacagccacccccucucccugaccagcgaccaguacaaggccuaccugcaggaccucgucgagggcauggacuuccagggccccggggagaccuga

SEQ ID NO: 8783 - RNA, 1179 nt, Artificial Sequence
  derived and/or modified sequence opt2 from IRF3__Homo_sapiens__ADN86147
auggucggccgcaagcagggcugguccugccgccucaccggcaucaagcccggcaagcccgccugggccgaggccaccggcgccuacguccccggccgcgacaagcccgaccuccccaccuggaagcgcaacuuccgcuccgcccucaaccgcaaggagggccuccgccucgccgaggaccgcuccaaggacccccacgacccccacaagaucuacgaguucgucaacuccggcgucggcgacuucucccagcccgacaccucccccgacaccaacggcggcggcuccaccuccgacacccaggaggacauccucgacgagcuccucggcaacaugguccucgccccccuccccgaccccggcccccccucccucgccgucgcccccgagcccugcccccagccccuccgcucccccucccucgacaaccccacccccuuccccaaccucggccccuccgagaacccccucaagcgccuccucguccccggcgaggagugggaguucgaggucaccgccuucuaccgcggccgccaggucuuccagcagaccaucuccugccccgagggccuccgccucgucggcuccgaggucggcgaccgcacccuccccggcuggcccgucacccuccccgaccccggcaugucccucaccgaccgcggcgucauguccuacguccgccacguccccuccugccucggcggcggccucgcccucuggcgcgccggccaguggcucugggcccagcgccucggccacugccacaccuacugggccgucuccgaggagcuccuccccaacuccggccacggccccgacggcgagguccccaaggacaaggagggcggcgucuucgaccucggccccuucaucgucgaccucaucaccuucaccgagggcuccggccgcuccccccgcuacgcccucugguucugcgucggcgaguccuggccccaggaccagcccuggaccaagcgccucgucauggucaaggucguccccaccugccuccgcgcccucgucgagauggcccgcgucggcggcgccuccucccucgagaacaccgucgaccuccacaucuccaacucccacccccucucccucaccuccgaccaguacaaggccuaccuccaggaccucgucgagggcauggacuuccagggccccggcgagaccuga

SEQ ID NO: 8784 - RNA, 1179 nt, Artificial Sequence
  derived and/or modified sequence opt3 from IRF3__Homo_sapiens__ADN86147
auggugggcagaaagcagggguggagcugcaggcugaccggaaucaaacccgguaagccugccugggcugaggcaacaggcgccuacgucccagggcgggacaaaccggaucuccccacuuggaagcgcaacuuccgauccgcgcuuaaucguaaagaaggacugagauuggcugaggacaggucuaaggauccucacgacccacauaagauuuaugaauuuguuaacucaggcgugggugauuucagucaacccgacacgagcccugauaccaaugggggaggcuccacaucugacacucaggaggauauauuagacgaacugcuaggcaacaugguacucgccccacugcccgauccugggccaccgucgcuugcaguggcccccgagccuuguccacagccccugcggucaccuagcuuggacaauccaacccccuuuccgaaccucggaccuagugagaauccccugaaacgccugcucgucccaggugaagagugggaguucgaagugacagcuuuuuacagaggcaggcagguuuuccaacagaccaucuccugcccugagggguuacggcuggugggaucugaagucggcgaucgcacucuucccgguuggccagugacauugcccgacccugggaugagccugaccgaccgaggaguaauguccuauguuagacacgugccaucaugucuaggcggcgggcucgcacuguggagggccggacaguggcuuugggcucagcggcugggucauugccacacguacugggccgucagugaggaauugcucccgaacagcggccaugggcccgauggagaggugccuaaggacaaagaaggcgguguguuugaucuggggccauucauugucgacuuaaucacuuuuaccgagggcucuggacguucaccccgcuaugcgcugugguucuguguuggcgaguccuggccucaagaucagccauggacaaagagacucgugaugguaaaagugguccccacuugccuuagggcacugguggaaauggcccggguugggggagcuagcaguuuggagaauaccguggaccuacacauuucuaacucccacccgcugagccucacaucggaucaguacaaggccuaucugcaggaccuugucgaagguauggauuuucaaggcccuggggagaccuga

SEQ ID NO: 8785 - RNA, 1179 nt, Artificial Sequence
  derived and/or modified sequence opt4 from IRF3__Homo_sapiens__ADN86147
auggugggcagaaagcagggcuggagcugcagacugaccggcaucaagcccggcaagcccgccugggccgaggccaccggcgccuacgugcccggcagagacaagcccgaccugcccaccuggaagagaaacuucagaagcgcccugaacagaaaggagggccugagacuggccgaggacagaagcaaggacccccacgacccccacaagaucuacgaguucgugaacagcggcgugggcgacuucagccagcccgacaccagccccgacaccaacggcggcggcagcaccagcgacacccaggaggacauccuggacgagcugcugggcaacauggugcuggccccccugcccgaccccggcccccccagccuggccguggcccccgagcccugcccccagccccugagaagccccagccuggacaaccccacccccuuccccaaccugggccccagcgagaacccccugaagagacugcuggugcccggcgaggagugggaguucgaggugaccgccuucuacagaggcagacagguguuccagcagaccaucagcugccccgagggccugagacuggugggcagcgaggugggcgacagaacccugcccggcuggcccgugacccugcccgaccccggcaugagccugaccgacagaggcgugaugagcuacgugagacacgugcccagcugccugggcggcggccuggcccuguggagagccggccaguggcugugggcccagagacugggccacugccacaccuacugggccgugagcgaggagcugcugcccaacagcggccacggccccgacggcgaggugcccaaggacaaggagggcggcguguucgaccugggccccuucaucguggaccugaucaccuucaccgagggcagcggcagaagccccagauacgcccugugguucugcgugggcgagagcuggccccaggaccagcccuggaccaagagacuggugauggugaagguggugcccaccugccugagagcccugguggagauggccagagugggcggcgccagcagccuggagaacaccguggaccugcacaucagcaacagccacccccugagccugaccagcgaccaguacaaggccuaccugcaggaccugguggagggcauggacuuccagggccccggcgagaccuga

SEQ ID NO: 8786 - RNA, 1179 nt, Artificial Sequence
  derived and/or modified sequence opt5 from IRF3__Homo_sapiens__ADN86147
auggugggcagaaagcagggguggagcugccggcugaccggaaucaaacccggcaagccugccugggcugaggccacaggggcguacgucccgggacgcgacaaacccgaucucccuacguggaagagaaacuuccgguccgcucugaaucgcaaagaaggccuuagacuggccgaggaccggucuaaggauccccacgacccucauaagauuuaugaauuuguuaacagcggggugggagauuucucccaacccgacaccucuccugauacaaauggcggcgggagcaccuccgacacacaggaggauauccucgacgaacugcuuggaaacauggugcuggccccgcuccccgauccugggcccccuucucuggcugucgcccccgagccguguccucagccccugcgcagcccuucccucgacaaucccacccccuuuccuaaccuggggccgagcgagaauccccuuaaaagacugcucgugccuggagaagagugggaguucgaaguuacagcuuuuuaccggggccgccagguguuccaacagaccauuucuugccccgaggggcugagacuugucggauccgaagugggcgaucggacgcugccuggcuggcccguuacccucccggacccugggaugagccugacagaccgcggagugaugucuuaugucagacacgugcccuccugucugggcgggggacucgcccuguggcgggcgggccaguggcuuugggcccagcgccuggggcauugccacaccuacugggcugugagcgaggaacuccugccuaacucuggacauggccccgauggcgaggucccuaaggacaaagaagggggaguuuuugaucuuggccccuucaucguggaccugauuacauuuaccgagggguccggaagaagcccgcgguaugcccucugguucugugugggcgaguccuggccucaagaucagcccuggacgaagagacuggucauggugaaaguugugcccacaugccugcgcgcucucgucgaaauggcccgggugggcggcgcgucuagccuggagaauaccguugaccuucacaucuccaacagccacccucugucucucacauccgaucaguacaaggccuaucugcaggaccuuguggaaggaauggauuuucaaggcccgggggagaccuga

SEQ ID NO: 8787 - protein, 154 aa, Artificial Sequence [sequence omitted]

SEQ ID NO: 8788 - RNA, 465 nt, Artificial Sequence
  IRF3__Homo_sapiens__ADN86148
augguguuggccccacucccagauccgggacccccaagccuggcuguagccccugagcccugcccucagccccugcggagccccagcuuggacaaucccacucccuucccaaaccuggggcccucugagaacccacugaagcggcuguuggugccgggggaagaucugauuaccuucacggaaggaagcggacgcucaccacgcuaugcccucugguucugugugggggagucauggccccaggaccagccguggaccaagaggcucgugauggucaagguugugcccacgugccucagggccuugguagaaauggcccggguagggggugccuccucccuggagaauacuguggaccugcacauuuccaacagccacccacucucccucaccuccgaccagcacaaggccuaccugcaggacuugguggagggcauggauuuccagggcccuggggagaccuga

SEQ ID NO: 8789 - RNA, 465 nt, Artificial Sequence
  derived and/or modified sequence opt1 from IRF3__Homo_sapiens__ADN86148
auggugcuggcgccccucccggaccccggcccgcccagccuggccgucgcccccgagcccugcccccagccccugcgcuccccgagccucgacaaccccacccccuuccccaaccuggggccguccgagaacccccugaagcggcuccuggugcccggcgaggaccugaucaccuucacggaggggagcggccgcagcccccgguacgcccucugguucugcgugggggaguccuggccgcaggaccagcccuggaccaagcgccuggucauggugaagguggucccgaccugccugcgggcccucguggagauggcccgcgugggcggcgccuccagccuggagaacaccgucgaccugcacaucuccaacagccacccccucucccugacgagcgaccagcacaaggcguaccugcaggaccucguggaggggauggacuuccagggccccggggagaccuga

SEQ ID NO: 8790 - RNA, 465 nt, Artificial Sequence
  derived and/or modified sequence opt2 from IRF3__Homo_sapiens__ADN86148
augguccucgccccccuccccgaccccggcccccccucccucgccgucgcccccgagcccugcccccagccccuccgcucccccucccucgacaaccccacccccuuccccaaccucggccccuccgagaacccccucaagcgccuccucguccccggcgaggaccucaucaccuucaccgagggcuccggccgcuccccccgcuacgcccucugguucugcgucggcgaguccuggccccaggaccagcccuggaccaagcgccucgucauggucaaggucguccccaccugccuccgcgcccucgucgagauggcccgcgucggcggcgccuccucccucgagaacaccgucgaccuccacaucuccaacucccacccccucucccucaccuccgaccagcacaaggccuaccuccaggaccucgucgagggcauggacuuccagggccccggcgagaccuga

SEQ ID NO: 8791 - RNA, 465 nt, Artificial Sequence
  derived and/or modified sequence opt3 from IRF3__Homo_sapiens__ADN86148
auggugcuggcuccccucccugacccaggcccgcccagccuugccgucgcaccugagccaugcccccagccucugagauccccaucuuuggauaaccccaccccuuucccaaauuuagggccgucagaaaacccccugaagaggcuacucguuccuggagaggaccugaucacauuuacugaagguaguggccggagcccacgcuacgcccuuugguucugugugggggaguccuggccccaagaucagccuuggacgaaacgacugguaauggugaaggucgugccaaccugcuugcgugcgcucguugaaauggcuagagugggaggcgccucuucgcuggagaauacagucgaccugcacauuucaaacagccauccccucaguuuaacuuccgaucagcacaaagcauaucugcaggaccuuguggaggguauggauuuucaagggccgggagaaaccuga

SEQ ID NO: 8792 - RNA, 465 nt, Artificial Sequence
  derived and/or modified sequence opt4 from IRF3__Homo_sapiens__ADN86148
auggugcuggccccccugcccgaccccggcccccccagccuggccguggcccccgagcccugcccccagccccugagaagccccagccuggacaaccccacccccuuccccaaccugggccccagcgagaacccccugaagagacugcuggugcccggcgaggaccugaucaccuucaccgagggcagcggcagaagccccagauacgcccugugguucugcgugggcgagagcuggccccaggaccagcccuggaccaagagacuggugauggugaagguggugcccaccugccugagagcccugguggagauggccagagugggcggcgccagcagccuggagaacaccguggaccugcacaucagcaacagccacccccugagccugaccagcgaccagcacaaggccuaccugcaggaccugguggagggcauggacuuccagggccccggcgagaccuga

SEQ ID NO: 8793 - RNA, 465 nt, Artificial Sequence
  derived and/or modified sequence opt5 from IRF3__Homo_sapiens__ADN86148
auggugcuggcuccccucccugacccggggcccccuagccuggcugucgcccccgagccuugcccccagccucuuagauccccgucucuggauaaccccaccccuuuccccaaucucggcccuagcgaaaacccccugaagcggcuucugguuccgggagaggaccucaucacauuuacggaaggcuccgggcgcucuccuagauacgcgcugugguucugugugggagagagcuggccccaagaucagccuuggaccaaacggcuggugauggucaaggugguucccacaugccuccgcgcucugguggaaauggccagagucggcggggccuccucucuugagaauaccguggaccugcacauuagcaacucccauccccucagccugacaucugaucagcacaaagccuaucuucaggaccugguugagggaauggauuuucaaggcccuggcgaaaccuga

SEQ ID NO: 8794 - protein, 281 aa, Artificial Sequence
  IRF3__Homo_sapiens__E2GIM7
MVLAPLPDPGPPSLAVAPEPCPQPLRSPSLDNPTPFPNLGPSENPLKRLLVPGEEWEFEVTAFYRGRQVFQQTISCPEGLRLVGSEVGDRTLPGWPVTLPDPGMSLTDRGVMSYVRHVLSCLGGGLALWRAGQWLWAQRLGHCHTYWAVSEELLPNSGHGPDGEVPKDKEGGVFDLGPFIVDLITFTEGSGRSPRYALWFCVGESWPQDQPWTKRLVMVKVVPTCLRALVEMARVGGASSLENTVDLHISNSHPLSLTSDQYKAYLQDLVEGMDFQGPGET

SEQ ID NO: 8795 - RNA, 846 nt, Artificial Sequence
  IRF3__Homo_sapiens__ADN86149
augguguuggccccacucccagauccgggacccccaagccuggcuguagccccugagcccugcccucagccccugcggagccccagcuuggacaaucccacucccuucccaaaccuggggcccucugagaacccacugaagcggcuguuggugccgggggaagagugggaguucgaggugacagccuucuaccggggccgccaagucuuccagcagaccaucuccugcccggagggccugcggcuggugggguccgaagugggagacaggacgcugccuggauggccagucacacugccagacccuggcaugucccugacagacaggggagugaugagcuacgugaggcaugugcugagcugccugggugggggacuggcucucuggcgggccgggcaguggcucugggcccagcggcuggggcacugccacacauacugggcagugagcgaggagcugcuccccaacagcgggcaugggccugauggcgagguccccaaggacaaggaaggaggcguguuugaccuggggcccuucauuguagaucugauuaccuucacggaaggaagcggacgcucaccacgcuaugcccucugguucugugugggggagucauggccccaggaccagccguggaccaagaggcucgugauggucaagguugugcccacgugccucagggccuugguagaaauggcccggguagggggugccuccucccuggagaauacuguggaccugcacauuuccaacagccacccacucucccucaccuccgaccaguacaaggccuaccugcaggacuugguggagggcauggauuuccagggcccuggggagaccuga

SEQ ID NO: 8796 - RNA, 846 nt, Artificial Sequence
  derived and/or modified sequence opt1 from IRF3__Homo_sapiens__ADN86149
auggugcuggcgccccucccggaccccggcccgcccagccuggccgucgcccccgagcccugcccccagccccugcgcuccccgagccucgacaaccccacccccuuccccaaccuggggccguccgagaacccccugaagcggcuccuggugcccggcgaggagugggaguucgaggugaccgccuucuaccgcgggcggcaggucuuccagcagacgaucagcugccccgagggccugcgccucgugggguccgaggugggcgaccggacccugccgggcuggcccgucacccugcccgaccccgggaugagccucaccgaccgcggcgugauguccuacgugcggcacguccugagcugccucgggggcgggcuggcccuguggcgcgccggccaguggcugugggcccagcggcucggccacugccacacguacugggcgguguccgaggagcugcugccgaacagcgggcacggccccgacggggaggugcccaaggacaaggagggcggcgucuucgaccucgggcccuucaucguggaccugaucaccuucaccgagggcuccgggcgcagcccgcgguacgcccugugguucugcgugggcgaguccuggccccaggaccagcccuggaccaagcgccucgucauggugaaggugguccccacgugccugcgggcccugguggagauggcccgcgucgggggcgcgagcucccucgagaacaccguggaccugcacaucagcaacucccacccgcugagccucaccuccgaccaguacaaggccuaccugcaggaccugguggagggcauggacuuccaggggcccggcgagaccuga

SEQ ID NO: 8797 - RNA, 846 nt, Artificial Sequence
  derived and/or modified sequence opt2 from IRF3__Homo_sapiens__ADN86149
augguccucgccccccuccccgaccccggcccccccucccucgccgucgcccccgagcccugcccccagccccuccgcucccccucccucgacaaccccacccccuuccccaaccucggccccuccgagaacccccucaagcgccuccucguccccggcgaggagugggaguucgaggucaccgccuucuaccgcggccgccaggucuuccagcagaccaucuccugccccgagggccuccgccucgucggcuccgaggucggcgaccgcacccuccccggcuggcccgucacccuccccgaccccggcaugucccucaccgaccgcggcgucauguccuacguccgccacguccucuccugccucggcggcggccucgcccucuggcgcgccggccaguggcucugggcccagcgccucggccacugccacaccuacugggccgucuccgaggagcuccuccccaacuccggccacggccccgacggcgagguccccaaggacaaggagggcggcgucuucgaccucggccccuucaucgucgaccucaucaccuucaccgagggcuccggccgcuccccccgcuacgcccucugguucugcgucggcgaguccuggccccaggaccagcccuggaccaagcgccucgucauggucaaggucguccccaccugccuccgcgcccucgucgagauggcccgcgucggcggcgccuccucccucgagaacaccgucgaccuccacaucuccaacucccacccccucucccucaccuccgaccaguacaaggccuaccuccaggaccucgucgagggcauggacuuccagggccccggcgagaccuga

SEQ ID NO: 8798 - RNA, 846 nt, Artificial Sequence
  derived and/or modified sequence opt3 from IRF3__Homo_sapiens__ADN86149
auggugcuggcuccccucccugacccaggcccgcccagccuugcugucgcaccugagccaugcccccagccucugagauccccaucuuuggauaaccccaccccuuucccaaauuuagggccgucagaaaacccccugaagaggcuacucguuccuggagaggaaugggaguuugaagugacagccuucuaccggggucgccaaguauuucagcagacuaucaguuguccagagggccugcgacuuguggggagcgaggucggagaccguacgcugcccggcuggccugugaccuugccagaucccgguaugucccucacagacagagggguuaugucuuaugugaggcacguccugucgugccugggaggcggccucgcguuauggcgggcugggcaguggcugugggcccaacgccuuggacauugucacacuuacugggcagugucagaagaguugcugccgaauagcggucauggcccugauggggaaguacccaaagacaaggagggaggcguuuucgaucuagguccauuuauuguggaccucauaaccuucacagaggggaguggaagauccccuagguaugcccugugguuuugcgucggcgaaucuuggccccaggaucagccauggaccaaacggcuugugauggugaaggucguucccacuugucugcgcgcuuugguggagauggcacgaguaggcggggccagcucccucgaaaacacaguggaccugcacaucucaaauagucauccuuuaagccugaccucugaucaguacaaagccuaucuccaagaccuugucgagggaauggauuuccaggguccaggcgaaacguga

SEQ ID NO: 8799 - RNA, 846 nt, Artificial Sequence
  derived and/or modified sequence opt4 from IRF3__Homo_sapiens__ADN86149
auggugcuggccccccugcccgaccccggcccccccagccuggccguggcccccgagcccugcccccagccccugagaagccccagccuggacaaccccacccccuuccccaaccugggccccagcgagaacccccugaagagacugcuggugcccggcgaggagugggaguucgaggugaccgccuucuacagaggcagacagguguuccagcagaccaucagcugccccgagggccugagacuggugggcagcgaggugggcgacagaacccugcccggcuggcccgugacccugcccgaccccggcaugagccugaccgacagaggcgugaugagcuacgugagacacgugcugagcugccugggcggcggccuggcccuguggagagccggccaguggcugugggcccagagacugggccacugccacaccuacugggccgugagcgaggagcugcugcccaacagcggccacggccccgacggcgaggugcccaaggacaaggagggcggcguguucgaccugggccccuucaucguggaccugaucaccuucaccgagggcagcggcagaagccccagauacgcccugugguucugcgugggcgagagcuggccccaggaccagcccuggaccaagagacuggugauggugaagguggugcccaccugccugagagcccugguggagauggccagagugggcggcgccagcagccuggagaacaccguggaccugcacaucagcaacagccacccccugagccugaccagcgaccaguacaaggccuaccugcaggaccugguggagggcauggacuuccagggccccggcgagaccuga

SEQ ID NO: 8800 - RNA, 846 nt, Artificial Sequence
  derived and/or modified sequence opt5 from IRF3__Homo_sapiens__ADN86149
auggugcuggcuccccucccugacccggggcccccuagccuggccgucgcccccgagccuugcccccagccucuuagauccccgucucuggauaaccccaccccuuuccccaaucucgggccuagcgaaaacccccugaagcggcuucugguuccgggagaggaaugggaguuugaagugacagcguucuaccgcggcagacaaguguuucagcagacgaucuccuguccugaggggcuccggcuggucggaucugaggugggcgaccgcacccugcccggguggccuguuacacuccccgaucccggaaugagccugaccgacagaggcgugauguccuauguccggcacgugcuuucuugccugggcgggggacucgcucuguggcgcgccggccaguggcuuugggcccaaagacuggggcauugucacacauacugggcuguuagcgaggaacuccugccuaauuccggacauggcccggauggggaagugcccaaagacaaggagggaggcgucuucgaucugggcccuuuuauuguggaccucaucaccuucacagaggggagcggacggucuccccgcuaugcccugugguuuugcgugggcgaauccuggccucaggaucagcccuggaccaaaagacuugucaugguuaagguggugccgacgugucugcgggcucucgucgagauggcccgcgugggcggagcgagcucucuggaaaacaccguugaccuucacauuuccaauagccauccucugucucucacauccgaucaguacaaagccuaucugcaagaccugguggagggcauggauuuccaggggcccggagaaaccuga

SEQ ID NO: 8801 - protein, 154 aa, Artificial Sequence [sequence omitted]

SEQ ID NO: 8802 - RNA, 465 nt, Artificial Sequence
  IRF3__Homo_sapiens__ADN86150
augguguuggccccacucccagauccgggacccccaagccuggcuguagccccugagcccugcccucagccccugcggagccccagcuuggacaaucccacucccuucccaaaccuggggcccucugagaacccacugaagcggcuguuggugccgggggaagaucugauuaccuucacggaaggaagcggacgcucaccacgcuaugcccucugguucugugugggggagucauggccccaggaccagccguggaccaagaggcucgugauggucaagguugugcccacgugccucagggccuugguagaaauggcccggguagggggugccuccucccuggagaauacuguggaccugcacauuuccaacagccacccacucucccucaccuccgaccaguacaaggccuaccugcaggacuugguggagggcauggauuuccagggcccuggggagaccuga

SEQ ID NO: 8803 - RNA, 465 nt, Artificial Sequence
  derived and/or modified sequence opt1 from IRF3__Homo_sapiens__ADN86150
auggugcuggcgccccucccggaccccggcccgcccagccuggccgucgcccccgagcccugcccccagccccugcgcuccccgagccucgacaaccccacccccuuccccaaccuggggccguccgagaacccccugaagcggcuccuggugcccggcgaggaccugaucaccuucacggaggggagcggccgcagcccccgguacgcccucugguucugcgugggggaguccuggccgcaggaccagcccuggaccaagcgccuggucauggugaagguggucccgaccugccugcgggcccucguggagauggcccgcgugggcggcgccuccagccuggagaacaccgucgaccugcacaucuccaacagccacccccucucccugacgagcgaccaguacaaggcguaccugcaggaccucguggaggggauggacuuccagggccccggggagaccuga

SEQ ID NO: 8804 - RNA, 465 nt, Artificial Sequence
  derived and/or modified sequence opt2 from IRF3__Homo_sapiens__ADN86150
augguccucgccccccuccccgaccccggcccccccucccucgccgucgcccccgagcccugcccccagccccuccgcucccccucccucgacaaccccacccccuuccccaaccucggccccuccgagaacccccucaagcgccuccucguccccggcgaggaccucaucaccuucaccgagggcuccggccgcuccccccgcuacgcccucugguucugcgucggcgaguccuggccccaggaccagcccuggaccaagcgccucgucauggucaaggucguccccaccugccuccgcgcccucgucgagauggcccgcgucggcggcgccuccucccucgagaacaccgucgaccuccacaucuccaacucccacccccucucccucaccuccgaccaguacaaggccuaccuccaggaccucgucgagggcauggacuuccagggccccggcgagaccuga

SEQ ID NO: 8805 - RNA, 465 nt, Artificial Sequence
  derived and/or modified sequence opt3 from IRF3__Homo_sapiens__ADN86150
auggugcuggcuccccucccugacccaggcccgcccagccuugccgucgcaccugagccaugcccccagccucugagauccccaucuuuggauaaccccaccccuuucccaaauuuagggccgucagaaaacccccugaagaggcuacucguuccuggagaggaccugaucacauuuacugaagguaguggccggagcccacgcuacgcccuuugguucugugugggggaguccuggccccaagaucagccuuggacgaaacgacugguaauggugaaggucgugccaaccugcuugcgugcgcucguugaaauggcuagagugggaggcgccucuucgcuggagaauacagucgaccugcacauuucaaacagccauccccucaguuuaacuuccgaucaguauaaagcauaccugcaggaccuuguggaggguauggauuuucaagggccgggagaaaccuga

SEQ ID NO: 8806 - RNA, 465 nt, Artificial Sequence
  derived and/or modified sequence opt4 from IRF3__Homo_sapiens__ADN86150
auggugcuggccccccugcccgaccccggcccccccagccuggccguggcccccgagcccugcccccagccccugagaagccccagccuggacaaccccacccccuuccccaaccugggccccagcgagaacccccugaagagacugcuggugcccggcgaggaccugaucaccuucaccgagggcagcggcagaagccccagauacgcccugugguucugcgugggcgagagcuggccccaggaccagcccuggaccaagagacuggugauggugaagguggugcccaccugccugagagcccugguggagauggccagagugggcggcgccagcagccuggagaacaccguggaccugcacaucagcaacagccacccccugagccugaccagcgaccaguacaaggccuaccugcaggaccugguggagggcauggacuuccagggccccggcgagaccuga

SEQ ID NO: 8807 - RNA, 465 nt, Artificial Sequence
  derived and/or modified sequence opt5 from IRF3__Homo_sapiens__ADN86150
auggugcuggcuccccucccugacccggggcccccuagccuggcugucgcccccgagccuugcccccagccucuuagauccccgucucuggauaaccccaccccuuuccccaaucucggcccuagcgaaaacccccugaagcggcuucugguuccgggagaggaccucaucacauuuacggaaggcuccgggcgcucuccuagauacgcgcugugguucugugugggagagagcuggccccaagaucagccuuggaccaaacggcuggugauggucaaggugguucccacaugccuccgcgcucugguggaaauggccagagucggcggggccuccucucuugagaauaccguggaccugcacauuagcaacucccauccccucagccugacaucugaucaguauaaagccuaccuucaggaccugguugagggaauggauuuucaaggcccuggcgaaaccuga

SEQ ID NO: 8808 - protein, 300 aa, Artificial Sequence [sequence omitted]

SEQ ID NO: 8809 - RNA, 903 nt, Artificial Sequence
  IRF3__Homo_sapiens__ADN86151
augggaaccccaaagccacggauccugcccuggcuggugucgcagcuggaccuggggcaacuggagggcguggccugggugaacaagagccgcacgcgcuuccgcaucccuuggaagcacggccuacggcaggaugcacagcaggaggauuucggaaucuuccaggccugggccgaggccacuggugcauauguucccgggagggauaagccagaccugccaaccuggaagaggaauuuccgcucugcccucaaccgcaaagaaggguugcguuuagcagaggaccggagcaaggacccucacgacccacauaaaaucuacgaguuugugaacucaggaguuggggacuuuucccagccagacaccucuccggacaccaaugguggaggcaguacuucugauacccaggaagacauucuggacgaguuacuggguaacaugguguuggccccacucccagauccgggacccccaagccuggcuguagccccugagcccugcccucagccccugcggagccccagcuuggacaaucccacucccuucccaaaccuggggcccucugagaacccacugaagcggcuguuggugccgggggaagaucugauuaccuucacggaaggaagcggacguucaccacgcuaugcccucugguucugugugggggagucauggccccaggaccagccguggaccaagaggcucgugauggucaagguugugcccacgugccucagggccuugguagaaauggcccggguagggggugccuccucccuggagaauacuguggaccugcacauuuccaacagccacccacucucccucaccuccgaccaguacaaggccuaccugcaggacuugguggagggcauggauuuccagggcccuggggagaccuga

SEQ ID NO: 8810 - RNA, 903 nt, Artificial Sequence
  derived and/or modified sequence opt1 from IRF3__Homo_sapiens__ADN86151
augggcacccccaagccgcgcauccugcccuggcucgugagccagcuggaccuggggcagcucgagggcgucgccugggugaacaagucccggacccgcuuccggauccccuggaagcacgggcugcgccaggacgcccagcaggaggacuucggcaucuuccaggcgugggccgaggccacgggggccuacgugcccggccgggacaagccggaccugcccaccuggaagcgcaacuuccggagcgcccucaaccgcaaggagggccugcggcuggcggaggaccgcuccaaggacccccacgacccccacaagaucuacgaguucgucaacagcggggugggcgacuucucccagccggacaccagccccgacaccaacgggggcggguccacgagcgacacccaggaggacauccucgacgagcugcugggcaacauggugcucgcgccccugcccgacccgggcccgcccucccuggccgucgcccccgagcccugcccccagccccuccggagccccucccuggacaacccgacccccuuccccaaccuggggcccagcgagaacccgcucaagcgccugcuggugcccggcgaggaccucaucaccuucacggagggguccggccggagcccccgcuacgcccugugguucugcgugggcgaguccuggccccaggaccagccguggaccaagcggcuggucauggugaagguggucccgaccugccuccgcgcccugguggagauggcccgggucgggggcgccagcucccuggagaacaccguggaccuccacaucagcaacucccacccccugagccugacgagcgaccaguacaaggccuaccuccaggaccugguggaggggauggacuuccagggccccggggagaccuga

SEQ ID NO: 8811 - RNA, 903 nt, Artificial Sequence
  derived and/or modified sequence opt2 from IRF3__Homo_sapiens__ADN86151
augggcacccccaagccccgcauccuccccuggcucgucucccagcucgaccucggccagcucgagggcgucgccugggucaacaagucccgcacccgcuuccgcauccccuggaagcacggccuccgccaggacgcccagcaggaggacuucggcaucuuccaggccugggccgaggccaccggcgccuacguccccggccgcgacaagcccgaccuccccaccuggaagcgcaacuuccgcuccgcccucaaccgcaaggagggccuccgccucgccgaggaccgcuccaaggacccccacgacccccacaagaucuacgaguucgucaacuccggcgucggcgacuucucccagcccgacaccucccccgacaccaacggcggcggcuccaccuccgacacccaggaggacauccucgacgagcuccucggcaacaugguccucgccccccuccccgaccccggcccccccucccucgccgucgcccccgagcccugcccccagccccuccgcucccccucccucgacaaccccacccccuuccccaaccucggccccuccgagaacccccucaagcgccuccucguccccggcgaggaccucaucaccuucaccgagggcuccggccgcuccccccgcuacgcccucugguucugcgucggcgaguccuggccccaggaccagcccuggaccaagcgccucgucauggucaaggucguccccaccugccuccgcgcccucgucgagauggcccgcgucggcggcgccuccucccucgagaacaccgucgaccuccacaucuccaacucccacccccucucccucaccuccgaccaguacaaggccuaccuccaggaccucgucgagggcauggacuuccagggccccggcgagaccuga

SEQ ID NO: 8812 - RNA, 903 nt, Artificial Sequence
  derived and/or modified sequence opt3 from IRF3__Homo_sapiens__ADN86151
augggcacccccaagccuagaauccugccauggcucgugagccagcuugaccuggggcaauuggagggagucgccuggguuaacaaauccaggacacgguuccgcauuccguggaagcacgguuuacgacaggaugcucagcaggaagacuuuggcauauuccaagcaugggccgaggcgacuggggcuuacgugcccggacgugauaaaccugaccugccaacguggaagagaaauuuuaggucugcccuaaaccggaaagaaggccuccgccuggcagaggauagaucaaaggacccccaugauccucacaagaucuaugaguucguaaauaguggugugggggacuuuagccagccagauaccucccccgacacaaacggaggcggcucuacuucggauacccaggaagacauucuugaugagcuguuggggaauaugguccucgccccucugccagacccgggacccccuucacuggcuguggcaccagaacccugcccucagccacucaggagccccaguuuagacaacccgacaccuuuccccaaucuggguccauccgagaacccucuuaaacgguugcugguucccggcgaagaucuaaucaccuuuacugaggggucuggacgcagcccacgauacgcccucugguucugugugggcgaguccuggccccaagaccagccuuggacaaagagacuggucauggugaaaguaguuccaaccugccuuagggcucugguggaaauggcccgggucgguggggcgucaaguuuggagaauacgguggaucuccauauuagcaacucucacccgcuguccuuaacuucagaccaguauaaggcauaccugcaggaucucguggaaggaauggacuuucaaggccccggcgagaccuga

SEQ ID NO: 8813 - RNA, 903 nt, Artificial Sequence
  derived and/or modified sequence opt4 from IRF3__Homo_sapiens__ADN86151
augggcacccccaagcccagaauccugcccuggcuggugagccagcuggaccugggccagcuggagggcguggccugggugaacaagagcagaaccagauucagaauccccuggaagcacggccugagacaggacgcccagcaggaggacuucggcaucuuccaggccugggccgaggccaccggcgccuacgugcccggcagagacaagcccgaccugcccaccuggaagagaaacuucagaagcgcccugaacagaaaggagggccugagacuggccgaggacagaagcaaggacccccacgacccccacaagaucuacgaguucgugaacagcggcgugggcgacuucagccagcccgacaccagccccgacaccaacggcggcggcagcaccagcgacacccaggaggacauccuggacgagcugcugggcaacauggugcuggccccccugcccgaccccggcccccccagccuggccguggcccccgagcccugcccccagccccugagaagccccagccuggacaaccccacccccuuccccaaccugggccccagcgagaacccccugaagagacugcuggugcccggcgaggaccugaucaccuucaccgagggcagcggcagaagccccagauacgcccugugguucugcgugggcgagagcuggccccaggaccagcccuggaccaagagacuggugauggugaagguggugcccaccugccugagagcccugguggagauggccagagugggcggcgccagcagccuggagaacaccguggaccugcacaucagcaacagccacccccugagccugaccagcgaccaguacaaggccuaccugcaggaccugguggagggcauggacuuccagggccccggcgagaccuga

SEQ ID NO: 8814 - RNA, 903 nt, Artificial Sequence
  derived and/or modified sequence opt5 from IRF3__Homo_sapiens__ADN86151
augggcacccccaagccuagaauccugccguggcucgugagccagcuggaccuugggcaacuggagggagucgccuggguuaacaaaucccggacacgcuuccggauucccuggaagcacggccucagacaggaugcucagcaggaagacuuugggaucuuccaagccugggcggaggcuacgggagccuacgugccuggccgcgauaaacccgaccugccuaccuggaagagaaauuuucggucugcccuuaaccgcaaagaagggcugagacucgcugaggaucggagcaaggacccccaugauccucacaagauuuaugaguucgucaauuccggagugggcgacuuuucucagccggauacaagccccgacaccaacggcgggggauccacaucugauacccaggaagacauccuggaugagcugcucggcaauauggugcuggccccucuucccgacccugggcccccgagccuggcuguugccccugaacccugcccucagccccuccgcucccccagccuggacaacccuacaccguuccccaaucuuggaccuucugagaacccccugaaaagacuccuggugccuggcgaagaucugauuaccuuuacggagggguccggacggagcccccgcuacgcgcucugguucugugucggcgagucuuggccgcaagaccagccuuggaccaagagacuggugaugguuaaagugguccccacaugccuucgggcccugguggaaauggcucgcgugggcggggccuccagccucgagaauaccgucgaucugcauaucucuaacucccacccucuuagccugacauccgaccaguauaaggcuuaccuccaggaucugguugaaggaauggacuuucaaggccccggggagaccuga

SEQ ID NO: 8815 - protein, 427 aa, Artificial Sequence
  IRF3__Homo_sapiens__Q14653
MGTPKPRILPWLVSQLDLGQLEGVAWVNKSRTRFRIPWKHGLRQDAQQEDFGIFQAWAEATGAYVPGRDKPDLPTWKRNFRSALNRKEGLRLAEDRSKDPHDPHKIYEFVNSGVGDFSQPDTSPDTNGGGSTSDTQEDILDELLGNMVLAPLPDPGPPSLAVAPEPCPQPLRSPSLDNPTPFPNLGPSENPLKRLLVPGEEWEFEVTAFYRGRQVFQQTISCPEGLRLVGSEVGDRTLPGWPVTLPDPGMSLTDRGVMSYVRHVLSCLGGGLALWRAGQWLWAQRLGHCHTYWAVSEELLPNSGHGPDGEVPKDKEGGVFDLGPFIVDLITFTEGSGRSPRYALWFCVGESWPQDQPWTKRLVMVKVVPTCLRALVEMARVGGASSLENTVDLHISNSHPLSLTSDQYKAYLQDLVEGMDFQGPGES

SEQ ID NO: 8816 - RNA, 1284 nt, Artificial Sequence
  IRF3__Homo_sapiens__AAH71721
augggaaccccaaagccacggauccugcccuggcuggugucgcagcuggaccuggggcaacuggagggcguggccugggugaacaagagccgcacgcgcuuccgcaucccuuggaagcacggccuacggcaggaugcacagcaggaggauuucggaaucuuccaggccugggccgaggccacuggugcauauguucccgggagggauaagccagaccugccaaccuggaagaggaauuuccgcucugcccucaaccgcaaagaaggguugcguuuagcagaggaccggagcaaggacccucacgacccacauaaaaucuacgaguuugugaacucaggaguuggggacuuuucccagccagacaccucuccggacaccaaugguggaggcaguacuucugauacccaggaagacauucuggaugaguuacuggguaacaugguguuggccccacucccagauccgggacccccaagccuggcuguagccccugagcccugcccucagccccugcggagccccagcuuggacaaucccacucccuucccaaaccuggggcccucugagaacccacugaagcggcuguuggugccgggggaagagugggaguucgaggugacagccuucuaccggggccgccaagucuuccagcagaccaucuccugcccggagggccugcggcuggugggguccgaagugggagacaggacgcugccuggauggccagucacacugccagacccuggcaugucccugacagacaggggagugaugagcuacgugaggcaugugcugagcugccugggugggggacuggcucucuggcgggccgggcaguggcucugggcccagcggcuggggcacugccacacauacugggcagugagcgaggagcugcuccccaacagcgggcaugggccugauggcgagguccccaaggacaaggaaggaggcguguuugaccuggggcccuucauuguagaucugauuaccuucacggaaggaagcggacgcucaccacgcuaugcccucugguucugugugggggagucauggccccaggaccagccguggaccaagaggcucgugauggucaagguugugcccacgugccucagggccuugguagaaauggcccggguagggggugccuccucccuggagaauacuguggaccugcacauuuccaacagccacccacucucccucaccuccgaccaguacaaggccuaccugcaggacuugguggagggcauggauuuccagggcccuggggagagcuga

SEQ ID NO: 8817 - RNA, 1284 nt, Artificial Sequence
  derived and/or modified sequence opt1 from IRF3__Homo_sapiens__AAH71721
augggcacccccaagccgcgcauccugcccuggcucgugagccagcuggaccuggggcagcucgagggcgucgccugggugaacaagucccggacccgcuuccggauccccuggaagcacgggcugcgccaggacgcccagcaggaggacuucggcaucuuccaggcgugggccgaggccacgggggccuacgugcccggccgggacaagccggaccugcccaccuggaagcgcaacuuccggagcgcccucaaccgcaaggagggccugcggcuggcggaggaccgcuccaaggacccccacgacccccacaagaucuacgaguucgucaacagcggggugggcgacuucucccagccggacaccagccccgacaccaacgggggcggguccacgagcgacacccaggaggacauccucgacgagcugcugggcaacauggugcucgcgccccugcccgacccgggcccgcccucccuggccgucgcccccgagcccugcccccagccccuccggagccccucccuggacaacccgacccccuuccccaaccuggggcccagcgagaacccgcucaagcgccugcuggugcccggcgaggagugggaguucgaggugaccgccuucuaccgggggcgccaggucuuccagcagacgaucuccugccccgagggccuccggcuggugggcagcgaggugggggaccgcacccugcccggcuggccggucacccuccccgaccccgggaugucccugaccgaccggggcgugaugagcuacgugcgccacguccuguccugccucgggggcggccuggcccuguggcgggccgggcaguggcucugggcccagcgccugggccacugccacacguacugggccgugagcgaggagcugcucccgaacuccgggcacggccccgacggggaggugcccaaggacaaggagggcggcgucuucgaccuggggcccuucaucguggaccugaucaccuucaccgagggcagcgggcggagcccgcgcuacgcgcucugguucugcgugggcgaguccuggccccaggaccagcccuggaccaagcgccuggucauggugaaggugguccccacgugccugcgggcccucguggagauggcccgcgucgggggcgccagcucccuggagaacaccguggaccugcacaucagcaacucccacccgcucagccugaccuccgaccaguacaaggccuaccugcaggaccucguggagggcauggacuuccaggggcccggcgagagcuga

SEQ ID NO: 8818 - RNA, 1284 nt, Artificial Sequence
  derived and/or modified sequence opt2 from IRF3__Homo_sapiens__AAH71721
augggcacccccaagccccgcauccuccccuggcucgucucccagcucgaccucggccagcucgagggcgucgccugggucaacaagucccgcacccgcuuccgcauccccuggaagcacggccuccgccaggacgcccagcaggaggacuucggcaucuuccaggccugggccgaggccaccggcgccuacguccccggccgcgacaagcccgaccuccccaccuggaagcgcaacuuccgcuccgcccucaaccgcaaggagggccuccgccucgccgaggaccgcuccaaggacccccacgacccccacaagaucuacgaguucgucaacuccggcgucggcgacuucucccagcccgacaccucccccgacaccaacggcggcggcuccaccuccgacacccaggaggacauccucgacgagcuccucggcaacaugguccucgccccccuccccgaccccggcccccccucccucgccgucgcccccgagcccugcccccagccccuccgcucccccucccucgacaaccccacccccuuccccaaccucggccccuccgagaacccccucaagcgccuccucguccccggcgaggagugggaguucgaggucaccgccuucuaccgcggccgccaggucuuccagcagaccaucuccugccccgagggccuccgccucgucggcuccgaggucggcgaccgcacccuccccggcuggcccgucacccuccccgaccccggcaugucccucaccgaccgcggcgucauguccuacguccgccacguccucuccugccucggcggcggccucgcccucuggcgcgccggccaguggcucugggcccagcgccucggccacugccacaccuacugggccgucuccgaggagcuccuccccaacuccggccacggccccgacggcgagguccccaaggacaaggagggcggcgucuucgaccucggccccuucaucgucgaccucaucaccuucaccgagggcuccggccgcuccccccgcuacgcccucugguucugcgucggcgaguccuggccccaggaccagcccuggaccaagcgccucgucauggucaaggucguccccaccugccuccgcgcccucgucgagauggcccgcgucggcggcgccuccucccucgagaacaccgucgaccuccacaucuccaacucccacccccucucccucaccuccgaccaguacaaggccuaccuccaggaccucgucgagggcauggacuuccagggccccggcgaguccuga

SEQ ID NO: 8819 - RNA, 1284 nt, Artificial Sequence
  derived and/or modified sequence opt3 from IRF3__Homo_sapiens__AAH71721
augggcacccccaagccuagaauccugccauggcucgugagccagcuugaccuggggcaauuggagggagucgccuggguuaacaaauccaggacacgguuccgcauuccguggaagcacgguuuacgacaggaugcucagcaggaagacuuuggcauauuccaagcaugggccgaggcgacuggggcuuacgugcccggacgugauaaaccugaccugccaacguggaagagaaauuuuaggucugcccuaaaccggaaagaaggccuccgccuggcagaggauagaucaaaggacccccaugauccucacaagaucuaugaguucguaaauaguggugugggggacuuuagccagccagauaccucccccgacacaaacggaggcggcucuacuucggauacccaggaagacauucuugaugagcuguuggggaauaugguccucgccccucugccagacccgggacccccuucacuggcuguggcaccagaacccugcccucagccacucaggagccccaguuuagacaacccgacaccuuuccccaaucuggguccauccgagaacccucuuaaacgguugcugguucccggcgaagagugggaguuugaagugaccgccuucuaccgcgggcgacaagucuuucagcagacuaucucuuguccagagggacuaagacucgugggcagcgaaguaggugauaggacacugcccggguggccuguuacccuuccagacccgggaaugucccugacggaucggggcgugaugucauauguccgucauguguugaguugccucggcgggggacuggcuuuauggcgcgccggucaguggcugugggcgcaaagacucggccacugucauacuuacugggcagugagcgaggaacuucugcccaauucugggcacggaccugacggcgaggucccaaaggauaaagagggugggguuuucgacuugggccccuuuauuguggaucuaaucaccuucacagaaggauccggcaggucaccucgguaugcccugugguuuugcguaggggagagcuggccacaggaccagcccuggacuaagcgacucgugauggucaaagugguuccgaccugucugcgcgcucuuguggaaauggccagagucggaggugcaaguucucuggagaacacaguggauuugcacauauccaauagccauccucucucgcugaccucugaccaauacaaggcuuauuuacaggaucugguagaaggcauggacuuccaggggccaggagaguccuga

SEQ ID NO: 8820 - RNA, 1284 nt, Artificial Sequence
  derived and/or modified sequence opt4 from IRF3__Homo_sapiens__AAH71721
augggcacccccaagcccagaauccugcccuggcuggugagccagcuggaccugggccagcuggagggcguggccugggugaacaagagcagaaccagauucagaauccccuggaagcacggccugagacaggacgcccagcaggaggacuucggcaucuuccaggccugggccgaggccaccggcgccuacgugcccggcagagacaagcccgaccugcccaccuggaagagaaacuucagaagcgcccugaacagaaaggagggccugagacuggccgaggacagaagcaaggacccccacgacccccacaagaucuacgaguucgugaacagcggcgugggcgacuucagccagcccgacaccagccccgacaccaacggcggcggcagcaccagcgacacccaggaggacauccuggacgagcugcugggcaacauggugcuggccccccugcccgaccccggcccccccagccuggccguggcccccgagcccugcccccagccccugagaagccccagccuggacaaccccacccccuuccccaaccugggccccagcgagaacccccugaagagacugcuggugcccggcgaggagugggaguucgaggugaccgccuucuacagaggcagacagguguuccagcagaccaucagcugccccgagggccugagacuggugggcagcgaggugggcgacagaacccugcccggcuggcccgugacccugcccgaccccggcaugagccugaccgacagaggcgugaugagcuacgugagacacgugcugagcugccugggcggcggccuggcccuguggagagccggccaguggcugugggcccagagacugggccacugccacaccuacugggccgugagcgaggagcugcugcccaacagcggccacggccccgacggcgaggugcccaaggacaaggagggcggcguguucgaccugggccccuucaucguggaccugaucaccuucaccgagggcagcggcagaagccccagauacgcccugugguucugcgugggcgagagcuggccccaggaccagcccuggaccaagagacuggugauggugaagguggugcccaccugccugagagcccugguggagauggccagagugggcggcgccagcagccuggagaacaccguggaccugcacaucagcaacagccacccccugagccugaccagcgaccaguacaaggccuaccugcaggaccugguggagggcauggacuuccagggccccggcgagagcuga

SEQ ID NO: 8821 - RNA, 1284 nt, Artificial Sequence
  derived and/or modified sequence opt5 from IRF3__Homo_sapiens__AAH71721
augggcacccccaagccuagaauccugccguggcucgugagccagcuggaccuugggcaacuggagggagucgccuggguuaacaaaucccggacacgcuuccggauucccuggaagcacggccucagacaggaugcucagcaggaagacuuugggaucuuccaagccugggcggaggcuacgggagccuacgugccuggccgcgauaaacccgaccugccuaccuggaagagaaauuuucggucugcccuuaaccgcaaagaagggcugagacucgcugaggaucggagcaaggacccccaugauccucacaagauuuaugaguucgucaauuccggagugggcgacuuuucucagccggauacaagccccgacaccaacggcgggggauccacaucugauacccaggaagacauccuggaugagcugcucggcaauauggugcuggccccucuucccgacccugggcccccgagccuggcuguugccccugaacccugcccucagccccuccgcucccccagccuggacaacccuacaccguuccccaaucuuggaccuucugagaacccccugaaaagacuccuggugccuggcgaagagugggaguuugaagucaccgcguucuaccgggggcgccaaguguuucagcagacgauuuccugucccgagggacugagacucguuggcagcgaagugggcgaucggacccugccgggguggccugucacacuucccgacccuggaaugucucugaccgaucgcggcgugauguccuaugugagacauguccucagcugccuugggggaggccuggcccuguggcgggcugggcaguggcucugggcccaaagacugggacacugucauacauacugggcuguuucugaggaacugcuccccaauuccggccacggcccugacggggaggugcccaaggauaaagagggaggcguguucgaccuggggccguuuaucgucgaucuuaucaccuucacggaaggaagcggccgcuccccucgguaugcccugugguuuugcgugggggagucuuggccccaggaccagcccuggacaaagagacucguuauggugaaagucgugccuaccugucugcgcgcgcuuguugaaauggcccgggugggcggagcuagcucccuggagaacacagucgaucuccacauuagcaauucucauccgcugucccugaccagcgaccaauacaaggccuaucuccaggaucugguggaaggcauggacuuccaggggcccggagagucuuga

SEQ ID NO: 8822 - protein, 452 aa, Artificial Sequence
  IRF3__Homo_sapiens__Q96GL3
MGTPKPRILPWLVSQLDLGQLEGVAWVNKSRTRFRIPWKHGLRQDAQQEDFGIFQAWAEATGAYVPGRDKPDLPTWKRNFRSALNRKEGLRLAEDRSKDPHDPHKIYEFVNSGVGDFSQPDTSPDTNGGGSTSDTQEDILDELLGNMVLAPLPDPGPPSLAVAPEPCPQPLRSPSLDNPTPFPNLGPSENPLKRLLVPGEEWEFEVTAFYRGRQVFQQTISCPEGLRLVGSEVGDRTLPGWPVTLPDPGMSLTDRGVMSYVRHVLSCLGGGLALWRAGQWLWAQRLGHCHTYWAVSEELLPNSGHGPDGEVPKDKEGGVFDLGPFIVGSWAPRSDYLHGRKRTLTTLCPLVLCGGVMAPGPAVDQEARDGQGCAHVPQGLGRNGPGRGCLLPGEYCGPAHFQQPPTLPHLRPVQGLPAGLGGGHGFPGPWGDLSPRSSWCASNPPVPHHLNQ

SEQ ID NO: 8823 - RNA, 1359 nt, Artificial Sequence
  IRF3__Homo_sapiens__AAH09395
augggaaccccaaagccacggauccugcccuggcuggugucgcagcuggaccuggggcaacuggagggcguggccugggugaacaagagccgcacgcgcuuccgcaucccuuggaagcacggccuacggcaggaugcacagcaggaggauuucggaaucuuccaggccugggccgaggccacuggugcauauguucccgggagggauaagccagaccugccaaccuggaagaggaauuuccgcucugcccucaaccgcaaagaaggguugcguuuagcagaggaccggagcaaggacccucacgacccacauaaaaucuacgaguuugugaacucaggaguuggggacuuuucccagccagacaccucuccggacaccaaugguggaggcaguacuucugauacccaggaagacauucuggaugaguuacuggguaacaugguguuggccccacucccagauccgggacccccaagccuggcuguagccccugagcccugcccucagccccugcggagccccagcuuggacaaucccacucccuucccaaaccuggggcccucugagaacccacugaagcggcuguuggugccgggggaagagugggaguucgaggugacagccuucuaccggggccgccaagucuuccagcagaccaucuccugcccggagggccugcggcuggugggguccgaagugggagacaggacgcugccuggauggccagucacacugccagacccuggcaugucccugacagacaggggagugaugagcuacgugaggcaugugcugagcugccugggugggggacuggcucucuggcgggccgggcaguggcucugggcccagcggcuggggcacugccacacauacugggcagugagcgaggagcugcuccccaacagcgggcaugggccugauggcgagguccccaaggacaaggaaggaggcguguuugaccuggggcccuucauuguaggcuccugggcccccagaucugauuaccuucacggaaggaagcggacgcucaccacgcuaugcccucugguucugugugggggagucauggccccaggaccagccguggaccaagaggcucgugauggucaagguugugcccacgugccucagggccuugguagaaauggcccggguagggggugccuccucccuggagaauacuguggaccugcacauuuccaacagccacccacucucccucaccuccgaccaguacaaggccuaccugcaggacuugguggagggcauggauuuccagggcccuggggagaccugagcccucgcuccucauggugugccuccaaccccccuguuccccaccaccucaaccaauaa

SEQ ID NO: 8824 - RNA, 1359 nt, Artificial Sequence
  derived and/or modified sequence opt1 from IRF3__Homo_sapiens__AAH09395
augggcacccccaagccgcgcauccugcccuggcucgugagccagcuggaccuggggcagcucgagggcgucgccugggugaacaagucccggacccgcuuccggauccccuggaagcacgggcugcgccaggacgcccagcaggaggacuucggcaucuuccaggcgugggccgaggccacgggggccuacgugcccggccgggacaagccggaccugcccaccuggaagcgcaacuuccggagcgcccucaaccgcaaggagggccugcggcuggcggaggaccgcuccaaggacccccacgacccccacaagaucuacgaguucgucaacagcggggugggcgacuucucccagccggacaccagccccgacaccaacgggggcggguccacgagcgacacccaggaggacauccucgacgagcugcugggcaacauggugcucgcgccccugcccgacccgggcccgcccucccuggccgucgcccccgagcccugcccccagccccuccggagccccucccuggacaacccgacccccuuccccaaccuggggcccagcgagaacccgcucaagcgccugcuggugcccggcgaggagugggaguucgaggugaccgccuucuaccgggggcgccaggucuuccagcagacgaucuccugccccgagggccuccggcuggugggcagcgaggugggggaccgcacccugcccggcuggccggucacccuccccgaccccgggaugucccugaccgaccggggcgugaugagcuacgugcgccacguccuguccugccucgggggcggccuggcccuguggcgggccgggcaguggcucugggcccagcgccugggccacugccacacguacugggccgugagcgaggagcugcucccgaacuccgggcacggccccgacggggaggugcccaaggacaaggagggcggcgucuucgaccuggggcccuucaucgugggcagcugggcgccgcggagcgacuaccugcacgggcgcaagcgcacccucaccacccugugcccccuggugcucugcggcggggucauggcccccggccccgccguggaccaggaggcccgggacggccaggggugcgcccacgugccgcagggccuggggcgcaacggccccggccgggggugccugcuccccggcgaguacugcgggcccgcgcacuuccagcagccgcccacgcugccccaccuccgccccguccagggccugccggccgggcugggcggcgggcacggcuuccccgggcccuggggcgaccugagcccccgguccuccuggugcgccagcaacccgcccgugccccaccaccucaaccaguga

SEQ ID NO: 8825 - RNA, 1359 nt, Artificial Sequence
  derived and/or modified sequence opt2 from IRF3__Homo_sapiens__AAH09395
augggcacccccaagccccgcauccuccccuggcucgucucccagcucgaccucggccagcucgagggcgucgccugggucaacaagucccgcacccgcuuccgcauccccuggaagcacggccuccgccaggacgcccagcaggaggacuucggcaucuuccaggccugggccgaggccaccggcgccuacguccccggccgcgacaagcccgaccuccccaccuggaagcgcaacuuccgcuccgcccucaaccgcaaggagggccuccgccucgccgaggaccgcuccaaggacccccacgacccccacaagaucuacgaguucgucaacuccggcgucggcgacuucucccagcccgacaccucccccgacaccaacggcggcggcuccaccuccgacacccaggaggacauccucgacgagcuccucggcaacaugguccucgccccccuccccgaccccggcccccccucccucgccgucgcccccgagcccugcccccagccccuccgcucccccucccucgacaaccccacccccuuccccaaccucggccccuccgagaacccccucaagcgccuccucguccccggcgaggagugggaguucgaggucaccgccuucuaccgcggccgccaggucuuccagcagaccaucuccugccccgagggccuccgccucgucggcuccgaggucggcgaccgcacccuccccggcuggcccgucacccuccccgaccccggcaugucccucaccgaccgcggcgucauguccuacguccgccacguccucuccugccucggcggcggccucgcccucuggcgcgccggccaguggcucugggcccagcgccucggccacugccacaccuacugggccgucuccgaggagcuccuccccaacuccggccacggccccgacggcgagguccccaaggacaaggagggcggcgucuucgaccucggccccuucaucgucggcuccugggccccccgcuccgacuaccuccacggccgcaagcgcacccucaccacccucugcccccucguccucugcggcggcgucauggcccccggccccgccgucgaccaggaggcccgcgacggccagggcugcgcccacgucccccagggccucggccgcaacggccccggccgcggcugccuccuccccggcgaguacugcggccccgcccacuuccagcagccccccacccucccccaccuccgccccguccagggccuccccgccggccucggcggcggccacggcuuccccggccccuggggcgaccucuccccccgcuccuccuggugcgccuccaacccccccgucccccaccaccucaaccaguga

SEQ ID NO: 8826 - RNA, 1359 nt, Artificial Sequence
  derived and/or modified sequence opt3 from IRF3__Homo_sapiens__AAH09395
augggcacccccaagccuagaauccugccauggcucgugagccagcuugaccuggggcaauuggagggagucgccuggguuaacaaauccaggacacgguuccgcauuccguggaagcacgguuuacgacaggaugcucagcaggaagacuuuggcauauuccaagcaugggccgaggcgacuggggcuuacgugcccggacgugauaaaccugaccugccaacguggaagagaaauuuuaggucugcccuaaaccggaaagaaggccuccgccuggcagaggauagaucaaaggacccccaugauccucacaagaucuaugaguucguaaauaguggugugggggacuuuagccagccagauaccucccccgacacaaacggaggcggcucuacuucggauacccaggaagacauucuugaugagcuguuggggaauaugguccucgccccucugccagacccgggacccccuucacuggcuguggcaccagaacccugcccucagccacucaggagccccaguuuagacaacccgacaccuuuccccaaucuggguccauccgagaacccucuuaaacgguugcugguucccggcgaagagugggaguuugaagugaccgccuucuaccgcgggcgacaagucuuucagcagacuaucucuuguccagagggacuaagacucgugggcagcgaaguaggugauaggacacugcccggguggccuguuacccuuccagacccgggaaugucccugacggaucggggcgugaugucauauguccgucauguguugaguugccucggcgggggacuggcuuuauggcgcgccggucaguggcugugggcgcaaagacucggccacugucauacuuacugggcagugagcgaggaacuucugcccaauucugggcacggaccugacggcgaggucccaaaggauaaagagggugggguuuucgacuugggccccuuuauugugggauccugggccccuaggucagauuaucuacacggccggaagcgaacccugacaacucucugcccacugguacuuugugggggagugauggcucccgguccggccgucgaccaggaagcacgcgauggccaggggugcgcucaugugccucaaggacugggcagaaacgguccagggaggggcuguuugcuccccggagaguacugcggcccugcccacuuccagcagcccccaacccugccucauuuacggcccguucaggggcugccagcgggacuagguggcgggcacggauuuccgggcccuuggggugaccucagcccccgcaguucuuggugugccuccaauccacccgugccucaccaucugaaccaauga

SEQ ID NO: 8827 - RNA, 1359 nt, Artificial Sequence
  derived and/or modified sequence opt4 from IRF3__Homo_sapiens__AAH09395
augggcacccccaagcccagaauccugcccuggcuggugagccagcuggaccugggccagcuggagggcguggccugggugaacaagagcagaaccagauucagaauccccuggaagcacggccugagacaggacgcccagcaggaggacuucggcaucuuccaggccugggccgaggccaccggcgccuacgugcccggcagagacaagcccgaccugcccaccuggaagagaaacuucagaagcgcccugaacagaaaggagggccugagacuggccgaggacagaagcaaggacccccacgacccccacaagaucuacgaguucgugaacagcggcgugggcgacuucagccagcccgacaccagccccgacaccaacggcggcggcagcaccagcgacacccaggaggacauccuggacgagcugcugggcaacauggugcuggccccccugcccgaccccggcccccccagccuggccguggcccccgagcccugcccccagccccugagaagccccagccuggacaaccccacccccuuccccaaccugggccccagcgagaacccccugaagagacugcuggugcccggcgaggagugggaguucgaggugaccgccuucuacagaggcagacagguguuccagcagaccaucagcugccccgagggccugagacuggugggcagcgaggugggcgacagaacccugcccggcuggcccgugacccugcccgaccccggcaugagccugaccgacagaggcgugaugagcuacgugagacacgugcugagcugccugggcggcggccuggcccuguggagagccggccaguggcugugggcccagagacugggccacugccacaccuacugggccgugagcgaggagcugcugcccaacagcggccacggccccgacggcgaggugcccaaggacaaggagggcggcguguucgaccugggccccuucaucgugggcagcugggcccccagaagcgacuaccugcacggcagaaagagaacccugaccacccugugcccccuggugcugugcggcggcgugauggcccccggccccgccguggaccaggaggccagagacggccagggcugcgcccacgugccccagggccugggcagaaacggccccggcagaggcugccugcugcccggcgaguacugcggccccgcccacuuccagcagccccccacccugccccaccugagacccgugcagggccugcccgccggccugggcggcggccacggcuuccccggccccuggggcgaccugagccccagaagcagcuggugcgccagcaacccccccgugccccaccaccugaaccaguga

SEQ ID NO: 8828 - RNA, 1359 nt, Artificial Sequence
  derived and/or modified sequence opt5 from IRF3__Homo_sapiens__AAH09395
augggcacccccaagccuagaauccugccguggcucgugagccagcuggaccuugggcaacuggagggagucgccuggguuaacaaaucccggacacgcuuccggauucccuggaagcacggccucagacaggaugcucagcaggaagacuuugggaucuuccaagccugggcggaggcuacgggagccuacgugccuggccgcgauaaacccgaccugccuaccuggaagagaaauuuucggucugcccuuaaccgcaaagaagggcugagacucgcugaggaucggagcaaggacccccaugauccucacaagauuuaugaguucgucaauuccggagugggcgacuuuucucagccggauacaagccccgacaccaacggcgggggauccacaucugauacccaggaagacauccuggaugagcugcucggcaauauggugcuggccccucuucccgacccugggcccccgagccuggcuguugccccugaacccugcccucagccccuccgcucccccagccuggacaacccuacaccguuccccaaucuuggaccuucugagaacccccugaaaagacuccuggugccuggcgaagagugggaguuugaagucaccgcguucuaccgggggcgccaaguguuucagcagacgauuuccugucccgagggacugagacucguuggcagcgaagugggcgaucggacccugccgggguggccugucacacuucccgacccuggaaugucucugaccgaucgcggcgugauguccuaugugagacauguccucagcugccuugggggaggccuggcccuguggcgggcugggcaguggcucugggcccaaagacugggacacugucauacauacugggcuguuucugaggaacugcuccccaauuccggccacggcccugacggggaggugcccaaggauaaagagggaggcguguucgaccuggggccguuuaucgucggaagcugggccccucgcuccgauuaucuucacggccggaagagaacccugacgacacucugcccccuggugcuuugugggggcguuauggcgcccggaccugccguggaccaggaagcucgcgauggccaggggugcgcccaugucccgcaaggacugggccggaacgggcccggaagaggcugucuccugccuggggaguacugcggccccgcucacuuccagcagccucccacccugccucaucuccgccccgugcagggacugccggccggccuugggggaggccacggguuuccuggacccuggggcgaccugucuccucggagcuccuggugugccagcaaucccccgguuccucaccaucucaaccaauga

SEQ ID NO: 8829 - protein, 503 aa, Artificial Sequence
  IRF-7__Homo_sapiens__Q92985
MALAPERAAPRVLFGEWLLGEISSGCYEGLQWLDEARTCFRVPWKHFARKDLSEADARIFKAWAVARGRWPPSSRGGGPPPEAETAERAGWKTNFRCALRSTRRFVMLRDNSGDPADPHKVYALSRELCWREGPGTDQTEAEAPAAVPPPQGGPPGPFLAHTHAGLQAPGPLPAPAGDKGDLLLQAVQQSCLADHLLTASWGADPVPTKAPGEGQEGLPLTGACAGGPGLPAGELYGWAVETTPSPGPQPAALTTGEAAAPESPHQAEPYLSPSPSACTAVQEPSPGALDVTIMYKGRTVLQKVVGHPSCTFLYGPPDPAVRATDPQQVAFPSPAELPDQKQLRYTEELLRHVAPGLHLELRGPQLWARRMGKCKVYWEVGGPPGSASPSTPACLLPRNCDTPIFDFRVFFQELVEFRARQRRGSPRYTIYLGFGQDLSAGRPKEKSLVLVKLEPWLCRVHLEGTQREGVSSLDSSSLSLCLSSANSLYDDIECFLMELEQPA

SEQ ID NO: 8830 - RNA, 1512 nt, Artificial Sequence
  IRF-7__Homo_sapiens__AAB80686
auggccuuggcuccugagagggcagccccacgcgugcuguucggagaguggcuccuuggagagaucagcagcggcugcuaugaggggcugcaguggcuggacgaggcccgcaccuguuuccgcgugcccuggaagcacuucgcgcgcaaggaccugagcgaggccgacgcgcgcaucuucaaggccugggcuguggcccgcggcagguggccgccuagcagcaggggagguggcccgccccccgaggcugagacugcggagcgcgccggcuggaaaaccaacuuccgcugcgcacugcgcagcacgcgucgcuucgugaugcugcgggauaacucgggggacccggccgacccgcacaagguguacgcgcucagccgggagcugugcuggcgagaaggcccaggcacggaccagacugaggcagaggcccccgcagcugucccaccaccacagggugggcccccagggccauucuuggcacacacacaugcuggacuccaagccccaggcccccucccugccccagcuggugacaagggggaccuccugcuccaggcagugcaacagagcugccuggcagaccaucugcugacagcgucauggggggcagauccagucccaaccaaggcuccuggagagggacaagaagggcuuccccugacuggggccugugcuggaggcccagggcucccugcuggggagcuguacgggugggcaguagagacgacccccagccccgggccccagcccgcggcacuaacgacaggcgaggccgcggccccagaguccccgcaccaggcagagccguaccugucacccuccccaagcgccugcaccgcggugcaagagcccagcccaggggcgcuggacgugaccaucauguacaagggccgcacggugcugcagaagguggugggacacccgagcugcacguuccuauacggccccccagacccagcuguccgggccacagacccccagcagguagcauuccccagcccugccgagcucccggaccagaagcagcugcgcuacacggaggaacugcugcggcacguggccccuggguugcaccuggagcuucgggggccacagcugugggcccggcgcaugggcaagugcaagguguacugggaggugggcggacccccaggcuccgccagccccuccaccccagccugccugcugccucggaacugugacacccccaucuucgacuucagagucuucuuccaagagcugguggaauuccgggcacggcagcgccguggcuccccacgcuauaccaucuaccugggcuucgggcaggaccugucagcugggaggcccaaggagaagagccugguccuggugaagcuggaacccuggcugugccgagugcaccuagagggcacgcagcgugagggugugucuucccuggauagcagcagccucagccucugccuguccagcgccaacagccucuaugacgacaucgagugcuuccuuauggagcuggagcagcccgccuag

SEQ ID NO: 8831 - RNA, 1512 nt, Artificial Sequence
  derived and/or modified sequence opt1 from IRF-7__Homo_sapiens__AAB80686
auggcccuggcccccgagcgcgcggccccgcggguccucuucggcgaguggcugcugggggagaucagcuccggcugcuacgaggggcuccaguggcuggacgaggcccggaccugcuuccgcgugcccuggaagcacuucgcccgcaaggaccugagcgaggccgacgcgcggaucuucaaggccugggccguggcccgcggccgguggccgcccuccagccgcgggggcgggcccccgcccgaggcggagaccgccgagcgggccggcuggaagacgaacuuccgcugcgcccuccgguccacccgccgguucgugaugcugcgcgacaacagcggcgaccccgccgacccccacaaggucuacgcgcugucccgggagcucugcuggcgcgaggggcccggcaccgaccagaccgaggccgaggcccccgccgccgugcccccgccccagggcgggccgcccggccccuuccuggcgcacacgcacgccgggcugcaggcccccggcccccuccccgccccggccggggacaagggcgaccugcugcuccaggcggugcagcagagcugccuggccgaccaccuccugaccgccuccuggggcgccgaccccguccccaccaaggcccccggggagggccaggaggggcugccgcugaccggcgcgugcgccgggggccccggccuccccgccggggagcuguacggcugggccguggagacgacccccagcccggggccccagcccgcggcccugaccaccggcgaggccgccgccccggagagcccccaccaggcggagcccuaccucagccccuccccgagcgccugcacggccgugcaggagcccucccccggggcccuggacgucaccaucauguacaagggccggaccgugcugcagaagguggucggccaccccagcugcaccuuccucuacgggccgcccgaccccgccgugcgcgcgacggacccccagcaggucgccuucccgucccccgccgagcugcccgaccagaagcagcugcgguacaccgaggagcuccugcgccacguggcccccggccugcaccucgagcugcgggggccgcagcugugggcccgccgcaugggcaagugcaagguguacugggaggucgggggcccgcccggcagcgcgucccccagcacccccgccugccuccugccccggaacugcgacacccccaucuucgacuuccgcguguucuuccaggagcugguggaguuccgggcccgccagcggcgcgggagcccccgguacacgaucuaccucggcuucgggcaggaccuguccgccggccgcccgaaggagaagucccuggugcucgucaagcuggagcccuggcugugccgggugcaccucgagggcacccagcgcgaggggguguccagccuggacuccagcucccugagccucugccuguccagcgcgaacucccuguacgacgacaucgagugcuuccugauggagcucgagcagcccgccuga

SEQ ID NO: 8832 - RNA, 1512 nt, Artificial Sequence
  derived and/or modified sequence opt2 from IRF-7__Homo_sapiens__AAB80686
auggcccucgcccccgagcgcgccgccccccgcguccucuucggcgaguggcuccucggcgagaucuccuccggcugcuacgagggccuccaguggcucgacgaggcccgcaccugcuuccgcguccccuggaagcacuucgcccgcaaggaccucuccgaggccgacgcccgcaucuucaaggccugggccgucgcccgcggccgcuggccccccuccucccgcggcggcggccccccccccgaggccgagaccgccgagcgcgccggcuggaagaccaacuuccgcugcgcccuccgcuccacccgccgcuucgucaugcuccgcgacaacuccggcgaccccgccgacccccacaaggucuacgcccucucccgcgagcucugcuggcgcgagggccccggcaccgaccagaccgaggccgaggcccccgccgccgucccccccccccagggcggcccccccggccccuuccucgcccacacccacgccggccuccaggcccccggcccccuccccgcccccgccggcgacaagggcgaccuccuccuccaggccguccagcaguccugccucgccgaccaccuccucaccgccuccuggggcgccgaccccguccccaccaaggcccccggcgagggccaggagggccucccccucaccggcgccugcgccggcggccccggccuccccgccggcgagcucuacggcugggccgucgagaccacccccucccccggcccccagcccgccgcccucaccaccggcgaggccgccgcccccgaguccccccaccaggccgagcccuaccucucccccucccccuccgccugcaccgccguccaggagcccucccccggcgcccucgacgucaccaucauguacaagggccgcaccguccuccagaaggucgucggccaccccuccugcaccuuccucuacggcccccccgaccccgccguccgcgccaccgacccccagcaggucgccuuccccucccccgccgagcuccccgaccagaagcagcuccgcuacaccgaggagcuccuccgccacgucgcccccggccuccaccucgagcuccgcggcccccagcucugggcccgccgcaugggcaagugcaaggucuacugggaggucggcggcccccccggcuccgccucccccuccacccccgccugccuccucccccgcaacugcgacacccccaucuucgacuuccgcgucuucuuccaggagcucgucgaguuccgcgcccgccagcgccgcggcuccccccgcuacaccaucuaccucggcuucggccaggaccucuccgccggccgccccaaggagaagucccucguccucgucaagcucgagcccuggcucugccgcguccaccucgagggcacccagcgcgagggcgucuccucccucgacuccuccucccucucccucugccucuccuccgccaacucccucuacgacgacaucgagugcuuccucauggagcucgagcagcccgccuga

SEQ ID NO: 8833 - RNA, 1512 nt, Artificial Sequence
  derived and/or modified sequence opt3 from IRF-7__Homo_sapiens__AAB80686
auggcccuggcucccgagagagcagccccuaggguucucuucggcgaauggcuucugggggagaucagcuccggaugcuacgaagguuugcagugguuagacgaggcgcggaccuguuuucgcgucccauggaagcacuucgcucgaaaagaucugucugaagccgacgcacguauuuuuaaggccugggcuguugcaagagggagguggccgcccucaagucggggcggaggcccuccacccgaggccgagacagcugaacgcgccgguuggaaaacuaacuucagaugcgcgcuaaggagcacgcggcgcuuugugaugcuccgagauaauuccggggacccugcagauccacauaagguauaugcccugucuagagagcuuuguuggagggaaggacccggcaccgaccaaacagaggcugaggccccugcagcugugccaccgccccagggcgggccuccaggacccuuccuggcccacacucaugcggguuugcaggccccuggcccacuccccgcaccggcuggggauaaaggagaccugcugcuccaggccguccaacagucgugcuuagcugaucaucugcuuaccgccucauggggcgcagacccugugcccacaaaggccccaggugaagggcaggagggauugccucugaccggcgcuugugcgggcgggcccggacuaccagccggugaacucuacggcugggcaguugagacuacacccagcccugggccacagccggcugcccugaccacgggagaagcagccgcucccgagaguccucaccaagccgagccauaucuuucccccucuccuagcgcaugcacugcggugcaggaaccaucccccggcgcucuggaugucaccauaauguacaagggucggacaguguugcagaaaguaguugggcacccgucauguacuuuucucuauggcccuccagaccccgccgugcgugcaaccgauccucagcaagucgccuuccccaguccagcugagcugccugaccagaagcaguuacgcuacacagaggaacugcucagacacguggcccccggacuucaucuggaauugaggggcccacaacuaugggcacggcgaauggggaaaugcaagguguauugggaggucggagguccgccuggcagcgcuucucccuccaccccagccugucugcucccccgcaacugcgacacgccuaucuuugauuucagaguguuuuuccaggagcugguggaauuuagggcgcggcagcgcagagggucaccaagguacacuauuuaccuuggauucggccaggaccugagcgccggucgucccaaagagaagaguuugguacucgugaagcuggaaccuugguuaugucggguccaccuggaggggacacaacgagaaggcgugucuucccuagauagcucgucucucucccugugccuuucaagugcuaauagcuuguaugacgauaucgagugcuuccugauggagcucgaacagccggcauga

SEQ ID NO: 8834 - RNA, 1512 nt, Artificial Sequence
  derived and/or modified sequence opt4 from IRF-7__Homo_sapiens__AAB80686
auggcccuggcccccgagagagccgcccccagagugcuguucggcgaguggcugcugggcgagaucagcagcggcugcuacgagggccugcaguggcuggacgaggccagaaccugcuucagagugcccuggaagcacuucgccagaaaggaccugagcgaggccgacgccagaaucuucaaggccugggccguggccagaggcagauggccccccagcagcagaggcggcggccccccccccgaggccgagaccgccgagagagccggcuggaagaccaacuucagaugcgcccugagaagcaccagaagauucgugaugcugagagacaacagcggcgaccccgccgacccccacaagguguacgcccugagcagagagcugugcuggagagagggccccggcaccgaccagaccgaggccgaggcccccgccgccgugccccccccccagggcggcccccccggccccuuccuggcccacacccacgccggccugcaggcccccggcccccugcccgcccccgccggcgacaagggcgaccugcugcugcaggccgugcagcagagcugccuggccgaccaccugcugaccgccagcuggggcgccgaccccgugcccaccaaggcccccggcgagggccaggagggccugccccugaccggcgccugcgccggcggccccggccugcccgccggcgagcuguacggcugggccguggagaccacccccagccccggcccccagcccgccgcccugaccaccggcgaggccgccgcccccgagagcccccaccaggccgagcccuaccugagccccagccccagcgccugcaccgccgugcaggagcccagccccggcgcccuggacgugaccaucauguacaagggcagaaccgugcugcagaagguggugggccaccccagcugcaccuuccuguacggcccccccgaccccgccgugagagccaccgacccccagcagguggccuuccccagccccgccgagcugcccgaccagaagcagcugagauacaccgaggagcugcugagacacguggcccccggccugcaccuggagcugagaggcccccagcugugggccagaagaaugggcaagugcaagguguacugggaggugggcggcccccccggcagcgccagccccagcacccccgccugccugcugcccagaaacugcgacacccccaucuucgacuucagaguguucuuccaggagcugguggaguucagagccagacagagaagaggcagccccagauacaccaucuaccugggcuucggccaggaccugagcgccggcagacccaaggagaagagccuggugcuggugaagcuggagcccuggcugugcagagugcaccuggagggcacccagagagagggcgugagcagccuggacagcagcagccugagccugugccugagcagcgccaacagccuguacgacgacaucgagugcuuccugauggagcuggagcagcccgccuga

SEQ ID NO: 8835 - RNA, 1512 nt, Artificial Sequence
  derived and/or modified sequence opt5 from IRF-7__Homo_sapiens__AAB80686
auggcccuggcucccgagagagccgcgccucggguccucuucggcgaauggcugcuuggggagaucagcuccggaugcuacgaaggccugcaguggcucgacgaggcucgcaccuguuuuagagucccguggaagcacuucgcccggaaagaucugucugaagccgacgcucgcauuuuuaaggccugggcuguugccagagggcgguggcccccuagcucccgcggaggcgggcccccucccgaggcggagacagccgaaagagcuggauggaaaacgaacuuccggugcgcccuucgcucuaccagacgguuugugaugcugcgcgauaauagcggcgacccugcugauccgcauaagguguaugcccucuccagagagcuguguuggcgggaaggccccgggacagaccaaaccgaggcggaggccccugcugccgugcccccuccccagggaggcccgccugggcccuuccuggcucacacacaugccggacuccaggccccuggcccccugcccgcuccugcgggggauaaaggagaccuucugcuccaggccgugcaacagucuugccuggcugaucaccuucugaccgccagcuggggcgccgacccgguucccacaaaggcuccuggcgaagggcaggagggacucccccugaccggcgccugugcugggggaccuggccugcccgcgggggaacucuacggaugggccguggagacgaccccguccccuggcccccagccugccgcucugacaaccggcgaagccgcugcccccgagagcccucaucaagcggagcccuaucuuucuccguccccuagcgccugcacagcuguccaggaacccucucccggggcccuggaugugaccaucauguacaagggacgcacgguucuccagaaaguggucggccacccuuccuguacauuucuguaugggccgcccgacccugcugugagagccaccgauccccagcaaguggcguucccuagccccgccgagcuuccugaccagaagcagcugcgguacacagaggagcuccugagacacgucgcucccggacugcaucucgaacugcgcggcccgcaacuuugggcccggagaauggggaaaugcaagguuuauugggaggugggcggaccucccggcucugcuuccccuagcacccccgccugucugcucccgcgcaacugcgacaccccuauuuuugauuuccggguguuuuuccaggagcuggucgaauuuagagcccgccagcggagagggucuccccgcuacacaaucuaccuuggauucggccaggaccuguccgcugggcggccuaaagaaaagagccucgugcugguuaagcuggaacccuggcucuguagagugcaccuggagggaacgcaacgcgaaggcgucuccagccuugauucuuccagccugucucucugccugagcuccgccaauucucuguaugacgauauugagugcuuccuuauggagcucgaacagcccgcguga

SEQ ID NO: 8836 - protein, 320 aa, Artificial Sequence
  JNK__Homo_sapiens__B4DU99
MISPDPRPSPGLARWAESYEAKCERRQEIRESRRCRPNVTTCRQVGKTLRIQQRELEEKGKAQHPQAREQGPSRRPGQVTVLKEPLSCARRISSPREQVTGTSSEVFPAQHPPPSGICRDLSDHLSSQAGGLPPQDTPIKKPPKHHRGTQTKAEGPTIKNDASQQTNYGVAVLDKEIIQLSDYLKEALQRELVLKQKMVILQDLLSTLIQASDSSWKGQLNEDKLKGKLRSLENQLYTCTQKYSPWGMKKVLLEMEDQKNSYEQKAKESLQKVLEEKMNAEQQLQSTQVWGCHIDMGLGTPGSLGNKGSQLHNSLEPSPL

SEQ ID NO: 8837 - RNA, 963 nt, Artificial Sequence
  JNK__Homo_sapiens__BAG62261
augaucagcccagaccccaggcccuccccuggcuuggcccggugggcugagagcuaugaggccaagugugagcgcaggcaagagauccgugaaagccgccgcugccgucccaaugugaccacuugccgccagguggggaagacgcugaggauccaacagagagagcuagaggagaagggcaaagcgcagcauccccaggccagggagcaagggcccuccaggcggccaggacaggugacuguccucaaggaacccuugucuugugccagaaggauuucuucucccagagagcaggugacaggcaccagcucugaagucuuuccagcccagcauccuccucccucaggcaucugcagggaucugucugaccaccucuccucacaggcugggggccuuccuccacaggacacucccaucaagaagccacccaaacaccaccgugguacucagacaaaggcagaaggaccaacaauuaagaacgaugccagucagcaaaccaauuacggaguugcaguucuggauaaggaaaucauccagcuuucugauuaccucaaagaggcccuacaaagggagcugguccuaaaacagaaaauggugauucuccaagaccuacuguccacucugauucaggccucugacagcucuuggaagggacagcuuaaugaagacaaacuaaaggggaaacugagauccuuagaaaaccagcuauacaccuguacccagaaauacuccccuuggggaaugaaaaaaguacuacuggagauggaagaccagaaaaacagcuaugagcagaaggccaaggagucacugcagaaagugcuggaggagaaaaugaaugcagagcagcaacuacagagcacacagguauggggaugccacauagacauggggcuggggacuccaggcagcuuggggaacaaggggagccagcugcacaacucccuggagcccucuccucucuga

SEQ ID NO: 8838 - RNA, 963 nt, Artificial Sequence
  derived and/or modified sequence opt1 from JNK__Homo_sapiens__BAG62261
augaucucccccgacccccgccccucccccggccuggcccggugggccgagagcuacgaggcgaagugcgagcgccggcaggagauccgcgagucccggcgcugccggcccaacgugacgaccugccgccaggucgggaagacccuccggauccagcagcgcgagcuggaggagaagggcaaggcccagcacccgcaggcccgggagcaggggcccagccgccggcccggccaggugaccgugcugaaggagccccucuccugcgcccgccggaucagcuccccgcgcgagcaggucaccgggaccagcuccgagguguuccccgcccagcacccgccgcccagcggcaucugccgggaccuguccgaccaccugagcucccaggcgggcgggcucccgccccaggacacgcccaucaagaagccgcccaagcaccaccgcggcacccagaccaaggccgaggggcccaccaucaagaacgacgccagccagcagacgaacuacggcguggccguccuggacaaggagaucauccagcuguccgacuaccucaaggaggcgcugcagcgggagcuggugcucaagcagaagauggugauccugcaggaccugcucagcacccugauccaggccuccgacagcuccuggaaggggcagcugaacgaggacaagcucaagggcaagcugcgcagccuggagaaccagcucuacacgugcacccagaaguacagccccuggggcaugaagaagguccugcuggagauggaggaccagaagaacuccuacgagcagaaggccaaggagagccuccagaaggugcuggaggagaagaugaacgccgagcagcagcugcaguccacccaggugugggggugccacaucgacaugggccucgggacccccggcagccugggcaacaaggggucccagcugcacaacagccucgagcccagcccccuguga

SEQ ID NO: 8839 - RNA, 963 nt, Artificial Sequence
  derived and/or modified sequence opt2 from JNK__Homo_sapiens__BAG62261
augaucucccccgacccccgccccucccccggccucgcccgcugggccgaguccuacgaggccaagugcgagcgccgccaggagauccgcgagucccgccgcugccgccccaacgucaccaccugccgccaggucggcaagacccuccgcauccagcagcgcgagcucgaggagaagggcaaggcccagcacccccaggcccgcgagcagggccccucccgccgccccggccaggucaccguccucaaggagccccucuccugcgcccgccgcaucuccuccccccgcgagcaggucaccggcaccuccuccgaggucuuccccgcccagcaccccccccccuccggcaucugccgcgaccucuccgaccaccucuccucccaggccggcggccuccccccccaggacacccccaucaagaagccccccaagcaccaccgcggcacccagaccaaggccgagggccccaccaucaagaacgacgccucccagcagaccaacuacggcgucgccguccucgacaaggagaucauccagcucuccgacuaccucaaggaggcccuccagcgcgagcucguccucaagcagaagauggucauccuccaggaccuccucuccacccucauccaggccuccgacuccuccuggaagggccagcucaacgaggacaagcucaagggcaagcuccgcucccucgagaaccagcucuacaccugcacccagaaguacucccccuggggcaugaagaagguccuccucgagauggaggaccagaagaacuccuacgagcagaaggccaaggagucccuccagaagguccucgaggagaagaugaacgccgagcagcagcuccaguccacccaggucuggggcugccacaucgacaugggccucggcacccccggcucccucggcaacaagggcucccagcuccacaacucccucgagcccuccccccucuga

SEQ ID NO: 8840 - RNA, 963 nt, Artificial Sequence
  derived and/or modified sequence opt3 from JNK__Homo_sapiens__BAG62261
augaucagccccgacccuagaccauccccgggccuggccaggugggcugagucuuacgaagcaaagugcgagcggcgccaggaaauucgagagucacguagauguaggcccaacgugaccacaugccggcaagucgggaaaacucuccgcauacagcagagagaacuugaggagaagggaaaagcccagcacccucaagcgagggaacaggguccaagucggcgccccggccagguuacggugcugaaggagccuuugagcugugcucgaagaaucuccucuccaagggaacagguaaccgggacaucgucagagguguuccccgcccaacauccuccaccgagcggaauuugccgggauuuaagugaccaccuguccucucaggcaggcggucuacccccucaggauacuccaaucaaaaagcccccuaagcaucaccgugggacccagacaaaagccgagggaccaaccauuaagaaugacgcuagccaacagacuaacuauggcgucgcagugcucgauaaagaaaucauacagcuguccgacuaccuuaaggaggcccugcaacgcgaauugguucucaaacagaagauggugauccugcaggaucugcucucaacauuaauucaggcuagugacagcucuuggaagggccaacugaaugaggauaaacuuaaggggaaauugagaucccuggaaaaccagcuauauaccuguacgcagaaguacucacccuggggaaugaaaaagguccuccuggagauggaggaccagaaaaauagcuaugaacaaaaggccaaggagagucuucagaaagugcuggaagagaagaugaacgcggaacagcaguugcaaucuacucagguaugggguugccauaucgauaugggccucgggaccccgggaucccugggcaauaaagguagccaguuacacaacucgcuggagccuucuccccucuga

SEQ ID NO: 8841 - RNA, 963 nt, Artificial Sequence
  derived and/or modified sequence opt4 from JNK__Homo_sapiens__BAG62261
augaucagccccgaccccagacccagccccggccuggccagaugggccgagagcuacgaggccaagugcgagagaagacaggagaucagagagagcagaagaugcagacccaacgugaccaccugcagacaggugggcaagacccugagaauccagcagagagagcuggaggagaagggcaaggcccagcacccccaggccagagagcagggccccagcagaagacccggccaggugaccgugcugaaggagccccugagcugcgccagaagaaucagcagccccagagagcaggugaccggcaccagcagcgagguguuccccgcccagcaccccccccccagcggcaucugcagagaccugagcgaccaccugagcagccaggccggcggccugcccccccaggacacccccaucaagaagccccccaagcaccacagaggcacccagaccaaggccgagggccccaccaucaagaacgacgccagccagcagaccaacuacggcguggccgugcuggacaaggagaucauccagcugagcgacuaccugaaggaggcccugcagagagagcuggugcugaagcagaagauggugauccugcaggaccugcugagcacccugauccaggccagcgacagcagcuggaagggccagcugaacgaggacaagcugaagggcaagcugagaagccuggagaaccagcuguacaccugcacccagaaguacagccccuggggcaugaagaaggugcugcuggagauggaggaccagaagaacagcuacgagcagaaggccaaggagagccugcagaaggugcuggaggagaagaugaacgccgagcagcagcugcagagcacccagguguggggcugccacaucgacaugggccugggcacccccggcagccugggcaacaagggcagccagcugcacaacagccuggagcccagcccccuguga

SEQ ID NO: 8842 - RNA, 963 nt, Artificial Sequence
  derived and/or modified sequence opt5 from JNK__Homo_sapiens__BAG62261
augaucagccccgacccuagaccgucccccggccuggcccggugggcugagucuuacgaagccaagugcgagcgcagacaggaaauucgggagagccgcagaugucggccuaacgugaccacaugccgccaagucgggaaaacgcucagaauccagcagcgggaacuggaggagaagggaaaagcgcagcacccccaagcucgcgaacagggcccuuccagacggcccgggcagguuaccgugcuuaaggagccucugucuugugcccgcagaauuagcuccccgcgggaacaggugacaggaaccucuagcgaggucuuccccgcccaacauccucccccuuccggcaucugccgcgaucucagcgaccaccugucuucccaggcugggggacuucccccgcaggauacaccuauuaaaaagcccccuaagcaucacagaggcacccagacaaaagccgagggccccaccaucaagaaugacgcuagccaacagacgaacuaugggguggccguucuggauaaagaaaucauucagcucucugacuaccugaaggaggcgcugcaacgggaacucgugcugaaacagaagauggucauccuucaggaucugcucuccacccugauucaggccagcgacucuuccuggaagggacaacuuaaugaggauaaacugaagggcaaacucagaagccuggaaaaccagcuguauacauguacccagaaguacucccccugggggaugaaaaaggugcuccuggagauggaggaccagaaaaauucuuaugaacaaaaggcuaaggagagccuucagaaaguucuggaagagaagaugaacgccgaacagcagcuccaauccacacagguguggggaugccauaucgauaugggccuggggaccccuggaagccuuggcaauaaaggcucucagcugcacaacucccucgagccgagcccccuguga

SEQ ID NO: 8843 - protein, 671 aa, Artificial Sequence
  KPCB__Homo_sapiens__P05771-1
MADPAAGPPPSEGEESTVRFARKGALRQKNVHEVKNHKFTARFFKQPTFCSHCTDFIWGFGKQGFQCQVCCFVVHKRCHEFVTFSCPGADKGPASDDPRSKHKFKIHTYSSPTFCDHCGSLLYGLIHQGMKCDTCMMNVHKRCVMNVPSLCGTDHTERRGRIYIQAHIDRDVLIVLVRDAKNLVPMDPNGLSDPYVKLKLIPDPKSESKQKTKTIKCSLNPEWNETFRFQLKESDKDRRLSVEIWDWDLTSRNDFMGSLSFGISELQKASVDGWFKLLSQEEGEYFNVPVPPEGSEANEELRQKFERAKISQGTKVPEEKTTNTVSKFDNNGNRDRMKLTDFNFLMVLGKGSFGKVMLSERKGTDELYAVKILKKDVVIQDDDVECTMVEKRVLALPGKPPFLTQLHSCFQTMDRLYFVMEYVNGGDLMYHIQQVGRFKEPHAVFYAAEIAIGLFFLQSKGIIYRDLKLDNVMLDSEGHIKIADFGMCKENIWDGVTTKTFCGTPDYIAPEIIAYQPYGKSVDWWAFGVLLYEMLAGQAPFEGEDEDELFQSIMEHNVAYPKSMSKEAVAICKGLMTKHPGKRLGCGPEGERDIKEHAFFRYIDWEKLERKEIQPPYKPKARDKRDTSNFDKEFTRQPVELTPTDKLFIMNLDQNEFAGFSYTNPEFVINV

SEQ ID NO: 8844 - RNA, 2016 nt, Artificial Sequence
  KPCB__Homo_sapiens__CCDS10618.1
auggcugacccggcugcggggccgccgccgagcgagggcgaggagagcaccgugcgcuucgcccgcaaaggcgcccuccggcagaagaacgugcaugaggucaagaaccacaaauucaccgcccgcuucuucaagcagcccaccuucugcagccacugcaccgacuucaucuggggcuucgggaagcagggauuccagugccaaguuugcugcuuuguggugcacaagcggugccaugaauuugucacauucuccugcccuggcgcugacaaggguccagccuccgaugacccccgcagcaaacacaaguuuaagauccacacguacuccagccccacguuuugugaccacugugggucacugcuguauggacucauccaccaggggaugaaaugugacaccugcaugaugaaugugcacaagcgcugcgugaugaauguucccagccuguguggcacggaccacacggagcgccgcggccgcaucuacauccaggcccacaucgacagggacguccucauuguccucguaagagaugcuaaaaaccuuguaccuauggaccccaauggccugucagaucccuacguaaaacugaaacugauucccgaucccaaaagugagagcaaacagaagaccaaaaccaucaaaugcucccucaacccugaguggaaugagacauuuagauuucagcugaaagaaucggacaaagacagaagacugucaguagagauuugggauugggauuugaccagcaggaaugacuucaugggaucuuuguccuuugggauuucugaacuucagaaagccaguguugauggcugguuuaaguuacugagccaggaggaaggcgaguacuucaaugugccugugccaccagaaggaagugaggccaaugaagaacugcggcagaaauuugagagggccaagaucagucagggaaccaaggucccggaagaaaagacgaccaacacugucuccaaauuugacaacaauggcaacagagaccggaugaaacugaccgauuuuaacuuccuaauggugcuggggaaaggcagcuuuggcaaggucaugcuuucagaacgaaaaggcacagaugagcucuaugcugugaagauccugaagaaggacguugugauccaagaugaugacguggagugcacuaugguggagaagcggguguuggcccugccugggaagccgcccuuccugacccagcuccacuccugcuuccagaccauggaccgccuguacuuugugauggaguacgugaaugggggcgaccucauguaucacauccagcaagucggccgguucaaggagccccaugcuguauuuuacgcugcagaaauugccaucggucuguucuucuuacagaguaagggcaucauuuaccgugaccuaaaacuugacaacgugaugcucgauucugagggacacaucaagauugccgauuuuggcauguguaaggaaaacaucugggauggggugacaaccaagacauucuguggcacuccagacuacaucgcccccgagauaauugcuuaucagcccuaugggaaguccguggauuggugggcauuuggaguccugcuguaugaaauguuggcugggcaggcacccuuugaaggggaggaugaagaugaacucuuccaauccaucauggaacacaacguagccuaucccaagucuauguccaaggaagcuguggccaucugcaaagggcugaugaccaaacacccaggcaaacgucuggguuguggaccugaaggcgaacgugauaucaaagagcaugcauuuuuccgguauauugauugggagaaacuugaacgcaaagagauccagcccccuuauaagccaaaagcuagagacaagagagacaccuccaacuucgacaaagaguucaccagacagccuguggaacugacccccacugauaaacucuucaucaugaacuuggaccaaaaugaauuugcuggcuucucuuauacuaacccagaguuugucauuaauguguag

SEQ ID NO: 8845 - RNA, 2016 nt, Artificial Sequence
  derived and/or modified sequence opt1 from KPCB__Homo_sapiens__CCDS10618.1
auggccgaccccgccgcgggcccgccgcccagcgagggggaggaguccaccgugcgcuucgcccggaagggcgcccugcgccagaagaacguccacgaggugaagaaccacaaguucaccgcccgguucuucaagcagcccacguucugcagccacugcaccgacuucaucuggggguucggcaagcagggguuccagugccaggugugcugcuucgucgugcacaagcgcugccacgaguucgugaccuucuccugccccggcgccgacaagggccccgcgagcgacgacccccgguccaagcacaaguucaagauccacaccuacagcucccccacguucugcgaccacugcgggagccuccuguacggccugauccaccaggggaugaagugcgacacgugcaugaugaacguccacaagcgcugcgugaugaacgugccgucccucugcggcaccgaccacaccgagcggcgcgggcggaucuacauccaggcccacaucgaccgcgacguccugaucgugcuggugcgggacgccaagaaccucguccccauggaccccaacggccugagcgaccccuacgugaagcugaagcucaucccggaccccaaguccgagagcaagcagaagaccaagaccaucaagugcucccugaaccccgaguggaacgagaccuuccgcuuccagcugaaggagagcgacaaggaccggcgccucuccguggagaucugggacugggaccugaccagccggaacgacuucaugggcucccugagcuucgggaucuccgagcuccagaaggccagcgucgacggcugguucaagcugcugagccaggaggagggggaguacuucaacgugcccgugccgcccgagggcuccgaggcgaacgaggagcuccgccagaaguucgagcgggccaagaucagccagggcacgaagguccccgaggagaagaccaccaacaccguguccaaguucgacaacaacgggaaccgcgaccggaugaagcugacggacuucaacuuccugauggugcucggcaaggggagcuucggcaaggucaugcuguccgagcgcaaggggaccgacgagcuguacgccgugaagauccucaagaaggacguggucauccaggacgacgacguggagugcaccauggucgagaagcgggugcuggcccugcccggcaagccgcccuuccucacccagcugcacagcugcuuccagacgauggaccgccuguacuucgugauggaguacgucaacggcggggaccucauguaccacauccagcaggucggccgcuucaaggagccccacgccguguucuacgcggccgagaucgccaucgggcuguucuuccugcaguccaagggcaucaucuaccgggaccucaagcuggacaacgugaugcuggacagcgaggggcacaucaagaucgccgacuucggcaugugcaaggagaacaucugggacggcgugaccaccaagaccuucugcgggacgcccgacuacaucgccccggagaucaucgcguaccagcccuacggcaaguccguggacuggugggccuucgggguccuccuguacgagaugcuggccggccaggcccccuucgagggggaggacgaggacgagcuguuccagagcaucauggagcacaacguggccuaccccaaguccaugagcaaggaggcgguggccaucugcaagggccucaugaccaagcacccgggcaagcgccuggggugcggccccgagggggagcgggacaucaaggagcacgccuucuuccgcuacaucgacugggagaagcucgagcggaaggagauccagcccccguacaagcccaaggcccgcgacaagcgggacaccuccaacuucgacaaggaguucacccgccagcccgucgagcugacgcccaccgacaagcuguucaucaugaaccucgaccagaacgaguucgccggcuucagcuacaccaacccggaguucgugaucaacguguga

SEQ ID NO: 8846 - RNA, 2016 nt, Artificial Sequence
  derived and/or modified sequence opt2 from KPCB__Homo_sapiens__CCDS10618.1
auggccgaccccgccgccggccccccccccuccgagggcgaggaguccaccguccgcuucgcccgcaagggcgcccuccgccagaagaacguccacgaggucaagaaccacaaguucaccgcccgcuucuucaagcagcccaccuucugcucccacugcaccgacuucaucuggggcuucggcaagcagggcuuccagugccaggucugcugcuucgucguccacaagcgcugccacgaguucgucaccuucuccugccccggcgccgacaagggccccgccuccgacgacccccgcuccaagcacaaguucaagauccacaccuacuccucccccaccuucugcgaccacugcggcucccuccucuacggccucauccaccagggcaugaagugcgacaccugcaugaugaacguccacaagcgcugcgucaugaacguccccucccucugcggcaccgaccacaccgagcgccgcggccgcaucuacauccaggcccacaucgaccgcgacguccucaucguccucguccgcgacgccaagaaccucguccccauggaccccaacggccucuccgaccccuacgucaagcucaagcucauccccgaccccaaguccgaguccaagcagaagaccaagaccaucaagugcucccucaaccccgaguggaacgagaccuuccgcuuccagcucaaggaguccgacaaggaccgccgccucuccgucgagaucugggacugggaccucaccucccgcaacgacuucaugggcucccucuccuucggcaucuccgagcuccagaaggccuccgucgacggcugguucaagcuccucucccaggaggagggcgaguacuucaacguccccgucccccccgagggcuccgaggccaacgaggagcuccgccagaaguucgagcgcgccaagaucucccagggcaccaagguccccgaggagaagaccaccaacaccgucuccaaguucgacaacaacggcaaccgcgaccgcaugaagcucaccgacuucaacuuccucaugguccucggcaagggcuccuucggcaaggucaugcucuccgagcgcaagggcaccgacgagcucuacgccgucaagauccucaagaaggacgucgucauccaggacgacgacgucgagugcaccauggucgagaagcgcguccucgcccuccccggcaagccccccuuccucacccagcuccacuccugcuuccagaccauggaccgccucuacuucgucauggaguacgucaacggcggcgaccucauguaccacauccagcaggucggccgcuucaaggagccccacgccgucuucuacgccgccgagaucgccaucggccucuucuuccuccaguccaagggcaucaucuaccgcgaccucaagcucgacaacgucaugcucgacuccgagggccacaucaagaucgccgacuucggcaugugcaaggagaacaucugggacggcgucaccaccaagaccuucugcggcacccccgacuacaucgcccccgagaucaucgccuaccagcccuacggcaaguccgucgacuggugggccuucggcguccuccucuacgagaugcucgccggccaggcccccuucgagggcgaggacgaggacgagcucuuccaguccaucauggagcacaacgucgccuaccccaaguccauguccaaggaggccgucgccaucugcaagggccucaugaccaagcaccccggcaagcgccucggcugcggccccgagggcgagcgcgacaucaaggagcacgccuucuuccgcuacaucgacugggagaagcucgagcgcaaggagauccagccccccuacaagcccaaggcccgcgacaagcgcgacaccuccaacuucgacaaggaguucacccgccagcccgucgagcucacccccaccgacaagcucuucaucaugaaccucgaccagaacgaguucgccggcuucuccuacaccaaccccgaguucgucaucaacgucuga

SEQ ID NO: 8847 - RNA, 2016 nt, Artificial Sequence
  derived and/or modified sequence opt3 from KPCB__Homo_sapiens__CCDS10618.1
auggccgaccccgcugcaggcccuccaccgagcgagggggaagaguccaccgugagauucgccaggaagggagcgcugcggcagaaaaacguccacgaaguuaagaaucauaaauuuacagcucgcuucuuuaagcaacccacuuucugcucucacuguacggauuuuaucugggguuucggcaaacagggguuucagugccagguguguugcuucguagugcauaagcgaugucacgaguuugucaccuucucaugcccuggagccgacaagggcccagcaagugaugacccccguagcaaacauaaguuuaaaauucacacauacuccucuccuacuuucugugaucacugcgguucgcuccuuuaugggcugauacaucaaggaaugaagugugauaccugcaugaugaacgugcacaaaagauguguuaugaaugugccaucauugugcggcacagaccauaccgaaaggcggggccgcaucuacauucaggcccacaucgacagagaugucuuaauugugcugguaagggacgcuaagaaccuaguucccauggauccuaaugggcucagcgacccauaugugaagcugaaacuuaucccggaucccaagagugaguccaaacagaagacuaaaacaauaaagugcucucugaacccugaguggaaugaaaccuuucgguuccaguugaaagagagcgacaaggaccgccgacucuccgucgaaaucugggauugggaccugacgucaagaaacgauuucaugggaagucugagcuuugguauuucugagcuccaaaaggcauccguggacggcugguucaaauuacugucacaggaggaaggggaguacuuuaaugugccaguucccccugaaggaagcgaggccaacgaggaacuuaggcagaaguucgagcgggcuaaaaucagucagggcacuaaggucccagaagagaaaaccacaaauacugugucuaaguuugauaacaaugguaaccgugaccgcaugaaguugaccgauuucaauuuucugaugguacuagggaaaggauccuucggcaaggugaugcucagcgaaagaaaaggcacagacgagcuguaugccgucaagauucuuaaaaaggaugugguuauccaagacgaugacguggaauguaccauggucgagaagagggugcuggcguugcccgggaaaccgccuuuucucacgcagcugcacucgugcuuccagacuauggaccgguuauacuuuguaauggaguauguuaacggaggugaucugauguaccauauacaacaggugggccgauucaaggaaccccacgcagucuuuuacgccgcugagauugccaucggacucuucuuccuucagucuaaagggauuaucuaucgcgaccugaaguuggauaacgugaugcuagacuccgaaggccauaucaaaauugcagauuuugguauguguaaggagaauauaugggacggggucacaaccaagacuuucugcggcacaccagauuacaucgcuccugaaauuaucgccuaucagcccuacggaaaaucaguggacuggugggcguuuggcguucugcucuaugagaugcuggccgggcaagcaccauucgagggagaagaugaggacgaacuuuuucagaguauaauggagcacaacguggcuuaccccaagagcauguccaaagaggccguagcuauuuguaagggucugaugaccaaacauccuggcaagagauuggggugcggaccagaaggcgagagggauaucaaagaacacgccuucuuucgguauaucgacugggagaagcucgaacgcaaggagauucagccgcccuacaaaccuaaggcaagagauaaaagggacacgucuaauuucgacaaggaguuuacccgucagccagucgaacugacacccacugauaaauuauucaucaugaaccuggaccaaaaugaguuugccgguuucagcuacaccaacccugaauuugugauuaauguuuga

SEQ ID NO: 8848 - RNA, 2016 nt, Artificial Sequence
  derived and/or modified sequence opt4 from KPCB__Homo_sapiens__CCDS10618.1
auggccgaccccgccgccggccccccccccagcgagggcgaggagagcaccgugagauucgccagaaagggcgcccugagacagaagaacgugcacgaggugaagaaccacaaguucaccgccagauucuucaagcagcccaccuucugcagccacugcaccgacuucaucuggggcuucggcaagcagggcuuccagugccaggugugcugcuucguggugcacaagagaugccacgaguucgugaccuucagcugccccggcgccgacaagggccccgccagcgacgaccccagaagcaagcacaaguucaagauccacaccuacagcagccccaccuucugcgaccacugcggcagccugcuguacggccugauccaccagggcaugaagugcgacaccugcaugaugaacgugcacaagagaugcgugaugaacgugcccagccugugcggcaccgaccacaccgagagaagaggcagaaucuacauccaggcccacaucgacagagacgugcugaucgugcuggugagagacgccaagaaccuggugcccauggaccccaacggccugagcgaccccuacgugaagcugaagcugauccccgaccccaagagcgagagcaagcagaagaccaagaccaucaagugcagccugaaccccgaguggaacgagaccuucagauuccagcugaaggagagcgacaaggacagaagacugagcguggagaucugggacugggaccugaccagcagaaacgacuucaugggcagccugagcuucggcaucagcgagcugcagaaggccagcguggacggcugguucaagcugcugagccaggaggagggcgaguacuucaacgugcccgugccccccgagggcagcgaggccaacgaggagcugagacagaaguucgagagagccaagaucagccagggcaccaaggugcccgaggagaagaccaccaacaccgugagcaaguucgacaacaacggcaacagagacagaaugaagcugaccgacuucaacuuccugauggugcugggcaagggcagcuucggcaaggugaugcugagcgagagaaagggcaccgacgagcuguacgccgugaagauccugaagaaggacguggugauccaggacgacgacguggagugcaccaugguggagaagagagugcuggcccugcccggcaagccccccuuccugacccagcugcacagcugcuuccagaccauggacagacuguacuucgugauggaguacgugaacggcggcgaccugauguaccacauccagcaggugggcagauucaaggagccccacgccguguucuacgccgccgagaucgccaucggccuguucuuccugcagagcaagggcaucaucuacagagaccugaagcuggacaacgugaugcuggacagcgagggccacaucaagaucgccgacuucggcaugugcaaggagaacaucugggacggcgugaccaccaagaccuucugcggcacccccgacuacaucgcccccgagaucaucgccuaccagcccuacggcaagagcguggacuggugggccuucggcgugcugcuguacgagaugcuggccggccaggcccccuucgagggcgaggacgaggacgagcuguuccagagcaucauggagcacaacguggccuaccccaagagcaugagcaaggaggccguggccaucugcaagggccugaugaccaagcaccccggcaagagacugggcugcggccccgagggcgagagagacaucaaggagcacgccuucuucagauacaucgacugggagaagcuggagagaaaggagauccagccccccuacaagcccaaggccagagacaagagagacaccagcaacuucgacaaggaguucaccagacagcccguggagcugacccccaccgacaagcuguucaucaugaaccuggaccagaacgaguucgccggcuucagcuacaccaaccccgaguucgugaucaacguguga

SEQ ID NO: 8849 - RNA, 2016 nt, Artificial Sequence
  derived and/or modified sequence opt5 from KPCB__Homo_sapiens__CCDS10618.1
auggccgaccccgcugccggcccuccgcccagcgagggggaagaguccaccgugagauucgcgcggaagggagcucugcgccagaaaaacguccacgaaguuaagaaucauaaauuuacagccagauucuuuaagcaaccuacguucugcucucacuguaccgauuuuaucuggggcuucgggaaacagggauuucagugccagguguguugcuucgugguccauaagcggugucacgaguuugugacauucagcugccccggcgccgacaaggggccugcuuccgaugacccccgcucuaaacauaaguuuaaaauucacaccuacagcuccccuacauucugugaucacugcggaucucuccuguauggccuuauccaucaaggcaugaagugugauaccugcaugaugaacguucacaaaagaugugugaugaaugucccgagccugugcgggacagaccauaccgaacggcgcggaagaauuuacauccaggcccacauugaccgggaugugcucaucguucuggugcgcgacgcuaagaaccuuguccccauggauccuaauggccuguccgaccccuaugugaagcucaaacugaucccugaucccaagagcgagucuaaacagaagacgaaaaccauuaagugcucccugaacccggaguggaaugaaacauuuagauuccagcucaaagagagcgacaaggaccggcgccugucuguggaaaucugggauugggaccuuaccuccagaaacgauuucauggggagccugucuuuuggaauuuccgagcuccaaaaggccagcgucgacggcugguucaaacugcuuucccaggaggaaggggaguacuuuaauguuccugugcccccugaaggaucugaggcgaacgaggaacugcggcagaaguucgagcgcgccaaaaucagccagggcacaaaggugcccgaagagaaaaccacgaauacagucuccaaguuugauaacaauggcaacagagaccggaugaagcucaccgauuucaauuuucugauggugcuggggaaaggcagcuucggaaagguuaugcucucugaaagaaaagggacagacgagcuguaugcugugaagauucuuaaaaaggaugucgugauccaagacgaugacguugaauguaccaugguggagaagcgcguccuggcccuccccggaaaaccuccguuucugacccagcuucacuccugcuuccagacaauggaccggcuguacuuugugauggaguaugucaacggcggggaucucauguaccauauucaacaggugggaagauucaaggaaccccacgcuguguuuuacgccgcggagaucgccaucggccuguucuuccugcagagcaaaggcauuaucuaucgcgaccucaagcuggauaacguuaugcuugacucugaagggcauauuaaaaucgcugauuuuggaauguguaaggagaauauuugggacggcgucacgaccaagacauucugcgggaccccugauuacaucgcccccgaaaucauugcuuaucagccuuacggaaaaagcguggacuggugggccuuuggcguucugcucuaugagaugcuggccgggcaagcucccuucgagggcgaagaugaggacgaacuuuuucaguccaucauggagcacaacguggcguacccgaagucuaugagcaaagaggccgucgcuauuuguaagggacugaugacaaaacauccuggcaagcggcucgggugcggacccgaaggcgagagagauaucaaagaacacgccuucuuucgcuauauugacugggagaagcuggaacggaaggagauccagccucccuacaaaccuaaggccagagauaaacgcgacaccuccaauuucgacaaggaguuuacgcggcagcccguggaacugacaccgaccgauaaacucuucaucaugaaccuggaccaaaaugaguuugcuggguucagcuacaccaacccugaauuugugauuaauguuuga

SEQ ID NO: 8850 - protein, 673 aa, Artificial Sequence
  KPCB__Homo_sapiens__P05771-2
MADPAAGPPPSEGEESTVRFARKGALRQKNVHEVKNHKFTARFFKQPTFCSHCTDFIWGFGKQGFQCQVCCFVVHKRCHEFVTFSCPGADKGPASDDPRSKHKFKIHTYSSPTFCDHCGSLLYGLIHQGMKCDTCMMNVHKRCVMNVPSLCGTDHTERRGRIYIQAHIDRDVLIVLVRDAKNLVPMDPNGLSDPYVKLKLIPDPKSESKQKTKTIKCSLNPEWNETFRFQLKESDKDRRLSVEIWDWDLTSRNDFMGSLSFGISELQKASVDGWFKLLSQEEGEYFNVPVPPEGSEANEELRQKFERAKISQGTKVPEEKTTNTVSKFDNNGNRDRMKLTDFNFLMVLGKGSFGKVMLSERKGTDELYAVKILKKDVVIQDDDVECTMVEKRVLALPGKPPFLTQLHSCFQTMDRLYFVMEYVNGGDLMYHIQQVGRFKEPHAVFYAAEIAIGLFFLQSKGIIYRDLKLDNVMLDSEGHIKIADFGMCKENIWDGVTTKTFCGTPDYIAPEIIAYQPYGKSVDWWAFGVLLYEMLAGQAPFEGEDEDELFQSIMEHNVAYPKSMSKEAVAICKGLMTKHPGKRLGCGPEGERDIKEHAFFRYIDWEKLERKEIQPPYKPKACGRNAENFDRFFTRHPPVLTPPDQEVIRNIDQSEFEGFSFVNSEFLKPEVKS

SEQ ID NO: 8851 - RNA, 2022 nt, Artificial Sequence
  KPCB__Homo_sapiens__CCDS10619.1
auggcugacccggcugcggggccgccgccgagcgagggcgaggagagcaccgugcgcuucgcccgcaaaggcgcccuccggcagaagaacgugcaugaggucaagaaccacaaauucaccgcccgcuucuucaagcagcccaccuucugcagccacugcaccgacuucaucuggggcuucgggaagcagggauuccagugccaaguuugcugcuuuguggugcacaagcggugccaugaauuugucacauucuccugcccuggcgcugacaaggguccagccuccgaugacccccgcagcaaacacaaguuuaagauccacacguacuccagccccacguuuugugaccacugugggucacugcuguauggacucauccaccaggggaugaaaugugacaccugcaugaugaaugugcacaagcgcugcgugaugaauguucccagccuguguggcacggaccacacggagcgccgcggccgcaucuacauccaggcccacaucgacagggacguccucauuguccucguaagagaugcuaaaaaccuuguaccuauggaccccaauggccugucagaucccuacguaaaacugaaacugauucccgaucccaaaagugagagcaaacagaagaccaaaaccaucaaaugcucccucaacccugaguggaaugagacauuuagauuucagcugaaagaaucggacaaagacagaagacugucaguagagauuugggauugggauuugaccagcaggaaugacuucaugggaucuuuguccuuugggauuucugaacuucagaaagccaguguugauggcugguuuaaguuacugagccaggaggaaggcgaguacuucaaugugccugugccaccagaaggaagugaggccaaugaagaacugcggcagaaauuugagagggccaagaucagucagggaaccaaggucccggaagaaaagacgaccaacacugucuccaaauuugacaacaauggcaacagagaccggaugaaacugaccgauuuuaacuuccuaauggugcuggggaaaggcagcuuuggcaaggucaugcuuucagaacgaaaaggcacagaugagcucuaugcugugaagauccugaagaaggacguugugauccaagaugaugacguggagugcacuaugguggagaagcggguguuggcccugccugggaagccgcccuuccugacccagcuccacuccugcuuccagaccauggaccgccuguacuuugugauggaguacgugaaugggggcgaccucauguaucacauccagcaagucggccgguucaaggagccccaugcuguauuuuacgcugcagaaauugccaucggucuguucuucuuacagaguaagggcaucauuuaccgugaccuaaaacuugacaacgugaugcucgauucugagggacacaucaagauugccgauuuuggcauguguaaggaaaacaucugggauggggugacaaccaagacauucuguggcacuccagacuacaucgcccccgagauaauugcuuaucagcccuaugggaaguccguggauuggugggcauuuggaguccugcuguaugaaauguuggcugggcaggcacccuuugaaggggaggaugaagaugaacucuuccaauccaucauggaacacaacguagccuaucccaagucuauguccaaggaagcuguggccaucugcaaagggcugaugaccaaacacccaggcaaacgucuggguuguggaccugaaggcgaacgugauaucaaagagcaugcauuuuuccgguauauugauugggagaaacuugaacgcaaagagauccagcccccuuauaagccaaaagcuugugggcgaaaugcugaaaacuucgaccgauuuuucacccgccauccaccaguccuaacaccucccgaccaggaagucaucaggaauauugaccaaucagaauucgaaggauuuuccuuuguuaacucugaauuuuuaaaacccgaagucaagagcuaa

SEQ ID NO: 8852 - RNA, 2022 nt, Artificial Sequence
  derived and/or modified sequence opt1 from KPCB__Homo_sapiens__CCDS10619.1
auggccgaccccgccgcggggcccccgcccagcgagggcgaggaguccaccgugcgcuucgcccggaagggcgcccugcgccagaagaacguccacgaggugaagaaccacaaguucaccgcccgguucuucaagcagcccacguucugcagccacugcaccgacuucaucuggggguucggcaagcagggguuccagugccaggugugcugcuucgucgugcacaagcgcugccacgaguucgugaccuucuccugccccggcgccgacaagggccccgcgagcgacgacccccgguccaagcacaaguucaagauccacaccuacagcucccccacguucugcgaccacugcgggagccuccuguacggccugauccaccaggggaugaagugcgacacgugcaugaugaacguccacaagcgcugcgugaugaacgugccgucccucugcggcaccgaccacaccgagcggcgcgggcggaucuacauccaggcccacaucgaccgcgacguccugaucgugcuggugcgggacgccaagaaccucguccccauggaccccaacggccugagcgaccccuacgugaagcugaagcucaucccggaccccaaguccgagagcaagcagaagaccaagaccaucaagugcucccugaaccccgaguggaacgagaccuuccgcuuccagcugaaggagagcgacaaggaccggcgccucuccguggagaucugggacugggaccugaccagccggaacgacuucaugggcucccugagcuucgggaucuccgagcuccagaaggccagcgucgacggcugguucaagcugcugagccaggaggagggggaguacuucaacgugcccgugccgcccgagggcuccgaggcgaacgaggagcuccgccagaaguucgagcgggccaagaucagccagggcacgaagguccccgaggagaagaccaccaacaccguguccaaguucgacaacaacgggaaccgcgaccggaugaagcugacggacuucaacuuccugauggugcucggcaaggggagcuucggcaaggucaugcuguccgagcgcaaggggaccgacgagcuguacgccgugaagauccucaagaaggacguggucauccaggacgacgacguggagugcaccauggucgagaagcgggugcuggcccugcccggcaagccgcccuuccucacccagcugcacagcugcuuccagacgauggaccgccuguacuucgugauggaguacgucaacggcggggaccucauguaccacauccagcaggucggccgcuucaaggagccccacgccguguucuacgcggccgagaucgccaucgggcuguucuuccugcaguccaagggcaucaucuaccgggaccucaagcuggacaacgugaugcuggacagcgaggggcacaucaagaucgccgacuucggcaugugcaaggagaacaucugggacggcgugaccaccaagaccuucugcgggacgcccgacuacaucgccccggagaucaucgcguaccagcccuacggcaaguccguggacuggugggccuucgggguccuccuguacgagaugcuggccggccaggcccccuucgagggggaggacgaggacgagcuguuccagagcaucauggagcacaacguggccuaccccaaguccaugagcaaggaggcgguggccaucugcaagggccucaugaccaagcacccgggcaagcgccuggggugcggccccgagggggagcgggacaucaaggagcacgccuucuuccgcuacaucgacugggagaagcucgagcggaaggagauccagcccccguacaagcccaaggccugcggccgcaacgccgagaacuucgaccgguucuucacccgccacccgcccguccugaccccgcccgaccaggaggugauccggaacaucgaccaguccgaguucgagggcuucagcuucgugaacuccgaguuccugaagcccgaggucaagagcuga

SEQ ID NO: 8853 - RNA, 2022 nt, Artificial Sequence
  derived and/or modified sequence opt2 from KPCB__Homo_sapiens__CCDS10619.1
auggccgaccccgccgccggccccccccccuccgagggcgaggaguccaccguccgcuucgcccgcaagggcgcccuccgccagaagaacguccacgaggucaagaaccacaaguucaccgcccgcuucuucaagcagcccaccuucugcucccacugcaccgacuucaucuggggcuucggcaagcagggcuuccagugccaggucugcugcuucgucguccacaagcgcugccacgaguucgucaccuucuccugccccggcgccgacaagggccccgccuccgacgacccccgcuccaagcacaaguucaagauccacaccuacuccucccccaccuucugcgaccacugcggcucccuccucuacggccucauccaccagggcaugaagugcgacaccugcaugaugaacguccacaagcgcugcgucaugaacguccccucccucugcggcaccgaccacaccgagcgccgcggccgcaucuacauccaggcccacaucgaccgcgacguccucaucguccucguccgcgacgccaagaaccucguccccauggaccccaacggccucuccgaccccuacgucaagcucaagcucauccccgaccccaaguccgaguccaagcagaagaccaagaccaucaagugcucccucaaccccgaguggaacgagaccuuccgcuuccagcucaaggaguccgacaaggaccgccgccucuccgucgagaucugggacugggaccucaccucccgcaacgacuucaugggcucccucuccuucggcaucuccgagcuccagaaggccuccgucgacggcugguucaagcuccucucccaggaggagggcgaguacuucaacguccccgucccccccgagggcuccgaggccaacgaggagcuccgccagaaguucgagcgcgccaagaucucccagggcaccaagguccccgaggagaagaccaccaacaccgucuccaaguucgacaacaacggcaaccgcgaccgcaugaagcucaccgacuucaacuuccucaugguccucggcaagggcuccuucggcaaggucaugcucuccgagcgcaagggcaccgacgagcucuacgccgucaagauccucaagaaggacgucgucauccaggacgacgacgucgagugcaccauggucgagaagcgcguccucgcccuccccggcaagccccccuuccucacccagcuccacuccugcuuccagaccauggaccgccucuacuucgucauggaguacgucaacggcggcgaccucauguaccacauccagcaggucggccgcuucaaggagccccacgccgucuucuacgccgccgagaucgccaucggccucuucuuccuccaguccaagggcaucaucuaccgcgaccucaagcucgacaacgucaugcucgacuccgagggccacaucaagaucgccgacuucggcaugugcaaggagaacaucugggacggcgucaccaccaagaccuucugcggcacccccgacuacaucgcccccgagaucaucgccuaccagcccuacggcaaguccgucgacuggugggccuucggcguccuccucuacgagaugcucgccggccaggcccccuucgagggcgaggacgaggacgagcucuuccaguccaucauggagcacaacgucgccuaccccaaguccauguccaaggaggccgucgccaucugcaagggccucaugaccaagcaccccggcaagcgccucggcugcggccccgagggcgagcgcgacaucaaggagcacgccuucuuccgcuacaucgacugggagaagcucgagcgcaaggagauccagccccccuacaagcccaaggccugcggccgcaacgccgagaacuucgaccgcuucuucacccgccacccccccguccucaccccccccgaccaggaggucauccgcaacaucgaccaguccgaguucgagggcuucuccuucgucaacuccgaguuccucaagcccgaggucaaguccuga

SEQ ID NO: 8854 - RNA, 2022 nt, Artificial Sequence
  derived and/or modified sequence opt3 from KPCB__Homo_sapiens__CCDS10619.1
auggccgaccccgcugcaggcccuccaccgagcgagggggaagaguccaccgugagauucgccaggaagggagcgcugcggcagaaaaacguccacgaaguuaagaaucauaaauuuacagcucgcuucuuuaagcaacccacuuucugcucucacuguacggauuuuaucugggguuucggcaaacagggguuucagugccagguguguugcuucguagugcauaagcgaugucacgaguuugucaccuucucaugcccuggagccgacaagggcccagcaagugaugacccccguagcaaacauaaguuuaaaauucacacauacuccucuccuacuuucugugaucacugcgguucgcuccuuuaugggcugauacaucaaggaaugaagugugauaccugcaugaugaacgugcacaaaagauguguuaugaaugugccaucauugugcggcacagaccauaccgaaaggcggggccgcaucuacauucaggcccacaucgacagagaugucuuaauugugcugguaagggacgcuaagaaccuaguucccauggauccuaaugggcucagcgacccauaugugaagcugaaacuuaucccggaucccaagagugaguccaaacagaagacuaaaacaauaaagugcucucugaacccugaguggaaugaaaccuuucgguuccaguugaaagagagcgacaaggaccgccgacucuccgucgaaaucugggauugggaccugacgucaagaaacgauuucaugggaagucugagcuuugguauuucugagcuccaaaaggcauccguggacggcugguucaaauuacugucacaggaggaaggggaguacuuuaaugugccaguucccccugaaggaagcgaggccaacgaggaacuuaggcagaaguucgagcgggcuaaaaucagucagggcacuaaggucccagaagagaaaaccacaaauacugugucuaaguuugauaacaaugguaaccgugaccgcaugaaguugaccgauuucaauuuucugaugguacuagggaaaggauccuucggcaaggugaugcucagcgaaagaaaaggcacagacgagcuguaugccgucaagauucuuaaaaaggaugugguuauccaagacgaugacguggaauguaccauggucgagaagagggugcuggcguugcccgggaaaccgccuuuucucacgcagcugcacucgugcuuccagacuauggaccgguuauacuuuguaauggaguauguuaacggaggugaucugauguaccauauacaacaggugggccgauucaaggaaccccacgcagucuuuuacgccgcugagauugccaucggacucuucuuccuucagucuaaagggauuaucuaucgcgaccugaaguuggauaacgugaugcuagacuccgaaggccauaucaaaauugcagauuuugguauguguaaggagaauauaugggacggggucacaaccaagacuuucugcggcacaccagauuacaucgcuccugaaauuaucgccuaucagcccuacggaaaaucaguggacuggugggcguuuggcguucugcucuaugagaugcuggccgggcaagcaccauucgagggagaagaugaggacgaacuuuuucagaguauaauggagcacaacguggcuuaccccaagagcauguccaaagaggccguagcuauuuguaagggucugaugaccaaacauccuggcaagagauuggggugcggaccagaaggcgagagggauaucaaagaacacgccuucuuucgguauaucgacugggagaagcucgaacgcaaggagauucagccgcccuacaaaccuaaggcaugugguagaaaugccgagaacuucgauagguuuuucacgcgucacccacccguccugaccccuccagaccaggaagugauccggaauauugaccaaucugaguuugaaggguucagcuuuguuaacucagaguucuuaaaacccgaagugaagaguuga

SEQ ID NO: 8855 - RNA, 2022 nt, Artificial Sequence
  derived and/or modified sequence opt4 from KPCB__Homo_sapiens__CCDS10619.1
auggccgaccccgccgccggccccccccccagcgagggcgaggagagcaccgugagauucgccagaaagggcgcccugagacagaagaacgugcacgaggugaagaaccacaaguucaccgccagauucuucaagcagcccaccuucugcagccacugcaccgacuucaucuggggcuucggcaagcagggcuuccagugccaggugugcugcuucguggugcacaagagaugccacgaguucgugaccuucagcugccccggcgccgacaagggccccgccagcgacgaccccagaagcaagcacaaguucaagauccacaccuacagcagccccaccuucugcgaccacugcggcagccugcuguacggccugauccaccagggcaugaagugcgacaccugcaugaugaacgugcacaagagaugcgugaugaacgugcccagccugugcggcaccgaccacaccgagagaagaggcagaaucuacauccaggcccacaucgacagagacgugcugaucgugcuggugagagacgccaagaaccuggugcccauggaccccaacggccugagcgaccccuacgugaagcugaagcugauccccgaccccaagagcgagagcaagcagaagaccaagaccaucaagugcagccugaaccccgaguggaacgagaccuucagauuccagcugaaggagagcgacaaggacagaagacugagcguggagaucugggacugggaccugaccagcagaaacgacuucaugggcagccugagcuucggcaucagcgagcugcagaaggccagcguggacggcugguucaagcugcugagccaggaggagggcgaguacuucaacgugcccgugccccccgagggcagcgaggccaacgaggagcugagacagaaguucgagagagccaagaucagccagggcaccaaggugcccgaggagaagaccaccaacaccgugagcaaguucgacaacaacggcaacagagacagaaugaagcugaccgacuucaacuuccugauggugcugggcaagggcagcuucggcaaggugaugcugagcgagagaaagggcaccgacgagcuguacgccgugaagauccugaagaaggacguggugauccaggacgacgacguggagugcaccaugguggagaagagagugcuggcccugcccggcaagccccccuuccugacccagcugcacagcugcuuccagaccauggacagacuguacuucgugauggaguacgugaacggcggcgaccugauguaccacauccagcaggugggcagauucaaggagccccacgccguguucuacgccgccgagaucgccaucggccuguucuuccugcagagcaagggcaucaucuacagagaccugaagcuggacaacgugaugcuggacagcgagggccacaucaagaucgccgacuucggcaugugcaaggagaacaucugggacggcgugaccaccaagaccuucugcggcacccccgacuacaucgcccccgagaucaucgccuaccagcccuacggcaagagcguggacuggugggccuucggcgugcugcuguacgagaugcuggccggccaggcccccuucgagggcgaggacgaggacgagcuguuccagagcaucauggagcacaacguggccuaccccaagagcaugagcaaggaggccguggccaucugcaagggccugaugaccaagcaccccggcaagagacugggcugcggccccgagggcgagagagacaucaaggagcacgccuucuucagauacaucgacugggagaagcuggagagaaaggagauccagccccccuacaagcccaaggccugcggcagaaacgccgagaacuucgacagauucuucaccagacacccccccgugcugaccccccccgaccaggaggugaucagaaacaucgaccagagcgaguucgagggcuucagcuucgugaacagcgaguuccugaagcccgaggugaagagcuga

SEQ ID NO: 8856 - RNA, 2022 nt, Artificial Sequence
  derived and/or modified sequence opt5 from KPCB__Homo_sapiens__CCDS10619.1
auggccgaccccgcugccggcccuccgcccagcgagggggaagaguccaccgugagauucgcgcggaagggagcucugcgccagaaaaacguccacgaaguuaagaaucacaaauuuacagccagauucuuuaagcaaccuacguucugcucucacuguaccgauuuuaucuggggcuucgggaaacagggauuucagugccagguguguugcuucgugguccauaagcggugucacgaguuugugacauucagcugccccggcgccgacaaggggccugcuuccgaugacccccgcucuaaacauaaguuuaaaauucacaccuacagcuccccuacauucugugaucacugcggaucucuccuguauggccuuauccaucaaggcaugaagugugauaccugcaugaugaacguucacaaaagaugugugaugaaugucccgagccugugcgggacagaccauaccgaacggcgcggaagaauuuacauccaggcccacauugaccgggaugugcucaucguucuggugcgcgacgcuaagaaccuuguccccauggauccuaauggccuguccgaccccuaugugaagcucaaacugaucccugaucccaagagcgagucuaaacagaagacgaaaaccauuaagugcucccugaacccggaguggaaugaaacauuuagauuccagcucaaagagagcgacaaggaccggcgccugucuguggaaaucugggauugggaccuuaccuccagaaacgauuucauggggagccugucuuuuggaauuuccgagcuccaaaaggccagcgucgacggcugguucaaacugcuuucccaggaggaaggggaguacuuuaauguuccugugcccccugaaggaucugaggcgaacgaggaacugcggcagaaguucgagcgcgccaaaaucagccagggcacaaaggugcccgaagagaaaaccacgaauacagucuccaaguuugauaacaauggcaacagagaccggaugaagcucaccgauuucaauuuucugauggugcuggggaaaggcagcuucggaaagguuaugcucucugaaagaaaagggacagacgagcuguaugcugugaagauucuuaaaaaggaugucgugauccaagacgaugacguugaauguaccaugguggagaagcgcguccuggcccuccccggaaaaccuccguuucugacccagcuucacuccugcuuccagacaauggaccggcuguacuuugugauggaguaugucaacggcggggaucucauguaccauauucaacaggugggaagauucaaggaaccccacgcuguguuuuacgccgcggagaucgccaucggccuguucuuccugcagagcaaaggcauuaucuaucgcgaccucaagcuggauaacguuaugcuugacucugaagggcauauuaaaaucgcugauuuuggaauguguaaggagaauauuugggacggcgucacgaccaagacauucugcgggaccccugauuacaucgcccccgaaaucauugcuuaucagccuuacggaaaaagcguggacuggugggccuuuggcguucugcucuaugagaugcuggccgggcaagcucccuucgagggcgaagaugaggacgaacuuuuucaguccaucauggagcacaacguggcguacccgaagucuaugagcaaagaggccgucgcuauuuguaagggacugaugacaaaacauccuggcaagcggcucgggugcggacccgaaggcgagagagauaucaaagaacacgccuucuuucgcuauauugacugggagaagcuggaacggaaggagauccagccucccuacaaaccuaaggccugugggagaaaugcugagaacuucgaucgcuuuuucacccggcaucccccggugcugacgccucccgaccaggaagugaucagaaauauugaccaauccgaguuugaaggauucagcuuuguuaacucugaguuccucaaacccgaagucaaguccuga

SEQ ID NO: 8857 - protein, 912 aa, Artificial Sequence
  KPCD1__Homo_sapiens__Q15139
MSAPPVLRPPSPLLPVAAAAAAAAAALVPGSGPGPAPFLAPVAAPVGGISFHLQIGLSREPVLLLQDSSGDYSLAHVREMACSIVDQKFPECGFYGMYDKILLFRHDPTSENILQLVKAASDIQEGDLIEVVLSASATFEDFQIRPHALFVHSYRAPAFCDHCGEMLWGLVRQGLKCEGCGLNYHKRCAFKIPNNCSGVRRRRLSNVSLTGVSTIRTSSAELSTSAPDEPLLQKSPSESFIGREKRSNSQSYIGRPIHLDKILMSKVKVPHTFVIHSYTRPTVCQYCKKLLKGLFRQGLQCKDCRFNCHKRCAPKVPNNCLGEVTINGDLLSPGAESDVVMEEGSDDNDSERNSGLMDDMEEAMVQDAEMAMAECQNDSGEMQDPDPDHEDANRTISPSTSNNIPLMRVVQSVKHTKRKSSTVMKEGWMVHYTSKDTLRKRHYWRLDSKCITLFQNDTGSRYYKEIPLSEILSLEPVKTSALIPNGANPHCFEITTANVVYYVGENVVNPSSPSPNNSVLTSGVGADVARMWEIAIQHALMPVIPKGSSVGTGTNLHRDISVSISVSNCQIQENVDISTVYQIFPDEVLGSGQFGIVYGGKHRKTGRDVAIKIIDKLRFPTKQESQLRNEVAILQNLHHPGVVNLECMFETPERVFVVMEKLHGDMLEMILSSEKGRLPEHITKFLITQILVALRHLHFKNIVHCDLKPENVLLASADPFPQVKLCDFGFARIIGEKSFRRSVVGTPAYLAPEVLRNKGYNRSLDMWSVGVIIYVSLSGTFPFNEDEDIHDQIQNAAFMYPPNPWKEISHEAIDLINNLLQVKMRKRYSVDKTLSHPWLQDYQTWLDLRELECKIGERYITHESDDLRWEKYAGEQGLQYPTHLINPSASHSDTPETEETEMKALGERVSIL

SEQ ID NO: 8858 - RNA, 2739 nt, Artificial Sequence
  KPCD1__Homo_sapiens__BAG36853
augagcgccccuccgguccugcggccgcccaguccgcugcugcccguggcggcggcagcugccgcagcggccgccgcacuggucccaggguccgggcccgggcccgcgccguucuuggcuccugucgcggccccggucgggggcaucucguuccaucugcagaucggccugagccgugagccggugcugcugcugcaggacucguccggggacuacagccuggcgcacguccgcgagauggcuugcuccauugucgaccagaaguucccugaaugugguuucuacggaauguaugauaagauccugcuuuuucgccaugacccuaccucugaaaacauccuucagcuggugaaagcggccagugauauccaggaaggcgaucuuauugaaguggucuugucagcuuccgccaccuuugaagacuuucagauucguccccacgcucucuuuguucauucauacagagcuccagcuuucugugaucacuguggagaaaugcugugggggcugguacgucaaggucuuaaaugugaaggguguggucugaauuaccauaagagaugugcauuuaaaauacccaacaauugcagcggugugaggcggagaaggcucucaaacguuucccucacuggggucagcaccauccgcacaucaucugcugaacucucuacaagugccccugaugagccccuucugcaaaaaucaccaucagagucguuuauuggucgagagaagaggucaaauucucaaucauacauuggacgaccaauucaccuugacaagauuuugaugucuaaaguuaaagugccgcacacauuugucauccacuccuacacccggcccacagugugccaguacugcaagaagcuucugaaggggcuuuucaggcagggcuugcagugcaaagauugcagauucaacugccauaaacguugugcaccgaaaguaccaaacaacugccuuggcgaagugaccauuaauggagauuugcuuagcccuggggcagagucugauguggucauggaagaagggagugaugacaaugauagugaaaggaacagugggcucauggaugauauggaagaagcaaugguccaagaugcagagauggcaauggcagagugccagaacgacaguggcgagaugcaagauccagacccagaccacgaggacgccaacagaaccaucaguccaucaacaagcaacaauaucccacucaugaggguagugcagucugucaaacacacgaagaggaaaagcagcacagucaugaaagaaggauggaugguccacuacaccagcaaggacacgcugcggaaacggcacuauuggagauuggauagcaaauguauuacccucuuucagaaugacacaggaagcagguacuacaaggaaauuccuuuaucugaaauuuugucucuggaaccaguaaaaacuucagcuuuaauuccuaauggggccaauccucauuguuucgaaaucacuacggcaaauguaguguauuaugugggagaaaauguggucaauccuuccagcccaucaccaaauaacaguguucucaccaguggcguuggugcagauguggccaggaugugggagauagccauccagcaugcccuuaugcccgucauucccaagggcuccuccguggguacaggaaccaacuugcacagagauaucucugugaguauuucaguaucaaauugccagauucaagaaaauguggacaucagcacaguauaucagauuuuuccugaugaaguacuggguucuggacaguuuggaauuguuuauggaggaaaacaucguaaaacaggaagagauguagcuauuaaaaucauugacaaauuacgauuuccaacaaaacaagaaagccagcuucguaaugagguugcaauucuacagaaccuucaucacccugguguuguaaauuuggaguguauguuugagacgccugaaagaguguuuguuguuauggaaaaacuccauggagacaugcuggaaaugaucuugucaagugaaaagggcagguugccagagcacauaacgaaguuuuuaauuacucagauacucguggcuuugcggcaccuucauuuuaaaaauaucguucacugugaccucaaaccagaaaauguguugcuagccucagcugauccuuuuccucaggugaaacuuugugauuuugguuuugcccggaucauuggagagaagucuuuccggaggucagugguggguacccccgcuuaccuggcuccugagguccuaaggaacaagggcuacaaucgcucucuagacauguggucuguuggggucaucaucuauguaagccuaagcggcacauucccauuuaaugaagaugaagacauacacgaccaaauucagaaugcagcuuucauguauccaccaaaucccuggaaggaaauaucucaugaagccauugaucuuaucaacaauuugcugcaaguaaaaaugagaaagcgcuacaguguggauaagaccuugagccacccuuggcuacaggacuaucagaccugguuagauuugcgagagcuggaaugcaaaaucggggagcgcuacaucacccaugaaagugaugaccugaggugggagaaguaugcaggcgagcaggggcugcaguaccccacacaccugaucaauccaagugcuagccacagugacacuccugagacugaagaaacagaaaugaaagcccucggugagcgugucagcauccucuga

SEQ ID NO: 8859 - RNA, 2739 nt, Artificial Sequence
  derived and/or modified sequence opt1 from KPCD1__Homo_sapiens__BAG36853
augagcgcgcccccggugcugcgcccgcccagcccccuccugcccgucgccgccgccgccgccgccgcggccgccgcccuggugcccggcagcgggcccggccccgcgccguuccucgcccccguggccgcccccgucgggggcaucuccuuccaccuccagaucgggcugagccgggagcccgugcugcugcugcaggacuccagcggcgacuacucccucgcccacgugcgcgagauggcgugcagcaucgucgaccagaaguucccggagugcggcuucuacgggauguacgacaagauccugcuguuccggcacgaccccaccuccgagaacauccuccagcuggugaaggccgccagcgacauccaggagggcgaccugaucgaggugguccucuccgccagcgccaccuucgaggacuuccagauccgcccccacgcgcuguucgugcacuccuaccgggcccccgccuucugcgaccacugcggggagaugcuguggggccucgugcgccaggggcugaagugcgagggcugcggccugaacuaccacaagcggugcgccuucaagaucccgaacaacugcagcgggguccgccggcgccggcucuccaacgugagccugacgggcguguccaccauccgcaccagcuccgccgagcugagcaccagcgcgcccgacgagccccuccugcagaagucccccagcgaguccuucaucgggcgggagaagcgcagcaacucccagagcuacaucggccggccgauccaccuggacaagauccucauguccaaggucaaggugccccacacguucgugauccacagcuacacccgccccaccgucugccaguacugcaagaagcugcugaagggccucuuccggcaggggcugcagugcaaggacugccgcuucaacugccacaagcggugcgcccccaaggugccgaacaacugccugggcgaggugaccaucaacggggaccuccugucccccggcgccgagagcgacgucgugauggaggagggguccgacgacaacgacagcgagcgcaacuccggccugauggacgacauggaggaggccauggugcaggacgccgagauggcgauggccgagugccagaacgacagcggcgagaugcaggaccccgaccccgaccacgaggacgccaaccggacgaucuccccgagcaccuccaacaacaucccccucaugcgcgucgugcagagcgucaagcacaccaagcgcaaguccagcaccgugaugaaggagggguggauggugcacuacacgagcaaggacacccugcggaagcgccacuacuggcggcuggacuccaagugcaucacccucuuccagaacgacaccggcagccgcuacuacaaggagaucccccuguccgagauccugagccucgagccggucaagacguccgcccugauccccaacggggcgaacccccacugcuucgagaucaccaccgccaacgugguguacuacgucggcgagaacguggugaaccccagcuccccgagccccaacaacuccguccugaccagcggggugggcgccgacguggcccggaugugggagaucgccauccagcacgcgcucaugcccgucauccccaagggcuccagcguggggacgggcaccaaccugcaccgcgacaucuccgugagcaucuccgucagcaacugccagauccaggagaacguggacaucuccaccguguaccagaucuucccggacgagguccuggggagcggccaguucgggaucguguacggcggcaagcaccggaagaccgggcgcgacguggccaucaagaucaucgacaagcuccgguuccccacgaagcaggagagccagcugcgcaacgaggucgccauccugcagaaccugcaccaccccggcguggugaaccucgagugcauguucgagacccccgagcgggucuucguggugauggagaagcugcacggggacaugcuggagaugauccucuccagcgagaagggccgccugccggagcacaucaccaaguuccugaucacccagauccucgucgcccugcggcaccuccacuucaagaacaucgugcacugcgaccugaagcccgagaacgugcugcuggccuccgcggaccccuucccccaggucaagcucugcgacuucggcuucgcccgcaucaucggggagaaguccuuccggcgcuccguggugggcacgccggccuaccuggcccccgagguccugcggaacaagggguacaaccgcagccucgacaugugguccgugggcgugaucaucuacgucagccuguccgggaccuuccccuucaacgaggacgaggacauccacgaccagauccagaacgccgcguucauguacccgcccaaccccuggaaggagaucagccacgaggccaucgaccugaucaacaaccuccuccaggugaagaugcggaagcgcuacuccguggacaagacccugagccaccccuggcugcaggacuaccagaccuggcuggaccugcgcgagcucgagugcaagaucggcgagcgguacaucacgcacgaguccgacgaccugcgcugggagaaguacgccggcgagcaggggcugcaguaccccacccaccucaucaacccgagcgccucccacagcgacacccccgagaccgaggagacggagaugaaggcgcugggcgagcgggucuccauccuguga

SEQ ID NO: 8860 - RNA, 2739 nt, Artificial Sequence
  derived and/or modified sequence opt2 from KPCD1__Homo_sapiens__BAG36853
auguccgccccccccguccuccgcccccccuccccccuccuccccgucgccgccgccgccgccgccgccgccgccgcccucguccccggcuccggccccggccccgcccccuuccucgcccccgucgccgcccccgucggcggcaucuccuuccaccuccagaucggccucucccgcgagcccguccuccuccuccaggacuccuccggcgacuacucccucgcccacguccgcgagauggccugcuccaucgucgaccagaaguuccccgagugcggcuucuacggcauguacgacaagauccuccucuuccgccacgaccccaccuccgagaacauccuccagcucgucaaggccgccuccgacauccaggagggcgaccucaucgaggucguccucuccgccuccgccaccuucgaggacuuccagauccgcccccacgcccucuucguccacuccuaccgcgcccccgccuucugcgaccacugcggcgagaugcucuggggccucguccgccagggccucaagugcgagggcugcggccucaacuaccacaagcgcugcgccuucaagauccccaacaacugcuccggcguccgccgccgccgccucuccaacgucucccucaccggcgucuccaccauccgcaccuccuccgccgagcucuccaccuccgcccccgacgagccccuccuccagaagucccccuccgaguccuucaucggccgcgagaagcgcuccaacucccaguccuacaucggccgccccauccaccucgacaagauccucauguccaaggucaaggucccccacaccuucgucauccacuccuacacccgccccaccgucugccaguacugcaagaagcuccucaagggccucuuccgccagggccuccagugcaaggacugccgcuucaacugccacaagcgcugcgcccccaagguccccaacaacugccucggcgaggucaccaucaacggcgaccuccucucccccggcgccgaguccgacgucgucauggaggagggcuccgacgacaacgacuccgagcgcaacuccggccucauggacgacauggaggaggccaugguccaggacgccgagauggccauggccgagugccagaacgacuccggcgagaugcaggaccccgaccccgaccacgaggacgccaaccgcaccaucucccccuccaccuccaacaacaucccccucaugcgcgucguccaguccgucaagcacaccaagcgcaaguccuccaccgucaugaaggagggcuggaugguccacuacaccuccaaggacacccuccgcaagcgccacuacuggcgccucgacuccaagugcaucacccucuuccagaacgacaccggcucccgcuacuacaaggagaucccccucuccgagauccucucccucgagcccgucaagaccuccgcccucauccccaacggcgccaacccccacugcuucgagaucaccaccgccaacgucgucuacuacgucggcgagaacgucgucaaccccuccucccccucccccaacaacuccguccucaccuccggcgucggcgccgacgucgcccgcaugugggagaucgccauccagcacgcccucaugcccgucauccccaagggcuccuccgucggcaccggcaccaaccuccaccgcgacaucuccgucuccaucuccgucuccaacugccagauccaggagaacgucgacaucuccaccgucuaccagaucuuccccgacgagguccucggcuccggccaguucggcaucgucuacggcggcaagcaccgcaagaccggccgcgacgucgccaucaagaucaucgacaagcuccgcuuccccaccaagcaggagucccagcuccgcaacgaggucgccauccuccagaaccuccaccaccccggcgucgucaaccucgagugcauguucgagacccccgagcgcgucuucgucgucauggagaagcuccacggcgacaugcucgagaugauccucuccuccgagaagggccgccuccccgagcacaucaccaaguuccucaucacccagauccucgucgcccuccgccaccuccacuucaagaacaucguccacugcgaccucaagcccgagaacguccuccucgccuccgccgaccccuucccccaggucaagcucugcgacuucggcuucgcccgcaucaucggcgagaaguccuuccgccgcuccgucgucggcacccccgccuaccucgcccccgagguccuccgcaacaagggcuacaaccgcucccucgacaugugguccgucggcgucaucaucuacgucucccucuccggcaccuuccccuucaacgaggacgaggacauccacgaccagauccagaacgccgccuucauguacccccccaaccccuggaaggagaucucccacgaggccaucgaccucaucaacaaccuccuccaggucaagaugcgcaagcgcuacuccgucgacaagacccucucccaccccuggcuccaggacuaccagaccuggcucgaccuccgcgagcucgagugcaagaucggcgagcgcuacaucacccacgaguccgacgaccuccgcugggagaaguacgccggcgagcagggccuccaguaccccacccaccucaucaaccccuccgccucccacuccgacacccccgagaccgaggagaccgagaugaaggcccucggcgagcgcgucuccauccucuga

SEQ ID NO: 8861 - RNA, 2739 nt, Artificial Sequence
  derived and/or modified sequence opt3 from KPCD1__Homo_sapiens__BAG36853
augagcgcucccccugugcugagaccaccgaguccccuccuuccugucgccgcagccgcggcugccgcagccgcugcacugguuccaggcucugggcccggaccugccccauucuuggcucccguggccgcgccuguagguggcaucucauuucacuuacagauugggcugaguagggagccagugcuacuccugcaagacagcuccggagauuacucucuugcacauguccgggaaauggccugcucgauaguggaccagaaguucccggaguguggcuuuuaugguauguacgauaaaauccuguuguuccgccacgaccccaccucagaaaacauucuccagcugguuaaggcugccagcgauauccaggagggggaccugauugaagugguccucagugcauccgcuacauuugaggauuuccaaauccgaccucaugccuuauuugugcacucuuaucgugcgccagccuucugcgaccauuguggagagaugcuguggggccuuguaagacagggcuugaaaugcgaaggguguggacugaauuaccacaagaggugcgcauuuaaaauacccaacaauuguagcgguguucggcgcagaaggcuauccaacgugucacucacuggcgucaguacgauccggaccagcucugcugagcuguccacaucagccccugaugaaccacuucugcaaaagagccccagugagucuuucauugggcgcgagaagcgauccaauagccagucguauaucggaagaccgauucacuuggacaaaauccucaugucuaaggugaaagugccucauacuuuugucauacacuccuacaccaggcccacaguuugccaguauuguaagaaacuguuaaagggccuguuccggcagggucuccagugcaaggauugucguuuuaacugccauaaacgcugcgcuccaaaggugccuaauaacugucuuggggaaguaaccauuaauggagaccuguugucacccggcgccgagagugauguggucauggaagagggcagcgacgacaacgauuccgaaagaaauucugggcuaauggacgauauggaggaggcaauggugcaggacgccgaaauggcuauggcggagugccaaaacgauagcggagaaaugcaggacccagaucccgaccacgaggaugcaaauaggacuaucucaccuaguacauccaacaauauuccacugaugcggguugugcagagcgucaaacacaccaagcgaaaaucuucaacggugaugaaggaagguuggaugguacauuacacuuccaaagacacccuccgcaagagacacuacuggaggcuggauagcaaguguaucacacuuuuccaaaacgacacuggcucccgguauuacaaagagaucccgcugucugagauuuugucgcucgaacccguuaagaccagcgcccugauaccuaacggggcuaauccacauugcuucgagaucacaaccgccaacguggucuauuacgugggagaaaaugucgugaaccccuccucaccuaguccaaauaacucuguuuuaacgagcggcgugggugcagacguagcccgcaugugggagauugcuauccagcacgcccugaugcccgucauaccgaaaggguccucagugggcacuggaacaaaucuacauagagauauuagcguuucuaucuccgugaguaacugucagauccaggaaaaugucgacauuagcaccguguaucaaaucuuuccugaugagguacucggcucugggcaguucggaauuguguacgguggcaagcacaggaaaacugggcgugacguugcaauaaagaucauugauaagcugcgguuuccaacaaaacaggagucccagcuucgaaacgaagucgcgaucuugcaaaaucugcaccaucccggaguggugaaccucgagugcauguucgaaaccccugagagagucuuuguugugauggagaagcugcacggcgacaugcuugaaaugauccugucaagugagaaagguagguugcccgaacauauuacgaaguuccucauaacccagauccugguggcuuuacgccaccuucacuuuaaaaauauuguacauugugaucuaaagccagagaacguccuccuggccagcgcagacccuuucccccaggugaagcugugcgauuuuggguucgcccggaucauuggcgaaaaaucguuuagaagguccguugugggaacaccagcuuauuuggccccggagguccugcgcaauaagggcuacaaccgaucucucgacauguggagcguggggguuaucauauacgugucacugaguggaacuuucccuuuuaacgaggaugaagacauccacgaucagauucaaaaugcagcuuucauguaucccccaaaccccuggaaagagaucucccaugaagccauugacuuaaucaauaaccugcuucagguaaagaugcggaaacguuacucugucgacaagaccuugagccacccuuggcuccaggauuaucagacauggcuggaccuaagagagcuggaauguaagauaggugagagguacauuacucaugaguccgaugaccuccgcugggaaaaauaugcgggcgagcaagggcugcaguacccaacccaccuuaucaaucccucagccagccacagugauacaccugaaaccgaggaaacugagaugaaggcuuugggagagcgggugucuauucuguga

SEQ ID NO: 8862 - RNA, 2739 nt, Artificial Sequence
  derived and/or modified sequence opt4 from KPCD1__Homo_sapiens__BAG36853
augagcgccccccccgugcugagaccccccagcccccugcugcccguggccgccgccgccgccgccgccgccgccgcccuggugcccggcagcggccccggccccgcccccuuccuggcccccguggccgcccccgugggcggcaucagcuuccaccugcagaucggccugagcagagagcccgugcugcugcugcaggacagcagcggcgacuacagccuggcccacgugagagagauggccugcagcaucguggaccagaaguuccccgagugcggcuucuacggcauguacgacaagauccugcuguucagacacgaccccaccagcgagaacauccugcagcuggugaaggccgccagcgacauccaggagggcgaccugaucgagguggugcugagcgccagcgccaccuucgaggacuuccagaucagaccccacgcccuguucgugcacagcuacagagcccccgccuucugcgaccacugcggcgagaugcuguggggccuggugagacagggccugaagugcgagggcugcggccugaacuaccacaagagaugcgccuucaagauccccaacaacugcagcggcgugagaagaagaagacugagcaacgugagccugaccggcgugagcaccaucagaaccagcagcgccgagcugagcaccagcgcccccgacgagccccugcugcagaagagccccagcgagagcuucaucggcagagagaagagaagcaacagccagagcuacaucggcagacccauccaccuggacaagauccugaugagcaaggugaaggugccccacaccuucgugauccacagcuacaccagacccaccgugugccaguacugcaagaagcugcugaagggccuguucagacagggccugcagugcaaggacugcagauucaacugccacaagagaugcgcccccaaggugcccaacaacugccugggcgaggugaccaucaacggcgaccugcugagccccggcgccgagagcgacguggugauggaggagggcagcgacgacaacgacagcgagagaaacagcggccugauggacgacauggaggaggccauggugcaggacgccgagauggccauggccgagugccagaacgacagcggcgagaugcaggaccccgaccccgaccacgaggacgccaacagaaccaucagccccagcaccagcaacaacaucccccugaugagaguggugcagagcgugaagcacaccaagagaaagagcagcaccgugaugaaggagggcuggauggugcacuacaccagcaaggacacccugagaaagagacacuacuggagacuggacagcaagugcaucacccuguuccagaacgacaccggcagcagauacuacaaggagaucccccugagcgagauccugagccuggagcccgugaagaccagcgcccugauccccaacggcgccaacccccacugcuucgagaucaccaccgccaacgugguguacuacgugggcgagaacguggugaaccccagcagccccagccccaacaacagcgugcugaccagcggcgugggcgccgacguggccagaaugugggagaucgccauccagcacgcccugaugcccgugauccccaagggcagcagcgugggcaccggcaccaaccugcacagagacaucagcgugagcaucagcgugagcaacugccagauccaggagaacguggacaucagcaccguguaccagaucuuccccgacgaggugcugggcagcggccaguucggcaucguguacggcggcaagcacagaaagaccggcagagacguggccaucaagaucaucgacaagcugagauuccccaccaagcaggagagccagcugagaaacgagguggccauccugcagaaccugcaccaccccggcguggugaaccuggagugcauguucgagacccccgagagaguguucguggugauggagaagcugcacggcgacaugcuggagaugauccugagcagcgagaagggcagacugcccgagcacaucaccaaguuccugaucacccagauccugguggcccugagacaccugcacuucaagaacaucgugcacugcgaccugaagcccgagaacgugcugcuggccagcgccgaccccuucccccaggugaagcugugcgacuucggcuucgccagaaucaucggcgagaagagcuucagaagaagcguggugggcacccccgccuaccuggcccccgaggugcugagaaacaagggcuacaacagaagccuggacauguggagcgugggcgugaucaucuacgugagccugagcggcaccuuccccuucaacgaggacgaggacauccacgaccagauccagaacgccgccuucauguacccccccaaccccuggaaggagaucagccacgaggccaucgaccugaucaacaaccugcugcaggugaagaugagaaagagauacagcguggacaagacccugagccaccccuggcugcaggacuaccagaccuggcuggaccugagagagcuggagugcaagaucggcgagagauacaucacccacgagagcgacgaccugagaugggagaaguacgccggcgagcagggccugcaguaccccacccaccugaucaaccccagcgccagccacagcgacacccccgagaccgaggagaccgagaugaaggcccugggcgagagagugagcauccuguga

SEQ ID NO: 8863 - RNA, 2739 nt, Artificial Sequence
  derived and/or modified sequence opt5 from KPCD1__Homo_sapiens__BAG36853
augagcgcucccccugugcugagaccgcccuccccucuccugcccgucgccgccgcggcugccgccgcugccgcugcccuuguuccuggcucugggcccggaccugcgccguuccuggcccccguggcugccccugugggcgggaucagcuuucaccuccagauuggacugucccgggagcccguccuucugcuccaagacucuagcggcgauuacucccuggcucaugugcgcgaaauggccugcucuaucguugaccagaaguucccugaguguggguuuuauggaauguacgauaaaauucuccuguucagacacgaccccaccagcgaaaacauccugcagcuugugaaggcggccuccgauauucaggagggcgaccugaucgaagucgugcucagcgcuucugccacauuugaggauuuccaaauccggccgcaugcucuguuuguucacuccuaucgcgccccugccuucugcgaccauuguggcgagaugcuuugggggcuggugagacagggacucaaaugcgaaggcugugggcugaauuaccacaagcggugcgcuuuuaaaauucccaacaauuguagcggaguccgcagacggcgccugucuaacgugucccucacgggcgugagcaccaucagaacaucuuccgcggagcugagcaccuccgccccugaugaaccccuucugcagaagucucccagcgaguccuucauugggcgggagaagcgcagcaauucucaguccuauaucggaagaccuauucaccucgacaaaauccugaugagcaaggucaaaguuccgcauacauuugugauucacucuuacacccggcccacagugugccaauauuguaagaaacuucugaagggccucuuccgccagggccugcagugcaaggauuguagauuuaacugccauaaacggugcgcuccuaagguccccaauaacugucugggggaagugaccaucaauggagaccuccugagcccuggcgccgaguccgauguugugauggaagaggggucugacgacaacgauagcgaaagaaauuccggacuuauggacgauauggaggaggccaugguccaggacgcugaaauggccauggcggagugccaaaacgauagcggcgaaaugcaggaccccgauccggaccacgaggaugcuaaucgcacgaucucuccuuccaccagcaacaauauuccccugaugcgggugguucagucugugaaacacacaaagagaaaauccagcaccgucaugaaggaaggguggauggugcauuacacauccaaagacacccuccgcaagcggcacuacuggagacuggauucuaaguguaucacgcuuuuccaaaacgacacaggaagccgcuauuacaaagagauuccucuguccgagauccucucucuggaacccgucaagaccagcgcccugauuccuaacggcgccaauccccauugcuucgagaucacaaccgcuaacgugguuuauuacgugggcgaaaaugucgugaacccguccagcccuucucccaauaacuccguucucaccagcggggugggagccgacgucgcucggaugugggagaucgccauucagcacgcgcugaugcccgugaucccuaaaggcagcuccguggggacaggaacgaaucuucauagagauauuagcguuucuaucagcgucuccaacugucagauucaggaaaauguggacaucagcaccguguaucaaaucuuuccggaugagguccugggcucugggcaguucggcauuguguacggaggcaagcaccgcaaaacagggcgggacguugccaucaagauuaucgauaagcucagauuucccaccaaacaggagucccagcugcgcaacgaaguggcuauucugcaaaaucuucaccauccuggagucgugaaccucgagugcauguucgaaacacccgagcggguuuuuguggucauggagaagcugcacggcgacaugcuggaaaugauccucagcuccgagaaagggagacugccugaacauauuaccaaguuccuuaucacgcagauccugguggcccuccggcaucugcacuuuaaaaauauuguucacugugaucugaagcccgagaacgugcuucucgcuucugccgacccuuucccccaggucaagcugugcgauuuuggauucgcgcgcaucauuggcgaaaaaucuuuuagacgguccgugguggggacaccggccuaucuggcuccugagguccucagaaauaagggcuacaaccgcucucuggacauguggagcguuggagugaucauuuacgugucccuuucuggcaccuuccccuuuaacgaggaugaagacauccacgaucagauccaaaaugccgcuuucauguauccucccaacccguggaaagagauuagccaugaagccaucgaccugauuaauaaccuccugcaggucaagaugcggaaaagauacuccguggacaagacccugagccacccuuggcuucaggauuaucagacauggcucgaccugcgcgagcuggaauguaagaucggggagagauacauuacccaugagucugaugaccuccggugggaaaaauaugccggagagcaaggccugcaguaccccacacaccuuaucaauccuuccgcuagccacucugauacgcccgaaaccgaggaaacagagaugaaggcgcugggggagcgcguuuccauccucuga

SEQ ID NO: 8864 - protein, 890 aa, Artificial Sequence
  KPCD3__Homo_sapiens__O94806
MSANNSPPSAQKSVLPTAIPAVLPAASPCSSPKTGLSARLSNGSFSAPSLTNSRGSVHTVSFLLQIGLTRESVTIEAQELSLSAVKDLVCSIVYQKFPECGFFGMYDKILLFRHDMNSENILQLITSADEIHEGDLVEVVLSALATVEDFQIRPHTLYVHSYKAPTFCDYCGEMLWGLVRQGLKCEGCGLNYHKRCAFKIPNNCSGVRKRRLSNVSLPGPGLSVPRPLQPEYVALPSEESHVHQEPSKRIPSWSGRPIWMEKMVMCRVKVPHTFAVHSYTRPTICQYCKRLLKGLFRQGMQCKDCKFNCHKRCASKVPRDCLGEVTFNGEPSSLGTDTDIPMDIDNNDINSDSSRGLDDTEEPSPPEDKMFFLDPSDLDVERDEEAVKTISPSTSNNIPLMRVVQSIKHTKRKSSTMVKEGWMVHYTSRDNLRKRHYWRLDSKCLTLFQNESGSKYYKEIPLSEILRISSPRDFTNISQGSNPHCFEIITDTMVYFVGENNGDSSHNPVLAATGVGLDVAQSWEKAIRQALMPVTPQASVCTSPGQGKDHKDLSTSISVSNCQIQENVDISTVYQIFADEVLGSGQFGIVYGGKHRKTGRDVAIKVIDKMRFPTKQESQLRNEVAILQNLHHPGIVNLECMFETPERVFVVMEKLHGDMLEMILSSEKSRLPERITKFMVTQILVALRNLHFKNIVHCDLKPENVLLASAEPFPQVKLCDFGFARIIGEKSFRRSVVGTPAYLAPEVLRSKGYNRSLDMWSVGVIIYVSLSGTFPFNEDEDINDQIQNAAFMYPPNPWREISGEAIDLINNLLQVKMRKRYSVDKSLSHPWLQDYQTWLDLREFETRIGERYITHESDDARWEIHAYTHNLVYPKHFIMAPNPDDMEEDP

SEQ ID NO: 8865 - RNA, 2673 nt, Artificial Sequence
  KPCD3__Homo_sapiens__AAY14817
augucugcaaauaauuccccuccaucagcccagaagucuguauuacccacagcuauuccugcugugcuuccagcugcuucuccguguucaaguccuaagacgggacucucugcccgacucucuaauggaagcuucagugcaccaucacucaccaacuccagaggcucagugcauacaguuucauuucuacugcaaauuggccucacacgggagaguguuaccauugaagcccaggaacugucuuuaucugcugucaaggaucuugugugcuccauaguuuaucaaaaguuuccagaguguggauucuuuggcauguaugacaaaauucuucucuuucgccaugacaugaacucagaaaacauuuugcagcugauuaccucagcagaugaaauacaugaaggagaccuaguggaagugguucuuucagcuuuagccacaguagaagacuuccagauucguccacauacucucuauguacauucuuacaaagcuccuacuuucugugauuacuguggugagaugcucuggggauugguacgucaaggacugaaaugugaaggcuguggauuaaauuaccauaaacgaugugccuucaagauuccaaauaacuguaguggaguaagaaagagacgucugucaaauguaucuuuaccaggacccggccucucaguuccaagaccccuacagccugaauauguagcccuucccagugaagagucacauguccaccaggaaccaaguaagagaauuccuucuuggaguggucgcccaaucuggauggaaaagaugguaaugugcagagugaaaguuccacacacauuugcuguucacucuuacacccgucccacgauaugucaguacugcaagcgguuacugaaaggccucuuucgccaaggaaugcaguguaaagauugcaaauucaacugccauaaacgcugugcaucaaaaguaccaagagacugccuuggagagguuacuuucaauggagaaccuuccagucugggaacagauacagauauaccaauggauauugacaauaaugacauaaauagugauaguagucgggguuuggaugacacagaagagccaucacccccagaagauaagauguucuucuuggauccaucugaucucgauguggaaagagaugaagaagccguuaaaacaaucaguccaucaacaagcaauaauauuccgcuaaugaggguuguacaauccaucaagcacacaaagaggaagagcagcacaauggugaaggaaggguggaugguccauuacaccagcagggauaaccugagaaagaggcauuauuggagacuugacagcaaaugucuaacauuauuucagaaugaaucuggaucaaaguauuauaaggaaauuccacuuucagaaauucuccgcauaucuucaccacgagauuucacaaacauuucacaaggcagcaauccacacuguuuugaaaucauuacugauacuaugguauacuucguuggugagaacaauggggacagcucucauaauccuguucuugcugccacuggaguuggacuugauguagcacagagcugggaaaaagcaauucgccaagcccucaugccuguuacuccucaagcaaguguuugcacuucuccagggcaagggaaagaucacaaagauuugucuacaaguaucucuguaucuaauugucagauucaggagaauguggauaucaguacuguuuaccagaucuuugcagaugaggugcuugguucaggccaguuuggcaucguuuauggaggaaaacauagaaagacugggagggauguggcuauuaaaguaauugauaagaugagauuccccacaaaacaagaaagucaacuccguaaugaaguggcuauuuuacagaauuugcaccauccugggauuguaaaccuggaauguauguuugaaaccccagaacgagucuuuguaguaauggaaaagcugcauggagauauguuggaaaugauucuauccagugagaaaagucggcuuccagaacgaauuacuaaauucauggucacacagauacuuguugcuuugaggaaucugcauuuuaagaauauugugcacugugauuuaaagccagaaaaugugcugcuugcaucagcagagccauuuccucaggugaagcugugugacuuuggauuugcacgcaucauuggugaaaagucauucaggagaucugugguaggaacuccagcauacuuagccccugaaguucuccggagcaaagguuacaaccguucccuagauauguggucagugggaguuaucaucuaugugagccucaguggcacauuuccuuuuaaugaggaugaagauauaaaugaccaaauccaaaaugcugcauuuauguacccaccaaauccauggagagaaauuucuggugaagcaauugaucugauaaacaaucugcuucaagugaagaugagaaaacguuacaguguugacaaaucucuuagucaucccuggcuacaggacuaucagacuuggcuugaccuuagagaauuugaaacucgcauuggagaacguuacauuacacaugaaagugaugaugcucgcugggaaauacaugcauacacacauaaccuuguauacccaaagcacuucauuauggcuccuaauccagaugauauggaagaagauccuuaa

SEQ ID NO: 8866 - RNA, 2673 nt, Artificial Sequence
  derived and/or modified sequence opt1 from KPCD3__Homo_sapiens__AAY14817
augagcgccaacaacuccccgcccagcgcccagaaguccgugcugcccaccgcgauccccgccguccuccccgccgccagcccgugcuccagccccaagaccggccuguccgcccgccugagcaacggguccuucagcgcgcccucccucacgaacagccggggcuccgugcacaccgugagcuuccugcugcagaucgggcucacccgcgaguccgucaccaucgaggcccaggagcugagccuguccgccgugaaggaccucgugugcagcaucgucuaccagaaguuccccgagugcggcuucuucgggauguacgacaagauccugcuguuccggcacgacaugaacuccgagaacauccuccagcugaucacgagcgccgacgagauccacgagggcgaccugguggaggugguccucagcgcgcuggccaccguggaggacuuccagauccgcccgcacacccuguacgugcacuccuacaaggcccccaccuucugcgacuacugcggcgagaugcucugggggcugguccggcagggccugaagugcgaggggugcggccucaacuaccacaagcgcugcgccuucaagauccccaacaacugcagcggggugcggaagcgccggcuguccaacgugagccugcccggcccgggccucuccgucccccgcccccugcagcccgaguacguggcccugccgagcgaggagucccacgugcaccaggagcccagcaagcggauccccuccuggagcgggcgccccaucuggauggagaagauggucaugugccgggugaaggugccgcacacguucgcgguccacuccuacacccgccccaccaucugccaguacugcaagcggcuccugaagggccuguuccgccaggggaugcagugcaaggacugcaaguucaacugccacaagcggugcgccagcaaggugccccgcgacugccucggcgaggugaccuucaacggcgagcccuccagccuggggacggacaccgacaucccgauggacaucgacaacaacgacaucaacuccgacagcucccggggccuggacgacaccgaggagcccagcccgcccgaggacaagauguucuuccucgaccccuccgaccuggacgucgagcgcgacgaggaggccgugaagaccaucagccccagcacguccaacaacaucccccugaugcgggucgugcagagcaucaagcacaccaagcgcaaguccagcaccauggugaaggagggguggaugguccacuacaccucccgcgacaaccuccggaagcgccacuacuggcggcuggacagcaagugccugacccucuuccagaacgaguccggcagcaaguacuacaaggagaucccgcuguccgagauccugcgcaucagcagcccccgggacuucaccaacaucucccagggguccaacccccacugcuucgagaucaucaccgacaccaugguguacuucgugggcgagaacaacggcgacagcucccacaaccccguccucgccgccacgggggugggccuggacguggcgcagagcugggagaaggccauccgccaggcccugaugccggucacgccccaggccuccgugugcaccagccccgggcagggcaaggaccacaaggaccucagcaccuccaucagcguguccaacugccagauccaggagaacgucgacaucagcacgguguaccagaucuucgccgacgaggugcugggguccggccaguucggcaucgucuacgggggcaagcaccggaagaccgggcgcgacguggcgaucaaggugaucgacaagaugcgguuccccaccaagcaggagagccagcugcgcaacgaggucgccauccuccagaaccugcaccacccgggcaucgugaaccuggagugcauguucgagacccccgagcggguguucgucgugauggagaagcugcacggggacaugcucgagaugauccuguccagcgagaagucccgccugcccgagcggaucacgaaguucauggugacccagauccucgucgcccugcgcaaccugcacuucaagaacaucgugcacugcgaccucaagcccgagaacgugcugcuggccagcgccgagccguucccccaggucaagcucugcgacuucggcuucgcgcggaucaucggcgagaaguccuuccgccggagcgugguggggacccccgccuaccuggcccccgagguccugcgcuccaagggcuacaaccggagccucgacaugugguccgugggggugaucaucuacgucagccuguccggcaccuucccguucaacgaggacgaggacaucaacgaccagauccagaacgccgcguucauguacccgcccaaccccuggcgcgagaucagcggcgaggccaucgaccugaucaacaaccuccuccaggugaagaugcgcaagcgguacuccguggacaagagccugagccaccccuggcugcaggacuaccagacguggcuggaccugcgcgaguucgagacccggaucggggagcgcuacaucacccacgaguccgacgacgcccggugggagauccacgccuacacccacaaccucgucuaccccaagcacuucaucauggcccccaaccccgacgacauggaggaggacccguga

SEQ ID NO: 8867 - RNA, 2673 nt, Artificial Sequence
  derived and/or modified sequence opt2 from KPCD3__Homo_sapiens__AAY14817
auguccgccaacaacuccccccccuccgcccagaaguccguccuccccaccgccauccccgccguccuccccgccgccucccccugcuccucccccaagaccggccucuccgcccgccucuccaacggcuccuucuccgcccccucccucaccaacucccgcggcuccguccacaccgucuccuuccuccuccagaucggccucacccgcgaguccgucaccaucgaggcccaggagcucucccucuccgccgucaaggaccucgucugcuccaucgucuaccagaaguuccccgagugcggcuucuucggcauguacgacaagauccuccucuuccgccacgacaugaacuccgagaacauccuccagcucaucaccuccgccgacgagauccacgagggcgaccucgucgaggucguccucuccgcccucgccaccgucgaggacuuccagauccgcccccacacccucuacguccacuccuacaaggcccccaccuucugcgacuacugcggcgagaugcucuggggccucguccgccagggccucaagugcgagggcugcggccucaacuaccacaagcgcugcgccuucaagauccccaacaacugcuccggcguccgcaagcgccgccucuccaacgucucccuccccggccccggccucuccgucccccgcccccuccagcccgaguacgucgcccuccccuccgaggagucccacguccaccaggagcccuccaagcgcauccccuccugguccggccgccccaucuggauggagaagauggucaugugccgcgucaaggucccccacaccuucgccguccacuccuacacccgccccaccaucugccaguacugcaagcgccuccucaagggccucuuccgccagggcaugcagugcaaggacugcaaguucaacugccacaagcgcugcgccuccaaggucccccgcgacugccucggcgaggucaccuucaacggcgagcccuccucccucggcaccgacaccgacauccccauggacaucgacaacaacgacaucaacuccgacuccucccgcggccucgacgacaccgaggagcccuccccccccgaggacaagauguucuuccucgaccccuccgaccucgacgucgagcgcgacgaggaggccgucaagaccaucucccccuccaccuccaacaacaucccccucaugcgcgucguccaguccaucaagcacaccaagcgcaaguccuccaccauggucaaggagggcuggaugguccacuacaccucccgcgacaaccuccgcaagcgccacuacuggcgccucgacuccaagugccucacccucuuccagaacgaguccggcuccaaguacuacaaggagaucccccucuccgagauccuccgcaucuccuccccccgcgacuucaccaacaucucccagggcuccaacccccacugcuucgagaucaucaccgacaccauggucuacuucgucggcgagaacaacggcgacuccucccacaaccccguccucgccgccaccggcgucggccucgacgucgcccaguccugggagaaggccauccgccaggcccucaugcccgucaccccccaggccuccgucugcaccucccccggccagggcaaggaccacaaggaccucuccaccuccaucuccgucuccaacugccagauccaggagaacgucgacaucuccaccgucuaccagaucuucgccgacgagguccucggcuccggccaguucggcaucgucuacggcggcaagcaccgcaagaccggccgcgacgucgccaucaaggucaucgacaagaugcgcuuccccaccaagcaggagucccagcuccgcaacgaggucgccauccuccagaaccuccaccaccccggcaucgucaaccucgagugcauguucgagacccccgagcgcgucuucgucgucauggagaagcuccacggcgacaugcucgagaugauccucuccuccgagaagucccgccuccccgagcgcaucaccaaguucauggucacccagauccucgucgcccuccgcaaccuccacuucaagaacaucguccacugcgaccucaagcccgagaacguccuccucgccuccgccgagcccuucccccaggucaagcucugcgacuucggcuucgcccgcaucaucggcgagaaguccuuccgccgcuccgucgucggcacccccgccuaccucgcccccgagguccuccgcuccaagggcuacaaccgcucccucgacaugugguccgucggcgucaucaucuacgucucccucuccggcaccuuccccuucaacgaggacgaggacaucaacgaccagauccagaacgccgccuucauguacccccccaaccccuggcgcgagaucuccggcgaggccaucgaccucaucaacaaccuccuccaggucaagaugcgcaagcgcuacuccgucgacaagucccucucccaccccuggcuccaggacuaccagaccuggcucgaccuccgcgaguucgagacccgcaucggcgagcgcuacaucacccacgaguccgacgacgcccgcugggagauccacgccuacacccacaaccucgucuaccccaagcacuucaucauggcccccaaccccgacgacauggaggaggaccccuga

SEQ ID NO: 8868 - RNA, 2673 nt, Artificial Sequence
  derived and/or modified sequence opt3 from KPCD3__Homo_sapiens__AAY14817
augagcgccaacaauuccccuccuucugcucagaagucagugcugccaaccgcaaucccggccguccuccccgcggcuaguccuugcagcuccccaaaaacaggccuuucugccagacugucgaacgggucauucagcgcacccaguuugacuaauuccaggggaucuguucacacggugagcuuuuuacugcaaauuggucuaacccgggaguccguaacaauagaagcccaggagcucucacugagugcugugaaggaccuugucuguagcaucguguaccagaaauucccugaaugcggcuuuuucgggauguaugauaagauucuguuguuucgccaugacaugaacucugagaauauccuccagcugauuacuuccgcagaugaaauccacgagggagaccugguugaggugguccucucagccuuagcuaccguggaagauuuccaaauacgaccacauacacuguacguacacagcuauaaagcccccaccuuuugugacuacugcggcgagaugcuuugggguuugguucgucaggggcugaagugugaaggaugcggccuaaacuaucauaagagaugugcguucaaaaucccuaauaacugcaguggcgugaggaagcggcgccucucuaaugucucccugccagggccgggacuuagcgugcccagaccucugcagccagaguacguggcauugcccucggaggaaucucacguccaccaggagccuuccaaaaggauuccaucauggaguggucggcccaucuggauggaaaagaugguuaugugucgcgugaaaguaccgcauacuuuugccgugcacagcuauacacgaccuaccauuugccaauacuguaagagacuccugaagggcuuauucaggcaggggaugcagugcaaagauugcaaguuuaacugucauaaacggugcgcuuccaaggucccccgugacugucugggagaggugacguucaauggcgaaccaucuagccucgguacugauaccgacaucccuauggauauagacaacaaugauauuaacucagacaguucccgcgggcuugacgauacagaggagcccagcccacccgaagacaaaauguuuuuccuggauccuucugacuuggauguugagagagacgaagaggccgugaagacuaucucaccaaguaccagcaauaacauuccgcuaaugagggucgugcaguccaucaaacacacaaagcggaagucuucgaccaugguaaaagaaggauggaugguucacuacacgagccgagauaaccugcgcaagagacauuauuggaggcucgacuccaaaugccugacucuuuuccaaaaugagucaggcaguaaguacuauaaagagaucccccugucugaaauuuugcggauaagcuccccucgcgauuuuacaaacaucucacagggcagcaauccacacuguuucgagauuaucaccgacacuaugguguacuuugucggggaaaacaauggagauucuucccauaaccccgugcucgcagcuacaggugucggccuggacguggcccagaguugggagaaggcgauaagacaagccuuaaugccuguuaccccacaggcaagcgugugcacgucucccgggcagggaaaggaccacaaagaucuguccaccucaauuaguguaagcaauugucagauccaagaaaacgucgacaucucgacaguguaucagauuuucgcugaugagguucuaggcuccggucaguuugggaucguguacggcggaaagcauaggaaaacuggccgugacgucgccauuaaggugauagauaaaaugcgguucccgaccaagcaggagucucaacuccgaaaugaaguagcuauccugcagaaccuucaccacccugggauugugaauuuggagugcauguuugaaacaccagagagaguuuucgucgugauggagaagcugcauggagacaugcucgaaaugauccugagcucagagaaaaguaggcuucccgaacgcaucacuaaguuuauggugacccagauucuggucgccuugcggaaccuccacuucaaaaauauaguucauugugaucugaagccugagaacguguuacuggcauccgccgaacccuuuccacaggugaaacuaugcgacuucgguuuugcuagaaucauuggcgagaagucuuucaggcgcagcguagucgggacacccgcguaucucgcacccgaggugcugcgauccaagggauacaaucggucacuugauauguggagcguuggcgugaucauuuacgucaguuugucugguaccuucccauuuaacgaagacgaggauaucaacgaccaaauacagaaugccgcuuucauguauccgccuaaccccuggcgugaaaucuccggggaggccauugaucugaucaauaaccucuuacaggugaaaaugagaaagagguacagcguugacaaaucgcugucacacccauggcugcaggacuaucaaacuuggcuugauuugcgcgaauuugagacgcggauuggcgagagauacaucacacacgaaucugacgaugcaaggugggagauacaugccuauacccacaaucucguguaccccaagcauuucauuauggcuccuaacccagacgauauggaagaggaccccuga

SEQ ID NO: 8869 - RNA, 2673 nt, Artificial Sequence
  derived and/or modified sequence opt4 from KPCD3__Homo_sapiens__AAY14817
augagcgccaacaacagcccccccagcgcccagaagagcgugcugcccaccgccauccccgccgugcugcccgccgccagccccugcagcagccccaagaccggccugagcgccagacugagcaacggcagcuucagcgcccccagccugaccaacagcagaggcagcgugcacaccgugagcuuccugcugcagaucggccugaccagagagagcgugaccaucgaggcccaggagcugagccugagcgccgugaaggaccuggugugcagcaucguguaccagaaguuccccgagugcggcuucuucggcauguacgacaagauccugcuguucagacacgacaugaacagcgagaacauccugcagcugaucaccagcgccgacgagauccacgagggcgaccugguggagguggugcugagcgcccuggccaccguggaggacuuccagaucagaccccacacccuguacgugcacagcuacaaggcccccaccuucugcgacuacugcggcgagaugcuguggggccuggugagacagggccugaagugcgagggcugcggccugaacuaccacaagagaugcgccuucaagauccccaacaacugcagcggcgugagaaagagaagacugagcaacgugagccugcccggccccggccugagcgugcccagaccccugcagcccgaguacguggcccugcccagcgaggagagccacgugcaccaggagcccagcaagagaauccccagcuggagcggcagacccaucuggauggagaagauggugaugugcagagugaaggugccccacaccuucgccgugcacagcuacaccagacccaccaucugccaguacugcaagagacugcugaagggccuguucagacagggcaugcagugcaaggacugcaaguucaacugccacaagagaugcgccagcaaggugcccagagacugccugggcgaggugaccuucaacggcgagcccagcagccugggcaccgacaccgacauccccauggacaucgacaacaacgacaucaacagcgacagcagcagaggccuggacgacaccgaggagcccagcccccccgaggacaagauguucuuccuggaccccagcgaccuggacguggagagagacgaggaggccgugaagaccaucagccccagcaccagcaacaacaucccccugaugagaguggugcagagcaucaagcacaccaagagaaagagcagcaccauggugaaggagggcuggauggugcacuacaccagcagagacaaccugagaaagagacacuacuggagacuggacagcaagugccugacccuguuccagaacgagagcggcagcaaguacuacaaggagaucccccugagcgagauccugagaaucagcagccccagagacuucaccaacaucagccagggcagcaacccccacugcuucgagaucaucaccgacaccaugguguacuucgugggcgagaacaacggcgacagcagccacaaccccgugcuggccgccaccggcgugggccuggacguggcccagagcugggagaaggccaucagacaggcccugaugcccgugaccccccaggccagcgugugcaccagccccggccagggcaaggaccacaaggaccugagcaccagcaucagcgugagcaacugccagauccaggagaacguggacaucagcaccguguaccagaucuucgccgacgaggugcugggcagcggccaguucggcaucguguacggcggcaagcacagaaagaccggcagagacguggccaucaaggugaucgacaagaugagauuccccaccaagcaggagagccagcugagaaacgagguggccauccugcagaaccugcaccaccccggcaucgugaaccuggagugcauguucgagacccccgagagaguguucguggugauggagaagcugcacggcgacaugcuggagaugauccugagcagcgagaagagcagacugcccgagagaaucaccaaguucauggugacccagauccugguggcccugagaaaccugcacuucaagaacaucgugcacugcgaccugaagcccgagaacgugcugcuggccagcgccgagcccuucccccaggugaagcugugcgacuucggcuucgccagaaucaucggcgagaagagcuucagaagaagcguggugggcacccccgccuaccuggcccccgaggugcugagaagcaagggcuacaacagaagccuggacauguggagcgugggcgugaucaucuacgugagccugagcggcaccuuccccuucaacgaggacgaggacaucaacgaccagauccagaacgccgccuucauguacccccccaaccccuggagagagaucagcggcgaggccaucgaccugaucaacaaccugcugcaggugaagaugagaaagagauacagcguggacaagagccugagccaccccuggcugcaggacuaccagaccuggcuggaccugagagaguucgagaccagaaucggcgagagauacaucacccacgagagcgacgacgccagaugggagauccacgccuacacccacaaccugguguaccccaagcacuucaucauggcccccaaccccgacgacauggaggaggaccccuga

SEQ ID NO: 8870 - RNA, 2673 nt, Artificial Sequence
  derived and/or modified sequence opt5 from KPCD3__Homo_sapiens__AAY14817
augagcgccaacaauuccccucccucugcucagaagucugugcugccgaccgccauccccgcgguccucccugcugccucccccugcucuagcccuaaaacaggccuguccgccagacuuucuaacgggagcuucuccgcucccagccugacgaauagccggggauccguucacaccgugagcuuucuccugcaaauuggccuuacacgcgagucugugaccaucgaagcccaggagcugucccucagcgcugucaaggaccugguguguucuauuguuuaccagaaauucccugaaugcggguuuuucggaauguaugauaagauccugcucuuuagacaugacaugaacuccgagaauauucugcagcuuaucacaagcgccgaugaaauccacgagggcgaccugguggaggucgugcucuccgcgcuggccaccguugaagauuuccaaauucggccgcauacacuuuacgugcacucuuauaaagcucccaccuuuugugacuacugcggggagaugcuguggggacucguccgccagggccugaagugugaaggcugcgggcugaacuaucauaagagaugugccuucaaaaucccuaauaacugcagcggagugcggaagcgcagacucuccaaugugagccugcccggcccugggcuuucugucccccggccgcugcagccugaguacguugcucuccccuccgaggaaagccacgugcaccaggagccuucuaaacgcauucccagcugguccggaagacccaucuggauggaaaagauggugaugugucgggucaaagugccucauacguuugccguucacucuuauacccgcccgacaauuugccaauacuguaagagacugcuuaagggccuguuccggcaggggaugcagugcaaagauugcaaguuuaacugucauaaacgcugcgcgagcaaggugcccagagacugucucggagaggucaccuucaauggcgaaccuuccagccugggcacagauaccgacauccccauggauauugacaacaaugauaucaacucugacuccagccgggggcuggacgauacggaggagccuucucccccggaagacaaaauguuuuuccucgauccuuccgaccuggauguggagagagacgaagaggccguuaagacaaucagccccuccaccucuaauaacauuccucuuaugcgcgugguccagagcaucaaacacacaaagcggaaguccucuaccauggugaaagaaggauggaugguccacuacaccagcagagauaaccugcgcaagcggcauuauuggagacucgacuccaaaugccugacacuuuuccaaaaugagagcggcucuaaguacuauaaagagauuccccuguccgaaauccuccgcauuagcucuccucgggauuuuacgaacaucucccaggggagcaauccccacuguuucgagaucauuaccgacacaaugguguacuuuguuggagaaaacaauggcgauucuagccauaacccggugcuggcugccaccggggucggacuggacguggcucaguccugggagaaggccaucagacaagcccucaugccuguuacaccccaggcuagcgugugcaccucucccggccagggcaaggaccacaaagaucuguccacgagcauuuccgucucuaauugucagauccaagaaaacguggacauuagcacaguguaucagaucuucgcggaugagguucuuggguccggacaguuuggcaucgucuacgggggaaagcaucgcaaaaccggccgggacguggccauuaaggugaucgauaaaaugagauucccuaccaagcaggagucucaacugcgcaaugaagucgcuauucuccagaaccugcaccacccggggaucgugaaucuggagugcauguuugaaacacccgagcggguuuucguggucauggagaaacuucauggcgacaugcucgaaaugauucugagcuccgagaagucuagacugccugaacggaucaccaaguuuauggugacacagauucucguugcccugcgcaaccuucacuucaaaaauaucgugcauugugaucugaagcccgagaacguccuccuggccagcgcugaaccuuuuccccaggugaaacugugcgacuucggauuugccagaaucauuggcgagaaguccuuccggagaagcguuguggggacgccugcguaucuugcucccgagguccuccgcucuaagggauacaaucggucccuggauauguggagcgugggcgugaucauuuacgucucucuguccgggaccuucccguuuaacgaagacgaggauaucaacgaccaaauucagaaugccgccuucauguauccucccaacccuuggagagaaaucagcggagaggcuaucgaucucauuaauaaccugcuucagguuaaaaugcgcaagagauacucuguggacaaaucccugagccaccccuggcuccaggacuaucaaacauggcuggaucugcgggaauuugagacccgcaucggcgagagauacauuacacacgaauccgacgaugcccggugggagauccaugcuuauacccacaaucuuguguacccgaagcauuucauuauggccccuaaccccgacgauauggaagaggacccuuga

SEQ ID NO: 8871 - protein, 676 aa, Artificial Sequence
  KPCD__Homo_sapiens__Q05655
MAPFLRIAFNSYELGSLQAEDEANQPFCAVKMKEALSTERGKTLVQKKPTMYPEWKSTFDAHIYEGRVIQIVLMRAAEEPVSEVTVGVSVLAERCKKNNGKAEFWLDLQPQAKVLMSVQYFLEDVDCKQSMRSEDEAKFPTMNRRGAIKQAKIHYIKNHEFIATFFGQPTFCSVCKDFVWGLNKQGYKCRQCNAAIHKKCIDKIIGRCTGTAANSRDTIFQKERFNIDMPHRFKVHNYMSPTFCDHCGSLLWGLVKQGLKCEDCGMNVHHKCREKVANLCGINQKLLAEALNQVTQRASRRSDSASSEPVGIYQGFEKKTGVAGEDMQDNSGTYGKIWEGSSKCNINNFIFHKVLGKGSFGKVLLGELKGRGEYFAIKALKKDVVLIDDDVECTMVEKRVLTLAAENPFLTHLICTFQTKDHLFFVMEFLNGGDLMYHIQDKGRFELYRATFYAAEIMCGLQFLHSKGIIYRDLKLDNVLLDRDGHIKIADFGMCKENIFGESRASTFCGTPDYIAPEILQGLKYTFSVDWWSFGVLLYEMLIGQSPFHGDDEDELFESIRVDTPHYPRWITKESKDILEKLFEREPTKRLGVTGNIKIHPFFKTINWTLLEKRRLEPPFRPKVKSPRDYSNFDQEFLNEKARLSYSDKNLIDSMDQSAFAGFSFVNPKFEHLLED

SEQ ID NO: 8872 - RNA, 2031 nt, Artificial Sequence
  KPCD__Homo_sapiens__AAA03175
auggcgccguuccugcgcaucgccuucaacuccuaugagcugggcucccugcaggccgaggacgaggcgaaccagcccuucugugccgugaagaugaaggaggcgcucagcacagagcgugggaaaacacuggugcagaagaagccgaccauguauccugaguggaagucgacguucgaugcccacaucuaugaggggcgcgucauccagauugugcuaaugcgggcagcagaggagccagugucugaggugaccgugggugugucggugcuggccgagcgcugcaagaagaacaauggcaaggcugaguucuggcuggaccugcagccucaggccaagguguugaugucuguucaguauuuccuggaggacguggauugcaaacagucuaugcgcagugaggacgaggccaaguucccaacgaugaaccgccgcggagccaucaaacaggccaaaauccacuacaucaagaaccaugaguuuaucgccaccuucuuugggcaacccaccuucuguucugugugcaaagacuuugucuggggccucaacaagcaaggcuacaaaugcaggcaauguaacgcugccauccacaagaaaugcaucgacaagaucaucggcagaugcacuggcaccgcggccaacagccgggacacuauauuccagaaagaacgcuucaacaucgacaugccgcaccgcuucaagguucacaacuacaugagccccaccuucugugaccacugcggcagccugcucuggggacuggugaagcagggauuaaagugugaagacugcggcaugaaugugcaccauaaaugccgggagaagguggccaaccucugcggcaucaaccagaagcuuuuggcugaggccuugaaccaagucacccagagagccucccggagaucagacucagccuccucagagccuguugggauauaucaggguuucgagaagaagaccggaguugcuggggaggacaugcaagacaacagugggaccuacggcaagaucugggagggcagcagcaagugcaacaucaacaacuucaucuuccacaagguccugggcaaaggcagcuucgggaaggugcugcuuggagagcugaagggcagaggagaguacuuugccaucaaggcccucaagaaggaugugguccugaucgacgacgacguggagugcaccaugguugagaagcgggugcugacacuugccgcagagaaucccuuucucacccaccucaucugcaccuuccagaccaaggaccaccuguucuuugugauggaguuccucaacgggggggaccugauguaccacauccaggacaaaggccgcuuugaacucuaccgugccacguuuuaugccgcugagauaauguguggacugcaguuucuacacagcaagggcaucauuuacagggaccucaaacuggacaaugugcuguuggaccgggauggccacaucaagauugccgacuuugggaugugcaaagagaacauauucggggagagccgggccagcaccuucugcggcaccccugacuauaucgccccugagauccuacagggccugaaguacacauucucuguggacugguggucuuucgggguccuucuguacgagaugcucauuggccagucccccuuccauggugaugaugaggaugaacucuucgaguccauccguguggacacgccacauuauccccgcuggaucaccaaggaguccaaggacauccuggagaagcucuuugaaagggaaccaaccaagaggcugggagugacgggaaacaucaaaauccaccccuucuucaagaccauaaacuggacucugcuggaaaagcggagguuggagccacccuucaggcccaaagugaagucacccagagacuacaguaacuuugaccaggaguuccugaacgagaaggcgcgccucuccuacagcgacaagaaccucaucgacuccauggaccagucugcauucgcuggcuucuccuuugugaaccccaaauucgagcaccuccuggaagauuga

SEQ ID NO: 8873 - RNA, 2031 nt, Artificial Sequence
  derived and/or modified sequence opt1 from KPCD__Homo_sapiens__AAA03175
auggcccccuuccugcgcaucgccuucaacagcuacgagcucggcucccugcaggcggaggacgaggccaaccagcccuucugcgccgugaagaugaaggaggcccugagcaccgagcgggggaagacccucguccagaagaagcccacgauguaccccgaguggaaguccaccuucgacgcccacaucuacgagggccgcgugauccagaucgugcugaugcgggcggccgaggagcccgucagcgaggugaccgugggggucuccgugcuggccgagcgcugcaagaagaacaacggcaaggccgaguucuggcucgaccugcagccgcaggcgaaggugcugaugagcguccaguacuuccucgaggacguggacugcaagcaguccaugcggagcgaggacgaggccaaguuccccaccaugaaccgccgcggggccaucaagcaggccaagauccacuacaucaagaaccacgaguucaucgccacguucuucggccagcccaccuucugcuccgugugcaaggacuucgucuggggccugaacaagcagggguacaagugccggcagugcaacgcggccauccacaagaagugcaucgacaagaucaucggccggugcaccgggaccgccgccaacagccgcgacacgaucuuccagaaggagcgguucaacaucgacaugccccaccgcuucaaggugcacaacuacauguccccgaccuucugcgaccacugcggcagccugcucugggggcuggugaagcagggccugaagugcgaggacugcggcaugaacguccaccacaagugccgggagaagguggccaaccucugcgggaucaaccagaagcugcuggcggaggcccucaaccaggugacccagcgcgccucccggcgcagcgacuccgccagcuccgagcccgucggcaucuaccagggguucgagaagaagaccggcguggccggcgaggacaugcaggacaacagcgggacguacggcaagaucugggagggguccagcaagugcaacaucaacaacuucaucuuccacaaggugcugggcaaggggagcuucggcaagguccugcucggcgagcugaaggggcggggcgaguacuucgcgaucaaggcccugaagaaggacguggugcucaucgacgacgacgucgagugcaccaugguggagaagcgcguccugacccuggccgccgagaaccccuuccucacccaccugaucugcacguuccagaccaaggaccaccuguucuucgugauggaguuccucaacgggggcgaccugauguaccacauccaggacaaggggcgguucgagcuguaccgcgccaccuucuacgcggccgagaucaugugcggccuccaguuccugcacuccaagggcaucaucuaccgggaccugaagcucgacaacgugcugcuggaccgcgacgggcacaucaagaucgccgacuucggcaugugcaaggagaacaucuucggggagagccgcgccuccaccuucugcggcacgcccgacuacaucgcgccggagauccuccaggggcugaaguacaccuucagcgucgacuggugguccuucggcgugcugcucuacgagaugcugaucggccagagccccuuccacggggacgacgaggacgagcuguucgaguccauccggguggacacgccccacuacccccgcuggaucaccaaggagagcaaggacauccucgagaagcuguucgagcgggagccgaccaagcgccugggcgucaccgggaacaucaagauccaccccuucuucaagaccaucaacuggacccuccuggagaagcggcgccuggagccgcccuuccggcccaaggugaaguccccgcgcgacuacagcaacuucgaccaggaguuccugaacgagaaggcccggcucuccuacagcgacaagaaccugaucgacuccauggaccagagcgccuucgccggcuucuccuucgugaaccccaaguucgagcaccuccuggaggacuga

SEQ ID NO: 8874 - RNA, 2031 nt, Artificial Sequence
  derived and/or modified sequence opt2 from KPCD__Homo_sapiens__AAA03175
auggcccccuuccuccgcaucgccuucaacuccuacgagcucggcucccuccaggccgaggacgaggccaaccagcccuucugcgccgucaagaugaaggaggcccucuccaccgagcgcggcaagacccucguccagaagaagcccaccauguaccccgaguggaaguccaccuucgacgcccacaucuacgagggccgcgucauccagaucguccucaugcgcgccgccgaggagcccgucuccgaggucaccgucggcgucuccguccucgccgagcgcugcaagaagaacaacggcaaggccgaguucuggcucgaccuccagccccaggccaagguccucauguccguccaguacuuccucgaggacgucgacugcaagcaguccaugcgcuccgaggacgaggccaaguuccccaccaugaaccgccgcggcgccaucaagcaggccaagauccacuacaucaagaaccacgaguucaucgccaccuucuucggccagcccaccuucugcuccgucugcaaggacuucgucuggggccucaacaagcagggcuacaagugccgccagugcaacgccgccauccacaagaagugcaucgacaagaucaucggccgcugcaccggcaccgccgccaacucccgcgacaccaucuuccagaaggagcgcuucaacaucgacaugccccaccgcuucaagguccacaacuacaugucccccaccuucugcgaccacugcggcucccuccucuggggccucgucaagcagggccucaagugcgaggacugcggcaugaacguccaccacaagugccgcgagaaggucgccaaccucugcggcaucaaccagaagcuccucgccgaggcccucaaccaggucacccagcgcgccucccgccgcuccgacuccgccuccuccgagcccgucggcaucuaccagggcuucgagaagaagaccggcgucgccggcgaggacaugcaggacaacuccggcaccuacggcaagaucugggagggcuccuccaagugcaacaucaacaacuucaucuuccacaagguccucggcaagggcuccuucggcaagguccuccucggcgagcucaagggccgcggcgaguacuucgccaucaaggcccucaagaaggacgucguccucaucgacgacgacgucgagugcaccauggucgagaagcgcguccucacccucgccgccgagaaccccuuccucacccaccucaucugcaccuuccagaccaaggaccaccucuucuucgucauggaguuccucaacggcggcgaccucauguaccacauccaggacaagggccgcuucgagcucuaccgcgccaccuucuacgccgccgagaucaugugcggccuccaguuccuccacuccaagggcaucaucuaccgcgaccucaagcucgacaacguccuccucgaccgcgacggccacaucaagaucgccgacuucggcaugugcaaggagaacaucuucggcgagucccgcgccuccaccuucugcggcacccccgacuacaucgcccccgagauccuccagggccucaaguacaccuucuccgucgacuggugguccuucggcguccuccucuacgagaugcucaucggccagucccccuuccacggcgacgacgaggacgagcucuucgaguccauccgcgucgacaccccccacuacccccgcuggaucaccaaggaguccaaggacauccucgagaagcucuucgagcgcgagcccaccaagcgccucggcgucaccggcaacaucaagauccaccccuucuucaagaccaucaacuggacccuccucgagaagcgccgccucgagccccccuuccgccccaaggucaaguccccccgcgacuacuccaacuucgaccaggaguuccucaacgagaaggcccgccucuccuacuccgacaagaaccucaucgacuccauggaccaguccgccuucgccggcuucuccuucgucaaccccaaguucgagcaccuccucgaggacuga

SEQ ID NO: 8875 - RNA, 2031 nt, Artificial Sequence
  derived and/or modified sequence opt3 from KPCD__Homo_sapiens__AAA03175
auggcccccuuccugagaaucgcuuuuaacagcuacgagcucggcucccuucaggcagaagacgaggccaaucaaccuuucugcgcggugaagaugaaagaagcucugucuaccgagagggggaagacauugguccagaaaaagccaacuauguauccggaauggaaaucaacguuugaugcccacauuuacgagggacggguuauacagaucguguuaaugcgcgcagccgaggaacccguaagugaggugaccgucggugugagcguucuggcugaacgauguaagaagaacaauggcaaagcagaguucuggcuagaccuccagccucaagccaaggugcugauguccguccaguauuuucuugaggauguggacugcaaacagucuaugcguucggaagaugaggcuaaguucccaacaaugaacagaaggggagccauuaaacaggcgaagauccauuacauuaagaaucacgaauuuaucgcaacuuucuuugggcaacccaccuucuguucaguaugcaaagacuuuguuuggggccugaacaagcaggguuauaaaugucggcagugcaaugccgcuauacauaagaaauguaucgauaagauuaucgggcgcugcacaggaaccgccgcaaacagcagagacacuauuuuccagaaagagagguuuaauaucgauaugccucaccgguucaaggugcauaacuacaugaguccaacauucugugaccacugcggcuccuugcucuggggccuggucaagcaagggcugaaaugugaagauugcggaaugaaugugcaccauaagugccgcgagaaaguggcuaaccucugugguauaaaucagaaguuacuggccgaggcgcuuaaccaggucacccaacgagccucuagaaggagcgacuccgcaucaagugaacccguuggcauuuaucagggguuugagaaaaagacgggaguggcuggcgaagauaugcaggacaauagcgguacuuacgggaagaucugggagggaucuuccaaaugcaacauuaacaauuucaucuuucacaagguauugggcaaaggcucauucgggaaggugcugcuaggagaacucaaaggucggggcgaguacuuugccaucaaggcucugaagaaagacgucgugcuuauugaugacgauguugaguguaccaugguggaaaagcguguccugacauuggccgcagagaacccuuuccucacucaucugauaugcaccuuucagacaaaagaccacuuauucuuugugauggaauuucugaaugggggagaucucauguaucacauccaagacaagggccgcuuugagcuuuacagagccaccuucuaugcugcggaaauuauguguggucugcaguuuuugcauagcaaagggaucauauacagggaucuaaagcuggacaacguacuccuggaucgggacggccacauuaagaucgcagauuucggaaugugcaaagagaauaucuucggcgagagucgagccucuacguuuugugggacuccagacuauauugcuccggaaauccuucagggacugaaguacacauucuccguugacugguggagcuuugguguguugcucuaugagaugcugauuggccagucgcccuuccauggggaugacgaagaugaguuauuugagucuauacgcgucgacaccccucacuacccaagauggaucacuaaagaauccaaggauauucuggagaaacuauucgaaagggagcccacaaagcggcucggagugaccggcaacaucaaaauccauccuuucuucaagacgauuaauuggacccugcuugaaaagcgcagauuggagccacccuuuaggccgaaagucaagucaccucgugacuacaguaacuucgaucaagaguuucugaaugaaaaagcccggcucagcuauuccgacaagaaccugauagauucuauggaccagagcgcauucgccgguuuuucauucgugaaucccaaauucgagcaccuucuggaagauuga

SEQ ID NO: 8876 - RNA, 2031 nt, Artificial Sequence
  derived and/or modified sequence opt4 from KPCD__Homo_sapiens__AAA03175
auggcccccuuccugagaaucgccuucaacagcuacgagcugggcagccugcaggccgaggacgaggccaaccagcccuucugcgccgugaagaugaaggaggcccugagcaccgagagaggcaagacccuggugcagaagaagcccaccauguaccccgaguggaagagcaccuucgacgcccacaucuacgagggcagagugauccagaucgugcugaugagagccgccgaggagcccgugagcgaggugaccgugggcgugagcgugcuggccgagagaugcaagaagaacaacggcaaggccgaguucuggcuggaccugcagccccaggccaaggugcugaugagcgugcaguacuuccuggaggacguggacugcaagcagagcaugagaagcgaggacgaggccaaguuccccaccaugaacagaagaggcgccaucaagcaggccaagauccacuacaucaagaaccacgaguucaucgccaccuucuucggccagcccaccuucugcagcgugugcaaggacuucguguggggccugaacaagcagggcuacaagugcagacagugcaacgccgccauccacaagaagugcaucgacaagaucaucggcagaugcaccggcaccgccgccaacagcagagacaccaucuuccagaaggagagauucaacaucgacaugccccacagauucaaggugcacaacuacaugagccccaccuucugcgaccacugcggcagccugcuguggggccuggugaagcagggccugaagugcgaggacugcggcaugaacgugcaccacaagugcagagagaagguggccaaccugugcggcaucaaccagaagcugcuggccgaggcccugaaccaggugacccagagagccagcagaagaagcgacagcgccagcagcgagcccgugggcaucuaccagggcuucgagaagaagaccggcguggccggcgaggacaugcaggacaacagcggcaccuacggcaagaucugggagggcagcagcaagugcaacaucaacaacuucaucuuccacaaggugcugggcaagggcagcuucggcaaggugcugcugggcgagcugaagggcagaggcgaguacuucgccaucaaggcccugaagaaggacguggugcugaucgacgacgacguggagugcaccaugguggagaagagagugcugacccuggccgccgagaaccccuuccugacccaccugaucugcaccuuccagaccaaggaccaccuguucuucgugauggaguuccugaacggcggcgaccugauguaccacauccaggacaagggcagauucgagcuguacagagccaccuucuacgccgccgagaucaugugcggccugcaguuccugcacagcaagggcaucaucuacagagaccugaagcuggacaacgugcugcuggacagagacggccacaucaagaucgccgacuucggcaugugcaaggagaacaucuucggcgagagcagagccagcaccuucugcggcacccccgacuacaucgcccccgagauccugcagggccugaaguacaccuucagcguggacugguggagcuucggcgugcugcuguacgagaugcugaucggccagagccccuuccacggcgacgacgaggacgagcuguucgagagcaucagaguggacaccccccacuaccccagauggaucaccaaggagagcaaggacauccuggagaagcuguucgagagagagcccaccaagagacugggcgugaccggcaacaucaagauccaccccuucuucaagaccaucaacuggacccugcuggagaagagaagacuggagccccccuucagacccaaggugaagagccccagagacuacagcaacuucgaccaggaguuccugaacgagaaggccagacugagcuacagcgacaagaaccugaucgacagcauggaccagagcgccuucgccggcuucagcuucgugaaccccaaguucgagcaccugcuggaggacuga

SEQ ID NO: 8877 - RNA, 2031 nt, Artificial Sequence
  derived and/or modified sequence opt5 from KPCD__Homo_sapiens__AAA03175
auggcccccuuccugagaaucgcuuuuaacagcuacgagcucggcucccugcaggccgaagacgaggcgaaucaaccuuucugcgcugugaagaugaaagaagcccuuucuaccgagcgggggaagacacugguccagaaaaagccgacgauguaucccgaauggaaaagcaccuuugaugcccacauuuacgagggacgcguuauccagauugugcucaugagagcugccgaggaaccuguguccgaggucacagugggcguuucugugcuggcugaacgguguaagaagaacaaugggaaagccgaguucuggcuugaccugcagccccaagcgaagguccucaugagcgugcaguauuuucuggaggauguugacugcaaacaguccaugcgcucugaagaugaggccaaguucccuaccaugaacagacggggagcuaucaaacaggccaagauucacuacaucaagaaucacgaauuuaucgcuacauucuuuggccaacccaccuucuguagcgugugcaaagacuuugucugggggcugaacaagcagggauauaaaugucgccagugcaaugccgcgauucauaagaaauguaucgauaagauuaucggcagaugcacaggcaccgccgcuaacucccgggacacgauuuuccagaaagagcgcuuuaauaucgauaugccucacagauucaaggugcauaacuacaugagcccgaccuucugugaccacugcgggucucuccuguggggacuugugaagcaaggccugaaaugugaagauugcgggaugaauguccaccauaagugccgggagaaaguugccaaccucuguggaauuaaucagaagcugcuugcugaggcccugaaccaggugacacaacgcgccuccagacggagcgacucugcuuccagcgaacccgugggcaucuaucagggguuugagaaaaagaccggagucgcgggcgaagauaugcaggacaauucuggcacauacgggaagaucugggagggauccagcaaaugcaacauuaacaauuucaucuuucacaaggugcucggcaaaggguccuucggaaagguucugcugggcgaacucaaagggcgcggagaguacuuugccauuaaggcucugaagaaagacgugguccuuaucgaugacgauguggaguguaccaugguugaaaagagagugcugacgcucgccgccgagaacccuuuccugacacaucuuauuugcaccuuucagacaaaagaccaccuguucuuugucauggaguuccucaauggcggcgaucugauguaucacauccaagacaaggggcgguuugaacuguacagagcuaccuucuaugccgcggaaaucauguguggacuccaguuucugcauucuaaaggcauuaucuaccgcgaucuuaagcuggacaacgugcuccuggaucgggacgggcacauuaagaucgcugauuucggaaugugcaaagagaauauuuucggcgagagcagagccuccaccuuuugugggacacccgacuauaucgccccugaaauccuucagggccugaaguacacguucagcgucgacugguggucuuuuggagugcuccuguaugagaugcugauuggccagucccccuuccauggggaugacgaagaugagcucuuugagagcauccgcguugacaccccgcacuacccucgguggauuacaaaagaaucuaaggauauccuggagaaacuuuucgaaagagagcccaccaagcgccugggagugacaggcaacauuaaaauccaucccuuuuucaagaccauuaauuggacgcuccuggaaaagcggagacuggagccucccuuucgcccuaaagucaagagcccgcgggacuacuccaacuucgaucaagaguuucuuaaugaaaaagcuagacucucuuauagcgacaagaaccugaucgauuccauggaccagagcgccuucgcuggguuuucuuucgugaaucccaaauucgagcaucugcucgaagauuga

SEQ ID NO: 8878 - protein, 737 aa, Artificial Sequence
  KPCE__Homo_sapiens__Q02156
MVVFNGLLKIKICEAVSLKPTAWSLRHAVGPRPQTFLLDPYIALNVDDSRIGQTATKQKTNSPAWHDEFVTDVCNGRKIELAVFHDAPIGYDDFVANCTIQFEELLQNGSRHFEDWIDLEPEGRVYVIIDLSGSSGEAPKDNEERVFRERMRPRKRQGAVRRRVHQVNGHKFMATYLRQPTYCSHCRDFIWGVIGKQGYQCQVCTCVVHKRCHELIITKCAGLKKQETPDQVGSQRFSVNMPHKFGIHNYKVPTFCDHCGSLLWGLLRQGLQCKVCKMNVHRRCETNVAPNCGVDARGIAKVLADLGVTPDKITNSGQRRKKLIAGAESPQPASGSSPSEEDRSKSAPTSPCDQEIKELENNIRKALSFDNRGEEHRAASSPDGQLMSPGENGEVRQGQAKRLGLDEFNFIKVLGKGSFGKVMLAELKGKDEVYAVKVLKKDVILQDDDVDCTMTEKRILALARKHPYLTQLYCCFQTKDRLFFVMEYVNGGDLMFQIQRSRKFDEPRSRFYAAEVTSALMFLHQHGVIYRDLKLDNILLDAEGHCKLADFGMCKEGILNGVTTTTFCGTPDYIAPEILQELEYGPSVDWWALGVLMYEMMAGQPPFEADNEDDLFESILHDDVLYPVWLSKEAVSILKAFMTKNPHKRLGCVASQNGEDAIKQHPFFKEIDWVLLEQKKIKPPFKPRIKTKRDVNNFDQDFTREEPVLTLVDEAIVKQINQEEFKGFSYFGEDLMP

SEQ ID NO: 8879 - RNA, 2214 nt, Artificial Sequence
  KPCE__Homo_sapiens__AAI09034
augguaguguucaauggccuucuuaagaucaaaaucugcgaggccgugagcuugaagcccacagccuggucgcugcgccaugcggugggaccccggccgcagacuuuccuucucgaccccuacauugcccucaauguggacgacucgcgcaucggccaaacggccaccaagcagaagaccaacagcccggccuggcacgacgaguucgucaccgaugugugcaacggacgcaagaucgagcuggcugucuuucacgaugcccccauaggcuacgacgacuucguggccaacugcaccauccaguuugaggagcugcugcagaacgggagccgccacuucgaggacuggauugaucuggagccagaaggaagaguguaugugaucaucgaucucucagggucgucgggugaagccccuaaagacaaugaagagcguguguucagggaacgcaugcggccgaggaagcggcagggggccgucaggcgcaggguccaucaggucaacggccacaaguucauggccaccuaucuucggcagcccaccuacugcucccauugcagagacuucaucuggggugucauaggaaagcagggauaccagugucaagucugcaccugcgugguccacaagcggugccacgagcucauaaucacaaagugugcuggguuaaagaagcaggagacccccgaccaggugggcucccagcgguucagcgucaacaugccccacaaguucgguauccacaacuacaaggucccuaccuucugcgaucacugugggucccugcucuggggacucuugcggcaggguuugcaguguaaagucugcaaaaugaauguucaccgucgaugugagaccaacguggcucccaacuguggaguggaugccagaggaaucgccaaaguacuggccgaccugggcguuaccccagacaaaaucaccaacagcggccagagaaggaaaaagcucauugcuggugccgaguccccgcagccugcuucuggaagcucaccaucugaggaagaucgauccaagucagcacccaccuccccuugugaccaggaaauaaaagaacuugagaacaacauucggaaagccuugucauuugacaaccgaggagaggagcaccgggcagcaucgucuccugauggccagcugaugagccccggugagaauggcgaaguccggcaaggccaggccaagcgccugggccuggaugaguucaacuucaucaagguguugggcaaaggcagcuuuggcaaggucauguuggcagaacucaagggcaaagaugaaguauaugcugugaaggucuuaaagaaggacgucauccuucaggaugaugacguggacugcacaaugacagagaagaggauuuuggcucuggcacggaaacacccguaccuuacccaacucuacugcugcuuccagaccaaggaccgccucuuuuucgucauggaauauguaaaugguggagaccucauguuucagauucagcgcucccgaaaauucgacgagccucguucacgguucuaugcugcagaggucacaucggcccucauguuccuccaccagcauggagucaucuacagggauuugaaacuggacaacauccuucuggaugcagaaggucacugcaagcuggcugacuucgggaugugcaaggaagggauucugaauggugugacgaccaccacguucugugggacuccugacuacauagcuccugagauccugcaggaguuggaguauggccccuccguggacuggugggcccugggggugcugauguacgagaugauggcuggacagccucccuuugaggccgacaaugaggacgaccuauuugaguccauccuccaugacgacgugcuguacccagucuggcucagcaaggaggcugucagcaucuugaaagcuuucaugacgaagaauccccacaagcgccugggcuguguggcaucgcagaauggcgaggacgccaucaagcagcacccauucuucaaagagauugacugggugcuccuggagcagaagaagaucaagccacccuucaaaccacgcauuaaaaccaaaagagacgucaauaauuuugaccaagacuuuacccgggaagagccgguacucacccuuguggacgaagcaauuguaaagcagaucaaccaggaggaauucaaagguuucuccuacuuuggugaagaccugaugcccuga

SEQ ID NO: 8880 - RNA, 2214 nt, Artificial Sequence
  derived and/or modified sequence opt1 from KPCE__Homo_sapiens__AAI09034
augguggucuucaacggccugcucaagaucaagaucugcgaggccgugagccugaagcccaccgccuggucccugcgccacgcgguggggccgcggccccagaccuuccuccuggaccccuacaucgcccugaacgucgacgacagccgcaucggccagacggccaccaagcagaagaccaacucccccgccuggcacgacgaguucgugaccgacgugugcaacgggcggaagaucgagcucgccgucuuccacgacgcgccgaucggcuacgacgacuucguggccaacugcacgauccaguucgaggagcugcugcagaacgggagccgccacuucgaggacuggaucgaccucgagcccgagggccggguguacgucaucaucgaccuguccggcagcuccggggaggcccccaaggacaacgaggagcgcguguuccgggagcgcaugcggccccgcaagcggcagggcgccgugcgccggcgcguccaccaggugaacgggcacaaguucauggcgaccuaccugcggcagccgaccuacugcagccacugccgcgacuucaucuggggcgugaucgggaagcagggcuaccagugccaggucugcacgugcguggugcacaagcggugccacgagcucaucaucaccaagugcgccggccugaagaagcaggagacccccgaccaggucgggucccagcgcuucagcgugaacaugccccacaaguucggcauccacaacuacaaggugcccaccuucugcgaccacugcgggucccugcucuggggccugcugcggcagggccuccagugcaaggucugcaagaugaacgugcaccgccggugcgagaccaacguggccccgaacugcggggucgacgcccgcggcaucgccaaggugcuggcggaccugggggucacgcccgacaagaucaccaacagcggccagcgccggaagaagcucaucgccggggccgagagcccccagcccgccuccggcuccagcccguccgaggaggaccgcagcaaguccgcccccaccagccccugcgaccaggagaucaaggagcuggagaacaacauccggaaggcgcugagcuucgacaaccgcggcgaggagcaccgggccgccuccagccccgacgggcagcucauguccccgggcgagaacggggaggugcgccagggccaggccaagcggcuggggcuggacgaguucaacuucaucaaggugcucggcaagggcagcuucgggaaggucaugcuggccgagcugaagggcaaggacgagguguacgcggugaagguccucaagaaggacgugauccugcaggacgacgacguggacugcaccaugacggagaagcgcauccuggcccucgcccggaagcaccccuaccugacccagcuguacugcugcuuccagaccaaggaccgccucuucuucgucauggaguacgugaacgggggcgaccugauguuccagauccagcggucccgcaaguucgacgagccccggagccgcuucuacgccgccgaggugaccuccgcgcugauguuccuccaccagcacggggucaucuaccgggaccugaagcuggacaacauccuccuggacgccgagggccacugcaagcuggccgacuucggcaugugcaaggaggggauccucaacggcgugacgaccaccaccuucugcgggacgcccgacuacaucgccccggagauccugcaggagcuggaguacggccccagcguggacuggugggcgcucggcguccugauguacgagaugauggccgggcagccgcccuucgaggccgacaacgaggacgaccuguucgaguccauccugcacgacgacgugcucuaccccguguggcugagcaaggaggccgucuccauccugaaggccuucaugaccaagaacccccacaagcgccucggcugcguggcgagccagaacggggaggacgccaucaagcagcaccccuucuucaaggagaucgacugggugcugcuggagcagaagaagaucaagccgcccuucaagccccggaucaagaccaagcgcgacgucaacaacuucgaccaggacuucacccgggaggagcccgugcucacgcugguggacgaggccaucgucaagcagaucaaccaggaggaguucaagggcuucuccuacuucggggaggaccugaugccguga

SEQ ID NO: 8881 - RNA, 2214 nt, Artificial Sequence
  derived and/or modified sequence opt2 from KPCE__Homo_sapiens__AAI09034
auggucgucuucaacggccuccucaagaucaagaucugcgaggccgucucccucaagcccaccgccuggucccuccgccacgccgucggcccccgcccccagaccuuccuccucgaccccuacaucgcccucaacgucgacgacucccgcaucggccagaccgccaccaagcagaagaccaacucccccgccuggcacgacgaguucgucaccgacgucugcaacggccgcaagaucgagcucgccgucuuccacgacgcccccaucggcuacgacgacuucgucgccaacugcaccauccaguucgaggagcuccuccagaacggcucccgccacuucgaggacuggaucgaccucgagcccgagggccgcgucuacgucaucaucgaccucuccggcuccuccggcgaggcccccaaggacaacgaggagcgcgucuuccgcgagcgcaugcgcccccgcaagcgccagggcgccguccgccgccgcguccaccaggucaacggccacaaguucauggccaccuaccuccgccagcccaccuacugcucccacugccgcgacuucaucuggggcgucaucggcaagcagggcuaccagugccaggucugcaccugcgucguccacaagcgcugccacgagcucaucaucaccaagugcgccggccucaagaagcaggagacccccgaccaggucggcucccagcgcuucuccgucaacaugccccacaaguucggcauccacaacuacaagguccccaccuucugcgaccacugcggcucccuccucuggggccuccuccgccagggccuccagugcaaggucugcaagaugaacguccaccgccgcugcgagaccaacgucgcccccaacugcggcgucgacgcccgcggcaucgccaagguccucgccgaccucggcgucacccccgacaagaucaccaacuccggccagcgccgcaagaagcucaucgccggcgccgaguccccccagcccgccuccggcuccucccccuccgaggaggaccgcuccaaguccgcccccaccucccccugcgaccaggagaucaaggagcucgagaacaacauccgcaaggcccucuccuucgacaaccgcggcgaggagcaccgcgccgccuccucccccgacggccagcucaugucccccggcgagaacggcgagguccgccagggccaggccaagcgccucggccucgacgaguucaacuucaucaagguccucggcaagggcuccuucggcaaggucaugcucgccgagcucaagggcaaggacgaggucuacgccgucaagguccucaagaaggacgucauccuccaggacgacgacgucgacugcaccaugaccgagaagcgcauccucgcccucgcccgcaagcaccccuaccucacccagcucuacugcugcuuccagaccaaggaccgccucuucuucgucauggaguacgucaacggcggcgaccucauguuccagauccagcgcucccgcaaguucgacgagccccgcucccgcuucuacgccgccgaggucaccuccgcccucauguuccuccaccagcacggcgucaucuaccgcgaccucaagcucgacaacauccuccucgacgccgagggccacugcaagcucgccgacuucggcaugugcaaggagggcauccucaacggcgucaccaccaccaccuucugcggcacccccgacuacaucgcccccgagauccuccaggagcucgaguacggccccuccgucgacuggugggcccucggcguccucauguacgagaugauggccggccagccccccuucgaggccgacaacgaggacgaccucuucgaguccauccuccacgacgacguccucuaccccgucuggcucuccaaggaggccgucuccauccucaaggccuucaugaccaagaacccccacaagcgccucggcugcgucgccucccagaacggcgaggacgccaucaagcagcaccccuucuucaaggagaucgacuggguccuccucgagcagaagaagaucaagccccccuucaagccccgcaucaagaccaagcgcgacgucaacaacuucgaccaggacuucacccgcgaggagcccguccucacccucgucgacgaggccaucgucaagcagaucaaccaggaggaguucaagggcuucuccuacuucggcgaggaccucaugcccuga

SEQ ID NO: 8882 - RNA, 2214 nt, Artificial Sequence
  derived and/or modified sequence opt3 from KPCE__Homo_sapiens__AAI09034
augguggucuucaacggccugcucaagaucaaaauuugcgaggccguuagccuuaagcccaccgcuuggucccugagacacgcaguggggccuaggccacagacauuuuuguuagacccguacauagcccugaauguagaugacucucggaucggacaaacugcgacgaaacagaagaccaacucacccgcuuggcaugaugaguucgugacagacgucuguaauggucgcaaaauugagcuagccguguuucacgaugcaccuaucggcuaugacgauuucguugccaacugcacuauucaguuugaagaacuccugcagaaugggagucgacauuucgaagacuggaucgaucuugagccagagggacguguguacgucauaaucgaccugagcggcuccucuggugaagcucccaaggauaacgaggaaagaguguuuagggagcggaugcgcccuagaaagaggcaaggggcaguacggcgccgaguucaccaggugaauggacauaaauucauggccaccuauuugagacagccaacauacuguucgcacugcagggacuuuauuuggggcgucaucggcaagcagggguaucaaugucaggugugcaccugugugguccacaaacggugccaugagcucauuaucacuaagugugcuggacugaaaaagcaggaaacacccgaucagguugguucacaacguuucagcgugaacaugccucacaaguuuggcauacauaauuacaaaguaccaaccuucugcgaccacugugggagucugcucuggggauuacugcgccagggccuucagugcaaggugugcaaaaugaacguccacagaaggugugagacgaauguggccccgaacugcgguguugacgcgcgggggauugcaaagguguuggccgaucugggagucacucccgacaaaaucaccaauuccggccaacgacgcaagaaacuaauugcuggcgccgaaucuccucagccagcaagcggguccucacccagugaggaagauagaagcaagucugcuccuacauccccaugugaccaggagaucaaggagcucgaaaacaauaucaggaaagcccugucauuugauaaccggggagaggaacaucgcgcggccagcagucccgacggucagcuuaugucuccgggcgagaacggggaagugagacaaggacaggcaaagaggcugggcuuggaugaguucaauuucauuaaaguacucgguaagggguccuuuggcaaaguuaugcuggcugaguuaaagggaaaggacgaaguguaugccgucaaagugcugaagaaagaugucauacuccaggacgaugacguggacugcacuaugaccgagaagcguauccuugcucuggcccggaaacacccuuacuugacacagcuauacuguugcuuccaaaccaaggaucgacuguuuuucguuauggaauaugugaacggcggggaccucauguuucagauucagagaagcaggaaguucgaugagccccgcucgcgguuuuacgcagccgaaguaacgucugcucugauguuccuucaucagcacggagucaucuauagagaccugaaauuggauaauauacuccuggacgcggagggucauuguaaguuagcagauuuuggcaugugcaaagaggggauucugaacggagugacuacaaccacuuucuguggcacaccagacuacaucgccccugaaauccuacaagagcucgaauauggucccuccguugauuggugggcucugggggugcuuauguacgagaugauggccggccagccacccuuugaggcagacaaugaagaugacuuguucgagucaauucugcacgaugacguccucuauccuguguggcugaguaaggaagccguaagcauccuuaaggcuuuuaugaccaaaaacccacacaagaggcugggaugcguggccucccagaauggcgaggacgcaauuaaacagcauccguucuucaaggaaauagauuggguuuugcucgagcagaaaaagaucaaacccccuuuuaagccacgcauuaaaacgaagcgagacgucaacaauuucgaucaagacuuuacccgggaggaacccgugcugacauuaguggaugaggcgaucgucaagcagaucaaccaagaagaguucaaaggguuuucuuacuucggagaagaccugaugccuuga

SEQ ID NO: 8883 - RNA, 2214 nt, Artificial Sequence
  derived and/or modified sequence opt4 from KPCE__Homo_sapiens__AAI09034
auggugguguucaacggccugcugaagaucaagaucugcgaggccgugagccugaagcccaccgccuggagccugagacacgccgugggccccagaccccagaccuuccugcuggaccccuacaucgcccugaacguggacgacagcagaaucggccagaccgccaccaagcagaagaccaacagccccgccuggcacgacgaguucgugaccgacgugugcaacggcagaaagaucgagcuggccguguuccacgacgcccccaucggcuacgacgacuucguggccaacugcaccauccaguucgaggagcugcugcagaacggcagcagacacuucgaggacuggaucgaccuggagcccgagggcagaguguacgugaucaucgaccugagcggcagcagcggcgaggcccccaaggacaacgaggagagaguguucagagagagaaugagacccagaaagagacagggcgccgugagaagaagagugcaccaggugaacggccacaaguucauggccaccuaccugagacagcccaccuacugcagccacugcagagacuucaucuggggcgugaucggcaagcagggcuaccagugccaggugugcaccugcguggugcacaagagaugccacgagcugaucaucaccaagugcgccggccugaagaagcaggagacccccgaccaggugggcagccagagauucagcgugaacaugccccacaaguucggcauccacaacuacaaggugcccaccuucugcgaccacugcggcagccugcuguggggccugcugagacagggccugcagugcaaggugugcaagaugaacgugcacagaagaugcgagaccaacguggcccccaacugcggcguggacgccagaggcaucgccaaggugcuggccgaccugggcgugacccccgacaagaucaccaacagcggccagagaagaaagaagcugaucgccggcgccgagagcccccagcccgccagcggcagcagccccagcgaggaggacagaagcaagagcgcccccaccagccccugcgaccaggagaucaaggagcuggagaacaacaucagaaaggcccugagcuucgacaacagaggcgaggagcacagagccgccagcagccccgacggccagcugaugagccccggcgagaacggcgaggugagacagggccaggccaagagacugggccuggacgaguucaacuucaucaaggugcugggcaagggcagcuucggcaaggugaugcuggccgagcugaagggcaaggacgagguguacgccgugaaggugcugaagaaggacgugauccugcaggacgacgacguggacugcaccaugaccgagaagagaauccuggcccuggccagaaagcaccccuaccugacccagcuguacugcugcuuccagaccaaggacagacuguucuucgugauggaguacgugaacggcggcgaccugauguuccagauccagagaagcagaaaguucgacgagcccagaagcagauucuacgccgccgaggugaccagcgcccugauguuccugcaccagcacggcgugaucuacagagaccugaagcuggacaacauccugcuggacgccgagggccacugcaagcuggccgacuucggcaugugcaaggagggcauccugaacggcgugaccaccaccaccuucugcggcacccccgacuacaucgcccccgagauccugcaggagcuggaguacggccccagcguggacuggugggcccugggcgugcugauguacgagaugauggccggccagccccccuucgaggccgacaacgaggacgaccuguucgagagcauccugcacgacgacgugcuguaccccguguggcugagcaaggaggccgugagcauccugaaggccuucaugaccaagaacccccacaagagacugggcugcguggccagccagaacggcgaggacgccaucaagcagcaccccuucuucaaggagaucgacugggugcugcuggagcagaagaagaucaagccccccuucaagcccagaaucaagaccaagagagacgugaacaacuucgaccaggacuucaccagagaggagcccgugcugacccugguggacgaggccaucgugaagcagaucaaccaggaggaguucaagggcuucagcuacuucggcgaggaccugaugcccuga

SEQ ID NO: 8884 - RNA, 2214 nt, Artificial Sequence
  derived and/or modified sequence opt5 from KPCE__Homo_sapiens__AAI09034
augguggucuucaacggccugcucaagaucaaaauuugcgaggccguuagccugaagcccaccgcuuggucccuuagacacgccguggggccucggccgcagacauuucugcucgaccccuacaucgcgcugaauguggaugacucucgcauuggacaaacggcuaccaaacagaagacaaacagcccugccuggcaugaugaguucgucaccgacguguguaauggcagaaaaaucgagcuugccguuuuucacgaugcucccauuggguaugacgauuucguggccaacugcacaauccaguuugaagaacugcuccagaauggaucccggcauuucgaagacuggaucgaucuggagccugagggccgcgucuacgugauuaucgaccugucugggagcuccggagaagcucccaaggauaacgaggaaagaguuuuucgggagcgcaugagaccucggaagcgccaaggcgccgugagacggcgcguccaccaggugaauggccauaaauucauggcgaccuaucucagacagccgacauacuguucucacugccgggacuuuauuuggggagugaucgggaagcagggcuaucaaugucaggucugcaccuguguugugcacaaacgcugccaugagcugauuaucacgaagugugccgggcuuaaaaagcaggaaacccccgaucaggugggaagccaaagauucuccgucaacaugccucacaaguuuggcauucauaauuacaaagugcccacauucugcgaccacugugggagccugcucuggggacugcuucggcagggccugcagugcaagguuugcaaaaugaacgugcacagacgcugugagaccaaugucgcuccuaacugcggcguggacgcccgggggaucgcuaagguucucgccgaucugggagugacacccgacaaaaucaccaauucuggccaaagacgcaagaaacugauugcgggggccgaauccccgcagccugcuagcggaucuucccccagcgaggaagaucggucuaaguccgccccuacgagccccugugaccaggagaucaaggagcucgaaaacaauauuagaaaagcucuguccuuugauaaccgcggcgaggaacaucgggccgccucuagccccgacgggcagcuuauguccccuggagagaacggcgaagucagacaaggccaggcuaagcgccuggggcucgaugaguucaauuucaucaaagugcugggaaagggcagcuuugggaaagucaugcuugcggagcugaagggaaaggacgaaguguaugccguuaaagugcucaagaaagaugucauucugcaggacgaugacguggacugcacaaugaccgagaagcggauccuggcucucgccagaaaacacccguaccugacacagcuuuacuguugcuuccaaaccaaggaucgccuguuuuucguuauggaauaugugaacggcggggaccucauguuucagauccagcggucuagaaaguucgaugagccccggucccgcuuuuacgccgcugaagucaccagcgcccugauguuccuucaucagcacggcgugauuuauagagaccugaaacucgauaauauccugcuggacgcggagggacauuguaagcucgcugauuuuggcaugugcaaagaggggauucugaacggagugacaacgaccacauucuguggcaccccugacuacaucgcccccgaaauucuucaagagcuggaauaugggccuucuguugauuggugggcccucggaguccugauguacgagaugauggcuggccagcccccguuugaggccgacaaugaagaugaccuguucgagagcauccuucacgaugacgugcucuauccuguguggcuguccaaggaagcugucucuauccugaaagccuuuaugacaaagaacccccacaagcggcucgggugcguggcgagccagaauggcgaggacgccauuaaacagcauccuuucuucaaggaaaucgauuggguucugcuugagcagaaaaagauuaaacccccuuuuaagcccagaaucaaaaccaagcgcgacgugaacaauuucgaucaagacuuuacgcgggaggaaccgguccugacacucguggaugaggcuauuguuaagcagaucaaccaagaagaguucaaaggauuuuccuacuucggcgaagaccugaugccuuga

SEQ ID NO: 8885 - protein, 697 aa, Artificial Sequence
  KPCG__Homo_sapiens__P05129
MAGLGPGVGDSEGGPRPLFCRKGALRQKVVHEVKSHKFTARFFKQPTFCSHCTDFIWGIGKQGLQCQVCSFVVHRRCHEFVTFECPGAGKGPQTDDPRNKHKFRLHSYSSPTFCDHCGSLLYGLVHQGMKCSCCEMNVHRRCVRSVPSLCGVDHTERRGRLQLEIRAPTADEIHVTVGEARNLIPMDPNGLSDPYVKLKLIPDPRNLTKQKTRTVKATLNPVWNETFVFNLKPGDVERRLSVEVWDWDRTSRNDFMGAMSFGVSELLKAPVDGWYKLLNQEEGEYYNVPVADADNCSLLQKFEACNYPLELYERVRMGPSSSPIPSPSPSPTDPKRCFFGASPGRLHISDFSFLMVLGKGSFGKVMLAERRGSDELYAIKILKKDVIVQDDDVDCTLVEKRVLALGGRGPGGRPHFLTQLHSTFQTPDRLYFVMEYVTGGDLMYHIQQLGKFKEPHAAFYAAEIAIGLFFLHNQGIIYRDLKLDNVMLDAEGHIKITDFGMCKENVFPGTTTRTFCGTPDYIAPEIIAYQPYGKSVDWWSFGVLLYEMLAGQPPFDGEDEEELFQAIMEQTVTYPKSLSREAVAICKGFLTKHPGKRLGSGPDGEPTIRAHGFFRWIDWERLERLEIPPPFRPRPCGRSGENFDKFFTRAAPALTPPDRLVLASIDQADFQGFTYVNPDFVHPDARSPTSPVPVPVM

SEQ ID NO: 8886 - RNA, 2094 nt, Artificial Sequence
  KPCG__Homo_sapiens__AAH47876
auggcuggucugggccccggcguaggcgauucagaggggggaccccggccccuguuuugcagaaagggggcccugaggcagaaggugguccacgaagucaagagccacaaguucaccgcucgcuucuucaagcagcccaccuucugcagccacugcaccgacuucaucugggguaucggaaagcagggccugcaaugucaagucugcagcuuugugguucaucgacgaugccacgaauuugugaccuucgaguguccaggcgcugggaagggcccccagacggaugacccccggaacaaacacaaguuccgccugcauagcuacagcagccccaccuucugcgaccacuguggcucccuccucuacgggcuugugcaccagggcaugaaaugcuccugcugcgagaugaacgugcaccggcgcugugugcguagcgugcccucccugugcgguguggaccacaccgagcgccgcgggcgccugcagcuggagauccgggcucccacagcagaugagauccacguaacuguuggcgaggcccguaaccuaauuccuauggaccccaauggucucucugaucccuaugugaaacugaagcucaucccagacccucggaaccugacgaaacagaagacccgaacggugaaagccacgcuaaacccuguguggaaugagaccuuuguguucaaccugaagccaggggauguggagcgccggcucagcguggaggugugggacugggaccggaccucccgcaacgacuucaugggggccauguccuuuggcgucucggagcugcucaaggcgcccguggauggcugguacaaguuacugaaccaggaggagggcgaguauuacaaugugccgguggccgaugcugacaacugcagccuccuccagaaguuugaggcuuguaacuacccccuggaauuguaugagcgggugcggaugggccccucuuccucucccauccccuccccuuccccuagucccaccgaccccaagcgcugcuucuucggggcgaguccaggacgccugcacaucuccgacuucagcuuccucaugguucuaggaaaaggcaguuuugggaaggugaugcuggccgagcgcaggggcucugaugagcucuacgccaucaagaucuugaaaaaggacgugaucguccaggacgacgauguggacugcacgcugguggagaaacgugugcuggcgcuggggggccgggguccuggcggccggccccacuuccucacccagcuccacuccaccuuccagaccccggaccgccuguauuucgugauggaguacgucaccgggggagacuugauguaccacauucaacagcugggcaaguuuaaggagccccaugcagcguucuacgcggcagaaaucgcuaucggccucuucuuccuucacaaucagggcaucaucuacagggaccugaagcuggacaaugugaugcuggaugcugagggacacaucaagaucacugacuuuggcauguguaaggagaacgucuuccccgggacgacaacccgcaccuucugcgggaccccggacuacauagccccggagaucauugccuaccagcccuaugggaagucugucgauuggugguccuuuggaguucugcuguaugagauguuggcaggacagccucccuucgauggggaggacgaggaggagcuguuucaggccaucauggaacaaacugucaccuaccccaagucgcuuucccgggaagccguggccaucugcaagggguuccugaccaagcacccagggaagcgccugggcucagggccugauggggaaccuaccauccgugcacauggcuuuuuccgcuggauugacugggagcggcuggaacgauuggagaucccgccuccuuucagaccccgcccguguggccgcagcggcgagaacuuugacaaguucuucacgcgggcggcgccagcgcugaccccuccagaccgccuaguccuggccagcaucgaccaggccgauuuccagggcuucaccuacgugaaccccgacuucgugcacccggaugcccgcagccccaccagcccagugccugugcccgucauguaa

SEQ ID NO: 8887 - RNA, 2094 nt, Artificial Sequence
  derived and/or modified sequence opt1 from KPCG__Homo_sapiens__AAH47876
auggccggccuggggcccggcgugggggacagcgagggcgggccgcgcccccucuucugccggaagggcgcccugcgccagaaggucgugcacgaggugaagucccacaaguucaccgcgcgguucuucaagcagcccaccuucugcagccacugcacggacuucaucuggggcaucgggaagcagggccugcagugccaggucugcuccuucguggugcaccgccggugccacgaguucgucaccuucgagugccccggggccggcaaggggccgcagaccgacgacccccgcaacaagcacaaguuccggcuccacagcuacuccagccccaccuucugcgaccacugcggcucccugcuguacggccucgugcaccaggggaugaagugcagcugcugcgagaugaacgugcaccgccggugcguccgcuccgugcccagccugugcggcguggaccacacggagcggcgcgggcggcugcagcucgagauccgcgccccgaccgccgacgagauccacgucaccgugggcgaggcccggaaccugauccccauggaccccaacggccuguccgaccccuacgugaagcucaagcugaucccggacccccgcaaccugaccaagcagaagacgcggaccgucaaggcgacccucaaccccguguggaacgagaccuucguguucaaccugaagcccggggacgucgagcgccggcugagcguggaggugugggacugggaccgcacgucccggaacgacuucaugggcgccaugagcuucggggucuccgagcuccugaaggccccgguggacggcugguacaagcugcucaaccaggaggagggggaguacuacaacgugcccgucgccgacgcggacaacugcagccugcugcagaaguucgaggccugcaacuacccccucgagcuguacgagcgcgugcgcaugggccccuccagcuccccgauccccagccccagccccuccccgaccgaccccaagcggugcuucuucggcgccagccccgggcgccugcacaucuccgacuucagcuuccucaugguccugggcaagggguccuucggcaaggugaugcuggccgagcggcgcgggagcgacgagcucuacgccaucaagauccugaagaaggacgugaucguccaggacgacgacguggacugcacccugguggagaagcggguccucgcgcugggcggccgcgggcccggcgggcggccgcacuuccugacccagcuccacuccacguuccagacccccgaccgccuguacuucgugauggaguacgugaccggcggggaccugauguaccacauccagcagcucggcaaguucaaggagccccacgccgccuucuacgccgccgagaucgcgaucggccuguucuuccugcacaaccaggggaucaucuaccgggaccucaagcuggacaacgucaugcuggacgccgagggccacaucaagaucaccgacuucgggaugugcaaggagaacguguucccgggcacgaccacccgcaccuucugcggcacgcccgacuacaucgcccccgagaucaucgccuaccagcccuacggcaagagcguggacuggugguccuucgggguccuccuguacgagaugcuggccgggcagccgcccuucgacggcgaggacgaggaggagcuguuccaggcgaucauggagcagaccgugaccuaccccaagagccucucccgggaggccguggccaucugcaagggguuccugaccaagcaccccggcaagcgccugggcagcgggccggacggcgagcccacgauccgggcccacggguucuuccgcuggaucgacugggagcggcucgagcgccuggagaucccgccgcccuuccggccccgccccugcggccgguccggggagaacuucgacaaguucuucacccgcgccgcgcccgcccugaccccgcccgaccgccucguccuggccagcaucgaccaggccgacuuccagggcuucaccuacgugaaccccgacuucgugcaccccgacgcgcggucccccacgagccccguccccgugcccgugauguga

SEQ ID NO: 8888 - RNA, 2094 nt, Artificial Sequence
  derived and/or modified sequence opt2 from KPCG__Homo_sapiens__AAH47876
auggccggccucggccccggcgucggcgacuccgagggcggcccccgcccccucuucugccgcaagggcgcccuccgccagaaggucguccacgaggucaagucccacaaguucaccgcccgcuucuucaagcagcccaccuucugcucccacugcaccgacuucaucuggggcaucggcaagcagggccuccagugccaggucugcuccuucgucguccaccgccgcugccacgaguucgucaccuucgagugccccggcgccggcaagggcccccagaccgacgacccccgcaacaagcacaaguuccgccuccacuccuacuccucccccaccuucugcgaccacugcggcucccuccucuacggccucguccaccagggcaugaagugcuccugcugcgagaugaacguccaccgccgcugcguccgcuccguccccucccucugcggcgucgaccacaccgagcgccgcggccgccuccagcucgagauccgcgcccccaccgccgacgagauccacgucaccgucggcgaggcccgcaaccucauccccauggaccccaacggccucuccgaccccuacgucaagcucaagcucauccccgacccccgcaaccucaccaagcagaagacccgcaccgucaaggccacccucaaccccgucuggaacgagaccuucgucuucaaccucaagcccggcgacgucgagcgccgccucuccgucgaggucugggacugggaccgcaccucccgcaacgacuucaugggcgccauguccuucggcgucuccgagcuccucaaggcccccgucgacggcugguacaagcuccucaaccaggaggagggcgaguacuacaacguccccgucgccgacgccgacaacugcucccuccuccagaaguucgaggccugcaacuacccccucgagcucuacgagcgcguccgcaugggccccuccuccucccccauccccucccccucccccucccccaccgaccccaagcgcugcuucuucggcgccucccccggccgccuccacaucuccgacuucuccuuccucaugguccucggcaagggcuccuucggcaaggucaugcucgccgagcgccgcggcuccgacgagcucuacgccaucaagauccucaagaaggacgucaucguccaggacgacgacgucgacugcacccucgucgagaagcgcguccucgcccucggcggccgcggccccggcggccgcccccacuuccucacccagcuccacuccaccuuccagacccccgaccgccucuacuucgucauggaguacgucaccggcggcgaccucauguaccacauccagcagcucggcaaguucaaggagccccacgccgccuucuacgccgccgagaucgccaucggccucuucuuccuccacaaccagggcaucaucuaccgcgaccucaagcucgacaacgucaugcucgacgccgagggccacaucaagaucaccgacuucggcaugugcaaggagaacgucuuccccggcaccaccacccgcaccuucugcggcacccccgacuacaucgcccccgagaucaucgccuaccagcccuacggcaaguccgucgacuggugguccuucggcguccuccucuacgagaugcucgccggccagccccccuucgacggcgaggacgaggaggagcucuuccaggccaucauggagcagaccgucaccuaccccaagucccucucccgcgaggccgucgccaucugcaagggcuuccucaccaagcaccccggcaagcgccucggcuccggccccgacggcgagcccaccauccgcgcccacggcuucuuccgcuggaucgacugggagcgccucgagcgccucgagauccccccccccuuccgcccccgccccugcggccgcuccggcgagaacuucgacaaguucuucacccgcgccgcccccgcccucaccccccccgaccgccucguccucgccuccaucgaccaggccgacuuccagggcuucaccuacgucaaccccgacuucguccaccccgacgcccgcucccccaccucccccguccccguccccgucauguga

SEQ ID NO: 8889 - RNA, 2094 nt, Artificial Sequence
  derived and/or modified sequence opt3 from KPCG__Homo_sapiens__AAH47876
auggccggccuggggcccggagugggugacagcgagggcgggccuagaccacucuucugcaggaagggagcucuacggcagaaagucguucacgaagugaagucccauaaauuuacugcacgcuucuuuaagcaaccgacauucuguucucacugcacugauuuuaucuggggcauugguaaacaggggcugcagugucagguaugcucauucgugguccaucgacguugucacgaguuugugacguucgaaugccccggagccggcaagggcccucaaaccgacgauccaagaaacaagcauaaauuuagguugcacaguuacagcucccccacauucugugaccacugcgggucuuuacuguauggacuuguucaucaggguaugaaguguucgugcugugagaugaaugugcaccggcgcugcgucagaucagugccuagccucugcggcguagaucauacugaaaggcgggggcgccugcagcuugagauacgagcgccaaccgcugacgagauccacguuacagugggagaagccagaaaccugauucccauggauccuaauggcuugagugacccauacgucaaacucaagcugaucccggaucccaggaaccugaccaaacagaagacucggacagugaaggcaacccucaauccuguguggaacgagacguuugucuucaauuuaaaaccaggugacguugaacgucgccuguccguggagguaugggauugggacagaacuucuaggaacgauuuuaugggggccaugagcuucggaguguccgagcuuuugaaggcucccgucgacggcugguauaaacugcuaaaucaagaagagggcgaauacuauaacgugccuguugcagacgccgauaauuguucacuccugcagaaguucgaggcuugcaacuacccacuugaacuguaugagcgggugcgaauggggcccaguagcucuccgauuccuucccccucaccaagcccuaccgaccccaaacgcugcuuuuucggagccaguccagguagauugcacaucucugauuuuuccuuccucaugguccugggcaaggggagcuuuggaaaagugauguuagcggagaggcggggcucggacgaacuguacgcaauaaagauccucaagaaagauguaauuguucaggacgaugacguggauuguacacuugucgagaagcgcgugcuggccuugggugggagaggccccggaggcaggccucauuuccuaacucagcugcacucuaccuuucaaacaccagaccgucucuacuucgucauggaauaugugaccgggggagaucugauguaccauauccagcagcuugguaaauuuaaggagccgcacgcugccuucuaugcagcugaaauugccaucggccuguuuuucuugcauaaucaagggauaauuuaccgggaccucaaacuggacaacguuauguuagaugcggagggacacaucaagauuacggacuuuggcauguguaaggagaauguguuccccgguacuacaacccgaacuuucugcgggacaccugauuauaucgccccagaaaucauugcauaccagcccuauggcaaauccguagacugguggucauuuggaguccugcuauacgagaugcucgcuggccagccuccauucgauggggaagacgaggaggaacuguuucaggccauaauggagcaaaccgugacguaccccaagagucuuagcagagaagcuguugccaucuguaaaggauucuugaccaagcacccggguaaaaggcugggcuccgggccugauggagagccaacaauucgcgcacauggcuuuuuccgguggaucgacugggaaagacucgagaggcuggagauacccccucccuuucgcccacgaccuugcggucggucuggggaaaacuucgauaaguuuuucacucgugccgcucccgcgcuuaccccaccggacagacugguguuggcaagcauugaucaggccgacuuucagggcuucacauaugucaacccugauuuugugcaccccgacgcuaggucaccaaccagucccguaccugugccaguuauguga

SEQ ID NO: 8890 - RNA, 2094 nt, Artificial Sequence
  derived and/or modified sequence opt4 from KPCG__Homo_sapiens__AAH47876
auggccggccugggccccggcgugggcgacagcgagggcggccccagaccccuguucugcagaaagggcgcccugagacagaagguggugcacgaggugaagagccacaaguucaccgccagauucuucaagcagcccaccuucugcagccacugcaccgacuucaucuggggcaucggcaagcagggccugcagugccaggugugcagcuucguggugcacagaagaugccacgaguucgugaccuucgagugccccggcgccggcaagggcccccagaccgacgaccccagaaacaagcacaaguucagacugcacagcuacagcagccccaccuucugcgaccacugcggcagccugcuguacggccuggugcaccagggcaugaagugcagcugcugcgagaugaacgugcacagaagaugcgugagaagcgugcccagccugugcggcguggaccacaccgagagaagaggcagacugcagcuggagaucagagcccccaccgccgacgagauccacgugaccgugggcgaggccagaaaccugauccccauggaccccaacggccugagcgaccccuacgugaagcugaagcugauccccgaccccagaaaccugaccaagcagaagaccagaaccgugaaggccacccugaaccccguguggaacgagaccuucguguucaaccugaagcccggcgacguggagagaagacugagcguggaggugugggacugggacagaaccagcagaaacgacuucaugggcgccaugagcuucggcgugagcgagcugcugaaggcccccguggacggcugguacaagcugcugaaccaggaggagggcgaguacuacaacgugcccguggccgacgccgacaacugcagccugcugcagaaguucgaggccugcaacuacccccuggagcuguacgagagagugagaaugggccccagcagcagccccauccccagccccagccccagccccaccgaccccaagagaugcuucuucggcgccagccccggcagacugcacaucagcgacuucagcuuccugauggugcugggcaagggcagcuucggcaaggugaugcuggccgagagaagaggcagcgacgagcuguacgccaucaagauccugaagaaggacgugaucgugcaggacgacgacguggacugcacccugguggagaagagagugcuggcccugggcggcagaggccccggcggcagaccccacuuccugacccagcugcacagcaccuuccagacccccgacagacuguacuucgugauggaguacgugaccggcggcgaccugauguaccacauccagcagcugggcaaguucaaggagccccacgccgccuucuacgccgccgagaucgccaucggccuguucuuccugcacaaccagggcaucaucuacagagaccugaagcuggacaacgugaugcuggacgccgagggccacaucaagaucaccgacuucggcaugugcaaggagaacguguuccccggcaccaccaccagaaccuucugcggcacccccgacuacaucgcccccgagaucaucgccuaccagcccuacggcaagagcguggacugguggagcuucggcgugcugcuguacgagaugcuggccggccagccccccuucgacggcgaggacgaggaggagcuguuccaggccaucauggagcagaccgugaccuaccccaagagccugagcagagaggccguggccaucugcaagggcuuccugaccaagcaccccggcaagagacugggcagcggccccgacggcgagcccaccaucagagcccacggcuucuucagauggaucgacugggagagacuggagagacuggagauccccccccccuucagacccagacccugcggcagaagcggcgagaacuucgacaaguucuucaccagagccgcccccgcccugaccccccccgacagacuggugcuggccagcaucgaccaggccgacuuccagggcuucaccuacgugaaccccgacuucgugcaccccgacgccagaagccccaccagccccgugcccgugcccgugauguga

SEQ ID NO: 8891 - RNA, 2094 nt, Artificial Sequence
  derived and/or modified sequence opt5 from KPCG__Homo_sapiens__AAH47876
auggccggccuggggcccggagugggcgacagcgaagggggaccuagaccgcuuuucugccggaagggcgcucugcgccagaaagucguucacgaagugaagucccauaaauuuaccgccagauucuuuaagcaacccacauucuguucucacugcacggauuuuaucugggggauuggaaaacagggccuucagugucaggugugcagcuucgucgugcaucggcgcugucacgaguuuguuaccuucgaaugcccuggcgcggggaagggaccccaaacagacgauccuagaaacaagcauaaauuucggcugcacuccuacucuagccccaccuucugugaccacugcggcucccuccuguaugggcuugugcaucagggaaugaaguguucuugcugugagaugaauguccaccgcagaugcgugcggagcguuccuucccugugcggcguggaucauacagaacgcagagggcggcuccagcuggagauccgcgcuccgaccgccgacgagauucacgucacagugggagaagccagaaaccugauccccauggauccuaauggccucagcgaccccuacgugaaacugaagcucauuccugauccccggaaccugaccaaacagaagacgcgcaccgucaaggcuacacucaauccgguuuggaacgagaccuuuguguucaaucugaaaccuggcgacguggaaagacggcuuucugucgaggugugggauugggacagaacaucccgcaacgauuuuaugggggccaugagcuucggaguuucugagcugcucaaggcucccguggacggcugguauaaacugcugaaucaagaagagggggaauacuauaacgucccuguggccgacgcggauaauuguucccuccugcagaaguucgaggccugcaacuacccccuugaacuguaugagcggguuagaaugggacccucuagcuccccuaucccgagccccuccccuucucccaccgacccuaaacgcugcuuuuucggcgcuagccccgggcggcuccacaucuccgauuuuagcuuccugauggugcuuggaaagggcucuuuuggcaaagucaugcuggccgagagacgcggguccgacgaacucuacgcuauuaagauccugaagaaagaugugauuguccaggacgaugacguggauuguacgcugguugagaagcgggugcucgcccugggaggcagagggccgggaggccgcccucauuuccuuacacagcugcacagcaccuuucaaacacccgaccggcucuacuucgucauggaauaugugaccgggggcgaucugauguaccauauccagcagcuuggaaaauuuaaggagccucacgcggccuucuaugcugccgaaauugcuaucggccuguuuuuccuccauaaucaagggauuaucuacagagaccugaaacuggacaacguuaugcucgaugccgagggacacaucaagauuaccgacuuuggcauguguaaggagaauguguuccccgggacaacgacccgcacauucugcggaaccccugauuauaucgcccccgaaauuaucgcuuaccagccguauggcaaaucugucgacugguggagcuuuggggugcugcuuuacgagaugcuggcgggccagccucccuucgauggagaagacgaggaggagcucuuucaggccauuauggagcaaacagugaccuaccccaagucccugucucgggaagcuguugccaucuguaaaggcuuccugacgaagcacccugggaaaagacuuggaagcggcccggauggggagcccacaauccgggcccauggauuuuuccgcuggauugacugggaaagacucgagcggcuggagaucccucccccuuuuagaccccgcccuugcggccgguccggggaaaacuucgauaaguuuuucaccagagcugcccccgcgcugaccccgccugaccgccucguccuggcuagcauugaucaggccgacuuucagggcuucacauaugugaaccccgauuuugugcacccugacgccagaucucccaccuccccggucccugugcccguuauguga

SEQ ID NO: 8892 - protein, 596 aa, Artificial Sequence
  KPCI__Homo_sapiens__P41743
MPTQRDSSTMSHTVAGGGSGDHSHQVRVKAYYRGDIMITHFEPSISFEGLCNEVRDMCSFDNEQLFTMKWIDEEGDPCTVSSQLELEEAFRLYELNKDSELLIHVFPCVPERPGMPCPGEDKSIYRRGARRWRKLYCANGHTFQAKRFNRRAHCAICTDRIWGLGRQGYKCINCKLLVHKKCHKLVTIECGRHSLPQEPVMPMDQSSMHSDHAQTVIPYNPSSHESLDQVGEEKEAMNTRESGKASSSLGLQDFDLLRVIGRGSYAKVLLVRLKKTDRIYAMKVVKKELVNDDEDIDWVQTEKHVFEQASNHPFLVGLHSCFQTESRLFFVIEYVNGGDLMFHMQRQRKLPEEHARFYSAEISLALNYLHERGIIYRDLKLDNVLLDSEGHIKLTDYGMCKEGLRPGDTTSTFCGTPNYIAPEILRGEDYGFSVDWWALGVLMFEMMAGRSPFDIVGSSDNPDQNTEDYLFQVILEKQIRIPRSLSVKAASVLKSFLNKDPKERLGCHPQTGFADIQGHPFFRNVDWDMMEQKQVVPPFKPNISGEFGLDNFDSQFTNEPVQLTPDDDDIVRKIDQSEFEGFEYINPLLMSAEECV

SEQ ID NO: 8893 - RNA, 1791 nt, Artificial Sequence
  KPCI__Homo_sapiens__EAW78513
augccgacccagagggacagcagcaccaugucccacacggucgcaggcggcggcagcggggaccauucccaccagguccgggugaaagccuacuaccgcggggauaucaugauaacacauuuugaaccuuccaucuccuuugagggccuuugcaaugagguucgagacauguguucuuuugacaacgaacagcucuucaccaugaaauggauagaugaggaaggagacccguguacaguaucaucucaguuggaguuagaagaagccuuuagacuuuaugagcuaaacaaggauucugaacucuugauucauguguucccuuguguaccagaacguccugggaugccuuguccaggagaagauaaauccaucuaccguagaggugcacgccgcuggagaaagcuuuauugugccaauggccacacuuuccaagccaagcguuucaacaggcgugcucacugugccaucugcacagaccgaauauggggacuuggacgccaaggauauaagugcaucaacugcaaacucuugguucauaagaagugccauaaacucgucacaauugaaugugggcggcauucuuugccacaggaaccagugaugcccauggaucagucauccaugcauucugaccaugcacagacaguaauuccauauaauccuucaagucaugagaguuuggaucaaguuggugaagaaaaagaggcaaugaacaccagggaaaguggcaaagcuucauccagucuaggucuucaggauuuugauuugcuccggguaauaggaagaggaaguuaugccaaaguacuguugguucgauuaaaaaaaacagaucguauuuaugcaaugaaaguugugaaaaaagagcuuguuaaugaugaugaggauauugauuggguacagacagagaagcauguguuugagcaggcauccaaucauccuuuccuuguugggcugcauucuugcuuucagacagaaagcagauuguucuuuguuauagaguauguaaauggaggagaccuaauguuucauaugcagcgacaaagaaaacuuccugaagaacaugccagauuuuacucugcagaaaucagucuagcauuaaauuaucuucaugagcgagggauaauuuauagagauuugaaacuggacaauguauuacuggacucugaaggccacauuaaacucacugacuacggcauguguaaggaaggauuacggccaggagauacaaccagcacuuucugugguacuccuaauuacauugcuccugaaauuuuaagaggagaagauuaugguuucaguguugacuggugggcucuuggagugcucauguuugagaugauggcaggaaggucuccauuugauauuguugggagcuccgauaacccugaccagaacacagaggauuaucucuuccaaguuauuuuggaaaaacaaauucgcauaccacguucucugucuguaaaagcugcaaguguucugaagaguuuucuuaauaaggacccuaaggaacgauuggguugucauccucaaacaggauuugcugauauucagggacacccguucuuccgaaauguugauugggauaugauggagcaaaaacaggugguaccucccuuuaaaccaaauauuucuggggaauuugguuuggacaacuuugauucucaguuuacuaaugaaccuguccagcucacuccagaugacgaugacauugugaggaagauugaucagucugaauuugaagguuuugaguauaucaauccucuuuugaugucugcagaagaaugugucuga

SEQ ID NO: 8894 - RNA, 1791 nt, Artificial Sequence
  derived and/or modified sequence opt1 from KPCI__Homo_sapiens__EAW78513
augcccacccagcgcgacagcuccaccaugagccacacgguggccggcgggggcuccggggaccacagccaccagguccgggugaaggccuacuaccgcggcgacaucaugaucacccacuucgagccguccaucagcuucgaggggcugugcaacgaggugcgggacaugugcuccuucgacaacgagcagcuguucaccaugaaguggaucgacgaggagggcgaccccugcaccgucagcucccagcucgagcuggaggaggcguuccgccucuacgagcugaacaaggacagcgagcugcucauccacguguuccccugcgugcccgagcggccgggcaugcccugccccggggaggacaaguccaucuaccgccggggcgcccgccgguggcgcaagcuguacugcgccaacgggcacacguuccaggccaagcgguucaaccgccgggcccacugcgcgaucugcaccgaccgcaucuggggccuggggcggcagggcuacaagugcaucaacugcaagcuccugguccacaagaagugccacaagcuggugaccaucgagugcggccgccacagccucccccaggagccggugaugcccauggaccaguccagcaugcacuccgaccacgcccagaccgucauccccuacaaccccagcucccacgagagccuggaccaggugggggaggagaaggaggccaugaacacgcgggaguccggcaaggccagcagcucccuggggcuccaggacuucgaccugcugcgcgugaucggccggggcagcuacgcgaagguccuccuggugcgccugaagaagaccgaccggaucuacgccaugaagguggucaagaaggagcucgugaacgacgacgaggacaucgacugggugcagaccgagaagcacgucuucgagcaggccuccaaccacccguuccugguggggcugcacagcugcuuccagaccgagucccgccucuucuucgugaucgaguacgucaacggcggggaccugauguuccacaugcagcgccagcggaagcugcccgaggagcacgcccgcuucuacagcgccgagaucucccucgcgcugaacuaccugcacgagcggggcaucaucuaccgcgaccucaagcuggacaacgugcugcucgacagcgaggggcacaucaagcugacggacuacggcaugugcaaggagggccugcggcccggggacaccaccuccaccuucugcggcacgcccaacuacaucgccccggagauccuccgcggggaggacuacggcuucagcguggacuggugggcccuggggguccugauguucgagaugauggccggccggucccccuucgacaucgugggcagcuccgacaaccccgaccagaacaccgaggacuaccucuuccaggucauccuggagaagcagauccgcaucccccggagccuguccgugaaggccgcgagcgugcucaaguccuuccugaacaaggacccgaaggagcgccuggggugccacccccagaccggcuucgccgacauccaggggcaccccuucuuccggaacgucgacugggacaugauggagcagaagcaggucgugcccccguucaagcccaacaucagcggcgaguucgggcucgacaacuucgacucccaguucaccaacgagcccgugcagcugacgcccgacgacgacgacaucgugcgcaagaucgaccagagcgaguucgagggcuucgaguacaucaacccgcugcucaugagcgccgaggagugcguguga

SEQ ID NO: 8895 - RNA, 1791 nt, Artificial Sequence
  derived and/or modified sequence opt2 from KPCI__Homo_sapiens__EAW78513
augcccacccagcgcgacuccuccaccaugucccacaccgucgccggcggcggcuccggcgaccacucccaccagguccgcgucaaggccuacuaccgcggcgacaucaugaucacccacuucgagcccuccaucuccuucgagggccucugcaacgagguccgcgacaugugcuccuucgacaacgagcagcucuucaccaugaaguggaucgacgaggagggcgaccccugcaccgucuccucccagcucgagcucgaggaggccuuccgccucuacgagcucaacaaggacuccgagcuccucauccacgucuuccccugcguccccgagcgccccggcaugcccugccccggcgaggacaaguccaucuaccgccgcggcgcccgccgcuggcgcaagcucuacugcgccaacggccacaccuuccaggccaagcgcuucaaccgccgcgcccacugcgccaucugcaccgaccgcaucuggggccucggccgccagggcuacaagugcaucaacugcaagcuccucguccacaagaagugccacaagcucgucaccaucgagugcggccgccacucccucccccaggagcccgucaugcccauggaccaguccuccaugcacuccgaccacgcccagaccgucauccccuacaaccccuccucccacgagucccucgaccaggucggcgaggagaaggaggccaugaacacccgcgaguccggcaaggccuccuccucccucggccuccaggacuucgaccuccuccgcgucaucggccgcggcuccuacgccaagguccuccucguccgccucaagaagaccgaccgcaucuacgccaugaaggucgucaagaaggagcucgucaacgacgacgaggacaucgacuggguccagaccgagaagcacgucuucgagcaggccuccaaccaccccuuccucgucggccuccacuccugcuuccagaccgagucccgccucuucuucgucaucgaguacgucaacggcggcgaccucauguuccacaugcagcgccagcgcaagcuccccgaggagcacgcccgcuucuacuccgccgagaucucccucgcccucaacuaccuccacgagcgcggcaucaucuaccgcgaccucaagcucgacaacguccuccucgacuccgagggccacaucaagcucaccgacuacggcaugugcaaggagggccuccgccccggcgacaccaccuccaccuucugcggcacccccaacuacaucgcccccgagauccuccgcggcgaggacuacggcuucuccgucgacuggugggcccucggcguccucauguucgagaugauggccggccgcucccccuucgacaucgucggcuccuccgacaaccccgaccagaacaccgaggacuaccucuuccaggucauccucgagaagcagauccgcaucccccgcucccucuccgucaaggccgccuccguccucaaguccuuccucaacaaggaccccaaggagcgccucggcugccacccccagaccggcuucgccgacauccagggccaccccuucuuccgcaacgucgacugggacaugauggagcagaagcaggucgucccccccuucaagcccaacaucuccggcgaguucggccucgacaacuucgacucccaguucaccaacgagcccguccagcucacccccgacgacgacgacaucguccgcaagaucgaccaguccgaguucgagggcuucgaguacaucaacccccuccucauguccgccgaggagugcgucuga

SEQ ID NO: 8896 - RNA, 1791 nt, Artificial Sequence
  derived and/or modified sequence opt3 from KPCI__Homo_sapiens__EAW78513
augcccacccagagagacagcuccacaaugucucacacuguggccggcgggggaucaggugaucauagucaccaagucaggguuaaggcuuacuaucggggcgacaucaugauuacgcauuucgagccuagcauauccuuugaagggcugugcaacgaggugcgcgauauguguucuuucgacaaugaacagcucuuuaccaugaaauggaucgaugaggaaggagacccaugcacaguaucgucacagcuugagcuggaggaagcauuccgauuguacgaguuaaacaaggauagcgaacugcuaauucacguguuuccguguguccccgagcguccuggcaugccaugccccggugaggacaaaaguaucuauagaaggggagcccggcgcuggagaaagcucuacugugcgaaugggcauacuuuccaggcuaaaagguuuaaccggcgcgcccacugcgcaauuuguaccgaucgaaucuggggccugggcagacaaggguauaagugcauaaauuguaagcuacuggugcacaaaaagugccauaaauugguuacaaucgaauguggaaggcacucccucccucaggagccagugaugcccauggaccagucuagcaugcauuccgaucacgcccagaccgucauuccuuacaacccaucaagucacgaaagccuggaccaagugggugaggaaaaggaggcuaugaauacucgggagucuggcaaagcauccucaagccuggggcuccaggauuucgacuuacugcguguaaucggacgcggcaguuaugccaagguucuuuuggugagacugaagaaaacagacaggauuuacgcuaugaaggucgugaaaaaggaacuugugaacgaugacgaggauaucgacuggguccagaccgaaaaacauguuuuugagcaggccucuaaucacccguuccucgugggucugcauuccugcuuucaaacggaaagccggcuuuucuuuguaauagaguacgugaacgggggagaucugauguuccacaugcagcgacagcgcaaguugcccgaggaacaugcgagauucuauucggcagagauuucucucgcccugaauuacuuacacgaaaggggcaucauuuaucgggaccugaaacucgauaacguccuucuggacuccgagggccacaucaaguugacugauuacgggaugugcaaggaaggacuacgcccuggugacaccacaucaacuuuuuguggcaccccaaauuauaucgcucccgagauucugagaggggaggauuacggauucaguguggacuggugggcccucggcguucugauguuugaaaugauggcagguaggagcccuuucgacauagugggguccucugauaacccagaccaaaauacagaggauuaucuuuuucaggucauccuggaaaaacagauucguaucccccggagcuugucagugaaggcugccaguguacucaaauccuuccugaacaaggacccgaaagagcgauuaggcugccauccucagaccggauuugcggauauacaaggccaccccuucuuuagaaacguugacugggauaugauggagcagaaacagguggucccaccuuucaagcccaauauuagcggggaauuuggacuggacaacuucgauucucaguuuacgaaugagccagugcaacuaacucccgacgaugacgauaucgucaggaagaucgaccagucagaguucgaagguuucgaauacauuaacccucuccugaugagugccgaggaguguguguga

SEQ ID NO: 8897 - RNA, 1791 nt, Artificial Sequence
  derived and/or modified sequence opt4 from KPCI__Homo_sapiens__EAW78513
augcccacccagagagacagcagcaccaugagccacaccguggccggcggcggcagcggcgaccacagccaccaggugagagugaaggccuacuacagaggcgacaucaugaucacccacuucgagcccagcaucagcuucgagggccugugcaacgaggugagagacaugugcagcuucgacaacgagcagcuguucaccaugaaguggaucgacgaggagggcgaccccugcaccgugagcagccagcuggagcuggaggaggccuucagacuguacgagcugaacaaggacagcgagcugcugauccacguguuccccugcgugcccgagagacccggcaugcccugccccggcgaggacaagagcaucuacagaagaggcgccagaagauggagaaagcuguacugcgccaacggccacaccuuccaggccaagagauucaacagaagagcccacugcgccaucugcaccgacagaaucuggggccugggcagacagggcuacaagugcaucaacugcaagcugcuggugcacaagaagugccacaagcuggugaccaucgagugcggcagacacagccugccccaggagcccgugaugcccauggaccagagcagcaugcacagcgaccacgcccagaccgugauccccuacaaccccagcagccacgagagccuggaccaggugggcgaggagaaggaggccaugaacaccagagagagcggcaaggccagcagcagccugggccugcaggacuucgaccugcugagagugaucggcagaggcagcuacgccaaggugcugcuggugagacugaagaagaccgacagaaucuacgccaugaagguggugaagaaggagcuggugaacgacgacgaggacaucgacugggugcagaccgagaagcacguguucgagcaggccagcaaccaccccuuccuggugggccugcacagcugcuuccagaccgagagcagacuguucuucgugaucgaguacgugaacggcggcgaccugauguuccacaugcagagacagagaaagcugcccgaggagcacgccagauucuacagcgccgagaucagccuggcccugaacuaccugcacgagagaggcaucaucuacagagaccugaagcuggacaacgugcugcuggacagcgagggccacaucaagcugaccgacuacggcaugugcaaggagggccugagacccggcgacaccaccagcaccuucugcggcacccccaacuacaucgcccccgagauccugagaggcgaggacuacggcuucagcguggacuggugggcccugggcgugcugauguucgagaugauggccggcagaagccccuucgacaucgugggcagcagcgacaaccccgaccagaacaccgaggacuaccuguuccaggugauccuggagaagcagaucagaauccccagaagccugagcgugaaggccgccagcgugcugaagagcuuccugaacaaggaccccaaggagagacugggcugccacccccagaccggcuucgccgacauccagggccaccccuucuucagaaacguggacugggacaugauggagcagaagcagguggugccccccuucaagcccaacaucagcggcgaguucggccuggacaacuucgacagccaguucaccaacgagcccgugcagcugacccccgacgacgacgacaucgugagaaagaucgaccagagcgaguucgagggcuucgaguacaucaacccccugcugaugagcgccgaggagugcguguga

SEQ ID NO: 8898 - RNA, 1791 nt, Artificial Sequence
  derived and/or modified sequence opt5 from KPCI__Homo_sapiens__EAW78513
augcccacccagagagacagcuccacaaugucucacacgguggccggcgggggaagcggcgaucauucccaccaaguccggguuaaggcuuacuaucgcggggacaucaugauuacccauuucgagccuucuaucagcuuugaaggacugugcaacgaggugagagauauguguuccuucgacaaugaacagcucuuuacaaugaaauggauugaugaggaaggcgacccgugcaccgugucuagccagcuggagcuugaggaagccuuccggcuguacgagcucaacaaggauuccgaacugcuuauccacgucuuucccugugugccugagcgccccgggaugccuugccccggagaggacaaaagcauuuauagacggggcgcgcgcagauggcggaagcuguacugugcuaauggccauacauuccaggccaaacgcuuuaacagacgggcccacugcgcuaucuguaccgaucgcaucugggggcucggaagacaaggcuauaagugcauuaauuguaagcugcugguucacaaaaagugccauaaacucgugacaaucgaaugugggcggcacucucugccucaggagccggucaugcccauggaccaguccagcaugcauucugaucacgcccagaccgugauuccuuacaaccccuccagccacgaaucucuugaccaaguuggagaggaaaaggaggcuaugaauacgcgcgaguccggcaaagccagcuccucucuggggcuccaggauuucgaccugcuuagagugaucggacggggcagcuaugcgaagguccugcucgugagacugaagaaaaccgaccgcauuuacgccaugaagguggucaaaaaggaacugguuaacgaugacgaggauaucgacugggugcagacagaaaaacauguguuugagcaggcuuccaaucacccuuuccucgucggccugcauagcugcuuucaaaccgaaucucggcuuuucuuugugauugaguacguuaacgggggagaucugauguuccacaugcagagacagcgcaagcuccccgaggaacaugcccgguucuauuccgcugagaucagccuggcccuuaauuaccugcacgaaagaggcaucauuuaucgcgaccucaaacuggauaacgugcugcucgacucugaggggcacaucaagcugacagauuacggaaugugcaaggaaggccuucggccgggggacaccacgagcacauuuuguggaaccccuaauuauauugcgcccgagauccugagaggcgaggauuacggcuucuccgucgacuggugggcccucggggugcugauguuugaaaugauggcuggacgcucuccuuucgacauuguuggcagcuccgauaaccccgaccaaaauacagaggauuaucuuuuucaggugauccuggaaaaacagauccggauucccagaagccucucugucaaggccgcuuccgugcugaaaucuuuccugaacaaggacccuaaagagcgccucgggugccauccgcagaccggauuugccgauauccaaggccaccccuucuuucggaacgucgacugggauaugauggagcagaaacaggugguuccucccuucaagccuaauauuagcggggaauuuggccuggacaacuucgauucccaguuuaccaaugagcccgugcaacuuacaccggacgaugacgauaucgucagaaagauugaccagagcgaguucgaaggauucgaauacaucaacccucugcucauguccgccgaggaguguguguga

SEQ ID NO: 8899 - protein, 683 aa, Artificial Sequence
  KPCL__Homo_sapiens__P24723
MSSGTMKFNGYLRVRIGEAVGLQPTRWSLRHSLFKKGHQLLDPYLTVSVDQVRVGQTSTKQKTNKPTYNEEFCANVTDGGHLELAVFHETPLGYDHFVANCTLQFQELLRTTGASDTFEGWVDLEPEGKVFVVITLTGSFTEATLQRDRIFKHFTRKRQRAMRRRVHQINGHKFMATYLRQPTYCSHCREFIWGVFGKQGYQCQVCTCVVHKRCHHLIVTACTCQNNINKVDSKIAEQRFGINIPHKFSIHNYKVPTFCDHCGSLLWGIMRQGLQCKICKMNVHIRCQANVAPNCGVNAVELAKTLAGMGLQPGNISPTSKLVSRSTLRRQGKESSKEGNGIGVNSSNRLGIDNFEFIRVLGKGSFGKVMLARVKETGDLYAVKVLKKDVILQDDDVECTMTEKRILSLARNHPFLTQLFCCFQTPDRLFFVMEFVNGGDLMFHIQKSRRFDEARARFYAAEIISALMFLHDKGIIYRDLKLDNVLLDHEGHCKLADFGMCKEGICNGVTTATFCGTPDYIAPEILQEMLYGPAVDWWAMGVLLYEMLCGHAPFEAENEDDLFEAILNDEVVYPTWLHEDATGILKSFMTKNPTMRLGSLTQGGEHAILRHPFFKEIDWAQLNHRQIEPPFRPRIKSREDVSNFDPDFIKEEPVLTPIDEGHLPMINQDEFRNFSYVSPELQP

SEQ ID NO: 8900 - RNA, 2052 nt, Artificial Sequence
  KPCL__Homo_sapiens__AAH37268
augucgucuggcaccaugaaguucaauggcuauuugaggguccgcaucggugaggcaguggggcugcagcccacccgcuggucccugcgccacucgcucuucaagaagggccaccagcugcuggaccccuaucugacggugagcguggaccaggugcgcgugggccagaccagcaccaagcagaagaccaacaaacccacguacaacgaggaguuuugcgcuaacgucaccgacggcggccaccucgaguuggccgucuuccacgagacgccccugggcuacgaccacuucguggccaacugcacccugcaguuccaggagcugcugcgcacgaccggcgccucggacaccuucgaggguuggguggaucucgagccagaggggaaaguauucgugguaauaacccuuaccgggaguuucacugaagcuacucuccagagagaccggaucuucaaacauuuuaccaggaagcgccaaagggcuaugcgaaggcgaguccaccagaucaauggacacaaguucauggccacguaucugaggcagcccaccuacugcucucacugcagggaguuuaucuggggaguguuugggaaacaggguuaucagugccaagugugcaccugugucguccauaaacgcugccaucaucuaauuguuacagccuguacuugccaaaacaauauuaacaaaguggauucaaagauugcagaacagagguucgggaucaacaucccacacaaguucagcauccacaacuacaaagugccaacauucugcgaucacuguggcucacugcucuggggaauaaugcgacaaggacuucaguguaaaauauguaaaaugaaugugcauauucgaugucaagcgaacguggccccuaacugugggguaaaugcgguggaacuugccaagacccuggcagggaugggucuccaacccggaaauauuucuccaaccucgaaacucguuuccagaucgacccuaagacgacagggaaaggagagcagcaaagaaggaaaugggauugggguuaauucuuccaaccgacuugguaucgacaacuuugaguucauccgaguguuggggaaggggaguuuugggaaggugaugcuugcaagaguaaaagaaacaggagaccucuaugcugugaaggugcugaagaaggacgugauucugcaggaugaugauguggaaugcaccaugaccgagaaaaggauccugucucuggcccgcaaucaccccuuccucacucaguuguucugcugcuuucagacccccgaucgucuguuuuuugugauggaguuugugaaugggggugacuugauguuccacauucagaagucucgucguuuugaugaagcacgagcucgcuucuaugcugcagaaaucauuucggcucucauguuccuccaugauaaaggaaucaucuauagagaucugaaacuggacaauguccuguuggaccacgagggucacuguaaacuggcagacuucggaaugugcaaggaggggauuugcaauggugucaccacggccacauucuguggcacgccagacuauaucgcuccagagauccuccaggaaaugcuguacgggccugcaguagacuggugggcaaugggcguguugcucuaugagaugcucuguggucacgcgccuuuugaggcagagaaugaagaugaccucuuugaggccauacugaaugaugagguggucuacccuaccuggcuccaugaagaugccacagggauccuaaaaucuuucaugaccaagaaccccaccaugcgcuugggcagccugacucagggaggcgagcacgccaucuugagacauccuuuuuuuaaggaaaucgacugggcccagcugaaccaucgccaaauagaaccgccuuucagacccagaaucaaaucccgagaagaugucaguaauuuugacccugacuucauaaaggaagagccaguuuuaacuccaauugaugagggacaucuuccaaugauuaaccaggaugaguuuagaaacuuuuccuaugugucuccagaauugcaaccauag

SEQ ID NO: 8901 - RNA, 2052 nt, Artificial Sequence
  derived and/or modified sequence opt1 from KPCL__Homo_sapiens__AAH37268
augagcuccggcaccaugaaguucaacggguaccugcgcgugcggaucggcgaggccgucgggcuccagcccacccgcuggagccugcggcacucccuguucaagaagggccaccagcuccuggacccguaccugacggugagcguggaccagguccgcguggggcagaccuccaccaagcagaagaccaacaagcccacguacaacgaggaguucugcgccaacgugaccgacggcggccaccucgagcuggcggucuuccacgagacgccccugggguacgaccacuucguggccaacugcacccuccaguuccaggagcugcugcggaccaccggcgccagcgacaccuucgagggguggguggaccucgagcccgagggcaaggucuucguggugaucacccugacgggguccuucaccgaggccacccugcagcgcgaccggaucuucaagcacuucacccgcaagcggcagcgcgccaugcggcgccggguccaccagaucaacggccacaaguucauggcgacguaccuccgccagccgaccuacugcagccacugccgggaguucaucuggggcguguucgggaagcagggcuaccagugccaggugugcacgugcgucgugcacaagcgcugccaccaccugaucgugaccgccugcacgugccagaacaacaucaacaaggucgacuccaagaucgccgagcagcgguucgggaucaacaucccccacaaguucagcauccacaacuacaaggugcccaccuucugcgaccacugcggcucccugcucuggggcaucaugcgccaggggcugcagugcaagaucugcaagaugaacgugcacauccggugccaggccaacgucgcgcccaacugcggcgugaacgccguggagcuggccaagacccucgccgggaugggccugcagccggggaacaucagccccaccuccaagcuggucagccgcuccacccuccggcgccagggcaaggagagcuccaaggagggcaacgggaucggcgugaacagcuccaaccgccuggggaucgacaacuucgaguucauccggguccugggcaaggggagcuucggcaaggugaugcucgcccgcgugaaggagaccggcgaccuguacgcggucaaggugcugaagaaggacgugauccuccaggacgacgacgucgagugcaccaugaccgagaagcggauccugagccuggcccgcaaccaccccuuccucacgcagcuguucugcugcuuccagacccccgaccggcuguucuucgugauggaguucgugaacgggggcgaccucauguuccacauccagaagucccgccgguucgacgaggcccgcgcccgguucuacgccgcggagaucaucagcgcccugauguuccugcacgacaaggggaucaucuaccgcgaccucaagcuggacaacguccugcucgaccacgagggccacugcaagcuggccgacuucgggaugugcaaggagggcaucugcaacggcgugaccaccgccacguucugcgggaccccggacuacaucgcccccgagauccugcaggagaugcucuacggccccgcgguggacuggugggccauggggguccugcuguacgagaugcucugcggccacgcccccuucgaggccgagaacgaggacgaccuguucgaggccauccugaacgacgaggugguguacccgaccuggcugcacgaggacgcgaccggcauccucaaguccuucaugacgaagaaccccaccaugcggcuggggagccugacccagggcggggagcacgccauccuccgccaccccuucuucaaggagaucgacugggcccagcugaaccaccggcagaucgagcccccguuccgcccccggaucaagucccgcgaggacgucagcaacuucgaccccgacuucaucaaggaggagcccgugcugaccccgaucgacgagggccaccuccccaugaucaaccaggacgaguuccggaacuucuccuacgugagccccgagcugcagcccuga

SEQ ID NO: 8902 - RNA, 2052 nt, Artificial Sequence
  derived and/or modified sequence opt2 from KPCL__Homo_sapiens__AAH37268
auguccuccggcaccaugaaguucaacggcuaccuccgcguccgcaucggcgaggccgucggccuccagcccacccgcuggucccuccgccacucccucuucaagaagggccaccagcuccucgaccccuaccucaccgucuccgucgaccagguccgcgucggccagaccuccaccaagcagaagaccaacaagcccaccuacaacgaggaguucugcgccaacgucaccgacggcggccaccucgagcucgccgucuuccacgagaccccccucggcuacgaccacuucgucgccaacugcacccuccaguuccaggagcuccuccgcaccaccggcgccuccgacaccuucgagggcugggucgaccucgagcccgagggcaaggucuucgucgucaucacccucaccggcuccuucaccgaggccacccuccagcgcgaccgcaucuucaagcacuucacccgcaagcgccagcgcgccaugcgccgccgcguccaccagaucaacggccacaaguucauggccaccuaccuccgccagcccaccuacugcucccacugccgcgaguucaucuggggcgucuucggcaagcagggcuaccagugccaggucugcaccugcgucguccacaagcgcugccaccaccucaucgucaccgccugcaccugccagaacaacaucaacaaggucgacuccaagaucgccgagcagcgcuucggcaucaacaucccccacaaguucuccauccacaacuacaagguccccaccuucugcgaccacugcggcucccuccucuggggcaucaugcgccagggccuccagugcaagaucugcaagaugaacguccacauccgcugccaggccaacgucgcccccaacugcggcgucaacgccgucgagcucgccaagacccucgccggcaugggccuccagcccggcaacaucucccccaccuccaagcucgucucccgcuccacccuccgccgccagggcaaggaguccuccaaggagggcaacggcaucggcgucaacuccuccaaccgccucggcaucgacaacuucgaguucauccgcguccucggcaagggcuccuucggcaaggucaugcucgcccgcgucaaggagaccggcgaccucuacgccgucaagguccucaagaaggacgucauccuccaggacgacgacgucgagugcaccaugaccgagaagcgcauccucucccucgcccgcaaccaccccuuccucacccagcucuucugcugcuuccagacccccgaccgccucuucuucgucauggaguucgucaacggcggcgaccucauguuccacauccagaagucccgccgcuucgacgaggcccgcgcccgcuucuacgccgccgagaucaucuccgcccucauguuccuccacgacaagggcaucaucuaccgcgaccucaagcucgacaacguccuccucgaccacgagggccacugcaagcucgccgacuucggcaugugcaaggagggcaucugcaacggcgucaccaccgccaccuucugcggcacccccgacuacaucgcccccgagauccuccaggagaugcucuacggccccgccgucgacuggugggccaugggcguccuccucuacgagaugcucugcggccacgcccccuucgaggccgagaacgaggacgaccucuucgaggccauccucaacgacgaggucgucuaccccaccuggcuccacgaggacgccaccggcauccucaaguccuucaugaccaagaaccccaccaugcgccucggcucccucacccagggcggcgagcacgccauccuccgccaccccuucuucaaggagaucgacugggcccagcucaaccaccgccagaucgagccccccuuccgcccccgcaucaagucccgcgaggacgucuccaacuucgaccccgacuucaucaaggaggagcccguccucacccccaucgacgagggccaccuccccaugaucaaccaggacgaguuccgcaacuucuccuacgucucccccgagcuccagcccuga

SEQ ID NO: 8903 - RNA, 2052 nt, Artificial Sequence
  derived and/or modified sequence opt3 from KPCL__Homo_sapiens__AAH37268
augagcuccggcaccaugaaguucaacggguaccugagagugaggaucggagaggccgucggucuccagcccacacgguggucucuucgccacucacuguuuaaaaagggccaucaauuguuagacccuuaucugacuguuaguguggaucagguacgaguggggcagacgagcaccaaacagaagacaaauaaaccaacuuacaacgaagaguucugcgcuaaugucaccgacggaggccaccuagaacucgcaguguuucaugagacaccgcuggguuaugaucacuucguugccaacuguacccuucaauuucaggaacuguugcguacuacaggggcguccgacaccuucgagggauggguggaucucgagcccgaaggcaaggucuuugugguaauuacgcugacuggcucuuucaccgaggcuacacugcagagagacaggauauuuaagcauuucacucggaaacgccagagagccaugaggcggcgcguucaccaaaucaaugggcacaaguuuauggcaaccuaccuccgacagccuacauauugcucgcauuguagagaguucauuuggggaguguuugguaaacagggcuaccagugccaagucuguaccugcguggugcacaagaggugucaucacuuaaucgucacggccugcacuugucagaacaauauuaacaaaguugauucaaagaucgcugaacagcgguucgggauaaauaucccacacaaguucagcauucauaacuauaaagugcccacauuuugcgaccacuguggaagucugcuuuggggcaucaugcgucaagguuugcagugcaagauuugcaaaaugaauguacauauccgcugucaggcaaacguggccccuaauugcggggucaacgcuguggagcuggccaagacccuagcgggaaugggccuccagccaggcaauauaucccccacuucuaaacugguuagcagauccacacuuaggcggcaagggaaggaaucaaguaaagagggaaacgguauuggcgugaacagcucuaaucgacuggggaucgauaacuucgaauuuauucgcgucuugggaaagggcuccuucgguaaggugaugcucgcaagaguaaaagagaccggggaccuguacgccguuaaggugcugaaaaaggaugucauccugcaggacgaugacguggaauguacgaugaccgagaaaaggauccucucacuugcucggaaucacccuuuucugacacaguuguucugcuguuuucagacuccagaccgccuauucuuugucauggaguucgugaacggcggagaucugauguuucauauucaaaagagcagaagguucgacgaagcccgugcacgguuuuacgcugccgagauaaucagugcgcucauguuccugcacgauaagggcauuaucuaucgagaccuuaaacuggauaauguuuugcucgaccacgaagggcauugcaagcuggccgauuucggaauguguaaagaggguauaugcaacggcgugaccacagcaacuuuuugugggaccccggacuacauugcucccgaaaucuuacaggagaugcuguauggaccugccguagauuggugggcuaugggcguccuacucuacgagaugcugugcggucacgccccauucgaagcagagaaugaagacgaucuuuuugaggccaucuugaacgacgaagugguuuaucccacauggcugcaugaggacgcuaccgggauucucaagucuuucaugacuaaaaauccuacgaugagacugggcucccuuacacagggaggcgagcacgcgauccugaggcacccauuuuucaaggaaauugauugggcacaguugaaccaucgccaaauagagcccccguuucggccuagaaucaagagcagggaagacgugucgaauuucgaucccgacuuuauuaaagaggagccaguccucaccccuaucgaugaagggcacuuacccaugaucaaccaggacgaguuccgcaauuuuucuuacguguccccagaauuacagcccuga

SEQ ID NO: 8904 - RNA, 2052 nt, Artificial Sequence
  derived and/or modified sequence opt4 from KPCL__Homo_sapiens__AAH37268
augagcagcggcaccaugaaguucaacggcuaccugagagugagaaucggcgaggccgugggccugcagcccaccagauggagccugagacacagccuguucaagaagggccaccagcugcuggaccccuaccugaccgugagcguggaccaggugagagugggccagaccagcaccaagcagaagaccaacaagcccaccuacaacgaggaguucugcgccaacgugaccgacggcggccaccuggagcuggccguguuccacgagaccccccugggcuacgaccacuucguggccaacugcacccugcaguuccaggagcugcugagaaccaccggcgccagcgacaccuucgagggcuggguggaccuggagcccgagggcaagguguucguggugaucacccugaccggcagcuucaccgaggccacccugcagagagacagaaucuucaagcacuucaccagaaagagacagagagccaugagaagaagagugcaccagaucaacggccacaaguucauggccaccuaccugagacagcccaccuacugcagccacugcagagaguucaucuggggcguguucggcaagcagggcuaccagugccaggugugcaccugcguggugcacaagagaugccaccaccugaucgugaccgccugcaccugccagaacaacaucaacaagguggacagcaagaucgccgagcagagauucggcaucaacaucccccacaaguucagcauccacaacuacaaggugcccaccuucugcgaccacugcggcagccugcuguggggcaucaugagacagggccugcagugcaagaucugcaagaugaacgugcacaucagaugccaggccaacguggcccccaacugcggcgugaacgccguggagcuggccaagacccuggccggcaugggccugcagcccggcaacaucagccccaccagcaagcuggugagcagaagcacccugagaagacagggcaaggagagcagcaaggagggcaacggcaucggcgugaacagcagcaacagacugggcaucgacaacuucgaguucaucagagugcugggcaagggcagcuucggcaaggugaugcuggccagagugaaggagaccggcgaccuguacgccgugaaggugcugaagaaggacgugauccugcaggacgacgacguggagugcaccaugaccgagaagagaauccugagccuggccagaaaccaccccuuccugacccagcuguucugcugcuuccagacccccgacagacuguucuucgugauggaguucgugaacggcggcgaccugauguuccacauccagaagagcagaagauucgacgaggccagagccagauucuacgccgccgagaucaucagcgcccugauguuccugcacgacaagggcaucaucuacagagaccugaagcuggacaacgugcugcuggaccacgagggccacugcaagcuggccgacuucggcaugugcaaggagggcaucugcaacggcgugaccaccgccaccuucugcggcacccccgacuacaucgcccccgagauccugcaggagaugcuguacggccccgccguggacuggugggccaugggcgugcugcuguacgagaugcugugcggccacgcccccuucgaggccgagaacgaggacgaccuguucgaggccauccugaacgacgaggugguguaccccaccuggcugcacgaggacgccaccggcauccugaagagcuucaugaccaagaaccccaccaugagacugggcagccugacccagggcggcgagcacgccauccugagacaccccuucuucaaggagaucgacugggcccagcugaaccacagacagaucgagccccccuucagacccagaaucaagagcagagaggacgugagcaacuucgaccccgacuucaucaaggaggagcccgugcugacccccaucgacgagggccaccugcccaugaucaaccaggacgaguucagaaacuucagcuacgugagccccgagcugcagcccuga

SEQ ID NO: 8905 - RNA, 2052 nt, Artificial Sequence
  derived and/or modified sequence opt5 from KPCL__Homo_sapiens__AAH37268
augagcuccggcaccaugaaguucaacggguaccugagagugcggaucggagaggccgucggccuccagcccacacgcuggucucugagacacagccuuuuuaaaaaggggcaccaacugcucgacccuuaucugacgguuuccguggaucaggugcgggucggacagaccucuacaaaacagaagaccaauaaaccgacauacaacgaagaguucugcgcuaaugugaccgacggcgggcaccuugaacuggccguuuuucaugagacaccccucggauaugaucacuucguggcgaacuguacccugcaauuucaggaacugcuccgcacgaccggcgcuagcgacacauucgagggcugggucgaucuggagccugaagggaagguguuuguugugauuacccuuacaggauccuucaccgaggccacgcugcagagagaccggaucuuuaagcauuucacacgcaaaagacagcgggccaugcgcagacggguccaccaaauuaauggccacaaguuuauggcuaccuaccuccgccagcccacauauugcucucauuguagagaguucaucuggggaguguuugggaaacagggcuaccagugccaaguguguaccugcgucguucacaagcggugucaucaccugauugugaccgccugcacaugucagaacaauaucaacaaaguggauagcaagaucgcugaacagcgcuucgggauuaauaucccucacaaguucuccauucauaacuauaaaguccccacguuuugcgaccacuguggaagccuucuguggggcaucaugagacaaggccuccagugcaagauuugcaaaaugaaugugcauauccggugucaggccaacguugcgccuaauugcggggugaacgccgucgagcuggcuaagacccuggccggaaugggccuccagccggggaauauuucucccacauccaaacuggugagcagaucuacccuucgccggcaaggaaaggaauccagcaaagagggcaacgggaucggaguuaacucuuccaauagacugggcaucgauaacuucgaauuuauucgcgugcucggcaaggggagcuucggaaaggucaugcuggcucgggugaaagagacaggcgaccuuuacgccgucaaggugcugaaaaaggauguuauccuccaggacgaugacguggaauguaccaugacggagaaacgcauucugucccuggcgagaaaucacccuuuucucacacagcuguucugcuguuuucagacccccgaccggcuuuucuuugucauggaguucgugaacgggggagaucugauguuucauauccaaaagucuagacgcuucgacgaagcccgggcuagauuuuacgccgcugagauuaucagcgcccucauguuccugcacgauaagggcaucauuuaucgcgaccuuaaacuggauaauguucuccuggaccacgaagggcauugcaagcuggccgauuucggcauguguaaagagggaaucugcaacggcgugaccacagcuaccuuuugugggacaccugacuacauugcgcccgaaauccuccaggagaugcuguauggaccggccgucgauuggugggcuaugggcgugcuucuguacgagaugcucugcgggcacgccccuuucgaagccgagaaugaagacgaucuguuugaggcuauucugaacgacgaagugguuuaucccacguggcuucaugaggacgccaccggaauccucaaguccuucaugaccaaaaauccuacaaugcggcugggcagccugacacaagggggcgagcacgcgauccucagacaccccuuuuucaaggaaauugauugggcucagcugaaccaucggcagaucgagcccccuuuucgcccgagaauuaagucucgggaagacgucuccaauuucgaucccgacuuuaucaaagaggagccugugcuuacccccauugaugaaggacaucugccuaugaucaaccaggacgaguucagaaauuuuagcuacgugucucccgaacuccagccguga

SEQ ID NO: 8906 - protein, 706 aa, Artificial Sequence
  KPCT__Homo_sapiens__Q04759
MSPFLRIGLSNFDCGSCQSCQGEAVNPYCAVLVKEYVESENGQMYIQKKPTMYPPWDSTFDAHINKGRVMQIIVKGKNVDLISETTVELYSLAERCRKNNGKTEIWLELKPQGRMLMNARYFLEMSDTKDMNEFETEGFFALHQRRGAIKQAKVHHVKCHEFTATFFPQPTFCSVCHEFVWGLNKQGYQCRQCNAAIHKKCIDKVIAKCTGSAINSRETMFHKERFKIDMPHRFKVYNYKSPTFCEHCGTLLWGLARQGLKCDACGMNVHHRCQTKVANLCGINQKLMAEALAMIESTQQARCLRDTEQIFREGPVEIGLPCSIKNEARPPCLPTPGKREPQGISWESPLDEVDKMCHLPEPELNKERPSLQIKLKIEDFILHKMLGKGSFGKVFLAEFKKTNQFFAIKALKKDVVLMDDDVECTMVEKRVLSLAWEHPFLTHMFCTFQTKENLFFVMEYLNGGDLMYHIQSCHKFDLSRATFYAAEIILGLQFLHSKGIVYRDLKLDNILLDKDGHIKIADFGMCKENMLGDAKTNTFCGTPDYIAPEILLGQKYNHSVDWWSFGVLLYEMLIGQSPFHGQDEEELFHSIRMDNPFYPRWLEKEAKDLLVKLFVREPEKRLGVRGDIRQHPLFREINWEELERKEIDPPFRPKVKSPFDCSNFDKEFLNEKPRLSFADRALINSMDQNMFRNFSFMNPGMERLIS

SEQ ID NO: 8907 - RNA, 2121 nt, Artificial Sequence
  KPCT__Homo_sapiens__AAA60101
augucgccauuucuucggauuggcuuguccaacuuugacugcggguccugccagucuugucagggcgaggcuguuaacccuuacugugcugugcucgucaaagaguaugucgaaucagagaacgggcagauguauauccagaaaaagccuaccauguacccacccugggacagcacuuuugaugcccauaucaacaagggaagagucaugcagaucauugugaaaggcaaaaacguggaccucaucucugaaaccaccguggagcucuacucgcuggcugagaggugcaggaagaacaacgggaagacagaaauaugguuagagcugaaaccucaaggccgaaugcuaaugaaugcaagauacuuucuggaaaugagugacacaaaggacaugaaugaauuugagacggaaggcuucuuugcuuugcaucagcgccggggugccaucaagcaggcaaagguccaccacgucaagugccacgaguucacugccaccuucuucccacagcccacauuuugcucugucugccacgaguuugucuggggccugaacaaacagggcuaccagugccgacaaugcaaugcagcaauucacaagaaguguauugauaaaguuauagcaaagugcacaggaucagcuaucaauagccgagaaaccauguuccacaaggagagauucaaaauugacaugccacacagauuuaaagucuacaauuacaagagcccgaccuucugugaacacugugggacccugcuguggggacuggcacggcaaggacucaagugugaugcauguggcaugaaugugcaucauagaugccagacaaagguggccaaccuuuguggcauaaaccagaagcuaauggcugaagcgcuggccaugauugagagcacucaacaggcucgcugcuuaagagauacugaacagaucuucagagaagguccgguugaaauuggucucccaugcuccaucaaaaaugaagcaaggccgccauguuuaccgacaccgggaaaaagagagccucagggcauuuccugggagucuccguuggaugagguggauaaaaugugccaucuuccagaaccugaacugaacaaagaaagaccaucucugcagauuaaacuaaaaauugaggauuuuaucuugcacaaaauguuggggaaaggaaguuuuggcaaggucuuccuggcagaauucaagaaaaccaaucaauuuuucgcaauaaaggccuuaaagaaagauguggucuugauggacgaugauguugagugcacgaugguagagaagagaguucuuuccuuggccugggagcauccguuucugacgcacauguuuuguacauuccagaccaaggaaaaccucuuuuuugugauggaguaccucaacggaggggacuuaauguaccacauccaaagcugccacaaguucgaccuuuccagagcgacguuuuaugcugcugaaaucauucuuggucugcaguuccuucauuccaaaggaauagucuacagggaccugaagcuagauaacauccuguuagacaaagauggacauaucaagaucgcggauuuuggaaugugcaaggagaacauguuaggagaugccaagacgaauaccuucugugggacaccugacuacaucgccccagagaucuugcugggucagaaauacaaccacucuguggacuggugguccuucgggguucuccuuuaugaaaugcugauuggucagucgccuuuccacgggcaggaugaggaggagcucuuccacuccauccgcauggacaaucccuuuuacccacgguggcuggagaaggaagcaaaggaccuucuggugaagcucuucgugcgagaaccugagaagaggcugggcgugaggggagacauccgccagcacccuuuguuucgggagaucaacugggaggaacuugaacggaaggagauugacccaccguuccggccgaaagugaaaucaccauuugacugcagcaauuucgacaaagaauucuuaaacgagaagccccggcugucauuugccgacagagcacugaucaacagcauggaccagaauauguucaggaacuuuuccuucaugaaccccgggauggagcggcugauauccuga

SEQ ID NO: 8908 - RNA, 2121 nt, Artificial Sequence
  derived and/or modified sequence opt1 from KPCT__Homo_sapiens__AAA60101
augagccccuuccugcgcaucggccucuccaacuucgacugcgggagcugccaguccugccagggcgaggccgugaacccguacugcgccgugcuggugaaggaguacguggagagcgagaacgggcagauguacauccagaagaagcccaccauguacccgcccugggacuccaccuucgacgcgcacaucaacaagggccgggucaugcagaucaucgugaaggggaagaacguggaccugaucagcgagacgaccgucgagcucuacucccuggccgagcgcugccggaagaacaacggcaagaccgagaucuggcuggagcucaagccccagggccgcaugcugaugaacgcccgguacuuccuggagaugagcgacaccaaggacaugaacgaguucgagacggagggguucuucgcccuccaccagcgccggggcgccaucaagcaggcgaaggugcaccacgugaagugccacgaguucaccgccaccuucuucccccagcccaccuucugcuccgucugccacgaguucgugugggggcugaacaagcagggcuaccagugccgccagugcaacgccgccauccacaagaagugcaucgacaaggugaucgcgaagugcacggggagcgccaucaacucccgggagaccauguuccacaaggagcgcuucaagaucgacaugccccaccgguucaaggucuacaacuacaagagcccgaccuucugcgagcacugcggcacccugcucuggggccuggcccgccaggggcugaagugcgacgccugcggcaugaacgugcaccaccggugccagacgaagguggccaaccucugcgggaucaaccagaagcugauggcggaggcccuggccaugaucgaguccacccagcaggcccgcugccuccgggacaccgagcagaucuuccgcgagggccccgucgagaucggccugcccugcagcaucaagaacgaggcccggcccccgugccugcccacccccgggaagcgcgagccccagggcaucuccugggagagcccgcucgacgagguggacaagaugugccaccuccccgagcccgagcugaacaaggagcggcccucccuccagaucaagcugaagaucgaggacuucauccugcacaagaugcucgggaagggcagcuucgggaagguguuccuggcggaguucaagaagacgaaccaguucuucgccaucaaggcccugaagaaggacgucgugcucauggacgacgacguggagugcaccauggucgagaagcgcgugcugucccuggccugggagcacccguuccucacccacauguucugcaccuuccagacgaaggagaaccuguucuucgugauggaguaccugaacggcggcgaccucauguaccacauccagagcugccacaaguucgaccugagccgggccaccuucuacgcggccgagaucauccuggggcuccaguuccugcacuccaagggcaucgucuaccgcgaccugaagcucgacaacauccugcuggacaaggacgggcacaucaagaucgccgacuucggcaugugcaaggagaacaugcucggggacgccaagaccaacaccuucugcggcacgcccgacuacaucgcccccgagauccugcugggccagaaguacaaccacagcguggacuggugguccuucgggguccuccuguacgagaugcugaucggccagagccccuuccacgggcaggacgaggaggagcuguuccacuccauccgcauggacaacccguucuacccccgguggcucgagaaggaggcgaaggaccugcuggugaagcuguucgugcgcgagcccgagaagcggcugggcguccgcggggacauccggcagcacccccuguuccgcgagaucaacugggaggagcucgagcggaaggagaucgacccgcccuuccgccccaaggucaagagcccguucgacugcuccaacuucgacaaggaguuccugaacgagaagccccggcugagcuucgccgaccgcgcccucaucaacuccauggaccagaacauguuccggaacuucagcuucaugaaccccggcauggagcgccugaucuccuga

SEQ ID NO: 8909 - RNA, 2121 nt, Artificial Sequence
  derived and/or modified sequence opt2 from KPCT__Homo_sapiens__AAA60101
augucccccuuccuccgcaucggccucuccaacuucgacugcggcuccugccaguccugccagggcgaggccgucaaccccuacugcgccguccucgucaaggaguacgucgaguccgagaacggccagauguacauccagaagaagcccaccauguacccccccugggacuccaccuucgacgcccacaucaacaagggccgcgucaugcagaucaucgucaagggcaagaacgucgaccucaucuccgagaccaccgucgagcucuacucccucgccgagcgcugccgcaagaacaacggcaagaccgagaucuggcucgagcucaagccccagggccgcaugcucaugaacgcccgcuacuuccucgagauguccgacaccaaggacaugaacgaguucgagaccgagggcuucuucgcccuccaccagcgccgcggcgccaucaagcaggccaagguccaccacgucaagugccacgaguucaccgccaccuucuucccccagcccaccuucugcuccgucugccacgaguucgucuggggccucaacaagcagggcuaccagugccgccagugcaacgccgccauccacaagaagugcaucgacaaggucaucgccaagugcaccggcuccgccaucaacucccgcgagaccauguuccacaaggagcgcuucaagaucgacaugccccaccgcuucaaggucuacaacuacaagucccccaccuucugcgagcacugcggcacccuccucuggggccucgcccgccagggccucaagugcgacgccugcggcaugaacguccaccaccgcugccagaccaaggucgccaaccucugcggcaucaaccagaagcucauggccgaggcccucgccaugaucgaguccacccagcaggcccgcugccuccgcgacaccgagcagaucuuccgcgagggccccgucgagaucggccuccccugcuccaucaagaacgaggcccgcccccccugccuccccacccccggcaagcgcgagccccagggcaucuccugggaguccccccucgacgaggucgacaagaugugccaccuccccgagcccgagcucaacaaggagcgccccucccuccagaucaagcucaagaucgaggacuucauccuccacaagaugcucggcaagggcuccuucggcaaggucuuccucgccgaguucaagaagaccaaccaguucuucgccaucaaggcccucaagaaggacgucguccucauggacgacgacgucgagugcaccauggucgagaagcgcguccucucccucgccugggagcaccccuuccucacccacauguucugcaccuuccagaccaaggagaaccucuucuucgucauggaguaccucaacggcggcgaccucauguaccacauccaguccugccacaaguucgaccucucccgcgccaccuucuacgccgccgagaucauccucggccuccaguuccuccacuccaagggcaucgucuaccgcgaccucaagcucgacaacauccuccucgacaaggacggccacaucaagaucgccgacuucggcaugugcaaggagaacaugcucggcgacgccaagaccaacaccuucugcggcacccccgacuacaucgcccccgagauccuccucggccagaaguacaaccacuccgucgacuggugguccuucggcguccuccucuacgagaugcucaucggccagucccccuuccacggccaggacgaggaggagcucuuccacuccauccgcauggacaaccccuucuacccccgcuggcucgagaaggaggccaaggaccuccucgucaagcucuucguccgcgagcccgagaagcgccucggcguccgcggcgacauccgccagcacccccucuuccgcgagaucaacugggaggagcucgagcgcaaggagaucgacccccccuuccgccccaaggucaagucccccuucgacugcuccaacuucgacaaggaguuccucaacgagaagccccgccucuccuucgccgaccgcgcccucaucaacuccauggaccagaacauguuccgcaacuucuccuucaugaaccccggcauggagcgccucaucuccuga

SEQ ID NO: 8910 - RNA, 2121 nt, Artificial Sequence
  derived and/or modified sequence opt3 from KPCT__Homo_sapiens__AAA60101
augagccccuuccugagaaucggccucuccaacuuugacugcgggucuugucagucaugccaaggagaggccgugaauccuuacugugcuguccuuguuaaggaauauguggagagugaaaacggucagauguacauucagaaaaagccaaccauguauccgcccugggauagcacauucgacgcacacauaaauaaaggcaggguaaugcagaucauugugaaggggaaaaacgucgaucugaucuccgagacuacgguggaauuguacucuuuagccgagcggugccgcaagaauaacggaaagaccgagauuuggcuggaacuaaaaccucaaggccgaaugcucaugaaugcgcguuauuuucuggagaugucggacacaaaggauaugaacgaguucgaaacugagggguuuuucgcccuucaucagagaaggggugcuaucaaacaggcaaagguucaccaugugaaaugucacgaauuuaccgccacauucuuuccacagcccaccuucugcucagucugucaugaguuuguguggggacugaauaagcaaggcuaccagugccggcaguguaacgcugcaauacacaagaaaugcaucgacaagguaauugccaaauguacuggcagcgcuaucaauagucgcgaaacaauguuccacaaggagagauuuaaaauugauaugccucauagguucaagguuuauaacuacaaauccccaaccuucugcgaacacugcgggacguugcucuggggacuggcccggcagggucugaagugugacgcgugcggcaugaaugugcaucaccgcugucaaacuaaggucgcaaaccucugcgggaucaaucagaaauuaauggccgaggcucuggccaugauagagucuacccagcaagcacgaugucuuagagauacagaacagauuuuuagggagggacccguggaaaucggcuugccuugcagcauuaagaacgaggcucggccaccgugucugcccacuccugguaaacgugaaccacaggggaucuccugggagucaccccuagacgagguggauaagaugugccaccucccugaaccagagcugaacaaagaacgccccagucuucagaucaagcugaagauugaggacuucauauugcauaaaaugcucggaaagggcagcuuuggcaaagucuuccuggccgaauuuaagaaaaccaaucaauucuuugcgaucaaggccuuaaagaaagauguugugcugauggacgacgauguagaguguacaaugguggagaagagaguccucucucuugcaugggaacacccguuccugacccauauguuuugcacguuccagacuaaagagaacuuguuuuucgugauggaauaccuaaaugggggagaccugauguaucacauucaguccugucauaaguuugaucucucaagggcuacauucuacgccgcugagaucauacugggucuucaguuccugcacagcaaaggcauuguuuaucgggacuugaagcucgauaacauccuguuagacaaggaugggcacaucaaaauugccgacuuuggaaugugcaaggagaauaugcugggcgaugcaaaaaccaacacuuucugcgguacaccugacuacaucgcccccgaaauucuacucgggcaaaaguauaaucauaguguggauugguggucuuuuggcguccugcuuuacgagauguugauaggacaguccccauuccacggccaggacgaagaggaacuguuucauagcauccgaauggacaacccuuucuauccccgcuggcucgagaaagaggcuaaggaucugcuugugaaacuguuuguaagagaaccagagaagagguuggggguucggggagacauucgccagcacccccucuucagagaaaucaauugggaggaacuggagaggaaggagaucgauccuccauuucguccgaaagugaagucgcccuucgacuguucuaacuuugauaaagaguucuuaaaugaaaagccucggcuguccuuugcggaccgagcacuaauuaacucaauggaucaaaauauguucagaaacuucaguuuuaugaauccagguauggaaaggcucauaagcuga

SEQ ID NO: 8911 - RNA, 2121 nt, Artificial Sequence
  derived and/or modified sequence opt4 from KPCT__Homo_sapiens__AAA60101
augagccccuuccugagaaucggccugagcaacuucgacugcggcagcugccagagcugccagggcgaggccgugaaccccuacugcgccgugcuggugaaggaguacguggagagcgagaacggccagauguacauccagaagaagcccaccauguacccccccugggacagcaccuucgacgcccacaucaacaagggcagagugaugcagaucaucgugaagggcaagaacguggaccugaucagcgagaccaccguggagcuguacagccuggccgagagaugcagaaagaacaacggcaagaccgagaucuggcuggagcugaagccccagggcagaaugcugaugaacgccagauacuuccuggagaugagcgacaccaaggacaugaacgaguucgagaccgagggcuucuucgcccugcaccagagaagaggcgccaucaagcaggccaaggugcaccacgugaagugccacgaguucaccgccaccuucuucccccagcccaccuucugcagcgugugccacgaguucguguggggccugaacaagcagggcuaccagugcagacagugcaacgccgccauccacaagaagugcaucgacaaggugaucgccaagugcaccggcagcgccaucaacagcagagagaccauguuccacaaggagagauucaagaucgacaugccccacagauucaagguguacaacuacaagagccccaccuucugcgagcacugcggcacccugcuguggggccuggccagacagggccugaagugcgacgccugcggcaugaacgugcaccacagaugccagaccaagguggccaaccugugcggcaucaaccagaagcugauggccgaggcccuggccaugaucgagagcacccagcaggccagaugccugagagacaccgagcagaucuucagagagggccccguggagaucggccugcccugcagcaucaagaacgaggccagaccccccugccugcccacccccggcaagagagagccccagggcaucagcugggagagcccccuggacgagguggacaagaugugccaccugcccgagcccgagcugaacaaggagagacccagccugcagaucaagcugaagaucgaggacuucauccugcacaagaugcugggcaagggcagcuucggcaagguguuccuggccgaguucaagaagaccaaccaguucuucgccaucaaggcccugaagaaggacguggugcugauggacgacgacguggagugcaccaugguggagaagagagugcugagccuggccugggagcaccccuuccugacccacauguucugcaccuuccagaccaaggagaaccuguucuucgugauggaguaccugaacggcggcgaccugauguaccacauccagagcugccacaaguucgaccugagcagagccaccuucuacgccgccgagaucauccugggccugcaguuccugcacagcaagggcaucguguacagagaccugaagcuggacaacauccugcuggacaaggacggccacaucaagaucgccgacuucggcaugugcaaggagaacaugcugggcgacgccaagaccaacaccuucugcggcacccccgacuacaucgcccccgagauccugcugggccagaaguacaaccacagcguggacugguggagcuucggcgugcugcuguacgagaugcugaucggccagagccccuuccacggccaggacgaggaggagcuguuccacagcaucagaauggacaaccccuucuaccccagauggcuggagaaggaggccaaggaccugcuggugaagcuguucgugagagagcccgagaagagacugggcgugagaggcgacaucagacagcacccccuguucagagagaucaacugggaggagcuggagagaaaggagaucgacccccccuucagacccaaggugaagagccccuucgacugcagcaacuucgacaaggaguuccugaacgagaagcccagacugagcuucgccgacagagcccugaucaacagcauggaccagaacauguucagaaacuucagcuucaugaaccccggcauggagagacugaucagcuga

SEQ ID NO: 8912 - RNA, 2121 nt, Artificial Sequence
  derived and/or modified sequence opt5 from KPCT__Homo_sapiens__AAA60101
augagccccuuccugagaaucggccucuccaacuuugacugcgggucuugucagagcugccaaggagaggccgugaauccuuacugugcuguccugguuaaggaauauguggaguccgaaaacggccagauguacauucagaaaaagccgaccauguaucccccuugggauucuacauucgacgcccacaucaauaaagggcgggugaugcagauuaucgucaagggcaaaaacguggaucuuauuagcgagacgaccguugaacuguacucccucgcggagcgcugcagaaagaauaacggaaagacagagaucuggcuggaacuuaaaccccaagggcggaugcugaugaaugcucgcuauuuucucgagaugucugacaccaaggauaugaacgaguucgaaacagagggauuuuucgcccugcaucagagacggggcgccaucaaacaggcuaaggugcaccaugucaaaugucacgaauuuaccgccacauucuuuccucagcccaccuucugcagcgugugucaugaguuuguuuggggccugaauaagcaaggguaccagugccgccaguguaacgcugccauucacaagaaaugcaucgacaaggugauugcgaaauguacgggauccgccaucaauagcagagaaaccauguuccacaaggagcgguuuaaaauugauaugccucaucgcuucaaggucuauaacuacaaaucuccgacauucugcgaacacugcggcacccuccugugggggcuugcuagacagggacugaagugugacgccugcggcaugaaugugcaucaccggugucaaacaaagguggcuaaccucugcgggaucaaucagaaacugauggccgaggcgcuugccaugauugaguccacccagcaagcucgcugucugagagauacggaacagaucuuucgggagggacccgucgaaaucggccucccuugcagcauuaagaacgaggccagacccccuugucugcccacaccgggcaaacgcgaaccucaggggaucucuugggagagcccccuggacgagguugauaagaugugccaccucccugaacccgagcugaacaaagaacggcccucccuucagauuaagcugaagaucgaggacuucauucuccauaaaaugcugggaaagggcucuuuugggaaaguguuccuugcugaauuuaagaaaaccaaucaauucuuugccaucaaggcccugaagaaagaugugguccucauggacgacgauguggaguguacaaugguugagaagagagugcugucccuggcuugggaacacccuuuccucacccauauguuuugcaccuuccagacaaaagagaaccuguuuuucgucauggaauaccuuaauggaggcgaccugauguaucacauccagagcugucauaaguuugaucucucccgcgcgacguucuacgccgcugagauuauccuggggcuucaguuccugcacucuaaaggaauuguguaucgggaccucaagcuggauaacauccugcucgacaaggauggccacauuaaaaucgccgacuuuggcaugugcaaggagaauaugcugggggaugccaaaaccaacacauucugcggaaccccggacuacaucgcucccgaaauucuucugggccaaaaguauaaucauagcguugauuggugguccuuuggggugcuccuguacgagaugcugaucggacagagcccuuuccacggccaggacgaagaggaacuuuuucauucuauuagaauggacaaccccuucuauccucgcuggcucgagaaagaggccaaggaucugcuggucaaacucuuugugcgggaacccgagaagagacuggggguccgcggcgacauccggcagcacccgcuuuucagagaaauuaauugggaggaacuggagcgcaaggagaucgauccucccuuucggccuaaagugaagucccccuucgacuguagcaacuuugauaaagaguuccucaaugaaaagccuagacugucuuuugcggaccgcgcucugauuaacagcauggaucaaaauauguuccggaacuucuccuuuaugaaucccggaauggaaagacuuaucucuuga

SEQ ID NO: 8913 - protein, 592 aa, Artificial Sequence
  KPCZ__Homo_sapiens__Q05513
MPSRTGPKMEGSGGRVRLKAHYGGDIFITSVDAATTFEELCEEVRDMCRLHQQHPLTLKWVDSEGDPCTVSSQMELEEAFRLARQCRDEGLIIHVFPSTPEQPGLPCPGEDKSIYRRGARRWRKLYRANGHLFQAKRFNRRAYCGQCSERIWGLARQGYRCINCKLLVHKRCHGLVPLTCRKHMDSVMPSQEPPVDDKNEDADLPSEETDGIAYISSSRKHDSIKDDSEDLKPVIDGMDGIKISQGLGLQDFDLIRVIGRGSYAKVLLVRLKKNDQIYAMKVVKKELVHDDEDIDWVQTEKHVFEQASSNPFLVGLHSCFQTTSRLFLVIEYVNGGDLMFHMQRQRKLPEEHARFYAAEICIALNFLHERGIIYRDLKLDNVLLDADGHIKLTDYGMCKEGLGPGDTTSTFCGTPNYIAPEILRGEEYGFSVDWWALGVLMFEMMAGRSPFDIITDNPDMNTEDYLFQVILEKPIRIPRFLSVKASHVLKGFLNKDPKERLGCRPQTGFSDIKSHAFFRSIDWDLLEKKQALPPFQPQITDDYGLDNFDTQFTSEPVQLTPDDEDAIKRIDQSEFEGFEYINPLLLSTEESV

SEQ ID NO: 8914 - RNA, 1779 nt, Artificial Sequence
  KPCZ__Homo_sapiens__AAH08058
augcccagcaggaccggccccaagauggaagggagcggcggccgcguccgccucaaggcgcauuacgggggggacaucuucaucaccagcguggacgccgccacgaccuucgaggagcucugugaggaagugagagacaugugucgucugcaccagcagcacccgcucacccucaaguggguggacagcgaaggugacccuugcacgguguccucccagauggagcuggaagaggcuuuccgccuggcccgucagugcagggaugaaggccucaucauucauguuuucccgagcaccccugagcagccuggccugccauguccgggagaagacaaaucuaucuaccgccggggagccagaagauggaggaagcuguaccgugccaacggccaccucuuccaagccaagcgcuuuaacaggagagcguacugcggucagugcagcgagaggauauggggccucgcgaggcaaggcuacaggugcaucaacugcaaacugcugguccauaagcgcugccacggccucgucccgcugaccugcaggaagcauauggauucugucaugccuucccaagagccuccaguagacgacaagaacgaggacgccgaccuuccuuccgaggagacagauggaauugcuuacauuuccucaucccggaagcaugacagcauuaaagacgacucggaggaccuuaagccaguuaucgaugggauggauggaaucaaaaucucucaggggcuugggcugcaggacuuugaccuaaucagagucaucgggcgcgggagcuacgccaagguucuccuggugcgguugaagaagaaugaccaaauuuacgccaugaaaguggugaagaaagagcuggugcaugaugacgaggauauugacuggguacagacagagaagcacguguuugagcaggcauccagcaaccccuuccuggucggauuacacuccugcuuccagacgacaagucgguuguuccuggucauugaguacgucaacggcggggaccugauguuccacaugcagaggcagaggaagcucccugaggagcacgccagguucuacgcggccgagaucugcaucgcccucaacuuccugcacgagagggggaucaucuacagggaccugaagcuggacaacguccuccuggaugcggacgggcacaucaagcucacagacuacggcaugugcaaggaaggccugggcccuggugacacaacgagcacuuucugcggaaccccgaauuacaucgcccccgaaauccugcggggagaggaguacggguucagcguggacuggugggcgcugggaguccucauguuugagaugauggccgggcgcuccccguucgacaucaucaccgacaacccggacaugaacacagaggacuaccuuuuccaagugauccuggagaagcccauccggaucccccgguuccuguccgucaaagccucccauguuuuaaaaggauuuuuaaauaaggaccccaaagagaggcucggcugccggccacagacuggauuuucugacaucaagucccacgcguucuuccgcagcauagacugggacuugcuggagaagaagcaggcgcucccuccauuccagccacagaucacagacgacuacggucuggacaacuuugacacacaguucaccagcgagcccgugcagcugaccccagacgaugaggaugccauaaagaggaucgaccagucagaguucgaaggcuuugaguauaucaacccauuauugcuguccaccgaggagucgguguga

SEQ ID NO: 8915 - RNA, 1779 nt, Artificial Sequence
  derived and/or modified sequence opt1 from KPCZ__Homo_sapiens__AAH08058
augcccagccgcaccggcccgaagauggagggguccggcgggcgggugcgccugaaggcccacuacggcggggacaucuucaucaccagcgucgacgccgcgacgaccuucgaggagcucugcgaggaggugcgggacaugugccgccugcaccagcagcacccccugacccucaaguggguggacuccgagggcgaccccugcaccgucagcucccagauggagcuggaggaggccuuccggcuggcccgccagugccgggacgagggccucaucauccacguguuccccagcacgccggagcagcccgggcugcccugccccggcgaggacaaguccaucuaccgccgcggggcccggcgguggcgcaagcuguaccgggccaacggccaccucuuccaggcgaagcgcuucaaccggcgcgccuacugcgggcagugcagcgagcggaucuggggccuggcccgccagggcuaccggugcaucaacugcaagcugcucgugcacaagcgcugccacgggcuggucccgcugaccugccggaagcacauggacuccgugaugcccagccaggagccgcccguggacgacaagaacgaggacgccgaccuccccuccgaggagaccgacggcaucgcguacaucagcuccagccgcaagcacgacuccaucaaggacgacagcgaggaccugaagcccgucaucgacgggauggacggcaucaagaucucccagggccuggggcuccaggacuucgaccugauccgcgugaucggccgggggagcuacgccaaggugcugcucguccgccugaagaagaacgaccagaucuacgccaugaagguggugaagaaggagcugguccacgacgacgaggacaucgacugggugcagaccgagaagcacguguucgagcaggccuccagcaaccccuuccucgucggccugcacagcugcuuccagacgaccucccggcuguuccucgugaucgaguacgugaacgggggcgaccugauguuccacaugcagcgccagcggaagcugcccgaggagcacgcccgcuucuacgcggccgagaucugcaucgcccucaacuuccugcacgagcggggcaucaucuaccgcgaccugaagcucgacaacguccugcuggacgccgacgggcacaucaagcucaccgacuacggcaugugcaaggaggggcugggcccgggggacaccacgagcaccuucugcggcacccccaacuacaucgcccccgagauccugcggggcgaggaguacggguucuccguggacuggugggcgcucggcgugcugauguucgagaugauggccgggcgcagccccuucgacaucaucaccgacaacccggacaugaacacggaggacuaccuguuccaggucauccucgagaagcccauccggaucccccgcuuccuguccgugaaggccagccacguccugaagggcuuccucaacaaggaccccaaggagcggcuggggugccgcccgcagaccggcuucuccgacaucaagagccacgccuucuuccgguccaucgacugggaccugcucgagaagaagcaggcccugccgcccuuccagccccagaucaccgacgacuacggccuggacaacuucgacacccaguucacgagcgagcccgugcagcugacccccgacgacgaggacgcgaucaagcgcaucgaccaguccgaguucgagggguucgaguacaucaacccccuccugcugagcaccgaggaguccguguga

SEQ ID NO: 8916 - RNA, 1779 nt, Artificial Sequence
  derived and/or modified sequence opt2 from KPCZ__Homo_sapiens__AAH08058
augcccucccgcaccggccccaagauggagggcuccggcggccgcguccgccucaaggcccacuacggcggcgacaucuucaucaccuccgucgacgccgccaccaccuucgaggagcucugcgaggagguccgcgacaugugccgccuccaccagcagcacccccucacccucaagugggucgacuccgagggcgaccccugcaccgucuccucccagauggagcucgaggaggccuuccgccucgcccgccagugccgcgacgagggccucaucauccacgucuuccccuccacccccgagcagcccggccuccccugccccggcgaggacaaguccaucuaccgccgcggcgcccgccgcuggcgcaagcucuaccgcgccaacggccaccucuuccaggccaagcgcuucaaccgccgcgccuacugcggccagugcuccgagcgcaucuggggccucgcccgccagggcuaccgcugcaucaacugcaagcuccucguccacaagcgcugccacggccucgucccccucaccugccgcaagcacauggacuccgucaugcccucccaggagccccccgucgacgacaagaacgaggacgccgaccuccccuccgaggagaccgacggcaucgccuacaucuccuccucccgcaagcacgacuccaucaaggacgacuccgaggaccucaagcccgucaucgacggcauggacggcaucaagaucucccagggccucggccuccaggacuucgaccucauccgcgucaucggccgcggcuccuacgccaagguccuccucguccgccucaagaagaacgaccagaucuacgccaugaaggucgucaagaaggagcucguccacgacgacgaggacaucgacuggguccagaccgagaagcacgucuucgagcaggccuccuccaaccccuuccucgucggccuccacuccugcuuccagaccaccucccgccucuuccucgucaucgaguacgucaacggcggcgaccucauguuccacaugcagcgccagcgcaagcuccccgaggagcacgcccgcuucuacgccgccgagaucugcaucgcccucaacuuccuccacgagcgcggcaucaucuaccgcgaccucaagcucgacaacguccuccucgacgccgacggccacaucaagcucaccgacuacggcaugugcaaggagggccucggccccggcgacaccaccuccaccuucugcggcacccccaacuacaucgcccccgagauccuccgcggcgaggaguacggcuucuccgucgacuggugggcccucggcguccucauguucgagaugauggccggccgcucccccuucgacaucaucaccgacaaccccgacaugaacaccgaggacuaccucuuccaggucauccucgagaagcccauccgcaucccccgcuuccucuccgucaaggccucccacguccucaagggcuuccucaacaaggaccccaaggagcgccucggcugccgcccccagaccggcuucuccgacaucaagucccacgccuucuuccgcuccaucgacugggaccuccucgagaagaagcaggcccucccccccuuccagccccagaucaccgacgacuacggccucgacaacuucgacacccaguucaccuccgagcccguccagcucacccccgacgacgaggacgccaucaagcgcaucgaccaguccgaguucgagggcuucgaguacaucaacccccuccuccucuccaccgaggaguccgucuga

SEQ ID NO: 8917 - RNA, 1779 nt, Artificial Sequence
  derived and/or modified sequence opt3 from KPCZ__Homo_sapiens__AAH08058
augcccagcagaaccggcccuaagauggagggguccggagguagggugcggcugaaagcccacuacggcggggacaucuucauuacaucugucgaugcugcaacuacguuugaggaacucugcgaagagguucgcgacaugugucgacuucaucagcaacacccacugaccuugaaguggguggauucagaaggagacccgugcacaguaaguagccagauggaguuagaggaagccuuccgucuggcgagacaguguagggaugagggccuaauaauccauguguuucccuccacuccugaacagccaggucuccccugcccuggggaggacaaaucuauuuaucggcgcggagcuagaagguggcggaagcuguaccgcgccaacggccaccuuuuccaagcaaaacgauuuaauagaagggccuauuguggccagugcucggagcggaucugggggcuggcucgucagggauaccgcuguauuaacugcaaguugcucguccauaagagaugucacggucuggugccacugaccugcaggaaacacauggauucaguuaugcccagccaggaaccuccaguggacgauaagaaugaggacgcagaucucccgagugaagagacagacggcaucgccuauauauccucuagccggaaacaugauuccaucaaggacgacucagaagauuuaaaacccgucauugacgggauggauggaaucaagauuagucaaggccugggucuucaggacuucgauuugauccgagugauagggcgcggaagcuacgcuaagguacugcuaguuagacucaaaaagaacgaccagauuuaugccaugaaaguggucaagaaagagcuggugcacgaugacgaggauaucgacugggugcagaccgaaaagcaugucuuugagcaagcgucuuccaauccuuuccuuguuggccugcacucauguuuucagacuacaagcagguuguuccucgugauugaauacguaaacggcggggaucugauguuucacaugcagcggcaacgcaaauuaccagaggaacaugcaagauucuacgccgcugagaucugcaucgcccugaauuuucuccacgagaggggaauuauauaucgugaccuuaagcuggacaacguguugcuagaugcagacggucauaucaagcugaccgauuacggcaugugcaaagaagggcucggacccggcgacacgaccaguacuuucugugguacaccuaauuauauugcuccagagauccugagaggggaagaguacggcuucucugucgauuggugggcccuuggagugcugauguuugaaaugauggcgggccgaucccccuucgacauaauuacugauaacccggacaugaauaccgaggauuauuuguuucagguuauccucgagaagccuauccggauucccagguuccugagcgugaaagccucgcacgucuuaaagggguuucugaacaaagacccaaaggaacgccuaggaugccggccucagacagguuucucugauaucaagucccaugcauuuuucagaucaauugacugggaucuccuggagaaaaagcaggcccuucccccauuucaaccccagauaaccgacgacuacggcuuggauaauuucgacacgcaguuuacaagugaaccugugcagcugacuccagaugacgaggaugcuaucaaaaggauugaccaaagcgaguucgaaggguuugaguauaucaacccgcuccugcuuuccaccgaagagucuguauga

SEQ ID NO: 8918 - RNA, 1779 nt, Artificial Sequence
  derived and/or modified sequence opt4 from KPCZ__Homo_sapiens__AAH08058
augcccagcagaaccggccccaagauggagggcagcggcggcagagugagacugaaggcccacuacggcggcgacaucuucaucaccagcguggacgccgccaccaccuucgaggagcugugcgaggaggugagagacaugugcagacugcaccagcagcacccccugacccugaaguggguggacagcgagggcgaccccugcaccgugagcagccagauggagcuggaggaggccuucagacuggccagacagugcagagacgagggccugaucauccacguguuccccagcacccccgagcagcccggccugcccugccccggcgaggacaagagcaucuacagaagaggcgccagaagauggagaaagcuguacagagccaacggccaccuguuccaggccaagagauucaacagaagagccuacugcggccagugcagcgagagaaucuggggccuggccagacagggcuacagaugcaucaacugcaagcugcuggugcacaagagaugccacggccuggugccccugaccugcagaaagcacauggacagcgugaugcccagccaggagccccccguggacgacaagaacgaggacgccgaccugcccagcgaggagaccgacggcaucgccuacaucagcagcagcagaaagcacgacagcaucaaggacgacagcgaggaccugaagcccgugaucgacggcauggacggcaucaagaucagccagggccugggccugcaggacuucgaccugaucagagugaucggcagaggcagcuacgccaaggugcugcuggugagacugaagaagaacgaccagaucuacgccaugaagguggugaagaaggagcuggugcacgacgacgaggacaucgacugggugcagaccgagaagcacguguucgagcaggccagcagcaaccccuuccuggugggccugcacagcugcuuccagaccaccagcagacuguuccuggugaucgaguacgugaacggcggcgaccugauguuccacaugcagagacagagaaagcugcccgaggagcacgccagauucuacgccgccgagaucugcaucgcccugaacuuccugcacgagagaggcaucaucuacagagaccugaagcuggacaacgugcugcuggacgccgacggccacaucaagcugaccgacuacggcaugugcaaggagggccugggccccggcgacaccaccagcaccuucugcggcacccccaacuacaucgcccccgagauccugagaggcgaggaguacggcuucagcguggacuggugggcccugggcgugcugauguucgagaugauggccggcagaagccccuucgacaucaucaccgacaaccccgacaugaacaccgaggacuaccuguuccaggugauccuggagaagcccaucagaauccccagauuccugagcgugaaggccagccacgugcugaagggcuuccugaacaaggaccccaaggagagacugggcugcagaccccagaccggcuucagcgacaucaagagccacgccuucuucagaagcaucgacugggaccugcuggagaagaagcaggcccugccccccuuccagccccagaucaccgacgacuacggccuggacaacuucgacacccaguucaccagcgagcccgugcagcugacccccgacgacgaggacgccaucaagagaaucgaccagagcgaguucgagggcuucgaguacaucaacccccugcugcugagcaccgaggagagcguguga

SEQ ID NO: 8919 - RNA, 1779 nt, Artificial Sequence
  derived and/or modified sequence opt5 from KPCZ__Homo_sapiens__AAH08058
augcccagcagaaccggcccuaagauggagggguccggaggccgggugcgccugaaagcccacuacgggggagacaucuucauuacaucugucgaugcugccacgaccuuugaggaacucugcgaagagguuagagacaugugucggcugcaucagcaacacccgcuuacacugaaguggguggauagcgaaggcgaccccugcaccguguccucucagauggagcucgaggaagcguuccgccuggcuagacagugucgggaugaggggcuuaucauucaugucuuuccuagcacacccgaacagccuggacugcccugcccuggcgaggacaaauccaucuaucgcagaggcgcccggcgcuggagaaagcucuaccgggccaacgggcaccuguuccaagcuaaacgcuuuaauagacgggccuauuguggacagugcucugagcgcauuuggggccuggcuagacagggguaccgguguaucaacugcaagcuccuggugcauaagagaugucacggacuuguuccgcugaccugccgcaaacacauggauagcgugaugcccucccaggaaccucccgucgacgauaagaaugaggacgccgaucucccuagcgaagagacagacggcaucgcguauauuucuuccagccggaaacaugauucuaucaaggacgacuccgaagaucugaaacccgugauugacgggauggauggaaucaagauuagccaaggccuuggccugcaggacuucgaucucaucagaguuauugggcgcggaucuuacgccaaggugcugcugguccggcucaaaaagaacgaccagaucuaugcuaugaaaguggugaagaaagagcugguccacgaugacgaggauaucgacuggguucagaccgaaaagcauguguuugagcaagccuccagcaauccguuccuugugggccugcacuccuguuuucagacgaccucuagacucuuccuggucauugaauacgugaacgggggagaucuuauguuucacaugcagcgccaacggaaacugccugaggaacaugcuagauucuacgccgcggagaucugcauugcccucaauuuucugcacgagcgcggcaucauuuaucgggaccugaagcucgacaacguucugcuugaugcugacgggcauaucaagcugacagauuacggaaugugcaaagaaggccucggccccggggacaccacaagcaccuucuguggaacgccuaauuauaucgcccccgagauucugagaggcgaagaguacggguucuccguggauuggugggcucuuggaguccugauguuugaaaugauggccggccgcagccccuucgacaucauuacagauaacccugacaugaauaccgaggauuaucucuuucaggugauccuggagaagccgauucggauccccagauuccugucuguuaaagccucccacgugcucaagggguuucugaacaaagacccuaaggaacggcuuggcugccgcccccagacaggauucagcgauaucaagucucaugcguuuuucagaagcauugacugggaucugcucgagaaaaagcaggcucugccucccuuucaaccgcagaucaccgacgacuacggccuggauaauuucgacacccaguuuacauccgaaccuguccagcuuacgcccgaugacgaggaugccauuaaacggaucgaccaaucugaguucgaaggguuugaguauauuaacccucuccugcugagcaccgaagaguccguguga

SEQ ID NO: 8920 - protein, 678 aa, Artificial Sequence
  LGP2__Homo_sapiens__A0A024R1Y5
MELRSYQWEVIMPALEGKNIIIWLPTGAGKTRAAAYVAKRHLETVDGAKVVVLVNRVHLVTQHGEEFRRMLDGRWTVTTLSGDMGPRAGFGHLARCHDLLICTAELLQMALTSPEEEEHVELTVFSLIVVDECHHTHKDTVYNVIMSQYLELKLQRAQPLPQVLGLTASPGTGGASKLDGAINHVLQLCANLDTWCIMSPQNCCPQLQEHSQQPCKQYNLCHRRSQDPFGDLLKKLMDQIHDHLEMPELSRKFGTQMYEQQVVKLSEAAALAGLQEQRVYALHLRRYNDALLIHDTVRAVDALAALQDFYHREHVTKTQILCAERRLLALFDDRKNELAHLATHGPENPKLEMLEKILQRQFSSSNSPRGIIFTRTRQSAHSLLLWLQQQQGLQTVDIRAQLLIGAGNSSQSTHMTQRDQQEVIQKFQDGTLNLLVATSVAEEGLDIPHCNVVVRYGLLTNEISMVQARGRARADQSVYAFVATEGSRELKRELINEALETLMEQAVAAVQKMDQAEYQAKIRDLQQAALTKRAAQAAQRENQRQQFPVEHVQLLCINCMVAVGHGSDLRKVEGTHHVNVNPNFSNYYNVSRDPVVINKVFKDWKPGGVISCRNCGEVWGLQMIYKSVKLPVLKVRSMLLETPQGRIQAKKWSRVPFSVPDFDFLQHCAENLSDLSLD

SEQ ID NO: 8921 - RNA, 2037 nt, Artificial Sequence
  LGP2__Homo_sapiens__EAW60797
auggagcuucgguccuaccaaugggaggugaucaugccugcccuggagggcaagaauaucaucaucuggcugcccacgggugccgggaagacccgggcggcugcuuauguggccaagcggcaccuagagacuguggauggagccaaggugguuguauuggucaacagggugcaccuggugacccagcauggugaagaguucaggcgcaugcuggauggacgcuggaccgugacaacccugaguggggacaugggaccacgugcuggcuuuggccaccuggcccggugccaugaccugcucaucugcacagcagagcuucugcagauggcacugaccagccccgaggaggaggagcacguggagcucacugucuucucccugaucgugguggaugagugccaccacacgcacaaggacaccgucuacaacgucaucaugagccaguaccuagaacuuaaacuccagagggcacagccgcuaccccaggugcugggucucacagccuccccaggcacuggcggggccuccaaacucgauggggccaucaaccacguccugcagcucugugccaacuuggacacguggugcaucaugucaccccagaacugcugcccccagcugcaggagcacagccaacagccuugcaaacaguacaaccucugccacaggcgcagccaggauccguuuggggacuugcugaagaagcucauggaccaaauccaugaccaccuggagaugccugaguugagccggaaauuugggacgcaaauguaugagcagcagguggugaagcugagugaggcugcggcuuuggcugggcuucaggagcaacggguguaugcgcuucaccugaggcgcuacaaugacgcgcugcucauccaugacaccguccgcgccguggaugccuuggcugcgcugcaggauuucuaucacagggagcacgucacuaaaacccagauccugugugccgagcgccggcugcuggcccuguucgaugaccgcaagaaugagcuggcccacuuggcaacucauggcccagagaauccaaaacuggagaugcuggaaaagauccugcaaaggcaguucaguagcucuaacagcccucgggguaucaucuucacccgcacccgccaaagcgcacacucccuccugcucuggcuccagcagcagcagggccugcagacuguggacauccgggcccagcuacugauuggggcugggaacagcagccagagcacccacaugacccagagggaccagcaagaagugauccagaaguuccaagauggaacccugaaccuucugguggccacgaguguggcggaggaggggcuggacaucccacauugcaaugugguggugcguuaugggcucuugaccaaugaaaucuccaugguccaggccaggggccgugcccgggccgaucagaguguauacgcguuuguagcaacugaagguagccgggagcugaagcgggagcugaucaacgaggcgcuggagacgcugauggagcaggcaguggcugcugugcagaaaauggaccaggccgaguaccaggccaagauccgggaucugcagcaggcagccuugaccaagcgggcggcccaggcagcccagcgggagaaccagcggcagcaguucccaguggagcacgugcagcuacucugcaucaacugcaugguggcugugggccauggcagcgaccugcggaagguggagggcacccaccaugucaaugugaaccccaacuucucgaacuacuauaaugucuccagggauccuguggucaucaacaaagucuucaaggacuggaagccugggggugucaucagcugcaggaacuguggggaggucuggggucugcagaugaucuacaagucagugaagcugccagugcucaaaguccgcagcaugcugcuggagaccccucaggggcggauccaggccaaaaaguggucccgcgugcccuucuccgugccugacuuugacuuccugcagcauugugccgagaacuugucggaccucucccuggacuga

SEQ ID NO: 8922 - RNA, 2037 nt, Artificial Sequence
  derived and/or modified sequence opt1 from LGP2__Homo_sapiens__EAW60797
auggagcugcgcagcuaccagugggaggugaucaugcccgcccucgagggcaagaacaucaucaucuggcugccgaccggggccggcaagacccgggcggccgccuacgucgccaagcgccaccuggagacgguggacggggccaagguggucgugcucgugaaccggguccaccuggugacccagcacggcgaggaguuccgccggaugcuggacgggcgcuggaccgugaccacgcucuccggcgacaugggcccccgggcgggguucggccaccuggcccgcugccacgaccugcucaucugcaccgccgagcugcugcagauggcccucaccagccccgaggaggaggagcacgucgagcugaccguguucucccugaucguggucgacgagugccaccacacgcacaaggacaccguguacaacgugaucaugagccaguaccucgagcugaagcugcagcgggcgcagccccucccgcagguccuggggcugaccgccucccccggcaccgggggcgccagcaagcucgacggcgccaucaaccacgugcugcagcugugcgccaaccucgacacguggugcaucaugagcccccagaacugcugcccccagcugcaggagcacucccagcagccgugcaagcaguacaaccugugccaccgccggucccaggaccccuucggggaccuccugaagaagcugauggaccagauccacgaccaccucgagaugcccgagcugagccgcaaguucggcacccagauguacgagcagcaggucgugaagcuguccgaggcggccgcccucgccgggcugcaggagcagcggguguacgcccugcaccuccgccgguacaacgacgcgcugcugauccacgacaccgugcgcgccgucgacgcccucgccgcccugcaggacuucuaccaccgggagcacgugaccaagacgcagauccugugcgcggagcgccggcuccuggcccuguucgacgaccgcaagaacgagcucgcccaccuggccacccacggccccgagaacccgaagcuggagaugcucgagaagauccugcagcggcaguucagcuccagcaacagcccccgcggcaucaucuucacccgcacccggcaguccgcccacucccugcugcucuggcugcagcagcagcaggggcugcagacgguggacauccgcgcgcagcuccugaucggcgccgggaacagcucccagagcacccacaugacccagcgggaccagcaggaggucauccagaaguuccaggacggcacccugaaccuccugguggccacgagcgucgccgaggaggggcuggacaucccccacugcaacguggugguccgcuacggccuccugaccaacgagaucuccauggugcaggcgcggggccgcgcccgggccgaccagagcguguacgccuucgucgccaccgaggggucccgcgagcugaagcgggagcucaucaacgaggcgcuggagacccugauggagcaggccguggccgccgugcagaagauggaccaggccgaguaccaggcgaagauccgcgaccuccagcaggccgcccugacgaagcgggccgcccaggcggcccagcgcgagaaccagcggcagcaguuccccgucgagcacgugcagcugcucugcaucaacugcaugguggccgucggccacgggagcgaccugcgcaagguggagggcacccaccacgugaacgucaacccgaacuucuccaacuacuacaacgugagccgggaccccguggucaucaacaagguguucaaggacuggaagcccgggggcgugaucuccugccgcaacugcggcgaggucugggggcugcagaugaucuacaagagcgugaagcuccccgugcugaagguccgguccaugcugcucgagaccccgcagggccgcauccaggccaagaaguggagccgggugcccuucuccgugcccgacuucgacuuccugcagcacugcgcggagaaccugagcgaccucucccuggacuga

SEQ ID NO: 8923 - RNA, 2037 nt, Artificial Sequence
  derived and/or modified sequence opt2 from LGP2__Homo_sapiens__EAW60797
auggagcuccgcuccuaccagugggaggucaucaugcccgcccucgagggcaagaacaucaucaucuggcuccccaccggcgccggcaagacccgcgccgccgccuacgucgccaagcgccaccucgagaccgucgacggcgccaaggucgucguccucgucaaccgcguccaccucgucacccagcacggcgaggaguuccgccgcaugcucgacggccgcuggaccgucaccacccucuccggcgacaugggcccccgcgccggcuucggccaccucgcccgcugccacgaccuccucaucugcaccgccgagcuccuccagauggcccucaccucccccgaggaggaggagcacgucgagcucaccgucuucucccucaucgucgucgacgagugccaccacacccacaaggacaccgucuacaacgucaucaugucccaguaccucgagcucaagcuccagcgcgcccagccccucccccagguccucggccucaccgccucccccggcaccggcggcgccuccaagcucgacggcgccaucaaccacguccuccagcucugcgccaaccucgacaccuggugcaucauguccccccagaacugcugcccccagcuccaggagcacucccagcagcccugcaagcaguacaaccucugccaccgccgcucccaggaccccuucggcgaccuccucaagaagcucauggaccagauccacgaccaccucgagaugcccgagcucucccgcaaguucggcacccagauguacgagcagcaggucgucaagcucuccgaggccgccgcccucgccggccuccaggagcagcgcgucuacgcccuccaccuccgccgcuacaacgacgcccuccucauccacgacaccguccgcgccgucgacgcccucgccgcccuccaggacuucuaccaccgcgagcacgucaccaagacccagauccucugcgccgagcgccgccuccucgcccucuucgacgaccgcaagaacgagcucgcccaccucgccacccacggccccgagaaccccaagcucgagaugcucgagaagauccuccagcgccaguucuccuccuccaacuccccccgcggcaucaucuucacccgcacccgccaguccgcccacucccuccuccucuggcuccagcagcagcagggccuccagaccgucgacauccgcgcccagcuccucaucggcgccggcaacuccucccaguccacccacaugacccagcgcgaccagcaggaggucauccagaaguuccaggacggcacccucaaccuccucgucgccaccuccgucgccgaggagggccucgacaucccccacugcaacgucgucguccgcuacggccuccucaccaacgagaucuccaugguccaggcccgcggccgcgcccgcgccgaccaguccgucuacgccuucgucgccaccgagggcucccgcgagcucaagcgcgagcucaucaacgaggcccucgagacccucauggagcaggccgucgccgccguccagaagauggaccaggccgaguaccaggccaagauccgcgaccuccagcaggccgcccucaccaagcgcgccgcccaggccgcccagcgcgagaaccagcgccagcaguuccccgucgagcacguccagcuccucugcaucaacugcauggucgccgucggccacggcuccgaccuccgcaaggucgagggcacccaccacgucaacgucaaccccaacuucuccaacuacuacaacgucucccgcgaccccgucgucaucaacaaggucuucaaggacuggaagcccggcggcgucaucuccugccgcaacugcggcgaggucuggggccuccagaugaucuacaaguccgucaagcuccccguccucaagguccgcuccaugcuccucgagaccccccagggccgcauccaggccaagaaguggucccgcguccccuucuccguccccgacuucgacuuccuccagcacugcgccgagaaccucuccgaccucucccucgacuga

SEQ ID NO: 8924 - RNA, 2037 nt, Artificial Sequence
  derived and/or modified sequence opt3 from LGP2__Homo_sapiens__EAW60797
auggagcugagaagcuaccagugggaagugaucaugcccgcccucgagggcaagaacauuauaaucuggcuuccuaccggggcuggaaaaacaagggcagccgcguaugucgcuaagcggcaccuggaaacuguugacggugccaaagugguaguguuggucaaucgcgugcauuuaguuacgcaacacggcgaggaguuccgacguaugcuggaugggagauggaccgugacaacucuauccggagacaugggcccaagggcagguuuugggcaucucgcccggugccacgaucugcuuauuuguaccgcugaacuguugcagauggcacucacaucuccggaggaagaggaacaugucgagcugaccguguucucacugaucguaguugacgagugccaccacacucauaaggauacaguguacaacgucauuaugagucaguaucucgaauuaaaacugcagcgcgcccaaccccuuccucagguguugggacugaccgcuagcccaggcacgggcggggccuccaagcuagacggagcgaucaaucacgugcuccagcugugugcaaaccuugauacuuggugcauaaugucuccccagaauuguugcccucaacugcaggagcauucgcagcagccauguaagcaauacaacuugugccacagaaggucacaggaccccuuuggugaucuccugaaaaaguuaauggaccagauccacgaucaucuggaaaugccugagcucagccggaaauucggcacccaaauguaugaacagcaggucguuaagcugagugaggccgcugcccuggcaggguugcaggagcaacgcguguacgcucuacaccuucgaagauauaaugacgcccuccugauucaugauacaguaagggcgguggacgcccuugcagcucugcaggacuuuuaccaccgggaacaugucacuaaaacccagaucuugugugccgagcgucgccuccuggcuuuauucgaugacagaaagaacgaacuggcccaccuagcaacacacggaccagagaauccgaagcucgaaaugcuggagaaaauucuucagaggcaauuuuccucuagcaacucccccagaggcaucauauucacccgaacgcgccagucagcccauaguuugcugcucuggcugcagcagcaacagggucuucagacuguggauauuagagcucagcuguugaucggggcgggaaauagcucucaauccacacacaugacccagagggaccagcaagagguuauucagaaguuucaggauggcacucucaaccuguuaguggcaacaucagucgccgaagagggccuggacaucccucauugcaaugugguaguucgguacgggcuacucaccaacgaaaucagcauggugcaggcucgcggacgggccagggcagaucaaagugucuaugccuucguggcuacggaggguucucgugaacugaaacgggagcuuauuaaugaggccuuggaaacccugauggagcaggcagucgcggcugugcagaagauggaccaggccgaauaccaagcaaaaauacgagaucuccagcaggccgcucugacaaagagagccgcacaggcugcccaaagggagaaccagcgccagcaauuuccaguugagcacgugcaguuacuguguaucaacugcaugguagcggucggccacggguccgaccuucggaaaguggaaggaacucaucacguuaaugugaaccccaauuucagcaacuauuacaaugucucgagagauccugugguaauuaacaagguguuuaaggacuggaaaccaggcgguguuaucucuugcaggaauuguggggaggucuggggcuugcagaugauauauaaguccgugaaacuccccgugcugaagguccgcucaaugcuacuggaaaccccgcagggacggauucaagccaaaaaguggagucgaguuccuuucagcgugcccgacuucgauuuucuccagcauugcgcugagaaccuguccgaccuuucuuuggauuga

SEQ ID NO: 8925 - RNA, 2037 nt, Artificial Sequence
  derived and/or modified sequence opt4 from LGP2__Homo_sapiens__EAW60797
auggagcugagaagcuaccagugggaggugaucaugcccgcccuggagggcaagaacaucaucaucuggcugcccaccggcgccggcaagaccagagccgccgccuacguggccaagagacaccuggagaccguggacggcgccaaggugguggugcuggugaacagagugcaccuggugacccagcacggcgaggaguucagaagaaugcuggacggcagauggaccgugaccacccugagcggcgacaugggccccagagccggcuucggccaccuggccagaugccacgaccugcugaucugcaccgccgagcugcugcagauggcccugaccagccccgaggaggaggagcacguggagcugaccguguucagccugaucgugguggacgagugccaccacacccacaaggacaccguguacaacgugaucaugagccaguaccuggagcugaagcugcagagagcccagccccugccccaggugcugggccugaccgccagccccggcaccggcggcgccagcaagcuggacggcgccaucaaccacgugcugcagcugugcgccaaccuggacaccuggugcaucaugagcccccagaacugcugcccccagcugcaggagcacagccagcagcccugcaagcaguacaaccugugccacagaagaagccaggaccccuucggcgaccugcugaagaagcugauggaccagauccacgaccaccuggagaugcccgagcugagcagaaaguucggcacccagauguacgagcagcagguggugaagcugagcgaggccgccgcccuggccggccugcaggagcagagaguguacgcccugcaccugagaagauacaacgacgcccugcugauccacgacaccgugagagccguggacgcccuggccgcccugcaggacuucuaccacagagagcacgugaccaagacccagauccugugcgccgagagaagacugcuggcccuguucgacgacagaaagaacgagcuggcccaccuggccacccacggccccgagaaccccaagcuggagaugcuggagaagauccugcagagacaguucagcagcagcaacagccccagaggcaucaucuucaccagaaccagacagagcgcccacagccugcugcuguggcugcagcagcagcagggccugcagaccguggacaucagagcccagcugcugaucggcgccggcaacagcagccagagcacccacaugacccagagagaccagcaggaggugauccagaaguuccaggacggcacccugaaccugcugguggccaccagcguggccgaggagggccuggacaucccccacugcaacgugguggugagauacggccugcugaccaacgagaucagcauggugcaggccagaggcagagccagagccgaccagagcguguacgccuucguggccaccgagggcagcagagagcugaagagagagcugaucaacgaggcccuggagacccugauggagcaggccguggccgccgugcagaagauggaccaggccgaguaccaggccaagaucagagaccugcagcaggccgcccugaccaagagagccgcccaggccgcccagagagagaaccagagacagcaguuccccguggagcacgugcagcugcugugcaucaacugcaugguggccgugggccacggcagcgaccugagaaagguggagggcacccaccacgugaacgugaaccccaacuucagcaacuacuacaacgugagcagagaccccguggugaucaacaagguguucaaggacuggaagcccggcggcgugaucagcugcagaaacugcggcgagguguggggccugcagaugaucuacaagagcgugaagcugcccgugcugaaggugagaagcaugcugcuggagaccccccagggcagaauccaggccaagaaguggagcagagugcccuucagcgugcccgacuucgacuuccugcagcacugcgccgagaaccugagcgaccugagccuggacuga

SEQ ID NO: 8926 - RNA, 2037 nt, Artificial Sequence
  derived and/or modified sequence opt5 from LGP2__Homo_sapiens__EAW60797
auggagcugagaagcuaccagugggaagugaucaugcccgcccucgagggcaagaacauuaucauuuggcugccuaccggggcuggaaaaacacgggccgcggcuuaugucgccaagcgccaccuugaaacgguugacggcgccaaaguggugguccuggugaauagaguucaucucgugacccaacacggggaggaguuccggcgcaugcuggauggaagauggacagucaccacacuuuccggcgacauggggccgcgggcuggauuuggccaucuggcccgcugccacgaucuccugaucuguaccgcugaacugcuccagauggcccugacaucucccgaggaagaggaacauguggagcuuaccguuuucagccugauuguggucgacgagugccaccacacgcauaaggauaccguguacaacgugaucaugucccaguaucucgaacugaaacuucagagagcgcaaccucugccccagguccucggccugacagccucuccugggaccggaggcgcuagcaagcuggacggggccaucaaucacguucuccagcugugugcuaaccuugauacauggugcauuaugucuccccagaauuguugcccucaacugcaggagcauucccagcagccguguaagcaauacaaccucugccaccggcgcagccaggaccccuuuggagaucugcuuaaaaagcugauggaccagauccacgaucaucucgaaaugccugagcuguccagaaaauucggcacccaaauguaugaacaacagguggugaagcugagcgaggccgcggcccucgcugggcugcaggagcagcgggucuacgcccuucaucugcgcagauauaaugacgcucuccugauucacgauacggugcgggccguugacgcccuugcugcgcugcaggacuuuuaccaccgcgaacaugugacaaaaacccagauccucugugccgagagacggcugcuggcucucuucgaugacagaaagaacgaacuggcccaccuugccacacacggacccgagaauccuaagcuggaaaugcucgagaaaauucugcagcgccaauuuucuuccagcaacucuccccggggcaucauuuucaccagaacccgccaguccgcucauagccugcuucucuggcugcagcagcaacagggccugcagacagucgauauccgggcccagcuccugaucggggcgggaaauucuucccaaagcacgcacaugacccagagagaccagcaagaggugauucagaaguuucaggauggcacacuuaaccugcucguugcuaccuccguggccgaagaggggcuggacaucccgcauugcaaugucgugguccgcuacggacugcuuacaaacgaaauuucuauggugcaggcccggggcagagcucgcgccgaucaaagcguuuaugcuuucguggccaccgaggggucccgggaacucaaaagagagcugaucaaugaggcgcuggaaacgcucauggagcaggccgucgcugccgugcagaagauggaccaggcugaauaccaagccaaaauucgcgaucugcagcaggcggcccuuacaaagcgggcugcccaggcugcccaaagagagaaccagcggcagcaauuuccuguugagcacgugcagcugcucuguaucaacugcauggucgccgugggacacggcagcgaccugcgcaaaguggaaggcacccaucacguuaaugucaaccccaauuucucuaacuauuacaauguguccagagauccuguggucaucaacaagguguuuaaggacuggaaacccgggggaguuauuagcugccggaauuguggcgaggugugggggcugcagaugaucuauaagucugucaaacuucccgugcucaagguuagaagcaugcugcuggaaaccccucagggacgcauucaagcuaaaaaguggucccgggugccguucucuguccccgacuucgauuuucuccagcauugcgcggagaaccugagcgaccuuucccuggauuga

SEQ ID NO: 8927 - protein, 678 aa, Artificial Sequence; identical to SEQ ID NO: 8920
  LGP2__Homo_sapiens__Q96C10

SEQ ID NO: 8928 - RNA, 2037 nt, Artificial Sequence; identical to SEQ ID NO: 8921
  LGP2__Homo_sapiens__AAH14949

SEQ ID NO: 8929 - RNA, 2037 nt, Artificial Sequence; identical to SEQ ID NO: 8922
  derived and/or modified sequence opt1 from LGP2__Homo_sapiens__AAH14949

SEQ ID NO: 8930 - RNA, 2037 nt, Artificial Sequence; identical to SEQ ID NO: 8923
  derived and/or modified sequence opt2 from LGP2__Homo_sapiens__AAH14949

SEQ ID NO: 8931 - RNA, 2037 nt, Artificial Sequence; identical to SEQ ID NO: 8924
  derived and/or modified sequence opt3 from LGP2__Homo_sapiens__AAH14949

SEQ ID NO: 8932 - RNA, 2037 nt, Artificial Sequence; identical to SEQ ID NO: 8925
  derived and/or modified sequence opt4 from LGP2__Homo_sapiens__AAH14949

SEQ ID NO: 8933 - RNA, 2037 nt, Artificial Sequence; identical to SEQ ID NO: 8926
  derived and/or modified sequence opt5 from LGP2__Homo_sapiens__AAH14949

SEQ ID NO: 8934 - protein, 1024 aa, Artificial Sequence
  l_IPAF__Homo_sapiens__Q9NPP4
MNFIKDNSRALIQRMGMTVIKQITDDLFVWNVLNREEVNIICCEKVEQDAARGIIHMILKKGSESCNLFLKSLKEWNYPLFQDLNGQSLFHQTSEGDLDDLAQDLKDLYHTPSFLNFYPLGEDIDIIFNLKSTFTEPVLWRKDQHHHRVEQLTLNGLLQALQSPCIIEGESGKGKSTLLQRIAMLWGSGKCKALTKFKFVFFLRLSRAQGGLFETLCDQLLDIPGTIRKQTFMAMLLKLRQRVLFLLDGYNEFKPQNCPEIEALIKENHRFKNMVIVTTTTECLRHIRQFGALTAEVGDMTEDSAQALIREVLIKELAEGLLLQIQKSRCLRNLMKTPLFVVITCAIQMGESEFHSHTQTTLFHTFYDLLIQKNKHKHKGVAASDFIRSLDHCGDLALEGVFSHKFDFELQDVSSVNEDVLLTTGLLCKYTAQRFKPKYKFFHKSFQEYTAGRRLSSLLTSHEPEEVTKGNGYLQKMVSISDITSTYSSLLRYTCGSSVEATRAVMKHLAAVYQHGCLLGLSIAKRPLWRQESLQSVKNTTEQEILKAININSFVECGIHLYQESTSKSALSQEFEAFFQGKSLYINSGNIPDYLFDFFEHLPNCASALDFIKLDFYGGAMASWEKAAEDTGGIHMEEAPETYIPSRAVSLFFNWKQEFRTLEVTLRDFSKLNKQDIRYLGKIFSSATSLRLQIKRCAGVAGSLSLVLSTCKNIYSLMVEASPLTIEDERHITSVTNLKTLSIHDLQNQRLPGGLTDSLGNLKNLTKLIMDNIKMNEEDAIKLAEGLKNLKKMCLFHLTHLSDIGEGMDYIVKSLSSEPCDLEEIQLVSCCLSANAVKILAQNLHNLVKLSILDLSENYLEKDGNEALHELIDRMNVLEQLTALMLPWGCDVQGSLSSLLKHLEEVPQLVKLGLKNWRLTDTEIRILGAFFGKNPLKNFQQLNLAGNRVSSDGWLAFMGVFENLKQLVFFDFSTKEFLPDPALVRKLSQVLSKLTFLQEARLVGWQFDDDDLSVITGAFKLVTA

SEQ ID NO: 8935 - RNA, 3075 nt, Artificial Sequence
  l_IPAF__Homo_sapiens__AAH31555
augaauuucauaaaggacaauagccgagcccuuauucaaagaaugggaaugacuguuauaaagcaaaucacagaugaccuauuuguauggaauguucugaaucgcgaagaaguaaacaucauuugcugcgagaagguggagcaggaugcugcuagagggaucauucacaugauuuugaaaaaggguucagaguccuguaaccucuuucuuaaaucccuuaaggaguggaacuauccucuauuucaggacuugaauggacaaagucuuuuucaucagacaucagaaggagacuuggacgauuuggcucaggauuuaaaggacuuguaccauaccccaucuuuucugaacuuuuauccccuuggugaagauauugacauuauuuuuaacuugaaaagcaccuucacagaaccuguccuguggaggaaggaccaacaccaucaccgcguggagcagcugacccugaauggccuccugcaggcucuucagagccccugcaucauugaaggggaaucuggcaaaggcaaguccacucugcugcagcgaauugccaugcucuggggcuccggaaagugcaaggcucugaccaaguucaaauucgucuucuuccuccgucucagcagggcccaggguggacuuuuugaaacccucugugaucaacuccuggauauaccuggcacaaucaggaagcagacauucauggccaugcugcugaagcugcggcagaggguucuuuuccuucuugauggcuacaaugaauucaagccccagaacugcccagaaaucgaagcccugauaaaggaaaaccaccgcuucaagaacauggucaucgucaccacuaccacugagugccugaggcacauacggcaguuuggugcccugacugcugaggugggggauaugacagaagacagcgcccaggcucucauccgagaagugcugaucaaggagcuugcugaaggcuuguugcuccaaauucagaaauccaggugcuugaggaaucucaugaagaccccucucuuuguggucaucacuugugcaauccagaugggugaaagugaguuccacucucacacacaaacaacgcuguuccauaccuucuaugaucuguugauacagaaaaacaaacacaaacauaaagguguggcugcaagugacuucauucggagccuggaccacuguggagaccuagcucuggaggguguguucucccacaaguuugauuucgaacugcaggauguguccagcgugaaugaggauguccugcugacaacugggcuccucuguaaauauacagcucaaagguucaagccaaaguauaaauucuuucacaagucauuccaggaguacacagcaggacgaagacucagcaguuuauugacgucucaugagccagaggaggugaccaaggggaaugguuacuugcagaaaaugguuuccauuucggacauuacauccacuuauagcagccugcuccgguacaccugugggucaucuguggaagccaccagggcuguuaugaagcaccucgcagcaguguaucaacacggcugccuucucggacuuuccaucgccaagaggccucucuggagacaggaaucuuugcaaagugugaaaaacaccacugagcaagaaauucugaaagccauaaacaucaauuccuuuguagaguguggcauccauuuauaucaagagaguacauccaaaucagcccugagccaagaauuugaagcuuucuuucaagguaaaagcuuauauaucaacucagggaacauccccgauuacuuauuugacuucuuugaacauuugcccaauugugcaagugcccuggacuucauuaaacuggacuuuuaugggggagcuauggcuucaugggaaaaggcugcagaagacacagguggaauccacauggaagaggccccagaaaccuacauucccagcagggcuguaucuuuguucuucaacuggaagcaggaauucaggacucuggaggucacacuccgggauuucagcaaguugaauaagcaagauaucagauaucuggggaaaauauucagcucugccacaagccucaggcugcaaauaaagagaugugcugguguggcuggaagccucaguuugguccucagcaccuguaagaacauuuauucucucaugguggaagccaguccccucaccauagaagaugagaggcacaucacaucuguaacaaaccugaaaaccuugaguauucaugaccuacagaaucaacggcugccggguggucugacugacagcuuggguaacuugaagaaccuuacaaagcucauaauggauaacauaaagaugaaugaagaagaugcuauaaaacuagcugaaggccugaaaaaccugaagaagauguguuuauuucauuugacccacuugucugacauuggagagggaauggauuacauagucaagucucugucaagugaacccugugaccuugaagaaauucaauuagucuccugcugcuugucugcaaaugcagugaaaauccuagcucagaaucuucacaauuuggucaaacugagcauucuugauuuaucagaaaauuaccuggaaaaagauggaaaugaagcucuucaugaacugaucgacaggaugaacgugcuagaacagcucaccgcacugaugcugcccuggggcugugacgugcaaggcagccugagcagccuguugaaacauuuggaggaggucccacaacucgucaagcuuggguugaaaaacuggagacucacagauacagagauuagaauuuuaggugcauuuuuuggaaagaacccucugaaaaacuuccagcaguugaauuuggcgggaaaucgugugagcagugauggauggcuugccuucauggguguauuugagaaucuuaagcaauuaguguuuuuugacuuuaguacuaaagaauuucuaccugauccagcauuagucagaaaacuuagccaaguguuauccaaguuaacuuuucugcaagaagcuaggcuuguuggguggcaauuugaugaugaugaucucaguguuauuacaggugcuuuuaaacuaguaacugcuuaa

SEQ ID NO: 8936 - RNA, 3075 nt, Artificial Sequence
  derived and/or modified sequence opt1 from l_IPAF__Homo_sapiens__AAH31555
augaacuucaucaaggacaacagccgcgcccugauccagcggaugggcaugaccgugaucaagcagaucaccgacgaccucuucgucuggaacgugcugaaccgcgaggaggugaacaucaucugcugcgagaaggucgagcaggacgccgcgcgggggaucauccacaugauccugaagaagggcuccgagagcugcaaccucuuccugaagucccugaaggaguggaacuacccccucuuccaggaccugaacgggcagagccuguuccaccagacguccgagggcgaccucgacgaccuggcccaggaccugaaggaccucuaccacaccccgagcuuccugaacuucuacccccugggggaggacaucgacaucaucuucaaccucaaguccaccuucaccgagcccgugcuguggcgcaaggaccagcaccaccaccggguggagcagcugacgcucaacggccugcugcaggcccuccagagccccugcaucaucgagggcgaguccgggaagggcaagagcacccugcugcagcgcaucgccaugcucuggggguccggcaagugcaaggcccugaccaaguucaaguucgucuucuuccugcggcucagccgcgcgcagggcgggcuguucgagacccugugcgaccagcuccuggacaucccgggcacgauccggaagcagaccuucauggccaugcugcucaagcugcgccagcgggugcuguuccuccuggacggguacaacgaguucaagccccagaacugccccgagaucgaggcccugaucaaggagaaccaccgcuucaagaacauggugaucgucaccaccacgaccgagugccuccggcacauccgccaguucggcgcccugaccgcggaggugggggacaugaccgaggacuccgcccaggcccugauccgggaggugcucaucaaggagcuggccgagggccugcuccugcagauccagaagucccgcugccugcggaaccucaugaagacgccccuguucgucgugaucacgugcgccauccagaugggcgaguccgaguuccacagccacacccagaccacccuguuccacaccuucuacgaccugcucauccagaagaacaagcacaagcacaaggggguggcggccuccgacuucauccgcagccuggaccacugcggcgaccuggcccucgagggggucuucucccacaaguucgacuucgagcugcaggacgugagcagcgugaacgaggacguccugcucaccaccggccugcugugcaaguacacggcccagcgguucaagccgaaguacaaguucuuccacaaguccuuccaggaguacaccgccgggcgccggcucagcucccugcugaccagccacgagcccgaggaggugaccaagggcaacggcuaccuccagaagaugguguccaucagcgacaucacguccaccuacagcucccugcugcgcuacacgugcgggagcuccgucgaggcgacccgcgccgugaugaagcaccucgccgccguguaccagcacggcugccugcuggggcucagcaucgccaagcggccccuguggcgccaggagucccugcagagcgucaagaacaccaccgagcaggagauccucaaggcgaucaacaucaacuccuucguggagugcggcauccaccuguaccaggagagcaccuccaagagcgcccugucccaggaguucgaggccuucuuccagggcaagagccucuacaucaacagcgggaacauccccgacuaccuguucgacuucuucgagcaccucccgaacugcgccuccgcccuggacuucaucaagcuggacuucuacggcggggcgauggccagcugggagaaggccgccgaggacaccggcgggauccacauggaggaggcgcccgagacguacauccccucccgggccgucagccuguucuucaacuggaagcaggaguuccgcacccucgaggugacccugcgggacuucuccaagcugaacaagcaggacauccgcuaccucggcaagaucuucagcuccgccaccagccugcggcugcagaucaagcgcugcgccgggguggccggcucccucagccugguccuguccacgugcaagaacaucuacagccucaugguggaggcgagcccccugaccaucgaggacgagcggcacaucaccagcgugaccaaccugaagacccucuccauccacgaccugcagaaccagcgccugccgggcgggcucacggacagccugggcaaccugaagaaccucaccaagcugaucauggacaacaucaagaugaacgaggaggacgccaucaagcuggccgaggggcucaagaaccugaagaagaugugccuguuccaccucacccaccuguccgacaucggcgagggcauggacuacaucgucaagagccugagcuccgagcccugcgaccucgaggagauccagcuggugagcugcugccuguccgccaacgccgugaagauccucgcgcagaaccugcacaaccuggucaagcucagcauccuggaccuguccgagaacuaccucgagaaggacgggaacgaggcccugcacgagcugaucgaccggaugaacgugcucgagcagcugaccgcccugaugcuccccuggggcugcgacgugcaggggagccuguccagccugcucaagcaccuggaggaggucccccagcuggugaagcucggccugaagaacuggcgccugacggacaccgagauccggauccucggggccuucuucggcaagaacccgcugaagaacuuccagcagcugaaccucgccggcaaccgcguguccagcgacggguggcuggcguucaugggcgucuucgagaaccugaagcagcucguguucuucgacuucuccaccaaggaguuccugcccgaccccgcccuggugcggaagcucagccagguccuguccaagcugaccuuccuccaggaggcccgccuggugggguggcaguucgacgacgacgaccugagcgugaucacgggcgccuucaagcuggucaccgcguga

SEQ ID NO: 8937 - RNA, 3075 nt, Artificial Sequence
  derived and/or modified sequence opt2 from l_IPAF__Homo_sapiens__AAH31555
augaacuucaucaaggacaacucccgcgcccucauccagcgcaugggcaugaccgucaucaagcagaucaccgacgaccucuucgucuggaacguccucaaccgcgaggaggucaacaucaucugcugcgagaaggucgagcaggacgccgcccgcggcaucauccacaugauccucaagaagggcuccgaguccugcaaccucuuccucaagucccucaaggaguggaacuacccccucuuccaggaccucaacggccagucccucuuccaccagaccuccgagggcgaccucgacgaccucgcccaggaccucaaggaccucuaccacacccccuccuuccucaacuucuacccccucggcgaggacaucgacaucaucuucaaccucaaguccaccuucaccgagcccguccucuggcgcaaggaccagcaccaccaccgcgucgagcagcucacccucaacggccuccuccaggcccuccagucccccugcaucaucgagggcgaguccggcaagggcaaguccacccuccuccagcgcaucgccaugcucuggggcuccggcaagugcaaggcccucaccaaguucaaguucgucuucuuccuccgccucucccgcgcccagggcggccucuucgagacccucugcgaccagcuccucgacauccccggcaccauccgcaagcagaccuucauggccaugcuccucaagcuccgccagcgcguccucuuccuccucgacggcuacaacgaguucaagccccagaacugccccgagaucgaggcccucaucaaggagaaccaccgcuucaagaacauggucaucgucaccaccaccaccgagugccuccgccacauccgccaguucggcgcccucaccgccgaggucggcgacaugaccgaggacuccgcccaggcccucauccgcgagguccucaucaaggagcucgccgagggccuccuccuccagauccagaagucccgcugccuccgcaaccucaugaagaccccccucuucgucgucaucaccugcgccauccagaugggcgaguccgaguuccacucccacacccagaccacccucuuccacaccuucuacgaccuccucauccagaagaacaagcacaagcacaagggcgucgccgccuccgacuucauccgcucccucgaccacugcggcgaccucgcccucgagggcgucuucucccacaaguucgacuucgagcuccaggacgucuccuccgucaacgaggacguccuccucaccaccggccuccucugcaaguacaccgcccagcgcuucaagcccaaguacaaguucuuccacaaguccuuccaggaguacaccgccggccgccgccucuccucccuccucaccucccacgagcccgaggaggucaccaagggcaacggcuaccuccagaagauggucuccaucuccgacaucaccuccaccuacuccucccuccuccgcuacaccugcggcuccuccgucgaggccacccgcgccgucaugaagcaccucgccgccgucuaccagcacggcugccuccucggccucuccaucgccaagcgcccccucuggcgccaggagucccuccaguccgucaagaacaccaccgagcaggagauccucaaggccaucaacaucaacuccuucgucgagugcggcauccaccucuaccaggaguccaccuccaaguccgcccucucccaggaguucgaggccuucuuccagggcaagucccucuacaucaacuccggcaacauccccgacuaccucuucgacuucuucgagcaccuccccaacugcgccuccgcccucgacuucaucaagcucgacuucuacggcggcgccauggccuccugggagaaggccgccgaggacaccggcggcauccacauggaggaggcccccgagaccuacauccccucccgcgccgucucccucuucuucaacuggaagcaggaguuccgcacccucgaggucacccuccgcgacuucuccaagcucaacaagcaggacauccgcuaccucggcaagaucuucuccuccgccaccucccuccgccuccagaucaagcgcugcgccggcgucgccggcucccucucccucguccucuccaccugcaagaacaucuacucccucauggucgaggccuccccccucaccaucgaggacgagcgccacaucaccuccgucaccaaccucaagacccucuccauccacgaccuccagaaccagcgccuccccggcggccucaccgacucccucggcaaccucaagaaccucaccaagcucaucauggacaacaucaagaugaacgaggaggacgccaucaagcucgccgagggccucaagaaccucaagaagaugugccucuuccaccucacccaccucuccgacaucggcgagggcauggacuacaucgucaagucccucuccuccgagcccugcgaccucgaggagauccagcucgucuccugcugccucuccgccaacgccgucaagauccucgcccagaaccuccacaaccucgucaagcucuccauccucgaccucuccgagaacuaccucgagaaggacggcaacgaggcccuccacgagcucaucgaccgcaugaacguccucgagcagcucaccgcccucaugcuccccuggggcugcgacguccagggcucccucuccucccuccucaagcaccucgaggaggucccccagcucgucaagcucggccucaagaacuggcgccucaccgacaccgagauccgcauccucggcgccuucuucggcaagaacccccucaagaacuuccagcagcucaaccucgccggcaaccgcgucuccuccgacggcuggcucgccuucaugggcgucuucgagaaccucaagcagcucgucuucuucgacuucuccaccaaggaguuccuccccgaccccgcccucguccgcaagcucucccagguccucuccaagcucaccuuccuccaggaggcccgccucgucggcuggcaguucgacgacgacgaccucuccgucaucaccggcgccuucaagcucgucaccgccuga

SEQ ID NO: 8938 - RNA, 3075 nt, Artificial Sequence
  derived and/or modified sequence opt3 from l_IPAF__Homo_sapiens__AAH31555
augaacuucaucaaggacaauagcagagcccugauucagaggaugggcaugaccgugauaaaacaaaucacagaugaccucuuugucuggaacguucuuaaucgggaggaagugaacauuaucugcugugagaagguagaacaggaugcugcacgcgggauuauccacaugauacugaaaaagggauccgagucuugcaauuuguucuuaaaaucacugaaggaauggaacuacccccuauuucaggaccucaauggucagagucuguuccaucaaacuagcgagggcgaucuugacgaucuggcccaggacuugaaggaucucuaucacacgccuuccuuucugaacuucuacccacugggggaggacaucgauauuaucuuuaaucucaaaucuaccuucacagaaccgguguuauggcgaaaggaccagcaucaccaucgugucgagcagcugacucuuaacggauugcugcaagcgcuacagucgcccuguauuaucgaaggcgagucagguaaaggaaagagcacccuccugcagagaauagcuaugcuuuggggaaguggcaaaugcaaggcccugacaaaguuuaaauucguguuuuucuugaggcucucccgggcacagggcgggcuguuugagaccuuaugugaucaacugcucgacauuccuggaacuauccgcaagcagacauucauggccaugcuucugaaauugagacagaggguucuauuccugcucgacgguuauaaugaauuuaagccacaaaacugccccgagauugaagcucugaucaaagagaaucaccgguucaagaacauggugaucgucaccacgacuaccgaaugucuucgccacauucgacaguuuggcgcacugacagccgaggugggggauaugacugaggacucugcucaggccuugauaagagaaguacucaucaaagagcuggcggaaggauuacugcuacagauucaaaaguccaggugccuccggaaucugaugaagaccccucuuuucguugugaucacaugugcaauacagaugggcgagagcgaauuucauucacacacccagacgacuuuguuccauacauuuuacgaucugcucauucagaaaaacaagcacaaacacaagggugucgccgcuagugacuucauccguagccuggaucauugcggggaccuugcccuggagggaguguuuucucacaaauucgauuuugaguugcaagacguguccucagucaacgaagauguucuccugaccacuggcuuacuguguaaguauacagcacagcgcuucaagccaaaauacaaguuuuuccauaagagcuuccaggaguauaccgcuggcagaaggcuaaguucucuccugacgucccacgaacccgaggaagugaccaaagggaauggauaccuucagaaaaugguaagcaucucggacauuacaucuacuuacuccucauugcugcgguauaccugcgguaguagcguggaggccacacgagcggucaugaagcaucucgccgcaguguaccaacacggcugccuguuagggcuguccaucgcuaagcgcccucuuuggagacaggagucuuugcagagcguuaaaaacacuaccgaacaggagauucucaaggccauaaauaucaacucauuuguggaaugugggauucaccuguaucaagagaguacauccaaaagcgcucuaucucaggaguucgaagccuuuuuccagggcaagucacuguacaucaauagugguaacaucccagauuaucucuuugacuucuuugagcaucugccgaauugcgcaagcgcccuugacuucauuaaauuggauuuuuacgggggcgcuauggcguccugggaaaaggcagccgaggacaccggaggcauacacauggaagaggcucccgagacuuauaucccuucuagggccgucucgcuguucuuuaacuggaagcaagaguuccggacguuagaagugacacuccgcgauuuuagcaaacugaauaagcaggacauuagauaccuugggaaaaucuucuccucagcaaccagucugagguugcagauuaagcguugugccggaguagcugguucucucagccugguucuauccacuugcaaaaacaucuacucacugaugguggaagccagcccacucaccauagaggaugaacggcauaucacaucugucaccaaucugaagacucuuuccauucacgacuugcagaaccaacgacugcccggcggguuaacagauagucucggaaaucugaaaaaccuuacgaagcugaucauggacaauauuaagaugaacgaggaggaugcaaucaaacuagcggaaggccucaagaaccugaaaaagauguguuuguuccaccugacccauuuaagcgacauaggugaggggauggauuauauugugaaaucucucuccucagaaccuugcgaccuggaggaaauccagcuugucaguuguugccugagcgcuaaugccgugaagauuuuggcacagaaccuccacaaucugguuaagcuaucgauccuggaucuuuccgagaacuaccucgagaaagacggcaaugaagcccugcaugaguugauagacagaaugaacgugcuggaacaguuaacugcucucaugcugccauggggaugugauguacaaggcucucuuagcucacuguugaagcaccucgaggaggucccccagcuggugaaacuagggcugaagaauuggaggcuuacagacaccgaaauccgcauucucggagccuuuuucgguaaaaacccgcugaagaauuuucagcaguugaacuuagcaggcaaucggguuaguuccgauggguggcuggcuuucaugggaguguuugagaaccucaagcaacuggucuucuuugacuucucuacaaaagaauuucuuccugaucccgcccuggugagaaaguugagccagguacuauccaaacugacuuuccuccaggaggcgaggcuggugggcuggcaauuugacgaugacgaucuuucaguuaucaccggugccuucaaguuagucacggcuuga

SEQ ID NO: 8939 - RNA, 3075 nt, Artificial Sequence
  derived and/or modified sequence opt4 from l_IPAF__Homo_sapiens__AAH31555
augaacuucaucaaggacaacagcagagcccugauccagagaaugggcaugaccgugaucaagcagaucaccgacgaccuguucguguggaacgugcugaacagagaggaggugaacaucaucugcugcgagaagguggagcaggacgccgccagaggcaucauccacaugauccugaagaagggcagcgagagcugcaaccuguuccugaagagccugaaggaguggaacuacccccuguuccaggaccugaacggccagagccuguuccaccagaccagcgagggcgaccuggacgaccuggcccaggaccugaaggaccuguaccacacccccagcuuccugaacuucuacccccugggcgaggacaucgacaucaucuucaaccugaagagcaccuucaccgagcccgugcuguggagaaaggaccagcaccaccacagaguggagcagcugacccugaacggccugcugcaggcccugcagagccccugcaucaucgagggcgagagcggcaagggcaagagcacccugcugcagagaaucgccaugcuguggggcagcggcaagugcaaggcccugaccaaguucaaguucguguucuuccugagacugagcagagcccagggcggccuguucgagacccugugcgaccagcugcuggacauccccggcaccaucagaaagcagaccuucauggccaugcugcugaagcugagacagagagugcuguuccugcuggacggcuacaacgaguucaagccccagaacugccccgagaucgaggcccugaucaaggagaaccacagauucaagaacauggugaucgugaccaccaccaccgagugccugagacacaucagacaguucggcgcccugaccgccgaggugggcgacaugaccgaggacagcgcccaggcccugaucagagaggugcugaucaaggagcuggccgagggccugcugcugcagauccagaagagcagaugccugagaaaccugaugaagaccccccuguucguggugaucaccugcgccauccagaugggcgagagcgaguuccacagccacacccagaccacccuguuccacaccuucuacgaccugcugauccagaagaacaagcacaagcacaagggcguggccgccagcgacuucaucagaagccuggaccacugcggcgaccuggcccuggagggcguguucagccacaaguucgacuucgagcugcaggacgugagcagcgugaacgaggacgugcugcugaccaccggccugcugugcaaguacaccgcccagagauucaagcccaaguacaaguucuuccacaagagcuuccaggaguacaccgccggcagaagacugagcagccugcugaccagccacgagcccgaggaggugaccaagggcaacggcuaccugcagaagauggugagcaucagcgacaucaccagcaccuacagcagccugcugagauacaccugcggcagcagcguggaggccaccagagccgugaugaagcaccuggccgccguguaccagcacggcugccugcugggccugagcaucgccaagagaccccuguggagacaggagagccugcagagcgugaagaacaccaccgagcaggagauccugaaggccaucaacaucaacagcuucguggagugcggcauccaccuguaccaggagagcaccagcaagagcgcccugagccaggaguucgaggccuucuuccagggcaagagccuguacaucaacagcggcaacauccccgacuaccuguucgacuucuucgagcaccugcccaacugcgccagcgcccuggacuucaucaagcuggacuucuacggcggcgccauggccagcugggagaaggccgccgaggacaccggcggcauccacauggaggaggcccccgagaccuacauccccagcagagccgugagccuguucuucaacuggaagcaggaguucagaacccuggaggugacccugagagacuucagcaagcugaacaagcaggacaucagauaccugggcaagaucuucagcagcgccaccagccugagacugcagaucaagagaugcgccggcguggccggcagccugagccuggugcugagcaccugcaagaacaucuacagccugaugguggaggccagcccccugaccaucgaggacgagagacacaucaccagcgugaccaaccugaagacccugagcauccacgaccugcagaaccagagacugcccggcggccugaccgacagccugggcaaccugaagaaccugaccaagcugaucauggacaacaucaagaugaacgaggaggacgccaucaagcuggccgagggccugaagaaccugaagaagaugugccuguuccaccugacccaccugagcgacaucggcgagggcauggacuacaucgugaagagccugagcagcgagcccugcgaccuggaggagauccagcuggugagcugcugccugagcgccaacgccgugaagauccuggcccagaaccugcacaaccuggugaagcugagcauccuggaccugagcgagaacuaccuggagaaggacggcaacgaggcccugcacgagcugaucgacagaaugaacgugcuggagcagcugaccgcccugaugcugcccuggggcugcgacgugcagggcagccugagcagccugcugaagcaccuggaggaggugccccagcuggugaagcugggccugaagaacuggagacugaccgacaccgagaucagaauccugggcgccuucuucggcaagaacccccugaagaacuuccagcagcugaaccuggccggcaacagagugagcagcgacggcuggcuggccuucaugggcguguucgagaaccugaagcagcugguguucuucgacuucagcaccaaggaguuccugcccgaccccgcccuggugagaaagcugagccaggugcugagcaagcugaccuuccugcaggaggccagacuggugggcuggcaguucgacgacgacgaccugagcgugaucaccggcgccuucaagcuggugaccgccuga

SEQ ID NO: 8940 - RNA, 3075 nt, Artificial Sequence
  derived and/or modified sequence opt5 from l_IPAF__Homo_sapiens__AAH31555
augaacuucaucaaggacaauagcagagcccugauucagcggaugggcaugaccgugaucaaacaaauuacagaugaccucuuugucuggaacguucugaaucgcgaggaagugaacaucauuugcugugagaagguggaacaggaugcugccagagggaucauccacaugauucuuaaaaagggauccgagucuugcaaucuguuccucaaaagccugaaggaauggaacuacccccuuuuucaggaccugaauggccagucccucuuccaucaaacgucugagggggaucuggacgaucuggcgcaggaccucaaggaucuguaucacaccccuagcuuucuuaacuucuacccgcugggagaggacaucgauauuaucuuuaaucucaaauccacauucaccgaacccguccuguggcggaaggaccagcaucaccaucgcguggagcagcuuacacugaacggccuccugcaagcucugcagucuccuuguauuaucgaaggggagagcggaaaaggcaaguccacccuccugcagagaauugccaugcuuuggggcagcgggaaaugcaaggcccugacaaaguuuaaauucguuuucuuccuccggcugucucgcgcucagggaggccuuuuugagacccugugugaucaacuccuggacauccccgggacgaucagaaagcagaccuucauggccaugcugcucaaacugcggcagcgcgugcuuuuccugcucgacggauauaaugaauuuaagccucaaaacugccccgagauugaagcucugaucaaagagaaucacagauucaagaacauggucauugugacaaccacaaccgaaugucuucggcacauccgccaguuuggcgcccugacggcggagguuggggauaugacagaggacuccgcccaggcucucauuagagaagugcugaucaaagagcuggccgaaggacuccugcuucagauccaaaagagccggugccugcgcaaucucaugaagaccccucuguucgucgugauuacaugugcuauccagaugggcgagucugaauuucauucccacacccagaccacacuguuccauacguuuuacgaucuucucauucagaaaaacaagcacaaacacaagggcguggccgcgagcgacuucaucagaucucuggaucauugcggggaccuggcccucgagggagucuuuucccacaaauucgauuuugagcugcaagacguuagcuccgugaacgaagaugugcuucugaccacaggccuccuguguaaguauaccgcucagcgguucaagccgaaauacaaguuuuuccauaaaucuuuccaggaguauacagccgggagacgccugagcucccuucucaccagccacgaacccgaggaagucacgaagggaaauggcuaccugcagaaaauggugucuauuuccgacaucacaagcaccuacucuagccugcuccgguauaccugcggguccucuguugaggcuacaagagccgugaugaagcaucuggccgcugucuaccaacacggaugccuucugggccucagcaucgcgaagcgcccucuguggcggcaggagucccugcagagcgugaaaaacaccacagaacaggagauucuuaaggccaucaauauuaacucuuuuguugaauguggcauccaccucuaucaagaguccacgagcaaaucugcucugucccaggaguucgaagccuuuuuccagggaaagagccuguacauuaauuccgggaacauccccgauuaucucuuugacuucuuugagcaucugccuaauugcgccucugcucuugacuucauuaaacuggauuuuuacggcggggccauggcgagcugggaaaaggcugccgaggacaccggaggcauccacauggaagaggcccccgagacauauaucccguccagagcugugucucucuucuuuaacuggaagcaagaauuucgcacccuggaggucacacugcgggauuuuagcaaacuuaauaagcaggacauuagauaccucgggaaaaucuucuccagcgccaccucucugcgccugcagauuaagcggugugcuggcguggccggaucccucagccugguccuuucuacgugcaaaaacaucuacucccugaugguggaagcgagcccucucaccauugaggaugaaagacauaucacaucuguuaccaaucugaagacacugagcauccacgaccuucagaaccaacgccugcccggcgggcucaccgauucccugggaaaucucaaaaaccugacgaaacuuauuauggacaauaucaagaugaacgaggaggaugccauuaagcuggcugaaggccucaagaaccugaaaaagaugugucuguuccaccuuacacaucugagcgacaucggggagggaauggauuauauugugaaaucucucuccagcgaaccuugcgaccuggaggaaauccagcucgucuccuguugccugucugccaaugcugugaagauccuugcccagaaccugcacaaucucguuaagcugagcauucuggaucuuuccgagaacuaccuggagaaagacggcaaugaagcgcuccaugagcugaucgaccggaugaacgugcucgaacagcugaccgcccuuaugcugcccugggggugugauguccaaggcucucugagcucccuccugaagcaccuugaggaggugccccagcuggugaaacucggacugaagaauuggagacucacagacaccgaaauucggauccugggcgccuuuuucgggaaaaacccucuuaagaauuuucagcagcugaaccuggcuggaaaucgcguuucuagcgauggcuggcucgcuuucaugggggucuuugagaaccugaagcaacuuguguucuuugacuucuccaccaaagaauuucugccggaucccgcccucgugagaaagcugagccagguccucucuaaacugacauuccuucaggaggcccggcuggugggauggcaauuugacgaugacgaucuguccguuauuacgggcgcuuucaagcucgugaccgcguga

SEQ ID NO: 8941 - protein, 1025 aa, Artificial Sequence
  MDA5__Homo_sapiens__Q9BYX4
MSNGYSTDENFRYLISCFRARVKMYIQVEPVLDYLTFLPAEVKEQIQRTVATSGNMQAVELLLSTLEKGVWHLGWTREFVEALRRTGSPLAARYMNPELTDLPSPSFENAHDEYLQLLNLLQPTLVDKLLVRDVLDKCMEEELLTIEDRNRIAAAENNGNESGVRELLKRIVQKENWFSAFLNVLRQTGNNELVQELTGSDCSESNAEIENLSQVDGPQVEEQLLSTTVQPNLEKEVWGMENNSSESSFADSSVVSESDTSLAEGSVSCLDESLGHNSNMGSDSGTMGSDSDEENVAARASPEPELQLRPYQMEVAQPALEGKNIIICLPTGSGKTRVAVYIAKDHLDKKKKASEPGKVIVLVNKVLLVEQLFRKEFQPFLKKWYRVIGLSGDTQLKISFPEVVKSCDIIISTAQILENSLLNLENGEDAGVQLSDFSLIIIDECHHTNKEAVYNNIMRHYLMQKLKNNRLKKENKPVIPLPQILGLTASPGVGGATKQAKAEEHILKLCANLDAFTIKTVKENLDQLKNQIQEPCKKFAIADATREDPFKEKLLEIMTRIQTYCQMSPMSDFGTQPYEQWAIQMEKKAAKEGNRKERVCAEHLRKYNEALQINDTIRMIDAYTHLETFYNEEKDKKFAVIEDDSDEGGDDEYCDGDEDEDDLKKPLKLDETDRFLMTLFFENNKMLKRLAENPEYENEKLTKLRNTIMEQYTRTEESARGIIFTKTRQSAYALSQWITENEKFAEVGVKAHHLIGAGHSSEFKPMTQNEQKEVISKFRTGKINLLIATTVAEEGLDIKECNIVIRYGLVTNEIAMVQARGRARADESTYVLVAHSGSGVIEHETVNDFREKMMYKAIHCVQNMKPEEYAHKILELQMQSIMEKKMKTKRNIAKHYKNNPSLITFLCKNCSVLACSGEDIHVIEKMHHVNMTPEFKELYIVRENKALQKKCADYQINGEIICKCGQAWGTMMVHKGLDLPCLKIRNFVVVFKNNSTKKQYKKWVELPITFPNLDYSECCLFSDED

SEQ ID NO: 8942 - RNA, 3078 nt, Artificial Sequence
  MDA5__Homo_sapiens__CCDS2217.1
augucgaauggguauuccacagacgagaauuuccgcuaucucaucucgugcuucagggccagggugaaaauguacauccagguggagccugugcuggacuaccugaccuuucugccugcagaggugaaggagcagauucagaggacagucgccaccuccgggaacaugcaggcaguugaacugcugcugagcaccuuggagaagggagucuggcaccuugguuggacucgggaauucguggaggcccuccggagaaccggcagcccucuggccgcccgcuacaugaacccugagcucacggacuugcccucuccaucguuugagaacgcucaugaugaauaucuccaacugcugaaccuccuucagcccacucugguggacaagcuucuaguuagagacgucuuggauaagugcauggaggaggaacuguugacaauugaagacagaaaccggauugcugcugcagaaaacaauggaaaugaaucagguguaagagagcuacuaaaaaggauugugcagaaagaaaacugguucucugcauuucugaauguucuucgucaaacaggaaacaaugaacuuguccaagaguuaacaggcucugauugcucagaaagcaaugcagagauugagaauuuaucacaaguugaugguccucaaguggaagagcaacuucuuucaaccacaguucagccaaaucuggagaaggaggucuggggcauggagaauaacucaucagaaucaucuuuugcagauucuucuguaguuucagaaucagacacaaguuuggcagaaggaagugucagcugcuuagaugaaagucuuggacauaacagcaacaugggcagugauucaggcaccaugggaagugauucagaugaagagaauguggcagcaagagcauccccggagccagaacuccagcucaggccuuaccaaauggaaguugcccagccagccuuggaagggaagaauaucaucaucugccucccuacagggaguggaaaaaccagaguggcuguuuacauugccaaggaucacuuagacaagaagaaaaaagcaucugagccuggaaaaguuauaguucuugucaauaagguacugcuaguugaacagcucuuccgcaaggaguuccaaccauuuuugaagaaaugguaucguguuauuggauuaaguggugauacccaacugaaaauaucauuuccagaaguugucaaguccugugauauuauuaucaguacagcucaaauccuugaaaacucccucuuaaacuuggaaaauggagaagaugcugguguucaauugucagacuuuucccucauuaucauugaugaaugucaucacaccaacaaagaagcaguguauaauaacaucaugaggcauuauuugaugcagaaguugaaaaacaauagacucaagaaagaaaacaaaccagugauuccccuuccucagauacugggacuaacagcuucaccugguguuggaggggccacgaagcaagccaaagcugaagaacacauuuuaaaacuaugugccaaucuugaugcauuuacuauuaaaacuguuaaagaaaaccuugaucaacugaaaaaccaaauacaggagccaugcaagaaguuugccauugcagaugcaaccagagaagauccauuuaaagagaaacuucuagaaauaaugacaaggauucaaacuuauugucaaaugaguccaaugucagauuuuggaacucaacccuaugaacaaugggccauucaaauggaaaaaaaagcugcaaaagaaggaaaucgcaaagaacguguuugugcagaacauuugaggaaguacaaugaggcccuacaaauuaaugacacaauucgaaugauagaugcguauacucaucuugaaacuuucuauaaugaagagaaagauaagaaguuugcagucauagaagaugauagugaugaggguggugaugaugaguauugugauggugaugaagaugaggaugauuuaaagaaaccuuugaaacuggaugaaacagauagauuucucaugacuuuauuuuuugaaaacaauaaaauguugaaaaggcuggcugaaaacccagaauaugaaaaugaaaagcugaccaaauuaagaaauaccauaauggagcaauauacuaggacugaggaaucagcacgaggaauaaucuuuacaaaaacacgacagagugcauaugcgcuuucccaguggauuacugaaaaugaaaaauuugcugaaguaggagucaaagcccaccaucugauuggagcuggacacagcagugaguucaaacccaugacacagaaugaacaaaaagaagucauuaguaaauuucgcacuggaaaaauaaaucugcuuaucgcuaccacaguggcagaagaaggucuggauauuaaagaauguaacauuguuauccguuauggucucgucaccaaugaaauagccaugguccaggcccguggucgagccagagcugaugagagcaccuacguccugguugcucacagugguucaggaguuaucgaacaugagacaguuaaugauuuccgagagaagaugauguauaaagcuauacauuguguucaaaauaugaaaccagaggaguaugcucauaagauuuuggaauuacagaugcaaaguauaauggaaaagaaaaugaaaaccaagagaaauauugccaagcauuacaagaauaacccaucacuaauaacuuuccuuugcaaaaacugcagugugcuagccuguucuggggaagauauccauguaauugagaaaaugcaucacgucaauaugaccccagaauucaaggaacuuuacauuguaagagaaaacaaagcacugcaaaagaagugugccgacuaucaaauaaauggugaaaucaucugcaaauguggccaggcuuggggaacaaugauggugcacaaaggcuuagauuugccuugucucaaaauaaggaauuuuguagugguuuucaaaaauaauucaacaaagaaacaauacaaaaaguggguagaauuaccuaucacauuucccaaucuugacuauucagaaugcuguuuauuuagugaugaggauuag

SEQ ID NO: 8943 - RNA, 3078 nt, Artificial Sequence
  derived and/or modified sequence opt1 from MDA5__Homo_sapiens__CCDS2217.1
augagcaacggcuacuccaccgacgagaacuuccgcuaccugaucagcugcuuccgggcccgcgugaagauguacauccaggucgagcccgugcucgacuaccugaccuuccugccggccgaggugaaggagcagauccagcggacggucgcgaccuccgggaacaugcaggccguggagcuccugcugagcacccucgagaagggcguguggcaccugggguggacccgcgaguucgucgaggcccugcggcgcacgggcagcccccucgccgcccgguacaugaaccccgagcugaccgaccugcccuccccguccuucgagaacgcgcacgacgaguaccuccagcugcugaaccuccugcagcccacccugguggacaagcuccuggugcgcgacguccuggacaagugcauggaggaggagcuccugaccaucgaggaccggaaccgcaucgccgccgccgagaacaacgggaacgagagcggcgugcgggagcugcucaagcgcaucgugcagaaggagaacugguucuccgcguuccugaacguccugcggcagacgggcaacaacgagcucgugcaggagcugaccgggagcgacugcuccgagagcaacgccgagaucgagaaccugucccagguggacggcccccaggucgaggagcagcuccugagcaccaccgugcagcccaaccuggagaaggaggugugggggauggagaacaacuccagcgaguccagcuucgccgacuccagcgucgugagcgaguccgacacgagccucgccgagggcuccgugagcugccuggacgagucccuggggcacaacagcaacaugggcuccgacagcggcaccaugggguccgacagcgacgaggagaacgucgccgcgcgcgccuccccggagcccgagcuccagcugcggcccuaccagauggagguggcccagcccgcccuggagggcaagaacaucaucaucugccucccgaccgggagcggcaagacccgcguggccgucuacaucgcgaaggaccaccuggacaagaagaagaaggccuccgagcccggcaaggugaucguccuggugaacaaggugcuccuggucgagcagcuguuccggaaggaguuccagcccuuccucaagaagugguaccgcgugaucgggcugagcggcgacacgcagcugaagaucuccuuccccgagguggucaagagcugcgacaucaucaucuccaccgcccagauccucgagaacagccugcugaaccuggagaacggggaggacgccggcgugcagcucuccgacuucagccugaucaucaucgacgagugccaccacaccaacaaggaggccguguacaacaacaucaugcggcacuaccugaugcagaagcucaagaacaaccgccugaagaaggagaacaagccggucaucccccugccccagauccucgggcugaccgcgagccccggcgugggcggggccacgaagcaggccaaggccgaggagcacauccugaagcucugcgccaaccuggacgcguucaccaucaagaccgugaaggagaaccuggaccagcucaagaaccagauccaggagccgugcaagaaguucgccaucgccgacgccacccgggaggaccccuucaaggagaagcugcuggagaucaugacgcgcauccagaccuacugccagaugucccccaugagcgacuucggcacccagcccuacgagcagugggcgauccagauggagaagaaggccgccaaggaggggaaccgcaaggagcgggucugcgccgagcaccuccgcaaguacaacgaggcccugcagaucaacgacaccauccggaugaucgacgcguacacgcaccuggagaccuucuacaacgaggagaaggacaagaaguucgccgugaucgaggacgacuccgacgagggcggggacgacgaguacugcgacggcgacgaggacgaggacgaccucaagaagccgcugaagcuggacgagaccgaccgcuuccucaugacccuguucuucgagaacaacaagaugcugaagcggcucgccgagaaccccgaguacgagaacgagaagcugacgaagcugcgcaacaccaucauggagcaguacacccggaccgaggagagcgcccgcggcaucaucuucacgaagacccggcaguccgccuacgcgcucagccaguggaucaccgagaacgagaaguucgccgaggugggggucaaggcccaccaccugaucggcgccgggcacuccagcgaguucaagcccaugacccagaacgagcagaaggaggugaucuccaaguuccgcaccggcaagaucaaccugcucaucgccacgaccguggcggaggaggggcuggacaucaaggagugcaacaucgucauccgguacggccuggugaccaacgagaucgccauggugcaggcccgcggccgggcccgcgcggacgagagcaccuacguccucguggcccacuccgggagcggcgugaucgagcacgagacggucaacgacuuccgggagaagaugauguacaaggccauccacugcgugcagaacaugaagcccgaggaguacgcccacaagauccuggagcugcagaugcaguccaucauggagaagaagaugaagaccaagcgcaacaucgccaagcacuacaagaacaacccgagccucaucaccuuccugugcaagaacugcuccgugcuggcgugcagcggggaggacauccacgucaucgagaagaugcaccacgugaacaugacccccgaguucaaggagcucuacaucgugcgggagaacaaggcccugcagaagaagugcgccgacuaccagaucaacggcgagaucaucugcaagugcggccaggccugggggacgaugaugguccacaagggccuggaccuccccugccugaagauccgcaacuucgugguggucuucaagaacaacuccaccaagaagcaguacaagaaguggguggagcugccgaucaccuuccccaaccucgacuacagcgagugcugccuguucagcgacgaggacuga

SEQ ID NO: 8944 - RNA, 3078 nt, Artificial Sequence
  derived and/or modified sequence opt2 from MDA5__Homo_sapiens__CCDS2217.1
auguccaacggcuacuccaccgacgagaacuuccgcuaccucaucuccugcuuccgcgcccgcgucaagauguacauccaggucgagcccguccucgacuaccucaccuuccuccccgccgaggucaaggagcagauccagcgcaccgucgccaccuccggcaacaugcaggccgucgagcuccuccucuccacccucgagaagggcgucuggcaccucggcuggacccgcgaguucgucgaggcccuccgccgcaccggcuccccccucgccgcccgcuacaugaaccccgagcucaccgaccuccccucccccuccuucgagaacgcccacgacgaguaccuccagcuccucaaccuccuccagcccacccucgucgacaagcuccucguccgcgacguccucgacaagugcauggaggaggagcuccucaccaucgaggaccgcaaccgcaucgccgccgccgagaacaacggcaacgaguccggcguccgcgagcuccucaagcgcaucguccagaaggagaacugguucuccgccuuccucaacguccuccgccagaccggcaacaacgagcucguccaggagcucaccggcuccgacugcuccgaguccaacgccgagaucgagaaccucucccaggucgacggcccccaggucgaggagcagcuccucuccaccaccguccagcccaaccucgagaaggaggucuggggcauggagaacaacuccuccgaguccuccuucgccgacuccuccgucgucuccgaguccgacaccucccucgccgagggcuccgucuccugccucgacgagucccucggccacaacuccaacaugggcuccgacuccggcaccaugggcuccgacuccgacgaggagaacgucgccgcccgcgccucccccgagcccgagcuccagcuccgccccuaccagauggaggucgcccagcccgcccucgagggcaagaacaucaucaucugccuccccaccggcuccggcaagacccgcgucgccgucuacaucgccaaggaccaccucgacaagaagaagaaggccuccgagcccggcaaggucaucguccucgucaacaagguccuccucgucgagcagcucuuccgcaaggaguuccagcccuuccucaagaagugguaccgcgucaucggccucuccggcgacacccagcucaagaucuccuuccccgaggucgucaaguccugcgacaucaucaucuccaccgcccagauccucgagaacucccuccucaaccucgagaacggcgaggacgccggcguccagcucuccgacuucucccucaucaucaucgacgagugccaccacaccaacaaggaggccgucuacaacaacaucaugcgccacuaccucaugcagaagcucaagaacaaccgccucaagaaggagaacaagcccgucaucccccucccccagauccucggccucaccgccucccccggcgucggcggcgccaccaagcaggccaaggccgaggagcacauccucaagcucugcgccaaccucgacgccuucaccaucaagaccgucaaggagaaccucgaccagcucaagaaccagauccaggagcccugcaagaaguucgccaucgccgacgccacccgcgaggaccccuucaaggagaagcuccucgagaucaugacccgcauccagaccuacugccagaugucccccauguccgacuucggcacccagcccuacgagcagugggccauccagauggagaagaaggccgccaaggagggcaaccgcaaggagcgcgucugcgccgagcaccuccgcaaguacaacgaggcccuccagaucaacgacaccauccgcaugaucgacgccuacacccaccucgagaccuucuacaacgaggagaaggacaagaaguucgccgucaucgaggacgacuccgacgagggcggcgacgacgaguacugcgacggcgacgaggacgaggacgaccucaagaagccccucaagcucgacgagaccgaccgcuuccucaugacccucuucuucgagaacaacaagaugcucaagcgccucgccgagaaccccgaguacgagaacgagaagcucaccaagcuccgcaacaccaucauggagcaguacacccgcaccgaggaguccgcccgcggcaucaucuucaccaagacccgccaguccgccuacgcccucucccaguggaucaccgagaacgagaaguucgccgaggucggcgucaaggcccaccaccucaucggcgccggccacuccuccgaguucaagcccaugacccagaacgagcagaaggaggucaucuccaaguuccgcaccggcaagaucaaccuccucaucgccaccaccgucgccgaggagggccucgacaucaaggagugcaacaucgucauccgcuacggccucgucaccaacgagaucgccaugguccaggcccgcggccgcgcccgcgccgacgaguccaccuacguccucgucgcccacuccggcuccggcgucaucgagcacgagaccgucaacgacuuccgcgagaagaugauguacaaggccauccacugcguccagaacaugaagcccgaggaguacgcccacaagauccucgagcuccagaugcaguccaucauggagaagaagaugaagaccaagcgcaacaucgccaagcacuacaagaacaaccccucccucaucaccuuccucugcaagaacugcuccguccucgccugcuccggcgaggacauccacgucaucgagaagaugcaccacgucaacaugacccccgaguucaaggagcucuacaucguccgcgagaacaaggcccuccagaagaagugcgccgacuaccagaucaacggcgagaucaucugcaagugcggccaggccuggggcaccaugaugguccacaagggccucgaccuccccugccucaagauccgcaacuucgucgucgucuucaagaacaacuccaccaagaagcaguacaagaagugggucgagcuccccaucaccuuccccaaccucgacuacuccgagugcugccucuucuccgacgaggacuga

SEQ ID NO: 8945 - RNA, 3078 nt, Artificial Sequence
  derived and/or modified sequence opt3 from MDA5__Homo_sapiens__CCDS2217.1
augagcaacggcuacuccaccgacgagaauuucagauaucugaucucuugcuuuagggcccgggugaagauguacauucaggucgaacccguucucgauuaucuuacauuccugccugcugaggugaaagaacaaauacagcgcacuguagcaacgucagggaacaugcaggccguggaguuguuacugaguacccuagaaaagggagucuggcaccucgguuggacacgagaguuuguggaggcgcugcguagaacuggcagcccacuugcugccagguacaugaauccggaacugaccgacuugcccuccccuucuuucgagaacgcacaugaugaauaucuccagcugcugaaucucuuacaaccaacacugguugacaaacuuuuggugcgggauguccuggacaaguguauggaggaggaacuacucaccaucgaggaucgcaacagaauugccgcugcagaaaauaacgggaaugagucgggagugagggaacugcuuaaacggaucguacagaaggagaacugguuuucagccuuccugaauguuuugcgccagacuggcaacaaugagcucgugcaggaacugacagguagcgacugcagugaguccaacgcugaaauugagaauuuaucucaagucgaugggccccagguggaagaacagcugcucagcaccacggugcagccuaaccuugagaaggaagucuggggaauggagaacaauuccucagaaaguagcuuugccgacucuuccguugugucagagagcgauaccagucuggcggaaggcucuguauccuguuuggacgagagccuaggccacaacucgaauauggggucugauuccggaacuauggguucagacagugacgaggaaaacguggcagcccgagcuagcccagagcccgaacugcaacucagaccuuaccagauggaggucgcccagccagcacuggagggcaaaaauaucauaaucugccuuccgacaggguccggaaagacuaggguggcuguuuauauugccaaagaucaucuggacaagaaaaagaaggcgucugaacccggcaaagugaucgucuuggugaacaagguacuccugguugagcaauuauuccggaaagaauuucagccuuuccugaagaaaugguaccgugugauuggucuaagcggggauacccagcucaagaucucauuuccagaggucgugaaaaguugugacauaauuaucuccacagcccagauucuggaaaauagccuuuugaaccuggagaauggagaggaugcaggcguccaacucucugacuucucacugaucaucauugaugaaugccaccauaccaacaaggaggcuguguacaauaacauaaugcgccacuaucuuaugcagaagcugaaaaauaacagauugaagaaagaaaauaagcccguuaucccucucccacagauucugggcuuaacggccagucccggggugggaggugcuacuaaacaggccaaggcagaggaacacauccugaagcuaugugccaaccucgacgcuuuuacaauaaaaaccguaaaggagaaccuggaucaacuuaaaaaucagauucaggagccgugcaagaaauucgcgaucgcagacgccacuagggaagauccuuucaaggagaaguugcuggaaaucaugacacggauucagaccuacugucaaaugagccccauguccgacuuuggcacgcagccauaugagcagugggcuauccagauggagaaaaaggccgcaaaagaggggaaccgaaaggagcgcgucugcgccgaacaucucagaaaauacaaugaggcucugcaaauuaacgacaccauaaggaugaucgaugccuauacacacuuagaaacuuucuacaaugaggagaaggacaagaaauuugcagugauugaagaugacucugaugagggaggcgacgaugaauauugugacggugaugaggacgaagaugaccugaagaaaccucuuaaguuggaugagaccgaccgguuccucaugacacuguuuuucgagaacaauaaaaugcuaaagcgccuggcggaaaaccccgaguacgaaaaugagaaacucacuaagcugagaaacaccaucauggaacaguacacaaggaccgaggagucggcucgugggaucauuuuuacuaagacgcggcagagcgccuaugcacuuucccaauggauaacagaaaaugagaaauucgccgaaguuggcgugaaggcucaucacuugaucggagccggccacucaagugaguuuaaaccaaugacccagaacgaacagaaggaggucauuucuaaauuccgaacugggaagaucaaucuguuaauugcaaccacaguggcugaggaaggacucgacaucaaggagugcaacauaguaaucagauacggucuggugaccaaugaaauugccaugguucaggcgaggggccgcgcccgggcugaugagagcacuuauguccuuguggcacauuccgggucaggagugaucgagcacgaaacagucaacgacuuuagagagaaaaugauguacaaggccauucauugcguucaaaacaugaaacccgaagaguaugcucacaagauccuggaauugcagaugcagagcauaauggagaaaaagaugaagacgaaaaggaauauugccaagcauuacaaaaacaauccuucucucaucaccuuccuguguaagaacugcuccgugcuagcauguaguggcgaggauauucacgugaucgagaaaaugcaccauguaaauaugacuccagaauuuaaggaacuguauauaguccgcgagaacaaggcgcuccagaaaaagugcgccgacuaccaaaucaauggugaaauuaucuguaaaugcgggcaggcuuggggcacaaugauggugcacaagggacuggaucuuccguguuugaaaauucgaaacuucguuguggucuucaagaauaacagcaccaaaaagcaguacaagaaauggguggagcugcccaucacauuuccuaauuuagacuauucugagugcugucucuucuccgaugaagacuga

SEQ ID NO: 8946 - RNA, 3078 nt, Artificial Sequence
  derived and/or modified sequence opt4 from MDA5__Homo_sapiens__CCDS2217.1
augagcaacggcuacagcaccgacgagaacuucagauaccugaucagcugcuucagagccagagugaagauguacauccagguggagcccgugcuggacuaccugaccuuccugcccgccgaggugaaggagcagauccagagaaccguggccaccagcggcaacaugcaggccguggagcugcugcugagcacccuggagaagggcguguggcaccugggcuggaccagagaguucguggaggcccugagaagaaccggcagcccccuggccgccagauacaugaaccccgagcugaccgaccugcccagccccagcuucgagaacgcccacgacgaguaccugcagcugcugaaccugcugcagcccacccugguggacaagcugcuggugagagacgugcuggacaagugcauggaggaggagcugcugaccaucgaggacagaaacagaaucgccgccgccgagaacaacggcaacgagagcggcgugagagagcugcugaagagaaucgugcagaaggagaacugguucagcgccuuccugaacgugcugagacagaccggcaacaacgagcuggugcaggagcugaccggcagcgacugcagcgagagcaacgccgagaucgagaaccugagccagguggacggcccccagguggaggagcagcugcugagcaccaccgugcagcccaaccuggagaaggagguguggggcauggagaacaacagcagcgagagcagcuucgccgacagcagcguggugagcgagagcgacaccagccuggccgagggcagcgugagcugccuggacgagagccugggccacaacagcaacaugggcagcgacagcggcaccaugggcagcgacagcgacgaggagaacguggccgccagagccagccccgagcccgagcugcagcugagacccuaccagauggagguggcccagcccgcccuggagggcaagaacaucaucaucugccugcccaccggcagcggcaagaccagaguggccguguacaucgccaaggaccaccuggacaagaagaagaaggccagcgagcccggcaaggugaucgugcuggugaacaaggugcugcugguggagcagcuguucagaaaggaguuccagcccuuccugaagaagugguacagagugaucggccugagcggcgacacccagcugaagaucagcuuccccgagguggugaagagcugcgacaucaucaucagcaccgcccagauccuggagaacagccugcugaaccuggagaacggcgaggacgccggcgugcagcugagcgacuucagccugaucaucaucgacgagugccaccacaccaacaaggaggccguguacaacaacaucaugagacacuaccugaugcagaagcugaagaacaacagacugaagaaggagaacaagcccgugaucccccugccccagauccugggccugaccgccagccccggcgugggcggcgccaccaagcaggccaaggccgaggagcacauccugaagcugugcgccaaccuggacgccuucaccaucaagaccgugaaggagaaccuggaccagcugaagaaccagauccaggagcccugcaagaaguucgccaucgccgacgccaccagagaggaccccuucaaggagaagcugcuggagaucaugaccagaauccagaccuacugccagaugagccccaugagcgacuucggcacccagcccuacgagcagugggccauccagauggagaagaaggccgccaaggagggcaacagaaaggagagagugugcgccgagcaccugagaaaguacaacgaggcccugcagaucaacgacaccaucagaaugaucgacgccuacacccaccuggagaccuucuacaacgaggagaaggacaagaaguucgccgugaucgaggacgacagcgacgagggcggcgacgacgaguacugcgacggcgacgaggacgaggacgaccugaagaagccccugaagcuggacgagaccgacagauuccugaugacccuguucuucgagaacaacaagaugcugaagagacuggccgagaaccccgaguacgagaacgagaagcugaccaagcugagaaacaccaucauggagcaguacaccagaaccgaggagagcgccagaggcaucaucuucaccaagaccagacagagcgccuacgcccugagccaguggaucaccgagaacgagaaguucgccgaggugggcgugaaggcccaccaccugaucggcgccggccacagcagcgaguucaagcccaugacccagaacgagcagaaggaggugaucagcaaguucagaaccggcaagaucaaccugcugaucgccaccaccguggccgaggagggccuggacaucaaggagugcaacaucgugaucagauacggccuggugaccaacgagaucgccauggugcaggccagaggcagagccagagccgacgagagcaccuacgugcugguggcccacagcggcagcggcgugaucgagcacgagaccgugaacgacuucagagagaagaugauguacaaggccauccacugcgugcagaacaugaagcccgaggaguacgcccacaagauccuggagcugcagaugcagagcaucauggagaagaagaugaagaccaagagaaacaucgccaagcacuacaagaacaaccccagccugaucaccuuccugugcaagaacugcagcgugcuggccugcagcggcgaggacauccacgugaucgagaagaugcaccacgugaacaugacccccgaguucaaggagcuguacaucgugagagagaacaaggcccugcagaagaagugcgccgacuaccagaucaacggcgagaucaucugcaagugcggccaggccuggggcaccaugauggugcacaagggccuggaccugcccugccugaagaucagaaacuucguggugguguucaagaacaacagcaccaagaagcaguacaagaaguggguggagcugcccaucaccuuccccaaccuggacuacagcgagugcugccuguucagcgacgaggacuga

SEQ ID NO: 8947 - RNA, 3078 nt, Artificial Sequence
  derived and/or modified sequence opt5 from MDA5__Homo_sapiens__CCDS2217.1
augagcaacggcuacuccaccgacgagaauuucagauaucugaucucuugcuuucgggcccgcgugaagauguacauucaggucgaacccguucucgauuaucugacauuccuuccugcugaggugaaagaacaaauccagagaacgguggccaccagcgggaacaugcaggcggucgagcugcuccuguccacacuugaaaagggaguguggcaccugggcuggacccgggaguuuguugaggcucuccgcagaacagggucuccgcuggccgcccgguacaugaaucccgaacugaccgaccucccuagccccuccuucgagaacgcucaugaugaauaucugcagcuucugaaucuccugcaaccuacacuuguggacaaacugcucguccgcgaugugcuggacaaguguauggaggaggaacugcucaccauugaggauagaaaccggaucgccgcugccgaaaauaacggaaaugagucuggcguucgcgaacugcuuaaaagaauugugcagaaggagaacugguuuagcgcguuccugaauguccuccggcagacggggaacaaugagcuggugcaggaacuuaccggauccgacugcagcgagucuaacgccgaaaucgagaaucugucccaaguggauggcccccaggucgaagaacagcuccugagcacaaccguucagccuaaccuggagaaggaaguguggggcauggagaacaauucuuccgaaagcucuuuugcugacuccagcguggucuccgagucugauacaagccucgccgaaggguccgugagcugucuggacgagucucuuggacacaacuccaauaugggcagcgauucugggaccaugggaagcgacuccgacgaggaaaacguugcugcccgcgcgucuccggagcccgaacugcaacucagaccuuaccagauggagguggcccagcccgcucuggagggcaaaaauaucauuaucugccuuccuacggggagcggaaagacacgggucgccguguauauugcuaaagaucaucuggacaagaaaaagaaggccuccgaacccggcaaaguuaucgugcucgucaacaaggugcugcuggucgagcaacucuuccgcaaagaauuucagccguuccugaagaaaugguacagagugauuggccuuagcggggauacccagcugaagaucucuuuuccugagguugugaaauccugugacauuaucaucagcacagcccagauucucgaaaauucucugcugaaccuugagaauggagaggaugcuggcguccaacucuccgacuucagccugaucauuaucgaugaaugccaccauaccaacaaggaggcgguguacaauaacauuaugcggcacuaucugaugcagaagcucaaaaauaacagacugaagaaagaaaauaagcccguuaucccucuuccccagauccuggggcucaccgccucccccggagugggcggggcuacaaaacaggccaaggccgaggaacacauucugaagcugugugcuaaccuugacgccuuuacgaucaaaaccgucaaggagaaccucgaucaacugaaaaaucagauucaggagccuugcaagaaauucgcgaucgcugacgccacacgcgaagauccguucaaggagaagcugcucgaaauuaugacccggauccagacauacugucaaaugucucccaugagcgacuuuggaacccagccuuaugagcagugggccauccagauggagaaaaaggcugccaaagagggcaacagaaaggagcgcgugugcgcugaacaucugcggaaauacaaugaggcccuucaaauuaacgacacgaucagaaugauugaugcguauacacaccuggaaaccuucuacaaugaggagaaggacaagaaauuugccgugaucgaagaugacuccgaugagggcggggacgaugaauauugugacggagaugaggacgaagaugaccucaagaaaccccugaagcuggaugagaccgaccgcuuccuuaugacacucuuuuucgagaacaauaaaaugcugaagcggcuggcugaaaacccugaguacgaaaaugagaaacucaccaagcugagaaacacaauuauggaacaguacacgcgcaccgaggagucugcccggggcaucauuuuuacaaagaccagacagagcgcuuaugcccuuucccaauggaucacagaaaaugagaaauucgcggaaguuggggucaaggcccaucaccugaucggagcuggccacagcucugaguuuaaacccaugacccagaacgaacagaaggaggugauuuccaaauuccgcacggggaagaucaaucuccugauugccaccacaguggcugaggaaggccuggacaucaaggagugcaacauugucauccgguacggacuugugaccaaugaaaucgccaugguucaggccagaggccgggcucgcgcggaugagagcacauaugugcucgucgcccauucuggguccggagugauugagcacgaaaccguuaacgacuuuagagagaaaaugauguacaaggcuauccauugcgugcaaaacaugaaaccggaagaguaugcccacaagauucuggaacugcagaugcagagcaucauggagaaaaagaugaagacgaaacggaauauugccaagcauuacaaaaacaauccuucucucaucacauuccuguguaagaacugcagcguccuugcuuguuccggcgaggauauccacgugauugagaaaaugcaccauguuaauaugacccccgaauuuaaggaacuguauaucgugagagagaacaaggcccuccagaaaaagugcgcggacuaccaaauuaauggggaaaucauuuguaaaugcggacaggcuuggggcacaaugaugguccacaaggggcuggaucugccuugucuuaaaauccgcaacuucgugguggucuucaagaauaacagcaccaaaaagcaguacaagaaauggguugagcugcccaucaccuuuccuaaucucgacuauucugagugcugucuguucuccgaugaagacuga

SEQ ID NO: 8948 - protein, 364 aa, Artificial Sequence
  MK11__Homo_sapiens__Q15759
MSGPRAGFYRQELNKTVWEVPQRLQGLRPVGSGAYGSVCSAYDARLRQKVAVKKLSRPFQSLIHARRTYRELRLLKHLKHENVIGLLDVFTPATSIEDFSEVYLVTTLMGADLNNIVKCQALSDEHVQFLVYQLLRGLKYIHSAGIIHRDLKPSNVAVNEDCELRILDFGLARQADEEMTGYVATRWYRAPEIMLNWMHYNQTVDIWSVGCIMAELLQGKALFPGSDYIDQLKRIMEVVGTPSPEVLAKISSEHARTYIQSLPPMPQKDLSSIFRGANPLAIDLLGRMLVLDSDQRVSAAEALAHAYFSQYHDPEDEPEAEPYDESVEAKERTLEEWKELTYQEVLSFKPPEPPKPPGSLEIEQ

SEQ ID NO: 8949 - RNA, 1095 nt, Artificial Sequence
  MK11__Homo_sapiens__AAC12714
augucgggcccucgcgccggcuucuaccggcaggagcugaacaagaccgugugggaggugccgcagcggcugcaggggcugcgcccggugggcuccggcgccuacggcuccgucuguucggccuacgacgcccggcugcgccagaagguggcggugaagaagcugucgcgccccuuccagucgcugauccacgcgcgcagaacguaccgggagcugcggcugcucaagcaccugaagcacgagaacgucaucgggcuucuggacgucuucacgccggccacguccaucgaggacuucagcgaaguguacuuggugaccacccugaugggcgccgaccugaacaacaucgucaagugccaggcgcugagcgacgagcacguucaauuccugguuuaccagcugcugcgcgggcugaaguacauccacucggccgggaucauccaccgggaccugaagcccagcaacguggcugugaacgaggacugugagcucaggauccuggauuucgggcuggcgcgccaggcggacgaggagaugaccggcuauguggccacgcgcugguaccgggcaccugagaucaugcucaacuggaugcauuacaaccaaacaguggauaucugguccgugggcugcaucauggcugagcugcuccagggcaaggcccucuucccgggaagcgacuacauugaccagcugaagcgcaucauggaaguggugggcacacccagcccugagguucuggcaaaaaucuccucggaacacgcccggacauauauccagucccugccccccaugccccagaaggaccugagcagcaucuuccguggagccaacccccuggccauagaccuccuuggaaggaugcuggugcuggacagugaccagagggucagugcagcugaggcacuggcccacgccuacuucagccaguaccacgaccccgaggaugagccagaggccgagccauaugaugagagcguugaggccaaggagcgcacgcuggaggaguggaaggagcucacuuaccaggaaguccuuagcuucaagcccccagagccaccgaagccaccuggcagccuggagauugagcaguga

SEQ ID NO: 8950 - RNA, 1095 nt, Artificial Sequence
  derived and/or modified sequence opt1 from MK11__Homo_sapiens__AAC12714
augagcggcccccgcgccggguucuaccggcaggagcugaacaagaccgugugggaggucccccagcgccuccagggccugcggcccgugggguccggcgccuacgggagcgugugcuccgcguacgacgcccgccugcggcagaaggucgccgugaagaagcucagccgccccuuccagucccugauccacgcccggcgcaccuaccgggagcugcgccuccugaagcaccugaagcacgagaacgugaucggccuccuggacgucuucacgcccgccaccagcaucgaggacuucuccgagguguaccuggugaccacccucaugggcgcggaccugaacaacaucgucaagugccaggcccugagcgacgagcacgugcaguuccucguguaccagcugcugcgggggcucaaguacauccacuccgccggcaucauccaccgcgaccugaagccgagcaacgucgccgugaacgaggacugcgagcugcggauccucgacuucgggcuggcgcgccaggccgacgaggagaugacgggcuacguggccacccggugguaccgcgcccccgagaucaugcugaacuggaugcacuacaaccagaccgucgacaucugguccguggggugcaucauggccgagcuccugcagggcaaggcgcuguuccccggcagcgacuacaucgaccagcucaagcggaucauggagguggucgggacccccuccccggaggugcuggccaagaucagcuccgagcacgcccgcacguacauccagagccugccgcccaugccccagaaggaccucuccagcaucuuccggggcgccaacccccuggccaucgaccugcucgggcgcaugcuggugcuggacuccgaccagcgggucagcgcggccgaggcccucgcccacgccuacuucagccaguaccacgaccccgaggacgagcccgaggcggagcccuacgacgaguccguggaggccaaggagcgcacccuggaggaguggaaggagcugaccuaccaggaggugcucagcuucaagccgcccgagccgcccaagccgcccggcucccuggagaucgagcaguga

SEQ ID NO: 8951 - RNA, 1095 nt, Artificial Sequence
  derived and/or modified sequence opt2 from MK11__Homo_sapiens__AAC12714
auguccggcccccgcgccggcuucuaccgccaggagcucaacaagaccgucugggaggucccccagcgccuccagggccuccgccccgucggcuccggcgccuacggcuccgucugcuccgccuacgacgcccgccuccgccagaaggucgccgucaagaagcucucccgccccuuccagucccucauccacgcccgccgcaccuaccgcgagcuccgccuccucaagcaccucaagcacgagaacgucaucggccuccucgacgucuucacccccgccaccuccaucgaggacuucuccgaggucuaccucgucaccacccucaugggcgccgaccucaacaacaucgucaagugccaggcccucuccgacgagcacguccaguuccucgucuaccagcuccuccgcggccucaaguacauccacuccgccggcaucauccaccgcgaccucaagcccuccaacgucgccgucaacgaggacugcgagcuccgcauccucgacuucggccucgcccgccaggccgacgaggagaugaccggcuacgucgccacccgcugguaccgcgcccccgagaucaugcucaacuggaugcacuacaaccagaccgucgacaucugguccgucggcugcaucauggccgagcuccuccagggcaaggcccucuuccccggcuccgacuacaucgaccagcucaagcgcaucauggaggucgucggcacccccucccccgagguccucgccaagaucuccuccgagcacgcccgcaccuacauccagucccucccccccaugccccagaaggaccucuccuccaucuuccgcggcgccaacccccucgccaucgaccuccucggccgcaugcucguccucgacuccgaccagcgcgucuccgccgccgaggcccucgcccacgccuacuucucccaguaccacgaccccgaggacgagcccgaggccgagcccuacgacgaguccgucgaggccaaggagcgcacccucgaggaguggaaggagcucaccuaccaggagguccucuccuucaagccccccgagccccccaagccccccggcucccucgagaucgagcaguga

SEQ ID NO: 8952 - RNA, 1095 nt, Artificial Sequence
  derived and/or modified sequence opt3 from MK11__Homo_sapiens__AAC12714
augagcggccccagagccggguucuacaggcaggagcugaacaagaccgugugggaagucccucaacggcuccagggacuucgcccaguugguuccggcgcuuaugggucugugugcucagcauacgacgcccgacugcgucagaaaguagcggugaagaaauugaguagaccguuucagagcuuaauccacgcuaggcggacauaucgcgagcugagacuacucaagcaucugaaacacgaaaaugucauuggacuucuggauguguucacucccgccacguccauagaggacuuuucugaaguuuacuuggugaccacacucaugggcgcagaucugaacaauaucgucaagugucaagcccugucggacgagcaugugcaguuccucguauaucaguuacugaggggucuuaaguacauucacucagcugggaucauucaucgggauuugaaaccuagcaacguugcagugaaugaggacugcgaacugcgcauccuagauuuuggacucgcccgacaggcugacgaggaaaugacuggcuaugucgccaccagaugguacagggcgccagagauaaugcugaacuggaugcacuacaaucaaacaguggauaucuggagugugggcuguauuauggcagagcuucugcaggggaaggccuuguuccccggauccgacuauaucgaucagcucaaacggauuauggaagucguugguaccccuucuccagaggugcuggcuaagaucagcuccgaacacgcccguacuuacauacagucauuacccccuaugccacaaaaagaccugaguagcauuuuucgcggcgcaaacccgcucgcuaucgaucuucuggggagaauguugguacuagacucugaccagaggguguccgccgcggaggcccuggcacaugcuuauuucucacaguaccacgaucccgaagacgagccugaggccgaaccauaugaugagagcgucgaagcuaaggagcggacacucgaagaguggaaggagcugaccuaccaagaagugcuuaguuuuaaacccccugagccacccaagccgccuggaucucuggaaauugagcaguga

SEQ ID NO: 8953 - RNA, 1095 nt, Artificial Sequence
  derived and/or modified sequence opt4 from MK11__Homo_sapiens__AAC12714
augagcggccccagagccggcuucuacagacaggagcugaacaagaccgugugggaggugccccagagacugcagggccugagacccgugggcagcggcgccuacggcagcgugugcagcgccuacgacgccagacugagacagaagguggccgugaagaagcugagcagacccuuccagagccugauccacgccagaagaaccuacagagagcugagacugcugaagcaccugaagcacgagaacgugaucggccugcuggacguguucacccccgccaccagcaucgaggacuucagcgagguguaccuggugaccacccugaugggcgccgaccugaacaacaucgugaagugccaggcccugagcgacgagcacgugcaguuccugguguaccagcugcugagaggccugaaguacauccacagcgccggcaucauccacagagaccugaagcccagcaacguggccgugaacgaggacugcgagcugagaauccuggacuucggccuggccagacaggccgacgaggagaugaccggcuacguggccaccagaugguacagagcccccgagaucaugcugaacuggaugcacuacaaccagaccguggacaucuggagcgugggcugcaucauggccgagcugcugcagggcaaggcccuguuccccggcagcgacuacaucgaccagcugaagagaaucauggagguggugggcacccccagccccgaggugcuggccaagaucagcagcgagcacgccagaaccuacauccagagccugccccccaugccccagaaggaccugagcagcaucuucagaggcgccaacccccuggccaucgaccugcugggcagaaugcuggugcuggacagcgaccagagagugagcgccgccgaggcccuggcccacgccuacuucagccaguaccacgaccccgaggacgagcccgaggccgagcccuacgacgagagcguggaggccaaggagagaacccuggaggaguggaaggagcugaccuaccaggaggugcugagcuucaagccccccgagccccccaagccccccggcagccuggagaucgagcaguga

SEQ ID NO: 8954 - RNA, 1095 nt, Artificial Sequence
  derived and/or modified sequence opt5 from MK11__Homo_sapiens__AAC12714
augagcggccccagagccggguucuaccggcaggagcugaacaagaccgugugggaagucccucaacgccuccagggacugagaccgguuggcuccggggcuuauggaucugugugcagcgccuacgacgcgcggcuucgccagaaaguggcugucaagaaacuguccagacccuuucagucucucauccacgcccggcgcacauauagagagcugcggcuucugaagcaucucaaacacgaaaaugugauuggccugcuggauguuuucacgccugccaccagcaucgaggacuuuuccgaaguguaccucgucacaacccugaugggggcugaucuuaacaauauugugaagugucaagcccugucugacgagcauguucaguuccucguguaucagcugcuucgcggacugaaguacauccacagcgcuggcauuauccauagagaucucaaacccuccaacgucgccgugaaugaggacugcgaacugcggauccuggauuuuggccucgcgcgccaggccgacgaggaaaugacaggguauguggcuaccagaugguaccgggccccugagauuaugcugaacuggaugcacuacaaucaaacagucgauaucuggagcguuggauguauuauggcugagcuucugcagggcaaggcccucuuccccgggucugacuauaucgaucagcugaaacgcauuauggaaguggugggaaccccuuccccggagguccuugcgaagaucagcucugaacacgccagaacguacauucagucccugcccccuaugccccaaaaagaccucagcucuaucuuucggggcgcuaacccucuggccaucgaucugcucgggagaaugcuggugcuugacuccgaccagcgcguuagcgcugccgaggcccuggcucaugcguauuucucccaguaccacgaucccgaagacgagccggaggccgaaccuuaugaugagucuguggaagcuaaggagcggacccucgaagaguggaaggagcugacauaccaagaaguccuuagcuuuaaacccccugagccucccaagcccccgggaucccuggaaauugagcaguga

SEQ ID NO: 8955 - protein, 367 aa, Artificial Sequence
  MK12__Homo_sapiens__P53778
MSSPPPARSGFYRQEVTKTAWEVRAVYRDLQPVGSGAYGAVCSAVDGRTGAKVAIKKLYRPFQSELFAKRAYRELRLLKHMRHENVIGLLDVFTPDETLDDFTDFYLVMPFMGTDLGKLMKHEKLGEDRIQFLVYQMLKGLRYIHAAGIIHRDLKPGNLAVNEDCELKILDFGLARQADSEMTGYVVTRWYRAPEVILNWMRYTQTVDIWSVGCIMAEMITGKTLFKGSDHLDQLKEIMKVTGTPPAEFVQRLQSDEAKNYMKGLPELEKKDFASILTNASPLAVNLLEKMLVLDAEQRVTAGEALAHPYFESLHDTEDEPQVQKYDDSFDDVDRTLDEWKRVTYKEVLSFKPPRQLGARVSKETPL

SEQ ID NO: 8956 - RNA, 1104 nt, Artificial Sequence
  MK12__Homo_sapiens__AAH15741
augagcucuccgccgcccgcccgcaguggcuuuuaccgccaggaggugaccaagacggccugggaggugcgcgccguguaccgggaccugcagcccgugggcucgggcgccuacggcgcggugugcucggccguggacggccgcaccggcgcuaagguggccaucaagaagcuguaucggcccuuccaguccgagcuguucgccaagcgcgccuaccgcgagcugcgccugcucaagcacaugcgccacgagaacgugaucgggcugcuggacguauucacuccugaugagacccuggaugacuucacggacuuuuaccuggugaugccguucaugggcaccgaccugggcaagcucaugaaacaugagaagcuaggcgaggaccggauccaguuccucguguaccagaugcugaaggggcugagguauauccacgcugccggcaucauccacagagaccugaagcccggcaaccuggcugugaacgaagacugugagcugaagauccuggacuucggccuggccaggcaggcagacagugagaugacuggguacguggugacccggugguaccgggcucccgaggucaucuugaauuggaugcgcuacacgcagacgguggacaucugguccgugggcugcaucauggcggagaugaucacaggcaagacgcuguucaagggcagcgaccaccuggaccagcugaaggagaucaugaaggugacggggacgccuccggcugaguuugugcagcggcugcagagcgaugaggccaagaacuacaugaagggccuccccgaauuggagaagaaggauuuugccucuauccugaccaaugcaagcccucuggcugugaaccuccuggagaagaugcuggugcuggacgcggagcagcgggugacggcaggcgaggcgcuggcccaucccuacuucgagucccugcacgacacggaagaugagccccagguccagaaguaugaugacuccuuugacgacguugaccgcacacuggaugaauggaagcguguuacuuacaaagaggugcucagcuucaagccuccccggcagcugggggccagggucuccaaggagacgccucuguga

SEQ ID NO: 8957 - RNA, 1104 nt, Artificial Sequence
  derived and/or modified sequence opt1 from MK12__Homo_sapiens__AAH15741
augagcagcccgccgcccgcccgcuccggcuucuaccggcaggaggugaccaagaccgccugggagguccgcgcgguguaccgggaccugcagcccgugggguccggcgccuacggggccgucugcagcgccguggacggccgcaccggggccaagguggcgaucaagaagcucuaccggcccuuccaguccgagcuguucgccaagcgcgccuaccgggagcugcgccuccugaagcacaugcggcacgagaacgucaucggccugcucgacguguucacccccgacgagacccuggacgacuucaccgacuucuaccuggugaugcccuucaugggcacggaccucgggaagcugaugaagcacgagaagcugggcgaggaccgcauccaguuccucgucuaccagaugcugaaggggcugcgguacauccacgccgcgggcaucauccaccgcgaccucaagcccgggaaccuggccgugaacgaggacugcgagcugaagauccucgacuucggccuggcccggcaggccgacagcgagaugaccggcuacguggucacccgcugguaccgggcccccgaggugauccugaacuggaugcgcuacacccagacgguggacaucugguccgucgggugcaucauggcggagaugaucaccggcaagacccucuucaaggggagcgaccaccuggaccagcugaaggagaucaugaaggugaccggcacgccgcccgccgaguucgugcagcggcuccaguccgacgaggccaagaacuacaugaagggccugcccgagcuggagaagaaggacuucgccagcauccucaccaacgccagcccccuggcggucaaccugcucgagaagaugcuggugcuggacgccgagcagcgcgugaccgccggggaggcccucgcccacccguacuucgagucccugcacgacaccgaggacgagccccagguccagaaguacgacgacuccuucgacgacguggaccggacgcuggacgaguggaagcgcgugaccuacaaggagguccucagcuucaagccgccccggcagcugggcgcgcgcguguccaaggagacgccccuguga

SEQ ID NO: 8958 - RNA, 1104 nt, Artificial Sequence
  derived and/or modified sequence opt2 from MK12__Homo_sapiens__AAH15741
auguccucccccccccccgcccgcuccggcuucuaccgccaggaggucaccaagaccgccugggagguccgcgccgucuaccgcgaccuccagcccgucggcuccggcgccuacggcgccgucugcuccgccgucgacggccgcaccggcgccaaggucgccaucaagaagcucuaccgccccuuccaguccgagcucuucgccaagcgcgccuaccgcgagcuccgccuccucaagcacaugcgccacgagaacgucaucggccuccucgacgucuucacccccgacgagacccucgacgacuucaccgacuucuaccucgucaugcccuucaugggcaccgaccucggcaagcucaugaagcacgagaagcucggcgaggaccgcauccaguuccucgucuaccagaugcucaagggccuccgcuacauccacgccgccggcaucauccaccgcgaccucaagcccggcaaccucgccgucaacgaggacugcgagcucaagauccucgacuucggccucgcccgccaggccgacuccgagaugaccggcuacgucgucacccgcugguaccgcgcccccgaggucauccucaacuggaugcgcuacacccagaccgucgacaucugguccgucggcugcaucauggccgagaugaucaccggcaagacccucuucaagggcuccgaccaccucgaccagcucaaggagaucaugaaggucaccggcaccccccccgccgaguucguccagcgccuccaguccgacgaggccaagaacuacaugaagggccuccccgagcucgagaagaaggacuucgccuccauccucaccaacgccuccccccucgccgucaaccuccucgagaagaugcucguccucgacgccgagcagcgcgucaccgccggcgaggcccucgcccaccccuacuucgagucccuccacgacaccgaggacgagccccagguccagaaguacgacgacuccuucgacgacgucgaccgcacccucgacgaguggaagcgcgucaccuacaaggagguccucuccuucaagcccccccgccagcucggcgcccgcgucuccaaggagaccccccucuga

SEQ ID NO: 8959 - RNA, 1104 nt, Artificial Sequence
  derived and/or modified sequence opt3 from MK12__Homo_sapiens__AAH15741
augagcucucccccuccagccagauccggcuucuacaggcaggaggugaccaagaccgcuugggaaguccgggcaguuuaucgcgaccugcaaccgguggggucaggagccuacggugcgguaugcagugcuguggauggccgaacuggggccaaagucgcaaucaagaaacucuaucgucccuuucagagcgagcuuuucgccaagagagcuuacagggaacugcgguuguuaaaacacaugcgccaugagaacgugauuggacugcuagacguuuuuacgccugaugaaacccucgacgauuucacagacuuuuaucuggugaugccauucaugggcacugaucuugguaagcugaugaagcacgagaaauugggggaggacagaauacaguuucucgucuaccagaugcugaagggacugagguauauccaugcagccggcauuauccaccgggaucucaaacccggcaauuuagcugugaacgaagacugugagcugaagauucuugauuucggguuggcccgccaagcggacuccgaaaugaccggauacguaguuacacgaugguacagagcaccugaggugauccugaauuggaugagguauacccagacugucgauauauggucuguggguugcaucauggccgagaugauuacaggcaaaacccuauuuaaggggucggaccaucucgaccagcugaaggaaaucaugaaagugacgggaacuccacccgcugaguucguccagcggcuucaaucagaugaagccaagaacuacaugaaaggccugccugaguuggaaaagaaagacuuugcaagcauucucaccaaugcuaguccacuggccguuaacuuacuggagaagaugcucgugcuugaugcggagcagcguguaacagccggugaagcacuggcucacccguauuucgaguccuugcacgacacugaagaugagccccaggugcagaaauacgacgauucuuuugacgaugucgaccgcacccuagaugaauggaagagagugacauauaaggagguucugagcuucaaaccuccaaggcaacucggggcccggguguccaaggagacaccccuguga

SEQ ID NO: 8960 - RNA, 1104 nt, Artificial Sequence
  derived and/or modified sequence opt4 from MK12__Homo_sapiens__AAH15741
augagcagccccccccccgccagaagcggcuucuacagacaggaggugaccaagaccgccugggaggugagagccguguacagagaccugcagcccgugggcagcggcgccuacggcgccgugugcagcgccguggacggcagaaccggcgccaagguggccaucaagaagcuguacagacccuuccagagcgagcuguucgccaagagagccuacagagagcugagacugcugaagcacaugagacacgagaacgugaucggccugcuggacguguucacccccgacgagacccuggacgacuucaccgacuucuaccuggugaugcccuucaugggcaccgaccugggcaagcugaugaagcacgagaagcugggcgaggacagaauccaguuccugguguaccagaugcugaagggccugagauacauccacgccgccggcaucauccacagagaccugaagcccggcaaccuggccgugaacgaggacugcgagcugaagauccuggacuucggccuggccagacaggccgacagcgagaugaccggcuacguggugaccagaugguacagagcccccgaggugauccugaacuggaugagauacacccagaccguggacaucuggagcgugggcugcaucauggccgagaugaucaccggcaagacccuguucaagggcagcgaccaccuggaccagcugaaggagaucaugaaggugaccggcaccccccccgccgaguucgugcagagacugcagagcgacgaggccaagaacuacaugaagggccugcccgagcuggagaagaaggacuucgccagcauccugaccaacgccagcccccuggccgugaaccugcuggagaagaugcuggugcuggacgccgagcagagagugaccgccggcgaggcccuggcccaccccuacuucgagagccugcacgacaccgaggacgagccccaggugcagaaguacgacgacagcuucgacgacguggacagaacccuggacgaguggaagagagugaccuacaaggaggugcugagcuucaagccccccagacagcugggcgccagagugagcaaggagaccccccuguga

SEQ ID NO: 8961 - RNA, 1104 nt, Artificial Sequence
  derived and/or modified sequence opt5 from MK12__Homo_sapiens__AAH15741
augagcucucccccuccggccagauccggcuucuaccggcaggaggugaccaagaccgcuugggaaguccgcgccguuuauagagaccugcaacccguggggagcggagcguacggcgcugugugcuccgccgucgaugggcggacgggagccaaaguggcuaucaagaaacucuaucgcccuuuucagucugagcuguucgccaagagagcuuaccgggaacuucgccugcucaaacacaugagacaugagaacguuauuggccugcuugacguguuuacccccgaugaaacacuggacgauuucaccgacuuuuaucucgucaugccuuucauggggacagaucugggaaagcugaugaagcacgagaaacucggcgaggaccggauccaguuucugguguaccagaugcuuaagggccugcgcuauauucaugccgcggggaucauucacagagaucucaaacccggaaaucuggccguuaacgaagacugugagcuuaagauccuggauuucggccucgcucggcaagccgacagcgaaaugaccggguacguggucacacgcugguacagagcuccugaggugauccugaauuggaugcgguauacccagacgguggauauuugguccgucggaugcaucauggccgagaugauuaccggcaaaacacuguuuaaggggucugaccaucucgaccagcugaaggaaaucaugaaaguuaccggaacaccgcccgcggaguucgugcagcgccuucaaagcgaugaagccaagaacuacaugaaaggccugccugagcucgaaaagaaagacuuugcuuccauucugaccaaugccagcccccuugcugugaaccugcucgagaagaugcugguccuggaugccgagcagagagugacggccggcgaagcucucgcgcacccuuauuucgagucucugcacgacacagaagaugagccccagguucagaaauacgacgauuccuuugacgauguggaccggacccuugaugaauggaagagagucacauauaaggaggugcugagcuucaaaccgccucgccaacucggggcccggguuucuaaggagacaccccuguga

SEQ ID NO: 8962 - protein, 365 aa, Artificial Sequence
  MK13__Homo_sapiens__O15264
MSLIRKKGFYKQDVNKTAWELPKTYVSPTHVGSGAYGSVCSAIDKRSGEKVAIKKLSRPFQSEIFAKRAYRELLLLKHMQHENVIGLLDVFTPASSLRNFYDFYLVMPFMQTDLQKIMGMEFSEEKIQYLVYQMLKGLKYIHSAGVVHRDLKPGNLAVNEDCELKILDFGLARHADAEMTGYVVTRWYRAPEVILSWMHYNQTVDIWSVGCIMAEMLTGKTLFKGKDYLDQLTQILKVTGVPGTEFVQKLNDKAAKSYIQSLPQTPRKDFTQLFPRASPQAADLLEKMLELDVDKRLTAAQALTHPFFEPFRDPEEETEAQQPFDDSLEHEKLTVDEWKQHIYKEIVNFSPIARKDSRRRSGMKL

SEQ ID NO: 8963 - RNA, 1098 nt, Artificial Sequence
  MK13__Homo_sapiens__AAB87639
augagccucauccggaaaaagggcuucuacaagcaggacgucaacaagacagccugggagcugcccaagaccuacguguccccgacgcacgucggcagcggggccuauggcuccgugugcucggccaucgacaagcggucaggggagaagguggccaucaagaagcugagccgacccuuucaguccgagaucuucgccaagcgcgccuaccgggagcugcugcugcugaagcacaugcagcaugagaacgucauugggcuccuggaugucuucaccccagccuccucccugcgcaacuucuaugacuucuaccuggugaugcccuucaugcagacggaucugcagaagaucauggggauggaguucagugaggagaagauccaguaccugguguaucagaugcucaaaggccuuaaguacauccacucugcuggggucgugcacagggaccugaagccaggcaaccuggcugugaaugaggacugugaacugaagauucuggauuuugggcuggcgcgacaugcagacgccgagaugacuggcuacguggugacccgcugguaccgagcccccgaggugauccucagcuggaugcacuacaaccagacaguggacaucuggucugugggcuguaucauggcagagaugcugacagggaaaacucuguucaaggggaaagauuaccuggaccagcugacccagauccugaaagugaccggggugccuggcacggaguuugugcagaagcugaacgacaaagcggccaaauccuacauccagucccugccacagacccccaggaaggauuucacucagcuguucccacgggccagcccccaggcugcggaccugcuggagaagaugcuggagcuagacguggacaagcgccugacggccgcgcaggcccucacccaucccuuuuuugaacccuuccgggacccugaggaagagacggaggcccagcagccguuugaugauuccuuagaacacgagaaacucacaguggaugaauggaagcagcacaucuacaaggagauugugaacuucagccccauugcccggaaggacucacggcgccggaguggcaugaagcuguag

SEQ ID NO: 8964 - RNA, 1098 nt, Artificial Sequence
  derived and/or modified sequence opt1 from MK13__Homo_sapiens__AAB87639
augagccugauccgcaagaagggcuucuacaagcaggacgugaacaagaccgccugggagcuccccaagaccuacgucuccccgacgcacguggggagcggcgccuacggguccgugugcagcgcgaucgacaagcgguccggcgagaaggucgccaucaagaagcugagccgccccuuccaguccgagaucuucgccaagcgggccuaccgcgagcugcuccugcugaagcacaugcagcacgagaacgugaucgggcuccuggacguguucacccccgccagcucccugcggaacuucuacgacuucuaccucgucaugcccuucaugcagaccgaccugcagaagaucaugggcauggaguucagcgaggagaagauccaguaccugguguaccagaugcucaagggccugaaguacauccacuccgcgggggugguccaccgcgaccugaagccgggcaaccucgccgugaacgaggacugcgagcugaagauccuggacuucgggcucgcccggcacgccgacgcggagaugaccggcuacguggucacgcgcugguaccgggcccccgaggugauccugagcuggaugcacuacaaccagaccguggacaucugguccgucgggugcaucauggccgagaugcugaccggcaagacccucuucaagggcaaggacuaccuggaccagcugacgcagauccucaaggugaccggggugcccggcaccgaguucguccagaagcugaacgacaaggccgccaagagcuacauccagucccugccccagaccccgcgcaaggacuucacgcagcuguucccccgggcgagcccccaggccgccgaccuccuggagaagaugcucgagcuggacguggacaagcgccugaccgccgcccaggcgcucacccaccccuucuucgagccguuccgggaccccgaggaggagaccgaggcccagcagcccuucgacgacucccuggagcacgagaagcugacgguggacgaguggaagcagcacaucuacaaggagaucgucaacuucagccccaucgcccgcaaggacucccggcgccggagcgggaugaagcucuga

SEQ ID NO: 8965 - RNA, 1098 nt, Artificial Sequence
  derived and/or modified sequence opt2 from MK13__Homo_sapiens__AAB87639
augucccucauccgcaagaagggcuucuacaagcaggacgucaacaagaccgccugggagcuccccaagaccuacgucucccccacccacgucggcuccggcgccuacggcuccgucugcuccgccaucgacaagcgcuccggcgagaaggucgccaucaagaagcucucccgccccuuccaguccgagaucuucgccaagcgcgccuaccgcgagcuccuccuccucaagcacaugcagcacgagaacgucaucggccuccucgacgucuucacccccgccuccucccuccgcaacuucuacgacuucuaccucgucaugcccuucaugcagaccgaccuccagaagaucaugggcauggaguucuccgaggagaagauccaguaccucgucuaccagaugcucaagggccucaaguacauccacuccgccggcgucguccaccgcgaccucaagcccggcaaccucgccgucaacgaggacugcgagcucaagauccucgacuucggccucgcccgccacgccgacgccgagaugaccggcuacgucgucacccgcugguaccgcgcccccgaggucauccucuccuggaugcacuacaaccagaccgucgacaucugguccgucggcugcaucauggccgagaugcucaccggcaagacccucuucaagggcaaggacuaccucgaccagcucacccagauccucaaggucaccggcguccccggcaccgaguucguccagaagcucaacgacaaggccgccaaguccuacauccagucccucccccagaccccccgcaaggacuucacccagcucuucccccgcgccuccccccaggccgccgaccuccucgagaagaugcucgagcucgacgucgacaagcgccucaccgccgcccaggcccucacccaccccuucuucgagcccuuccgcgaccccgaggaggagaccgaggcccagcagcccuucgacgacucccucgagcacgagaagcucaccgucgacgaguggaagcagcacaucuacaaggagaucgucaacuucucccccaucgcccgcaaggacucccgccgccgcuccggcaugaagcucuga

SEQ ID NO: 8966 - RNA, 1098 nt, Artificial Sequence
  derived and/or modified sequence opt3 from MK13__Homo_sapiens__AAB87639
augagccugaucagaaagaaaggcuucuacaagcaggacgugaacaaaaccgccugggagcuccccaagacauaugucuccccuacucacguugggucuggagcuuacgguucagugugcagugcaauugauaaaaggagcggcgaaaagguagccauaaagaaacuuucccggccauuucaaucugagaucuucgcgaagcgcgcuuaucgagaacuguuguuacugaaacauaugcagcacgagaaugugauugggcuacucgacgucuuuacgccggccucgucacugcguaacuucuacgauuuuuaucuugugaugcccuucaugcagaccgaccugcagaagaucaugggaauggaauuuagcgaggagaaaauucaauacuugguuuaucagaugcucaagggccugaaguacauccauagugccggugugguccacagagaucugaaaccugggaaucucgcagugaacgaagacugugaguuaaagauacuggauuucggacuugcuaggcaugcagacgccgaaaugacaggcuacguaguuacucggugguaucgcgcuccagaggugaucuuguccuggaugcacuacaaucagaccgucgauauuuggucugugggcugcaucauggccgagaugcugacagggaaaacccuauuuaagggaaaagacuaucucgaucagcugacucaaauucuuaaggugacagguguccccggcaccgaguucguucagaaacugaacgacaaggcggcaaagagcuacauccaguccuugccucagacgccaagaaaagauuuuacucaacucuuccccagggccucaccucaggcugccgaccuguuagaaaagaugcuggaacucgacguggauaaacggcuuaccgcagcucaggcccugacacacccauuuuucgagccguuccgcgaccccgaagaggagacugaagcgcaacagccuuuugaugacaguuuggagcaugaaaagcuaaccguagaugaguggaaacagcacauauauaaggaaauugugaauuucagcccaaucgcccgaaaggacucuagaaggcgguccgggaugaaacuguga

SEQ ID NO: 8967 - RNA, 1098 nt, Artificial Sequence
  derived and/or modified sequence opt4 from MK13__Homo_sapiens__AAB87639
augagccugaucagaaagaagggcuucuacaagcaggacgugaacaagaccgccugggagcugcccaagaccuacgugagccccacccacgugggcagcggcgccuacggcagcgugugcagcgccaucgacaagagaagcggcgagaagguggccaucaagaagcugagcagacccuuccagagcgagaucuucgccaagagagccuacagagagcugcugcugcugaagcacaugcagcacgagaacgugaucggccugcuggacguguucacccccgccagcagccugagaaacuucuacgacuucuaccuggugaugcccuucaugcagaccgaccugcagaagaucaugggcauggaguucagcgaggagaagauccaguaccugguguaccagaugcugaagggccugaaguacauccacagcgccggcguggugcacagagaccugaagcccggcaaccuggccgugaacgaggacugcgagcugaagauccuggacuucggccuggccagacacgccgacgccgagaugaccggcuacguggugaccagaugguacagagcccccgaggugauccugagcuggaugcacuacaaccagaccguggacaucuggagcgugggcugcaucauggccgagaugcugaccggcaagacccuguucaagggcaaggacuaccuggaccagcugacccagauccugaaggugaccggcgugcccggcaccgaguucgugcagaagcugaacgacaaggccgccaagagcuacauccagagccugccccagacccccagaaaggacuucacccagcuguuccccagagccagcccccaggccgccgaccugcuggagaagaugcuggagcuggacguggacaagagacugaccgccgcccaggcccugacccaccccuucuucgagcccuucagagaccccgaggaggagaccgaggcccagcagcccuucgacgacagccuggagcacgagaagcugaccguggacgaguggaagcagcacaucuacaaggagaucgugaacuucagccccaucgccagaaaggacagcagaagaagaagcggcaugaagcuguga

SEQ ID NO: 8968 - RNA, 1098 nt, Artificial Sequence
  derived and/or modified sequence opt5 from MK13__Homo_sapiens__AAB87639
augagccugaucagaaagaaaggcuucuacaagcaggacgugaacaaaaccgccugggagcuccccaagacauaugucuccccuacgcacguugggucuggagcuuacggcagcgugugcuccgccauugauaaacggucuggggaaaagguggcgaucaagaaacugagccgcccguuucaauccgagauuuucgcuaagagagccuaucgggaacuucugcuccugaaacauaugcagcacgagaaugucaucggacuucuggacguguuuacccccgccucuagccuccgcaacuucuacgauuuuuaucugguuaugccuuucaugcagacagaccugcagaagauuaugggcauggaauuuuccgaggagaaaauccaauaccucguguaucagaugcugaaggggcuuaaguacauccauagcgcuggagucgugcacagagaucugaaacccggcaaucucgccguuaacgaagacugugagcugaagauucuugauuucggccuggcucggcaugccgacgcggaaaugaccggguacguggucacacgcugguauagagccccugaggugauccucucuuggaugcacuacaaucagaccguggauauuugguccgucggaugcaucauggcugagaugcugacaggcaaaacccuguuuaaggggaaagacuaucucgaucagcugacgcaaauucuuaagguuaccggagugcccggcacagaguucgugcagaaacugaacgacaaggccgcuaagagcuacauccagucucucccucagaccccgcggaaagauuuuacacaacuguucccccgcgccuccccucaggcggccgaccuucuggaaaagaugcucgaacuggacgucgauaaaagacugaccgcugcccaggcucucacgcaccccuuuuucgagccuuuccgggaccccgaagaggagacagaagcccaacagccguuugaugacagccuggagcaugaaaaacuuaccguggaugaguggaagcagcacauuuauaaggaaaucguuaauuucucuccuaucgcccgcaaggacuccagacggcgcagcgggaugaaacuguga

SEQ ID NO: 8969 - protein, 360 aa, Artificial Sequence
  MK14__Homo_sapiens__Q16539
MSQERPTFYRQELNKTIWEVPERYQNLSPVGSGAYGSVCAAFDTKTGLRVAVKKLSRPFQSIIHAKRTYRELRLLKHMKHENVIGLLDVFTPARSLEEFNDVYLVTHLMGADLNNIVKCQKLTDDHVQFLIYQILRGLKYIHSADIIHRDLKPSNLAVNEDCELKILDFGLARHTDDEMTGYVATRWYRAPEIMLNWMHYNQTVDIWSVGCIMAELLTGRTLFPGTDHIDQLKLILRLVGTPGAELLKKISSESARNYIQSLTQMPKMNFANVFIGANPLAVDLLEKMLVLDSDKRITAAQALAHAYFAQYHDPDDEPVADPYDQSFESRDLLIDEWKSLTYDEVISFVPPPLDQEEMES

SEQ ID NO: 8970 - RNA, 1083 nt, Artificial Sequence
  MK14__Homo_sapiens__AAA57456
augucucaggagaggcccacguucuaccggcaggagcugaacaagacaaucugggaggugcccgagcguuaccagaaccugucuccagugggcucuggcgccuauggcucugugugugcugcuuuugacacaaaaacgggguuacguguggcagugaagaagcucuccagaccauuucaguccaucauucaugcgaaaagaaccuacagagaacugcgguuacuuaaacauaugaaacaugaaaaugugauuggucuguuggacguuuuuacaccugcaaggucucuggaggaauucaaugauguguaucuggugacccaucucaugggggcagaucugaacaacauugugaaaugucagaagcuuacagaugaccauguucaguuccuuaucuaccaaauucuccgaggucuaaaguauauacauucagcugacauaauucacagggaccuaaaaccuaguaaucuagcugugaaugaagacugugagcugaagauucuggauuuuggacuggcucggcacacagaugaugaaaugacaggcuacguggccacuaggugguacagggcuccugagaucaugcugaacuggaugcauuacaaccagacaguugauauuuggucagugggaugcauaauggccgagcuguugacuggaagaacauuguuuccugguacagaccauauugaucaguugaagcucauuuuaagacucguuggaaccccaggggcugagcuuuugaagaaaaucuccucagagucugcaagaaacuauauucagucuuugacucagaugccgaagaugaacuuugcgaauguauuuauuggugccaauccccuggcugucgacuugcuggagaagaugcuuguauuggacucagauaagagaauuacagcggcccaagcccuugcacaugccuacuuugcucaguaccacgauccugaugaugaaccaguggccgauccuuaugaucaguccuuugaaagcagggaccuccuuauagaugaguggaaaagccugaccuaugaugaagucaucagcuuugugccaccaccccuugaccaagaagagauggaguccuga

SEQ ID NO: 8971 - RNA, 1083 nt, Artificial Sequence
  derived and/or modified sequence opt1 from MK14__Homo_sapiens__AAA57456
augagccaggagcgccccaccuucuaccggcaggagcugaacaagaccaucugggaggugcccgagcgcuaccagaaccucucccccgucggcagcggggccuacggcuccgugugcgccgcguucgacacgaagaccgggcugcggguggccgucaagaagcugagccgccccuuccaguccaucauccacgccaagcggaccuaccgcgagcuccggcugcugaagcacaugaagcacgagaacgugaucggccuccuggacguguucacccccgcccgcagccuggaggaguucaacgacgucuaccucgugacgcaccugaugggggccgaccugaacaacaucgugaagugccagaagcucaccgacgaccacguccaguuccugaucuaccagauccugcggggccucaaguacauccacuccgcggacaucauccaccgcgaccugaagccgagcaaccuggccgugaacgaggacugcgagcucaagauccuggacuucggccuggcccggcacaccgacgacgagaugaccggguacguggccacgcgcugguaccgggcgcccgagaucaugcucaacuggaugcacuacaaccagaccgucgacaucugguccgugggcugcaucauggccgagcugcugaccgggcgcacccucuuccccggcacggaccacaucgaccagcugaagcugauccuccggcugguggggacccccggcgccgagcugcucaagaagaucagcuccgagagcgcccgcaacuacauccagucccugacccagaugccgaagaugaacuucgccaacgucuucaucggcgcgaacccccuggccguggaccuccuggagaagaugcuggugcucgacagcgacaagcggaucaccgccgcccaggcccuggcgcacgccuacuucgcccaguaccacgaccccgacgacgagcccgucgccgacccguacgaccaguccuucgagagccgcgaccugcucaucgacgaguggaagucccugacguacgacgaggugaucagcuucgugcccccgccccuggaccaggaggagauggaguccuga

SEQ ID NO: 8972 - RNA, 1083 nt, Artificial Sequence
  derived and/or modified sequence opt2 from MK14__Homo_sapiens__AAA57456
augucccaggagcgccccaccuucuaccgccaggagcucaacaagaccaucugggagguccccgagcgcuaccagaaccucucccccgucggcuccggcgccuacggcuccgucugcgccgccuucgacaccaagaccggccuccgcgucgccgucaagaagcucucccgccccuuccaguccaucauccacgccaagcgcaccuaccgcgagcuccgccuccucaagcacaugaagcacgagaacgucaucggccuccucgacgucuucacccccgcccgcucccucgaggaguucaacgacgucuaccucgucacccaccucaugggcgccgaccucaacaacaucgucaagugccagaagcucaccgacgaccacguccaguuccucaucuaccagauccuccgcggccucaaguacauccacuccgccgacaucauccaccgcgaccucaagcccuccaaccucgccgucaacgaggacugcgagcucaagauccucgacuucggccucgcccgccacaccgacgacgagaugaccggcuacgucgccacccgcugguaccgcgcccccgagaucaugcucaacuggaugcacuacaaccagaccgucgacaucugguccgucggcugcaucauggccgagcuccucaccggccgcacccucuuccccggcaccgaccacaucgaccagcucaagcucauccuccgccucgucggcacccccggcgccgagcuccucaagaagaucuccuccgaguccgcccgcaacuacauccagucccucacccagaugcccaagaugaacuucgccaacgucuucaucggcgccaacccccucgccgucgaccuccucgagaagaugcucguccucgacuccgacaagcgcaucaccgccgcccaggcccucgcccacgccuacuucgcccaguaccacgaccccgacgacgagcccgucgccgaccccuacgaccaguccuucgagucccgcgaccuccucaucgacgaguggaagucccucaccuacgacgaggucaucuccuucgucccccccccccucgaccaggaggagauggaguccuga

SEQ ID NO: 8973 - RNA, 1083 nt, Artificial Sequence
  derived and/or modified sequence opt3 from MK14__Homo_sapiens__AAA57456
augagccaggagagacccaccuucuacaggcaagaacugaacaagacaauaugggaggugccugaacgguaucagaaucucuccccagucggcucuggggccuacggaucaguuugcgcugcauuugacacuaaaacgggucuucgcguggccguaaagaaacugagucgaccguuccagagcauuauacacgcgaagcguaccuauagagaguugagguuacugaaacauaugaagcacgaaaacgugaucggccuacucgaugucuuuacacccgcucggucccuggaggaguucaaugacguguaccuuguuacucaucugaugggggccgauuugaacaauauugugaagugucagaaacucaccgacgaucacguccaauuucugaucuaucagauucugcgcggacucaaguacauccauucugcagacauaauccacagagauuuaaaaccuucgaaccuggccgugaaugaagacugcgagcuuaagauuuuggauuucggccuggcuaggcacacagacgaugaaaugaccgguuauguagcaacucggugguaccgcgccccagagaucaugcuaaacuggaugcauuacaaucagacaguugacauuuggucagugggguguaucauggcugagcuccugaccggacgaacgcuuuuucccggcacugaucacauagaccagcugaaauugauucucagacuggucggcaccccuggggccgaauuacugaagaagaucagcagugaguccgcgaggaacuauauucaaucucucacacagaugccaaaaaugaauuucgcaaacguguuuaucggagccaauccccuugcuguggaccuguuggaaaagaugcuaguccuggauagcgacaaacggaucacugccgcacaggcucucgcccaugcguacuucgcccaguaucacgauccugacgaugagccaguugcagacccguacgaucaauccuuugaaucacgugaccugcuuauugaugaguggaagagucugaccuaugacgaggugaucagcuucguacccccuccauuggaucaggaagagauggaaucuuga

SEQ ID NO: 8974 - RNA, 1083 nt, Artificial Sequence
  derived and/or modified sequence opt4 from MK14__Homo_sapiens__AAA57456
augagccaggagagacccaccuucuacagacaggagcugaacaagaccaucugggaggugcccgagagauaccagaaccugagccccgugggcagcggcgccuacggcagcgugugcgccgccuucgacaccaagaccggccugagaguggccgugaagaagcugagcagacccuuccagagcaucauccacgccaagagaaccuacagagagcugagacugcugaagcacaugaagcacgagaacgugaucggccugcuggacguguucacccccgccagaagccuggaggaguucaacgacguguaccuggugacccaccugaugggcgccgaccugaacaacaucgugaagugccagaagcugaccgacgaccacgugcaguuccugaucuaccagauccugagaggccugaaguacauccacagcgccgacaucauccacagagaccugaagcccagcaaccuggccgugaacgaggacugcgagcugaagauccuggacuucggccuggccagacacaccgacgacgagaugaccggcuacguggccaccagaugguacagagcccccgagaucaugcugaacuggaugcacuacaaccagaccguggacaucuggagcgugggcugcaucauggccgagcugcugaccggcagaacccuguuccccggcaccgaccacaucgaccagcugaagcugauccugagacuggugggcacccccggcgccgagcugcugaagaagaucagcagcgagagcgccagaaacuacauccagagccugacccagaugcccaagaugaacuucgccaacguguucaucggcgccaacccccuggccguggaccugcuggagaagaugcuggugcuggacagcgacaagagaaucaccgccgcccaggcccuggcccacgccuacuucgcccaguaccacgaccccgacgacgagcccguggccgaccccuacgaccagagcuucgagagcagagaccugcugaucgacgaguggaagagccugaccuacgacgaggugaucagcuucgugccccccccccuggaccaggaggagauggagagcuga

SEQ ID NO: 8975 - RNA, 1083 nt, Artificial Sequence
  derived and/or modified sequence opt5 from MK14__Homo_sapiens__AAA57456
augagccaggagagacccaccuucuaccggcaagaacugaacaagacaaucugggaggugccugaacgcuaucagaaucucuccccggucggcucuggggccuacggaagcguuugcgcugccuuugacacgaagaccggccugagaguggcggugaagaaacuuucccggcccuuccagucuauuauccacgcuaagcgcacauauagagagcugcggcuccugaaacauaugaagcacgaaaacgucauugggcuucuggauguguuuaccccugcccgcagccucgaggaguucaaugacguuuaccuggugacacaucugaugggagccgaucucaacaauaucgucaagugucagaaacugaccgacgaucacgugcaauuucuuauuuaucagauccugagaggccucaaguacauccauuccgcugacauuauccaccgggaucugaaacccucuaaccuugccguuaaugaagacugcgagcugaagauucucgauuucgggcuggcucgccacacagacgaugaaaugaccggauauguggccacgagaugguaccgggcgccugagaucaugcugaacuggaugcauuacaaucagaccgucgacauuuggagcgugggcuguaucauggccgagcuccugacaggccgcacccuuuuucccgggacagaucacauugaccagcugaaacucauccugagacuugugggaaccccuggcgcugaacugcucaagaagaucuccagcgagucugcccggaacuauauucaaucccugacgcagaugccgaaaaugaauuucgcuaacgucuuuaucggggccaauccccuggcgguugaccuccuggaaaagaugcuugugcuggauagcgacaaacgcauuacagccgcucaggcccucgcucaugccuacuucgcccaguaucacgauccugacgaugagcccguggcugacccuuacgaucaaucuuuugaauccagagaccugcuuaucgaugaguggaaaagccugaccuaugacgaggucauuucuuucgugcccccgccucucgaucaggaagagauggaauccuga

SEQ ID NO: 8976 - protein, 393 aa, Artificial Sequence [sequence omitted]

SEQ ID NO: 8977 - RNA, 1182 nt, Artificial Sequence
  MKK1__Homo_sapiens__AAA36318
augcccaagaagaagccgacgcccauccagcugaacccggcccccgacggcucugcaguuaacgggaccagcucugcggagaccaacuuggaggccuugcagaagaagcuggaggagcuagagcuugaugagcagcagcgaaagcgccuugaggccuuucuuacccagaagcagaaggugggagaacugaaggaugacgacuuugagaagaucagugagcugggggcuggcaauggcggugugguguucaaggucucccacaagccuucuggccuggucauggccagaaagcuaauucaucuggagaucaaacccgcaauccggaaccagaucauaagggagcugcagguucugcaugagugcaacucuccguacaucgugggcuucuauggugcguucuacagcgauggcgagaucaguaucugcauggagcacauggauggagguucucuggaucaaguccugaagaaagcuggaagaauuccugaacaaauuuuaggaaaaguuagcauugcuguaauaaaaggccugacauaucugagggagaagcacaagaucaugcacagagaugucaagcccuccaacauccuagucaacucccguggggagaucaagcucugugacuuuggggucagcgggcagcucaucgacuccauggccaacuccuucgugggcacaagguccuacaugucgccagaaagacuccaggggacucauuacucugugcagucagacaucuggagcaugggacugucucugguagagauggcgguugggagguaucccaucccuccuccagaugccaaggagcuggagcugauguuugggugccagguggaaggagaugcggcugagaccccacccaggccaaggacccccgggaggccccuuagcucauacggaauggacagccgaccucccauggcaauuuuugaguuguuggauuacauagucaacgagccuccuccaaaacugcccaguggaguguucagucuggaauuucaagauuuugugaauaaaugcuuaauaaaaaaccccgcagagagagcagauuugaagcaacucaugguucaugcuuuuaucaagagaucugaugcugaggaaguggauuuugcagguuggcucugcuccaccaucggccuuaaccagcccagcacaccaacccaugcugcuggcgucuaa

SEQ ID NO: 8978 - RNA, 1182 nt, Artificial Sequence
  derived and/or modified sequence opt1 from MKK1__Homo_sapiens__AAA36318
augcccaagaagaagcccacccccauccagcugaaccccgcccccgacggcagcgccgugaacgggaccuccagcgcggagacgaaccucgaggcccugcagaagaagcuggaggagcucgagcuggacgagcagcagcgcaagcggcuggaggccuuccucacccagaagcagaaggucggcgagcugaaggacgacgacuucgagaagaucuccgagcugggggccggcaacgggggcgugguguucaaggucagccacaagccguccggccucgugauggcccgcaagcugauccaccuggagaucaagcccgcgauccggaaccagaucauccgcgagcuccaggugcugcacgagugcaacagccccuacaucgucggguucuacggcgccuucuacuccgacggggagaucagcaucugcauggagcacauggacggcgggucccuggaccaggugcucaagaaggccggccggauccccgagcagauccugggcaaggugagcaucgccgucaucaaggggcugaccuaccuccgcgagaagcacaagaucaugcaccgggacgugaagccguccaacauccuggugaacagccgcggcgagaucaagcugugcgacuucggggucuccggccagcucaucgacagcauggcgaacuccuucgugggcacccggagcuacaugucccccgagcgccugcaggggacgcacuacagcgugcaguccgacaucuggagcaugggccugagccucgucgagauggccguggggcgguaccccaucccgccgcccgacgccaaggagcuggagcugauguucggcugccagguggagggggacgccgccgagaccccgccccgcccccggacccccggccgcccccucuccagcuacggcauggacucccggccgcccauggcgaucuucgagcugcuggacuacaucgucaacgagcccccgcccaagcuccccagcgggguguucucccuggaguuccaggacuucgugaacaagugccugaucaagaaccccgccgagcgcgccgaccucaagcagcugaugguccacgccuucaucaagcggagcgacgccgaggagguggacuucgcgggcuggcugugcuccaccaucgggcucaaccagcccagcacgcccacccacgccgccggcguguga

SEQ ID NO: 8979 - RNA, 1182 nt, Artificial Sequence
  derived and/or modified sequence opt2 from MKK1__Homo_sapiens__AAA36318
augcccaagaagaagcccacccccauccagcucaaccccgcccccgacggcuccgccgucaacggcaccuccuccgccgagaccaaccucgaggcccuccagaagaagcucgaggagcucgagcucgacgagcagcagcgcaagcgccucgaggccuuccucacccagaagcagaaggucggcgagcucaaggacgacgacuucgagaagaucuccgagcucggcgccggcaacggcggcgucgucuucaaggucucccacaagcccuccggccucgucauggcccgcaagcucauccaccucgagaucaagcccgccauccgcaaccagaucauccgcgagcuccagguccuccacgagugcaacucccccuacaucgucggcuucuacggcgccuucuacuccgacggcgagaucuccaucugcauggagcacauggacggcggcucccucgaccagguccucaagaaggccggccgcauccccgagcagauccucggcaaggucuccaucgccgucaucaagggccucaccuaccuccgcgagaagcacaagaucaugcaccgcgacgucaagcccuccaacauccucgucaacucccgcggcgagaucaagcucugcgacuucggcgucuccggccagcucaucgacuccauggccaacuccuucgucggcacccgcuccuacaugucccccgagcgccuccagggcacccacuacuccguccaguccgacaucugguccaugggccucucccucgucgagauggccgucggccgcuaccccauccccccccccgacgccaaggagcucgagcucauguucggcugccaggucgagggcgacgccgccgagacccccccccgcccccgcacccccggccgcccccucuccuccuacggcauggacucccgcccccccauggccaucuucgagcuccucgacuacaucgucaacgagcccccccccaagcuccccuccggcgucuucucccucgaguuccaggacuucgucaacaagugccucaucaagaaccccgccgagcgcgccgaccucaagcagcucaugguccacgccuucaucaagcgcuccgacgccgaggaggucgacuucgccggcuggcucugcuccaccaucggccucaaccagcccuccacccccacccacgccgccggcgucuga

SEQ ID NO: 8980 - RNA, 1182 nt, Artificial Sequence
  derived and/or modified sequence opt3 from MKK1__Homo_sapiens__AAA36318
augcccaagaaaaagccuaccccaauccagcugaacccggcccccgacggcagcgcugugaaugggacauccucugcagagacuaaccucgaagcccuucagaaaaagcuggaggaauuggaguuagaugaacaacagagaaaaaggcuggaggcguuccuaacgcagaagcaaaaggucggagagcucaaagacgaugacuuugaaaagauuucagagcugggugcuggcaaugggggaguuguguucaaaguaagucacaagccuagcggccuugugauggcccggaaacugauacauuuggaaaucaagccagcaauucgcaaccagaucauucgagagcuccagguccugcacgagugcaauucccccuacaucguggguuuuuauggggccuucuacucugauggagaaauaucgaucuguauggagcauauggacggcggcucacuggaucagguucucaagaaagcugggcguauuccugaacaaaucuuaggaaaggugagcauugcagucaucaaaggucugaccuaucuuagagagaagcacaaaauaaugcauagggacgugaagccaaguaacauuuugguaaauucccggggcgaaaucaaacugugcgauuuugggguuucuggacagcuaauugacagcauggccaacuccuucgugggcacacgcucauacaugagucccgagagacuccaggguacucacuauagcguccagucugauaucugguccauggggcugucacuuguggagauggcugugggaagguacccuaucccaccgcccgacgccaaggaacuggaguugauguuuggcugucaagucgaaggcgaugcggcagagaccccuccacggccccgcacaccugggcgaccacucagcaguuauggaauggacucuagacccccgauggccauuuucgaacuguuagacuacauaguuaaugagccucccccaaagcugccuuccgguguguuuagccucgaguuccaggauuuuguaaacaaaugccuuaucaagaaucccgcugaaagggccgaccugaaacaguugauggugcacgcauucauuaagcggucggaugcugaggaagucgacuuugccggcuggcuauguucuaccaucgggcugaaccaaccauccacucccacacaugcggccggaguguga

SEQ ID NO: 8981 - RNA, 1182 nt, Artificial Sequence
  derived and/or modified sequence opt4 from MKK1__Homo_sapiens__AAA36318
augcccaagaagaagcccacccccauccagcugaaccccgcccccgacggcagcgccgugaacggcaccagcagcgccgagaccaaccuggaggcccugcagaagaagcuggaggagcuggagcuggacgagcagcagagaaagagacuggaggccuuccugacccagaagcagaaggugggcgagcugaaggacgacgacuucgagaagaucagcgagcugggcgccggcaacggcggcgugguguucaaggugagccacaagcccagcggccuggugauggccagaaagcugauccaccuggagaucaagcccgccaucagaaaccagaucaucagagagcugcaggugcugcacgagugcaacagccccuacaucgugggcuucuacggcgccuucuacagcgacggcgagaucagcaucugcauggagcacauggacggcggcagccuggaccaggugcugaagaaggccggcagaauccccgagcagauccugggcaaggugagcaucgccgugaucaagggccugaccuaccugagagagaagcacaagaucaugcacagagacgugaagcccagcaacauccuggugaacagcagaggcgagaucaagcugugcgacuucggcgugagcggccagcugaucgacagcauggccaacagcuucgugggcaccagaagcuacaugagccccgagagacugcagggcacccacuacagcgugcagagcgacaucuggagcaugggccugagccugguggagauggccgugggcagauaccccauccccccccccgacgccaaggagcuggagcugauguucggcugccagguggagggcgacgccgccgagaccccccccagacccagaacccccggcagaccccugagcagcuacggcauggacagcagaccccccauggccaucuucgagcugcuggacuacaucgugaacgagcccccccccaagcugcccagcggcguguucagccuggaguuccaggacuucgugaacaagugccugaucaagaaccccgccgagagagccgaccugaagcagcugauggugcacgccuucaucaagagaagcgacgccgaggagguggacuucgccggcuggcugugcagcaccaucggccugaaccagcccagcacccccacccacgccgccggcguguga

SEQ ID NO: 8982 - RNA, 1182 nt, Artificial Sequence
  derived and/or modified sequence opt5 from MKK1__Homo_sapiens__AAA36318
augcccaagaaaaagccuaccccgauccagcugaaccccgccccugacggcagcgcugugaaugggacauccucugccgagacgaaccucgaagcgcugcaaaagaaacuugaggaacuggagcucgaugaacagcagagaaaacggcuggaggcuuuccuuacccagaagcaaaaggucggagagcugaaagacgaugacuuugaaaagauuagcgagcucggcgccgggaauggaggcguuguguucaaagugucccacaagcccucugggcuggucauggcccgcaaacugauccaucucgaaauuaagccugcuaucagaaaccagauuauccgggagcuucaggugcugcacgagugcaauagccccuacaucguuggauuuuauggcgccuucuacuccgauggcgaaauuucuaucuguauggagcauauggacgggggaagccuggaucaggugcucaagaaagcuggccgcauuccugaacaaauccuggggaaggucuccauugccgugaucaaaggacuuacauaucugagagagaagcacaaaauuaugcaucgggacguuaagccgagcaacauccucgucaauucucgcggcgaaaucaaacugugcgauuuugggguguccggacagcugauugacagcauggcgaacucuuucgugggcaccagauccuacaugagccccgagcggcuccagggcacacacuauucugugcaguccgauaucuggagcauggggcugucccuugucgagauggccguuggacgcuacccuauucccccucccgacgcuaaggaacuggagcucauguuuggcugucaaguggaaggggaugccgcugagaccccgccuagaccccggacaccuggacgcccccugucuagcuauggcauggacuccagacccccuauggccaucuucgaacuucuggacuacauugugaaugagccgcccccuaagcuccccagcggggucuuuucucuggaguuccaggauuuugugaacaaaugccugaucaagaauccugcggaacgggccgaccucaaacagcugaugguucacgcuuucaucaagcgcuccgaugccgaggaaguggacuuugcuggauggcuuuguagcaccauuggccugaaccaacccucuacgccgacccaugccgccggcgucuga

SEQ ID NO: 8983 - protein, 347 aa, Artificial Sequence
  MKK3__Homo_sapiens__P46734
MESPASSQPASMPQSKGKSKRKKDLRISCMSKPPAPNPTPPRNLDSRTFITIGDRNFEVEADDLVTISELGRGAYGVVEKVRHAQSGTIMAVKRIRATVNSQEQKRLLMDLDINMRTVDCFYTVTFYGALFREGDVWICMELMDTSLDKFYRKVLDKNMTIPEDILGEIAVSIVRALEHLHSKLSVIHRDVKPSNVLINKEGHVKMCDFGISGYLVDSVAKTMDAGCKPYMAPERINPELNQKGYNVKSDVWSLGITMIEMAILRFPYESWGTPFQQLKQVVEEPSPQLPADRFSPEFVDFTAQCLRKNPAERMSYLELMEHPFFTLHKTKKTDIAAFVKEILGEDS

SEQ ID NO: 8984 - RNA, 1044 nt, Artificial Sequence
  MKK3__Homo_sapiens__AAH32478
auggagucgcccgccucgagccagcccgccagcaugccccaguccaaaggaaaauccaagaggaagaaggaucuacggauauccugcauguccaagccacccgcacccaaccccacacccccccggaaccuggacucccggaccuucaucaccauuggagacagaaacuuugagguggaggcugaugacuuggugaccaucucagaacugggccguggagccuauggggugguagagaaggugcggcacgcccagagcggcaccaucauggccgugaagcggauccgggccaccgugaacucacaggagcagaagcggcugcucauggaccuggacaucaacaugcgcacggucgacugcuucuacacugucaccuucuacggggcacuauucagagagggagacguguggaucugcauggagcucauggacacauccuuggacaaguucuaccggaaggugcuggauaaaaacaugacaauuccagaggacauccuuggggagauugcugugucuaucgugcgggcccuggagcaucugcacagcaagcugucggugauccacagagaugugaagcccuccaauguccuuaucaacaaggagggccaugugaagaugugugacuuuggcaucaguggcuacuugguggacucuguggccaagacgauggaugccggcugcaagcccuacauggccccugagaggaucaacccagagcugaaccagaagggcuacaaugucaaguccgacgucuggagccugggcaucaccaugauugagauggccauccugcgguucccuuacgaguccugggggaccccguuccagcagcugaagcaggugguggaggagccguccccccagcucccagccgaccguuucucccccgaguuuguggacuucacugcucagugccugaggaagaaccccgcagagcguaugagcuaccuggagcugauggagcaccccuucuucaccuugcacaaaaccaagaagacggacauugcugccuucgugaaggagauccugggagaagacucauag

SEQ ID NO: 8985 - RNA, 1044 nt, Artificial Sequence
  derived and/or modified sequence opt1 from MKK3__Homo_sapiens__AAH32478
auggagagccccgccuccagccagccggccuccaugccccagagcaagggcaaguccaagcgcaagaaggaccugcggaucagcugcauguccaagccgcccgcgcccaaccccaccccgccccgcaaccucgacagccggaccuucaucacgaucggggaccgcaacuucgagguggaggccgacgaccuggucaccaucuccgagcugggccgcggggccuacggcgugguggagaagguccggcacgcccagagcgggaccaucauggccgugaagcggauccgcgcgaccgugaacucccaggagcagaagcggcuccugauggaccuggacaucaacaugcgcacggucgacugcuucuacaccgugaccuucuacggcgcccucuuccgggagggcgacguguggaucugcauggagcugauggacaccagccuggacaaguucuaccgcaagguccucgacaagaacaugacgauccccgaggacauccugggggagaucgccguguccaucgugcgggcccuggagcaccuccacagcaagcuguccgucauccaccgcgacgugaagcccagcaacgugcugaucaacaaggagggccacgucaagaugugcgacuucgggaucuccggcuaccucguggacagcguggcgaagaccauggacgccgggugcaagcccuacauggcccccgagcggaucaacccggagcugaaccagaagggcuacaacgucaaguccgacguguggagccugggcaucaccaugaucgagauggccauccuccgcuuccccuacgagagcugggggacccccuuccagcagcugaagcaggucguggaggagcccuccccgcagcugcccgccgaccgguucagccccgaguucguggacuucacggcgcagugccuccgcaagaaccccgccgagcggauguccuaccuggagcugauggagcacccguucuucacccuccacaagaccaagaagaccgacaucgccgccuucgugaaggagauccugggcgaggacagcuga

SEQ ID NO: 8986 - RNA, 1044 nt, Artificial Sequence
  derived and/or modified sequence opt2 from MKK3__Homo_sapiens__AAH32478
auggagucccccgccuccucccagcccgccuccaugccccaguccaagggcaaguccaagcgcaagaaggaccuccgcaucuccugcauguccaagccccccgcccccaaccccacccccccccgcaaccucgacucccgcaccuucaucaccaucggcgaccgcaacuucgaggucgaggccgacgaccucgucaccaucuccgagcucggccgcggcgccuacggcgucgucgagaagguccgccacgcccaguccggcaccaucauggccgucaagcgcauccgcgccaccgucaacucccaggagcagaagcgccuccucauggaccucgacaucaacaugcgcaccgucgacugcuucuacaccgucaccuucuacggcgcccucuuccgcgagggcgacgucuggaucugcauggagcucauggacaccucccucgacaaguucuaccgcaagguccucgacaagaacaugaccauccccgaggacauccucggcgagaucgccgucuccaucguccgcgcccucgagcaccuccacuccaagcucuccgucauccaccgcgacgucaagcccuccaacguccucaucaacaaggagggccacgucaagaugugcgacuucggcaucuccggcuaccucgucgacuccgucgccaagaccauggacgccggcugcaagcccuacauggcccccgagcgcaucaaccccgagcucaaccagaagggcuacaacgucaaguccgacgucuggucccucggcaucaccaugaucgagauggccauccuccgcuuccccuacgaguccuggggcacccccuuccagcagcucaagcaggucgucgaggagcccuccccccagcuccccgccgaccgcuucucccccgaguucgucgacuucaccgcccagugccuccgcaagaaccccgccgagcgcauguccuaccucgagcucauggagcaccccuucuucacccuccacaagaccaagaagaccgacaucgccgccuucgucaaggagauccucggcgaggacuccuga

SEQ ID NO: 8987 - RNA, 1044 nt, Artificial Sequence
  derived and/or modified sequence opt3 from MKK3__Homo_sapiens__AAH32478
auggagagccccgccuccucucagccugcuucaaugccacaaaguaagggcaaaagcaagaggaaaaaggaccugagaaucuccugcaugucuaaaccgcccgcaccuaacccaacacccccucggaaucucgauucgcgcaccuucauuacuauaggggaccgaaacuuugaaguggaggccgaugaccuugucacgaucucagaacugggacguggugcguacggcguuguggagaagguaagacacgcucagagcgggaccauuauggccgugaagaggauccgggcaacagucaauagucaggaacagaaacgcuuguuaauggaucuggacauuaacaugagaacuguggauuguuucuauaccguuacauuuuacggagcccuauucagggagggcgacguguggaucugcauggagcucauggauaccucccuggacaaguuuuaucggaaaguccuugauaagaauaugacuauaccagaagacauccugggugagauugcugugucuaucguacgcgcauuggaacaucuccacagcaaacuguccguuauucaucgagaugugaagcccucaaacguccugaucaauaaggaggggcacgugaaaaugugugacuucggaauaaguggcuaccucguggacagcgucgccaagacaauggaugcuggcugcaaaccuuauauggccccagagagaauuaacccggaauuaaaucaaaagggguacaacguuaaaucugacguguggucccugggaaucaccaugauugagauggcgauccuuagguuucccuaugaaucaugggguacgccuuuccagcaguugaagcagguaguggaggaaccaagcccccaacugccugcagaucgguuuaguccagaguucgucgacuuuacugcccagugucuacguaaaaaucccgcugagcgcaugucuuaccucgaacugauggagcauccguucuuuacccuucacaagacaaagaaaacugauaucgccgcauucgugaaggaaauucugggcgaggacuccuga

SEQ ID NO: 8988 - RNA, 1044 nt, Artificial Sequence
  derived and/or modified sequence opt4 from MKK3__Homo_sapiens__AAH32478
auggagagccccgccagcagccagcccgccagcaugccccagagcaagggcaagagcaagagaaagaaggaccugagaaucagcugcaugagcaagccccccgcccccaaccccaccccccccagaaaccuggacagcagaaccuucaucaccaucggcgacagaaacuucgagguggaggccgacgaccuggugaccaucagcgagcugggcagaggcgccuacggcgugguggagaaggugagacacgcccagagcggcaccaucauggccgugaagagaaucagagccaccgugaacagccaggagcagaagagacugcugauggaccuggacaucaacaugagaaccguggacugcuucuacaccgugaccuucuacggcgcccuguucagagagggcgacguguggaucugcauggagcugauggacaccagccuggacaaguucuacagaaaggugcuggacaagaacaugaccauccccgaggacauccugggcgagaucgccgugagcaucgugagagcccuggagcaccugcacagcaagcugagcgugauccacagagacgugaagcccagcaacgugcugaucaacaaggagggccacgugaagaugugcgacuucggcaucagcggcuaccugguggacagcguggccaagaccauggacgccggcugcaagcccuacauggcccccgagagaaucaaccccgagcugaaccagaagggcuacaacgugaagagcgacguguggagccugggcaucaccaugaucgagauggccauccugagauuccccuacgagagcuggggcacccccuuccagcagcugaagcaggugguggaggagcccagcccccagcugcccgccgacagauucagccccgaguucguggacuucaccgcccagugccugagaaagaaccccgccgagagaaugagcuaccuggagcugauggagcaccccuucuucacccugcacaagaccaagaagaccgacaucgccgccuucgugaaggagauccugggcgaggacagcuga

SEQ ID NO: 8989 - RNA, 1044 nt, Artificial Sequence
  derived and/or modified sequence opt5 from MKK3__Homo_sapiens__AAH32478
auggagagccccgccuccucucagccugcuagcaugccgcaauccaagggcaaaucuaagagaaagaaggaccugcggaucagcugcauguccaaacccccugcccccaacccuacacccccucgcaaucucgauucuagaaccuucauuacgaucggggaccggaacuuugaaguggaggcggaugaccuggucaccauuagcgaacuuggacgcggcgcuuacgggguuguggagaaggugagacacgcccaguccggaacaaucauggccgucaagcggauucgcgcuaccgugaauagccaggaacagaaaagacugcucauggaucuggacaucaacaugcggacaguugauuguuucuauaccgugacauuuuacggcgcccuuuuccgcgagggggacgucuggaucugcauggagcugauggauaccucucucgacaaguuuuauagaaaagugcuggauaagaauaugacgauuccggaagacauccugggagagauugcuguuuccaucgugcgggcccucgaacaucugcacagcaaacuuucugucauucaucgcgaugugaagcccuccaacgugcugaucaauaaggagggccacgucaaaaugugugacuucggcauuagcggguaccucguugacucuguggcgaagaccauggaugccggaugcaaaccuuauauggcucccgagagaaucaacccugaacugaaucaaaagggcuacaacgugaaauccgacgucuggagccuugggaucacaaugauugagauggccauccugcgguuucccuaugaauccuggggaaccccguuccagcagcucaaacaggugguugaggaaccuucuccccaacugccugcugaucgcuuuagccccgaguucguggacuuuacagcccagugucugcggaaaaaucccgcggagagaauguccuaccucgaacugauggagcauccuuucuuuacccuucacaagacgaagaaaacagauauugccgcuuucgucaaggaaauccugggcgaggacagcuga

SEQ ID NO: 8990 - protein, 399 aa, Artificial Sequence
  MKK4__Homo_sapiens__P45985
MAAPSPSGGGGSGGGSGSGTPGPVGSPAPGHPAVSSMQGKRKALKLNFANPPFKSTARFTLNPNPTGVQNPHIERLRTHSIESSGKLKISPEQHWDFTAEDLKDLGEIGRGAYGSVNKMVHKPSGQIMAVKRIRSTVDEKEQKQLLMDLDVVMRSSDCPYIVQFYGALFREGDCWICMELMSTSFDKFYKYVYSVLDDVIPEEILGKITLATVKALNHLKENLKIIHRDIKPSNILLDRSGNIKLCDFGISGQLVDSIAKTRDAGCRPYMAPERIDPSASRQGYDVRSDVWSLGITLYELATGRFPYPKWNSVFDQLTQVVKGDPPQLSNSEEREFSPSFINFVNLCLTKDESKRPKYKELLKHPFILMYEERAVEVACYVCKILDQMPATPSSPMYVD

SEQ ID NO: 8991 - RNA, 1200 nt, Artificial Sequence
  MKK4__Homo_sapiens__AAC24130
auggcggcuccgagcccgagcggcggcggcggcuccgggggcggcagcggcagcggcacccccggccccguaggguccccggcgccaggccacccggccgucagcagcaugcaggguaaacgcaaagcacugaaguugaauuuugcaaauccaccuuucaaaucuacagcaagguuuacucugaaucccaauccuacaggaguucaaaacccacacauagagagacugagaacacacagcauugagucaucaggaaaacugaagaucuccccugaacaacacugggauuucacugcagaggacuugaaagaccuuggagaaauuggacgaggagcuuaugguucugucaacaaaaugguccacaaaccaagugggcaaauaauggcaguuaaaagaauucggucaacaguggaugaaaaagaacaaaaacaacuucuuauggauuuggauguaguaaugcggaguagugauugcccauacauuguucaguuuuauggugcacucuucagagagggugacuguuggaucuguauggaacucaugucuaccucguuugauaaguuuuacaaauauguauauaguguauuagaugauguuauuccagaagaaauuuuaggcaaaaucacuuuagcaacugugaaagcacuaaaccacuuaaaagaaaacuugaaaauuauucacagagauaucaaaccuuccaauauucuucuggacagaaguggaaauauuaagcucugugacuucggcaucaguggacagcuuguggacucuauugccaagacaagagaugcuggcuguaggccauacauggcaccugaaagaauagacccaagcgcaucacgacaaggauaugauguccgcucugaugucuggaguuuggggaucacauuguaugaguuggccacaggccgauuuccuuauccaaaguggaauaguguauuugaucaacuaacacaagucgugaaaggagauccuccgcagcugaguaauucugaggaaagggaauucuccccgaguuucaucaacuuugucaacuugugccuuacgaaggaugaauccaaaaggccaaaguauaaagagcuucugaaacaucccuuuauuuugauguaugaagaacgugccguugaggucgcaugcuauguuuguaaaauccuggaucaaaugccagcuacucccagcucucccauguaugucgauuga

SEQ ID NO: 8992 - RNA, 1200 nt, Artificial Sequence
  derived and/or modified sequence opt1 from MKK4__Homo_sapiens__AAC24130
auggccgcccccagcccguccggcgggggcgggagcggcgggggcuccggcagcgggacccccggccccguggggucccccgcgccgggccaccccgccgucagcuccaugcaggggaagcgcaaggcccugaagcucaacuucgccaacccgcccuucaagagcaccgcccgguucacgcugaaccccaaccccaccggcgugcagaacccccacaucgagcgccugcggacccacuccaucgagagcuccggcaagcucaagaucagccccgagcagcacugggacuucaccgcggaggaccugaaggaccugggggagaucggccgcggggccuacggcuccgugaacaagaugguccacaagccgagcggccagaucauggccgugaagcggauccgcuccacgguggacgagaaggagcagaagcagcuccugauggaccuggacgucgugaugcggagcuccgacugccccuacaucgugcaguucuacggggcccucuuccgcgagggcgacugcuggaucugcauggagcugaugagcaccuccuucgacaaguucuacaaguacgucuacagcgugcuggacgacgugauccccgaggagauccucgggaagaucacccuggcgaccgucaaggcccugaaccaccucaaggagaaccugaagaucauccaccgggacaucaagcccagcaacauccugcucgaccgcuccggcaacaucaagcugugcgacuucgggaucagcggccagcugguggacuccaucgccaagacgcgggacgccggcugccgcccguacauggcccccgagcggaucgaccccagcgcgucccgccagggguacgacgugcggagcgacgucuggucccucggcaucacccuguacgagcuggccaccgggcgcuuccccuacccgaaguggaacagcguguucgaccagcucacccagguggucaagggcgacccgccccagcuguccaacagcgaggagcgggaguucucccccagcuucaucaacuucgugaaccugugccucacgaaggacgaguccaagcgccccaaguacaaggagcugcugaagcaccccuucauccucauguacgaggagcgggccguggaggucgccugcuacgugugcaagauccuggaccagaugcccgccacccccagcuccccgauguacguggacuga

SEQ ID NO: 8993 - RNA, 1200 nt, Artificial Sequence
  derived and/or modified sequence opt2 from MKK4__Homo_sapiens__AAC24130
auggccgcccccucccccuccggcggcggcggcuccggcggcggcuccggcuccggcacccccggccccgucggcucccccgcccccggccaccccgccgucuccuccaugcagggcaagcgcaaggcccucaagcucaacuucgccaacccccccuucaaguccaccgcccgcuucacccucaaccccaaccccaccggcguccagaacccccacaucgagcgccuccgcacccacuccaucgaguccuccggcaagcucaagaucucccccgagcagcacugggacuucaccgccgaggaccucaaggaccucggcgagaucggccgcggcgccuacggcuccgucaacaagaugguccacaagcccuccggccagaucauggccgucaagcgcauccgcuccaccgucgacgagaaggagcagaagcagcuccucauggaccucgacgucgucaugcgcuccuccgacugccccuacaucguccaguucuacggcgcccucuuccgcgagggcgacugcuggaucugcauggagcucauguccaccuccuucgacaaguucuacaaguacgucuacuccguccucgacgacgucauccccgaggagauccucggcaagaucacccucgccaccgucaaggcccucaaccaccucaaggagaaccucaagaucauccaccgcgacaucaagcccuccaacauccuccucgaccgcuccggcaacaucaagcucugcgacuucggcaucuccggccagcucgucgacuccaucgccaagacccgcgacgccggcugccgccccuacauggcccccgagcgcaucgaccccuccgccucccgccagggcuacgacguccgcuccgacgucuggucccucggcaucacccucuacgagcucgccaccggccgcuuccccuaccccaaguggaacuccgucuucgaccagcucacccaggucgucaagggcgaccccccccagcucuccaacuccgaggagcgcgaguucucccccuccuucaucaacuucgucaaccucugccucaccaaggacgaguccaagcgccccaaguacaaggagcuccucaagcaccccuucauccucauguacgaggagcgcgccgucgaggucgccugcuacgucugcaagauccucgaccagaugcccgccacccccuccucccccauguacgucgacuga

SEQ ID NO: 8994 - RNA, 1200 nt, Artificial Sequence
  derived and/or modified sequence opt3 from MKK4__Homo_sapiens__AAC24130
auggccgcucccagcccuuccggcgggggagguucuggcgggggaucaggcagugguaccccagggccggugggaagccccgcaccuggccacccagccgucuccucuaugcagggcaagagaaaagcgcugaagcucaacuucgcuaaucccccuuuuaaaucgacagccagguucacucuuaacccaaaucccacggggguucaaaacccucauaucgagcggcugcgcacccacucaauugaaagcaguggaaaguugaaaauauccccagagcagcauugggacuuuacagcagaagauuuaaaggaccugggugagaucggccgaggggccuacggaucugugaauaagaugguacacaaaccgagcggccagauuauggcugugaagcguaucagauccacugucgaugaaaaagagcagaagcaacuacucauggaccuggaugugguuaugaggucaagugacugccccuauauugugcaguucuacggugcacuuuuucgggagggggauuguuggaucugcauggaacugaugagcaccucuuucgacaaauuuuauaaguacgucuauuccguguuggaugacguaauaccugaggaaauccucggaaagauuacacuggccaccguuaaagcucugaaccaucucaaggagaauuuaaaaaucauucaccgcgauaucaagccaucaaacauacugcuugacagaagcggcaauauuaaauugugugauuucggcaucagugggcagcugguggacucuauugccaagacuagggacgcgggaugccggcccuacauggcaccugagcgcaucgauccauccgccagccgacaggguuaugacgucagaucggauguguggucucuaggcaucacacucuacgaacuggcuaccgggagguuucccuacccgaaauggaacuccguguucgaccaacuuacgcaggucguuaagggagauccuccccagcugucaaauagugaggaacgggaguuuagcccauccuucauuaacuuugugaauuugugucucacuaaggacgaaucuaaacguccuaaguauaaagagcuguuaaagcaccccuucauacugauguacgaggaacgcgccguagagguggcaugcuaugucuguaaaauccucgaucagaugccagcuacccccagcucaccuauguacguggacuga

SEQ ID NO: 8995 - RNA, 1200 nt, Artificial Sequence
  derived and/or modified sequence opt4 from MKK4__Homo_sapiens__AAC24130
auggccgcccccagccccagcggcggcggcggcagcggcggcggcagcggcagcggcacccccggccccgugggcagccccgcccccggccaccccgccgugagcagcaugcagggcaagagaaaggcccugaagcugaacuucgccaacccccccuucaagagcaccgccagauucacccugaaccccaaccccaccggcgugcagaacccccacaucgagagacugagaacccacagcaucgagagcagcggcaagcugaagaucagccccgagcagcacugggacuucaccgccgaggaccugaaggaccugggcgagaucggcagaggcgccuacggcagcgugaacaagauggugcacaagcccagcggccagaucauggccgugaagagaaucagaagcaccguggacgagaaggagcagaagcagcugcugauggaccuggacguggugaugagaagcagcgacugccccuacaucgugcaguucuacggcgcccuguucagagagggcgacugcuggaucugcauggagcugaugagcaccagcuucgacaaguucuacaaguacguguacagcgugcuggacgacgugauccccgaggagauccugggcaagaucacccuggccaccgugaaggcccugaaccaccugaaggagaaccugaagaucauccacagagacaucaagcccagcaacauccugcuggacagaagcggcaacaucaagcugugcgacuucggcaucagcggccagcugguggacagcaucgccaagaccagagacgccggcugcagacccuacauggcccccgagagaaucgaccccagcgccagcagacagggcuacgacgugagaagcgacguguggagccugggcaucacccuguacgagcuggccaccggcagauuccccuaccccaaguggaacagcguguucgaccagcugacccagguggugaagggcgaccccccccagcugagcaacagcgaggagagagaguucagccccagcuucaucaacuucgugaaccugugccugaccaaggacgagagcaagagacccaaguacaaggagcugcugaagcaccccuucauccugauguacgaggagagagccguggagguggccugcuacgugugcaagauccuggaccagaugcccgccacccccagcagccccauguacguggacuga

SEQ ID NO: 8996 - RNA, 1200 nt, Artificial Sequence
  derived and/or modified sequence opt5 from MKK4__Homo_sapiens__AAC24130
auggccgcucccagcccuuccggcgggggaggcucugggggaggcagcggguccggaaccccgggccccgugggcucuccugcccccgggcacccugcggucagcuccaugcagggaaagagaaaagcucugaagcucaacuucgccaaucccccuuuuaaaucuacagcccgguucacgcugaacccgaaucccaccggcguucaaaacccucauaucgagcgccuuagaacacacagcauugaauccagcgggaagcugaaaaucucucccgagcagcauugggacuuuaccgcugaagaucucaaggaccugggagagauuggccgcggggccuacggauccgugaauaagauggugcacaaaccuagcggccagaucauggcugucaagcggauuagaucuacaguggaugaaaaagagcagaagcaacuucugauggaccucgauguugugaugcgguccagcgacugccccuauaucguccaguucuacggcgcccuguuucgcgagggggauuguuggaucugcauggaacugaugucuaccuccuucgacaaauuuuauaaguacguguauagcguucucgaugacgugauuccggaggaaauccugggaaagauuacacuugcgaccgucaaagcccugaaccaucucaaggagaaucugaaaaucauucacagagauaucaagccuuccaacauucuucuggaccggucuggcaauaucaaacucugugauuucgggaucagcggacagcugguggacuccauugcuaagacgcgcgacgccggcugcagacccuacauggcuccugagcggaucgaucccagcgccucucgccagggguaugacgugagauccgaugucuggagccugggaauuacccucuacgaacuggcgacaggccgguuucccuacccuaaauggaacucuguuuucgaccaacuuacccagguggugaagggcgauccgccccagcugagcaauuccgaggaacgcgaguuuucuccuagcuucaucaacuuugucaaucucugucugacaaaggacgaauccaaaagacccaaguauaaagagcuucugaagcacccuuucauucucauguacgaggaacgggccguggagguugcuugcuauguguguaaaauccuggaucagaugcccgccaccccgagcucuccuauguacgucgacuga

SEQ ID NO: 8997 - protein, 334 aa, Artificial Sequence
  MKK6__Homo_sapiens__P52564
MSQSKGKKRNPGLKIPKEAFEQPQTSSTPPRDLDSKACISIGNQNFEVKADDLEPIMELGRGAYGVVEKMRHVPSGQIMAVKRIRATVNSQEQKRLLMDLDISMRTVDCPFTVTFYGALFREGDVWICMELMDTSLDKFYKQVIDKGQTIPEDILGKIAVSIVKALEHLHSKLSVIHRDVKPSNVLINALGQVKMCDFGISGYLVDSVAKTIDAGCKPYMAPERINPELNQKGYSVKSDIWSLGITMIELAILRFPYDSWGTPFQQLKQVVEEPSPQLPADKFSAEFVDFTSQCLKKNSKERPTYPELMQHPFFTLHESKGTDVASFVKLILGD

SEQ ID NO: 8998 - RNA, 1005 nt, Artificial Sequence
  MKK6__Homo_sapiens__AAB05035
augucucagucgaaaggcaagaagcgaaacccuggccuuaaaauuccaaaagaagcauuugaacaaccucagaccaguuccacaccaccucgagauuuagacuccaaggcuugcauuucuauuggaaaucagaacuuugaggugaaggcagaugaccuggagccuauaauggaacugggacgaggugcguacggggugguggagaagaugcggcacgugcccagcgggcagaucauggcagugaagcggauccgagccacaguaaauagccaggaacagaaacggcuacugauggauuuggauauuuccaugaggacgguggacuguccauucacugucaccuuuuauggcgcacuguuucgggagggugauguguggaucugcauggagcucauggauacaucacuagauaaauucuacaaacaaguuauugauaaaggccagacaauuccagaggacaucuuagggaaaauagcaguuucuauuguaaaagcauuagaacauuuacauaguaagcugucugucauucacagagacgucaagccuucuaauguacucaucaaugcucucggucaagugaagaugugcgauuuuggaaucaguggcuacuugguggacucuguugcuaaaacaauugaugcagguugcaaaccauacauggccccugaaagaauaaacccagagcucaaccagaagggauacagugugaagucugacauuuggagucugggcaucacgaugauugaguuggccauccuucgauuucccuaugauucauggggaacuccauuucagcagcucaaacaggugguagaggagccaucgccacaacucccagcagacaaguucucugcagaguuuguugacuuuaccucacagugcuuaaagaagaauuccaaagaacggccuacauacccagagcuaaugcaacauccauuuuucacccuacaugaauccaaaggaacagauguggcaucuuuuguaaaacugauucuuggagacuaa

SEQ ID NO: 8999 - RNA, 1005 nt, Artificial Sequence
  derived and/or modified sequence opt1 from MKK6__Homo_sapiens__AAB05035
augagccaguccaagggcaagaagcgcaaccccgggcugaagaucccgaaggaggccuucgagcagccccagaccagcuccaccccgccccgggaccucgacagcaaggccugcaucuccaucggcaaccagaacuucgaggugaaggcggacgaccuggagcccaucauggagcuggggcgcggcgccuacggggucguggagaagaugcggcacgugcccagcggccagaucauggccgucaagcgcauccgggccacggugaacucccaggagcagaagcgccuccugauggaccuggacaucagcaugcggaccguggacugccccuucaccgucaccuucuacggcgcccucuuccgcgagggggacguguggaucugcauggagcugauggacacgucccuggacaaguucuacaagcaggucaucgacaagggccagaccauccccgaggacauccucgggaagaucgcggugagcaucgugaaggcccuggagcaccuccacuccaagcugagcgugauccaccgggacgucaagccguccaacgugcugaucaacgcccugggccaggugaagaugugcgacuucgggaucagcggcuaccucgucgacuccguggccaagaccaucgacgcgggcugcaagcccuacauggcccccgagcgcaucaaccccgagcugaaccagaagggguacagcgugaaguccgacaucuggagccugggcaucaccaugaucgagcucgccauccugcgguucccguacgacuccugggggacgcccuuccagcagcugaagcaggucguggaggagcccagcccccagcucccggccgacaaguucagcgccgaguucguggacuucaccucccagugccugaagaagaacagcaaggagcgccccaccuaccccgagcugaugcagcaccccuucuucacccuccacgaguccaagggcacggacgucgcgagcuucgugaagcugauccugggcgacuga

SEQ ID NO: 9000 - RNA, 1005 nt, Artificial Sequence
  derived and/or modified sequence opt2 from MKK6__Homo_sapiens__AAB05035
augucccaguccaagggcaagaagcgcaaccccggccucaagauccccaaggaggccuucgagcagccccagaccuccuccacccccccccgcgaccucgacuccaaggccugcaucuccaucggcaaccagaacuucgaggucaaggccgacgaccucgagcccaucauggagcucggccgcggcgccuacggcgucgucgagaagaugcgccacguccccuccggccagaucauggccgucaagcgcauccgcgccaccgucaacucccaggagcagaagcgccuccucauggaccucgacaucuccaugcgcaccgucgacugccccuucaccgucaccuucuacggcgcccucuuccgcgagggcgacgucuggaucugcauggagcucauggacaccucccucgacaaguucuacaagcaggucaucgacaagggccagaccauccccgaggacauccucggcaagaucgccgucuccaucgucaaggcccucgagcaccuccacuccaagcucuccgucauccaccgcgacgucaagcccuccaacguccucaucaacgcccucggccaggucaagaugugcgacuucggcaucuccggcuaccucgucgacuccgucgccaagaccaucgacgccggcugcaagcccuacauggcccccgagcgcaucaaccccgagcucaaccagaagggcuacuccgucaaguccgacaucuggucccucggcaucaccaugaucgagcucgccauccuccgcuuccccuacgacuccuggggcacccccuuccagcagcucaagcaggucgucgaggagcccuccccccagcuccccgccgacaaguucuccgccgaguucgucgacuucaccucccagugccucaagaagaacuccaaggagcgccccaccuaccccgagcucaugcagcaccccuucuucacccuccacgaguccaagggcaccgacgucgccuccuucgucaagcucauccucggcgacuga

SEQ ID NO: 9001 - RNA, 1005 nt, Artificial Sequence
  derived and/or modified sequence opt3 from MKK6__Homo_sapiens__AAB05035
augagccaguccaagggcaaaaagagaaaccccgggcugaaaaucccuaaggaggccuucgaacaaccacagaccucuucaacaccgcccagggaccucgauaguaaggcuugcauuagcauaggaaaucagaacuuugaggugaaggcagacgaucuugaaccuaucauggagcugggucggggcgccuacggggucguugaaaagaugcgccacgugccauccggacagauuauggcgguaaaacgaauccgugcuacugucaauucucaagagcagaagagauuguuaauggaccuggauauuucgaugaggacgguggacugucccuucaccgugacauuuuauggcgcccuauuccgggagggugauguuuggaucugcauggaacucauggacacuucacuggauaaauuuuacaaacaggugauagacaaagggcagaccaucccugaggauauucuuggaaagaucgcagucagcauugugaaggcccuggaacauuugcacaguaaacucuccguaauccaucgcgacguuaagccaucuaacgugcugauaaaugcucugggccaagucaaaaugugugauuucggcauuagcggguaucucguggacuccguggcaaagacaaucgacgccggaugcaaacccuacauggcuccugagagaauuaacccagaguuaaaucagaaggguuauucagucaaaagugauaucuggagccugggcaucaccaugauugaacuugccauauugagguuuccguacgacucuugggggacucccuuccagcagcugaagcaaguuguggaggaaccuuccccacagcuacccgcggauaaguuuucagcagaguucguagacuuuacaagccagugucucaaaaagaacaguaaagaacggccuaccuauccagagcugaugcaacaccccuucuuuacgcuucaugagucuaagggaacugauguggccuccuucgucaaacugaucuugggcgacuga

SEQ ID NO: 9002 - RNA, 1005 nt, Artificial Sequence
  derived and/or modified sequence opt4 from MKK6__Homo_sapiens__AAB05035
augagccagagcaagggcaagaagagaaaccccggccugaagauccccaaggaggccuucgagcagccccagaccagcagcaccccccccagagaccuggacagcaaggccugcaucagcaucggcaaccagaacuucgaggugaaggccgacgaccuggagcccaucauggagcugggcagaggcgccuacggcgugguggagaagaugagacacgugcccagcggccagaucauggccgugaagagaaucagagccaccgugaacagccaggagcagaagagacugcugauggaccuggacaucagcaugagaaccguggacugccccuucaccgugaccuucuacggcgcccuguucagagagggcgacguguggaucugcauggagcugauggacaccagccuggacaaguucuacaagcaggugaucgacaagggccagaccauccccgaggacauccugggcaagaucgccgugagcaucgugaaggcccuggagcaccugcacagcaagcugagcgugauccacagagacgugaagcccagcaacgugcugaucaacgcccugggccaggugaagaugugcgacuucggcaucagcggcuaccugguggacagcguggccaagaccaucgacgccggcugcaagcccuacauggcccccgagagaaucaaccccgagcugaaccagaagggcuacagcgugaagagcgacaucuggagccugggcaucaccaugaucgagcuggccauccugagauuccccuacgacagcuggggcacccccuuccagcagcugaagcaggugguggaggagcccagcccccagcugcccgccgacaaguucagcgccgaguucguggacuucaccagccagugccugaagaagaacagcaaggagagacccaccuaccccgagcugaugcagcaccccuucuucacccugcacgagagcaagggcaccgacguggccagcuucgugaagcugauccugggcgacuga

SEQ ID NO: 9003 - RNA, 1005 nt, Artificial Sequence
  derived and/or modified sequence opt5 from MKK6__Homo_sapiens__AAB05035
augagccaguccaagggcaaaaagagaaaccccgggcugaaaaucccuaaggaggccuucgaacaaccgcagaccucuagcacacccccucgggaccucgauuccaaggcuugcauuucuaucggaaaucagaacuuugaggugaaagccgacgaucuggaacccauuauggagcuuggccgcggggcguacggagucguugaaaagaugagacacgugccuagcggccagaucauggcugugaaacggauucgcgccacggucaauucccaagagcagaagagacugcucauggaccuggauaucucuaugcggaccguggacugucccuucacaguuaccuuuuauggggcccuuuuccgcgagggagauguguggaucugcauggaacugauggacacaagccucgauaaauuuuacaagcaggucauugacaaaggccagaccaucccugaggauauucugggcaagaucgcuguguccauuguuaaggcccuggaacaucuccacagcaaacugucugugauccauagagacgucaagccguccaacgugcuuauuaaugcucuggggcaagugaaaaugugugauuucggaaucagcggcuaucucgucgacucuguugccaagacaaucgacgcggggugcaaacccuacauggccccugagcggauuaaccccgagcugaaucagaagggauauuccgugaaaagcgauaucuggucucuuggcauuaccaugaucgaacuggcuauucuccgcuuuccuuacgacuccugggggacgcccuuccagcagcugaagcaaguggucgaggaaccgagcccucagcugcccgccgauaaguuuuccgcugaguucguggacuuuaccucucagugucucaaaaagaacagcaaagaaagaccuacauaucccgagcugaugcaacaccccuucuuuacccuucaugaguccaagggaacagauguugccagcuucgugaaacugauccucggcgacuga

SEQ ID NO: 9004 - protein, 419 aa, Artificial Sequence
  MKK7__Homo_sapiens__O14733
MAASSLEQKLSRLEAKLKQENREARRRIDLNLDISPQRPRPTLQLPLANDGGSRSPSSESSPQHPTPPARPRHMLGLPSTLFTPRSMESIEIDQKLQEIMKQTGYLTIGGQRYQAEINDLENLGEMGSGTCGQVWKMRFRKTGHVIAVKQMRRSGNKEENKRILMDLDVVLKSHDCPYIVQCFGTFITNTDVFIAMELMGTCAEKLKKRMQGPIPERILGKMTVAIVKALYYLKEKHGVIHRDVKPSNILLDERGQIKLCDFGISGRLVDSKAKTRSAGCAAYMAPERIDPPDPTKPDYDIRADVWSLGISLVELATGQFPYKNCKTDFEVLTKVLQEEPPLLPGHMGFSGDFQSFVKDCLTKDHRKRPKYNKLLEHSFIKRYETLEVDVASWFKDVMAKTESPRTSGVLSQPHLPFFR

SEQ ID NO: 9005 - RNA, 1260 nt, Artificial Sequence
  MKK7__Homo_sapiens__AAC26142
auggcggcguccucccuggaacagaagcugucccgccuggaagcaaagcugaagcaggagaaccgggaggcccggcggaggaucgaccucaaccuggauaucagcccccagcggcccaggcccacccugcagcucccgcuggccaacgaugggggcagccgcucgccauccucagagagcuccccgcagcaccccacgccccccgcccggccccgccacaugcuggggcucccgucaacccuguucacaccccgcagcauggagagcauugagauugaccagaagcugcaggagaucaugaagcagacgggcuaccugaccaucgggggccagcgcuaccaggcagaaaucaacgaccuggagaacuugggcgagaugggcagcggcaccugcggccagguguggaagaugcgcuuccggaagaccggccacgucauugccguuaagcaaaugcggcgcuccgggaacaaggaggagaacaagcgcauccucauggaccuggauguggugcugaagagccacgacugccccuacaucgugcagugcuuugggacguucaucaccaacacggacgucuucaucgccauggagcucaugggcaccugcgcugagaagcucaagaagcggaugcagggccccauccccgagcgcauucugggcaagaugacaguggcgauugugaaggcgcuguacuaccugaaggagaagcacggugucauccaccgcgacgucaagcccuccaacauccugcuggacgagcggggccagaucaagcucugcgacuucggcaucagcggccgccugguggacuccaaagccaagacgcggagcgccggcugugccgccuacauggcacccgagcgcauugaccccccagaccccaccaagccggacuaugacauccgggccgacguauggagccugggcaucucguugguggagcuggcaacaggacaguuucccuacaagaacugcaagacggacuuugagguccucaccaaaguccuacaggaagagcccccgcuucugcccggacacaugggcuucucgggggacuuccaguccuucgucaaagacugccuuacuaaagaucacaggaagagaccaaaguauaauaagcuacuugaacacagcuucaucaagcgcuacgagacgcuggagguggacguggcguccugguucaaggaugucauggcgaagacugagucaccgcggacuagcggcguccugagccagccccaccugcccuucuucagguag

SEQ ID NO: 9006 - RNA, 1260 nt, Artificial Sequence
  derived and/or modified sequence opt1 from MKK7__Homo_sapiens__AAC26142
auggccgccagcucccuggagcagaagcucagccgccuggaggcgaagcugaagcaggagaaccgggaggcccgccggcgcaucgaccucaaccuggacaucagcccccagcggccgcgccccacccugcagcucccccuggccaacgacggcgggucccggucccccagcuccgagagcuccccgcagcaccccaccccgcccgcccgcccccggcacaugcugggccuccccagcacgcuguucacgccccgcuccauggagagcaucgagaucgaccagaagcugcaggagaucaugaagcagaccggguaccucaccaucggcgggcagcgguaccaggccgagaucaacgaccuggagaaccugggcgagaugggcuccgggaccugcggccagguguggaagaugcgcuuccggaagaccgggcacgucaucgcggugaagcagaugcgccggagcggcaacaaggaggagaacaagcgcauccucauggaccuggacgugguccugaagucccacgacugccccuacaucgugcagugcuucgggaccuucaucaccaacacggacguguucaucgccauggagcucauggggaccugcgccgagaagcugaagaagcggaugcagggcccgauccccgagcgcauccugggcaagaugaccgucgccaucgugaaggcgcucuacuaccugaaggagaagcacggcgugauccaccgggacgucaagcccagcaacauccugcucgacgagcgcgggcagaucaagcugugcgacuucggcaucuccggccggcugguggacagcaaggccaagacccgcuccgccgggugcgccgccuacauggcgcccgagcgcaucgacccgcccgaccccacgaagcccgacuacgacauccgggccgacguguggagccucggcaucagccuggucgagcuggccaccgggcaguucccguacaagaacugcaagaccgacuucgaggugcucaccaaggugcugcaggaggagccgccccugcuccccggccacaugggguucuccggcgacuuccagagcuucgucaaggacugccugacgaaggaccaccgcaagcggcccaaguacaacaagcugcucgagcacuccuucaucaagcgcuacgagacccuggagguggacguggccagcugguucaaggacgucauggccaagaccgagagcccccggaccuccggcgugcugucccagccccaccuccccuucuuccgcuga

SEQ ID NO: 9007 - RNA, 1260 nt, Artificial Sequence
  derived and/or modified sequence opt2 from MKK7__Homo_sapiens__AAC26142
auggccgccuccucccucgagcagaagcucucccgccucgaggccaagcucaagcaggagaaccgcgaggcccgccgccgcaucgaccucaaccucgacaucuccccccagcgcccccgccccacccuccagcucccccucgccaacgacggcggcucccgcucccccuccuccgaguccuccccccagcaccccaccccccccgcccgcccccgccacaugcucggccuccccuccacccucuucaccccccgcuccauggaguccaucgagaucgaccagaagcuccaggagaucaugaagcagaccggcuaccucaccaucggcggccagcgcuaccaggccgagaucaacgaccucgagaaccucggcgagaugggcuccggcaccugcggccaggucuggaagaugcgcuuccgcaagaccggccacgucaucgccgucaagcagaugcgccgcuccggcaacaaggaggagaacaagcgcauccucauggaccucgacgucguccucaagucccacgacugccccuacaucguccagugcuucggcaccuucaucaccaacaccgacgucuucaucgccauggagcucaugggcaccugcgccgagaagcucaagaagcgcaugcagggccccauccccgagcgcauccucggcaagaugaccgucgccaucgucaaggcccucuacuaccucaaggagaagcacggcgucauccaccgcgacgucaagcccuccaacauccuccucgacgagcgcggccagaucaagcucugcgacuucggcaucuccggccgccucgucgacuccaaggccaagacccgcuccgccggcugcgccgccuacauggcccccgagcgcaucgacccccccgaccccaccaagcccgacuacgacauccgcgccgacgucuggucccucggcaucucccucgucgagcucgccaccggccaguuccccuacaagaacugcaagaccgacuucgagguccucaccaagguccuccaggaggagcccccccuccuccccggccacaugggcuucuccggcgacuuccaguccuucgucaaggacugccucaccaaggaccaccgcaagcgccccaaguacaacaagcuccucgagcacuccuucaucaagcgcuacgagacccucgaggucgacgucgccuccugguucaaggacgucauggccaagaccgaguccccccgcaccuccggcguccucucccagccccaccuccccuucuuccgcuga

SEQ ID NO: 9008 - RNA, 1260 nt, Artificial Sequence
  derived and/or modified sequence opt3 from MKK7__Homo_sapiens__AAC26142
auggccgcuagcucccuggagcagaagcucucuagacuugaagcaaaacugaagcaagagaacagggaagcccggcgccgaaucgacuugaauuuagauauuucaccccagcguccuagaccaacccugcagcuaccgcucgcgaacgacggcgggaguaggagccccuccucugagucgucaccucagcacccaacacccccugcucggccacgccauaugcugggacuucccagcacucuguucacgccuagaaguauggaauccauagagaucgaucaaaaauugcaggagauuaugaagcagaccgguuaccucacaaucggcgggcagagguaucaagccgaaauuaaugaccuggagaaccugggagaaaugggcucugguacuugcggacagguguggaaaaugcgguuucgcaagaccgggcacgucaucgcaguuaagcagaugcgaagaagcggcaauaaagaggagaacaagaggauacucauggauuuagacgugguacugaaaucccaugauuguccauacaucgugcagugcuucggcacauuuauuaccaauacugacgucuucaucgccauggaacuuauggggacaugugcugagaaguugaaaaagcggaugcaaggaccgauucccgaacguauccuggguaagaugaccguggcaauaguuaaagcccuauauuaccucaaggagaaacacggcgugauucaucgcgaugucaagccuucaaacauccugcuugacgaaagagggcagauuaaacugugcgauuuuggaaucaguggcagguugguggacagcaaggcuaaaacgcggucugccgguugugcggcauauauggccccagagcgaaucgaucccccugacccaacuaagcccgacuacgauauucgcgcugacguauggucccucgggauaucacugguugaguuagccaccggacaguucccguauaagaauugcaaaacagauuuugaagugcugacuaagguccuccaagaggaaccuccccuucugccaggccacaugggcuucagcggggacuuucagaguuucgugaaagauuguuugaccaaggaccacagaaaaaggccuaaguacaacaagcuacuggagcauucuuuuaucaaacgguacgaaacacucgagguggaugucgcauccugguucaaggacguuauggcuaaaaccgagagcccccgcacgucgggagugcugucucagccacaccuucccuuuuucagauga

SEQ ID NO: 9009 - RNA, 1260 nt, Artificial Sequence
  derived and/or modified sequence opt4 from MKK7__Homo_sapiens__AAC26142
auggccgccagcagccuggagcagaagcugagcagacuggaggccaagcugaagcaggagaacagagaggccagaagaagaaucgaccugaaccuggacaucagcccccagagacccagacccacccugcagcugccccuggccaacgacggcggcagcagaagccccagcagcgagagcagcccccagcaccccaccccccccgccagacccagacacaugcugggccugcccagcacccuguucacccccagaagcauggagagcaucgagaucgaccagaagcugcaggagaucaugaagcagaccggcuaccugaccaucggcggccagagauaccaggccgagaucaacgaccuggagaaccugggcgagaugggcagcggcaccugcggccagguguggaagaugagauucagaaagaccggccacgugaucgccgugaagcagaugagaagaagcggcaacaaggaggagaacaagagaauccugauggaccuggacguggugcugaagagccacgacugccccuacaucgugcagugcuucggcaccuucaucaccaacaccgacguguucaucgccauggagcugaugggcaccugcgccgagaagcugaagaagagaaugcagggccccauccccgagagaauccugggcaagaugaccguggccaucgugaaggcccuguacuaccugaaggagaagcacggcgugauccacagagacgugaagcccagcaacauccugcuggacgagagaggccagaucaagcugugcgacuucggcaucagcggcagacugguggacagcaaggccaagaccagaagcgccggcugcgccgccuacauggcccccgagagaaucgacccccccgaccccaccaagcccgacuacgacaucagagccgacguguggagccugggcaucagccugguggagcuggccaccggccaguuccccuacaagaacugcaagaccgacuucgaggugcugaccaaggugcugcaggaggagcccccccugcugcccggccacaugggcuucagcggcgacuuccagagcuucgugaaggacugccugaccaaggaccacagaaagagacccaaguacaacaagcugcuggagcacagcuucaucaagagauacgagacccuggagguggacguggccagcugguucaaggacgugauggccaagaccgagagccccagaaccagcggcgugcugagccagccccaccugcccuucuucagauga

SEQ ID NO: 9010 - RNA, 1260 nt, Artificial Sequence
  derived and/or modified sequence opt5 from MKK7__Homo_sapiens__AAC26142
auggccgcuagcucccuggagcagaagcucucuagacuggaagccaaacuuaagcaagagaaccgggaagcgcgcagacggaucgaccugaaucucgauauuagcccccagcgcccuagaccgacccugcagcuuccccuggcuaacgacggcgggucccggucuccuagcuccgagucuagcccccagcacccuacacccccugcccgcccgagacauaugcucggacugcccuccacgcuguucaccccucggagcauggaaucuaucgagauugaucaaaaacuccaggagaucaugaagcagacaggcuaccugaccauugggggacagcgcuaucaagccgaaaucaaugaccuugagaaccugggcgaaaugggguccggaacaugcggccagguguggaaaaugagauuucggaagaccggccacgucaucgcuguuaagcagaugcgcagaagcgggaauaaagaggagaacaagcggauucucauggaucuggacguggugcuuaaaucucaugauugucccuacaucguccagugcuucggaacauuuauuaccaauacggacguguucaucgccauggaacugaugggcaccugugcugagaagcucaaaaagcgcaugcaagggccuauucccgaaagaauccugggaaagaugacaguugccauugugaaagcgcuguauuaccucaaggagaaacacggcgucauccaucgggaugugaagccguccaacauccugcuugacgaaagagggcagauuaaacugugcgauuuuggaaucagcggccgccucguugacucuaaggccaaaacccgguccgcuggcugugccgcuuauauggccccugagagaauugaucccccugaccccacaaagcccgacuacgauauccgcgcggacguguggagccuggggauuucccuugucgagcuggccaccggacaguucccuuauaagaauugcaaaacggauuuugaagugcucacaaaggugcugcaagaggaaccgccccugcucccuggccacaugggguucucuggagacuuucagagcuucgucaaagauugucugaccaaggaccaccggaaaagacccaaguacaacaaacuucuggagcauuccuuuaucaagcgcuacgaaacacucgagguugauguggcuagcugguucaaggacgugauggccaaaaccgagucuccucggaccuccggcguccugagccagccccaccuuccguuuuucagauga

SEQ ID NO: 9011 - protein, 181 aa, Artificial Sequence
  MSTP104__Homo_sapiens__Q7Z4D5
MKDGQKILFHGEGDQEPELEPGDVIIVLDQKDHSVFQRRGHDLIMKMKIQLSEALCGFKKTIKTLDNRILVITSKAGEVIKHGDLRCVRDEGMPIYKAPLEKGILIIQFLVIFPEKHWLSLEKLPQLEALLPPRQKVRITDDMDQVELKEFCPNEQNWRQHREAYEEDEDGPQAGVQCQTA

SEQ ID NO: 9012 - RNA, 546 nt, Artificial Sequence
  MSTP104__Homo_sapiens__AAQ13629
augaaagaugggcaaaagauacuauuucauggagaaggagaucaggagccugagcuggagccuggugaugucauaauugugcuugaucagaaggaucauagugucuuucagagacgaggccaugacuugaucaugaaaaugaaaauucagcuuucugaagcucuuuguggcuucaagaagacgauaaaaacauuggacaaucgaauucuuguuauuacauccaaagcaggugaggugauaaagcacggggaccugagaugcgugcgcgaugaaggaaugcccaucuacaaagcaccccuggaaaaagggauucugaucauacaguuuuuaguaaucuuuccugaaaaacacuggcuuucucuggaaaagcuuccucagcuggaagcuuuacucccuccucgacagaaagugaggauuacagaugacauggaucagguggagcugaaggaguuuugucccaaugagcagaacuggcgucagcacagggaggccuacgaggaggacgaagacgggccccaggcuggagugcagugccagacggcauga

SEQ ID NO: 9013 - RNA, 546 nt, Artificial Sequence
  derived and/or modified sequence opt1 from MSTP104__Homo_sapiens__AAQ13629
augaaggacggccagaagauccuguuccacggggagggcgaccaggagcccgagcucgagccgggggacgugaucaucguccuggaccagaaggaccacagcguguuccagcgccggggccacgaccugaucaugaagaugaagauccagcucuccgaggcccugugcggguucaagaagaccaucaagacccuggacaaccgcauccucgugaucacgagcaaggccggcgaggucaucaagcacggcgaccugcggugcgugcgcgacgaggggaugcccaucuacaaggcgccccuggagaagggcauccucaucauccaguuccuggugaucuuccccgagaagcacuggcugucccucgagaagcugccgcagcuggaggcccuccugccgccccggcagaagguccgcaucaccgacgacauggaccagguggagcugaaggaguucugccccaacgagcagaacuggcggcagcaccgcgaggccuacgaggaggacgaggacgggccccaggccggcgugcagugccagaccgccuga

SEQ ID NO: 9014 - RNA, 546 nt, Artificial Sequence
  derived and/or modified sequence opt2 from MSTP104__Homo_sapiens__AAQ13629
augaaggacggccagaagauccucuuccacggcgagggcgaccaggagcccgagcucgagcccggcgacgucaucaucguccucgaccagaaggaccacuccgucuuccagcgccgcggccacgaccucaucaugaagaugaagauccagcucuccgaggcccucugcggcuucaagaagaccaucaagacccucgacaaccgcauccucgucaucaccuccaaggccggcgaggucaucaagcacggcgaccuccgcugcguccgcgacgagggcaugcccaucuacaaggccccccucgagaagggcauccucaucauccaguuccucgucaucuuccccgagaagcacuggcucucccucgagaagcucccccagcucgaggcccuccuccccccccgccagaagguccgcaucaccgacgacauggaccaggucgagcucaaggaguucugccccaacgagcagaacuggcgccagcaccgcgaggccuacgaggaggacgaggacggcccccaggccggcguccagugccagaccgccuga

SEQ ID NO: 9015 - RNA, 546 nt, Artificial Sequence
  derived and/or modified sequence opt3 from MSTP104__Homo_sapiens__AAQ13629
augaaggacggccagaaaauccuguuccacggggagggagaucaagaacccgagcucgaaccuggugacgugauuauaguccuugaucagaaggaccauagcguuuuucagagaaggggccacgaucugaucaugaaaaugaagauucaguuguccgaggccuuaugcggguucaaaaagaccaucaagacacuggacaaccggauucuagugaucacuucuaaagcuggagaaguaauaaagcauggcgaucuccgcugugugcgagacgaggguaugccaaucuacaaagcaccgcuggagaaggggauucuuaucauucaauuucuggucaucuuccccgaaaaacacugguugucacucgagaagcugccucagcuggaagcccucuuaccaccccgucagaaggugagaauaacggaugacauggaucagguugagcugaaagaguuuugcccuaaugaacaaaacuggaggcagcaucgggaggcguaugaagaggacgaagauggaccacaggcuggcgugcagugucaaaccgccuga

SEQ ID NO: 9016 - RNA, 546 nt, Artificial Sequence
  derived and/or modified sequence opt4 from MSTP104__Homo_sapiens__AAQ13629
augaaggacggccagaagauccuguuccacggcgagggcgaccaggagcccgagcuggagcccggcgacgugaucaucgugcuggaccagaaggaccacagcguguuccagagaagaggccacgaccugaucaugaagaugaagauccagcugagcgaggcccugugcggcuucaagaagaccaucaagacccuggacaacagaauccuggugaucaccagcaaggccggcgaggugaucaagcacggcgaccugagaugcgugagagacgagggcaugcccaucuacaaggccccccuggagaagggcauccugaucauccaguuccuggugaucuuccccgagaagcacuggcugagccuggagaagcugccccagcuggaggcccugcugccccccagacagaaggugagaaucaccgacgacauggaccagguggagcugaaggaguucugccccaacgagcagaacuggagacagcacagagaggccuacgaggaggacgaggacggcccccaggccggcgugcagugccagaccgccuga

SEQ ID NO: 9017 - RNA, 546 nt, Artificial Sequence
  derived and/or modified sequence opt5 from MSTP104__Homo_sapiens__AAQ13629
augaaggacggccagaaaauccuguuccacggggagggagaucaagaacccgagcucgaaccuggcgacgugauuaucguccuggaucagaaggaccauagcguuuuucagagacgggggcacgaucuuauuaugaaaaugaagauccagcuguccgaggcccucugcggauucaaaaagaccauuaagacacuggacaaccgcauccuugugaucacgucuaaagcuggcgaagugauuaagcauggggaucugagauguguccgggacgagggaaugccgaucuacaaagcgccccucgagaagggcauucugaucauucaauuucuggugaucuucccugaaaaacacuggcucagccuggagaaacuuccccagcuggaagcccuccugccuccccgccagaagguuagaauuaccgaugacauggaucagguggagcuuaaggaguuuugcccuaaugaacaaaacuggcggcagcaucgcgaggcuuaugaagaggacgaagauggcccgcaggccgggguccagugucaaacagccuga

SEQ ID NO: 9018 - protein, 296 aa, Artificial Sequence
  MyD88__Homo_sapiens__Q99836
MAAGGPGAGSAAPVSSTSSLPLAALNMRVRRRLSLFLNVRTQVAADWTALAEEMDFEYLEIRQLETQADPTGRLLDAWQGRPGASVGRLLELLTKLGRDDVLLELGPSIEEDCQKYILKQQQEEAEKPLQVAAVDSSVPRTAELAGITTLDDPLGHMPERFDAFICYCPSDIQFVQEMIRQLEQTNYRLKLCVSDRDVLPGTCVWSIASELIEKRCRRMVVVVSDDYLQSKECDFQTKFALSLSPGAHQKRLIPIKYKAMKKEFPSILRFITVCDYTNPCTKSWFWTRLAKALSLP

SEQ ID NO: 9019 - RNA, 891 nt, Artificial Sequence
  MyD88__Homo_sapiens__AAC50954
auggcugcaggaggucccggcgcggggucugcggccccggucuccuccacauccucccuuccccuggcugcucucaacaugcgagugcggcgccgccugucucuguucuugaacgugcggacacagguggcggccgacuggaccgcgcuggcggaggagauggacuuugaguacuuggagauccggcaacuggagacacaagcggaccccacuggcaggcugcuggacgccuggcagggacgcccuggcgccucuguaggccgacugcucgagcugcuuaccaagcugggccgcgacgacgugcugcuggagcugggacccagcauugaggaggauugccaaaaguauaucuugaagcagcagcaggaggaggcugagaagccuuuacagguggccgcuguagacagcagugucccacggacagcagagcuggcgggcaucaccacacuugaugacccccuggggcauaugccugagcguuucgaugccuucaucugcuauugccccagcgacauccaguuugugcaggagaugauccggcaacuggaacagacaaacuaucgacugaaguugugugugucugaccgcgauguccugccuggcaccugugucuggucuauugcuagugagcucaucgaaaagaggugccgccggaugguggugguugucucugaugauuaccugcagagcaaggaaugugacuuccagaccaaauuugcacucagccucucuccaggugcccaucagaagcgacugauccccaucaaguacaaggcaaugaagaaagaguuccccagcauccugagguucaucacugucugcgacuacaccaaccccugcaccaaaucuugguucuggacucgccuugccaaggccuugucccugcccuga

SEQ ID NO: 9020 - RNA, 891 nt, Artificial Sequence
  derived and/or modified sequence opt1 from MyD88__Homo_sapiens__AAC50954
auggccgccggcgggcccggcgcggggagcgccgccccgguguccagcaccuccagccugccccucgccgcccugaacaugcgcguccggcgccggcugucccucuuccugaacgugcgcacccagguggcggccgacuggacggcccuggccgaggagauggacuucgaguaccucgagauccggcagcuggagacccaggcggaccccaccggccgccugcucgacgccuggcaggggcggcccggcgccagcgucggccgccugcuggagcuccugaccaagcuggggcgggacgacgugcuccuggagcugggcccguccaucgaggaggacugccagaaguacauccucaagcagcagcaggaggaggccgagaagccccuccagguggccgcggucgacagcuccgugccccgcacggccgagcuggccgggaucaccacccuggacgacccccugggccacaugccggagcgguucgacgccuucaucugcuacugccccagcgacauccaguucgugcaggagaugauccgccagcuggagcagaccaacuaccggcucaagcugugcgucuccgaccgcgacgugcugcccgggacgugcguguggagcaucgccuccgagcucaucgagaagcggugccgccggauggucgugguggucagcgacgacuaccugcaguccaaggagugcgacuuccagaccaaguucgcgcugagccucucccccggcgcccaccagaagcgccugaucccgaucaaguacaaggccaugaagaaggaguuccccagcauccugcgguucaucaccgugugcgacuacaccaaccccugcacgaaguccugguucuggacccgccucgccaaggcccugagccugcccuga

SEQ ID NO: 9021 - RNA, 891 nt, Artificial Sequence
  derived and/or modified sequence opt2 from MyD88__Homo_sapiens__AAC50954
auggccgccggcggccccggcgccggcuccgccgcccccgucuccuccaccuccucccucccccucgccgcccucaacaugcgcguccgccgccgccucucccucuuccucaacguccgcacccaggucgccgccgacuggaccgcccucgccgaggagauggacuucgaguaccucgagauccgccagcucgagacccaggccgaccccaccggccgccuccucgacgccuggcagggccgccccggcgccuccgucggccgccuccucgagcuccucaccaagcucggccgcgacgacguccuccucgagcucggccccuccaucgaggaggacugccagaaguacauccucaagcagcagcaggaggaggccgagaagccccuccaggucgccgccgucgacuccuccgucccccgcaccgccgagcucgccggcaucaccacccucgacgacccccucggccacaugcccgagcgcuucgacgccuucaucugcuacugccccuccgacauccaguucguccaggagaugauccgccagcucgagcagaccaacuaccgccucaagcucugcgucuccgaccgcgacguccuccccggcaccugcgucugguccaucgccuccgagcucaucgagaagcgcugccgccgcauggucgucgucgucuccgacgacuaccuccaguccaaggagugcgacuuccagaccaaguucgcccucucccucucccccggcgcccaccagaagcgccucauccccaucaaguacaaggccaugaagaaggaguuccccuccauccuccgcuucaucaccgucugcgacuacaccaaccccugcaccaaguccugguucuggacccgccucgccaaggcccucucccuccccuga

SEQ ID NO: 9022 - RNA, 891 nt, Artificial Sequence
  derived and/or modified sequence opt3 from MyD88__Homo_sapiens__AAC50954
auggccgcuggcgggcccggagcagguagcgccgcgccuguguccucuaccucaagucugccacucgcugcccuuaacaugagagucaggcggcgccugagcuuguucuuaaauguucgaacacagguggcagccgacuggacugcucuggcagaggaaauggauuuugaguaccuagaaauccgucaacucgagacgcaggccgacccgaccggcagacugcuugaugcuuggcaggggaggcccggagccuccguaggccggcuguuggaacuccugacaaagcugggucgcgacgaugugcucuuagagcuggggccuucuauugaggaagacugccagaaauauauacuuaagcaacagcaggaggaagcggagaaaccauugcaggucgcagccguggauucgucaguucccagaacugcugagcuggccggaaucaccacacuagacgauccucucggccacaugccagaaagguucgacgcauuuauuuguuacugccccagcgauauccaauucgugcaggagaugauucggcagcuggaacagaccaacuaucgccuuaagcugugugucagugaccgagauguguugccuggcacuugcguaugguccaucgcuucugagcucauagagaaaagauguaggcggaugguuguggucgugagcgacgacuaccugcaauccaaggaaugcgauuuucagacaaaguucgccuuaucacugaguccaggggcgcaucagaaacgucucaucccgauuaaguauaaagccaugaagaaagaguuucccagcauccuucgcuucauuaccgugugugacuacacgaauccuugcacuaagucuugguuuuggaccagacuggcaaaggcuuugucccuaccauga

SEQ ID NO: 9023 - RNA, 891 nt, Artificial Sequence
  derived and/or modified sequence opt4 from MyD88__Homo_sapiens__AAC50954
auggccgccggcggccccggcgccggcagcgccgcccccgugagcagcaccagcagccugccccuggccgcccugaacaugagagugagaagaagacugagccuguuccugaacgugagaacccagguggccgccgacuggaccgcccuggccgaggagauggacuucgaguaccuggagaucagacagcuggagacccaggccgaccccaccggcagacugcuggacgccuggcagggcagacccggcgccagcgugggcagacugcuggagcugcugaccaagcugggcagagacgacgugcugcuggagcugggccccagcaucgaggaggacugccagaaguacauccugaagcagcagcaggaggaggccgagaagccccugcagguggccgccguggacagcagcgugcccagaaccgccgagcuggccggcaucaccacccuggacgacccccugggccacaugcccgagagauucgacgccuucaucugcuacugccccagcgacauccaguucgugcaggagaugaucagacagcuggagcagaccaacuacagacugaagcugugcgugagcgacagagacgugcugcccggcaccugcguguggagcaucgccagcgagcugaucgagaagagaugcagaagaaugguggugguggugagcgacgacuaccugcagagcaaggagugcgacuuccagaccaaguucgcccugagccugagccccggcgcccaccagaagagacugauccccaucaaguacaaggccaugaagaaggaguuccccagcauccugagauucaucaccgugugcgacuacaccaaccccugcaccaagagcugguucuggaccagacuggccaaggcccugagccugcccuga

SEQ ID NO: 9024 - RNA, 891 nt, Artificial Sequence
  derived and/or modified sequence opt5 from MyD88__Homo_sapiens__AAC50954
auggccgcuggcgggcccggagccggcagcgcggcuccuguguccucuaccagcucccugccgcucgccgcccugaacaugagaguccggcgcagacuuucucuguuccucaauguucggacacagguggcugccgacuggacggcucuggccgaggaaauggauuuugaguaccuugaaauccgccaacuggagacccaggcggaccccacagggagacuccuggaugccuggcagggacggccuggcgcuagcguggggcgccugcucgaacugcuuaccaagcugggaagagacgauguccuccuggagcuuggccccuccauugaggaagacugccagaaauauauccugaagcaacagcaggaggaagccgagaaaccucuccagguggcugccguugauucuagcgugccccggacagcggagcuggccggcauuaccacacuggacgauccucucgggcacaugccggaacgcuucgacgcuuuuaucuguuacugccccuccgauauucaauucguccaggagaugaucagacagcuggaacagaccaacuaucggcuuaagcugugugugagcgaccgcgauguucucccuggaacgugcguguggucuaucgccuccgagcugauugagaaaagaugucggcgcauggucgugguggucagcgacgacuaccuucaaucuaaggaaugcgauuuucagaccaaguucgcucugucccucagccccggcgcccaucagaaaagacugaucccuauuaaguauaaagccaugaagaaagaguuucccucuauccugcgguucauuacaguuugugacuacaccaauccgugcacaaaguccugguuuuggaccagacucgcuaaggcgcugagccuuccuuga

SEQ ID NO: 9025 - protein, 655 aa, Artificial Sequence
  NALP10__Homo_sapiens__Q86W26
MAMAKARKPREALLWALSDLEENDFKKLKFYLRDMTLSEGQPPLARGELEGLIPVDLAELLISKYGEKEAVKVVLKGLKVMNLLELVDQLSHICLHDYREVYREHVRCLEEWQEAGVNGRYNQVLLVAKPSSESPESLACPFPEQELESVTVEALFDSGEKPSLAPSLVVLQGSAGTGKTTLARKMVLDWATGTLYPGRFDYVFYVSCKEVVLLLESKLEQLLFWCCGDNQAPVTEILRQPERLLFILDGFDELQRPFEEKLKKRGLSPKESLLHLLIRRHTLPTCSLLITTRPLALRNLEPLLKQARHVHILGFSEEERARYFSSYFTDEKQADRAFDIVQKNDILYKACQVPGICWVVCSWLQGQMERGKVVLETPRNSTDIFMAYVSTFLPPDDDGGCSELSRHRVLRSLCSLAAEGIQHQRFLFEEAELRKHNLDGPRLAAFLSSNDYQLGLAIKKFYSFRHISFQDFFHAMSYLVKEDQSRLGKESRREVQRLLEVKEQEGNDEMTLTMQFLLDISKKDSFSNLELKFCFRISPCLAQDLKHFKEQMESMKHNRTWDLEFSLYEAKIKNLVKGIQMNNVSFKIKHSNEKKSQSQNLFSVKSSLSHGPKEEQKCPSVHGQKEGKDNIAGTQKEASTGKGRGTEETPKNTYI

SEQ ID NO: 9026 - RNA, 1968 nt, Artificial Sequence
  NALP10__Homo_sapiens__AAI04958
auggccauggccaaggccagaaagccccgggaggcauugcucugggccuugagugaccuugaggagaacgauuucaagaaguuaaaguucuacuuacgggauaugacccugucugagggccagcccccacuggccagaggggaguuggagggccugauuccgguggaccuggcagaauuacugauuucaaaguauggagaaaaggaggcugugaaaguuguccucaagggcuugaaggucaugaaccuguuggaacuuguggaccagcucagccauauuugucugcaugauuacagagaaguauaccgagagcaugugcgcugccuagaggaauggcaggaagcaggagucaauggcagauacaaccaggugcuccugguggccaagcccagcucagagagcccagaaucacuugccugccccuucccggagcaggagcuggagucugucacgguggaggcucuauuugauucaggggaaaagcccucacuggccccauccuuaguugugcuacaggggucggcuggcacuggaaagacaacucucgccagaaaaaugguguuggacugggccaccgguacucuguacccaggccgguuugauuaugucuuuuauguaagcugcaaagaagugguccugcugcuggagagcaaacuggagcagcuccuuuucuggugcugcggggacaaucaagccccugucacagagauucugaggcagccagagcggcuccuguucauccuggauggcuuugaugagcugcagaggcccuuugaagaaaaguugaagaagagggguuugagucccaaggagagccugcugcaccuucuaauuaggagacauacacuccccacgugcucccuucucaucaccacccggccccuggcuuugaggaaucuggagcccuugcugaaacaagcacgucauguccauauccuaggcuucucugaggaggagagggcgagguacuucagcuccuauuucacggaugagaagcaagcugaccgugccuucgacauuguacagaaaaaugacauucucuacaaagcgugucagguuccaggcauuugcuggguggucugcuccuggcugcaggggcagauggagagaggcaaaguugucuuagagacaccuagaaacagcacugacaucuucauggcuuacgucuccaccuuucugccgcccgaugaugaugggggcugcuccgagcuuucccggcacaggguccugaggagucugugcucccuagcagcugaagggauucagcaccagagguuccuauuugaagaagcugagcucaggaaacauaauuuagauggccccaggcuugccgcuuuccugaguaguaacgacuaccaauugggacuugccaucaagaaguucuacagcuuccgccacaucagcuuccaggacuuuuuucaugccaugucuuaccuggugaaagaggaccaaagccggcuggggaaggagucccgcagagaagugcaaaggcugcuggagguaaaggagcaggaagggaaugaugagaugacccucacuaugcaguuuuuacuggacaucucgaaaaaagacagcuucucgaacuuggagcucaaguucugcuucagaauuucucccuguuuagcgcaggaucugaagcauuuuaaagaacagauggaaucuaugaagcacaacaggaccugggauuuggaauucucccuguaugaagcuaaaauaaagaaucugguaaaagguauucagaugaacaauguaucauucaagauaaaacauucaaaugaaaagaaaucacagagccagaauuuauuuucugucaaaagcagcuugagucauggaccuaaggaggagcaaaaauguccuucuguccauggacagaaggagggcaaagauaauauagcaggaacacaaaaggaagcuucuacuggaaaaggcagagggacagaggaaacaccaaaaaauacuuacauauaa

SEQ ID NO: 9027 - RNA, 1968 nt, Artificial Sequence
  derived and/or modified sequence opt1 from NALP10__Homo_sapiens__AAI04958
auggccauggccaaggcgcgcaagccccgggaggcccugcucugggcccugagcgaccuggaggagaacgacuucaagaagcucaaguucuaccugcgcgacaugacccuguccgagggccagccgccccucgcccgcggggagcuggagggccugauccccguggaccucgccgagcugcugaucagcaaguacggggagaaggaggcggucaagguggugcucaagggccugaaggucaugaaccugcucgagcugguggaccagcugucccacaucugccuccacgacuaccgggagguguaccgggagcacguccgcugccuggaggaguggcaggaggccggggugaacggccgguacaaccaggugcugcucgucgccaagcccagcuccgagagcccggagucccuggccugccccuuccccgagcaggagcuggagagcgugaccguggaggcgcuguucgacuccggcgagaagcccagccuggccccgucccuggucgugcuccaggggagcgccggcacggggaagaccacccuggcccgcaagauggugcuggacugggccaccggcacgcucuaccccgggcgguucgacuacgucuucuacguguccugcaaggaggugguccugcugcucgagagcaagcuggagcagcugcuguucuggugcugcggcgacaaccaggcgcccgugaccgagauccugcgccagcccgagcggcuccucuucauccuggacggcuucgacgagcugcagcgcccguucgaggagaagcucaagaagcgggggcugucccccaaggagagccugcuccaccuccugauccgccggcacacccucccgaccugcucccugcugaucacgacccgcccccuggcccuccggaaccuggagccccugcucaagcaggcccgccacgugcacauccugggcuucagcgaggaggagcgggcccgcuacuucuccagcuacuucaccgacgagaagcaggccgaccgggcguucgacaucguccagaagaacgacauccuguacaaggccugccaggugcccgggaucugcuggguggucugcagcuggcuccagggccagauggagcgcggcaaggugguccuggagacgccccgcaacuccaccgacaucuucauggccuacgugagcaccuuccugcccccggacgacgacgggggcugcuccgagcucagccggcaccgcgugcugcggucccugugcagccucgccgccgaggggauccagcaccagcgcuuccuguucgaggaggcggagcugcggaagcacaaccucgacggcccccgccuggccgccuuccuguccagcaacgacuaccagcucgggcuggccaucaagaaguucuacuccuuccggcacaucagcuuccaggacuucuuccacgccauguccuaccuggucaaggaggaccagagccgccucggcaaggagucccggcgcgaggugcagcggcugcuggaggugaaggagcaggagggcaacgacgagaugacccucaccaugcaguuccugcuggacaucagcaagaaggacuccuucagcaaccucgagcugaaguucugcuuccgcaucucccccugccuggcgcaggaccucaagcacuucaaggagcagauggagagcaugaagcacaaccggacgugggaccuggaguucucccuguacgaggccaagaucaagaaccucgucaaggggauccagaugaacaacgugagcuucaagaucaagcacagcaacgagaagaagucccagagccagaaccuguucuccgucaagagcucccugagccacggccccaaggaggagcagaagugcccguccgugcacgggcagaaggagggcaaggacaacaucgccgggacccagaaggaggccagcaccggcaagggccgcgggaccgaggagacgcccaagaacaccuacaucuga

SEQ ID NO: 9028 - RNA, 1968 nt, Artificial Sequence
  derived and/or modified sequence opt2 from NALP10__Homo_sapiens__AAI04958
auggccauggccaaggcccgcaagccccgcgaggcccuccucugggcccucuccgaccucgaggagaacgacuucaagaagcucaaguucuaccuccgcgacaugacccucuccgagggccagcccccccucgcccgcggcgagcucgagggccucauccccgucgaccucgccgagcuccucaucuccaaguacggcgagaaggaggccgucaaggucguccucaagggccucaaggucaugaaccuccucgagcucgucgaccagcucucccacaucugccuccacgacuaccgcgaggucuaccgcgagcacguccgcugccucgaggaguggcaggaggccggcgucaacggccgcuacaaccagguccuccucgucgccaagcccuccuccgagucccccgagucccucgccugccccuuccccgagcaggagcucgaguccgucaccgucgaggcccucuucgacuccggcgagaagcccucccucgcccccucccucgucguccuccagggcuccgccggcaccggcaagaccacccucgcccgcaagaugguccucgacugggccaccggcacccucuaccccggccgcuucgacuacgucuucuacgucuccugcaaggaggucguccuccuccucgaguccaagcucgagcagcuccucuucuggugcugcggcgacaaccaggcccccgucaccgagauccuccgccagcccgagcgccuccucuucauccucgacggcuucgacgagcuccagcgccccuucgaggagaagcucaagaagcgcggccucucccccaaggagucccuccuccaccuccucauccgccgccacacccuccccaccugcucccuccucaucaccacccgcccccucgcccuccgcaaccucgagccccuccucaagcaggcccgccacguccacauccucggcuucuccgaggaggagcgcgcccgcuacuucuccuccuacuucaccgacgagaagcaggccgaccgcgccuucgacaucguccagaagaacgacauccucuacaaggccugccagguccccggcaucugcugggucgucugcuccuggcuccagggccagauggagcgcggcaaggucguccucgagaccccccgcaacuccaccgacaucuucauggccuacgucuccaccuuccucccccccgacgacgacggcggcugcuccgagcucucccgccaccgcguccuccgcucccucugcucccucgccgccgagggcauccagcaccagcgcuuccucuucgaggaggccgagcuccgcaagcacaaccucgacggcccccgccucgccgccuuccucuccuccaacgacuaccagcucggccucgccaucaagaaguucuacuccuuccgccacaucuccuuccaggacuucuuccacgccauguccuaccucgucaaggaggaccagucccgccucggcaaggagucccgccgcgagguccagcgccuccucgaggucaaggagcaggagggcaacgacgagaugacccucaccaugcaguuccuccucgacaucuccaagaaggacuccuucuccaaccucgagcucaaguucugcuuccgcaucucccccugccucgcccaggaccucaagcacuucaaggagcagauggaguccaugaagcacaaccgcaccugggaccucgaguucucccucuacgaggccaagaucaagaaccucgucaagggcauccagaugaacaacgucuccuucaagaucaagcacuccaacgagaagaagucccagucccagaaccucuucuccgucaaguccucccucucccacggccccaaggaggagcagaagugccccuccguccacggccagaaggagggcaaggacaacaucgccggcacccagaaggaggccuccaccggcaagggccgcggcaccgaggagacccccaagaacaccuacaucuga

SEQ ID NO: 9029 - RNA, 1968 nt, Artificial Sequence
  derived and/or modified sequence opt3 from NALP10__Homo_sapiens__AAI04958
auggccauggcuaaggcaagaaaacccagggaggcccugcucugggcgcuuagcgaccuggaagagaacgauuucaagaaauugaaguuuuacuuacgggacaugacccuguccgaaggccagccuccacuagcucgcggggagcucgaaggacugaucccgguggaucuugccgagcuguugauuucuaaauauggugagaaggaagcagucaagguugugcucaaaggccugaagguaaugaaucugcucgaguuaguggaccaacugucacacauaugccuucaugauuaccgagaagucuaucgugagcacgugagauguuuggaggaauggcaggaggccgggguuaacggaagguacaaucaggugcugcuagucgcuaaacccaguagcgaauccccugagucucucgcaugcccauuccccgaacaggagcuggagucggugacaguagaagcccuuuuugacucaggcgagaagccuagccuggcuccaaguuugguugugcuccaagguuccgccgggacuggaaaaacgacccuggcgcggaagauggucuuagauugggcaacaggcacucuguaucccggccgcuucgacuacguguuuuaugugucuuguaaggaagucguucuccuucuggagagcaaauuggaacagcuacuguucuggugcuguggggauaaccaggccccugugaccgagauccucagacagccagagaggcugcuuuuuauucuggacggauucgaugaauugcaacggccguuugaggaaaagcucaaaaagcgcggucugucccccaaagagucauuacugcaucuacucauccgaagacacacacugccuaccugcagucuuuugauuacuacaaggccacuggcucuccggaaucuggaaccccuucugaagcaggcccgucauguacacaucuugggcuucagcgaggaggaacgcgcaagauacuuuucuuccuacuucaccgacgagaaacaggcugauagggccuuugacauagugcagaagaacgacauccucuauaaggcgugucaagucccugggauuugcugggugguuuguucauggcugcagggacagauggaacggggcaaaguggucuuagagacgccacgaaauagcacugauaucuucauggccuacgugaguaccuuccugcccccggacgaugacggugggugcucugagcuaucccgccacagaguacucaggagccuguguucgcuugcagcugaaggcauucaacaucagcgguuuuuguucgaggaagccgagcugcgcaagcacaaccucgauggaccuagacuggcugccuuuuuaucuuccaaugacuaucagcugggccuugcaaucaaaaaguucuacucauuuaggcauauaaguuuccaggauuucuuccacgccaugagcuauuugguuaaagaagaccaaucccgucucgggaaggagucucggcgagaggugcagagacugcuagaagucaaggagcaggaaggaaacgaugagaugacacugacuaugcaguuucuccuggacauuagcaaaaaggauucauucaguaaucuugaauugaaauuuugcuucaggaucucccccugccuggcucaagacuuaaagcacuuuaaagagcagauggagagcaugaagcauaaccgcaccugggaccucgaauuuucucuguacgaggcgaagauuaaaaaucuugugaaggguauccagaugaacaaugucucauucaaaaucaagcacaguaacgagaaaaagagccagucccaaaaccuguuuucugugaagucgagcuugucccauggcccaaaagaagaacagaaguguccuucaguucacgggcagaaagagggaaaggauaauauugcaggcacacagaaagaggccaguaccgguaaggggcggggcacggaagagacucccaaaaacacauauauauga

SEQ ID NO: 9030 - RNA, 1968 nt, Artificial Sequence
  derived and/or modified sequence opt4 from NALP10__Homo_sapiens__AAI04958
auggccauggccaaggccagaaagcccagagaggcccugcugugggcccugagcgaccuggaggagaacgacuucaagaagcugaaguucuaccugagagacaugacccugagcgagggccagcccccccuggccagaggcgagcuggagggccugauccccguggaccuggccgagcugcugaucagcaaguacggcgagaaggaggccgugaagguggugcugaagggccugaaggugaugaaccugcuggagcugguggaccagcugagccacaucugccugcacgacuacagagagguguacagagagcacgugagaugccuggaggaguggcaggaggccggcgugaacggcagauacaaccaggugcugcugguggccaagcccagcagcgagagccccgagagccuggccugccccuuccccgagcaggagcuggagagcgugaccguggaggcccuguucgacagcggcgagaagcccagccuggcccccagccugguggugcugcagggcagcgccggcaccggcaagaccacccuggccagaaagauggugcuggacugggccaccggcacccuguaccccggcagauucgacuacguguucuacgugagcugcaaggagguggugcugcugcuggagagcaagcuggagcagcugcuguucuggugcugcggcgacaaccaggcccccgugaccgagauccugagacagcccgagagacugcuguucauccuggacggcuucgacgagcugcagagacccuucgaggagaagcugaagaagagaggccugagccccaaggagagccugcugcaccugcugaucagaagacacacccugcccaccugcagccugcugaucaccaccagaccccuggcccugagaaaccuggagccccugcugaagcaggccagacacgugcacauccugggcuucagcgaggaggagagagccagauacuucagcagcuacuucaccgacgagaagcaggccgacagagccuucgacaucgugcagaagaacgacauccuguacaaggccugccaggugcccggcaucugcuggguggugugcagcuggcugcagggccagauggagagaggcaagguggugcuggagacccccagaaacagcaccgacaucuucauggccuacgugagcaccuuccugccccccgacgacgacggcggcugcagcgagcugagcagacacagagugcugagaagccugugcagccuggccgccgagggcauccagcaccagagauuccuguucgaggaggccgagcugagaaagcacaaccuggacggccccagacuggccgccuuccugagcagcaacgacuaccagcugggccuggccaucaagaaguucuacagcuucagacacaucagcuuccaggacuucuuccacgccaugagcuaccuggugaaggaggaccagagcagacugggcaaggagagcagaagagaggugcagagacugcuggaggugaaggagcaggagggcaacgacgagaugacccugaccaugcaguuccugcuggacaucagcaagaaggacagcuucagcaaccuggagcugaaguucugcuucagaaucagccccugccuggcccaggaccugaagcacuucaaggagcagauggagagcaugaagcacaacagaaccugggaccuggaguucagccuguacgaggccaagaucaagaaccuggugaagggcauccagaugaacaacgugagcuucaagaucaagcacagcaacgagaagaagagccagagccagaaccuguucagcgugaagagcagccugagccacggccccaaggaggagcagaagugccccagcgugcacggccagaaggagggcaaggacaacaucgccggcacccagaaggaggccagcaccggcaagggcagaggcaccgaggagacccccaagaacaccuacaucuga

SEQ ID NO: 9031 - RNA, 1968 nt, Artificial Sequence
  derived and/or modified sequence opt5 from NALP10__Homo_sapiens__AAI04958
auggccauggcuaaggccagaaaaccccgggaggcgcugcucugggcucugagcgaccuugaagagaacgauuucaagaaacugaaguuuuaccuccgcgacaugacccuguccgaaggccagccuccgcuugccagaggggagcuggaaggacucauccccguggaucuggccgagcugcucauuucuaaauauggcgagaaggaagcugucaagguugugcugaaagggcuuaaggugaugaaucugcucgagcuggucgaccaacuuagccacaucugccugcaugauuaccgggaaguguaucgcgagcacguuagaugucucgaggaauggcaggaggccggagugaacggccgguacaaucagguccugcugguggcuaaaccuuccucugaaagccccgagucccucgccugcccuuuccccgaacaggagcuggagucuguuacaguggaagcgcuuuuugacagcggggagaagccuucccuggccccgagccucgucgugcugcaaggaucugcuggcacgggcaaaaccacacuugcccgcaagauggugcuggauugggcuaccgggacacucuaucccggaagauucgacuacgucuuuuauguuuccuguaaggaaguggugcugcugcucgagagcaaacuggaacagcuucuguucuggugcuguggcgauaaccaggccccugucaccgagauucuccggcagcccgagcgccugcuuuuuauccuggacggguucgaugaacuccaaagaccuuuugaggaaaagcugaaaaagcggggacugucucccaaagagucccuccugcaucuucugauucgcagacacacacucccgaccugcagccugcugaucacgacccggccucuugcgcuccgcaaucuggaaccccugcucaagcaggccagacaugugcacauccugggcuucucugaggaggaacgggcuagauacuuuuccagcuacuucacagacgagaaacaggccgaucgcgcuuuugacauuguucagaagaacgacauccuuuauaaggccugucaagugccugggauuugcugggucguguguuccuggcugcagggacagauggaacggggcaaaguugugcucgagacccccagaaauucuacagauaucuucauggccuacgucagcaccuuccugcccccugacgaugacggcgggugcuccgagcugagccgccaccgggugcuuagaucucucuguucccuggcugcggaaggcauucaacaucagcgcuuucuguucgaggaagccgagcuccggaagcacaaccuggauggaccgagacuugcugccuuucugagcucuaaugacuaucagcucgggcuggccaucaaaaaguucuacagcuuucgccauauuuccuuccaggauuucuuccacgcuaugucuuaucuggucaaagaagaccaaagccggcuuggaaaggaguccagacgcgaggugcagcggcuccuggaaguuaaggagcaggaaggcaacgaugagaugacgcugacaaugcaguuucuccuggacaucagcaaaaaggauucuuucuccaaucuugaacugaaauuuugcuucagaaucagccccugccucgcccaagaccugaagcacuuuaaagagcagauggagucuaugaagcauaaccggaccugggaccuggaauuuucccuuuacgaggcgaagauuaaaaaucucgugaaggggauccagaugaacaaugucagcuucaaaauuaagcacuccaacgagaaaaagucucagagccaaaaccuguuuuccgugaagucuagccugucccauggaccuaaagaagaacagaagugucccagcguucacggccagaaagagggcaaggauaauaucgcugggacacagaaagaggccucuaccggaaagggccgcgggaccgaagagacaccuaaaaacacguauauuuga

SEQ ID NO: 9032 - protein, 1033 aa, Artificial Sequence
  NALP11__Homo_sapiens__P59045
MAESDSTDFDLLWYLENLSDKEFQSFKKYLARKILDFKLPQFPLIQMTKEELANVLPISYEGQYIWNMLFSIFSMMRKEDLCRKIIGRRNRNQEACKAVMRRKFMLQWESHTFGKFHYKFFRDVSSDVFYILQLAYDSTSYYSANNLNVFLMGERASGKTIVINLAVLRWIKGEMWQNMISYVVHLTAHEINQMTNSSLAELIAKDWPDGQAPIADILSDPKKLLFILEDLDNIRFELNVNESALCSNSTQKVPIPVLLVSLLKRKMAPGCWFLISSRPTRGNNVKTFLKEVDCCTTLQLSNGKREIYFNSFFKDRQRASAALQLVHEDEILVGLCRVAILCWITCTVLKRQMDKGRDFQLCCQTPTDLHAHFLADALTSEAGLTANQYHLGLLKRLCLLAAGGLFLSTLNFSGEDLRCVGFTEADVSVLQAANILLPSNTHKDRYKFIHLNVQEFCTAIAFLMAVPNYLIPSGSREYKEKREQYSDFNQVFTFIFGLLNANRRKILETSFGYQLPMVDSFKWYSVGYMKHLDRDPEKLTHHMPLFYCLYENREEEFVKTIVDALMEVTVYLQSDKDMMVSLYCLDYCCHLRTLKLSVQRIFQNKEPLIRPTASQMKSLVYWREICSLFYTMESLRELHIFDNDLNGISERILSKALEHSSCKLRTLKLSYVSTASGFEDLLKALARNRSLTYLSINCTSISLNMFSLLHDILHEPTCQISHLSLMKCDLRASECEEIASLLISGGSLRKLTLSSNPLRSDGMNILCDALLHPNCTLISLVLVFCCLTENCCSALGRVLLFSPTLRQLDLCVNRLKNYGVLHVTFPLLFPTCQLEELHLSGCFFSSDICQYIAIVIATNEKLRSLEIGSNKIEDAGMQLLCGGLRHPNCMLVNIGLEECMLTSACCRSLASVLTTNKTLERLNLLQNHLGNDGVAKLLESLISPDCVLKVVGLPLTGLNTQTQQLLMTVKERKPSLIFLSETWSLKEGREIGVTPASQPGSIIPNSNLDYMFFKFPRMSAAMRTSNTASRQPL

SEQ ID NO: 9033 - RNA, 3102 nt, Artificial Sequence
  NALP11__Homo_sapiens__CCDS12935.1
auggcagaaucggauucuacugacuuugaccugcugugguaucuagagaaucucagugacaaggaauuucagaguuuuaagaaguaucuggcacgcaagauucuugauuucaaacugccacaguuuccacugauacagaugacaaaagaagaacuggcuaacguguugccaaucucuuaugagggacaguauauauggaauaugcucuucagcauauuuucaaugaugcguaaggaagaucuuuguaggaagaucauuggcagacgaaaccgcaaucaggaggcaugcaaagcugucaugaggagaaaauucaugcugcaaugggaaagucacacuuuuggaaaauuucauuauaaauuuuuucgugacguuucgucagauguguucuacauacuucaauuagccuaugauucuaccagcuauuauucagcaaacaaucucaauguguuccugaugggagagagagcaucuggaaaaacuauuguuauaaaucuggcuguguugagguggaucaagggugagauguggcagaacaugaucucguacgucguucaccucacugcucacgaaauaaaccagaugaccaacagcagcuuggcugagcuaaucgccaaggacuggccugacggccaggcucccauugcagacauccugucugaucccaagaaacuccuuuucauccucgaggacuuggacaacauaagauucgaguuaaaugucaaugaaagugcuuuguguaguaacagcacccagaaaguucccauuccaguucuccuggucaguuugcugaagagaaaaauggcuccaggcugcugguuccucaucuccucaaggcccacacgugggaauaauguaaaaacguucuugaaagagguagauugcugcacgaccuugcagcugucgaaugggaagagggagauauauuuuaacucuuucuuuaaagaccgccagagggcgucggcagcccuccagcuuguacaugaggaugaaauacucgugggucugugccgagucgccaucuuaugcuggaucacguguacuguccugaagcggcagauggacaaggggcgugacuuccagcucugcugccaaacacccacugaucuacaugcccacuuucuugcugaugcguugacaucagaggcuggacuuacugccaaucaguaucaccuaggucuccuaaaacgucuguguuugcuggcugcaggaggacuguuucugagcacccugaauuucaguggugaagaccucagauguguuggguuuacugaggcugaugucucuguguugcaggccgcgaauauucuuuugccgagcaacacucauaaagaccguuacaaguucauacacuugaacguccaggaguuuuguacagccauugcauuucugauggcaguacccaacuaucugauccccucaggcagcagagaguauaaagagaagagagaacaauacucugacuuuaaucaaguguuuacuuucauuuuuggucuucuaaaugcaaacaggagaaagauucuugagacauccuuuggauaccagcuaccgaugguagacagcuucaagugguacucggugggauacaugaaacauuuggaccgugacccggaaaaguugacgcaccauaugccuuuguuuuacugucucuaugagaaucgggaagaagaauuugugaagacgauuguggaugcucucauggagguuacaguuuaccuucaaucagacaaggauaugauggucucauuauacugucuggauuacugcugucaccugaggacacuuaaguugaguguucagcgcaucuuucaaaacaaagagccacuuauaaggccaacugcuagucaaaugaagagccuugucuacuggagagagaucugcucucuuuuuuauacaauggagagccuccgggagcugcauaucuuugacaaugaccuuaaugguauuucagaaaggauucugucuaaagcccuggagcauucuagcuguaaacuucgcacacucaaguuguccuaugucucgacugcuucugguuuugaagacuuacucaaggcuuuggcucguaaucggagccugacauaccugaguaucaacuguacguccauuucccuaaauauguuuucacuucugcaugacauccugcacgagcccacaugccaaauaagucaucugagcuugaugaaaugugauuugcgagccagcgaaugugaagaaaucgccucucuccucaucaguggcgggagucugagaaaacugaccuuauccagcaauccgcugaggagcgacgggaugaacauacugugugaugccuugcuucaucccaacugcacucuuauaucacugguguuagucuucugcugucucacugaaaauugcugcagcgcccuuggaagagugcuucuguucagcccaacucuaagacaacuagaccugugugugaaucgcuuaaaaaauuacggaguguugcaugugacguuucccuugcuguuuccaaccugucaguuagaggagcuucaucugucuggcuguuucuuuagcagcgauaucugucaauauauugccauaguuauugcuacuaaugaaaaacugaggagccuggagauugggagcaacaaaauagaagaugcaggaaugcagcugcuauguggugguuugagacaucccaacugcauguuggugaauauugggcuagaagagugcauguuaaccagugccugcugucgaucucuugccucuguucuuaccaccaacaaaacacuagaaagacucaacuugcuucaaaaucacuugggcaaugauggaguugcaaaacuucuugagagcuugaucagcccagauuguguacuuaagguaguugggcuuccauuaacuggccugaacacacaaacccagcaguugcugaugacuguaaaggaaagaaaacccaguuugaucuuucugucugaaacuuggucuuuaaaggaaggcagagaaauuggugugacaccugcuucucagccagguucaauaauaccuaauucuaauuuggauuacauguuuuucaaauuucccagaaugucugcagccaugagaacgucaaauacagcaucuaggcaaccccuuuga

SEQ ID NO: 9034 - RNA, 3102 nt, Artificial Sequence
  derived and/or modified sequence opt1 from NALP11__Homo_sapiens__CCDS12935.1
auggccgagagcgacuccaccgacuucgaccugcucugguaccuggagaaccugagcgacaaggaguuccaguccuucaagaaguaccucgcccgcaagauccuggacuucaagcugccccaguucccgcucauccagaugaccaaggaggagcuggcgaacgugcugcccaucagcuacgagggccaguacaucuggaacaugcuguucuccaucuucagcaugaugcggaaggaggaccugugccgcaagaucaucgggcggcgcaaccggaaccaggaggccugcaaggccgucaugcgccggaaguucaugcugcagugggagucccacacguucggcaaguuccacuacaaguucuuccgcgacgugagcuccgacguguucuacauccuccagcuggccuacgacagcaccuccuacuacagcgccaacaaccugaacgucuuccucaugggggagcgggcguccggcaagaccaucgugaucaaccuggccgugcugcgcuggaucaagggggagauguggcagaacaugaucagcuacgucgugcaccucaccgcccacgagaucaaccagaugacgaacuccagccuggccgagcugaucgcgaaggacuggcccgacggccaggcccccaucgccgacauccucuccgacccgaagaagcugcuguucauccucgaggaccuggacaacauccgguucgagcugaacgugaacgagagcgcccucugcuccaacagcacccagaagguccccauccccgugcugcuggugagccuccugaagcgcaagauggcccccggcugcugguuccugaucuccagccggccgacccgcgggaacaacgucaagaccuuccucaaggagguggacugcugcacgacccugcagcuguccaacggcaagcgggagaucuacuucaacagcuucuucaaggaccgccagcgggcguccgccgcccuccagcuggugcacgaggacgagauccuggucgggcucugccgcguggccauccugugcuggaucacgugcaccgugcugaagcggcagauggacaagggccgcgacuuccagcucugcugccagacccccaccgaccugcacgcccacuuccuggcggacgcccucaccagcgaggccgggcugaccgccaaccaguaccaccugggccuccugaagcggcugugccugcucgccgcgggcgggcuguuccuguccacgcucaacuucagcggcgaggaccugcgcugcgucggguucaccgaggccgacguguccgugcugcaggccgccaacauccuccugcccagcaacacccacaaggaccgcuacaaguucauccaccugaacguccaggaguucugcaccgccaucgcguuccucauggccgugcccaacuaccugaucccguccggcagccgggaguacaaggagaagcgcgagcaguacuccgacuucaaccagguguucacguucaucuucggccugcucaacgccaaccggcgcaagauccuggagaccagcuucggguaccagcugcccauggucgacuccuucaagugguacagcgugggcuacaugaagcaccucgaccgggaccccgagaagcugacccaccacaugccccuguucuacugccucuacgagaaccgcgaggaggaguucgucaagaccaucguggacgcccugauggaggugacggucuaccugcaguccgacaaggacaugauggugagccucuacugccuggacuacugcugccaccuccggacccucaagcuguccgugcagcgcaucuuccagaacaaggagccgcugauccggcccaccgcgagccagaugaagucccucgucuacuggcgcgagaucugcagccuguucuacaccauggagagccugcgggagcuccacaucuucgacaacgaccugaacgggaucuccgagcgcauccugagcaaggcccucgagcacuccagcugcaagcugcggacgcugaagcucuccuacgugagcaccgccuccggcuucgaggaccugcugaaggcccucgcccgcaaccggagccugaccuaccuguccaucaacugcaccagcaucucccucaacauguucagccugcugcacgacauccuccacgagcccacgugccagaucucccaccugagccugaugaagugcgaccuccgcgcguccgagugcgaggagaucgccagccugcugaucagcgggggcucccuccggaagcugacccugagcuccaacccccuccgcagcgacggcaugaacauccugugcgacgcccugcuccacccgaacugcacccugaucucccuggugcucgucuucugcugccugaccgagaacugcugcagcgcccuggggcgggugcuccuguucucccccacgcugcgccagcucgaccugugcgugaaccgccugaagaacuacggcguccuccacgugaccuucccccugcuguucccgaccugccagcucgaggagcugcaccugagcgggugcuucuucuccagcgacaucugccaguacaucgccaucgugaucgcgaccaacgagaagcuccggucccuggagaucggcagcaacaagaucgaggacgccgggaugcagcugcucugcggcggccugcgccaccccaacugcaugcuggucaacaucgggcucgaggagugcaugcugaccuccgccugcugccggagccuggccuccgugcucacgaccaacaagacccuggagcgccugaaccuccugcagaaccaccugggcaacgacgggguggccaagcuccuggagagccugaucucccccgacugcguccucaagguggugggccugccccugaccgggcugaacacgcagacccagcagcuccugaugaccgucaaggagcggaagcccagccugaucuuccucuccgagaccuggagccugaaggagggccgcgagaucggcgugacgccggcgagccagcccggguccaucauccccaacagcaaccuggacuacauguucuucaaguucccgcggauguccgccgccaugcgcaccagcaacaccgccucccggcagccccucuga

SEQ ID NO: 9035 - RNA, 3102 nt, Artificial Sequence
  derived and/or modified sequence opt2 from NALP11__Homo_sapiens__CCDS12935.1
auggccgaguccgacuccaccgacuucgaccuccucugguaccucgagaaccucuccgacaaggaguuccaguccuucaagaaguaccucgcccgcaagauccucgacuucaagcucccccaguucccccucauccagaugaccaaggaggagcucgccaacguccuccccaucuccuacgagggccaguacaucuggaacaugcucuucuccaucuucuccaugaugcgcaaggaggaccucugccgcaagaucaucggccgccgcaaccgcaaccaggaggccugcaaggccgucaugcgccgcaaguucaugcuccagugggagucccacaccuucggcaaguuccacuacaaguucuuccgcgacgucuccuccgacgucuucuacauccuccagcucgccuacgacuccaccuccuacuacuccgccaacaaccucaacgucuuccucaugggcgagcgcgccuccggcaagaccaucgucaucaaccucgccguccuccgcuggaucaagggcgagauguggcagaacaugaucuccuacgucguccaccucaccgcccacgagaucaaccagaugaccaacuccucccucgccgagcucaucgccaaggacuggcccgacggccaggcccccaucgccgacauccucuccgaccccaagaagcuccucuucauccucgaggaccucgacaacauccgcuucgagcucaacgucaacgaguccgcccucugcuccaacuccacccagaagguccccauccccguccuccucgucucccuccucaagcgcaagauggcccccggcugcugguuccucaucuccucccgccccacccgcggcaacaacgucaagaccuuccucaaggaggucgacugcugcaccacccuccagcucuccaacggcaagcgcgagaucuacuucaacuccuucuucaaggaccgccagcgcgccuccgccgcccuccagcucguccacgaggacgagauccucgucggccucugccgcgucgccauccucugcuggaucaccugcaccguccucaagcgccagauggacaagggccgcgacuuccagcucugcugccagacccccaccgaccuccacgcccacuuccucgccgacgcccucaccuccgaggccggccucaccgccaaccaguaccaccucggccuccucaagcgccucugccuccucgccgccggcggccucuuccucuccacccucaacuucuccggcgaggaccuccgcugcgucggcuucaccgaggccgacgucuccguccuccaggccgccaacauccuccuccccuccaacacccacaaggaccgcuacaaguucauccaccucaacguccaggaguucugcaccgccaucgccuuccucauggccguccccaacuaccucauccccuccggcucccgcgaguacaaggagaagcgcgagcaguacuccgacuucaaccaggucuucaccuucaucuucggccuccucaacgccaaccgccgcaagauccucgagaccuccuucggcuaccagcuccccauggucgacuccuucaagugguacuccgucggcuacaugaagcaccucgaccgcgaccccgagaagcucacccaccacaugccccucuucuacugccucuacgagaaccgcgaggaggaguucgucaagaccaucgucgacgcccucauggaggucaccgucuaccuccaguccgacaaggacaugauggucucccucuacugccucgacuacugcugccaccuccgcacccucaagcucuccguccagcgcaucuuccagaacaaggagccccucauccgccccaccgccucccagaugaagucccucgucuacuggcgcgagaucugcucccucuucuacaccauggagucccuccgcgagcuccacaucuucgacaacgaccucaacggcaucuccgagcgcauccucuccaaggcccucgagcacuccuccugcaagcuccgcacccucaagcucuccuacgucuccaccgccuccggcuucgaggaccuccucaaggcccucgcccgcaaccgcucccucaccuaccucuccaucaacugcaccuccaucucccucaacauguucucccuccuccacgacauccuccacgagcccaccugccagaucucccaccucucccucaugaagugcgaccuccgcgccuccgagugcgaggagaucgccucccuccucaucuccggcggcucccuccgcaagcucacccucuccuccaacccccuccgcuccgacggcaugaacauccucugcgacgcccuccuccaccccaacugcacccucaucucccucguccucgucuucugcugccucaccgagaacugcugcuccgcccucggccgcguccuccucuucucccccacccuccgccagcucgaccucugcgucaaccgccucaagaacuacggcguccuccacgucaccuucccccuccucuuccccaccugccagcucgaggagcuccaccucuccggcugcuucuucuccuccgacaucugccaguacaucgccaucgucaucgccaccaacgagaagcuccgcucccucgagaucggcuccaacaagaucgaggacgccggcaugcagcuccucugcggcggccuccgccaccccaacugcaugcucgucaacaucggccucgaggagugcaugcucaccuccgccugcugccgcucccucgccuccguccucaccaccaacaagacccucgagcgccucaaccuccuccagaaccaccucggcaacgacggcgucgccaagcuccucgagucccucaucucccccgacugcguccucaaggucgucggccucccccucaccggccucaacacccagacccagcagcuccucaugaccgucaaggagcgcaagcccucccucaucuuccucuccgagaccuggucccucaaggagggccgcgagaucggcgucacccccgccucccagcccggcuccaucauccccaacuccaaccucgacuacauguucuucaaguucccccgcauguccgccgccaugcgcaccuccaacaccgccucccgccagccccucuga

SEQ ID NO: 9036 - RNA, 3102 nt, Artificial Sequence
  derived and/or modified sequence opt3 from NALP11__Homo_sapiens__CCDS12935.1
auggccgagagcgacuccaccgauuucgaccugcucugguaccuugaaaaccugucugauaaggaguuucagucauucaaaaaguauuuggcuagaaaaaucuuagacuuuaagcugccccaauucccucuaauucagaugacaaaagaagaacucgcaaaugugcugccaauaaguuacgaaggccaguauaucuggaacaugcuuuuuagcauuuucuccaugaugaggaaggaggaucugugccggaagaucauugggcgccgaaaucguaaccaggaggccuguaaagcggucaugagaaggaaguuuauguugcaaugggaaucucacacuuucggaaaauuucauuacaaguucuuucgggacguuucgucagauguguucuauauccuccagcuggcuuacgacagcacgaguuauuacuccgccaauaaccugaauguauuucucaugggugagcgcgcaucuggcaaaaccauagugaucaacuuagccguccugagauggauuaagggggaaauguggcagaauaugaucagcuacgugguucaccuuacagcucaugagauuaaccagaugacuaauuccucauuggcagagcugaucgccaaggauuggccggacggacaagcucccauagccgauauucuaagugacccuaaaaagcuccuguucauccuugaagaucuggacaacauuagguucgaguugaaugugaacgaaagcgcgcucugcucuaauuccacccagaaagucccaauccccgugcuguuaguaucacugcucaagcggaaaauggcaccuggcuguugguuucuuaucagcagucgcccaacacgagguaacaacguuaagaccuuccugaaagagguggacugcuguacuacauugcagcuaucuaaugggaagagagaaauuuauuuuaacuccuucuuuaaggauaggcagcgggccagcgcugcccugcaacucguccacgaggacgagauacuggugggacuuugccguguggcaauccuguguuggauuaccugcacggucuugaaacgccagauggauaagggcagagacuuccagcucuguugccaaacucccaccgaucugcaugcucacuuuuuagccgacgcgcugacaucggaagccggccuaacugcaaaucaguaccaccucgggcugcuuaaaagguugugucugcucgcugccggaggucuguuccuuucuacccugaacuuuuccggcgaggauuugcggugcguuggguucacagaagcugacgugucaguacuccaggccgcaaauauccuguuaccuaguaacacccauaaggaucgauauaaauuuauacaccugaaugugcaggaguucugcacggccauugcuuuucuaauggcggucccaaacuaccucaucccgagcggaucccgcgaauauaaggagaagagagagcaauacucugacuucaaucagguguucacuuuuaucuucggccugcuuaacgcaaauaggcggaaaauuuuggaaaccagcuuugguuaucagcugcccaugguugauucauucaagugguacagugugggguacaugaaacaucucgaccgcgacccugagaagcugacacaccacaugccauuauuuuauugucuguacgaaaacagagaggaagaguucgucaaaacuaucguggaugcccuuauggagguaacaguuuauuugcaguccgacaaggauaugauggugagccucuacugccuggacuauuguugccaucuaaggacccugaagcucucuguccaacguauuuuucagaauaaagaaccccugauacggccuacggcuucacagaugaagagucuuguguacuggcgagagaucuguagcuuguucuauaccauggaaucccugagagaguuacacauuuuugauaacgaccucaauggaaucucugagaggauccugucgaaagcccuugaacauagcuccugcaagcugcgcacauugaaacucucauacgucaguacugcaucuggcuucgaggaucugcuaaaggcccuggcucggaacagaagccucaccuaccuguccauuaacuguacaucaauaagccuuaauauguuuucuuugcugcacgacaucuuacaugaaccaacuugccagauuucccaccucagucugaugaagugugaucuuagggccagcgagugcgaagagaucgcaucucugcuaauuuccggcgggucacuccgcaaacugaccuugaguagcaacccccugcgaucggacggaaugaauaucuuaugugaugcgcuccugcacccgaacugcacacuuauaucccugguguugguuuucugcugucucaccgagaauugcuguucugcucugggucgggugcuacuguuuagcccuacucuucgucaacucgaccugugcguaaacagauugaagaauuauggcguccugcaugugacguuccccuuacucuucccaacaugucagcuggaggagcuucaccugucagggugcuuuuucaguuccgauaucugucaguacauugccaucguuauugcaaccaacgaaaaauugaggucucucgagaucggaagcaauaagauagaagacgccggcaugcagcugcuaugcggugggcugcgccauccuaacuguaugcuugugaauauuggccucgaggagugcaugcugacuuccgcuuguugccggucauuggccagcgucuuaaccacaaacaaaacccuggaaagacucaaucugcuucaaaaccaccugggaaaugacggcguggcaaaguugcuagagagucugaucucucccgauugcguacucaaagugguugggcugccacuuacuggauuaaacacacagacgcagcaacugcucaugaccgucaaggaaaggaagcccuccuugauuuuucugagcgagacuuggucgcucaaagaaggucgagagaucggcgugaccccugcuucacagccagggucuauaaucccgaacaguaaucuggacuauauguucuuuaaguucccccgcauguccgccgcgaugcggacaagcaacacagccucuagacagccucuuuga

SEQ ID NO: 9037 - RNA, 3102 nt, Artificial Sequence
  derived and/or modified sequence opt4 from NALP11__Homo_sapiens__CCDS12935.1
auggccgagagcgacagcaccgacuucgaccugcugugguaccuggagaaccugagcgacaaggaguuccagagcuucaagaaguaccuggccagaaagauccuggacuucaagcugccccaguucccccugauccagaugaccaaggaggagcuggccaacgugcugcccaucagcuacgagggccaguacaucuggaacaugcuguucagcaucuucagcaugaugagaaaggaggaccugugcagaaagaucaucggcagaagaaacagaaaccaggaggccugcaaggccgugaugagaagaaaguucaugcugcagugggagagccacaccuucggcaaguuccacuacaaguucuucagagacgugagcagcgacguguucuacauccugcagcuggccuacgacagcaccagcuacuacagcgccaacaaccugaacguguuccugaugggcgagagagccagcggcaagaccaucgugaucaaccuggccgugcugagauggaucaagggcgagauguggcagaacaugaucagcuacguggugcaccugaccgcccacgagaucaaccagaugaccaacagcagccuggccgagcugaucgccaaggacuggcccgacggccaggcccccaucgccgacauccugagcgaccccaagaagcugcuguucauccuggaggaccuggacaacaucagauucgagcugaacgugaacgagagcgcccugugcagcaacagcacccagaaggugcccauccccgugcugcuggugagccugcugaagagaaagauggcccccggcugcugguuccugaucagcagcagacccaccagaggcaacaacgugaagaccuuccugaaggagguggacugcugcaccacccugcagcugagcaacggcaagagagagaucuacuucaacagcuucuucaaggacagacagagagccagcgccgcccugcagcuggugcacgaggacgagauccuggugggccugugcagaguggccauccugugcuggaucaccugcaccgugcugaagagacagauggacaagggcagagacuuccagcugugcugccagacccccaccgaccugcacgcccacuuccuggccgacgcccugaccagcgaggccggccugaccgccaaccaguaccaccugggccugcugaagagacugugccugcuggccgccggcggccuguuccugagcacccugaacuucagcggcgaggaccugagaugcgugggcuucaccgaggccgacgugagcgugcugcaggccgccaacauccugcugcccagcaacacccacaaggacagauacaaguucauccaccugaacgugcaggaguucugcaccgccaucgccuuccugauggccgugcccaacuaccugauccccagcggcagcagagaguacaaggagaagagagagcaguacagcgacuucaaccagguguucaccuucaucuucggccugcugaacgccaacagaagaaagauccuggagaccagcuucggcuaccagcugcccaugguggacagcuucaagugguacagcgugggcuacaugaagcaccuggacagagaccccgagaagcugacccaccacaugccccuguucuacugccuguacgagaacagagaggaggaguucgugaagaccaucguggacgcccugauggaggugaccguguaccugcagagcgacaaggacaugauggugagccuguacugccuggacuacugcugccaccugagaacccugaagcugagcgugcagagaaucuuccagaacaaggagccccugaucagacccaccgccagccagaugaagagccugguguacuggagagagaucugcagccuguucuacaccauggagagccugagagagcugcacaucuucgacaacgaccugaacggcaucagcgagagaauccugagcaaggcccuggagcacagcagcugcaagcugagaacccugaagcugagcuacgugagcaccgccagcggcuucgaggaccugcugaaggcccuggccagaaacagaagccugaccuaccugagcaucaacugcaccagcaucagccugaacauguucagccugcugcacgacauccugcacgagcccaccugccagaucagccaccugagccugaugaagugcgaccugagagccagcgagugcgaggagaucgccagccugcugaucagcggcggcagccugagaaagcugacccugagcagcaacccccugagaagcgacggcaugaacauccugugcgacgcccugcugcaccccaacugcacccugaucagccuggugcugguguucugcugccugaccgagaacugcugcagcgcccugggcagagugcugcuguucagccccacccugagacagcuggaccugugcgugaacagacugaagaacuacggcgugcugcacgugaccuucccccugcuguuccccaccugccagcuggaggagcugcaccugagcggcugcuucuucagcagcgacaucugccaguacaucgccaucgugaucgccaccaacgagaagcugagaagccuggagaucggcagcaacaagaucgaggacgccggcaugcagcugcugugcggcggccugagacaccccaacugcaugcuggugaacaucggccuggaggagugcaugcugaccagcgccugcugcagaagccuggccagcgugcugaccaccaacaagacccuggagagacugaaccugcugcagaaccaccugggcaacgacggcguggccaagcugcuggagagccugaucagccccgacugcgugcugaagguggugggccugccccugaccggccugaacacccagacccagcagcugcugaugaccgugaaggagagaaagcccagccugaucuuccugagcgagaccuggagccugaaggagggcagagagaucggcgugacccccgccagccagcccggcagcaucauccccaacagcaaccuggacuacauguucuucaaguuccccagaaugagcgccgccaugagaaccagcaacaccgccagcagacagccccuguga

SEQ ID NO: 9038 - RNA, 3102 nt, Artificial Sequence
  derived and/or modified sequence opt5 from NALP11__Homo_sapiens__CCDS12935.1
auggccgagagcgacuccaccgauuucgaccugcucugguaccuggaaaaccuuucugauaaggaguuucagagcuucaaaaaguaucuggcuagaaaaauccucgacuuuaagcugccccaauucccucuuauucagaugacaaaagaagaacuggccaaugugcucccgaucuccuacgaaggccaguauauuuggaacaugcuguuuucuaucuucagcaugaugcggaaggaggaucugugccgcaagauuaucgggagacggaaucgcaaccaggaggcguguaaagcugucaugagacggaaguuuaugcuccaaugggaaucccacacguucggaaaauuucauuacaaguucuuucgcgacguuucuagcgauguguucuauauccugcagcuugccuacgacuccaccagcuauuacucugccaauaaccugaauguguuucucaugggcgagagagcuuccgggaaaacaauugucaucaaccuggccgugcuucgguggauuaagggagaaauguggcagaauaugaucagcuacguugugcaccugaccgcucaugagauuaaccagaugacaaauucuucccucgccgagcugaucgcgaaggauuggcccgacggccaagccccuauugcugauauccugagcgaccccaaaaagcuccuguucauccuugaagaucuggacaacauucgcuucgagcucaaugucaacgaaucugcccugugcuccaauagcacccagaaagugccuauccccguucuucuggugucccuccugaagagaaaaauggcuccuggguguugguuucugauuucuagccggccgacacgcggaaacaacgucaagaccuuccucaaagagguggacugcuguacgacccugcagcuuuccaauggcaagagagaaaucuauuuuaacagcuucuuuaaggaucggcagcgcgccucugcggcccugcaacucgugcacgaggacgagauucuggucggccuuugcagaguugcuauccuguguuggaucacaugcaccgugcucaaacggcagauggauaaggggagagacuuccagcuguguugccaaacacccaccgaucugcaugcccacuuucucgcugacgcccugacguccgaagccggacuuacagcuaaucaguaccaccugggccuccugaaacgccugugucuucucgcggccgggggacuguuccugagcacccucaacuuuucuggcgaggaucugcggugcgugggguucacagaagcugacgucagcgugcuucaggccgccaauauucugcucccuuccaacacccauaaggauagauauaaauuuauccaccugaauguucaggaguucugcaccgcuauugccuuucugauggcggugcccaacuaccuuaucccuucuggaagccgcgaauauaaggagaagcgggagcaauacuccgacuucaaucaggucuucacauuuauuuucggccuccugaacgcuaauagacgcaaaauccuggaaacgagcuuuggcuaucagcuccccaugguggauucuuucaagugguacuccguuggguacaugaaacaucuggaccgggacccggagaaacuuacccaccacaugccucuguuuuauugucucuacgaaaacagagaggaagaguucgugaagacaaucgucgaugcccugauggaggugaccgucuaucugcagagcgacaaggauaugauggugucucuuuacugccucgacuauuguugccaucugcgcacacugaagcucuccguucaacggauuuuucagaauaaagaaccccugaucagaccuaccgccagccagaugaagucccuuguguacuggcgcgagauuuguucucuguucuauacgauggaaagccuccgggagcugcacaucuuugauaacgaccugaauggaauuuccgagagaauccuuucuaaagcucucgaacauagcuccugcaagcugcggacacugaaacucagcuacgucucuaccgccuccggcuucgaggaucugcuuaaggcucuggcccgcaacagaagccucaccuaccugucuauuaacuguacauccaucagccugaauauguuuucucuucugcacgacauccuccaugaacccacaugccagauuagccaccugucccucaugaagugugaucugcgggcgagcgagugcgaagagaucgccucucuucugauuuccgggggaagccucagaaaacugacacuguccucuaacccccuucgcagcgacggcaugaauauccugugugaugcucuccugcacccuaacugcacgcucauuucccuggugcuuguuuucugcugucugaccgagaauugcuguucugcccucgggcgggugcugcuguuuagcccgacacuuagacaacuggaccucugcgucaaccgccugaagaauuauggagugcuccaugugaccuucccccugcuuuucccuacaugucagcuggaggagcugcaccucuccggcugcuuuuucucuagcgauaucugucaguacaucgcuauuguuaucgccaccaacgaaaaacugagaucccuugagauuggcagcaauaagaucgaagacgcggggaugcagcugcucugcggaggccugcggcaucccaacuguaugcucgucaauauugggcuggaggagugcaugcuuacgucugccuguugccgcucccuggcuagcgugcugaccacaaacaaaacccucgaaagacugaaucuucugcaaaaccaccucggaaaugacggcguggccaagcugcucgagucucugaucuccccugauugcguccuuaaagugguugggcugccccugacaggccucaacacccagacgcagcaacugcuuaugacagugaaggaacggaagccgagccugaucuuucucucugagaccuggucccugaaagaaggacgcgagauuggcgucaccccugcuagccagcccggguccaucauuccuaacagcaaucucgacuauauguucuuuaaguuccccagaaugucugccgccaugcggaccagcaacaccgcuucccgccagccucuguga

SEQ ID NO: 9039 - protein, 1061 aa, Artificial Sequence
  NALP12__Homo_sapiens__P59046
MLRTAGRDGLCRLSTYLEELEAVELKKFKLYLGTATELGEGKIPWGSMEKAGPLEMAQLLITHFGPEEAWRLALSTFERINRKDLWERGQREDLVRDTPPGGPSSLGNQSTCLLEVSLVTPRKDPQETYRDYVRRKFRLMEDRNARLGECVNLSHRYTRLLLVKEHSNPMQVQQQLLDTGRGHARTVGHQASPIKIETLFEPDEERPEPPRTVVMQGAAGIGKSMLAHKVMLDWADGKLFQGRFDYLFYINCREMNQSATECSMQDLIFSCWPEPSAPLQELIRVPERLLFIIDGFDELKPSFHDPQGPWCLCWEEKRPTELLLNSLIRKKLLPELSLLITTRPTALEKLHRLLEHPRHVEILGFSEAERKEYFYKYFHNAEQAGQVFNYVRDNEPLFTMCFVPLVCWVVCTCLQQQLEGGGLLRQTSRTTTAVYMLYLLSLMQPKPGAPRLQPPPNQRGLCSLAADGLWNQKILFEEQDLRKHGLDGEDVSAFLNMNIFQKDINCERYYSFIHLSFQEFFAAMYYILDEGEGGAGPDQDVTRLLTEYAFSERSFLALTSRFLFGLLNEETRSHLEKSLCWKVSPHIKMDLLQWIQSKAQSDGSTLQQGSLEFFSCLYEIQEEEFIQQALSHFQVIVVSNIASKMEHMVSSFCLKRCRSAQVLHLYGATYSADGEDRARCSAGAHTLLVQLPERTVLLDAYSEHLAAALCTNPNLIELSLYRNALGSRGVKLLCQGLRHPNCKLQNLRLKRCRISSSACEDLSAALIANKNLTRMDLSGNGVGFPGMMLLCEGLRHPQCRLQMIQLRKCQLESGACQEMASVLGTNPHLVELDLTGNALEDLGLRLLCQGLRHPVCRLRTLWLKICRLTAAACDELASTLSVNQSLRELDLSLNELGDLGVLLLCEGLRHPTCKLQTLRLGICRLGSAACEGLSVVLQANHNLRELDLSFNDLGDWGLWLLAEGLQHPACRLQKLWLDSCGLTAKACENLYFTLGINQTLTDLYLTNNALGDTGVRLLCKRLSHPGCKLRVLWLFGMDLNKMTHSRLAALRVTKPYLDIGC

SEQ ID NO: 9040 - RNA, 3186 nt, Artificial Sequence
  NALP12__Homo_sapiens__AAH28069
augcuacgaaccgcaggcagggacggccucugucgccuguccaccuacuuggaagaacucgaggcuguggaacugaagaaguucaaguuauaccuggggaccgcgacagagcugggagaaggcaagauccccuggggaagcauggagaaggccgguccccuggaaauggcccagcugcucaucacccacuucgggccagaggaggccuggagguuggcucucagcaccuuugagcggauaaacaggaaggaccugugggagagaggacagagagaggaccuggugagggauaccccaccugguggcccguccucacuugggaaccagucaacaugccuucuggaagucucucuugucacuccaagaaaagauccccaggaaaccuacagggacuauguccgcaggaaauuccggcucauggaagaccgcaaugcgcgccuaggggaaugugucaaccucagccaccgguacacccggcuccugcuggugaaggagcacucaaaccccaugcagguccagcagcagcuucuggacacaggccggggacacgcgaggaccgugggacaccaggcuagccccaucaagauagagacccucuuugagccagacgaggagcgccccgagccaccgcgcaccguggucaugcaaggcgcggcagggauaggcaaguccaugcuggcacacaaggugaugcuggacugggcggacgggaagcucuuccaaggcagauuugauuaucucuucuacaucaacugcagggagaugaaccagagugccacggaaugcagcaugcaagaccucaucuucagcugcuggccugagcccagcgcgccucuccaggagcucauccgaguucccgagcgccuccuuuucaucaucgacggcuucgaugagcucaagccuucuuuccacgauccucagggacccuggugccucugcugggaggagaaacggcccacggagcugcuucuuaacagcuuaauucggaagaagcugcucccugagcuaucuuugcucaucaccacacggcccacggcuuuggagaagcuccaccgucugcuggagcaccccaggcauguggagauccugggcuucucugaggcagaaaggaaggaauacuucuacaaguauuuccacaaugcagagcaggcgggccaagucuucaauuacgugagggacaacgagccucucuucaccaugugcuucgucccccuggugugcugggugguguguaccugccuccagcagcagcuggaggguggggggcuguugagacagacguccaggaccaccacugcaguguacaugcucuaccugcugagucugaugcaacccaagccgggggccccgcgccuccagcccccacccaaccagagaggguugugcuccuuggcggcagaugggcucuggaaucagaaaauccuauuugaggagcaggaccuccggaagcacggccuagacggggaagacgucucugccuuccucaacaugaacaucuuccagaaggacaucaacugugagagguacuacagcuucauccacuugaguuuccaggaauucuuugcagcuauguacuauauccuggacgagggggagggcggggcaggcccagaccaggacgugaccaggcuguugaccgaguacgcguuuucugaaaggagcuuccuggcacucaccagccgcuuccuguuuggacuccugaacgaggagaccaggagccaccuggagaagagucucugcuggaaggucucgccgcacaucaagauggaccuguugcaguggauccaaagcaaagcucagagcgacggcuccacccugcagcagggcuccuuggaguucuucagcugcuuguacgagauccaggaggaggaguuuauccagcaggcccugagccacuuccaggugaucguggucagcaacauugccuccaagauggagcacauggucuccucguucugucugaagcgcugcaggagcgcccaggugcugcacuuguauggcgccaccuacagcgcggacggggaagaccgcgcgaggugcuccgcaggagcgcacacgcuguuggugcagcuaccagagaggaccguucugcuggacgccuacagugaacaucuggcagcggcccugugcaccaauccaaaccugauagagcugucucuguaccgaaaugcccugggcagccggggggugaagcugcucugucaaggacucagacaccccaacugcaaacuucagaaccugaggcugaagaggugccgcaucuccagcucagccugcgaggaccucucugcagcucucauagccaauaagaauuugacaaggauggaucucaguggcaacggcguuggauucccaggcaugaugcugcuuugcgagggccugcggcauccccagugcaggcugcagaugauucaguugaggaagugucagcuggaguccggggcuugucaggagauggcuucugugcucggcaccaacccacaucugguugaguuggaccugacaggaaaugcacuggaggauuugggccugagguuacuaugccagggacugaggcacccagucugcagacuacggacuuuguggcugaagaucugccgccucacugcugcugccugugacgagcuggccucaacucucagugugaaccagagccugagagagcuggaccugagccugaaugagcugggggaccucggggugcugcugcugugugagggccucaggcaucccacgugcaagcuccagacccugcgguugggcaucugccggcugggcucugccgccugugagggucuuucuguggugcuccaggccaaccacaaccuccgggagcuggacuugaguuucaacgaccugggagacuggggccugugguugcuggcugaggggcugcaacaucccgccugcagacuccagaaacuguggcuggauagcuguggccucacagccaaggcuugugagaaucuuuacuucacccuggggaucaaccagaccuugaccgaccuuuaccugaccaacaacgcccuaggggacacagguguccgacugcuuugcaagcggcugagccauccuggcugcaaacuccgaguccucugguuauuugggauggaccugaauaaaaugacccacaguagguuggcagcgcuucgaguaacaaaaccuuauuuggacauuggcugcuga

SEQ ID NO: 9041 - RNA, 3186 nt, Artificial Sequence
  derived and/or modified sequence opt1 from NALP12__Homo_sapiens__AAH28069
augcugcgcaccgccggccgggacgggcucugccgccugagcaccuaccuggaggagcucgaggccguggagcugaagaaguucaagcuguaccucggcacggcgaccgagcugggggagggcaagauccccuggggguccauggagaaggccggcccgcuggagauggcccagcuccugaucacccacuucggccccgaggaggccuggcggcuggcccucagcaccuucgagcgcaucaaccggaaggaccugugggagcgcgggcagcgggaggaccugguccgcgacacgccgcccggcgggcccuccagccucggcaaccaguccacgugccugcuggaggugagccucgugacgccccggaaggacccccaggagaccuaccgcgacuacguccggcgcaaguuccggcugauggaggaccgcaacgcgcggcugggggagugcgugaaccucucccaccgcuacacccggcugcugcucgugaaggagcacagcaaccccaugcagguccagcagcagcugcuggacaccggccgcggccacgcccggaccguggggcaccaggccuccccgaucaagaucgagacccucuucgagcccgacgaggagcgccccgagcccccgcggaccguggucaugcagggcgccgcggggaucggcaagagcaugcuggcccacaaggugaugcuggacugggccgacggcaagcuguuccaggggcgcuucgacuaccuguucuacaucaacugccgcgagaugaaccaguccgccaccgagugcagcaugcaggaccugaucuucuccugcuggcccgagcccagcgcgccccuccaggagcugauccgggugccggagcgccuccucuucaucaucgacggcuucgacgagcugaagcccuccuuccacgacccccaggggcccuggugccugugcugggaggagaagcggccgaccgagcuccugcugaacagccucauccgcaagaagcugcugcccgagcucucccugcugaucaccacgcggcccaccgcccucgagaagcugcaccgccugcuggagcacccccggcacgucgagauccucggcuucagcgaggccgagcgcaaggaguacuucuacaaguacuuccacaacgccgagcaggccggccagguguucaacuacgugcgggacaacgagccgcuguucaccaugugcuucgucccccuggugugcuggguggucugcacgugccuccagcagcagcuggagggcggcgggcugcuccgccagaccucccggaccaccaccgccguguacaugcuguaccugcucagccugaugcagcccaagcccggggcgccgcgccugcagccgccgcccaaccagcgggggcucugcagccuggccgccgacggccuguggaaccagaagauccucuucgaggagcaggaccugcgcaagcacgggcuggacggcgaggacguguccgccuuccucaacaugaacaucuuccagaaggacaucaacugcgagcgguacuacagcuucauccaccuguccuuccaggaguucuucgccgcgauguacuacauccuggacgagggcgagggcggggccgggcccgaccaggacgucacgcgccuccugaccgaguacgccuucagcgagcgguccuuccuggcccucaccagccgcuuccuguucggccugcucaacgaggagacccggucccaccuggagaagucccugugcuggaaggugagcccccacaucaagauggaccuccugcaguggauccagagcaaggcccaguccgacgggagcacgcugcagcagggcucccucgaguucuucagcugccuguacgagauccaggaggaggaguucauccagcaggcgcugucccacuuccaggugaucgucgugagcaacaucgccuccaagauggagcacauggucagcuccuucugccucaagcgcugccgcagcgcccaggugcugcaccuguacggcgccaccuacagcgcggacggggaggaccgggcccgcugcuccgccggcgcccacacccuccuggugcagcugcccgagcggaccguccuccuggacgccuacagcgagcaccuggcggccgcccucugcacgaaccccaaccugaucgagcugucccucuaccgcaacgcccuggggagccggggcgugaagcugcucugccagggccugcgccaccccaacugcaagcugcagaaccuccggcugaagcgcugccggaucuccagcuccgccugcgaggaccugagcgcggcccucaucgccaacaagaaccugacccgcauggaccuguccgggaacggcgugggguuccccggcaugaugcuccugugcgaggggcugcggcacccccagugccgccuccagaugauccagcugcggaagugccagcuggagagcggcgccugccaggagauggccuccguccucggcaccaacccgcaccugguggagcuggaccucaccgggaacgcgcuggaggaccugggccuccgccugcugugccaggggcuccggcaccccgugugccgccugcggacgcuguggcucaagaucugccgccugaccgccgccgccugcgacgagcuggcgagcacccucuccgucaaccagagccugcgggagcuggaccucucccugaacgagcugggcgaccucggggugcugcugcucugcgagggccugcgccacccgaccugcaagcugcagacccuccggcugggcaucugccgccuggggagcgccgccugcgagggccuguccgugguccuccaggccaaccacaaccugcgcgagcuggaccucagcuucaacgaccugggggacuggggccuguggcuccuggccgaggggcugcagcaccccgcgugccggcuccagaagcuguggcuggacagcugcggccucacggccaaggccugcgagaaccuguacuucacccugggcaucaaccagacccucaccgaccuguaccugacgaacaacgcccucggggacaccggcgugcgccugcugugcaagcggcucucccaccccgggugcaagcugcgcgugcuguggcuguucggcauggaccucaacaagaugacccacagccggcuggccgcgcuccgcgucaccaagcccuaccuggacaucgggugcuga

SEQ ID NO: 9042 - RNA, 3186 nt, Artificial Sequence
  derived and/or modified sequence opt2 from NALP12__Homo_sapiens__AAH28069
augcuccgcaccgccggccgcgacggccucugccgccucuccaccuaccucgaggagcucgaggccgucgagcucaagaaguucaagcucuaccucggcaccgccaccgagcucggcgagggcaagauccccuggggcuccauggagaaggccggcccccucgagauggcccagcuccucaucacccacuucggccccgaggaggccuggcgccucgcccucuccaccuucgagcgcaucaaccgcaaggaccucugggagcgcggccagcgcgaggaccucguccgcgacaccccccccggcggccccuccucccucggcaaccaguccaccugccuccucgaggucucccucgucaccccccgcaaggacccccaggagaccuaccgcgacuacguccgccgcaaguuccgccucauggaggaccgcaacgcccgccucggcgagugcgucaaccucucccaccgcuacacccgccuccuccucgucaaggagcacuccaaccccaugcagguccagcagcagcuccucgacaccggccgcggccacgcccgcaccgucggccaccaggccucccccaucaagaucgagacccucuucgagcccgacgaggagcgccccgagcccccccgcaccgucgucaugcagggcgccgccggcaucggcaaguccaugcucgcccacaaggucaugcucgacugggccgacggcaagcucuuccagggccgcuucgacuaccucuucuacaucaacugccgcgagaugaaccaguccgccaccgagugcuccaugcaggaccucaucuucuccugcuggcccgagcccuccgccccccuccaggagcucauccgcguccccgagcgccuccucuucaucaucgacggcuucgacgagcucaagcccuccuuccacgacccccagggccccuggugccucugcugggaggagaagcgccccaccgagcuccuccucaacucccucauccgcaagaagcuccuccccgagcucucccuccucaucaccacccgccccaccgcccucgagaagcuccaccgccuccucgagcacccccgccacgucgagauccucggcuucuccgaggccgagcgcaaggaguacuucuacaaguacuuccacaacgccgagcaggccggccaggucuucaacuacguccgcgacaacgagccccucuucaccaugugcuucgucccccucgucugcugggucgucugcaccugccuccagcagcagcucgagggcggcggccuccuccgccagaccucccgcaccaccaccgccgucuacaugcucuaccuccucucccucaugcagcccaagcccggcgccccccgccuccagcccccccccaaccagcgcggccucugcucccucgccgccgacggccucuggaaccagaagauccucuucgaggagcaggaccuccgcaagcacggccucgacggcgaggacgucuccgccuuccucaacaugaacaucuuccagaaggacaucaacugcgagcgcuacuacuccuucauccaccucuccuuccaggaguucuucgccgccauguacuacauccucgacgagggcgagggcggcgccggccccgaccaggacgucacccgccuccucaccgaguacgccuucuccgagcgcuccuuccucgcccucaccucccgcuuccucuucggccuccucaacgaggagacccgcucccaccucgagaagucccucugcuggaaggucuccccccacaucaagauggaccuccuccaguggauccaguccaaggcccaguccgacggcuccacccuccagcagggcucccucgaguucuucuccugccucuacgagauccaggaggaggaguucauccagcaggcccucucccacuuccaggucaucgucgucuccaacaucgccuccaagauggagcacauggucuccuccuucugccucaagcgcugccgcuccgcccagguccuccaccucuacggcgccaccuacuccgccgacggcgaggaccgcgcccgcugcuccgccggcgcccacacccuccucguccagcuccccgagcgcaccguccuccucgacgccuacuccgagcaccucgccgccgcccucugcaccaaccccaaccucaucgagcucucccucuaccgcaacgcccucggcucccgcggcgucaagcuccucugccagggccuccgccaccccaacugcaagcuccagaaccuccgccucaagcgcugccgcaucuccuccuccgccugcgaggaccucuccgccgcccucaucgccaacaagaaccucacccgcauggaccucuccggcaacggcgucggcuuccccggcaugaugcuccucugcgagggccuccgccacccccagugccgccuccagaugauccagcuccgcaagugccagcucgaguccggcgccugccaggagauggccuccguccucggcaccaacccccaccucgucgagcucgaccucaccggcaacgcccucgaggaccucggccuccgccuccucugccagggccuccgccaccccgucugccgccuccgcacccucuggcucaagaucugccgccucaccgccgccgccugcgacgagcucgccuccacccucuccgucaaccagucccuccgcgagcucgaccucucccucaacgagcucggcgaccucggcguccuccuccucugcgagggccuccgccaccccaccugcaagcuccagacccuccgccucggcaucugccgccucggcuccgccgccugcgagggccucuccgucguccuccaggccaaccacaaccuccgcgagcucgaccucuccuucaacgaccucggcgacuggggccucuggcuccucgccgagggccuccagcaccccgccugccgccuccagaagcucuggcucgacuccugcggccucaccgccaaggccugcgagaaccucuacuucacccucggcaucaaccagacccucaccgaccucuaccucaccaacaacgcccucggcgacaccggcguccgccuccucugcaagcgccucucccaccccggcugcaagcuccgcguccucuggcucuucggcauggaccucaacaagaugacccacucccgccucgccgcccuccgcgucaccaagcccuaccucgacaucggcugcuga

SEQ ID NO: 9043 - RNA, 3186 nt, Artificial Sequence
  derived and/or modified sequence opt3 from NALP12__Homo_sapiens__AAH28069
augcugagaaccgccggcagggacgggcucugccggcuuagcacauaccuggaggaauuggaggcuguggaauuaaagaaauucaagcuguaucuaggaacugcaacggagcucggugaaggcaaaauccccuggggguccauggagaaggccggaccucuggagauggcgcagcuucugauuacccacuuuggcccagaagaggcuuggcgcuuggcccucucuacauucgaacgaauaaaccguaaagaucugugggagagaggucaaagggaggaccugguccgggauacuccgcccgggggaccuucaagucucggcaaucagagcaccuguuuacuggaaguuucccuugugacaccacgcaaggacccccaggagaccuacagagauuauguaaggcggaaguuucgcuugauggaagaccgaaacgcaagacugggcgagugcgugaaucuaucucauagguacacucggcuccugcuugucaaagaacacucgaacccuaugcaagugcaacagcagcuguuggauacagggcguggacaugcccgcaccguuggucaccaggcuucaccaaucaagauugagacguuguucgagcccgacgaagagagaccugaaccaccgaggacuguggucaugcaaggcgcagccgggaucggaaaaagcaugcuggcucauaaggugauguuagauugggccgacggcaaacuguuucagggucgguucgauuaucucuuuuacauuaauugucgagagaugaaccagagugcgaccgaaugcuccaugcaggaccuuaucuucucuuguuggcccgagccuagcgcaccacugcaagaguugauacgcguacccgaaagacuacuguuuaucauugauggguucgacgagcucaagccuuccuuucacgacccacagggacccuggugccuguguugggaagagaagaggccgacagaacuucugcucaauucacucauccggaaaaagcuguuaccugagcugagucuacucauuacuacccgccccacagcccuggagaaacuucacagauugcuggaacauccaaggcacguugagauccucggcuucagcgaagcugagcguaaggaguauuuuuacaaauacuuccauaacgccgaacaggcaggccaaguguucaauuauguccgggauaacgagccucuguuuaccaugugcuucgugccccuuguguguugggucguuugcacgugucugcagcagcaguuggaagggggaggucuccugcgacaaacuucuagaacaaccacugcuguguacauguuauaucugcuaucccucaugcagccaaagcccggcgccccuaggcugcagccaccgcccaaucagcgcgggcuuugcucauuggcggccgacggacuguggaaccagaaaauacucuuugaggaacaggaucugcggaagcacggcuuagacggugaggauguaagcgcauuccugaauaugaacauuuuucagaaggacaucaauugcgagagauacuauaguuucauucaccuuucuuuucaggaguucuuugcugccauguacuauaucuuggaugaaggggaaggcggagcuggcccugaccaagaugugacaaggcuccugaccgaguacgccuucuccgaacgcagcuuucuagcacugacgucgcgauuccucuuugggcugcuuaacgaggagacccggucucauuuggaaaaaucccuguguuggaaggucucaccacacaucaaaauggacuuacuccaguggauucagaguaaggcccagagcgauggauccacacugcaacaggguucucuugaguucuucagcugccuguacgaaauacaggaggaagaguuuauccaacaggcuuugucacauuuccaggugauuguugugaguaacaucgcguccaaaauggagcacauggucagcucuuuuugucucaagcguugcagaucagcacaggugcugcaucuauauggcgccacuuacagugcugacggggaagacagggcccgcuguagcgcaggagcccacacccugcucguacaacugcccgagcggacaguucuuuuggaugcuuauuccgaacaccuggccgcagcguuaugcacuaauccuaaccucauagagcugucucuuuacagaaaugcucugggcucgaggggugugaagcuacucugucaggggcugcgacauccaaacugcaaauugcagaaucugcgcuuaaagcgguguagaauuagcuccucagccugcgaggaccucagugcagcccugaucgcuaacaaaaaucuuaccaggauggaucugucuggcaacggagucggcuuccccgggaugauguugcucugugaaggacugcgucacccgcagugccgccuacaaaugauccagcugcggaagugccagcuugagagcggugccugucaggaaauggcauccgugcucggcacaaauccucaucuggucgaguuggaccugaccgggaacgcuuuagaagaucucggacugagacuucugugccaaggcuugaggcacccagugugucgacuccggacucuguggcuaaaaauuugccgccugacggccgcggccugugacgagcuugcuucaacacucagcguuaaucagucucugagagaguuggauuuaucccugaacgaacucggugaccugggggugcuucuguugugcgagggccuaaggcaccccaccuguaagcugcagacucuccggcugggaaucugccgacuuggcagugcagccugugaaggguuaagcguaguccugcaagcuaaucauaaccucagagaguuggaucugucuuuuaaugaccucggagauuggggccuguggcuucuggccgaagguuugcagcacccugcaugccgccuacagaagcuguggcucgacuccuguggguuaaccgcgaaagccugcgagaaccuguauuucacacuuggaauuaaccagacccugacugaucucuacuugacaaauaacgcucugggcgacacgggugugaggcuccugugcaagcgucuuucacaucccggcuguaaacuacggguucugugguuguuugggauggacuuaaauaagaugacccacaguagacuggccgcacucagggugacuaaaccauaucuggauauaggaugcuga

SEQ ID NO: 9044 - RNA, 3186 nt, Artificial Sequence
  derived and/or modified sequence opt4 from NALP12__Homo_sapiens__AAH28069
augcugagaaccgccggcagagacggccugugcagacugagcaccuaccuggaggagcuggaggccguggagcugaagaaguucaagcuguaccugggcaccgccaccgagcugggcgagggcaagauccccuggggcagcauggagaaggccggcccccuggagauggcccagcugcugaucacccacuucggccccgaggaggccuggagacuggcccugagcaccuucgagagaaucaacagaaaggaccugugggagagaggccagagagaggaccuggugagagacaccccccccggcggccccagcagccugggcaaccagagcaccugccugcuggaggugagccuggugacccccagaaaggacccccaggagaccuacagagacuacgugagaagaaaguucagacugauggaggacagaaacgccagacugggcgagugcgugaaccugagccacagauacaccagacugcugcuggugaaggagcacagcaaccccaugcaggugcagcagcagcugcuggacaccggcagaggccacgccagaaccgugggccaccaggccagccccaucaagaucgagacccuguucgagcccgacgaggagagacccgagccccccagaaccguggugaugcagggcgccgccggcaucggcaagagcaugcuggcccacaaggugaugcuggacugggccgacggcaagcuguuccagggcagauucgacuaccuguucuacaucaacugcagagagaugaaccagagcgccaccgagugcagcaugcaggaccugaucuucagcugcuggcccgagcccagcgccccccugcaggagcugaucagagugcccgagagacugcuguucaucaucgacggcuucgacgagcugaagcccagcuuccacgacccccagggccccuggugccugugcugggaggagaagagacccaccgagcugcugcugaacagccugaucagaaagaagcugcugcccgagcugagccugcugaucaccaccagacccaccgcccuggagaagcugcacagacugcuggagcaccccagacacguggagauccugggcuucagcgaggccgagagaaaggaguacuucuacaaguacuuccacaacgccgagcaggccggccagguguucaacuacgugagagacaacgagccccuguucaccaugugcuucgugccccuggugugcuggguggugugcaccugccugcagcagcagcuggagggcggcggccugcugagacagaccagcagaaccaccaccgccguguacaugcuguaccugcugagccugaugcagcccaagcccggcgcccccagacugcagcccccccccaaccagagaggccugugcagccuggccgccgacggccuguggaaccagaagauccuguucgaggagcaggaccugagaaagcacggccuggacggcgaggacgugagcgccuuccugaacaugaacaucuuccagaaggacaucaacugcgagagauacuacagcuucauccaccugagcuuccaggaguucuucgccgccauguacuacauccuggacgagggcgagggcggcgccggccccgaccaggacgugaccagacugcugaccgaguacgccuucagcgagagaagcuuccuggcccugaccagcagauuccuguucggccugcugaacgaggagaccagaagccaccuggagaagagccugugcuggaaggugagcccccacaucaagauggaccugcugcaguggauccagagcaaggcccagagcgacggcagcacccugcagcagggcagccuggaguucuucagcugccuguacgagauccaggaggaggaguucauccagcaggcccugagccacuuccaggugaucguggugagcaacaucgccagcaagauggagcacauggugagcagcuucugccugaagagaugcagaagcgcccaggugcugcaccuguacggcgccaccuacagcgccgacggcgaggacagagccagaugcagcgccggcgcccacacccugcuggugcagcugcccgagagaaccgugcugcuggacgccuacagcgagcaccuggccgccgcccugugcaccaaccccaaccugaucgagcugagccuguacagaaacgcccugggcagcagaggcgugaagcugcugugccagggccugagacaccccaacugcaagcugcagaaccugagacugaagagaugcagaaucagcagcagcgccugcgaggaccugagcgccgcccugaucgccaacaagaaccugaccagaauggaccugagcggcaacggcgugggcuuccccggcaugaugcugcugugcgagggccugagacacccccagugcagacugcagaugauccagcugagaaagugccagcuggagagcggcgccugccaggagauggccagcgugcugggcaccaacccccaccugguggagcuggaccugaccggcaacgcccuggaggaccugggccugagacugcugugccagggccugagacaccccgugugcagacugagaacccuguggcugaagaucugcagacugaccgccgccgccugcgacgagcuggccagcacccugagcgugaaccagagccugagagagcuggaccugagccugaacgagcugggcgaccugggcgugcugcugcugugcgagggccugagacaccccaccugcaagcugcagacccugagacugggcaucugcagacugggcagcgccgccugcgagggccugagcguggugcugcaggccaaccacaaccugagagagcuggaccugagcuucaacgaccugggcgacuggggccuguggcugcuggccgagggccugcagcaccccgccugcagacugcagaagcuguggcuggacagcugcggccugaccgccaaggccugcgagaaccuguacuucacccugggcaucaaccagacccugaccgaccuguaccugaccaacaacgcccugggcgacaccggcgugagacugcugugcaagagacugagccaccccggcugcaagcugagagugcuguggcuguucggcauggaccugaacaagaugacccacagcagacuggccgcccugagagugaccaagcccuaccuggacaucggcugcuga

SEQ ID NO: 9045 - RNA, 3186 nt, Artificial Sequence
  derived and/or modified sequence opt5 from NALP12__Homo_sapiens__AAH28069
augcugagaaccgccggccgggacgggcucugccgccugagcacauaccuugaggaacuggaggcuguggaacucaagaaauucaagcuguaucuuggaacggccaccgagcugggcgaagggaaaauccccuggggauccauggagaaggcgggcccucucgagauggcucagcugcugauuacacacuuugggccggaagaggccuggagacucgcccugucuaccuucgaacggaucaaccgcaaagaucuuugggagagaggacaacgggaggaccugguccgcgauacacccccuggcggccccagcucccucgggaaucagucuaccugucugcuugaaguuagccuggugacaccuagaaaggacccccaggagaccuaccgggauuaugugcgcagaaaguuucggcucauggaagaccgcaacgcuagacugggagagugcgucaaucugucccaucgguacacgcgccuccugcuugugaaagaacacucuaacccuaugcagguucaacagcagcugcucgauaccggcagagggcaugcccggacagugggacaccaggcuagcccgauuaagaucgagacccuguucgagcccgacgaagagagaccugaacccccucgcacagucgugaugcaaggcgccgcggggauuggaaaauccaugcuugcccauaagguuaugcuggauugggcugacggcaaacucuuucagggccgguucgauuaucuguuuuacaucaauuguagagagaugaaccagagcgccaccgaaugcucuaugcaggaccugaucuucuccuguuggcccgagccgagcgcuccucuccaagagcugauucgcgugcccgaacggcuucuguuuaucauugauggguucgacgagcucaagccuucuuuucacgacccccagggacccuggugccuguguugggaagagaagagaccuacggaacuucugcucaauucccugauccgcaaaaagcugcucccggagcugagccuucugauuacaacccggcccacagcccucgagaaacugcacagacugcuugaacauccucgccacgucgagauccucggcuucucugaagcggagcggaaggaguauuuuuacaaauacuuccauaacgccgaacaggcugggcaaguguucaauuaugugagagauaacgagccccuguuuaccaugugcuucgucccucugguuuguuggguggugugcaccugucuccagcagcagcuggaaggaggcgggcuucugcgccaaacaucccggacgaccacagccgucuacaugcucuaucugcugagccuuaugcagcccaagccgggagcuccuagacuccagcccccucccaaucagcggggccugugcucccuggccgccgacggccucuggaaccagaaaauucuguuugaggaacaagaucuucgcaagcacgggcuggacggagaggaugugucugcuuuccucaauaugaacaucuuucagaaggacaucaauugcgagagauacuauagcuucauucaccuguccuuucaggaguucuuugcggccauguacuauauccuggaugaaggcgaagggggagcuggcccugaccaagauguuacccggcuucucacagaguacgccuucagcgaaagaucuuuucuggcccugaccucccgcuuccucuuugggcugcuuaacgaggagacgcggagccaucuggaaaaaucucucuguuggaaggugagcccccacauuaaaauggaccugcugcaguggauccaguccaaggcucagucugauggcagcacacuucaacagggaucccucgaguucuucagcugccuguacgaaauucaggaggaagaguuuauccaacaggcccugucucauuuccaggucaucgugguuuccaacauugcgagcaaaauggagcacauggugucuuccuuuugucucaagagaugccgcagcgcucagguccugcaucuuuauggcgccaccuacuccgccgacggggaagacagagcucgguguucugccggagcucacacccugcucgugcaacugccggagcgcacaguccugcuugaugccuauagcgaacaccuggcggccgcucucugcaccaauccuaaccugaucgagcucucccuguacagaaaugcccuuggcucucgcggggugaagcugcucugucagggacugcggcaucccaacugcaaacugcagaaucuuagacugaagcggugucgcauuagcuccagcgcuugcgaggaccucucugccgcgcugaucgccaacaaaaaucucacaagaauggaucuguccggcaacgggguuggcuuccccggaaugaugcuucugugugaaggccuccggcacccucagugccgccugcaaaugauucagcugagaaagugccagcuugagagcggggcuugucaggaaauggccucugugcugggaacgaauccgcaucucgucgagcuggaccucaccggcaacgcucuggaagaucuugggcugcggcugcucugccaaggacugagacaccccgugugucgccuucggacacuguggcucaaaaucugcagacugaccgccgccgcuugugacgagcucgcguccacacugagcguuaaucagucucuucgcgagcuggaucugagccucaacgaacugggcgaccuuggggugcugcuccugugcgagggccuccggcacccuaccuguaagcugcagacgcuuagacugggaaucugccgccugggcuccgccgcuugugaagggcucagcgucgugcugcaagccaaucauaaccuucgggagcuggaucucucuuuuaaugaccugggagauuggggccucuggcugcuugccgaagggcugcagcaccccgcuugcagacugcagaagcucuggcuggacuccuguggacuuaccgccaaagcgugcgagaaccuguauuucacacucggcauuaaccagacccugacagaucuguaccucaccaauaacgcucuuggggacacgggcgugcgccugcugugcaagcggcucagccauccuggauguaaacugagaguucuuuggcuguuuggcauggaccucaauaagaugacacacucccggcuggccgcccugcgcgucaccaaacccuaucucgauaucgggugcuga

SEQ ID NO: 9046 - protein, 1043 aa, Artificial Sequence
  NALP13__Homo_sapiens__Q86W25
MNFSVITCPNGGTNQGLLPYLMALDQYQLEEFKLCLEPQQLMDFWSAPQGHFPRIPWANLRAADPLNLSFLLDEHFPKGQAWKVVLGIFQTMNLTSLCEKVRAEMKENVQTQELQDPTQEDLEMLEAAAGNMQTQGCQDPNQEELDELEEETGNVQAQGCQDPNQEEPEMLEEADHRRKYRENMKAELLETWDNISWPKDHVYIRNTSKDEHEELQRLLDPNRTRAQAQTIVLVGRAGVGKTTLAMQAMLHWANGVLFQQRFSYVFYLSCHKIRYMKETTFAELISLDWPDFDAPIEEFMSQPEKLLFIIDGFEEIIISESRSESLDDGSPCTDWYQELPVTKILHSLLKKELVPLATLLITIKTWFVRDLKASLVNPCFVQITGFTGDDLRVYFMRHFDDSSEVEKILQQLRKNETLFHSCSAPMVCWTVCSCLKQPKVRYYDLQSITQTTTSLYAYFFSNLFSTAEVDLADDSWPGQWRALCSLAIEGLWSMNFTFNKEDTEIEGLEVPFIDSLYEFNILQKINDCGGCTTFTHLSFQEFFAAMSFVLEEPREFPPHSTKPQEMKMLLQHVLLDKEAYWTPVVLFFFGLLNKNIARELEDTLHCKISPRVMEELLKWGEELGKAESASLQFHILRLFHCLHESQEEDFTKKMLGRIFEVDLNILEDEELQASSFCLKHCKRLNKLRLSVSSHILERDLEILETSKFDSRMHAWNSICSTLVTNENLHELDLSNSKLHASSVKGLCLALKNPRCKVQKLTCKSVTPEWVLQDLIIALQGNSKLTHLNFSSNKLGMTVPLILKALRHSACNLKYLCLEKCNLSAASCQDLALFLTSIQHVTRLCLGFNRLQDDGIKLLCAALTHPKCALERLELWFCQLAAPACKHLSDALLQNRSLTHLNLSKNSLRDEGVKFLCEALGRPDGNLQSLNLSGCSFTREGCGELANALSHNHNVKILDLGENDLQDDGVKLLCEALKPHRALHTLGLAKCNLTTACCQHLFSVLSSSKSLVNLNLLGNELDTDGVKMLCKALKKSTCRLQKLG

SEQ ID NO: 9047 - RNA, 3132 nt, Artificial Sequence
  NALP13__Homo_sapiens__CCDS33119.1
augaacuuuucuguaaucaccugccccaacggugguaccaaccaagggcuucugccuuaccugauggcccuggaucaguaucagcuggaggaauucaagcuuugcuuggaaccccagcagcugauggacuucuggucggccccccaggggcacuucccgcguauccccugggcaaacuugagagcugccgacccuuugaaucuguccuuucuuuuggaugaacacuucccaaaaggucaggcauggaaagugguccucggcaucuuccagacaaugaaucugaccucacugugugagaaaguuagagccgagaugaaagagaaugugcagacccaagagcugcaagauccaacccaggaagaucuagagaugcuagaagcagcagcagggaauaugcagacccagggaugccaagauccaaaccaagaagaacuagacgagcuagaagaagaaacagggaauguacaggcccagggaugccaagauccaaaccaagaagaaccagagaugcuagaggaagcagaccacagaagaaaauacagagagaacaugaaggcugaacuacuggagacaugggacaacaucaguuggccuaaagaccacguauauauccguaauacaucaaaggacgaacaugaggaacugcagcgccuacuggauccuaauaggacuagagcccaggcccagacgauagucuugguggggagggcagggguugggaagaccaccuuggcaaugcaggcuaugcugcacugggcaaauggaguucucuuucagcaaagguucuccuauguuuucuaucucagcugccauaaaauaagguacaugaaggaaacuaccuuugcugaauugauuucuuuggauuggcccgauuuugaugcccccauugaagaguucaugucucaaccagagaagcuccuguuuauuauugauggcuuugaggaaauaaucauaucugagucacgcucugagagcuuggaugauggcucgccauguacagacugguaccaggagcucccagugaccaaaauccuacacagcuuguugaagaaagaauugguuccccuggcuaccuuacugaucacgaucaagaccugguuugugagagaucuuaaggccucauuagugaauccaugcuuuguacaaauuacaggguucacaggggacgaccuacggguauauuucaugagacacuuugaugacucaagugaaguugagaaaauccugcagcagcuaagaaaaaacgaaacucucuuucauuccugcagugcccccaugguguguuggaccguauguuccugucugaagcagccgaaggugagguauuacgaucuccagucaaucacucagacuaccaccagucuguaugccuauuuuuucuccaacuuguucuccacagcagagguagauuuggcagaugacagcuggccaggacaauggagggcccucugcagucuggccauagaagggcuguggucuaugaacuucacguuuaacaaagaagacacugagaucgagggccuggaagugccuuucauugauucucucuacgaguucaauauucuucaaaagaucaaugacuguggggguugcacuacuuucacccaccuaaguuuccaggaguuuuuugcagccauguccuuugugcuagaggaaccuagagaauucccuccccauuccacaaagccacaagagaugaagauguuacugcaacacgucuugcuugacaaagaagccuacuggacuccagugguucuguucuucuuuggucuuuuaaauaaaaacauagcaagagaacuggaagauacuuugcauuguaaaauaucucccaggguaauggaggaauuauuaaaguggggagaagaguuagguaaggcugaaagugccucucuccaauuucacauucuacgacuuuuucacugccuacacgagucccaggaggaagacuucacaaagaagauguugggucguaucuuugaaguugaccuuaauauuuuggaggacgaagaacuccaagcuucuucauuuugccuaaagcacuguaaaagguuaaauaagcuaaggcuuucuguuagcagucacauccuugaaagggacuuggaaauucuggagacaagcaaguuugauuccaggaugcacgcauggaacagcauuugcucuacguuggucacaaaugagaaucugcaugagcuagaccugaguaacagcaaacuucaugcuuccucugugaagggucucugucuugcacugaaaaauccaagaugcaaaguccagaaacugacgugcaaaucgguaacuccugaguggguucugcaggaccucauuauugcccuucaggguaacagcaagcugacccaucugaacuucagcucuaacaagcugggaaugacugucccccugauucuuaaagcuuugagacacucagcuugcaaccucaaguaucugugccuggagaaaugcaacuugucggcagccagcugucaggaccuagccuuguuucucaccagcauccaacacguaacucgauugugccugggauuuaaucggcuccaagaugauggcauaaagcuauugugugcggcccugacucaccccaagugugccuuagagagacuggagcucugguuuugccagcuggcagcacccgcuugcaagcacuugucagaugcucuccugcagaacaggagccugacacaccugaaucugagcaagaacagccugagagacgagggagucaaguuccugugugaggccuugggucgcccagaugguaaccugcagagccugaauuugucagguuguucuuucacaagagagggcuguggagagcuggcuaaugcccucagccauaaucauaaugugaaaaucuuggauuugggagaaaaugaucuucaggaugauggagugaagcuacugugugaggcucugaaaccacaucgugcauugcacacacuuggguuggcgaaaugcaaucugacaacugcuugcugccagcaucucuucucuguucucagcagcaguaagagccuggucaaucugaaccuucuaggcaaugaauuggauacugauggugucaagaugcuauguaaggcuuugaaaaagucgacaugcaggcugcagaaacucggguaa

SEQ ID NO: 9048 - RNA, 3132 nt, Artificial Sequence
  derived and/or modified sequence opt1 from NALP13__Homo_sapiens__CCDS33119.1
augaacuucagcgugaucacgugccccaacggcgggaccaaccagggccugcucccguaccugauggcccuggaccaguaccagcucgaggaguucaagcugugccuggagccccagcagcucauggacuucuggagcgcgccccaggggcacuucccccgcaucccgugggccaaccugcgggccgccgacccccugaaccucagcuuccugcuggacgagcacuuccccaagggccaggccuggaaggucgugcucgggaucuuccagaccaugaaccugaccucccugugcgagaaggugcgcgccgagaugaaggagaacguccagacccaggagcuccaggaccccacccaggaggaccuggagaugcuggaggcggccgccggcaacaugcagacgcagggcugccaggacccgaaccaggaggagcucgacgagcuggaggaggagaccgggaacgugcaggcccagggcugccaggaccccaaccaggaggagcccgagaugcuggaggaggcggaccaccggcgcaaguaccgggagaacaugaaggccgagcuccuggagaccugggacaacaucagcuggcccaaggaccacguguacauccgcaacaccuccaaggacgagcacgaggagcugcagcggcuccuggacccgaaccgcacgcgggcccaggcccagaccaucguccugguggggcgcgccggcguggggaagaccacccucgcgaugcaggccaugcugcacugggccaacggcguccuguuccagcagcgguucagcuacguguucuaccucuccugccacaagauccgcuacaugaaggagacgaccuucgccgagcugaucagccuggacuggcccgacuucgacgcccccaucgaggaguucaugucccagcccgagaagcuccuguucaucaucgacggcuucgaggagaucaucaucagcgagucccggagcgagucccuggacgacgggagcccgugcaccgacugguaccaggagcuccccgugaccaagauccugcacucccugcucaagaaggagcuggucccccuggcgacgcuccugaucaccaucaagaccugguucgugcgcgaccugaaggccagccucgugaaccccugcuucguccagaucaccggcuucacgggggacgaccugcggguguacuucaugcgccacuucgacgacuccagcgagguggagaagauccugcagcagcuccggaagaacgagacccuguuccacuccugcagcgccccgauggucugcuggaccgugugcagcugccugaagcagcccaaggugcgcuacuacgaccugcaguccaucacccagacgaccaccagccucuacgccuacuucuucuccaaccuguucagcaccgccgaggucgaccuggcggacgacuccuggcccggccaguggcgggcccucugcagccuggccaucgagggccugugguccaugaacuucacguucaacaaggaggacaccgagaucgaggggcucgaggugcccuucaucgacagccuguacgaguucaacauccugcagaagaucaacgacugcggcgggugcaccaccuucacgcaccucuccuuccaggaguucuucgccgccaugagcuucgugcuggaggagccgcgcgaguucccgccccacuccaccaagccccaggagaugaagaugcugcuccagcacguccugcuggacaaggaggcguacuggacccccgugguccucuucuucuucggccugcugaacaagaacaucgcccgggagcucgaggacacccugcacugcaagaucagcccccgcgugauggaggagcugcucaaguggggcgaggagcuggggaaggccgaguccgccagccugcaguuccacauccuccgccuguuccacugccugcacgagucccaggaggaggacuucacgaagaagaugcucggccggaucuucgagguggaccugaacauccuggaggacgaggagcuccaggcgagcuccuucugccugaagcacugcaagcgccugaacaagcuccggcugagcgucuccagccacauccuggagcgcgaccucgagauccuggagaccagcaaguucgacucccggaugcacgccuggaacagcaucugcuccacccuggugaccaacgagaaccuccacgagcuggaccugagcaacuccaagcuccacgccagcuccgugaaggggcugugccuggcccucaagaacccccgcugcaagguccagaagcugaccugcaagagcgugacgccggagugggugcugcaggaccucaucaucgcccugcagggcaacuccaagcugacccaccucaacuucagcuccaacaagcuggggaugaccgucccccugauccucaaggcgcugcggcacagcgccugcaaccugaaguaccucugccuggagaagugcaaccuguccgccgccagcugccaggaccucgcccuguuccugaccuccauccagcacgugacgcgccucugccugggcuucaaccggcugcaggacgacgggaucaagcuccugugcgcggcccugacccaccccaagugcgcccucgagcgccuggagcugugguucugccagcucgccgcccccgcgugcaagcaccugagcgacgcccugcuccagaaccggucccugacccaccugaaccucagcaagaacagccugcgcgacgagggcgugaaguuccugugcgaggcccucggccggccggacgggaaccugcagucccugaaccucagcggcugcuccuucacccgcgaggggugcggcgagcuggccaacgcgcugagccacaaccacaacgucaagauccucgaccugggggagaacgaccugcaggacgacggcgugaagcuccugugcgaggcccugaagccccaccgggcccuccacacgcugggccuggccaagugcaaccugaccaccgccugcugccagcaccucuucuccgugcugagcuccagcaagucccuggucaaccucaaccugcuggggaacgagcucgacaccgacggcgugaagaugcugugcaaggcgcugaagaaguccacgugccgccuccagaagcugggguga

SEQ ID NO: 9049 - RNA, 3132 nt, Artificial Sequence
  derived and/or modified sequence opt2 from NALP13__Homo_sapiens__CCDS33119.1
augaacuucuccgucaucaccugccccaacggcggcaccaaccagggccuccuccccuaccucauggcccucgaccaguaccagcucgaggaguucaagcucugccucgagccccagcagcucauggacuucugguccgccccccagggccacuucccccgcauccccugggccaaccuccgcgccgccgacccccucaaccucuccuuccuccucgacgagcacuuccccaagggccaggccuggaaggucguccucggcaucuuccagaccaugaaccucaccucccucugcgagaagguccgcgccgagaugaaggagaacguccagacccaggagcuccaggaccccacccaggaggaccucgagaugcucgaggccgccgccggcaacaugcagacccagggcugccaggaccccaaccaggaggagcucgacgagcucgaggaggagaccggcaacguccaggcccagggcugccaggaccccaaccaggaggagcccgagaugcucgaggaggccgaccaccgccgcaaguaccgcgagaacaugaaggccgagcuccucgagaccugggacaacaucuccuggcccaaggaccacgucuacauccgcaacaccuccaaggacgagcacgaggagcuccagcgccuccucgaccccaaccgcacccgcgcccaggcccagaccaucguccucgucggccgcgccggcgucggcaagaccacccucgccaugcaggccaugcuccacugggccaacggcguccucuuccagcagcgcuucuccuacgucuucuaccucuccugccacaagauccgcuacaugaaggagaccaccuucgccgagcucaucucccucgacuggcccgacuucgacgcccccaucgaggaguucaugucccagcccgagaagcuccucuucaucaucgacggcuucgaggagaucaucaucuccgagucccgcuccgagucccucgacgacggcucccccugcaccgacugguaccaggagcuccccgucaccaagauccuccacucccuccucaagaaggagcucgucccccucgccacccuccucaucaccaucaagaccugguucguccgcgaccucaaggccucccucgucaaccccugcuucguccagaucaccggcuucaccggcgacgaccuccgcgucuacuucaugcgccacuucgacgacuccuccgaggucgagaagauccuccagcagcuccgcaagaacgagacccucuuccacuccugcuccgcccccauggucugcuggaccgucugcuccugccucaagcagcccaagguccgcuacuacgaccuccaguccaucacccagaccaccaccucccucuacgccuacuucuucuccaaccucuucuccaccgccgaggucgaccucgccgacgacuccuggcccggccaguggcgcgcccucugcucccucgccaucgagggccucugguccaugaacuucaccuucaacaaggaggacaccgagaucgagggccucgagguccccuucaucgacucccucuacgaguucaacauccuccagaagaucaacgacugcggcggcugcaccaccuucacccaccucuccuuccaggaguucuucgccgccauguccuucguccucgaggagccccgcgaguuccccccccacuccaccaagccccaggagaugaagaugcuccuccagcacguccuccucgacaaggaggccuacuggacccccgucguccucuucuucuucggccuccucaacaagaacaucgcccgcgagcucgaggacacccuccacugcaagaucuccccccgcgucauggaggagcuccucaaguggggcgaggagcucggcaaggccgaguccgccucccuccaguuccacauccuccgccucuuccacugccuccacgagucccaggaggaggacuucaccaagaagaugcucggccgcaucuucgaggucgaccucaacauccucgaggacgaggagcuccaggccuccuccuucugccucaagcacugcaagcgccucaacaagcuccgccucuccgucuccucccacauccucgagcgcgaccucgagauccucgagaccuccaaguucgacucccgcaugcacgccuggaacuccaucugcuccacccucgucaccaacgagaaccuccacgagcucgaccucuccaacuccaagcuccacgccuccuccgucaagggccucugccucgcccucaagaacccccgcugcaagguccagaagcucaccugcaaguccgucacccccgaguggguccuccaggaccucaucaucgcccuccagggcaacuccaagcucacccaccucaacuucuccuccaacaagcucggcaugaccgucccccucauccucaaggcccuccgccacuccgccugcaaccucaaguaccucugccucgagaagugcaaccucuccgccgccuccugccaggaccucgcccucuuccucaccuccauccagcacgucacccgccucugccucggcuucaaccgccuccaggacgacggcaucaagcuccucugcgccgcccucacccaccccaagugcgcccucgagcgccucgagcucugguucugccagcucgccgcccccgccugcaagcaccucuccgacgcccuccuccagaaccgcucccucacccaccucaaccucuccaagaacucccuccgcgacgagggcgucaaguuccucugcgaggcccucggccgccccgacggcaaccuccagucccucaaccucuccggcugcuccuucacccgcgagggcugcggcgagcucgccaacgcccucucccacaaccacaacgucaagauccucgaccucggcgagaacgaccuccaggacgacggcgucaagcuccucugcgaggcccucaagccccaccgcgcccuccacacccucggccucgccaagugcaaccucaccaccgccugcugccagcaccucuucuccguccucuccuccuccaagucccucgucaaccucaaccuccucggcaacgagcucgacaccgacggcgucaagaugcucugcaaggcccucaagaaguccaccugccgccuccagaagcucggcuga

SEQ ID NO: 9050 - RNA, 3132 nt, Artificial Sequence
  derived and/or modified sequence opt3 from NALP13__Homo_sapiens__CCDS33119.1
augaacuucagcgugauuaccugccccaauggcgggacaaaccagggacugcucccuuaccuuauggcccuggaccaauaucaguuggaggaauuuaaguuaugucuggagccacagcagcuaauggauuucugguccgcuccgcaaggucacuuucccagaaucccuugggcaaaucucagggccgcggacccacugaaccuuucuuuccuguuggaugaacauuuucccaaaggccaggcuuggaaggucguucucgggauauuccagacuaugaaucugacgucacugugcgagaaagugcgggccgaaaugaaggagaacguacagacccaagagcuccaggacccuacacaggaagauuuagagaugcuggaagcagccgcuggaaauaugcagacucaaggcugucaggacccaaaccaggaggagcuugaugaauuggaggaagagaccgguaaugugcaagcacaggggugccaggaccccaaccaggaagaaccugagaugcuggaagaggccgaucaccgccgaaaauaccgugaaaauaugaaggcugagcuacucgaaacaugggacaacaucaguuggccaaaggaucaugucuauauuagaaauaccagcaaagacgagcacgaggaacugcaaaggcuucuggauccgaaccggacucgcgcccaggcgcagacaaucguguugguuggcagagcaggagugggcaagaccacgcucgccaugcaggcuaugcugcauugggccaauggggucuuauuucaacagagguucuccuacguguuuuaucugucuugucacaaaauucgguacaugaaggagacuaccuucgcagaacucaucucgcuugacuggcccgacuuugaugcuccuauagaggaguucaugucacagccagagaaacuguuguuuaucauugacggauucgaggaaaucauuaucagcgagagucgcuccgaaucucuagaugacgguagccccugcacagauugguaucaggagcugccuguaacuaagauacuccacucccugcuuaagaaagagcugguuccauuggccacccuccugauuacaaucaagaccugguucgugcgagacuuaaaagcgucacuggucaaccccuguuuugugcaaauuacgggcuucacuggggaugaccuaagaguguacuuuaugaggcauuucgaugacaguagcgaagucgagaagauccuccagcagcugcggaaaaacgaaacacuuuuucacucuugcuccgccccgaugguuuguuggaccgugugcucauguuugaagcagccuaaaguacguuacuaugaucugcaaagcaucacucagacaaccacgagucucuacgcauauuucuuuucuaaucuguucuccaccgcugagguggaccuugccgacgauagcuggcccggacaguggcgcgcucugugcucguuggccauugaaggccucuggucuaugaacuuuacauucaauaaggaggacacugagauagaaggucuggaggucccauuuaucgauuccuuauacgaguucaacauucugcaaaagaucaaugacugcgggggauguaccacauuuacucaucuaucauuccaggaguucuuugcagccaugaguuucgugcucgaagaaccuagagaguuucccccacacagcaccaaaccccaggaaaugaagaugcugcuucagcacguuuugcuggauaaagaggcuuauuggacaccugugguccucuucuuuuucggccuguuaaacaagaauauagcgagggaacuggaggacacccuucauugcaaaauuuccccacgggugauggaagaguugcucaaguggggcgaggaacuggggaaggcagagucugccagccuacaauuucacauccugcgacucuuccauugucugcacgaaucacaggaggaggauuuuacuaaaaagaugcuuggacgcaucuucgaaguagacuugaacauucuggaggaugaagaguuacaggcuaguuccuuuugccucaaacauuguaagagacugaauaaacuuaggcugagcguuucuucacacaucuuggaacgggaccucgagauucuggagacgaguaaguucgauagccgcaugcacgccuggaacuccauaugcucuacacuugugaccaaugaaaaccugcaugagcucgaccugucgaauagcaagcuacacgcauccucagucaaagguuugugucuggccuuaaagaacccgagaugcaaagugcagaagcucacuuguaaaagugucacccccgaaugggugcugcaagaucuuaucauugcucugcagggcaauucuaagcuaacacaucucaacuuuagcuccaacaagcuggggaugaccguuccuuugauccugaaagccuuaaggcacucagcaugcaaucucaaguaccugugucuugagaaaugcaaccugagcgcggcuucuugccaggacuuggcccucuuccugacuuccauccagcacgugacacgucuaugucugggauucaaucggcuucaagacgauggcauuaagcuccugugcgcagccuugacgcauccaaaaugugcucuggaacgauuagagcucugguuuugccagcuggccgcacccgcuuguaagcaccuuagugacgcccuguugcagaacagaagccucacccaucugaaucuaucuaaaaacucccugagggaugaggguguaaaguuccuuugcgaagcgcucgggcgcccugacggcaaucugcaaucauugaacuuaaguggauguagcuuuacucgggagggcugcggggaacuggccaaugcucucucgcacaaccauaaugucaagauacuggaucuuggagagaacgaccugcaggaugacggugugaaauugcuaugugaagcacugaagccacacagagcccuccacacacugggccuugcuaaaugcaauuuaaccacagccuguugccagcaucuguucuccguucucucuagcucaaagaguuuggugaaccugaaucuccuggggaacgagcuugauacugacggagucaaaaugcugugcaaggcauugaagaaauccaccuguaggcuacagaagcugggcuga

SEQ ID NO: 9051 - RNA, 3132 nt, Artificial Sequence
  derived and/or modified sequence opt4 from NALP13__Homo_sapiens__CCDS33119.1
augaacuucagcgugaucaccugccccaacggcggcaccaaccagggccugcugcccuaccugauggcccuggaccaguaccagcuggaggaguucaagcugugccuggagccccagcagcugauggacuucuggagcgccccccagggccacuuccccagaauccccugggccaaccugagagccgccgacccccugaaccugagcuuccugcuggacgagcacuuccccaagggccaggccuggaagguggugcugggcaucuuccagaccaugaaccugaccagccugugcgagaaggugagagccgagaugaaggagaacgugcagacccaggagcugcaggaccccacccaggaggaccuggagaugcuggaggccgccgccggcaacaugcagacccagggcugccaggaccccaaccaggaggagcuggacgagcuggaggaggagaccggcaacgugcaggcccagggcugccaggaccccaaccaggaggagcccgagaugcuggaggaggccgaccacagaagaaaguacagagagaacaugaaggccgagcugcuggagaccugggacaacaucagcuggcccaaggaccacguguacaucagaaacaccagcaaggacgagcacgaggagcugcagagacugcuggaccccaacagaaccagagcccaggcccagaccaucgugcuggugggcagagccggcgugggcaagaccacccuggccaugcaggccaugcugcacugggccaacggcgugcuguuccagcagagauucagcuacguguucuaccugagcugccacaagaucagauacaugaaggagaccaccuucgccgagcugaucagccuggacuggcccgacuucgacgcccccaucgaggaguucaugagccagcccgagaagcugcuguucaucaucgacggcuucgaggagaucaucaucagcgagagcagaagcgagagccuggacgacggcagccccugcaccgacugguaccaggagcugcccgugaccaagauccugcacagccugcugaagaaggagcuggugccccuggccacccugcugaucaccaucaagaccugguucgugagagaccugaaggccagccuggugaaccccugcuucgugcagaucaccggcuucaccggcgacgaccugagaguguacuucaugagacacuucgacgacagcagcgagguggagaagauccugcagcagcugagaaagaacgagacccuguuccacagcugcagcgcccccauggugugcuggaccgugugcagcugccugaagcagcccaaggugagauacuacgaccugcagagcaucacccagaccaccaccagccuguacgccuacuucuucagcaaccuguucagcaccgccgagguggaccuggccgacgacagcuggcccggccaguggagagcccugugcagccuggccaucgagggccuguggagcaugaacuucaccuucaacaaggaggacaccgagaucgagggccuggaggugcccuucaucgacagccuguacgaguucaacauccugcagaagaucaacgacugcggcggcugcaccaccuucacccaccugagcuuccaggaguucuucgccgccaugagcuucgugcuggaggagcccagagaguuccccccccacagcaccaagccccaggagaugaagaugcugcugcagcacgugcugcuggacaaggaggccuacuggacccccguggugcuguucuucuucggccugcugaacaagaacaucgccagagagcuggaggacacccugcacugcaagaucagccccagagugauggaggagcugcugaaguggggcgaggagcugggcaaggccgagagcgccagccugcaguuccacauccugagacuguuccacugccugcacgagagccaggaggaggacuucaccaagaagaugcugggcagaaucuucgagguggaccugaacauccuggaggacgaggagcugcaggccagcagcuucugccugaagcacugcaagagacugaacaagcugagacugagcgugagcagccacauccuggagagagaccuggagauccuggagaccagcaaguucgacagcagaaugcacgccuggaacagcaucugcagcacccuggugaccaacgagaaccugcacgagcuggaccugagcaacagcaagcugcacgccagcagcgugaagggccugugccuggcccugaagaaccccagaugcaaggugcagaagcugaccugcaagagcgugacccccgagugggugcugcaggaccugaucaucgcccugcagggcaacagcaagcugacccaccugaacuucagcagcaacaagcugggcaugaccgugccccugauccugaaggcccugagacacagcgccugcaaccugaaguaccugugccuggagaagugcaaccugagcgccgccagcugccaggaccuggcccuguuccugaccagcauccagcacgugaccagacugugccugggcuucaacagacugcaggacgacggcaucaagcugcugugcgccgcccugacccaccccaagugcgcccuggagagacuggagcugugguucugccagcuggccgcccccgccugcaagcaccugagcgacgcccugcugcagaacagaagccugacccaccugaaccugagcaagaacagccugagagacgagggcgugaaguuccugugcgaggcccugggcagacccgacggcaaccugcagagccugaaccugagcggcugcagcuucaccagagagggcugcggcgagcuggccaacgcccugagccacaaccacaacgugaagauccuggaccugggcgagaacgaccugcaggacgacggcgugaagcugcugugcgaggcccugaagccccacagagcccugcacacccugggccuggccaagugcaaccugaccaccgccugcugccagcaccuguucagcgugcugagcagcagcaagagccuggugaaccugaaccugcugggcaacgagcuggacaccgacggcgugaagaugcugugcaaggcccugaagaagagcaccugcagacugcagaagcugggcuga

SEQ ID NO: 9052 - RNA, 3132 nt, Artificial Sequence
  derived and/or modified sequence opt5 from NALP13__Homo_sapiens__CCDS33119.1
augaacuucagcgugauuaccugccccaauggcgggacaaaccagggacugcucccuuaccugauggcccuugaccaauaucagcuggaggaauuuaagcucugucuggagccgcagcagcuuauggauuucugguccgcuccccaaggccacuuuccuagaauccccugggccaaucugcgggcggcugacccucucaaccugucuuuccugcucgaugaacauuuucccaaagggcaggccuggaaggucguucugggaaucuuccagacgaugaaucuuaccagccugugcgagaaagugcgcgccgaaaugaaggagaacgugcagacacaagagcuccaggacccuacccaggaagaucuggagaugcuugaagcugccgcuggcaauaugcagacacaagggugucaggacccgaaccaggaggagcuggaugaacucgaggaagagaccggaaauguccaagcccagggcugccaggaccccaaccaggaagaaccugagaugcuggaagaggcggaucacagacggaaauaccgcgaaaauaugaaggccgagcugcucgaaacaugggacaacauuuccuggcccaaggaucauguguauaucagaaauaccucuaaagacgagcacgaggaacugcaacggcuucuggauccuaaccgcacgagagcucaggcccagaccauuguucucgugggccgggcuggggucggaaagacaacccuggccaugcaggcgaugcuucauugggccaauggcgugcuguuucaacagcgcuucagcuacguuuucuaucucuccugucacaaaaucagauacaugaaggagacaaccuucgcugaacugaucucucuggacuggcccgacuuugaugccccgauugaggaauuuaugagccagccugagaaacuccuguuuaucauugacggguucgaggaaaucauuaucuccgagagccggucugaaucccuugaugacggaagccccugcacggauugguaucaggagcugccugugacaaagauucuccacucucugcuuaagaaagagcuggucccccucgcuacccugcugaucacaaucaagaccugguucgugcgcgaccucaaagccucccuggugaaccccuguuuuguccaaauuaccggcuucacaggggaugaccuuagaguuuacuuuaugcggcauuucgaugacagcucugaaguggagaagauccugcagcagcuccgcaaaaacgaaacgcuguuucacuccugcagcgccccuaugguguguuggaccgucugcuccugucugaagcagccgaaagugagauacuaugaucuucaaucuauuacacagaccacaaccagccucuacgcuuauuucuuuuccaaucuguucagcacggcggagguugaccuggccgacgauucuuggcccggacaguggcgggcucucugcucccuggccaucgaaggccuuuggagcaugaacuuuacauucaauaaggaggacaccgagauugaaggccuggaggugccuuuuaucgauucucucuacgaguucaacauccugcaaaagauuaaugacugcgggggauguaccacauuuacccaucugagcuuccaggaguucuuugccgcuauguccuucguccuugaagaacccagagaguuuccuccccacucuacaaaaccgcaggaaaugaagaugcuccugcagcacgugcugcucgauaaagaggccuauuggacgccuguugugcuguucuuuuucggccuucugaacaagaauaucgcgcgcgaacucgaggacacccugcauugcaaaauuagcccccgggucauggaggagcugcuuaaguggggagaggaacucgggaaggcugaguccgccagccugcaauuucacauccugagacucuuccauugucugcacgaaucucaggaggaggauuuuaccaaaaagaugcuuggccgcauuuucgaaguggaccugaacauccucgaggaugaggaacugcaggccuccagcuuuugccugaaacauuguaagcggcuuaauaaacucagacugucugucuccagccacauccuggaacgcgaccucgagauucuggagacauccaaguucgauucucggaugcacgcuuggaacagcaucugcuccacacuugugaccaaugaaaaccugcaugagcucgaccugucuaauagcaagcugcacgccuccagcguuaaagggcuuugucuggcucucaagaacccuagaugcaaagugcagaagcugacguguaaaucugucacccccgaaugggugcuccaagaucugauuaucgcccuucagggaaauuccaagcugacacaucucaacuuuagcucuaacaagcugggcaugaccguuccucugauucuuaaagcgcugcgccacuccgccugcaaucucaaguaccugugucucgagaaaugcaaccugagcgcugccucuugccaggaccuugcucuguuccucacaagcauccagcacgugacccggcugugucugggcuucaauagacuucaagacgaugggauuaagcugcucugcgccgcgcugacgcaucccaaaugugcccucgaacgccuggagcuuugguuuugccagcuggcugccccggcuuguaagcaccuguccgacgcccuccugcagaaccggagccuuacacaucugaaucucucuaaaaacucccugagagaugagggagucaaguuccucugcgaagcccugggccggccugacgggaaucuucaaagccugaaccuguccggauguucuuuuacccgcgagggcugcggggaacucgcuaaugcgcugagccacaaccauaaugugaagauccuugaucugggcgagaacgaccuccaggaugacggagugaaacugcucugugaagcccugaagccccacagagcccuucacacacugggccuggcuaaaugcaaucucaccaccgccuguugccagcaucuguucuccguucuuucuagcuccaagucucuggucaaccucaaucugcucgggaacgagcuggauacagacggagugaaaaugcuuugcaaggcucugaagaaaagcacgugucggcugcagaagcucggcuga

SEQ ID NO: 9053 - protein, 197 aa, Artificial Sequence
  NALP2__Homo_sapiens__Q8WY49
MSPLSLSVSNPRLKSQRCITAVRTHRFGFAFFLWLISRLWNCDITSDGCCDLTKLLQEKSSLLCLDLGLNHIGVKGMKFLCEALRKPLCNLRCLWLWGCSIPPFSCEDLCSALSCNQSLVTLDLGQNPLGSSGVKMLFETLTCSSGTLRTLRLKIDDFNDELNKLLEEIEEKNPQLIIDTEKHHPWAERPSSHDFMI

SEQ ID NO: 9054 - RNA, 594 nt, Artificial Sequence
  NALP2__Homo_sapiens__AAG23171
augucaccacugucucuaagugugucuaacccacggcucaagagucaaaggugcaucacagcagugagaacucacagguucggguuugcuuucuuccugugguugauuucuaggcuuuggaacugcgacauaacuagcgauggcugcugcgaucucacaaagcuucuccaagaaaaaucaagccuguuguguuuggaucuggggcugaaucacauaggaguuaagggaaugaaguuccugugugaggcuuugaggaaaccacugugcaacuugagaugucugugguuguggggauguuccaucccuccguucaguugugaagaccucugcucugcccucagcugcaaccagagccucgucacucuggaccugggucagaaucccuuggggucuaguggagugaagaugcuguuugaaaccuugacauguuccaguggcacccuccggacacucagguugaaaauagaugacuuuaaugaugaacucaauaagcugcuggaagaaauagaagaaaaaaacccacaacugauuauugauacugagaaacaucaucccugggcagaaaggccuucuucucaugacuucaugaucuga

SEQ ID NO: 9055 - RNA, 594 nt, Artificial Sequence
  derived and/or modified sequence opt1 from NALP2__Homo_sapiens__AAG23171
augagcccccugucccucagcguguccaacccgcgccucaagagccagcggugcaucaccgccguccgcacccaccgguucggcuucgccuucuuccuguggcugaucucccgccuguggaacugcgacaucacgagcgacgggugcugcgaccugaccaagcuccugcaggagaaguccagccugcucugccuggaccugggccucaaccacaucggggugaagggcaugaaguuccugugcgaggcgcugcggaagccccucugcaaccugcgcugccuguggcucugggggugcuccaucccgcccuucagcugcgaggaccugugcuccgcccugagcugcaaccagucccucgugacccuggaccugggccagaacccccucggcagcuccggggucaagaugcuguucgagacccugacgugcagcuccggcacccuccggacccugcgccugaagaucgacgacuucaacgacgagcucaacaagcugcuggaggagaucgaggagaagaacccccagcucaucaucgacaccgagaagcaccaccccugggccgagcggcccagcucccacgacuucaugaucuga

SEQ ID NO: 9056 - RNA, 594 nt, Artificial Sequence
  derived and/or modified sequence opt2 from NALP2__Homo_sapiens__AAG23171
auguccccccucucccucuccgucuccaacccccgccucaagucccagcgcugcaucaccgccguccgcacccaccgcuucggcuucgccuucuuccucuggcucaucucccgccucuggaacugcgacaucaccuccgacggcugcugcgaccucaccaagcuccuccaggagaaguccucccuccucugccucgaccucggccucaaccacaucggcgucaagggcaugaaguuccucugcgaggcccuccgcaagccccucugcaaccuccgcugccucuggcucuggggcugcuccaucccccccuucuccugcgaggaccucugcuccgcccucuccugcaaccagucccucgucacccucgaccucggccagaacccccucggcuccuccggcgucaagaugcucuucgagacccucaccugcuccuccggcacccuccgcacccuccgccucaagaucgacgacuucaacgacgagcucaacaagcuccucgaggagaucgaggagaagaacccccagcucaucaucgacaccgagaagcaccaccccugggccgagcgccccuccucccacgacuucaugaucuga

SEQ ID NO: 9057 - RNA, 594 nt, Artificial Sequence
  derived and/or modified sequence opt3 from NALP2__Homo_sapiens__AAG23171
augagcccccugucccucucugugucaaacccuagacuuaagagucagaggugcaucaccgccguccggacacaccgcuucggcuuugcuuucuuucugugguugauuagccgauuauggaauugugacauaacuuccgaugggugcugugaccugacgaaacuacuccaagagaagucuucgcugcuuugccuggauuugggacucaaccauaucgguguuaaaggcaugaaguuccugugugaagcacugcguaaaccacucugcaauuuaagaugucuguggcuuugggggugcucaauuccgcccuuuagcugugaggacuugugcagugcccuguccuguaaccagucucuagugacccucgaucugggacagaauccucuuggcagcuccgguguaaagaugcuguucgaaacauugacuugcucaagugggacccucaggacacugcgguuaaagaucgacgauuuuaacgacgagcugaauaaacuccuugaagagauugaggaaaagaacccacagcugaucauagauaccgagaaacaccaucccugggcggaacgcccuagcucucacgacuucaugaucuga

SEQ ID NO: 9058 - RNA, 594 nt, Artificial Sequence
  derived and/or modified sequence opt4 from NALP2__Homo_sapiens__AAG23171
augagcccccugagccugagcgugagcaaccccagacugaagagccagagaugcaucaccgccgugagaacccacagauucggcuucgccuucuuccuguggcugaucagcagacuguggaacugcgacaucaccagcgacggcugcugcgaccugaccaagcugcugcaggagaagagcagccugcugugccuggaccugggccugaaccacaucggcgugaagggcaugaaguuccugugcgaggcccugagaaagccccugugcaaccugagaugccuguggcuguggggcugcagcaucccccccuucagcugcgaggaccugugcagcgcccugagcugcaaccagagccuggugacccuggaccugggccagaacccccugggcagcagcggcgugaagaugcuguucgagacccugaccugcagcagcggcacccugagaacccugagacugaagaucgacgacuucaacgacgagcugaacaagcugcuggaggagaucgaggagaagaacccccagcugaucaucgacaccgagaagcaccaccccugggccgagagacccagcagccacgacuucaugaucuga

SEQ ID NO: 9059 - RNA, 594 nt, Artificial Sequence
  derived and/or modified sequence opt5 from NALP2__Homo_sapiens__AAG23171
augagcccccugucccucucugugagcaacccuagacugaagucccagcggugcaucaccgccguccgcacacacagauucggcuuugcuuucuuucuuuggcugauuucucggcucuggaauugugacaucacgagcgaugggugcugugaccugaccaaacuucugcaagagaaguccucucuccugugccuggaucucggacugaaccauauuggcguuaaagggaugaaguuccuuugugaagcccugcgcaaaccgcucugcaaucugagaugucuuuggcuguggggaugcagcauucccccuuuuuccugugaggaccucugcagcgcgcugucuuguaaccagucccuggugacacucgaucugggccagaauccccuugggagcucuggagugaagaugcuguucgaaacccucacaugcuccagcggcacccugcggacacuucgccugaagaucgacgauuuuaacgacgagcucaauaaacugcuggaagagaucgaggaaaagaacccucagcucaucauugauaccgagaaacaccaucccugggcugaaagaccuucuucccacgacuucaugaucuga

SEQ ID NO: 9060 - protein, 1062 aa, Artificial Sequence
  NALP2__Homo_sapiens__Q9NX02
MVSSAQMGFNLQALLEQLSQDELSKFKYLITTFSLAHELQKIPHKEVDKADGKQLVEILTTHCDSYWVEMASLQVFEKMHRMDLSERAKDEVREAALKSFNKRKPLSLGITRKERPPLDVDEMLERFKTEAQAFTETKGNVICLGKEVFKGKKPDKDNRCRYILKTKFREMWKSWPGDSKEVQVMAERYKMLIPFSNPRVLPGPFSYTVVLYGPAGLGKTTLAQKLMLDWAEDNLIHKFKYAFYLSCRELSRLGPCSFAELVFRDWPELQDDIPHILAQARKILFVIDGFDELGAAPGALIEDICGDWEKKKPVPVLLGSLLNRVMLPKAALLVTTRPRALRDLRILAEEPIYIRVEGFLEEDRRAYFLRHFGDEDQAMRAFELMRSNAALFQLGSAPAVCWIVCTTLKLQMEKGEDPVPTCLTRTGLFLRFLCSRFPQGAQLRGALRTLSLLAAQGLWAQTSVLHREDLERLGVQESDLRLFLDGDILRQDRVSKGCYSFIHLSFQQFLTALFYTLEKEEEEDRDGHTWDIGDVQKLLSGVERLRNPDLIQAGYYSFGLANEKRAKELEATFGCRMSPDIKQELLRCDISCKGGHSTVTDLQELLGCLYESQEEELVKEVMAQFKEISLHLNAVDVVPSSFCVKHCRNLQKMSLQVIKENLPENVTASESDAEVERSQDDQHMLPFWTDLCSIFGSNKDLMGLAINDSFLSASLVRILCEQIASDTCHLQRVVFKNISPADAHRNLCLALRGHKTVTYLTLQGNDQDDMFPALCEVLRHPECNLRYLGLVSCSATTQQWADLSLALEVNQSLTCVNLSDNELLDEGAKLLYTTLRHPKCFLQRLSLENCHLTEANCKDLAAVLVVSRELTHLCLAKNPIGNTGVKFLCEGLRYPECKLQTLVLWNCDITSDGCCDLTKLLQEKSSLLCLDLGLNHIGVKGMKFLCEALRKPLCNLRCLWLWGCSIPPFSCEDLCSALSCNQSLVTLDLGQNPLGSSGVKMLFETLTCSSGTLRTLRLKIDDFNDELNKLLEEIEEKNPQLIIDTEKHHPWAERPSSHDFMI

SEQ ID NO: 9061 - RNA, 3189 nt, Artificial Sequence
  NALP2__Homo_sapiens__AAG30289
auggugucuucggcgcagaugggcuucaaccugcaggcucuccuggagcagcucagccaggaugaguugagcaaguucaaguaucugaucacgaccuucucccuggcacacgagcuccagaagaucccccacaaggagguagacaaggcugaugggaagcaacugguagaaauccucaccacccauugugacagcuacuggguggagauggcgagccuccaggucuuugaaaagaugcaccgaauggaucugucugagagagcaaaggaugaagucagagaagcagcuuugaaauccuuuaauaaaaggaaaccucuaucauuagggauaacacggaaagaacgaccaccucuagacguggacgaaaugcuggagcgcuucaaaacagaagcacaagcguuuacagaaacgaaaggaaaugucaucugccuggguaaagaagucuuuaaaggaaaaaagccagacaaagacaauaggugcagguauauauugaagacgaaguuccgggagauguggaagagcuggccuggagauagcaaagagguccagguuauggcugagagauacaagaugcugaucccauucagcaaccccagggugcuucccgggcccuucucauacacgguggugcuguaugguccugcaggccuugggaaaaccacgcuggcccagaaacuaaugcuagacugggcagaggacaaccucauccacaaauucaaauaugcguucuaccucagcugcagggagcucagccgccugggcccgugcaguuuugcagagcuggucuucagggacuggccugaauugcaggaugacauuccacacauccuagcccaagcacggaaaaucuuguucgugauugacggcuuugaugagcugggagccgcaccuggggcgcugaucgaggacaucugcggggacugggagaagaagaagccggugcccguccuccuggggaguuugcugaacagggugauguuacccaaggccgcccugcuggucaccacgcggcccagggcccugagggaccuccggauccuggcggaggagccgaucuacauaaggguggagggcuuccuggaggaggacaggagggccuauuuccugagacacuuuggagacgaggaccaagccaugcgugccuuugagcuaaugaggagcaacgcggcccuguuccagcugggcucggcccccgcggugugcuggaucgugugcacgacucugaagcugcagauggagaagggggaggacccgguccccaccugccucacccgcacggggcuguuccugcguuuccucugcagccgguucccgcagggcgcacagcugcggggcgcgcugcggacgcugagccuccuggccgcgcagggccugugggcgcagacguccgugcuucaccgagaggaucuggaaaggcucggggugcaggaguccgaccuccgucuguuccuggacggagacauccuccgccaggacagagucuccaaaggcugcuacuccuucauccaccucagcuuccagcaguuucucacugcccuguucuacacccuggagaaggaggaggaagaggauagggacggccacaccugggacauuggggacguacagaagcugcuuuccggaguagaaagacucaggaaccccgaccugauccaagcaggcuacuacuccuuuggccucgcuaacgagaagagagccaaggaguuggaggccacuuuuggcugccggaugucaccggacaucaaacaggaauugcugcgaugcgacauaaguuguaaggguggacauucaacggugacagaccugcaggagcuccucggcugucuguacgagucucaggaggaggagcuggugaaggaggugauggcucaguucaaagaaauaucccugcacuuaaaugcaguagacguugugccaucuucauucugcgucaagcacugucgaaaccugcagaaaaugucacugcagguaauaaaggagaaucucccggagaaugucacugcgucugaaucagacgccgagguugagagaucccaggaugaucagcacaugcuuccuuucuggacggaccuuuguuccauauuuggaucaaauaaggaucugaugggucuagcaaucaaugauagcuuucucagugccucccuaguaaggauccugugugaacaaauagccucugacaccugucaucuccagagagugguguucaaaaacauuuccccagcugaugcucaucggaaccucugccuagcucuucgaggucacaagacuguaacguaucugacccuucaaggcaaugaccaggaugauauguuucccgcauugugugaggucuugagacauccagaauguaaccugcgauaucucggguuggugucuuguuccgcuaccacucagcagugggcugaucucuccuuggcccuugaagucaaccagucccugacgugcguaaaccucuccgacaaugagcuucuggaugagggugcuaaguugcuguacacaacuuugagacaccccaagugcuuucugcagagguugucguuggaaaacugucaccuuacagaagccaauugcaaggaccuugcugcuguguugguugucagccgggagcugacacaccugugcuuggccaagaaccccauugggaauacaggggugaaguuucugugugagggcuugagguaccccgaguguaaacugcagaccuuggugcuuuggaacugcgacauaacuagcgauggcugcugcgaucucacaaagcuucuccaagaaaaaucaagccuguuguguuuggaucuggggcugaaucacauaggaguuaagggaaugaaguuccugugugaggcuuugaggaaaccacugugcaacuugagaugucugugguuguggggauguuccaucccuccguucaguugugaagaccucugcucugcccucagcugcaaccagagccucgucacucuggaccugggucagaaucccuuggggucuaguggagugaagaugcuguuugaaaccuugacauguuccaguggcacccuccggacacucagguugaaaauagaugacuuuaaugaugaacucaauaagcugcuggaagaaauagaagaaaaaaacccacaacugauuauugauacugagaaacaucaucccugggcagaaaggccuucuucucaugacuucaugaucuga

SEQ ID NO: 9062 - RNA, 3189 nt, Artificial Sequence
  derived and/or modified sequence opt1 from NALP2__Homo_sapiens__AAG30289
auggugagcuccgcccagaugggcuucaaccugcaggcccuccuggagcagcugagccaggacgagcucuccaaguucaaguaccugaucaccaccuucagccuggcgcacgagcuccagaagaucccccacaaggaggucgacaaggccgacgggaagcagcugguggagauccugacgacccacugcgacuccuacuggguggagauggccagccuccaggucuucgagaagaugcaccgcauggaccuguccgagcgggccaaggacgaggugcgcgaggccgcgcucaagagcuucaacaagcggaagccgcucucccugggcaucacccgcaaggagcggccgccccuggacguggacgagaugcucgagcgcuucaagaccgaggcccaggccuucacggagaccaaggggaacgucaucugccugggcaaggagguguucaaggggaagaagcccgacaaggacaaccggugccgcuacauccugaagaccaaguuccgggagauguggaaguccuggcccggcgacagcaaggaggugcaggucauggccgagcgcuacaagaugcucauccccuucagcaacccccgggugcugcccggcccguucuccuacaccgugguccuguacgggcccgcgggccucgggaagacgacccuggcccagaagcugaugcucgacugggccgaggacaaccugauccacaaguucaaguacgccuucuaccugagcugccgcgagcucucccggcugggccccugcagcuucgccgagcugguguuccgcgacuggcccgagcuccaggacgacaucccgcacauccuggcgcaggcccggaagauccuguucgugaucgacggguucgacgagcucggcgccgcccccggcgcccugaucgaggacaucugcggggacugggagaagaagaagcccguccccgugcugcucggcucccugcugaaccgcgugaugcucccgaaggcggcccugcuggucaccacccggccccgcgcccuccgggaccugcgcauccuggccgaggagcccaucuacauccggguggagggguuccucgaggaggaccgccgcgccuacuuccugcggcacuucggcgacgaggaccaggcgaugcgcgccuucgagcugaugcggagcaacgccgcccucuuccagcugggcuccgcccccgcggugugcuggaucgucugcacgacccugaagcugcagauggagaagggggaggacccggugccgaccugccucacccgcacgggccuguuccugcgguuccucugcagccgcuucccccagggggcccagcugcggggcgcccugcgcacccucagccugcuggccgcgcaggggcucugggcccagaccuccgugcugcaccgggaggaccuggagcgccucggcguccaggagagcgaccugcggcuguuccucgacggcgacauccugcgccaggaccggguguccaaggggugcuacagcuucauccaccuguccuuccagcaguuccucaccgcccuguucuacacgcuggagaaggaggaggaggaggaccgcgacggccacaccugggacaucggggacguccagaagcuccugagcggcguggagcggcugcgcaaccccgaccucauccaggccggguacuacuccuucggccuggccaacgagaagcgggcgaaggagcuggaggccaccuucggcugccgcaugagccccgacaucaagcaggagcuccugcggugcgacaucuccugcaagggcgggcacagcaccgugacggaccugcaggagcuccuggggugccuguacgagucccaggaggaggagcucgucaaggaggugauggcccaguucaaggagaucagccugcaccugaacgccguggacgucgugcccuccagcuucugcgugaagcacugccgcaaccuccagaagaugucccugcaggucaucaaggagaaccugcccgagaacgugaccgccagcgaguccgacgcggagguggagcgcagccaggacgaccagcacaugcuccccuucuggaccgaccugugcuccaucuucggcagcaacaaggaccugauggggcucgccaucaacgacagcuuccuguccgccagccugguccggauccucugcgagcagaucgccuccgacacgugccaccuccagcgcgugguguucaagaacaucagcccggccgacgcgcaccggaaccugugccuggcccugcgcggccacaagaccgucaccuaccugacccuccagggcaacgaccaggacgacauguuccccgcccugugcgaggugcugcggcaccccgagugcaaccuccgcuaccuggggcugguguccugcagcgccaccacgcagcagugggcggaccucucccuggcccuggaggucaaccagagccugaccugcgugaaccuguccgacaacgagcugcucgacgagggcgccaagcugcuguacaccacccuccggcacccgaagugcuuccugcagcgccugagccucgagaacugccaccugacggaggccaacugcaaggaccuggccgcggugcucgucgugucccgggagcugacccaccugugccucgccaagaaccccaucgggaacaccggcgugaaguuccugugcgagggccugcgcuaccccgagugcaagcuccagacccugguccuguggaacugcgacaucaccagcgacgggugcugcgaccucacgaagcugcugcaggagaaguccagccuccugugccuggaccucggccugaaccacaucggggugaagggcaugaaguuccugugcgaggcccuccggaagccccugugcaaccugcgcugccucuggcugugggggugcuccaucccgcccuucagcugcgaggaccugugcuccgcccugagcugcaaccagagccucgugacccuggaccugggccagaacccccucggcuccagcggggucaagaugcuguucgagacccugaccugcuccagcggcacgcuccggacccugcgccugaagaucgacgacuucaacgacgagcucaacaagcugcuggaggagaucgaggagaagaacccccagcucaucaucgacaccgagaagcaccacccgugggccgagcggcccuccagccacgacuucaugaucuga
